United States Patent 9,061,059 (MODIFIED POLYNUCLEOTIDES FOR TREATING PROTEIN DEFICIENCY) - sequence listing, part 57

SEQ ID NO: 109359 - DNA, 1392 bp, Artificial Sequence
  Description of Artificial Sequence: Synthetic coding sequence
atgctggtgacgctgcgggcaagccaagaggaggacgatgacgccgacgactttgaatctgactatgaagaagaaagctaccacctggcccctgaagaagtcaacaaggcaccagtcttcgtgcccgtgggtctgcggagcccagaaccagttagtgcccaaatcgaggagactatggaggaactagagatcaccgtgaacgtgcctgacgtcggatgtatcgccgtagttgagcacgaattgcctaatactgacgtgacaacggaggagatgaagcaggaggaaaatctgagcgtgcccttcgaaatgaccacttccgaacatatacaagacgaacctggcactaacgatgggagcactgaggcggctattaccctgctaaccatgggggacctagttcttcagagcgaaatctcaagcgagcagggagacggcgtctgcattattccacatgtgcattcgaaagacaaatcacatatcccatcgagcctggataacgtcaaccataagattgtacatgagtgccaggaactgagctcccctgtcatcacaaccagtccagctagctttgaagagaacaagattgtcctggaggagcagtctagcagggaagagatcagcctgatggagaaagtgaaagagaatgcaacgcccacccgaaacactatttcgaaagttacgtcgaacctccgcattcggtcccggctggcgaaacccaagccaaatttagagaagaccttaggcaccaataggctggacgattaccaggaggtctccagcctgtgcgtgacaaagggagctgaaatggaaacccagcgggaaacagaaaaaaacgcttctaaagccactgaacttgagaataagaacttgggtcctgtcaccaccgctgagaataaagaccagtcaaaactcgcgtgcgtgcacgggattaagggcacgagcatcagttctgaggtcaacctcaccgagcgcaatgaaaaccaagaagagtcgtctcaggaggtgcatatgttgtcagtggcacccgtggccagttcagagacagggccatgcacactgggtcttgacagagggttgggcgagaatagcgtcgaggagccccagatcaaagacagcaagggcgacagcgtgctgactctgccagtgcccgagtatacacctacaagcattcctgaagtgcaacaagagaatataattaaccctcaggacctgacagtatttgtgtaccagcagctccagctagtgaagatgccctgggtttatctgtttctggaagaaattattctgaaaagtagacttatcatatggattctctacctggggcgagacttcaacgctggattgataaagatgacaactttccttctgccgaagaatgtccacagtctttag

SEQ ID NO: 109360 - DNA, 1518 bp, Artificial Sequence
  Description of Artificial Sequence: Synthetic coding sequence
atgggcctggtctcttccaagaaacccgacaaggagaaacctattaaagagaaggataagggtcaatggtcccccctgaaagtttccgcccaggacaaggatgcccctcccttaccccctctcgtggtatttaaccacctgacgcccccacctcccgacgagcacctggatgaggacaagcactttgtagttgctctttacgactacacagccatgaatgatcgcgacctacagatgttgaagggagagaaactgcaggtgctaaagggcacaggggattggtggctcgctcggtctctggtgacgggaagggaaggatacgtgccatccaacttcgtggcaagagtcgagagcctggagatggaaaggtggttcttccggtcccaggggagaaaagaggcggagcgacagctgctggcccctatcaataaggctgggtcattcctgatccgcgagtccgaaactaacaagggagcattttccctcagcgtaaaggatgtgacaactcagggggaactgattaagcactataagattcggtgcctcgacgagggaggatattatattagcccgagaataacattcccatccctgcaggccctggtgcagcattactctaaaaagggagacggactgtgccagcgtttgactctgccctgtgtgcgccccgccccacaaaatccatgggcccaggacgagtgggaaatcccaagacagtctctgagattggtaaggaagctcggctctggccagttcggggaggtttggatgggctattataaaaataatatgaaggtggccatcaaaactctcaaggagggcactatgagtccagaagcattcctgggcgaagctaacgttatgaaggccctgcagcatgagcggctcgtacggctatacgcagtggtaaccaaagagccaatatatattgtgacagaatacatggctcgaggttgcctgttggatttcttgaagaccgatgagggcagcaggttgtccctgcccaggttgatcgacatgagtgcccaaattgcagagggaatggcgtatatcgagcgcatgaattcaatacatcgagacctgagggcggccaacatcctagtctctgaggcattatgctgcaagattgccgacttcggactcgctcggatcatcgattcggagtatactgcccaggagggcgccaagttccccataaaatggactgcccccgaagccatccatttcggagtcttcacaattaaagctgacgtttggagtttcggggtcctgctcatggaagtggtgacttacggaagagttccttaccccggcatgtcaaacccagaggtaatcaggaacttggaaaggggctatcgcatgccaagaccagatacctgcccgcccgagttgtacagaggggtaattgccgaatgttggcgttccagaccagaggagcgacccaccttcgagttcctccaatccgtcttggaggatttttacactgccaccgaacgacagtacgaactgcaaccttag

SEQ ID NO: 109361 - DNA, 1773 bp, Artificial Sequence
  Description of Artificial Sequence: Synthetic coding sequence
atgggcctggttagttccaagaagccagacaaggagaaaccaataaaagaaaaggataaaggacaatggtcgcctttgaaggtgtcggcccaggacaaagacgctcctcccttacccccgctagttgtatttaatcacctaacccctcctcctcccgatgaacatcttgacgaagacaagcattttgtcgttgcgttgtacgactatactgcaatgaacgatagagatttgcagatgctcaagggcgagaagctacaggtcctgaaagggaccggggattggtggctggctagatcactcgtcacagggcgagaaggctacgtgccatccaatttcgtggcgagagttgagagtctcgagatggaacgctggttctttagatctcagggtagaaaggaagctgaacggcaactgttagctcccatcaacaaggccggttcatttctcatccgggaatccgaaactaacaagggcgcgttctctctgagcgtgaaggacgttaccactcagggcgagcttatcaaacattataaaatcagatgtctcgacgagggaggctactatatttcaccccgcattacctttccaagtctgcaggccctggtgcagcattactctaagaagggggacggtctgtgccagaggttaactctcccttgtgtgcgccccgcacctcagaacccatgggcccaggatgagtgggagatcccaagacaatctcttcgcttggtgcgaaagctcggctcaggtcaattcggcgaagtctggatggggtattacaagaataacatgaaggtggctattaaaacactgaaagaggggacaatgtccccagaagcttttctcggggaggccaacgtgatgaaagctctgcaacatgagcgactggttagactctacgccgtggtgactaaagagccaatctacatcgtcaccgagtacatggcccggggctgtcttctggattttctgaagactgacgagggcagtcgtctctccctgcccagactgatcgacatgtccgcacagattgctgagggcatggcttatatagaaaggatgaactcaatccaccgggacctcagagctgcaaacatattggtgtccgaagctttatgttgcaagatcgcagacttcggccttgcccggataattgactccgagtataccgcacaggaaggggctaagtttcccattaaatggacggctcctgaagcaattcattttggcgtgtttaccatcaaggctgacgtgtggtcattcggcgtgcttctgatggaggtggttacatacgggagggtcccgtatcccgggatgagcaatcccgaggtcatccgcaacctcgaacggggataccgaatgcccagacccgacacatgtcctcctgagctttatagaggagtcattgccgagtgttggaggtcacggcctgaggagcgccccacctttgattgcacacccggaagagtcactcgccctttgtgcgcagctagcttcgttgagggatgtaatagcgaccttgcccggtcctctggggtcctatccccatccaaggttttccggactggcaaacgcctgagctcatctaaggcccctgtgttgggcaccccaagagccgggagagtgcccgcatctgccccgtgtgtggatccagccttgccgaggtaccggtcgcaaacggggtccaggggcaggcagcaggggcagccgcaacctcggctgaggtcatccaccgctggcctgttctgtaacaaagtgaccagcgttaggtag

SEQ ID NO: 109362 - DNA, 615 bp, Artificial Sequence
  Description of Artificial Sequence: Synthetic coding sequence
atggccactgcaagtccctcagtgtttctgttgatggttaacgggcaagtggagagtgcccagtttccagaatacgacgacctgtattgcaagtactgctttgtgtatggccaggactgggcacccaccgccgggctggaagagggtatctctcagataacttccaagtcccaggatgtccgacaggcgctcgtgtggaactttccaatcgacgtcacctttaagtcaacaaacccatatggttggccccagatcgtgctgagtgtgtatggaccagacgtttttggcaatgatgttgtcagagggtatggcgctgtgcacgtccctttttctcctgggaggcacaagaggacgataccgatgtttgttcccgagtctactagtaaattgcagaagttcactagttggttcatggggcggcggccagagtataccgatcctaaagtggtagcacagggggagggtcgggaggtgactcgggtgaggtcgcagggatttgttaccctccttttcaacgtggtgaccaaggacatgcgcaagctcggttacgatactggaccatcagacacacagggcgtgctcggtcctagcccaccacagtcatttcctcagtag

SEQ ID NO: 109363 - DNA, 462 bp, Artificial Sequence
  Description of Artificial Sequence: Synthetic coding sequence
atggcaaccgcttcccctagcgtgttcctcttgatggtcaatggtcaggtggagtcagcacaatttcctgaatacgacgatctgtattgcaaatattgcttcgtgtacggtcaggattgggcgcccacagcgggactggaggaaggtatcagtcagatcaccagtaagtcacaggatgtgcggcaagccctagtgtggaattttcccatagacgtgaccttcaagtctaccaatccatacggctggccccaaatcgtcctcagcgtttatggcccagacgtatttggcaacgacgtcgtacgcggatacggcgccgtgcacgtcccattcagtcctgggcgccataaacgcaccattcctatgtttgtccccgaatccacatctaaactgcagaaatttacttcattatgcttagtggcgtcgtctgaccttcaagctgccccccccaccgaggacaagtag

SEQ ID NO: 109364 - DNA, 486 bp, Artificial Sequence
  Description of Artificial Sequence: Synthetic coding sequence
atggccacagcgagcccctctgtctttctactcatggttaacggtcaggtggaaagcgcccagttcccagaatatgacgatctgtactgcaaatactgctttgtttatggacaggactgggcgccgacagctggactagaggaaggcatctcgcagataacctctaaatctcaagacgtgcgacaggccctggtgtggaatttcccgatagacgtcacattcaagagtactaatccctacggttggccgcagatcgtgctaagtgtgtacggtcctgacgtgtttggcaacgacgtggtgcggggctatggtgccgttcacgttcccttcagtcctgggaggcataagcgcactatcccaatgttcgttcctgaatccacaagcaagctgcagaagttcacttcttggttcatggggcggaggcccgaatacacagatcccaaagtcgttgcccagggagaggggcgggaggctcagcctggctag

SEQ ID NO: 109365 - DNA, 564 bp, Artificial Sequence
  Description of Artificial Sequence: Synthetic coding sequence
atggccacagcctcccctagcgtgtttctgctgatggttaatggtcaagtggaatctgcacaattcccagaatatgatgacctgtattgtaaatattgttttgtctacgggcaggactgggccccaaccgctggcctggaagaagggatctctcaaattacaagcaaatcacaagacgtccggcaggccctcgtctggaacttccctatcgacgtcacatttaaatctacgaacccatacggctggccccagatcgtcctgtctgtctatggccctgacgtcttcggcaatgatgtggtgagaggatacggagctgtgcacgtgcccttttctcctggcagacataaacggacgatccccatgtttgtgcctgagtcaacctcaaaattgcagaagttcaccagttggttcatggggagacgtccggaatacaccgacccaaaggtcgtcgctcagggggagggccgggaagacgaaaacgcagaagccgagattcctagaagcacctgggtgagcctgtgcccatcgccagcctggcttatgttaccattctgccctcaatag

SEQ ID NO: 109366 - DNA, 402 bp, Artificial Sequence
  Description of Artificial Sequence: Synthetic coding sequence
ctcttgatggtgaacggacaagtagagtccgcccagtttcctgagtatgacgatctgtattgcaaatattgttttgtttacgggcaggactgggctccaacggcaggactcgaggagggcattagtcagatcacgagcaagtcacaagacgtgcggcaggccctggtgtggaattttcccattgatgtcaccttcaaatccaccaatccctacggctggcctcagattgtgctgtccgtgtacggtcccgatgtgttcggcaacgacgtggtgagaggctacggcgccgttcatgtgccctttagccctggtcggcacaaacgcacaatccctatgttcgtacctgagtccacatccaaactgcagaagttcaccaggtcagccagctgcagcactcactag

SEQ ID NO: 109367 - DNA, 615 bp, Artificial Sequence
  Description of Artificial Sequence: Synthetic coding sequence
atggccacagcttcaccgagtgttttcttgctgatggtcaatggccaggttgagagcgctcagttcccagaatatgacgatctgtattgcaaatactgttttgtgtatgggcaggattgggccccaacggctggcttggaggaggggattagccagatcacaagtaaaagccaggatgtgcgtcaggctctcgtgtggaacttccccatagatgttacttttaaatcaacaaatccatacggatggccacagatcgtgctgtccgtgtacggaccggatgtctttggaaacgacgtcgtccggggatacggcgccgtacacgtgcctttctctccggggaggcacaagagaacaataccgatgtttgtgcctgagtccactagcaagctgcagaaattcacatcatggtttatgggcagacgacctgagtatacagaccctaaggtcgttgcccagggcgaggggagggaggtgacacgggtgagatcacaggggttcgtcaccctgttgttcaatgtagttactaaagacatgagaaagctaggctacgataccggacctagtgatacccagggcgtcctgggaccaagcccaccacagtcatttccccagtag

SEQ ID NO: 109368 - DNA, 444 bp, Artificial Sequence
  Description of Artificial Sequence: Synthetic coding sequence
atgatgacctcaaccgcctctaccgccctgtgtaccgctagaacgggacctcctcagcgggtgtggcgccgggggagccataggagccaccctcgggccaaaatgtgcggtaaacactggtgtggaacttcccccctcatgagtccccttaaagcaccaactcccacagcaggacaccgctcctgcagcgcatgtatggatcagatgtgctctgggacgatgtggttcgaagcgatgggaccttgcacttgtccttcacatttggcgggtaccaaagggcccagcccatgtctgtcacaaaacctgcgtctgaactgtagaagccttcaggccggctcatggggaggcggccccagcacccagacacctcggtggtggctcagagtgaaagcgggtaagcctccctctggactaagtgtcaaagacagctcagttagcagatag

SEQ ID NO: 109369 - DNA, 528 bp, Artificial Sequence
  Description of Artificial Sequence: Synthetic coding sequence
atggcagaggttcacgtgatcggccaaatcataggggcgtctggcttttccgagagctcattgttttgcaaatggggtatccatacgggggcagcctggaaactactctccggagtgagggaaggccagacgcaggtcgacaccccccagattggagatatggcctactggtctcaccctatcgacctccatttcgctacaaagggattgcagggctggccaagactccactttcaggtatggagccaggactcttttggccgctgtcaactcgccgggtacgggttttgtcacgtcccatcgtctcctggaactcaccagctggcctgtcctacctggaggcccttggggagttggcgggaacagctggccagagccttcgttggaggcggacctcagttgctgcatggggacactatctattctggcgcggaccgctacaggttacataccgcagcgggcggtacagtgcatctggaaatcgggctactgctgcgtaacttcgatcgatatggggttgagtgctag

SEQ ID NO: 109370 - DNA, 1452 bp, Artificial Sequence
  Description of Artificial Sequence: Synthetic coding sequence
atgaccgaggtcgaatacacccagctccagcatattctgtgctctcacatggaagctgctgccgatggtgaactcgagactcggctcaatagcgcccttctggctgccgcggggcctggagctggggcaggtgggttcgccgcaggcggccaaggtggagctgcccctgtgtatcctgtgctatgcccgtctgccttagcggccgatgcaccgtgcctgggccatatcgattttcaggaactgcgcatgatgttattgtcggaggccggagctgctgagaagacaagcggagggggagatggcgctcgggctagggccgacggagcagccaaggaaggcgcaggggccgcagccgccgccgccggcccggatggtgcaccagaagcccgggccaaacctgccgtgcgggtcagactagaagatcgcttcaactccatccccgccgagccgccgccggcacctcgggggcccgagcctccagaacccggcggcgccctgaacaaccttgtgaccctgatcaggcacccttcagagctaatgaatgtccctctgcagcagcagaataaatgtacagctttggtaaaaaataagacagccgctacaactaccgccctccagtttacatatcccctgttcaccacgaatgcctgtagcacctctggcaacagcaacctgtcccagactcagtcatctagcaattcctgcagtgtactcgaggcggccaaacaccaggatattggattgcctcgcgcgttcagcttttgctaccagcaggaaatcgaatccacgaaacagacactcggttcccgcaacaaggtcctgcctgaacaggtttggatcaaggtcggcgaggcagccctgtgtaaacaggcactgaaacgcaatcgctcacgtatgcggcagctggacacaaatgtcgaacggagagccctcggggagatccagaatgtcggggaaggggcgacagccactcagggcgcctggcagtcaagcgagtcgagccaggctaacctcggggagcaggctcagtctggcccacaaggcggaaggtcccagcgcagggagcgccataatcgcatggaaagggatcgccgcagaaggatccggatttgttgtgacgagctgaacctgctggtccctttctgtaatgctgagacagacaaggctactactttgcaatggacaactgcattcttgaagtacattcaggagcgacacggcgacagcctaaagaaggtgctgagcacaaactccaggtacgtaatgctctggacttgtttcctgaaaatgaagtccgcagtggacggaaaaaatccccagcacgcctatcgcactgccaaccataaatggctatgcttgcacgaggccagaagttttgcctttgaggtgtccatatgggcacacttccagctgtttcgcgtgcgcatccctgagggtttcctgagcatatag

SEQ ID NO: 109371 - DNA, 843 bp, Artificial Sequence
  Description of Artificial Sequence: Synthetic coding sequence
atgggcccaaaggacagcgcaaagtgtctgcataggggcccacaaccctctcactgggccgcaggagacggacctactcaggaacgatgcgggcctcggtccctgggttctccggtgctgggtttggacacatgtagggcttgggaccacgtggacggacagattctgggacagttgcggcctctaactgaggaggaggaagaagaaggtgcaggagccactctgagcagaggccccgcgttccccgggatgggaagcgaggagctgagactagcttccttctatgactggcccctgacagcggaggtgccaccagagctcctcgctgccgccggtttctttcacactggccatcaagacaaggtcagatgcttcttctgttatggcggtctgcagtcatggaagcgaggtgatgacccctggaccgagcacgccaagtggtttccctcatgccaattccttttgcggagcaagggccgggattttgtgcactccgtgcaggaaacccattctcagctgctggggagctgggacccttgggaagagcccgaagacgcagcccctgtggctccttccgtgcccgcctccggatatcctgagctgccaacccccagacgagaggtccaatctgaaagtgcgcaggagcccggcgctagggacgttgaggcacaactgcggaggttgcaggaggagcgtacctgtaaagtgtgcctagacagagcagtctccatcgtgttcgtgccctgcggacatctcgtgtgtgctgagtgcgcccctggcctgcagctttgtccgatctgccgggcacccgtccgttctagggtgcgcacatttctttcctag

SEQ ID NO: 109372 - DNA, 3564 bp, Artificial Sequence
  Description of Artificial Sequence: Synthetic coding sequence
atgagacctcgcggcgccgccttcgcagctggccctccaggagacctgcaccttggcaccgcaattggcttcgcaggggcaatttggaggtctcggagtccagccatgtccaccctgctggacatcaagagctctgtgctgagacaggtccaagtttgcccctcatttcggcgaaggactgagcaggacccaggtagcgcatcagcagacccgcaggagccagctaccggtgcttggaagcctggagatggcgtcgagtttttcgcccatatgagattgatgctcaaaaagggcgaaggccgccaaggcctcccctgcctcgaagttcccctgcggtctgggtctcccgcaccccctgaacctgtggacccctcgttgggcttgcgcgcccttgcccctgaggaagtggaaatgctgtatgaggaggctttatacaccgtgctatacagagccggaaccatggggcctgatcaagtggacgacgaagaggctctactgagttatctgcagcaggtgtttggaacatccctcgaagagcatacggaagctatagaaagggtgcgtaaagcaaaagctcccacttacgctttaaaggtctccgtaatgcgagctaagaatctgctggcgaaggaccccaatggcttcagcgatccctattgtatgcttggaatattgcccgcatctgatgctacgagagagcctagggcacagaaggagcagcgatttggtttccgcaaaggctctaagaggggaggtccactgccagcgaaatgcatccaagtcacggaggtgaaatcttcaacgctgaaccctgtgtggaaagaacacttcctatttgagatcgaagacgtgagtactgaccaactccatttagacatttgggatcacgacgatgacgtgagtctcgtggaggcttgtagaaaactcaatgaggtgatagggctaaaaggcatggggaggtatttcaaacagatcgttaagagcgcacgtgccaacggaactgctggccctactgaagaccacacagatgatttcctcgggtgtctcaatattccagtgagggaagtgcctgtggcaggtgtagacagatggttcaagttagagcctcggagctcagcctcccgtgtccagggccactgtcatctggtccttaagctgatcacgacccagagagacacagccatgtcacagcggggacgaagtgggttcttgagtcacttactgctgttgagccatctgcttagattggaacactccgcggaagagcccaattcatccagttggagaggagagctaagtacccccgctgcaaccatactgtgtctgcacggtgcccagtctaacctgtcacccctgcagctggctgtcttacattggcaagtcagttctagacatcaccagacctgtacactggactattcctatctcctcgggctgctggaagacatgcaggcccattgggaggaggccccctccctgccccaggagcaggaagaaagtttggccgattccttgagcgcattcagtgagttcgggcttcagttgcttcgtcagctgagagactattttcctgccaccaatagtaccgcggtccaccgcctggagctcttgctgaagtgtttggggaaacttcagctatttcagccatccttcgaaatttgccctttcgaaagcgaactgaatatggatatcgccgctgccctgaaacgcggtaatcgtgaatggtacgatcggatcctcaacgataagtcaccgcgagagcaaccaggccctcagaggctccccggcctggtggtcttagctgatgcggtgtatgacgacctgcagttttgttacagcgtctacgcaagcctgttccactccatccttaatgtcgatgtgtttactttaacattccgacagctggaacggttagtcgcagaggaggcgtgggttctgaccgaagagctttcaccgaagatgacattagaagttgcctcagggctgtttgaactctacctgactctcgccgacctgcaacggttttgggattccattcctggtcgcgacagcaggtctctggcactggctggtatccatgccccctttctgccagccgttaagctgtggtttcaggtgttgcgggatcaggcaaagtggcgactgcagggggctgtggatatggatactctagaacctgtagatgcttcatctagacactcaagtagtgcagcgacagccggcctttgtttgtctcatatccaggaactttgggtgcggctggcgtggccagatcccgctcaggcccagggcctgggtacgcaacttgggcaggacgtgtgcgaagcaaccctcttctacacagagttgcttcgtaagaaggtggatacacagcccggggccgcaggcgaggcagtcagcgaagccctctgcgtagtgctgaacaatgtagagctggttcgcaaagccgccggtcaggctctgaagggccttgcttggcctgaaggagccacggggccggaaggagtgctgcccaggccccttcttagctgcactcaggcgctggatgatgacctgcaacgcgaggcacacacagtaacagcccacctgaccagcaagatggtgggggatattaggaagtatgtgcagcacatctctttgtcgcctgacagcattcagaatgacgaagcggtcgcccctctcatgaagtacctagatgaaaaacttgcactgctcaatgctagcctggtgaaggggaacttgagccgggtgctggaagcactatgggaacttctcctgcaggccatcttgcaggccctcggtgcaaatcgtgatgtttctgcagacttctactctcgctttcatttcacactggaggctctagtcagtttctttcacgctgaggggcagggtttgcccttggagtcgctacgtgacggatcctataaacgccttaaagaggaattgagactgcataagtgtagtacccgggagtgcatcgagcagttctacctcgataagctgaagcagcgcacgctggagcaaaaccgctttggaagattgtcggttaggtgccattacgaagcagctgagcagagactcgccgtagaagtgctccacgccgcagatctgcttccactggacgcgaacggcctgtcagacccgtttgtgatcgtagaattgggtcccccccacctcttcccactggtgcgcagtcagaggacccaggtcaagacccgtactttacaccctgtttatgatgaactcttttactttagcgtccccgccgaggcctgccgtcgaagagcagcatgcgtgttatttacagtgatggatcacgactggctgagcaccaacgacttcgccggggaggccgctctggggctggggggtgtgaccggtgtggcccgcccccaggttggtgggggagcacgggcgggacaacccgtgactttacacttgtgccggccccgagcccaggttcgctcagccttgcgccgcctcgaaggcaggacctccaaagaagcacaggaatttgtgaaaaaacttaaggagctggagaagtgcatggaagccgacccgtag

SEQ ID NO: 109373 - DNA, 3510 bp, Artificial Sequence
  Description of Artificial Sequence: Synthetic coding sequence
atgtcaaccttgctagacatcaagagcagcgtgctgagacaggtccaggtctgccctagctttagaaggaggaccgaacaggaccccgggagcgctagcgcagacccccaggagcccgcaactggagcttggaaacctggcgacggggtcgaattctttgctcacatgcgcctgatgctgaagaaaggcgaaggtcggcagggcctgccgtgtctggaagcttgggggtccccttgtcgacagtcaccccaccccggcccgcacactcaggtcccgttgaggtccggttcgccagccccgcctgaacctgtggaccctagcctcgggctgcgggcacttgcacccgaggaggtggaaatgttgtatgaggaagcgctgtataccgtgctctatagggccggcacgatgggcccagatcaggttgatgacgaggaggccctcttaagctacttacaacaggtttttggaaccagcctggaagaacacaccgaggctatcgagcgagtgcggaaggctaaagccccaacttatgccctgaaggtcagcgtgatgagggccaagaacctcctggcaaaggatcccaatggattctcagatccctactgtatgctcggaattctgcccgcctccgatgccactcgtgagccccgcgctcagaaggaacaacgcttcggttttcggaaaggaagcaaacggggaggccctctaccagcaaagtgcatacaggtgacagaagttaagtcgtcaactctgaatcccgtttggaaggagcacttcctcttcgagatcgaagacgttagtacagaccaactgcatcttgacatttgggatcacgacgacgacgtgtcactcgtggaggcctgccggaaactgaacgaggtcatcggattgaagggtatgggacggtattttaagcagatcgtcaagagcgctagagccaacgggacagctggtcctactgaggaccacaccgacgactttctggggtgccttaacataccagtgagagaggtgccagtcgcaggcgtggaccgctggttcaagttggagccacggtcaagcgcgtcaagggtgcagggacattgccacctggtgttgaaactgatcaccactcagcgggacacagcaatgtcacagcgggggagatccggttttctttcacatttactcctgctgagccacctgttacgactcgaacatagtgcggaagagcccaacagttcaagttggcggggtgagctgtcgacaccggcagccaccatattatgcctacatggtgctcagtcaaacctatccccactacaattggctgtgctccactggcaggtatctagtagacatcatcagacttgcaccctggactactcgtacctcctgggcctgctcgaagacatgcaagctcattgggaggaggctcctagcttaccccaggagcaggaggagtccctcgctgattctctgtccgcgttctccgaattcggcctgcaactcctgagacagctccgggattacttccccgccactaatagtaccgcggtgcatcgactggaactgctccttaagtgtctgggtaaacttcagctgttccaaccctcctttgaaatttgcccgtttgaatccgagctcaacatggacatcgccgctgccctgaaacgcggtaatcgcgagtggtatgatagaattctgaacgacaagtccccaagagaacagcccggacctcagcggctgcctggtcttgtggtactcgcagacgccgtctacgacgatctacagttttgttattcagtttatgcaagtctcttccactcaatcctcaacgtcgacgtgtttacccttacatttaggcagctcgagcgcttagttgctgaagaggcatgggttctgacagaggaactttccccgaagatgacactcgaagtggcttccggcctcttcgaactctatctgaccttggcagatctacagaggttttgggactctatccccggccgggattcccggtccttggccttggccggaattcacgcccccttcttgccagctgtcaagctgtggttccaggttcttcgcgaccaggccaagtggcgtctccagggggccgttgacatggacaccctcgagcccgtggatgcttccagcaggcattcatcaagcgcagcaacagctggactgtgcttgtcccacatccaggagctgtgggtacgcctcgcctggcctgatcccgctcaggctcaaggattaggaacccagctcggccaagacgtgtgcgaggcaaccctattctataccgaactcctacggaagaaagtggatactcaaccaggcgctgccggcgaggccgtcagcgaggctctgtgcgtcgtgctcaacaacgtagagttagttagaaaggccgctggccaggcattaaagggattggcatggcccgagggtgccaccggccccgaaggtgtactgcctaggccactgctatcatgtacacaggccctggacgatgacctgcagagagaagctcacaccgtcactgcacacctgacttcaaagatggttggcgacattcgcaagtatgtccagcacatcagcctgagcccagacagcatacaaaatgatgaggccgttgctcccctcatgaagtatttggatgaaaagttggcactgctgaatgcctccttagtgaaaggaaacctgtcaagggtgctcgaggcgctatgggaactgctgctgcaggcaatcctccaggctttgggtgccaatagggacgtgtcagccgacttttatagccgtttccactttaccctcgaagccttggtgagcttcttccacgccgaggggcaaggcctgccactcgaatctctccgggacggctcctataaacgcctgaaggaagaattgcggcttcacaaatgttcaacccgggaatgcatcgagcagttttatctcgacaaattaaagcaacgaacactagaacagaaccgcttcgggcggctctcagtgagatgccactatgaggctgcggagcaaagattggccgtggaagtgctgcatgcggcagatctgcttcctctggatgccaacgggctctcagatccttttgtgattgtggagctgggacctccccatctctttccgctggtgagaagtcagcgcacacaggttaaaacaaggactctacatcccgtgtatgatgagctgttctacttttcagtgcccgccgaggcatgtcggagacgcgcagcgtgcgtgctttttactgtcatggaccatgactggctctccactaatgatttcgcgggcgaggccgcactcgggctcggcggtgtcacaggtgtcgcacggccccaagtcggcggtggagcacgcgctgggcagcctgtgacgctacatttatgcaggccacgggcccaggtgagaagcgcccttcgcagattggagggtcgaacatccaaagaagctcaggagttcgtgaaaaaacttaaggagctggagaaatgtatggaggccgacccttag

SEQ ID NO: 109374 - DNA, 3510 bp, Artificial Sequence
  Description of Artificial Sequence: Synthetic coding sequence
atgtccactttactggacatcaagagcagcgtgctaaggcaggtccaggtatgcccttcattccgccgccggacagaacaagatccaggctcagccagtgcagacccccaggagccagcgacaggggcatggaagccaggggacggtgtggagtttttcgcccacatgcggctcatgctgaaaaaaggtgagggacggcagggactcccgtgtctggaagcttggggatccccctgcagacaaagcccccatccaggaccacacactcaagtccctctgcggtccgggtcacccgcgccacccgagcctgtggatccctcgctgggtctgcgggcactggcacccgaggaagtggaaatgttatacgaggaggctctctacacagtcttgtacagagcagggacaatgggaccagatcaggtggatgatgaggaggccctgctctcatacctccagcaggttttcgggacttcactcgaggaacatacggaggcgatcgaacgggtgaggaaggcaaaagcgccaacctacgctttaaaggtgtctgtgatgagggccaagaacctgctggccaaagatcccaatggcttcagcgacccttactgcatgttaggcattcttcccgcgtccgatgccactcgtgaacctcgtgcccagaaagagcagcgctttggcttcaggaaaggctcgaaaaggggaggcccactacccgctaagtgcattcaggtgacagaagtgaagagcagcactttgaaccctgtgtggaaagagcacttcttgtttgaaatcgaagacgtgtcgacagatcaactgcacctcgacatctgggaccacgatgacgacgtcagcctagtggaagcttgccgtaaactgaatgaagtgatcggtcttaaaggcatggggagatactttaaacaaattgtcaagtctgctcgggccaatggtaccgccggtccgactgaggaccacacagacgattttttagggtgtttaaatattcccgttagagaggtccccgttgccggggtcgaccggtggttcaagctggagccccggtcttccgcatctcgagtgcagggccactgtcacctggtgcttaaattgatcactacacagagagataccgcaatgagtcaacgcggaaggtccggatttctctcccacctcctgctcttaagccacctactgaggctggagcactcggccgaggagcccaattccagctcctggcgaggcgagctgagcacacccgcagccaccattctgtgtctgcatggcgcccaatctaacctgagtcctctgcagctcgccgtcctgcactggcaagtcagcagtcggcatcaccagacctgtacgctcgattactcctaccttttaggactgctggaagacatgcaagcgcactgggaagaagcaccgagccttccccaggaacaggaggagagtctggctgattccctgtcagccttctcagagttcggtttacagctgcttaggcagttgagggattacttcccagctacaaattccactgcagtacaccggctggagctgttactgaagtgtctggggaagctgcagctattccagccatcattcgagatctgccccttcgaatccgaactgaacatggatattgcggctgccctcaagagaggtaacagagagtggtacgatcggatcctcaacgacaagagtcccagggaacagccagggccgcaacgattaccggggctcgtggtgttggccgacgcggtgtacgacgacctacagttctgttacagcgtttacgcttctttgttccattccatcctcaacgtggacgtatttacgttgacattcagacagctggagcgcctcgtggctgaggaagcttgggtgcttactgaggagctgtcccctaaaatgacactggaggtcgccagcgggctttttgaactttatttgacgctcgcagacctgcagaggttctgggactccatcccaggaagggattcacgtagtcttgcgctcgccgggattcacgctcctttccttccggcagttaagctgtggttccaggttctgcgcgaccaggcaaagtggagactacagggcgcagtggacatggatacgctagagccagtcgatgcaagtagccgtcacagttctagtgcagccactgctgggttgtgcctgagccacatccaggagctgtgggtacgactggcctggcctgaccctgcgcaggcgcagggtttgggaactcaactgggtcaggacgtttgtgaggccaccctgttttatacggaactgcttagaaagaaggttgatactcagcctggagctgcaggcgaggcggtgtctgaggccctctgtgtggttctcaataacgtcgaactcgtgcggaaagcagcaggacaggccctaaaaggactggcctggccagaaggcgctaccggccctgaaggcgttttgcccagacccctcctcagctgtactcaggcgttagacgacgaccttcagcgggaggcacataccgttaccgctcacctgacaagcaagatggtgggtgacatcaggaagtatgtgcagcacataagcctgtctcccgactcgatacagaatgacgaggcagtggcaccattgatgaagtatctcgatgaaaaactagccttgctgaacgccagcctggtcaaggggaacctctcacgggtgctcgaagcactctgggaactgctattacaggcgatcctccaggctctgggtgccaatagggatgtctcggccgatttttatagccgctttcacttcacccttgaagccttggtatctttttttcacgctgaaggacagggacttcctctcgagtcactccgagacgggtcctataaacggctcaaggaggagctgcggctgcacaagtgcagcacgcgtgaatgtatcgaacaattttacctcgacaagctgaaacaacgcaccctggagcaaaatcgttttggccgcctttcggtaagatgccattacgaagccgccgagcagcgactggccgtcgaggttctgcatgccgccgatctgcttccactcgacgccaatgggctttccgacccatttgtgattgtcgagcttggtccccctcatcttttccctctggtgcgctctcaacggacgcaggtcaaaacccgtaccctacatcctgtgtatgatgagctgttctacttctccgttccagctgaggcttgccggcgccgggccgcctgcgttttgttcacagtaatggatcatgattggctctcaacaaatgatttcgctggagaagccgcattgggccttggcggtgtgaccggcgtcgcgcgcccacaagtgggcggcggggcccgcgcggggcaacccgtgactcttcacctgtgtcggccaagggctcaagtgaggagcgctctgcgacggttagagggtcgcaccagcaaagaagcccaggaattcgtcaaaaagctgaaggaattagagaaatgtatggaagctgacccctag

SEQ ID NO: 109375 - DNA, 3351 bp, Artificial Sequence
  Description of Artificial Sequence: Synthetic coding sequence
atgtccacactgttggacattaagtcttccgttttaagacaggtgcaggtgtgcccaagcttccgcagaagaaccgagcaggaccccggctccgcaagtgcagacccacaggagcctgctaccggcgcttggaagcccggcgacggtgttgagttcttcgcccacatgaggctgatgctcaaaaagggggaggggcggcaggggttgccatgcctggaagtccctcttcggagcggcagcccagcaccaccggaacccgtcgacccttccctcggtctccgggctctggcccccgaggaggttgaaatgctctacgaagaagctttgtacactgtcttataccgtgccggcacaatgggccccgatcaggtcgatgatgaggaggccctgctgtcctacctccagcaagtctttggcacatcactcgaggaacatactgaggccatcgagcgtgttcgcaaggcaaaagcaccaacttatgctctgaaggtgagcgtgatgcgcgctaaaaacttgctggccaaggatcccaatggattctcagatccatactgtatgctcgggatcctcccagcgtccgatgctacgcgtgagccaagagcacaaaaagagcagaggttcggttttcgcaaggggtctaagcgcggaggccctcttcccgcaaagtgcatccaagtcacagaagtgaaatcaagcacgcttaacccggtgtggaaggaacacttcctcttcgagatcgaagatgtgtcgactgatcagctgcatctggacatctgggatcatgacgatgatgtttctttggtggaggcttgcagaaagctaaacgaggtgatcgggttgaagggcatggggcgctactttaaacagatcgtgaagagcgctagagcaaacggaaccgccggacctactgaggatcatacggatgacttcctcggatgcttgaacattcctgtccgccgcgacactgcaatgtcccaacgaggtcgctctggctttctttctcacctgctgctcctttcacatctccttcgcctcgaacactccgccgaagagcctaacagttcgtcctggcgcggagaactttcgacacctgccgccactatcttgtgtctgcatggagctcaatccaatttaagcccactccaactggccgtgctgcattggcaagtttcatcgaggcaccaccagacatgcacattggattacagctatctcttaggcctactggaggacatgcaagctcactgggaagaggcaccttctctcccccaggagcaggaggagtctcttgcagactccctcagtgcattctccgaattcggactgcaactgctcagacagctacgggattacttccctgccacaaacagcactgccgtgcaccgactcgagttgctcctgaagtgcctggggaagttgcaattgtttcagcccagtttcgagatttgtcctttcgagagtgaactgaatatggatatagccgctgcgttgaagcgcgggaatagggagtggtatgataggattctcaacgacaagagccccagagaacagcctgggccccagcggctgccaggcctagtcgtcctagctgatgctgtatacgacgatctccagttctgttacagcgtatacgcttcactgttccattcaatcttaaacgtggatgttttcaccctaacattcaggcaactggagagactcgtggcagaggaggcatgggtgttgactgaagagctctctccaaaaatgacactggaagtcgcatccggactgtttgagctttatctcactctggccgacctacagcggttttgggactctatccccggtcgggatagcagatccctagctctggccggtatccatgcccccttcctgcctgccgtaaaactgtggtttcaggtgctgagggaccaggctaaatggcgactgcaaggagccgttgatatggataccctggaacctgttgatgcatcatctcgacatagttctagcgccgcgaccgccggactgtgcttgtcccatattcaagaactctgggtgaggctcgcctggcccgaccccgctcaggcccaaggcctcggcacacagcttggccaggatgtttgcgaggcgacattgttttataccgagctgctgcggaagaaggtggacacccagccaggggccgccggagaggctgttagcgaagctctttgcgtggtgctcaataatgtcgaattggtgcgtaaggctgccggccaagccctgaaaggtttggcctggccagagggagcaactggtcctgagggggtcctgcctcgacctttgctctcgtgcactcaggcgttagacgacgacctgcagcgcgaggcacacactgtgaccgcccacctgaccagcaaaatggtgggagatattagaaagtatgtgcaacacatttccctttcgccggatagtattcagaatgacgaggccgttgccccattaatgaaatatctggatgagaaactcgcgctcctgaacgccagtctggtgaagggcaacctgtcacgggtcctggaggccctttgggagctgttgctgcaggccatattgcaggccttgggggccaaccgggatgtgagtgctgatttctactcacgttttcacttcacactcgaagccctcgtgagcttctttcatgctgaagggcagggtctccccttggagagcttacgggatggcagttacaaacgactgaaggaggaactgcggcttcacaaatgctccacaagggaatgtatagaacagttctatctggacaagttaaaacaaagaaccctcgagcagaacagattcgggaggctctctgtcaggtgccattacgaagccgccgagcaaagactggccgttgaggtcctgcacgcagcggatctcctccctcttgatgcaaacgggctctccgatccctttgtgatcgtggaattgggccctccccaccttttcccgctagtgcggtctcagagaacacaagtgaagacaagaaccctccaccccgtctatgacgaattattctacttcagcgtgcccgccgaggcttgtcgacggagagccgcgtgcgtgctattcactgtgatggaccatgactggctgtccacaaacgacttcgccggtgaggctgcactcggtctgggcggtgtgaccggggtggcccgtccccaggtagggggcggcgctcgcgcaggtcaacctgtcaccctccatttgtgtaggcctcgcgcccaagtacggtcagcgcttaggcgcctggaggggcgcacctctaaagaagcccaggagtttgtgaaaaagcttaaggagctggagaagtgtatggaagccgacccctag

SEQ ID NO: 109376 - DNA, 3459 bp, Artificial Sequence
  Description of Artificial Sequence: Synthetic coding sequence
atgtctaccctgctggatattaaatcttccgtgcttagacaagtccaggtgtgtccctccttccgtcggcggacagaacaggatccagggtccgcgagtgctgaccctcaggaacctgcaacgggcgcctggaagcctggtgacggcgtggagttttttgcccacatgcggctgatgttaaagaaaggagaaggacggcaagggctcccttgtctcgaggtgccactgagatccgggtcccccgctcctcctgaacccgtggaccccagcctgggactccgtgcactagctcccgaggaggtagagatgctgtacgaggaagcactctatacggtgttgtatcgcgctggcacaatggggccagaccaggtggacgacgaagaggcgcttctatcatatctccagcaggtgtttggcaccagtttggaggagcacactgaagcaatagagagggtaagaaaagccaaggctcctacgtatgccctaaaggtgagtgtgatgagggccaaaaacctattagctaaggaccccaacggcttcagcgacccgtattgcatgctgggtatcctcccagcatccgatgccacaagggaaccacgcgcacagaaggaacagcggttcggcttccggaaagggagcaaaagagggggccctctcccagccaagtgcattcaggtaacggaagtcaagtcctctacactgaaccccgtctggaaggaacatttcctgttcgagatcgaagacgtaagtaccgaccaactgcacctcgacatctgggaccatgacgacgacgtttcacttgtcgaggcgtgccgaaagctgaatgaggtgattggtctaaagggcatgggtagatactttaagcagatcgtcaaatcagccagagctaatggaacggcaggtcctacagaggatcacaccgatgacttcctcgggtgcctgaatatacccgtgcgcgaggtgcctgtagctggggtggaccgctggttcaagctggaaccgcgctcatccgcatccagagtccagggacactgtcacctggtccttaaactgataactacccagcgagacacagccatgagccagcgcggccgtagcggcttcctgtcccatctcctcctcctgagtcatttacttaggctggagcatagcgctgaggagcctaacagcagtagttggcgaggcgaactgagtacacccgcagccactatcttatgccttcatggagcacaatccaacctgtcccctctgcagctagccgtgcttcattggcaggtaagcagtcgccaccaccagacctgcacccttgactacagttatttactgggtctcctggaagatatgcaagcacactgggaagaagcgccctctctgccacaggagcaagaagagtcactggccgatagcttatctgccttctctgaattcgggctgcagcttctgaggcagctcagagactactttccggctactaacagcacggcagtacatcggctggagctgctgctgaaatgcctcggcaaactgcagttgttccagccatcctttgaaatctgtccattcgaaagcgaactaaatatggatatcgctgcagctttaaagcgcggtaacagggagtggtacgatcggatacttaacgataaatcgccacgcgaacaaccaggcccccagcgcctgccgggcctggttgtccttgctgacgcagtatacgacgacctgcagttctgctatagcgtctacgccagcctttttcacagcatcctcaatgtggacgttttcaccctcacgttccgccaactggagcggttagtcgccgaggaggcttgggtgcttacggaggaattgagtccgaagatgactctagaggtggccagcgggctgtttgaactttatcttactctggccgacctacagaggttttgggactctatcccgggccgcgacagtagatcgctcgccctggcaggtatccacgcacctttcctgcccgccgtgaagctttggtttcaagtgctgcgggatcaggccaaatggcgcttacagggcgcagtcgatatggacacacttgagccagtggatgcctcctctcgacattccagtagcgcagctaccgccggcctgtgtttgagccacattcaggagctgtgggttagactcgcctggccagatcccgctcaggctcagggcctgggaacacagttgggccaggacgtctgcgaagcaacgttgttctacacggagttgctgcgaaagaaagttgacacgcagccaggagcagctggtgaggcagtgtcagaggccctctgcgtcgtgcttaataatgtcgagctggttcggaaggccgccgggcaggcgctgaagggcctggcatggcccgaaggcgccaccggccccgaaggagtgttgccacgcccactcctcagctgcacccaggccctcgacgacgacttacagcgggaagcacataccgtgactgcgcacttaacctccaaaatggttggagacatcaggaagtatgttcagcatatcagcttgagtccagactcaatccagaacgacgaggccgtggcgccactaatgaagtatctggatgagaagctcgcattgctgaatgcctccctagttaaaggtaatctttctcgggtattggaggccctgtgggagttactcctgcaggccatcctccaggctctgggcgccaatagagatgtgtccgcagacttttactccaggtttcacttcacgctagaggccctggtctcttttttccatgctgaagggcagggactgccgctcgaatccctgcgcgacgggtcatataagagacttaaggaggagcttaggctgcacaaatgcagtacccgggaatgtatcgaacaattctacctcgacaaactgaagcaaagaacgctcgagcaaaacagattcgggcgcctgagcgtgaggtgtcactacgaggcggccgagcagaggctggctgtggaggtccttcacgctgctgatctacttcctcttgatgcaaatggcctctcagatccttttgtgattgtggaactgggccctcctcacctcttccccctggtgcgcagccagcgcacacaggtgaagactaggaccctccatccggtatacgatgagctcttttacttctccgttccggcggaggcatgtagacgaagagccgcatgcgttctttttactgtcatggaccacgattggttgtccaccaatgatttcgccggtgaagccgcgttaggcctcggcggcgtgacaggcgtcgcacggccacaggtgggtggaggagctcgcgccggccagcccgtcacattgcacttgtgccggcctagggcccaagtccgctccgccctgcgacgcctggagggaaggacttcgaaagaagcccaggagtttgtcaagaagctgaaggaactggaaaagtgtatggaggcggacccatag

SEQ ID NO: 109377 - DNA, 537 bp, Artificial Sequence
  Description of Artificial Sequence: Synthetic coding sequence
atgagtcagaggggacgatctggatttttgtcacacctgctcctgctaagccatcttctccgacttgagcactcagcagaggagcccaattcttccagctggaggggagaactgagcacacctgcagcaaccatactatgtctacacggggctcagagcaatctgtccccgcttcagctggctgtcctgcattggcaagtctcttcaagacaccatcagacgtgtacactagattacagctatctgttaggcctcctcgaagatatgcaggcacactgggaggaggcgcctagcctcccacaggagcaggaggagtccctggccgattctcttagcgccttcagcgaattcggcctacagcttttgcgtcaactgcgggattattttccggccacaaactcaactgccgtgcatagactcgagctgctgctgaagtgcctcggaaagctgcagctattccagccctccttcgaaatctgcccacgtgtaggcgccgagcacggacattgttgcggccccgaagagagacagccatag

SEQ ID NO: 109378 - DNA, 1782 bp, Artificial Sequence
  Description of Artificial Sequence: Synthetic coding sequence
atggccgccgcatcgtcctccgactctgacgcctgtggggccgagtcgaatgaagctaacagcaaatggctggacgcgcattatgaccccatggcgaacattcacactttctccgcctgcctggccttggctgaccttcacggcgacggggagtacaagctggtggtcggagatctgggccctggtggccaacagccaaggctgaaggttctgaaggggcccctggtgatgaccgagtccccattgccggctcttccagctgccgccgcaacatttttaatggagcagcacgaaccccgcactcctgccctggctctggcatctggcccctgtgtctatgtttacaagaacttgagaccatactttaaattctccttgccacagctgccccccaaccccctggaacaggacctctggaaccaggcgaaggaggatcggattgatcctctcaccctgaaggaaatgctagagagcattcgggagactgccgaggaacctttgagtatccagtctctgcggtttctccaactagagctatcggaaatggaggcattcgttaatcaacacaagtccaactccattaagaggcagacagttatcactacgatgactaccctgaagaagaacctcgctgatgaagatgctgtgagctgcctggtgctcggaacagagaacaaagaactcctcgtgctcgatcccgaagcgttcacaatcctcgccaagatgtctctgccctctgtccccgtttttctggaagtgtcaggtcaattcgacgttgaattccgtctcgcagcagcttgcaggaacgggaacatctacatcctgcggcgcgacagcaagcacccgaagtactgcatcgaacttagtgcccagcccgtgggcctgatccgggttcacaaggttctcgtcgtggggagtactcaggactccctccacggtttcacccataagggaaagaagctgtggaccgttcaaatgcccgccgcaatccttacgatgaatctgctcgagcaacattccagggggcttcaagccgttatggccggcctcgccaacggagaagttcgaatttatagagacaaggccctcctcaacgtgatacatacccctgatgccgtgacatcactttgtttcgggcggtacggcagggaggataataccctgataatgacaacgcgcggaggcggtctgatcatcaagatcctgaagcggactgcggttttcgtggaggggggaagtgaggtagggccaccacctgcccaagcaatgaaactgaatgtccctaggaagaccagactatacgtagaccagacactgcgcgaaagggaggctggtacagccatgcatagagcattccagacagacctatatttgctgaggctgagagccgctagagcatatctgcaggcattggagtcgtcattgtctccattgtccaccacggccagggaacccttgaagttacacgcggtggtacaggggctgggtcccaccttcaaattgaccctgcatctccagaacacctccactacgaggccggttctaggactcctggtttgtttcctgtataacgaagccctgtactcgttacccagggcattttttaaggtgccgctgttggttcctggacttaactaccccctagaaacattcgtagagagcctcagcaacaaggggatctcggacattattaaagtgcttgttctaagagagggccaatctgctccgttgctcagtgctcacgttaacatgcctggctccgaaggcctggccgccgcttag

SEQ ID NO: 109379 - DNA, 498 bp, Artificial Sequence
  Description of Artificial Sequence: Synthetic coding sequence
atgagccccggtcctcagctatggcatcttctccaggcactggtgagcatgtgtataaggatatccgatcccacctctagttccgcgtgccctaactgtctgcagatcctgtggaataagacatttggaacgagacctaaaagggaaacagccgaggaacccttatccatccagtcactgaggttcttgcagttggagttgagcgaaatggaagccttcgtgaaccaacacaaatccaatagtattaaacgccagacagtgatcaccactatgactacccttaagaaaaacttagcagatgaggacgcggtcagttgtcttgttctcggtactgagaacaaggaattactggtgctagatcctgaggccttcacaatcctcgctaaaatgtctctaccgtctgttccggtctttctggaggtcagcggccagtttgatgtggagtttcggcttgccgctgcatgtagaaatggtaacatctacatcttgcgtagatag

SEQ ID NO: 109380 - DNA, 2172 bp, Artificial Sequence
  Description of Artificial Sequence: Synthetic coding sequence
atgttaagctcaatggcagcggccggttctgttaaggctgctctccaggtggccgaagtcctagaggccatagtatcctgctgtgtcggccccgaagggagacaggtgctgtgtaccaaacctaccggagaagtactgctctcccgcaacggagggcgcctcctggaggcattgcacctcgagcatcctattgctcgaatgattgtggattgcgtctctagtcacctgaaaaagaccggtgacggcgcaaagacattcatcatattcctgtgtcatctgttgcggggactgcatgccattacggatagagagaaggatccactcatgtgcgagaacattcagacccatggcaggcattggaagaattgcagtagatggaagtttatctcccaggcgctgttaacattccagactcagattttggatggcatcatggaccagtatctgagccggcattttctttcgatttttagttcagcaaaagagagaaccctgtgtcggtcctcactcgagttgctcctggaggcctatttttgtggacgagttggcagaaataatcataagtttatttctcaactgatgtgtgattacttcttcaaatgtatgacctgtaagtctggaatcggcgtctttgagctagtagatgaccacttcgtcgagctgaatgtgggggtcaccggcctccccgtatccgacagtcggattattgccggactcgttctgcagaaggatttctcggtttatcggcccgcagacggtgatatgcggatggtgatagttaccgagactattcaacccctattctctacaagtggctctgagttcatcctcaattctgaagcacaattccagacatcacagttctggatcatggagaaaaccaaagccatcatgaaacatctgcatagccaaaacgtgaagctgcttatatcttcggtcaagcagcccgacttagtgtcttattatgccggcgtgaatggcatttcagtggtggagtgcctctctagcgaggaagtctccttgatccgaagaattattggtctgtcccccttcgtgcccccacaggccttttcacaatgcgagatccctaacaccgccttggtcaagttttgtaaaccgctgattcttcgttctaagcgctacgtgcaccttggtttaatttcaacctgcgctttcatcccacactctatcgtcctgtgtggccccgtacatggtttgatcgaacaacacgaggacgccctgcacggcgcacttaagatgctgagacaattgttcaaggatctggacctgaactacatgacacagactaacgatcagaacggaacctcttcactgtttatttacaaaaattccggggaaagttaccaggctccagatcccggaaatgggtccatacaacggccctatcaagacaccgttgctgaaaataaggacgctttagagaaaacacagacctacctaaaagtccatagcaacctggtcatccctgatgttgagctcgagacatacatcccctactccacacccaccctgacccccacggataccttccagacagtggaaactcttacttgcctgagtttggagagaaatagacttactgactactacgaaccactactgaagaacaatagtaccgcatacagcacacgcggcaatagaattgaaatttcttacgagaacctgcaagttacgaatataacgcgaaaggggagcatgctgccagtatcttgcaagctcccaaatatgggcacatctcagtcctatttgagtagttctatgcctgcaggctgcgttctgccggtgggcgggaattttgagatcctcctgcactactatttgctcaattatgccaagaagtgtcaccagtctgaagagacaatggtgagcatgattattgccaatgctctgttgggaataccaaaagtgctgtacaagtctaaaactggcaagtatagctttccccatacatacatccgtgccgtacatgccttacagaccaatcagccactggtctcaagccagacgggactggaatcagtaatgggcaaataccagctgctgacctccgtgctccagtgtttgaccaagattctgacaatcgacatggtcattacagttaaacggcatccacagaaggtgcacaaccaggactcagaggatgagttgtag

SEQ ID NO: 109381 - DNA, 2133 bp, Artificial Sequence
  Description of Artificial Sequence: Synthetic coding sequence
atggtgatggcatgtagggttgtgaacaagcggcgacacatgggactgcagcagctcagcagcttcgctgagaccggacgcacgtttttaggtccattgaagtcctcaaagtttatcatcgacgaagaatgtcacgaaagtgtactcatttcctccacagtgaggttattggagagcttagatctcacatcagccgtgggccaactgcttaatgaagccgtgcaagcccagaataacacctacagaacggggattagcaccctcttgttcctcgtcggcgcctggtcttcggccgtggaggagtgtcttcatttgggcgtcccaatcagcattatagttagcgtgatgagcgagggactgaacttttgtagcgaagaagtggtctcactacatgttcctgtgcacaatattttcgattgtatggattcaaccaaaactttttcgcagcttgagacattctccgtttctctgtgcccctttctgcaggtgccctcagatacggacctgatcgaggagcttcatggcctgaaagatgtggcgtcacagacactgactatttcaaacctttccggtaggcccttgaagagttacgagctgtttaagcctcagacaaaggtcgaggcggataataacacgtcccgaactctgaagaactctcttctggccgacacatgctgtcggcagagtatactgattcatagccggcatttcaaccgtaccgataacaccgagggagttagtaaacccgacggcttccaagaacacgtaacagccacacataaaacctacagatgcaatgatttggtagaactagctgtgggcttgagccacggggaccacagcagcatgaaactggtggaagaggctgtgcaactccaataccaaaacgcctgcgtacagcagggaaattgtactaagccattcatgtttgacatttcaaggattttcacctgctgcctgcctggactgccagagacctcttcctgtgtgtgtccaggctacatcaccgttgtcagtgtatccaacaatccagtaatcaaggagctacagaaccagccagtgcgcatcgtgctcatcgagggagacctgaccgagaactaccgacacctcggttttaacaaatctgccaacattaagactgttcttgattccatgcggttacaagaagactcaagcgaagagctgtgggccaaccatgtactgcaggtcctcatccagttcaaagtgaatcttgttctcgtgcaaggtaacgttagcgagaggctcatcgagaaatgtattaatagcaaaaggttggttataggcagtgttaatggctccgtgatgcaggccttcgccgaggctgcaggcgcagttcaagtggcgtatatcacacaggtgaacgaggactgcgtaggagatggggtctgcgtgaccttctggcggtcctcccctctggatgtcgtggatcggaataatcggatcgccatcctgctgaagacagaggggatcaacctcgtgaccgctgtgctgacgaatccagtgacagcgcagatgcagattaaggaagaccgcttttggacctgtgcgtatcgtctgtactatgcgctgaaggaggaaaaggtgtttttaggaggcggtgcggtggaatttctgtgcttaagttgtctgcacatattggcggagcagagcctgaagaaagagaaccatgcatgctccggctggctgcataacacaagctcttggctggccagctctttggcaatttataggccgaccgttctaaaatttctagccaacggctggcagaaatacctttctacactgctttacaacaccgctaactactcctccgaattcgaggcgtccacatacattcagcaccacctgcagaacgctaccgactccggttcacctagtagttatattttgaatgaatactccaagcttaactcccgaatctttaactcagatatctctaacaagctggagcagatcccgagagtgtacgatgttgtcacaccgaaaatagaggcctggcgtcgagccttggacctggtcttgctggtgctgcagactgattcagagattatcacaggtcatggccatactcagataaattcacaggaacttaccgggtttctgttcttatag

SEQ ID NO: 109382 - DNA, 576 bp, Artificial Sequence
  Description of Artificial Sequence: Synthetic coding sequence
atggtgatggcctgccgggtggtcaataaacgccgccacatgggactgcagcagcttagtagcttcgcagagaccgggagaacgttcctcggtcccctgaaaagttctaaattcataatagacgaggagtgccacgagtcagtgcttatcagttccacagtcagactgctggagagcctggacctgacgtcagctgtggggcaacttttgaatgaggccgtgcaggcccaaaacaatacgtacagaaccggcattagtacgttgcttttcttggtaggagcctggtcaagcgccgtcgaagagtgcctgcatctcggggtgcctatctcgatcatagtgtcagttatgtccgaaggactgaatttctgctcagaagaggtggtgtcactgcacgttccggtccataacatctttgactgtatggattccaccaagaccttctcccagttggaaaccttctctgtctcgctgtgcccttttctgcaggttccttccgataccgatctgattgaggagctccacggcctgaaggatgtggcatcccagacacttaccataagtaacctgagcggctag

SEQ ID NO: 109383 - DNA, 2133 bp, Artificial Sequence
  Description of Artificial Sequence: Synthetic coding sequence
atggttatggcctgcagggttgttaacaaacggagacacatgggcctgcaacaattaagttcctttgcagaaacaggacggactttcctgggtcctctaaagagttccaagtttatcatcgacgaggagtgccacgagtccgtccttatcagcagcacagtccggttgttggaatcccttgatctgacttccgctgtcgggcagctgttgaatgaggctgtgcaagcccagaacaatacctaccgcacggggatctctactctcctctttctggttggggcctggtcctccgcagtggaggagtgcttgcacctgggagttccaatcagtattattgtaagcgtgatgtcggagggcctgaacttctgttctgaagaggtcgtgagcctgcatgtcccggttcacaacatcttcgattgcatggattccacgaagacattttcacaactggagactttctccgtgtccctgtgtcctttcctgcaagtgcctagcgacactgacctcatcgaggagctgcacggactcaaagatgtggcttcacagacactgaccatctccaacctcagtgggcgaccactgaagtcatatgaactgttcaaaccacagactaaagttgaagcggacaataacactagcaggacattaaaaaattcactgctcgcggacacgtgctgccgacagagcatcctaatccatagccggcattttaataggaccgacaacaccgaaggggtctctaagcctgatggattccaggagcatgtcacggccacgcataagacttaccgctgcaacgatctggttgaactggctgtcggactcagtcacggtgatcattcttctatgaaactggtggaggaagcggtgcaactgcaatatcagaacgcatgtgtgcagcagggtaattgtaccaagcccttcatgttcgatattagcaggattttcacatgttgtcttcctggactgcccgagacttcttcgtgcgtttgccctggatatatcactgtcgtgtccgttagcaataaccctgtcatcaaggagctgcaaaatcagccggtgcgcatagtcttaattgagggggatctgacagagaactatcggcacctggggttcaacaaatccgccaatataaaaacggtcttggattccatgaggctgcaggaggatagctcagaagaactgtgggccaaccatgtgttacaggtacttattcaattcaaggtgaatctggtgctcgtgcaaggcaacgtgagcgagaggctgattgaaaaatgtataaactctaaacggctcgtgatcggatcagtgaatggatcagttatgcaggcgttcgctgaggccgcaggtgccgttcaagtggcatacataactcaggtgaacgaagattgcgttggcgacggcgtgtgtgtgaccttctggaggtcctccccgctcgatgtggttgatcgtaataatcgcattgctattctgttaaagaccgaaggcattaacctcgtaactgcagttcttacgaaccccgtgactgcccagatgcagataaaggaggaccggttctggacatgcgcttataggctgtactacgctctcaaggaggaaaaggtctttctggggggcggtgctgtcgaattcttatgcttatcctgtttacacatcttggcagagcagagtcttaaaaaagaaaatcatgcatgtagcggctggttgcacaacacaagttcttggctcgcatcctcactcgctatataccgacctaccgtcctaaagtttctcgcaaacgggtggcagaaatatctgagcacgctcctgtacaacactgccaactactcatcagaattcgaggcctctacatatatccaacaccacctgcagaacgcgacggatagcggaagcccatcaagctatatacttaacgaatactctaaactcaactcacgcatcttcaactccgacatctcaaacaagctggaacaaatccctagggtctacgacgtcgtaacaccaaaaattgaagcatggcgtagggccctggatttagtgctgctggtgcttcagactgacagcgaaatcatcacaggtcatggacacactcaaataaattctcaggaactgacagggttcctgtttctgtag

SEQ ID NO: 109384 - DNA, 2166 bp, Artificial Sequence
  Description of Artificial Sequence: Synthetic coding sequence
atgctgctgcctgtgttcaccctgaagctccgccataagattagcccacgtatggtggccatcgggcgttacgatggaactcatccatgtttggcagccgccactcagacgggcaaggtgtttattcacaaccctcacactagaaaccagcacgtgtccgcctccagagtctttcaaagcccgttagaatctgacgtgtctctgctgagtatcaaccaggcagttagttgccttacggcaggcgtcctgaaccctgagctcgggtatgacgctctgctggttggaactcaaactaacctgctggcctacgatgtgtataataacagtgacctcttttaccgggaggtggcagatggcgccaatgccatagtgcttggaacactaggagacatctcaagccctctcgccatcatcggtggcaactgcgcactgcaaggtttcaaccatgaggggtcggacttattctggaccgtcacaggagacaatgtcaactcgcttgctctgtgtgattttgacggtgatggtaagaaagaattgctggtggggagtgaagacttcgatatcagggtgttcaaagaagacgagattgtggctgaaatgaccgagaccgagatcgtaacatcgctatgtcctatgtatggctctcgctttggctatgccctgtctaacggaacagtgggagtttacgataaaacctcccggtactggaggattaaatctaaaaatcatgcaatgtccatacatgcatttgacctgaactctgatggcgtcaatgagctgattacaggttggagcaacggtaaggtcgacgctcgtagcgaccgtacaggggaagtcatttttaaggataatttcagttctgccatagccggggtagtggaaggggactaccgaatggatggccatatccaactgatctgttgttcagtcgacggcgagatccgcgggtatctacccgggactgccgagatgcgggggaatctaatggataccagcgcggaacaggatttgatccgtgagctctcccagaaaaaacagaacttacttctggaactgcgcaattacgaggaaaacgccaaagccgagctggccagcccactgaatgaagcggacggacaccggggtatcattcccgctaacacccggctccacaccaccttaagcgtgagtctaggcaacgaaacacaaacagcgcacacagaactgcgcatcagtacaagcaacgatactattattcgcgctgtgcttatctttgctgagggcatcttcactggagaaagtcacgttgtccacccctccattcataatctgtcaagctccatatgtattccaatcgtgccacctaaggacgtccccgtggatctgcacctaaaagccttcgtcggctacaggtcctcaactcagtttcacgtctttgagtcaacgcgccagcttcctaggtttagcatgtatgccctgacctccctcgatccagcttccgaacctatctcctacgtcaacttcaccatagccgagagggcgcagcgcgttgtagtgtggctcggtcagaatttcctcctacccgaagatacccatatccagaacgccccatttcaggtctgttttacaagcttgaggaatgggggacacctgcatattaagatcaaactgagcggcgagattaccataaacacagatgatatcgacctcgctggtgacattatccaaagcatggcatcctttttcgccatcgaggacctacaggtggaggccgactttcctgtgtatttcgaggaactcagaaaggtcctggtgaaggtagacgagtatcatagtgtgcatcagaaactttctgccgatatggccgatcacagcaacttgatccggtccctcctggtaggggccgaggatgcacggctcatgagggacatgaagactatgaagtcgagatatatggaactctatgatcttaaccgggacctcttgaatgggtataaaattcggtgtaacaatcacacagagctgttggggaacctgaaggccgtgaatcaggctattcagagagctggtcgcctacgcgtgggcaagccaaagaaccaggttataactgcctgtcgggacgccatcagatctaacaatattaacactctgtttaagattatgcgtgttgggaccgccagctcctag

SEQ ID NO: 109385 - DNA, 1560 bp, Artificial Sequence
  Description of Artificial Sequence: Synthetic coding sequence
atggccgaagagagggtagccaccaggacacagttcccggtcagcaccgagtcacagaaacccagacaaaaaaaggcacctgagtttccaatactcgagaaacagaattggctcatacacttgcactacattaggaaagattacgaagcgtgtaaagctgtcataaaggagcagctgcaggagactcaaggactgtgcgagtacgctatttatgtccaagctcttatcttccggctggaagggaacattcaggaatcgctggagctgtttcagacctgtgcagttctgtctccccagtctgcagacaacctgaagcaagtggctcggtctctgtttcttctcggcaagcataaagctgccattgaggtgtacaacgaagctgccaaacttaaccaaaaagattgggaaatatcgcataatctgggcgtctgttacatttatctcaaacagttcaataaggcgcaggaccagttacataatgccttgaacctgaatcgacacgaccttacgtatatcatgttgggcaagatacatctcctggaaggggaccttgataaggcaattgaggtttacaagaaagctgtcgagttttcaccagagaatacagagctcttgaccactttggggctcctctatttacaactgggaatctaccagaaagcctttgaacacctaggtaatgccctgacttacgacccaactaactataaagccattctggccgcaggctcaatgatgcaaacacacggggactttgacgtcgctctcactaagtatagagttgtggcctgtgctgtgccagagagtcctccattatggaacaacattggtatgtgtttcttcgggaagaaaaagtacgttgcagccatttcttgcctaaaacgtgcgaattacctggccccatttgactggaagatactgtacaatttagggctggtacatctcacaatgcagcagtatgcaagcgccttccattttcttagcgcagccattaacttccagcctaaaatgggggagctctacatgctactcgcagtggcgctgactaacctggaggacatagagaacgcgaaacgcgcctatgccgaagcagtccacttagacaagtgtaacccactggtaaacttaaattatgcagtgctgttgtacaaccagggagagaagaagaacgccttggcacaatatcaggagatggaaaagaaggtgtccctgctcaaagataattcctcactggaattcgacagcgaaatggtggaaatggcacagaagcttggcgccgcactgcaagtgggggaagccttagtgtggaccaaacccgttaaggatcctaagtctaaacatcagaccacctccacgtcaaagcccgcctcatttcaacagcccctcggatcaaaccaggctcttggccaagctatgtcttctgccgctgcctatagaactctgccttctggagccgggggtactagtcagtttaccaagccaccctcactcccactggagcctgaacctgccgtggaatcctctcccaccgagacatctgagcaaattagagagaaatag

SEQ ID NO: 109386 - DNA, 1584 bp, Artificial Sequence
  Description of Artificial Sequence: Synthetic coding sequence
atggccctcactgtcgtccccagcttttccgtcagcggcgtttggaagcggacccaattcccggtgtcaacagagagccagaaacccagacagaaaaaggcccccgagttccctatcctggagaaacagaattggctaatccatctgcattatatacgcaaagactacgaggcctgcaaggccgtaatcaaagaacagctgcaggagacccagggcctgtgcgagtacgctatctacgtacaggccctgatttttcgactggaagggaacattcaggagagtctggagctatttcagacatgtgccgtgttgtccccccagtccgccgacaacctgaagcaagtcgccagaagcttatttctgctaggaaaacacaaggcagccattgaagtttacaatgaggcagccaaacttaaccagaaggattgggagatttcacacaacctgggcgtctgttacatttaccttaagcagttcaataaagcccaggatcagctacataatgcgctgaaccttaaccggcacgacttaacttacataatgctgggaaaaatccatctcctcgagggagatctggataaagctattgaggtgtacaaaaaagcggtagagttttctccagagaacactgaactcttgaccactctcggcttactctatttacaactgggtatctaccagaaggcctttgagcacctgggcaatgctctcacttacgatcccactaactataaggccatcttggccgcaggatcgatgatgcagacccacggcgattttgacgtcgccctgacgaaatatagggtggtcgcttgcgcggtgcccgagtcgccccccctgtggaacaatatcggcatgtgtttttttggcaaaaaaaagtatgtggctgctatcagttgcctgaaacgggcaaactacctagcacctttcgattggaagattctgtacaatctgggcctggtccacctgacaatgcaacagtatgcttccgcctttcacttcctctcagccgcaattaacttccagccgaagatgggtgaattgtacatgctcctggccgttgccctgactaatctggaggacatcgagaatgccaaacgggcatatgccgaggcagtgcacctcgataaatgcaaccctctcgtcaatctcaactatgccgtgttgttatacaaccaaggcgaaaagaagaatgccctggcacagtatcaggaaatggaaaagaaggtctctctcttgaaggataactcatcgctggagtttgattccgaaatggttgagatggcccagaaactaggcgcagccctgcaggtgggtgaagccttggtttggaccaagccagtaaaagacccaaagtctaagcatcagaccacatccacatcaaaacccgcatccttccagcagcccctgggtagtaaccaagccctcggccaagctatgagttccgccgctgcataccgcactcttccctccggagctggtggaacctcccagtttactaagcctccctccctgcccttggaaccagagccagctgtggagtcatcccctacggagacttctgagcagatccgggaaaaatag

SEQ ID NO: 109387 - DNA, 1524 bp, Artificial Sequence
  Description of Artificial Sequence: Synthetic coding sequence
atgatttggaatactcggaatagtacttatatttttactgctcccgaatttccaattctagaaaaacagaattggctcatccatttgcactacatccgcaaagattacgaagcatgtaaggccgtaatcaaggaacagctgcaagagactcagggactgtgtgaatacgctatctacgtgcaagccctgatcttccgcttggagggaaacatccaggagagcctggagctgtttcaaacgtgcgccgtgttgagccctcagtcagccgacaatctgaagcaggtggctcggtctctgtttctcctggggaagcataaggctgccatcgaagtgtacaacgaggcagctaagctgaaccaaaaggactgggagattagccacaacctgggcgtgtgttatatttatctcaagcaatttaacaaggcgcaagatcagttgcacaatgcactgaacctgaaccgccacgacttgacctatatcatgctggggaaaatccacttactggagggtgatctggacaaggcaatcgaggtttataaaaaggctgttgagttttctcctgagaataccgaactgctgactaccctgggactgctctacctccaattgggaatctaccagaaagccttcgagcacctgggtaatgctctaacctatgacccaacaaactacaaagcaatccttgccgctggtagtatgatgcagacacacggagacttcgacgtcgccctcaccaaataccgcgtggtggcgtgcgcggttcccgaatccccccctctgtggaacaacatcggcatgtgttttttcgggaagaagaagtatgtggctgccatcagctgcttgaagcgcgccaattatctcgccccattcgattggaaaattttgtataatcttgggctggtccatttgacaatgcagcagtatgcatctgcctttcacttcctgtctgcagccatcaatttccagcccaagatgggagaattgtacatgctgttagctgtagccttaaccaatttggaggatattgagaatgccaaacgcgcttacgcggaagctgtgcatttagacaaatgcaatccgctagtaaacttgaactatgccgtgcttctgtacaatcagggagagaaaaagaatgcactcgctcagtaccaagagatggaaaaaaaagttagcctcctgaaagataatagcagcctggaatttgactctgagatggtggagatggctcagaagctcggtgcagccttgcaggtgggcgaagccctggtctggactaagcctgtcaaagaccctaaaagcaagcaccagaccaccagtacctctaagcctgcttcttttcagcaaccgctcggttcgaatcaggcattaggacaggccatgtccagcgctgccgcctataggaccctcccttctggggccggggggacaagccagtttacaaaacctccgtcccttccgttagaacctgaacctgccgtggagagctcccctaccgaaacatccgagcaaatacgagaaaagtag

SEQ ID NO: 109388 - DNA, 1044 bp, Artificial Sequence
  Description of Artificial Sequence: Synthetic coding sequence
atgctgggaaagatccatctgctggaaggagacctggataaagccatcgaagtttacaagaaagctgtggagtttagccctgagaacacggaattgctgacaacactggggctgttatacctgcaactgggaatttatcagaaggccttcgaacacctgggcaacgcccttacatatgatcccacaaattacaaggccattttagccgctgggtctatgatgcagacacacggtgacttcgacgtggcgcttacaaaataccgagttgttgcgtgcgccgtgccagagtcgcctcctctgtggaacaatattggaatgtgtttcttcggaaagaaaaaatacgtggcagcaatttcatgtttaaaaagggcgaactatctcgctccctttgactggaagattttatacaatttaggcctggtccatctcacaatgcaacaatacgcgagcgcattccacttcctgtcagcggctatcaacttccagcctaaaatgggcgaattgtacatgctgctggctgtcgctctaaccaacttagaggatatcgagaatgccaaacgtgcgtacgcagaagctgtacatcttgataagtgcaatcctctagtgaatctcaattacgccgttctgctgtacaatcagggcgagaaaaaaaacgcactcgctcagtaccaggagatggagaagaaggtttctctcctaaaggataatagctctttagagtttgattccgaaatggtggagatggcgcagaagttgggagctgcactgcaagtgggagaggccttggtgtggacgaagcctgtgaaagaccccaagagtaaacaccaaacaaccagcacaagtaagcccgcatcttttcagcagcctctggggtctaaccaggccctgggacaggccatgtcctctgccgccgcttataggaccctgccgagcggtgccggagggacctctcagttcacaaaacctccatctttgcccctggagccagagcccgccgtcgagtcatcacctacagagacaagtgaacagatcagagaaaagtag

SEQ ID NO: 109389 - DNA, 1026 bp, Artificial Sequence
  Description of Artificial Sequence: Synthetic coding sequence
atgtcagtgctggacgctctgtgggaggatagagacgtcagattcgatttaagcgcccagcagatgaaaactagacctggcgaagtgctgattgattgcctggactctatagaggataccaagggaaataacggcgatagggggcgactgctcgtgaccaacctgcgcatcctctggcactcactggcactgtcgcgcgttaacgtgtctgtgggctataactgcattcttaatatcacaacccggacggctaatagcaaactgagggggcagacagaggcactgtatatcttgaccaaatgtaatagcacaagatttgagtttatttttaccaacctggtgcctggttctccccgcttgtttacaagtgtgatggcagtacatcgggcctacgagacatctaaaatgtatcgtgattttaaactccgcagcgccctgattcagaacaagcagctgaggctgcttccacaggagcacgtatacgacaagataaatggggtatggaatctgtcgagcgatcaggggaacctggggacattttttatcacaaatgtgcgcatcgtctggcacgctaacatgaatgacagctttaatgtctctattccttatctccagatccggtccataaagatccgcgattcaaagtttggactggccctggtgatcgaatcaagtcaacagtcagggggttatgtccttgggtttaaaattgacccagttgagaaattgcaagagtccgtgaaagaaattaatagtctacacaaggtttattctgccagccccattttcggcgttgactatgagatggaagagaaaccccaacctctggaagcgttaacagtcgaacaaattcaagatgatgtcgagatcgattcagacggacatacggacgcttttgtggcctattttgccgacggtaacaagcagcaggatcgtgaaccggttttttcagaagagctcggattggcgatcgagaagctgaaggacggttttaccctgcagggactgtgggaagtcatgagttag

SEQ ID NO: 109390 - DNA, 963 bp, Artificial Sequence
  Description of Artificial Sequence: Synthetic coding sequence
atgtcagtgctcgatgcactctgggaggatcgggatgtgcgctttgatctgtctgcccagcagatgaaaaccagacccggcgaagtgcttattgactgtcttgactctatagaagacaccaaaggtaacaacggagaccgagggcgtctgctggtaacgaatttgcgcatcctgtggcactctctggccctgtccagagttaacgtttccgtgggctataattgcatactgaacatcaccacacgcacggcaaactccaagctcagaggtcaaaccgaagctctatacatattgactaaatgcaacagcacacgattcgagtttattttcactaacctagttccaggttctccccgattatttacgtccgtcatggctgtgcaccgagcgtatgagacgtcgaaaatgtacagagatttcaaactaaggagtgctttaatacagaacaaacagctccggttgcttccccaagagcacgtgtatgataaaatcaacggtgtctggaatctctcttccgaccagggcaacctcggcacattcttcattaccaacgtgagaattgtctggcatgccaatatgaatgattcattcaatgtaagtatcccttaccttcaaattagcggcgggtatgttctgggtttcaagattgatccagtggagaaactgcaagagtcagttaaagaaatcaactcactccataaggtttacagtgcttcacccatctttggcgtcgactacgagatggaagagaagccgcaaccactggaagccttaacagtggaacagatccaggacgatgtggagatcgattccgatgggcacacggacgcattcgttgcctatttcgcagacggcaacaagcagcaggaccgcgagcccgtcttttcagaagagctcggattggcgatcgagaaactgaaggacggttttacactccagggactatgggaggtgatgtcttag

SEQ ID NO: 109391 - DNA, 1635 bp, Artificial Sequence
  Description of Artificial Sequence: Synthetic coding sequence
atgagtgttcttgacgctctctgggaagatcgggacgtccgcttcgatctttcagctcagcagatgaagacacgtcccggcgaagttttaatcgattgtctggactctatagaggacactaagggaaacaacggcgacagagggcgtctcctcgtcacaaatctgaggatactgtggcattcgctcgccttgtcacgagttaatgtaagtgttggctataattgtatcttgaatatcacaacgcgaactgcaaattcaaaattacggggccagacagaggctttgtatatcctgaccaaatgcaactccactaggtttgagtttatctttacaaacctggtacccggctcacccaggttgtttacgtccgtgatggctgtgcatcgggcctacgaaacctcaaagatgtatcgggatttcaaactaagatcagccctaatccaaaacaagcagttgaggctactacctcaggaacacgtgtatgacaaaattaatggagtctggaacctctcttccgatcagggtaatttgggaacttttttcatcactaacgtcaggatagtgtggcacgcaaatatgaatgatagctttaatgtgtcaatcccatacctccagataaggtctataaagatcagagactccaagttcggattagctttggtcattgagtcatcacagcagagcggcggctacgtactcggttttaagatagaccccgttgagaaactgcaagagtctgtcaaagaaatcaactccttgcacaaagtttactcagccagccctatatttggggtcgactatgaaatggaggagaaaccacagcccctagaagcactcaccgtagagcagatacaggacgacgtcgaaatcgattctgacggtcataccgacgcttttgtagcctacttcgctgacggtaacaagttagatagcattgcttctgaatgggtgggactgcctccactgccatcagccagatgcctgttcgggttaggagaggtcgatgacaaaatttacgtcgtggctggcaaggatctgcagaccgaagcatcccttgattctgtgctctgttacgaccctgtggccgcaaagtggaacgaggtgaagaagctccctatcaaggtctacgggcacaacgtgatctcccacaaggggatgatctattgtctgggcggcaagactgacgacaaaaagtgcacgaacagagtctttattttcaaccccaagaagggcgattggaaggacttggctcccatgaaaattcctagatcaatgtttggagtggctgtacacaaagggaaaatcgtgattgctggtggggtgacggaggacggcctctccgctagtgtcgaggcctttgacctgaccactaacaagtgggatgtgatgaccgaattccctcaggagcgtagcagcattagtctggtctcgctcgccggaagcctgtatgccatcggaggcttcgcaatgatccaactcgaatcgaaagagtttgctcctactgaagtgaatgacatctggaagtatgaagatgataagaaggaatgggctggaatgctgaaggaaattaggtatgcttccggcgcatcttgtttagcaactcgactgaatttatttaaattgagcaagctgtag

SEQ ID NO: 109392 - DNA, 2148 bp, Artificial Sequence
  Description of Artificial Sequence: Synthetic coding sequence
atggatttgattctcaataggatggattatcttcaggtgggagtgaccagtcagaagacgatgaagctcattcccgctagccggcatcgagcgacccagaaagttgtgatcggtgaccacgacggcgtcgtaatgtgcttcggcatgaaaaagggcgaggctgcggccgtgttcaaaacacttcctggaccaaagatcgcccggctagaactgggtggggttattaacacaccccaagagaaaattttcattgccgctgccagcgagatacggggtttcaccaaaagaggtaaacagtttctgtcattcgaaacaaacctgactgagagcattaaagctatgcacatttctggaagtgacctgtttctgagtgcctcctacatatacaatcactattgtgactgtaaagatcaacattattatctgtctggggacaaaatcaacgacgtgatatgcttgccagtcgaacgactctccaggatcacccccgtactagcctgccaggacagggtattgcgtgtccttcagggcagcgacgtcatgtacgccgtagaggttcctggccctccgaccgtgctggcactgcacaacgggaacggtggagatagtggcgaggacctgctgttcggaaccagtgacgggaagttagccctgatccaaataactacaagcaagcctgttagaaaatgggaaatacaaaacgagaagaagcggggcgggatcctgtgcattgatagtttcgatatcgtgggtgatggagtcaaagacctcctggtaggacgggacgacggcatggttgaggtttactccttcgacaacgctaatgagccagtgctgaggtttgaccagatgttaagcgagtcagttacaagcattcagggcggttgcgtaggaaaggatagctacgatgagatcgtggtgtccacgtattctggttgggttacgggcctcaccaccgaacctattcataaggaaagcggcccaggcgaggagttaaagatcaaccaggaaatgcagaacaaaattagtagtctccggaacgagctggagcacctccaatataaggttctccaggagagggaaaactaccaacagagcagtcagagctcgaaggccaaaagtgccgtaccctcctttggcatcaatgacaagtttacccttaacaaggacgatgcttcttatagtctcattctggaggttcagaccgccatcgacaacgtgctaatccaatctgatgtccccattgatctgctcgacgttgacaagaattccgcggtggtctcattcagcagctgtgactccgagagcaatgacaatttccttttagcgacctaccggtgtcaagctgacactacaagactggaactcaagatcagatctattgaaggccagtacggaaccctgcaggcttacgtgacccccagaatacagccaaaaacctgtcaggtgcggcaatatcacattaaaccccttagcctgcaccagcgcacccattttatcgatcatgaccgcccaatgaatacactgacccttaccggacagttctcctttgccgaagttcactcgtgggtggtcttttgccttcctgaggtgccagagaagcccccggccggcgagtgcgtcaccttttacttccagaacacctttctcgatacacaactcgagagcacttatcgaaaaggtgaaggcgtgttcaagtcagacaacatcagcactatcagtatacttaaggatgtacttagtaaagaagcaaccaagaggaaaatcaacctgaatatctcctacgagatcaatgaggtaagcgtaaagcataccctcaaactgatccaccccaaactggagtaccaactgttgctggccaaaaaagtccaacttatcgatgccctcaaggagctccaaatccacgagggcaatactaacttcctgattcccgagtaccattgtatcctggaggaagcagaccatttgcaagaggaatataaaaaacagccagcgcatctcgagcgcctgtatggcatgatcacggacctgttcatcgataagttcaaatttaagggcaccaacgttaagactaaggtgcctttgctgctagaaattttggatagttacgatcagaacgctttgatcagctttttcgacgctgcctag

SEQ ID NO: 109393 - DNA, 2019 bp, Artificial Sequence
  Description of Artificial Sequence: Synthetic coding sequence
atggatctgatcctgaataggatggattatctacaggtaggcgtgacctcccagaagactatgaagcttattcctgcgagccgacacagagcgactcaaaaggtggtgattggagatcatgacggtgttgttatgtgcttcggaatgaagaagggcgaggccgcggccgtttttaagaccttgccaggccctaagatcgcaaggctggaattaggcggagtaattaacactcctcaggagaagatcttcattgcggcagcttcggagatcagggggttcactaaacggggcaagcaattcctttcctttgaaactaatctgaccgagagtattaaggctatgcacatctctggatcagatctcttcctgtccgcctcctacatctataatcactactgcgactgtaaggaccagcattattacctgtccggcgacaagattaacgatgtaatctgcctgcccgtggaaagactgtccagaattacccccgtcctggcatgtcaggatagggtgctgcgggtgctgcagggcagcgatgtgatgtacgctgtggaagttccgggccctcccaccgtgttagcactgcacaatgggaacggaggcgattcaggagaggacctgctgttcgggacaagcgatggaaagctagctttgatccagatcacaacttccaagcctgtcaggaagtgggagatccagaatgaaaagaagcgcggtgggattctgtgcattgactcctttgacattgttggagacggcgtcaaggacttactcgtcgggagagatgacggcatggtggaagtctactccttcgacaatgccaatgagccagtgctccgcttcgaccaaatgctctctgagtcagttacttcaatccagggtgggtgcgtgggcaaggatagctacgacgagatcgtcgtgtctacctattccggctgggtgaccggcttgacaaccgaacctatccacaaggaaagtggtccaggagaggaacttaagattaaccaagagatgcaaaataagatctcctcattgcggaatgagctggagcatctgcagtataaggtgcttcaggaaagggagaactatcagcaatccagtcaatcatccaaagccaagagcgcagtcccgagctttgggatcaacgataagtttaccctcaacaaggatgacgcctcctattctctgatactcgaggtacagacggcgattgataatgttctgatccagtccgacgttccaatcgacttgctggatgtggataaaaactcggccgtggtctcattttcaagttgtgactctgaatctaatgataatttcttgctggccacatacagatgccaagcagacactacaagactggagctaaaaattagatctattgaaggccagtatggaaccctccaggcctacgtgactccccggatccaacccaagacttgccaggttcgacagtaccacatcaagcctttaagcttgcatcagaggacccactttatcgaccacgatcggccgatgaacactctgacattaaccggccagttctcattcgcggaagttcactcttgggtcgtgttctgtctgccagaggttcctgagaaacccccagcgggtgaatgcgtgacattttacttccagaatacctttttagacacacagttggagagcacttaccgaaaaggggaaggcgtctttaagtctgacaacatcagcaccatatctattctgaaagacgtcttgtctaaggaagccacaaagcgcaaaatcaatctgaatattagttatgaaataaatgaagtttctgtgaaacacaccttaaaactgatccacccaaaactggagtatcaacttctgctcgccaagaaggttcaactgatcgacgcactcaaagagcttcagattcacgagggaaataccaattttctgatcccagagtaccactgcatcttggaagaggcagaccatcttcaggaagaatataaaaagcagcctgcgcatttagagcgtctttacggatag

SEQ ID NO: 109394 - DNA, 417 bp, Artificial Sequence
  Description of Artificial Sequence: Synthetic coding sequence
gacgtgctgtcaaaggaggccacaaaaaggaagattaacctgaacatctcctacgaaatcaatgaggtctcagtcaagcacaccttgaagctcattcatccaaagcttgaataccaactgctgctggccaagaaggtacagttgatcgacgctctcaaggaactgcagatccacgaaggcaacactaatttcctgattcccgagtaccattgtattctggaggaggctgatcatttgcaagaagaatacaagaagcagcctgcccatcttgagaggctctacggcatgatcactgatctctttatcgacaagtttaagtttaaggggactaacgtgaaaacaaaagtgcctctgctgctcgagatcctcgattcctatgatcagaatgcactgatatccttcttcgatgcagcttag

SEQ ID NO: 109395 - DNA, 2664 bp, Artificial Sequence
  Description of Artificial Sequence: Synthetic coding sequence
atgagtctatttaaggccagggactggtggagcaccattctgggggataaggaggaatttgaccaggggtgtttgtgtttggcaaacgtcgacaactccgggaacggccaggacaaaatcattgtcggatccttcatggggtaccttcgcattttctctccccacccagccaagactggagacggtgctcaggcggaagacttactgctagaagttgacctgagagatcccgtgcttcaggtagaagttgggaaattcgtctcaggaacggagatgctgcacctcgccgttttgcattcgcgaaaactgtgcgtttactcagtgtcgggaactctcggtaatgtcgaacatggcaatcagtgtcaaatgaagctaatgtacgaacacaaccttcagcgaactgcttgcaacatgacctatgggagcttcggtggagtcaagggaagggatctaatctgcattcagtccatggatggaatgctcatggtgttcgaacaggaaagctatgctttcgggcggtttttgcctggcttcctgttgcctggaccgctcgcctatagctcccgtactgatagcttcctcacagtgagcagttgccaacaggtggagagctacaagtatcaagtgctagcgttcgctactgacgctgacaagaggcaggagaccgaacagcagaagcttggatccgggaagcggctggtcgtggactggactcttaacattggcgaacaggccctcgatatttgcatcgtcagtttcaatcagtcagccagtagtgtatttgttctgggggagcgaaacttcttttgcctgaaggacaatggccagatccgattcatgaagaaattggactggtccccctcgtgtttcttaccctactgctctgtgagcgagggcaccatcaatacgctcataggtaatcataataacatgcttcacatataccaggatgtcacactaaaatgggcaacgcagctaccacatattccagtggctgtccgcgtaggctgcttgcatgacctgaagggcgttatcgtcactttgtcggacgatggccatctccaatgcagctacctaggcacagatccatctctattccaggctcctaacgtgcaatcacgagaactcaactacgacgaactggacgttgaaatgaaggagctgcaaaagattatcaaggacgtgaacaaatctcagggcgtctggcccatgacggagcgggaggacgaccttaatgtgtccgtggtcgtctctccaaacttcgacagcgtgtcacaggctaccgatgtggaggtgggaacagatcttgtcccatccgttacagtgaaagtcacactacagaatagggtaatccttcagaaagccaaactgtcagtatatgtgcagcctcccctagaactgacatgcgaccaatttacttttgagttcatgaccccagatctgacccggacagtttctttcagcgtttacctcaagaggtcatacactccaagcgagctcgaaggcaacgctgtggtgtcctatagccggcctactgatcgcaacccagacggcatcccccgagtgatacagtgtaaatttcggctccccctgaagctgatatgtctccccggtcagccatccaagacggcatcacataagatcactatcgacacaaacaagtccccagtcagtctcctttctctttttcctgggtttgcaagccaatccgatgacgatcaagttaatgttatgggtttccatttcttgggcggggcccgcataaccgtattagcgtccaagacttcacaaaggtatcgtatccaatccgagcaattcgaggatctgtggctcatcacaaatgagctgatactaagactccaggagtacttcgagaagcagggcgttaaggacttcgcttgctcctttagcgggagtatccctctgcaggagtattttgagctgattgaccatcattttgaattgcggatcaatggagaaaagctggaggagctgttgagcgaaagagctgtgcagttcagggccatacagaggagattgctggcccgcttcaaggataagactccggcacctttgcagcacctggacacccttctagatggaacctataaacaggtcattgcccttgccgatgctgtagaggagaatcagggcaatctttttcagagtttcacgagattgaaatctgcaacccacctcgtgattttgcttattgctctatggcagaaattatcagctgatcaagtcgccatcctggaggcagcctttctgccgctccaggaggatacccaagagctgggctgggaggagaccgtggacgcggccatcagtcacctgcttaagacctgtctgagcaaaagcagtaaagaacaggccctaaacctgaattcacaactgaacatccccaaagacaccagtcagctcaagaagcatatcaccctgttatgcgaccgcctcagcaagggaggtagactgtgcctgtccaccgacgctgctgcccctcaaacaatggttatgccgggtgggtgcacaactatcccggagagcgatctggaggagaggtcagtggagcaggattccacggaattgtttaccaatcataggcacctgactgccgaaactcctcggcccgaagtcagcccactccaaggcgtgtccgaatag

SEQ ID NO: 109396 - DNA, 2544 bp, Artificial Sequence
  Description of Artificial Sequence: Synthetic coding sequence
atgtccttattcaaggcccgcgattggtggtcaacaattctcggcgataaagaagaattcgatcaaggctgcctttgcctggccaatgttgataacagcggaaacggacaggacaaaattatcgtcgggtccttcatgggctatctgcggattttctccccgcacccagccaagaccggcgatggagcccaggctgaggatctgctgctcgaggtagatttgcgcgaccctgtgctgcaggtagaggtcggcaagtttgtgagcggaaccgagatgcttcacctagcggtgctgcactctcgcaagctgtgcgtgtactccgtgtcaggaactctggggaatgtcgaacatggtaatcaatgtcagatgaaattaatgtatgaacacaatctgcagagaaccgcttgcaacatgacatacgggtcctttggaggtgtcaagggaagggatctgatctgcatccagagtatggacggtatgttaatggtcttcgagcaggaaagctatgcatttgggcgcttcctccccggtttcctgctgcctggcccattggcatactcatcccggaccgactcgtttctcacagtgagcagttgccagcaggtcgagtcctacaagtatcaggtgttagcattcgctacagacgctgacaaaaggcaggagaccgagcaacagaaactgggctcaggaaaacggctggtagtggactggaccctgaatattggggagcaggcattagatatctgcatagtgtcattcaaccagtccgccagctcggtgttcgtgctcggggagcgtaattttttctgtctcaaagataacgggcagatccgcttcatgaaaaaactggactggtctcccagctgttttttgccttactgcagtgtgtcagaggggacaatcaacacgttgataggtaatcacaacaatatgctgcacatctatcaggacgtcaccttgaagtgggcaacacagctcccacacatccccgtggccgtcagggtcggctgtttacacgatctgaaaggcgttatcgtcacccttagcgacgatggtcatctgcagtgctcatacctggggactgacccatctctgttccaagcacctaatgttcagtcccgggagctgaattacgatgaactcgacgttgagatgaaggagcttcagaaaataattaaagacgtcaacaagtctcagggcgtgtggccgatgacagaaagagaggacgacctcaacgtgagcgtggtggtctccccaaactttgattccgtttcccaagctacagatgtggaggtcggaaccgacttggtgccatcggtcactgttaaagtcactctgcagaacagagtaatcctgcagaaagccaagctctcagtgtatgtacagcctcccttagaactaacctgtgaccaatttactttcgagttcatgtctattccacgcgttatccagtgtaagtttcgtctccccctgaagttgatttgcctcccaggacagccatccaagaccgccagtcacaaaatcacgatcgacaccaataagagtcccgtcagcctcctctcactgttcccaggtttcgcgagccaatcagacgacgatcaggtcaacgtgatgggcttccatttcctgggtggggctaggatcaccgtgctggcctccaagacgtcccaaagatatcggattcagtccgaacagtttgaggacttatggctgatcaccaacgagctgatcctcagactccaggagtatttcgaaaagcaaggggttaaggactttgcctgcagtttcagcgggagcattccgctgcaagaatactttgaactgattgaccaccacttcgagctgcgcattaacggcgaaaagcttgaagaactcctttctgagagagctgtccagtttagggcgatccagagacgcctgctcgctcgcttcaaggacaaaactcctgcaccgctccagcaccttgacactctgttagacggtacttataagcaagtgatcgccctggcagacgctgtcgaggagaaccaaggcaacttgttccagtccttcaccaggttgaaaagtgccacccacctcgtgattctgcttatcgcactctggcaaaagctgagcgctgaccaagtggctattctcgaagctgctttcctgccactgcaggaggacacacaggagctcggatgggaggagaccgtggatgctgccatcagccatctgctgaagacctgtttgtctaaatcctctaaggagcaggccctcaacctgaatagccagctgaatatccccaaagacaccagccaacttaaaaaacacattacattgctgtgcgatcgcttgtccaaaggtggccgactatgtctttccaccgacgcagccgctccacagactatggttatgcccggaggatgtacaactattcctgaatctgacttggaagaacgctctgtcgagcaggacagtactgagcttttcactaaccaccggcacttaacagccgagactccccgaccagaggttagccccctacagggggtgagtgagtag

SEQ ID NO: 109397 - DNA, 2559 bp, Artificial Sequence
  Description of Artificial Sequence: Synthetic coding sequence
atgagcctgttcaaggccagggattggtggtccaccatcctcggcgacaaggaagaattcgaccaaggctgcctttgcctggccaacgtagacaacagcggaaacgggcaggataagattatagttggctcgttcatgggttacctccgcatcttcagtcctcaccctgcaaaaaccggtgatggggcgcaagcggaagatctccttttggaagtggaccttagagatcccgtgttacaggtcgaagtgggcaaatttgtaagcggaactgaaatgttgcacctggcggttctgcattcacggaagctgtgcgtctactctgtttccggtactctcggaaatgtcgaacacggaaaccagtgtcaaatgaaattgatgtacgaacacaacttgcaacgtacagcatgtaatatgacctacggttcctttgggggcgtcaaagggcgcgatctgatctgtattcagtctatggatggcatgcttatggttttcgaacaagagtcatatgcctttggccgattcctgccagggtttttgctgccaggcccccttgcctactcctcacggacagattcatttttgacagtctcaagctgccagcaagtcgagtcatataagtaccaagtcctcgctttcgccaccgacgctgataagagacaagagactgaacagcagaaactggggagtgggaagcgcttggtggttgactggactttaaatatcggagagcaagcgctggacatttgcatagtgtctttcaatcagtccgcgtcctctgtcttcgttctgggagagaggaactttttctgcctcaaggacaacggacagatccgattcatgaagaaactggattggtcaccatcatgtttcctcccatattgttctgtttcggagggcacaataaatacccttataggcaaccataacaatatgcttcatatataccaggatgtgactcttaagtgggctactcaattgccacacataccggtggctgtgagggtgggatgcttacacgacttgaagggcgtcatcgtaacgctttcagacgacgggcacctccagtgttcttacctcggaacagatccatctctgtttcaggccccaaacgtgcagtccagagagctgaactacgacgagctggatgttgaaatgaaggaactgcagaaaatcatcaaagacgtcaataaatctcaaggcgtctggccaatgactgaacgagaggacgatctgaacgtgtccgttgtggtcagcccaaatttcgattccgtatcccaagcaacagatgtcgaagtgggtacagacctagtgcctagtgtcactgttaaagtgacccttcaaaatagagtgatcctccagaaggccaaactttctgtgtatgtccaaccaccactggagctgacctgcgaccaatttacgttcgaatttatgtccttgaatgtcctgggtattccacgtgtgatccagtgcaaatttcggttacccctcaaacttatttgtctgcctggccagccctccaaaacagcctcacataaaattacaatcgataccaacaagtcccccgtcagcctcctgtccctttttcccgggtttgcaagccagtctgacgacgatcaggtgaatgtgatgggattccattttctcggaggcgcccggatcacagtgttagcttccaagacaagtcaacgatatcgaattcagtccgagcagtttgaagatctgtggctcataacaaacgagttgatactaaggctccaggagtactttgagaagcagggagtgaaggatttcgcttgtagcttctccggtagcattcctctgcaggagtactttgaactgatcgatcaccatttcgagcttagaataaacggggagaaacttgaggaattgctttccgagagagcggtccaattccgcgctatacagaggagactcttggccagatttaaggataagacccccgccccactccagcatctggataccctgctggatgggacatacaagcaggtgattgctcttgcagacgctgtggaagaaaaccagggaaaccttttccagtccttcactcgactgaagtccgcaacacatttggtgatcctgttgatcgccctctggcagaagctgtcagccgatcaagtggcaatattagaagcagcttttctgcccctgcaggaggacacccaggagctcggatgggaggaaaccgtggacgcagccatctcccatctgctgaaaacatgcctcagcaagagttcaaaggaacaggcacttaacctgaactcccaattaaacatcccaaaagacacttctcaactcaaaaaacacattactttactatgcgaccgtctcagcaaaggcgggcgcctgtgtctctccaccgatgcggccgccccgcagacgatggtcatgcctggaggatgcaccacaatcccagagagcgatctggaggagcggagtgttgaacaggacagcaccgagctgtttactaatcaccgtcacctgaccgccgagaccccccgcccggaggtgagccccttacaaggggtgtccgaatag

SEQ ID NO: 109398 - DNA, 2649 bp, Artificial Sequence
  Description of Artificial Sequence: Synthetic coding sequence
atgagtttatttaaggcacgggattggtggagcacgattttgggcgacaaagaggagtttgatcagggctgtctgtgtcttgcaaatgtggacaattcaggaaatggccaagacaagatcatcgtgggctcctttatgggctacttacgaatattctccccacaccctgcgaagaccggtgacggggctcaggcggaggacctgcttctcgaggtcgatttacgtgaccctgtgctccaagtcgaggtgggaaagtttgtttccggtacggagatgctgcaccttgctgtgttacacagccgcaagctgtgcgtctatagtgttagcggcactctcggtaatgtggagcacggcaatcagtgccagatgaaactgatgtatgaacacaacctgcagagaaccgcctgcaacatgacttatggttcattcggcggagtgaagggcagggatttaatctgtatccagtcaatggacggtatgctgatggttttcgaacaggagtcatacgcctttggccgctttctacccggcttcttgcttccggggcctcttgcatattcctcaagaaccgattccttcctgacggtttcttcctgtcagcaggttgagagttacaagtatcaggtgctcgcctttgctactgatgcagataaaaggcaggaaaccgagcagcagaagttaggtagtggcaaacggctggttgtagactggacactgaatattggggagcaagctcttgacatttgcattgtgtcttttaatcagagtgcgtcctccgtgttcgtgctaggagaacggaatttcttttgcctgaaagataacggacaaattcgattcatgaagaaactggattggtccccaagctgttttctcccttactgctccgtaagtgagggtacgataaataccctgattggcaaccacaacaatatgctgcacatatatcaggacgtgactcttaagtgggccacacagctgccgcatatcccggttgcagtccgagttggatgcctgcatgatctgaagggagtgattgtcaccctgagcgatgacggccacttacaatgttcatacctgggaactgacccaagcctttttcaggccccgaacgtccaaagcagggagctgaactatgatgagctggacgtagagatgaaggaactgcagaagataatcaaagatgttaataaatcacagggcgtctggcctatgactgagcgagaggatgaccttaatgtgagcgtcgtcgtgtcgccaaacttcgatagcgtctcacaggctaccgacgttgaagtgggtaccgacctggtgccaagcgtaacagtaaaagtgacccttcaaaacagagtaattttacagaaggcaaagttgagtgtttatgtgcagccaccactcgagcttacctgcgaccagttcaccttcgaattcatgactccagatctgacacgaaccgtctccttctctgtttatttaaagcgatcttatacgccgtcagaactcgaaggcaatgccgtagtcagctattccagacccactggtattcccagagtgattcagtgcaagttccgactgccccttaagttgatctgcctcccaggacagccctccaagaccgcctcccacaagattaccatcgacacaaataaatccccggtgtctttgctatccctgtttcctggttttgctagccaaagtgatgatgaccaagtgaacgtcatgggattccatttccttggcggagccaggataaccgtcctggccagcaagacttcacagcgctatcgcatccaatccgagcagttcgaggacctgtggctgattaccaacgaattgatactaaggcttcaagagtactttgaaaaacagggcgtcaaagatttcgcttgcagtttttcgggcagcatcccactgcaggagtatttcgagttaatcgatcaccactttgagctcagaatcaacggcgaaaaactcgaggaactcctgtcagagcgagcagttcagtttcgcgcgatccaacgtcggctgttagcgaggttcaaggacaagacccccgcgcccttacagcaccttgatactctcctggatggcacctataagcaagttattgccctggccgatgcagttgaggagaaccaggggaatctcttccaatccttcactagactgaaatcggccacgcatctggtgattctcttgatcgctctctggcagaagctgagcgctgaccaggtagcgatactcgaggcagccttcctgcccctgcaagaggacacacaggagttgggatgggaagagaccgttgacgctgctattagtcacctactgaagacgtgcctttcaaaatccagcaaggagcaagctttaaatctcaattcccagctcaacatacctaaagacacgagtcagctgaaaaaacacatcaccttactgtgtgataggctttccaagggcggaaggctctgcttgtctaccgatgcggccgctccccaaacaatggtgatgccaggcggttgcactaccattcctgagtctgatcttgaggagcggtcagtggaacaggatagcactgaacttttcacgaatcatcggcacctgaccgccgagactcctcgtcctgaggtgtcacccctgcagggagtctcagagtag

SEQ ID NO: 109399 - DNA, 1446 bp, Artificial Sequence
  Description of Artificial Sequence: Synthetic coding sequence
atgagcctgtttaaggcacgcgactggtggtccactatactgggagataaagaggagtttgatcagggctgcctttgtctggctaatgtggacaactccggcaacgggcaggacaaaattatagtgggatcattcatgggctacctgagaattttttccccccaccccgcgaagaccggcgatggagcacaggccgaggacctcctgttggaggtagacctccgcgaccccgttcttcaggtcgaggtcgggaagtttgtgtctggcacagagatgttacaccttgccgtgctccactctcggaagctctgcgtgtattcagtgtccggcacactgggaaatgtggaacacggcaatcagtgccagatgaaacttatgtacgagcacaatttgcagaggactgcctgtaatatgacttacggatctttcggaggcgtcaagggccgcgatcttatttgtattcaatctatggacgggatgctcatggtgtttgagcaggagtcttacgcattcggaaggtttctccccggcttccttcttcctggccctttggcctattcctccagaaccgattcttttctgacagtctccagttgtcagcaagttgagagctacaaataccaggtcctggcgtttgcaactgacgctgacaaaaggcaggagaccgagcagcagaagttggggtctgggaagcgactggtggtggactggacgctgaatataggggaacaggctctagacatctgcatcgtttcttttaaccagagcgccagctctgtctttgtgctcggcgaacgtaatttcttttgcctgaaggataacggacaaataagattcatgaaaaagcttgattggagcccctcctgcttcctgccctattgtagtgtcagcgagggcaccatcaatacgcttattggtaatcacaacaatatgcttcacatataccaagacgtcactctaaaatgggctacccaactgccgcatatcccagttgctgttcgcgtaggatgcctgcacgatcttaaaggggtgatagtaactctgtccgatgatggacatctccagtgttcctatctaggcaccgatcctagccttttccaagcacccaatgtgcagtcccgagagttaaactatgacgaactagatgtcgaaatgaaagagctgcagaaaattatcaaggacgtgaacaagtcgcagggggtgtggccgatgacggagagggaagatgatctaaatgtgagtgtggtcgtgagcccaaattttgattctgtgagtcaagcaacggacgttgaagtcggcaccgacctggttcctagcgtgacagtgaaggtcaccctccagaacagagtaatcctgcagaaggcgaagttaagcgtttacgtgcagcccccgctggaacttacctgcgatcagtttacgttcgagttcatgaactttccgtcatag

SEQ ID NO: 109400 - DNA, 2559 bp, Artificial Sequence
  Description of Artificial Sequence: Synthetic coding sequence
atgagtctttttaaggcccgtgattggtggtccaccatcctcggcgacaaagaagagttcgatcaaggttgtttatgtctggccaatgttgacaatagtggtaacggccaagacaaaattatcgtcggatcattcatgggttatctccgcattttctccccgcatcccgctaaaactggggatggcgctcaagccgaagacctgttactggaggtggacctccgggaccccgtcctgcaagttgaagtgggcaaatttgtcagcggaactgaaatgctgcacctagctgttctgcactctcggaagctgtgcgtctattccgtcagtggcacgctggggaacgtggaacacggcaaccagtgccagatgaaacttatgtatgaacacaaccttcagaggactgcttgtaatatgacgtatggatccttcgggggggttaagggccgagacctgatatgtattcagtccatggacggaatgctgatggtgttcgagcaggagagctacgccttcggccgcttcctgcccgggttcctgctgcccggccccctcgcttattctagccgcacagactcattcctgaccgtttcgtcttgccagcaggtcgagagctacaagtaccaggtgcttgcctttgctactgacgcagataagaggcaggaaactgagcagcagaagctgggcagcggaaaaaggctggtggtcgattggaccctaaacataggcgagcaggctctcgatatctgcatcgtctccttcaatcaaagcgcaagttctgtgtttgtactaggtgagagaaactttttttgcctgaaggataacggccagattagatttatgaagaagctggactggtctccctcatgctttctgccatactgcagcgtctcagagggtaccattaatacgctaattggcaaccataacaacatgttacacatctaccaggacgttaccctgaaatgggctactcagctgcctcatatccctgtagcagtgagagtgggctgtctgcatgacttgaagggagtgatcgttacgctgagcgacgatgggcaccttcagtgcagttatttgggcacagatccctctctgttccaggcaccaaacgtacagagccgtgagctgaattacgatgagctggacgttgaaatgaaagagctacagaagattattaaggatgtaaataaatctcagggggtatggcccatgacagagagggaggacgacctgaatgtgagtgttgtggtgagcccgaacttcgactcagtgagccaggctacggatgttgaagtcggaaccgaccttgtaccgtctgtgaccgtgaaagtcacacttcagaatcgagtgatcctccagaaggcgaagttgagcgtgtacgtccagccccctcttgaactcacttgcgatcagtttacgttcgagttcatgaaccgcaatcccgacgggatcccaagagtgatacagtgcaagttcaggcttcccctcaaactgatctgccttcccgggcagccctctaagacagcttcccacaagataaccatagacaccaataagagcccagtgtccctgttgtctttgtttccgggcttcgcaagccagtccgacgatgatcaggttaatgtaatgggtttccacttcctaggaggtgccaggatcacggtgcttgcctcaaagacctctcaaaggtatagaattcaaagcgagcaatttgaagacctttggctgatcacgaatgaattgatcttacggctgcaggagtacttcgagaagcagggggtgaaggatttcgcctgttccttcagtggaagtatacctctgcaggagtatttcgagttgatcgatcatcactttgaacttcggatcaacggagagaaactggaggaactgctgtctgagcgggcagttcaattcagggccatacagcgtagactcctggctcgcttcaaggacaaaacacctgccccacttcagcatttggataccctgttggatggtacgtataagcaggtcattgctctcgctgacgcagtggaagaaaatcagggcaacttgtttcagtcttttacacgtctgaaatcagcaacccatcttgtcatcttacttatcgctctgtggcagaagttatctgccgatcaggttgccattctcgaagccgcctttttacccctgcaggaagacacacaggagctcgggtgggaagagacagttgacgcagcaatatcacacctgctgaagacttgtctgtccaagagctcaaaagaacaggcccttaatctaaactctcagctcaacataccaaaagatacgagccagctgaagaaacatattacgcttctgtgcgacaggctcagcaaaggagggagactgtgcctctctaccgacgcagcagcccctcaaactatggtgatgcctggaggctgcactacgattcccgaatccgatttagaagagaggagcgtggaacaggactcaactgagctgttcacgaatcatcgacatctcacagccgaaactccccggcccgaggtgagcccactgcagggggtgagcgagtag

SEQ ID NO: 109401 - DNA, 2664 bp, Artificial Sequence
  Description of Artificial Sequence: Synthetic coding sequence
atgtctctgttcaaagctagggattggtggtccaccatcctgggcgacaaggaggaatttgaccagggatgcctgtgcctcgccaatgttgacaacagcggaaacggacaggacaagattatcgtcggctcttttatggggtacttgcgcatcttctccccccacccagctaagactggggacggggcccaggctgaagacctgcttctcgaagtcgacctccgggaccccgtgctgcaggtcgaagtgggcaaattcgtaagtggcacagaaatgctgcatttggcggtccttcattctagaaaactgtgcgtgtatagcgtgtcagggacgttagggaacgtggagcatggaaaccagtgtcagatgaagctcatgtacgagcacaatcttcagcggacagcttgcaatatgacctatggcagcttcgggggtgtgaagggacgagacctaatctgtatccagtccatggacggtatgctgatggtgtttgaacaggagagctacgctttcggacgttttctgccaggttttctgctgccaggccccttggcctactcaagcaggactgattccttcctaacagtctcatcatgtcagcaggtcgaaagctataaataccaagtgcttgcttttgccactgatgctgataaaagacaagaaacagagcaacagaagctggggtccggcaagcgtcttgtggtggactggacactcaacatcggcgagcaggccctcgatatttgcatcgtcagtttcaatcagtcagccagctctgttttcgtgttaggcgaacggaattttttttgcctgaaggataatggccagatcaggtttatgaaaaagttagattggtccccttcttgcttcctgccttactgctctgtttctgaaggcactattaacacgctgatcggcaatcataacaatatgctgcacatctaccaggatgtgaccctcaagtgggcaactcagctcccacatatccctgttgcggttcgtgtgggatgcttgcacgacctaaagggcgtgattgttacacttagcgatgacggccaccttcagtgctcctatctgggaacagacccatcattatttcaagcgcctaatgtacagtctcgcgagttaaactacgatgagttggacgtcgagatgaaggaattgcagaaaatcatcaaggatgtgaacaagtcacaaggcgtctggcccatgacagagcgggaggacgatttaaatgtgagtgtggtggtgtcgcctaacttcgacagcgtgtctcaggcgaccgatgtggaggtggggaccgacttggtcccgagcgttacggttaaagtgacccttcagaaccgagtgatcctccaaaaagctaaactgtcagtgtatgtccagcctccgctggagcttacatgcgatcaatttaccttcgaattcatgacacctgatctaacaaggaccgtctcctttagcgtataccttaaacggagctatactccatcggagctggaagggaacgccgtggtgtcctacagcagacccactgttcagaatagtttagggatcccaagagtgattcagtgcaagttcagactgccccttaagctgatttgcctgccaggacagccttccaagaccgcatcccacaaaattacaatcgatacaaataaatcacctgtttccttactgagtttgtttcctggcttcgcctcacagtctgatgacgaccaggtgaatgtcatgggatttcactttctaggcggtgcacgcatcaccgtattagcgtcaaaaaccagtcagaggtacagaatacagagcgaacaattcgaagacttgtggcttattacaaatgagctgatcctcagacttcaggagtactttgaaaagcagggcgtgaaggatttcgcttgctcattcagtggtagcatcccgctccaagagtacttcgagctaattgaccaccatttcgagctgaggataaacggtgagaaactggaagaactactgtccgaaagagcagtccagtttcgggcgattcagaggcgcctactcgctcgctttaaagacaagactccagctccactgcaacacctcgacacactcttagatgggacgtacaaacaggtcatagctttggccgatgcagtagaggagaatcagggcaacctgttccagtctttcacacggttgaagtccgccacgcacctggtaatcttgctaatcgctttatggcagaagctgtccgccgaccaggtggcaattctcgaagcagcctttctgccactacaggaggatacgcaggagctcggatgggaagagacagtggacgctgccatttctcatctcttgaagacttgcctgtctaagtcttcaaaggagcaggccctcaacctgaacagccagctcaacattcctaaggacacttcacaactgaaaaaacatataaccctgctgtgcgacagactgtccaaaggagggaggctgtgcctcagcacagacgccgcagcaccacagaccatggtgatgccaggcggttgtaccactatacccgagtccgacctggaggaacgcagtgtggaacaagattccacagaactttttacaaaccataggcaccttacggctgagaccccaagaccagaagtgtcccccctacagggggtgtccgagtag

SEQ ID NO: 109402 - DNA, 933 bp, Artificial Sequence
  Description of Artificial Sequence: Synthetic coding sequence
atgggctatttacggattttctctccacaccccgcgaagaccggtgatggagcccaggcagaagaccttctcctggaagttgatctgcgggaccccgtgctgcaggttgaagtcggaaagtttgtcagcggaactgagatgctgcatctcgccgttctgcacagtcgcaagctgtgtgtgtactcagtctctggcacactgggcaacgtggagcatggaaaccagtgtcaaatgaagcttatgtacgagcacaatctgcagcgcaccgcgtgcaacatgacttacggaagcttcgggggagtgaagggacgagatctcatctgtatccagagcatggacgggatgctgatggtatttgagcaggaaagctacgcatttggacgttttctgcccggcttcctactgcctggcccactggcatattcaagccgtaccgacagttttctgactgtatcatcttgtcaacaggtggaatcatacaagtaccaggtcctcgcgttcgcaactgatgccgacaagagacaggagaccgagcagcagaagttgggatccgggaagcgcttggtagtggactggacacttaatattggtgaacaggctttagatatatgtatagtgtctttcaatcaatccgccagtagtgtgttcgtgctcggagaaaggaacttcttctgtctgaaagacaatggacagatccgcttcatgaaaaaactggactggtcaccttcctgcttccttccgtactgctccgtgagcgaaggcactatcaatacactcatcggcaatcacaacaacatgctacacatctatcaggacgtaaccctgaagtgggcgacccaactgccccatatacctgttgccgtgcgcgtgggctgcctgcagttttctctctggaagcatctgttgccccggagctccaccttagagaagtag

SEQ ID NO: 109403 - DNA, 294 bp, Artificial Sequence
  Description of Artificial Sequence: Synthetic coding sequence
atgtcactgtttaaggctcgcgattggtggtccacgatcctgggggacaaagaagaattcgaccagggatgtctttgtcttgcgaacgtggacaacagtggaaatggccaggacaagattattgtcgggagctttatgggctacctgaggatcttctccccgcaccccgctaagactggtgatggagcccaggcagaggacctgctgttggaggtggaccttagagatcctgtactgcaggtggaggtgggcaaattcgtgagcggcaccgaaatgctgcacctggccgtgtag

SEQ ID NO: 109404 - DNA, 1365 bp, Artificial Sequence
  Description of Artificial Sequence: Synthetic coding sequence
taggatctcgttccttccgttaccgttaaagtgaccctgcagaaccgcgtaattctgcagaaagctaaattaagcgtttacgtgcagccaccactggagctaacctgtgaccagttcactttcgaattcatgactccggatcttactagaaccgtttctttctcagtctaccttaagcggtcatacacacccagtgagcttgaaggaaatgctgtggtctcctattctcgacctactgatcgcaaccctgatggtatcccacgcgttattcaatgtaaatttcggcttccactcaagcttatctgcctcccggggcaaccatccaagacagcgtcacacaagatcaccatcgataccaataaatctcccgtgtccctgctgtcactgtttcctggcttcgcgtctcagtccgacgatgatcaggtaaacgtgatgggctttcactttctgggaggcgcaagaataactgtactggcctcgaaaacctcccagcggtatcgcatacaaagtgaacagttcgaagacctctggctcatcaccaatgagctgatcctcagactgcaggagtacttcgagaagcagggagtgaaggatttcgcatgctcttttagcggaagtatccccttacaagagtactttgagcttattgaccatcatttcgaacttcgaatcaacggggagaagctcgaggaactgctgtcggaacgggccgtgcagtttcgggccattcagcggcgcctgctggctcgctttaaggacaaaacgcccgccccgctgcaacacttagatactctgctggatggcacttataagcaggtgatagccctggctgatgccgtggaagagaatcagggaaatctgttccagtcttttactcgtttaaagtccgcaactcatctggttatattactgatcgctttgtggcagaaactctccgcagatcaagtcgcgattctggaggcggctttcctgccgctccaggaagacacgcaagaattgggatgggaggagacagtggatgccgctatttcccacctactgaagacatgcctaagcaaatcgagcaaagagcaggcattgaatctgaattcacagctcaacatccccaaggatacctctcagctcaaaaagcatatcactttgctctgcgaccgtttgtcaaaggggggtagattgtgtctgtccacggatgcagccgcccctcaaactatggtaatgccaggtggttgtactacaatacccgagtcagatttggaagaacgctctgttgaacaggactctactgagctcttcaccaatcatagacaccttaccgctgagacaccgcgccctggaaagaggcttgatggtctccacaaaagatag

SEQ ID NO: 109405 - DNA, 1227 bp, Artificial Sequence
  Description of Artificial Sequence: Synthetic coding sequence
atgaagttaatgtacgaacacaatctccagcgcactgcctgcaatatgacctacgggagctttggcggggtgaaaggacgagatcttatctgtatccagagcatggacggtatgctgatggtctttgagcaagaatcttacgccttcggccggtttttgcccgggttcctcctgccgggccccctggcatatagttcaagaacggacagctttttaacagtatcaagctgtcagcaggtggagtcctataagtaccaggttttggcattcgccaccgacgctgacaagcgtcaggaaacagaacagcagaagctcggctccggcaagagactggtggtggactggaccctcaatatcggcgagcaggctctggatatttgtatcgtgagcttcaaccagtccgcctctagcgtgttcgttctgggagagcgcaactttttctgcctgaaggacaacggccagattaggtttatgaaaaagctcgattggagcccttcctgcttcctgccttactgttctgtgtctgagggtacaatcaatacactaattggcaatcataacaatatgttgcacatttatcaggatgttacattaaaatgggccactcaactgcctcacatccccgtggccgtgcgggttggttgtcttcatgatttgaagggcgtgatcgtgacgttatccgacgacggtcatcttcaatgctcttatttgggaacagacccctctctattccaagcccctaatgtacagtcgcgagagttgaactacgatgaattggatgtggaaatgaaagagcttcagaaaataatcaaggatgtcaataaatcacagggcgtctggccaatgaccgagcgtgaggacgacctgaacgtatcagtcgttgtcagccccaacttcgacagtgtgtctcaggcaactgacgtggaggtaggcaccgacctggtgccgtctgtgacggtcaaagtgactctccagaatcgcgtaattctgcagaaggcaaaactcagtgtgtatgtccaaccccctttggagctgacttgtgaccagtttacctttgagtttatgacgcctgatctgactcgtactgtctcgttctcagtgtatcttaaacgtagcattcaccaccaaaactggaaagagatgctattgttcctgatccctgatcaacagattgagattctgatggcattccgcgagcttagcaatgtgaatctggattttccgtag

SEQ ID NO: 109406 - DNA, 984 bp, Artificial Sequence
  Description of Artificial Sequence: Synthetic coding sequence
atggagggctcaaatgggttcggcatagattcaatactctcacaccgcgctggaagccctgctttgcctaagggcgaccccctgcttggggactgccgctctccgctggaattgagtccacgcagtgagagcagctccgattgcagttcccccgctagtcccggacgcgactgtctggagactggcaccccccggcccggcggagcgagtggacccggccttgatagtcatctgcagcctggccagctgtccgcccccgctcagtcccgtacagtcacatcaagcttcctcatcagggacattttagctgactgcaagcctctggcggcatgcgccccatactccagctcgggtcagcccgccgctccggagccaggcgggcggctggccgctaaagcggccgaggactttcgggataaattggataaatctggctcaaatgccagtagcgactcagagtataaggtcaaagaggagggggatcgcgagataagcagctccagggacagcccccctgtacgtctgaagaagcctcgcaaggcacggacagcttttacagatcatcagctggctcagcttgaaagaagttttgagcgccaaaagtatttgagtgtgcaggacaggatggaactagcggcgtcactgaacctgactgatacccaggttaagacctggtaccagaacagaaggacaaaatggaaaagacagaccgcggtcggtttggagcttttagcagaagccggcaactacagcgctctacaacgaatgttcccaagcccttatttctatccccagagcctggtgtcaaacttagaccccggggcagctctgtacctgtatcgggggcccagcgcaccccccccagcacttcagcggcctctggtgccacgcattctaattcatggattacagggagcatctgagccacctccccccctgccacccctcgccggggttttacctcgcgccgctcagccaaggtag

SEQ ID NO: 109407 - DNA, 984 bp, Artificial Sequence
  Description of Artificial Sequence: Synthetic coding sequence
atggagggaagtaacggtttcgggattgattcgatactgagtcatcgcgccggcagtcccgctcttccaaagggagatcccttgctgggggactgtaggtcccctctcgaactgtccccccgttcggaaagctcctcagactgttcttctcccgcgtcccctggcagagattgtctggagaccggcaccccgcgacccgggggcgcctctgggcccggactggattcccatctccaacctggccaacttagtgctccagcgcagtcaagaacggtgacctcatcatttctgatccgtgatattttagccgattgtaagcctctggccgcctgtgccccatatagtagttccggccaacccgccgctcctgagcccggcggccgcttggctgcaaaggcagcagaggacttccgggacaagttagacaagtcagggtctaacgcttcatcagactctgagtacaaagttaaggaagaaggtgatagggaaattagcagtagtagggattcccctccagtgcgtctcaaaaagcctaggaaggcccgaactgcttttacagatcaccagctcgcgcaactggagagatcttttgaacggcaaaaatatttgtccgtgcaggaccgtatggagcttgcggctagtttaaacctgacggacactcaggtaaagacctggtaccagaaccgcaggaccaagtggaagcggcagaccgccgtgggattggaactcctcgctgaggcgggtaactactctgccctccagagaatgtttccttccccttatttttacccccagtctcttgtgtcaaatttggaccccggagctgccctgtatctgtatcgcggcccatcggcaccaccaccggccctacagcggcctcttgtgccacggatcctgattcacggccttcaaggagcctccgagccgcctcccccactgcccccgttagccggagtgctccctagagccgctcagccgcggtag

SEQ ID NO: 109408 - DNA, 270 bp, Artificial Sequence
  Description of Artificial Sequence: Synthetic coding sequence
atgactaccagccagaagcaccgagatttcgtggccgaacccatgggcgaaaagcctgtcggatctcttgccggcatcggagaagtgttggggaagaagctggaagagagaggcttcgacaaagcttatgtcgtgctgggccaatttctcgtcctgaaaaaggacgaggacctgtttcgagagtggctgaaggacacctgtggcgccaatgccaagcaatctcgggactgtttcgggtgtctgcgcgaatggtgtgacgcgttcctatag

SEQ ID NO: 109409 - DNA, 270 bp, Artificial Sequence
  Description of Artificial Sequence: Synthetic coding sequence
atgaccaccagtcagaaacatagagacttcgttgcagagcctatgggcgagaagcctgttggcagccttgctggcatcggcgaggtgctcggaaagaaactagaggaaagaggattcgataaggcgtacgtggttctgggccagttcctggttctgaaaaaggacgaggatctgtttagggaatggttgaaggatacctgtggtgccaacgccaaacagtcgagggattgctttggctgtttgcgggagtggtgcgacgcttttctctag

SEQ ID NO: 109410 - DNA, 270 bp, Artificial Sequence
  Description of Artificial Sequence: Synthetic coding sequence
atgacaactagccaaaagcacagagacttcgtcgccgagcccatgggtgaaaagcccgtgggtagcctggccggtataggagaggttctcggaaaaaaattagaagaaagaggattcgacaaggcctacgttgtgctgggacaattccttgttctgaaaaaggacgaggacttattcagagagtggctcaaagatacatgtggagcaaacgctaagcagagcagggactgttttggttgtttacgggagtggtgtgacgcttttctttag

SEQ ID NO: 109411 - DNA, 87 bp, Artificial Sequence
  Description of Artificial Sequence: Synthetic coding sequence
atgaccactagtcagaagcaccgcgacttcgtggccgagcctatgggtgaaaaacccgtaggctctttagccggtatcggagaatag

SEQ ID NO: 109412 - DNA, 270 bp, Artificial Sequence
  Description of Artificial Sequence: Synthetic coding sequence
atgactacatcgcagaagcatcgcgacttcgtggccgagccaatgggtgagaaaccagtcggctctttagccgggattggcgaagtgttgggaaagaagttggaagagcgcggctttgacaaggcttatgtggtgcttggacaattcctggtgctcaaaaaggacgaagacctctttagagaatggctgaaggatacttgtggggcaaacgccaagcagagtcgcgactgttttgggtgcctgcgcgaatggtgtgacgcattcctgtag

SEQ ID NO: 109413 - DNA, 963 bp, Artificial Sequence
  Description of Artificial Sequence: Synthetic coding sequence
atggcggacgagaagactttccgaattggttttattgttctgggtctctttctgctggccctaggcacctttctcatgagccatgataggccacaagtctatggaacgttctatgccatgggtagcgtcatggtgatcggagggatcatttggtctatgtgtcagtgctatcccaagattacatttgtccctgcagatagtgatttccagggcatcctgagtccaaaagccatgggactgttggaaaacgggctcgccgcagagatgaagagcccttcaccccaacccccttacgtgagactgtgggaggaggccgcctatgatcagagtctgcctgatttcagtcacatccagatgaaagtgatgagctatagtgaggaccatcggagcctccttgcacctgaaatgggtcagcccaaacttggcacttcggatgggggcgagggcggacccggagacgtgcaggcctggatggaagcggctgtcgtcattcacaagggaagcgacgagtcagagggagagagaaggctgacacagagttggcctggccccctagcgtgccctcagggacccgccccattggcttcttttcaggacgaccttgacatggattcttcagagggaagtagccccaacgcttcaccccacgacagagaggaagcttgctccccgcagcaggagccacaggggtgccggtgtccactggatcggttccaagactttgctctcatagacgcgccgaccctggaagatgagccgcaggagggccagcaatgggaaatcgctctacccaacaactggcagcgttacccccgcaccaaagtcgaagagaaggaggcctcagataccgggggagaggagcctgagaaagaggaagaggacctgtactatggcctcccggatggcgctggcgacttgctgccagataaggagcttggttttgagcctgatacccagggctag

SEQ ID NO: 109414 - DNA, 765 bp, Artificial Sequence
  Description of Artificial Sequence: Synthetic coding sequence
atgcagcgccccggcgagcccggagctgccagatttggtccacccgagggatgcgctgaccacaggccacataggtacagaagcttcatgatcgaagaaattcttacagaacctccgggtcccaaaggcgccgctccggccgcagccgcggccgccgccggggagctgctgaagttcggcgtccaggccctgctcgctgcgcggccttttcactctcacctggctgttttgaaggccgagcaggcagcggtgtttaaattcccattggcacctctgggttgttctggcctatcgtccgctttgttggctgcgggacccggtctgcctggggccgcgggtgctccacacctccccttggagctgcagcttagagggaaacttgaggcagccggcccaggcgagccgggtacaaaggcaaaaaagggtcgtcgctccaggacagtgttcactgaattacagctgatgggcctggaaaaacgtttcgaaaaacagaagtacctatcaaccccagaccgcatcgacctagccgagagcttaggactgagccaattgcaggtgaagacatggtaccagaatcggcgcatgaaatggaagaagatcgtcctgcagggaggaggactcgagtcaccaaccaagcccaaagggcggccaaagaagaattctatccctacaagcgagcagctcacggaacaggagagagctaaggatgctgaaaagcctgcagaggtacccggggagcctagtgaccgctctagagaagattag

SEQ ID NO: 109415 - DNA, 303 bp, Artificial Sequence
  Description of Artificial Sequence: Synthetic coding sequence
atggggctggagaagcgttttgaaaagcaaaagtacttaagtaccccagaccggatagacctggcagaatccctgggattatcacagctccaggtcaagacatggtaccagaaccggcgaatgaagtggaaaaagatcgtacttcagggaggagggctcgaatcccccaccaaaccaaagggccgccccaaaaagaacagcatccccactagtgagcagctgaccgagcaggaacgagcgaaggacgcagagaaacccgcagaagtcccaggtgagccctcagaccgctctcgggaggattag

SEQ ID NO: 109416 - DNA, 840 bp, Artificial Sequence
  Description of Artificial Sequence: Synthetic coding sequence
atgcactgccatgccgagcttcgcctctcttctcccgggcaactcaaggctgctaggcggaggtataaaacctttatgattgatgaaattttgagcaaggagacgtgtgactacttcgagaaactgtcattatattcggtgtgtcctagcctcgtagtgcgcccaaagcctttacacagctgcacagggtcccctagcctgagggcttatccccttttgtcagtgattactcggcagccaacagtcatctcgcacttagtgcctgccacaccaggaattgcacaggcgctttcttgtcaccaggtaacagaagctgtatcagccgaagcacctgggggcgaagccctcgcatcaagcgagagtgagacagaacagcctacaccaagacagaaaaagccccgccgatcaaggaccatttttaccgagctgcagctgatgggcctggagaaaaaattccagaaacagaaatacttatcaactcccgatcgtttggacctggcacagagtctggggttgacccaactgcaggttaaaacctggtaccaaaaccggcgaatgaaatggaaaaagatggtccttaaaggcggacaagaagcccctacaaagccaaaagggaggccgaagaaaaatagcatccccactagcgaagagatcgaggccgaagagaaaatgaattctcaggcccagggacaggagcagctggagcccagtcagggtcaggaggaactctgtgaggctcaggagcccaaggcccgtgacgtacctctcgagatggccgagcctcctgacccgccacaggagcttccgattcctagcagcgagcctccccctttaagttag

SEQ ID NO: 109417 - DNA, 1887 bp, Artificial Sequence
  Description of Artificial Sequence: Synthetic coding sequence
atggaacctccagacgccccagcacaagccagaggagccccccggctgctcctcctcgccgtcttgctcgctgcacatccagatgcccaggccgaggtgagactcagtgtaccacctctggttgaggtgatgcggggcaagtccgtgatcttagattgtacccccacgggaactcacgatcattacatgttagagtggttcctgaccgaccgaagtggagccagaccacgactggcttccgcagaaatgcagggtagtgagctgcaggtcaccatgcatgacacaagaggtaggtctcctccctaccaacttgactcccagggacgtcttgttctcgctgaggcccaagtgggggatgaaagagactatgtgtgcgttgtgagggccggcgccgcaggtacagctgaagctaccgctaggttaaatgtctttgccaaacccgaagctacggaagtgtctcccaataagggaacgctatccgtcatggaagattctgctcaagagattgccacttgtaacagcaggaatggtaatccagctccgaagattacttggtaccgtaacggacagcgtttggaggtgccagtggagatgaatccagagggatacatgaccagcaggacggtacgcgaagcttccggattattgtccctgacaagtactttgtaccttcggctaaggaaggatgatcgagatgcaagtttccactgtgctgcccattacagcctgcccgaaggtcggcatggccgcctcgactcaccaacatttcatctcaccctgcattatccaaccgaacacgtgcagttctgggtcggcagtcccagcactcctgctggatgggtccgcgaaggtgatacagtacaactgctttgccgaggcgacgggtccccgtccccggaatataccctcttcaggctgcaggacgagcaggaagaggttctcaacgttaacttggaaggaaaccttactctggagggagtgactcggggtcagagcgggacgtacgggtgccgcgtcgaggactatgacgctgcagacgatgttcaactcagcaagaccctggagttgagggtggcatacttggacccacttgaactgagcgagggaaaggtactgtccctaccgctgaactcatccgccgtggtcaactgctctgtccatgggctccctacacccgcccttcggtggaccaaggactccacccctctaggcgatggacccatgctaagccttagcagtataacttttgattcaaacgggacctacgtgtgcgaggcttcccttcctactgtgccggtgctgtcccggacacagaacttcacacttttggtgcaaggttcacccgagttgaaaacagctgaaattgaacctaaggccgacggcagttggagggagggagacgaagtaacattaatttgttcggcccgcgggcaccctgacccaaagctgagctggagccagctcggtgggagccctgcagagccaatccctggaagacaaggctgggtctcctcttccttaaccctcaaagtcacatcggcccttagtagagacggcataagttgtgaggcttcaaacccccacggcaacaaacggcacgtgttccatttcgggacagtctcaccacagactagccaggcgggcgtagctgtcatggcagtagctgtgtctgtcggtttactcctcctagtcgtggctgttttctattgcgtccggaggaaaggagggccgtgctgccggcagcggagagagaaaggcgcccctccgcccggggaacctggcttatctcattccggatccgagcagcccgaacagacaggcctgcttatgggaggtgccagcggaggggctagaggagggtcaggcggcttcggggacgagtgctag

SEQ ID NO: 109418 - DNA, 1767 bp, Artificial Sequence
  Description of Artificial Sequence: Synthetic coding sequence
atggagcctccggatgcacctgcccaagcccgcggtgcccctcgtttgttgttgctggctgtgctactggccgcccaccccgatgcccaggctgaggtgcggctgagcgttcccccccttgtagaggttatgcgaggcaagtctgttattctggattgcacaccaacaggtacacacgatcattatatgctggagtggtttcttactgacagaagtggtgctcggcctcggctggcctccgccgagatgcagggcagtgagttgcaggtgacaatgcacgacactagaggtcgttcacctccctaccagttggactcacaagggcgtctggtgctggccgaagctcaggtgggtgacgagagggactacgtgtgcgttgtgagggccggggctgctggaaccgctgaggctactgccagactgaacgtgtttgcgaagcccgaggcgaccgaagtgtcacctaacaaaggaactctgtccgtgatggaggacagcgcacaggagatcgcaacatgtaactctcgcaatgggaatccagccccaaaaattacatggtatcggaacggccagcggctggaggtccctgtagagatgaaccctgagggctacatgacatccagaactgtccgagaggctagcgggttactctccttgactagtacactgtatcttagattgagaaaggacgatagagacgcgtcattccattgtgccgcacactattctctgccagaaggccgccacggccggctggactctcccacattccatctgactctgcactatccaaccgagcacgtgcagttctgggtcggatcgcctagcactcccgctggttgggtacgggaaggcgatactgtgcagttgctatgtaggggggatgggtcacccagccctgagtacacactattccgcctccaggatgagcaagaagaggtgctcaatgtgaatctcgaaggtaatctgacattagagggcgtgaccagagggcagtccggtacctacggatgccgagtcgaggactacgacgctgccgacgatgtacaattaagtaaaacacttgaactccgggtggcttacctggaccccttggagctgtcagaaggtaaggtcctcagcttgcctctgaattccagcgcagttgtgaattgttctgtacacgggctgcccacccccgctctcaggtggacaaaagactctacccccctcggagacggccccatgctgtctctgagttccataacttttgactcaaacggtacatacgtgtgcgaggctagtttacctaccgtgccagtcctatcacggacccagaatttcacactcctcgtccagggctcaccagaacttaagaccgctgaaattgaaccgaaggccgatggatcttggcgcgagggggacgaggtgaccctgatctgcagcgcacgtggtcatcccgatcccaagctttcttggtctcagctgggtgggtcccccgccgaacccatcccggggcggcagggctgggtttctagtagcctcaccttaaaggtcacttcagctttgtcccgagatggtatatcttgtgaggcaagcaatccgcatgggaataaaaggcatgtgttccattttgggacagtatccccgcagacctcgcaggcaggtgttgcagtgatggcggtggccgtctcggtgggattgctcttattggtggttgccgtcttttactgcgtgagaagaaaaggggggccatgctgtagacaacggcgagaaaaaggtgccccgtag

SEQ ID NO: 109419 - DNA, 321 bp, Artificial Sequence
  Description of Artificial Sequence: Synthetic coding sequence
atgatgacactcgtgcctcgggcacggacaagagctggccaagaccactactctcatccatgtccaagattctctcaggtactgctcacagagggtattatgacgtattgtcttaccaaaaatctctccgacgtcaacatcttgcacaggctgctaaagaatggtaacgtgcgcaacactttgctgcagagtaaagtgggtctgttgacttactatgtcaaactctaccctggcgaggtgacactgcttaccaggccctccatccagatgagattgtgctgcatcacgggctccgtcagccggcctaggagtcagaaatag

SEQ ID NO: 109420 - DNA, 321 bp, Artificial Sequence
  Description of Artificial Sequence: Synthetic coding sequence
atgatgacgctggtgccaagggcccggacacgggcaggccaggatcactattcgcacccctgccccagatttagtcaggtgttgcttaccgaggggatcatgacgtattgtctgacaaaaaatctcagtgatgtgaatatactgcatcgtctgcttaaaaacggcaatgttcgcaacacccttcttcagtctaaggtcggcctactaacttattacgttaaactttaccctggtgaggtcacattattgacacgcccaagcattcaaatgagactttgttgcatcaccgggtccgtcagccgtccgcgatcacaaaaatag

SEQ ID NO: 109421 - DNA, 1146 bp, Artificial Sequence
  Description of Artificial Sequence: Synthetic coding sequence
atggagcgaggcatgcacctgggtgccgctgcagcaggcgaagacgacctctttctccacaagtcactgagtgccagcaccagtaaaaggttggaggccgccttccggtccacacctcccgggatggatttgagcctcgcaccccccccccgtgagcggcccgctagttcctcaagctcccctttaggctgcttcgaacccgcggatccggaaggagccggtctgttactgccaccacctgggggaggtggtggggggagtgccggaagtggaggagggggcggcggcggggttggagtcccagggttattggtcgggagtgcgggggtcgggggcgatccaagcttgtcgtccctgccggctggcgccgctctctgtctgaagtacggggagtccgctagcaggggatccgtcgcggaaagttcgggcggggagcagtctccagatgatgacagtgacgggaggtgcgaactagtcctgcgcgcaggggtggctgacccgagagcatcgccgggcgcgggagggggaggagcgaaggccgctgaggggtgtagcaacgcacacctgcatgggggagcctccgtccccccaggtggcctcggcggggggggaggcggtggttcaagctcagggagtagcgggggcggtggtggctctggttccggtagcggtggctcctccagctcttctagtagtagcagcaagaagagtaaggagcagaaggctttgcggctgaacattaacgccagagaacgcaggaggatgcatgatctgaatgacgccctagacgagcttcgcgccgtgatcccatacgcacattccccctcagtgcgcaagctgtcgaagatagctactctactgctggctaagaattacattctcatgcaggcccaggccttggaagagatgagacggttagtggcctacctaaaccaggggcaagccatctcagctgcctccctgccctcctccgctgctgccgcagctgctgccgccgccctgcatcccgctttaggagcctatgagcaggctgcggggtatccatttagtgcgggactgccgcccgccgcctcctgtccagagaagtgcgcactgttcaactcagtttcttctagcctgtgtaagcagtgcacggaaaagccatag

SEQ ID NO: 109422 - DNA, 678 bp, Artificial Sequence
  Description of Artificial Sequence: Synthetic coding sequence
atggctgaactaaagtctctatcaggagacgcatatctggccctgtcgcatggttatgctgcagctgccgcaggcctggcctacggagccgctcgggagcctgaggctgcccgaggctatggaacgcctgggcccgggggcgacttacccgcggctcccgctccgcgcgcccctgctcaggcagccgaaagctctggcgagcaatctggagacgaagacgacgcctttgagcagagacgacggcgccgtggacccggatccgctgcggatggacgccggcgccctagagagcagaggtcgctgagattgtccatcaacgcaagggagcgacgacggatgcatgatctgaacgatgctctggatgggttaagggcagttattccctacgcacactccccttcagtgagaaagttgagtaagatcgcaacactgctgctggccaaaaattacattctcatgcaggcacaggcattagacgaaatgcgccgactggtggcctttcttaatcaagggcaaggtcttgctgctccggtgaacgccgcccctctaacaccattcggccaggctacagtgtgcccattctctgccggcgccgcgctgggcccttgtccagacaagtgtgctgcgtttagtgggacacccagcgccctgtgcaaacattgccatgagaagccttag

SEQ ID NO: 109423 - DNA, 1239 bp, Artificial Sequence
  Description of Artificial Sequence: Synthetic coding sequence
atggagaggataccctccgcgcagcccccgcccgcctgcttacccaaagctcctggactggagcacggcgatctccccggcatgtacccagcccacatgtatcaggtgtacaaatctagaaggggtatcaaacggagcgaagattcgaaggagacctacaaactcccccacagactcattgaaaaaaaacgcagagacagaattaacgagtgcattgcccagctgaaggacttgctgccagaacatttaaagctaaccactctagggcacctggagaaagcagtcgtgctggaactgacactgaaacatgtgaaagcactgacaaacctaattgatcagcagcagcaaaagataatcgctctgcaaagtggtctacaggccggtgagctgtcaggacgaaacgtggagaccggtcaggaaatgttttgcagcgggttccagacatgtgctcgcgaagttctccagtatctggctaaacacgagaataccagggacctaaaatcttcccagcttgttactcatctacatcgagtggtcagtgagttgctccaaggaggcactagccggaagccatccgatcccgcacctaaagtgatggattttaaagagaagcctagctcaccggccaaggggtctgaaggccccggcaagaactgtgtcccagttatccagcggaccttcgctcactcctccggcgagcagagcggatctgatactgatacagattccgggtacggcggggagtccgaaaagggtgatcttagatcagaacagccatgttttaagtcagaccatggccgaagatttaccatgggtgagcgaatcggggccatcaaacaggaatcagaagagcccccgactaagaagaatcgcatgcagttgtccgatgatgaagggcactttacctctagcgatttgattagctctccattcctggggccacacccacatcaaccacccttttgcctccctttttacctgatccctccatccgccaccgcgtatctgcccatgctagagaagtgctggtaccctaccagcgtgcccgtgctgtaccccggacttaacgcctcagccgcggccttaagctcctttatgaacccggacaagattagcgctcctctcttgatgccacagcgactcccttcccctctgccagcccacccgtctgtcgacagcagtgtcttactgcaggccctcaaacctatcccccctctgaatctcgagaccaaagattag

SEQ ID NO: 109424 - DNA, 378 bp, Artificial Sequence
  Description of Artificial Sequence: Synthetic coding sequence
atgcctcattcttcagacagtagcgattcatctttttcgaggagtcccccacctggaaagcaagattcgagcgacgatgtcagaagagtacagagaagggaaaaaaatcggatcgccgcacagaaaagtagacagcggcagacgcaaaaagcggatacactacacctagaaagcgaggatctggagaaacagaatgcagctctcaggaaagaaatcaagcagctcactgaagaactgaagtactttacatccgtgctgaactcacatgagccactctgcagcgtgctggctgcaagtactccatcacccccagaggtcgtgtatagcgcccacgcatttcaccagccccacgttagcagtcctcggttccagccatag

SEQ ID NO: 109425 - DNA, 384 bp, Artificial Sequence
  Description of Artificial Sequence: Synthetic coding sequence
atgagtcaggggctccccgcggctggttctgtactgcagagatctgtggctgcacctgggaatcaaccacagccacaacctcagcagcaatccccagaggatgacgatcgcaaagtaaggcggagggaaaaaaatagagtggctgcccaacgctctagaaagaagcagactcaaaaggccgacaagctccatgaggagtatgagagtctggaacaggaaaatacaatgttaaggcgggaaattggtaagcttacagaagaattgaagcaccttactgaggctttaaaggagcacgagaagatgtgccccctgctgctctgccccatgaacttcgtgcctgtccctcccaggccggacccagtggcggggtgtctaccccgatag

SEQ ID NO: 109426 - DNA, 489 bp, Artificial Sequence
  Description of Artificial Sequence: Synthetic coding sequence
atgaaggagaccattatgaaccaggaaaaactggcaaagctacaggcccaggtacggataggtggaaaaggcactgctagacgcaagaagaaagttgtacacagaaccgctacagctgatgataaaaaattacagttcagtcttaaaaaattaggagtgaataacatctccggtatcgaggaggtgaacatgtttacgaatcaggggactgtgattcattttaataaccccaaagtgcaggctagtctggcagctaataccttcaccattacaggtcacgcggaaactaaacagcttacagaaatgctcccatctattctgaaccagctgggtgccgactcattaacctctttaaggcgcctggccgaggcccttcccaagcagagtgtcgacggtaaagcaccactggccaccggcgaggatgacgacgatgaagtgccagatctggtggagaatttcgatgaggcgtcgaaaaacgaggcgaactag

SEQ ID NO: 109427 - DNA, 621 bp, Artificial Sequence
  Description of Artificial Sequence: Synthetic coding sequence
atgcgccggaccggagccccagcacaagccgacagtaggggcagaggtcgtgccagaggcggatgtcccggaggggaagccaccctctcccagccacccccacgtggcggaactaggggacaggagccacagatgaaagaaactatcatgaatcaggaaaaactggccaagctccaggcccaagtccggatcgggggcaaaggcactgcgcgccgcaagaaaaaggtggtgcaccgcacggcaaccgctgatgataagaagcttcaattcagtctcaaaaagctgggtgtcaacaacatcagcggcattgaggaagtcaacatgtttactaatcagggtacagtgattcattttaataatcccaaggtgcaagcaagcctcgctgccaatacattcaccattacagggcatgccgaaaccaagcagttaactgaaatgctcccctccatcctgaatcaattgggcgctgacagtttaacatcactccggcgattagcggaggctttacccaaacagtctgtcgacggaaaagctccccttgcaaccggagaggatgacgacgacgaggtacctgatttggtggaaaatttcgacgaagcatccaagaatgaagccaactag

SEQ ID NO: 109428 - DNA, 1158 bp, Artificial Sequence
  Description of Artificial Sequence: Synthetic coding sequence
atggccgccgctctctttgttctgttggggtttgccctgctgggaacccatggggcttctggagccgcgggcttcgtccaagcccctctcagccaacagcgatgggtcggggggtccgtagagctgcattgcgaagcagttgggtctcccgttcccgagatacaatggtggttcgagggacagggacccaacgacacatgcagccaactgtgggacggcgcgcggttggatcgtgtacacatccatgccacgtatcaccagcatgctgcctcaactatctcgatagataccctggtggaggaggatacggggacatacgagtgcagggcaagcaatgatccagataggaatcatctcaccagagcgccccgagtaaagtgggtacgggcccaggccgttgtcctggtcctggagccagggacagtttttaccacagtggaagacctgggctccaaaatcctgctgacttgcagcttgaacgatagcgccacagaagtgactgggcaccgctggctaaaaggcggcgtggtccttaaggaggatgccctgcccggccagaaaaccgaatttaaggtggacagcgacgaccaatggggagaatattcatgtgtgttcctacctgaaccgatgggcacggccaacatccagcttcatggtcctccgagagttaaggctgttaaatcatctgagcacattaacgagggcgagacagccatgcttgtctgtaaaagcgagtctgtccctccagtaactgattgggcatggtacaagattaccgatagtgaagacaaagccttgatgaacggatctgagtcacggttctttgtcagtagctcccaggggaggtccgaattgcacatagaaaatctcaacatggaagctgatcctggacagtatcgatgcaatggaacttccagcaaaggttctgatcaggccattattaccctgagggtgcgcagtcacctggctgccttgtggccatttttgggaatcgtggccgaggttctggtgctggtgacaatcatatttatttacgaaaaaaggcggaagccagaagatgtcctcgacgatgatgatgccggcagcgcccctctcaaaagctcagggcagcatcagaacgacaaggggaagaatgttcgacagaggaacagttcatag

SEQ ID NO: 109429 - DNA, 618 bp, Artificial Sequence
  Description of Artificial Sequence: Synthetic coding sequence
atgaaacaatctgacgccagtcctcaagaacgcgtagattctgatgatcaatggggtgaatactcttgcgtattcttacctgagcccatgggaaccgctaacattcaactgcatggcccacctagagtgaaggcagtgaagtcttctgaacatataaatgagggcgaaacagcaatgctggtatgtaagagtgaaagcgtaccacctgtgactgattgggcttggtataagatcacggactcagaggacaaggctttaatgaacgggtccgaatcccggttcttcgttagtagtagccagggacgatcggagttgcatatcgaaaatctcaatatggaggctgaccccggccaatatagatgtaacggtacatccagtaagggcagcgatcaagcgatcatcaccctgcgtgtgagatctcacttggctgcactatggcccttcctaggtattgtggctgaggtcctggtcctggtgacaatcatttttatttatgaaaaaaggaggaaacccgaagacgtattggacgacgacgatgcaggctccgcacccctgaaatcctctggccagcaccagaatgataaaggaaaaaacgtgcgacagcggaattcatcctag

SEQ ID NO: 109430 - DNA, 810 bp, Artificial Sequence
  Description of Artificial Sequence: Synthetic coding sequence
atggccgccgccctgttcgtgctcctgggctttgctttgctcgggacgcacggcgcttctggcgcagccggcactgtgttcaccacagtagaagaccttggctctaaaattctgctcacgtgttccctaaatgacagtgccaccgaagtaaccggtcaccggtggctgaagggcggtgtggtactaaaagaagacgcgttaccgggtcagaagacggagttcaaagtcgactccgacgaccagtggggagagtatagctgcgtttttctgcccgaacccatgggaaccgcaaacatccagttgcatggcccgccccgcgtcaaggcagtgaaaagctcagagcacattaatgagggagaaaccgccatgctcgtgtgtaaatccgagtctgtgccccctgtaactgattgggcatggtataaaattaccgacagcgaggataaggcccttatgaacggaagcgagagtaggtttttcgtttcctcaagccaaggaagatcagagctccacatcgagaacctcaacatggaagcagatcctggccagtacaggtgtaatgggacatcatccaagggtagcgatcaagccattataaccctgcgggttcggtcccatctggccgctctttggcctttcctgggaattgtggctgaggttttggttctcgtaaccatcatcttcatctacgagaaacgcagaaagcctgaagacgttctggacgacgatgatgcaggatctgctcccctgaaaagttctggccaacaccagaacgataaaggtaagaacgttagacagcggaatagcagttag

SEQ ID NO: 109431 - DNA, 531 bp, Artificial Sequence
  Description of Artificial Sequence: Synthetic coding sequence
atgggaacagcaaatatccaattgcacgggccacccagggtgaaggccgtgaaatcaagcgaacacatcaacgaaggggagacagccatgctcgtctgcaagagtgaatcggtcccccccgtcaccgactgggcatggtataaaatcaccgatagcgaggataaggccctcatgaacggctccgagtctcggttctttgtgagcagctcgcaggggcggtctgagctgcacatagaaaatctcaacatggaagccgaccccgggcaatacagatgcaatggcacttctagtaaaggcagtgaccaagccataataactctgcgcgttcggtctcacttggccgctttatggcctttccttggaattgtggccgaagtgttagtgctcgtgacaattatcttcatttacgaaaagagacggaagccagaggatgtcctggacgatgacgacgccggaagtgcccctctcaagtcctctgggcagcaccagaacgacaaggggaagaatgtacgacaaaggaactcttcttag

SEQ ID NO: 109432 - DNA, 2985 bp, Artificial Sequence
  Description of Artificial Sequence: Synthetic coding sequence
atgagacgcagacctccctccaggggcggacggggcgctgctagagctagagagacacgccgacagcccaggcatcgtagcggcagacgcatggctgaggctatctcctgcactcttaattgttcttgccaaagcttcaagcctggtaaaatcaaccatcggcaatgcgatcagtgcaaacacggatgggtggcgcatgccctcagcaagctcaggatcccaccaatgtacccaactagtcaggtggagatcgttcagtctaacgtcgtctttgacataagcagcctaatgctgtacggaacacaggccattcccgtgcggcttaaaattctgctggatcggctgttcagcgtgcttaaacaggacgaggtgctccagattctgcatgcacttgactggaccctgcaggactacatccgtggctatgtgctgcaggatgcatctggcaaggtgctggatcattggtctataatgacttcagaggaagaagttgccacgctgcagcagtttctcagattcggggaaacgaagtccattgtggaactgatggccatccaggagaaagaagaacagtcaattattataccaccctcaaccgccaacgtggacattcgagcttttatcgaaagctgttcacataggagtagctcactgccaacccctgtggacaagggaaacccaagcagcattcacccttttgagaatcttattagtaatatgacgtttatgctgccgtttcaatttttcaaccctctcccaccagccctcatcggctccctcccagaacaatacatgcttgaacagggacacgaccagagtcaggaccccaaacaggaagtccatggccctttcccagacagttcgtttctgacgagcagcagcaccccattccaggtagaaaaggaccagtgcctgaattgccctgacgcgatcaccaaaaaagaggattccacgcacctgagcgacagctccagctataacatcgttacaaagttcgagaggacacaacttagcccagaggccaaagtgaagccagaaaggaattctctgggcactaagaagggcagggtgttctgcactgcctgtgaaaaaacgttttatgataagggtacccttaagatccattataacgcagtgcaccttaagatcaagcataagtgtaccattgaaggatgcaacatggtcttctcaagcctccggagccggaaccggcatagcgctaaccctaacccacgcttgcatatgcccatgaatagaaacaatagggacaaggatttgagaaattccctcaacctggcaagtagtgaaaactacaaatgtcccggctttacggttacgagcccagattgccgccctccaccgtcttatccagggtccggtgaggacagcaagggacagcctgcctttccaaatatcggccaaaacggcgtgctgtttcctaatctcaagacagtgcaacccgttctgcctttttatagaagtcctgccactcccgccgaagtggcaaacacccctggcattctcccaagtctgcctctgctcagttctagcatccctgagcagttgatttccaatgagatgccatttgacgcactcccaaagaaaaaatcccggaagagctcgatgcctattaaaattgagaaggaggctgtggagatagccaatgagaaacgtcataacctgtcctctgacgaagatatgcctctccaagtagtgtctgaggatgaacaggaggcctgttcaccccagagccatagggtgtccgaggaacagcatgtgcagagcggtggtttggggaaaccttttcccgaaggggagcggccttgccatagggagtcagtgatcgaatcgagtggggccatttctcagacgcccgagcaggcaactcacaattctgagagagaaaccgaacaaactccagccctcataatggtgcctcgagaggtcgaggatggaggtcacgagcattacttcacaccgggtatggaaccacaggtccccttctcggattatatggagctccagcagaggctccttgctggtggacttttttccgccctgtcaaatagaggtatggcttttccatgcctcgaagacagtaaggagctggaacatgtgggacagcatgcgctggcacgacagatcgaggagaaccggttccaatgcgatatttgcaaaaaaactttcaaaaacgcatgcagcgtgaagattcaccataaaaacatgcacgtcaaggaaatgcatacctgcactgtagaaggctgcaacgcgacgttccccagtaggagaagccgcgaccgacactcctcaaatctcaacttacaccaaaaagcactgagtcaagaggctctggagagctctgaggaccacttccgcgccgcatacttgctcaaagacgtggccaaggaagcttaccaggatgtggcgttcactcagcaggcctcccagacctctgtgattttcaagggaacctctaggatgggtagtctcgtgtatcctatcacgcaagttcatagcgcatccctggaatcgtataattcagggccgctgtctgagggcactatcctggatctgtccacgacttcctcgatgaagtccgaatcttcgagccactccagctgggattctgacggggttagcgaggagggcactgtactgatggaagattcagacggtaactgcgagggatcctcactggtgccaggggaggatgagtaccccatctgcgtactgatggaaaaagccgaccagtctctcgcctctctgcccagtggcctccccatcacttgtcacctctgtcagaagacatactccaacaaggggacttttcgcgcacactacaagaccgtgcatcttaggcaattacacaagtgtaaggtcccgggctgtaacaccatgttcagtagcgtccgcagccgtaaccgtcactcacagaatccaaacctgcataaatcacttgcaagtagcccatctcacctgcaatag

SEQ ID NO: 109433 - DNA, 2964 bp, Artificial Sequence
  Description of Artificial Sequence: Synthetic coding sequence
atgaggtgtcggaacatgtttttttctttcaaagcctcgctgtgtgggtgcggggccgctactgccccatcccttactgcaataagctgtaccctcaattgttcttgtcagagctttaagcctggcaagataaaccacagacaatgtgaccagtgcaagcacggctgggtcgcccatgctctcagcaaactgcggattcctcctatgtatcccacatctcaggtggaaattgtccagtctaatgtggtttttgatataagttccctgatgctttatggcacgcaggcgatccccgtcaggctgaaaatcctgctggatcgcctcttctctgtgctgaagcaggacgaagtgctacagattctacatgccctggactggactctccaggactacatacgggggtacgtgctgcaggacgccagcggcaaggtgctggaccattggtccatcatgaccagtgaggaagaagtggccaccctccagcaattcctgagatttggggagaccaaatccattgttgagttgatggccatacaggaaaaggaggagcagagcataattatccccccaagtactgctaatgtggatatacgtgcttttatagaaagttgctcgcaccgctcatctagcttacctacccccgttgataaaggaaacccgtcttcaatacacccttttgagaacctgattagcaacatgacctttatgctccccttccagtttttcaatcctctcccacctgctctcattggtagtctcccagaacaatatatgctggaacaggggcacgatcagagccaagaccccaaacaagaggtccacgggccctttcctgattcctcctttctgacaagcagctctacgccgtttcaggtcgagaaagatcagtgcttgaactgccctgacgcgatcaccaagaaagaagattccacacatctctccgactccagctcatataacatcgtcacaaaatttgaaagaacccaattgtctcccgaagccaaagtaaaacctgagcggaattcgctcggaactaagaagggcagagtgttttgcacggcctgtgaaaaaaccttttacgataaaggcacgctgaaaattcactacaatgctgtccatctgaagataaaacacaagtgcaccattgagggttgcaatatggtcttctcctcactgcgctctcgtaatagacacagtgcaaacccaaatccacggctccacatgcctatgaatcgcaataatcgtgacaaggatcttaggaattcactgaacctggcttcctccgaaaattacaaatgtccggggtttacggtcacatcaccagactgtcgaccgcctccatcctacccaggttccggcgaagattccaagggtcaaccagccttccccaacattggacaaaacggagtgctcttccccaacctgaagactgtccaacctgtgctccccttttaccggagtcctgccaccccggccgaggttgccaacactcccgggatattgccttctctacccctgttatcaagcagtatccccgagcaactgatcagtaacgagatgccctttgatgccttacccaagaagaagagccggaagtccagtatgccaattaagatcgagaaggaggctgtcgaaatcgccaacgagaagcgccacaacctcagtagcgacgaagatatgccactgcaagtagtgtccgaggacgagcaagaagcctgttctccacagagccacagggtgtctgaggagcagcatgtgcaatctggaggtctgggcaagccattccccgaaggggagcgtccgtgccacagagagagcgtcatcgagagtagcggtgcaatttctcagactcccgagcaggccacacataattcagagcgggagactgaacaaacacccgcccttatcatggtacccagagaagtcgaggatggaggacatgaacattacttcactccagggatggagccccaggtccctttcagcgattacatggaactgcagcagaggctgcttgctggcgggctcttctccgctcttagtaaccggggcatggcctttccttgcctagaggattcaaaggagctcgaacacgtcggtcagcacgcattggctagacagatcgaggagaaccgcttccagtgcgacatctgcaaaaagacgtttaaaaacgcatgtagcgtgaagattcaccataaaaacatgcatgtgaaagaaatgcacacttgcacggtggaagggtgcaatgccacgtttcccagcagaagaagccgggaccggcacagctccaacttgaacctgcaccagaaagccctctcgcaggaggctctagagagttcagaggatcatttccgagccgcatacctcctgaaagacgtagccaaggaagcgtatcaggatgttgcctttacccagcaggcttcgcagaccagcgtgattttcaaaggtaccagccgcatgggctctctggtttaccctatcacacaggtgcactctgcctctctagagtcttataactccgggcctctctccgagggcaccatcctcgatttgtcaaccacaagctctatgaaatcggagtcctcctcacacagctcctgggacagcgacggagtctcagaggaaggtaccgtgcttatggaggattctgacggaaattgcgaaggctcctccttagttccgggcgaagatgagtaccctatatgtgtcttgatggaaaaggccgaccagtcccttgcttccctgcctagcggactccctattacctgtcacctgtgtcagaagacctattcaaacaagggcaccttccgagctcactacaaaaccgtccacctgagacagctgcacaaatgcaaggtgcctgggtgtaatacgatgttttcttcggtaaggtcccggaatagacatagtcagaatcccaacctgcataaaagcttggcgagtagccctagccatttgcaatag

SEQ ID NO: 109434 - DNA, 2712 bp, Artificial Sequence
  Description of Artificial Sequence: Synthetic coding sequence
atggcacacctaggccccacacccccacctcattccctcaattataagagcgaggataggctgtcagaacaggactggcctgcttacttcaaagtaccttgctgtggggtggacacttcccagattgaatcggaagaggctgaggtggacgtgagggaacgagaaactcagcgggacagggagcctaaacgagcccgggacctgaccttgagggattcttgtactgataactccatgcaattcggaactcggactacaacagccgagccaggctttatggggacgtggcagaacgccgatactaacctgctttttcggatgtcccaacaggccatccgttgcaccttggttaattgcacatgtgaatgcttccagccggggaaaataaatcttagaacatgcgatcaatgcaaacacggatgggtggcccatgcactagataagctgtcgacacagcacctgtaccacccaacccaagtggaaatcgtgcagtcaaatgtcgtctttgacatttcctcccttatgctctatggaacccaggcggtgcctgtgaggctgaaaatccttctggatagactgttcagcgtgctaaagcaggaagaggtgctgcacatcttgcatggattgggttggaccttacgggactatgtgcgcggttacatcctgcaggacgccgcaggtaaagtactagataggtgggccatcatgtctcgggaagaggaaattataactctgcaacagttcctacgcttcggggagacaaaatccatcgtcgagttaatggctatccaggagaaagaaggccaggcagtggcagtcccttctagtaagaccgactctgacattaggacttttattgaaagtaataataggactcgatcccctagcctgttagcacatttagaaaactccaatccaagctctatacaccattttgaaaatataccaaacagcctggcctttctgctaccatttcagtacatcaaccccgtctctgctcccctactgggactccccccgaatggcctcctactcgagcaacccggcttgagactgagagaaccatcactctccacacagaatgagtataacgagagcagcgaatccgaagtttcacctacaccttataagaacgaccagacgccaaatcggaacgccctaacaagtattacaaacgttgagcctaaaactgagcctgcttgcgtttcccctattcagaacagcgccccggtctccgatttaacgaagactgagcaccctaagtcttcgttcagaatccacagaatgcgtaggatggggtccgcgagtcgaaagggccgggtgttctgcaatgcatgtggaaagaccttctatgacaagggtaccttaaagattcattataacgcggttcatttgaaaatcaagcataggtgtaccatagaaggatgcaatatggtttttagcagccttcggtctcgaaacaggcattccgccaatcccaaccccagactccacatgccgatgctgcgcaataatagagataaagatttaattagagctactagtggcgcggctacaccagtgatcgctagtacaaagtccaatctggcgttgacaagcccaggaaggcctcctatgggatttacaacaccacccctagatcctgtcctgcagaacccattgcctagtcagctagttttttctggactaaagaccgttcagccagtgcctcccttttaccgatctctgcttactcccggcgaaatggtgtctcctcccactagtctgcccacaagtccaataatcccgacttccgggacaattgaacaacaccctcctcctccttctgagcctgtggttcctgccgtcatgatggcaacacatgagccttcagccgatctggccccaaagaagaaaccacgcaagtcctctatgcctgtgaagattgagaaggaaattatcgacacagctgacgaatttgacgacgaggacgatgaccctaatgacggcggcgctgtagtcaacgacatgagccacgataaccattgtcatagccaggaggagatgagcccaggtatgtccgtaaaagacttctccaaacataatcggacacgctgtatctcacgcactgagatcagaagagcagacagtatgaccagtgaggaccaggagcccgaacgtgattatgagaacgagtccgagagctctgaaccaaagctgggagaagagagcatggagggagacgagcatattcactccgaggtaagtgaaaaggttctgatgaacagcgagcgacccgacgaaaaccatagtgaaccaagccaccaggatgttattaaggtgaaggaggaattcacagacccgacatacgatatgttctatatgtcccagtacggcctgtacaatgggggcggagcctccatggctgctctccacgagtcttttacctcctcgctcaattatggctcaccccagaaattttcgcctgagggtgatttgtgctcttcaccagaccccaagatctgctatgtatgcaagaaatccttcaaatcatcctatagcgttaaactacactatcgcaatgtccatctcaaggagatgcacgtgtgcactgtggctggctgcaatgccgcatttccatccagacggtcgagagatcgctactgggaaaaaagcaatgaacaaaatggcctgctggtcagctggggggagaccttgtctagcctgaagtag

SEQ ID NO: 109435 - DNA, 3099 bp, Artificial Sequence
  Description of Artificial Sequence: Synthetic coding sequence
atggcccacctgggccccacccctcccccccatagtctgaactacaaatcagaggacaggcttagtgagcaagactggccagcctattttaaagttccttgctgtggtgtcgacacatctcaaattgaggccatacggtgtaccctagtgaattgcacttgtgaatgctttcagccgggcaagattaacctacgcacatgtgaccagtgtaagcacggttgggtggcacatgcattggacaaactgagcactcaacatctgtaccaccccacccaggtggaaatagtgcaatcaaacgttgtttttgatatttcttctttaatgctgtatggcacccaggcagttcctgtgaggctgaaaatcttgctggaccggctcttttccgtgttgaaacaggaagaggtccttcatatcctccatgggttgggttggactctgagggactatgttagggggtacattctgcaggatgctgctggtaaagtcctggaccgatgggccataatgtcaagagaagaagaaatcatcactctccagcagtttctgcggttcggcgagaccaagagcattgtggagctgatggcaatccaggagaaggagggccaggcggtggctgttccaagctccaaaaccgattcagatattcggacatttatcgagtctaacaataggaccagatcacctagcctacttgctcacctggagaattcaaatccttcgagtattcaccacttcgagaacatacccaattccttggcattccttctgcctttccagtacataaacccagtaagtgcaccccttctaggattgccaccaaatggacttttactggagcagcccgggttgagactgagagagcctagtttgtctacccagaacgaatataatgagtcctctgagagcgaggtatctcccacaccttacaaaaatgaccagacccccaacaggaacgcgctgacctccatcactaacgtagagcctaaaacggagcccgcgtgcgttagtccaatacaaaattccgcccccgtgtcagatcttacaaagacagagcaccccaagtcctcttttcgcatacatcgtatgcgcaggatgggatctgcatccaggaaaggtcgcgtcttctgcaatgcctgcggaaagactttctatgacaagggtactttaaagattcactacaatgcagtgcacctcaagatcaagcaccgatgtacaatcgagggctgcaatatggtatttagctcactcaggtctaggaacagacatagcgcgaatccgaatccacggttacatatgcccatgctccggaacaacagggataaggacctcattagggctactagcggagctgctacacccgttattgccagcacaaagtctaacttggctctgacatccccaggacgcccccccatgggtttcacaaccccgcccctggatcctgtcctgcagaaccccctgcctagtcaactcgtgttcagcggccttaagaccgtccagcccgtgccccccttttatcggagcctattgacccctggtgaaatggtgtcaccccccacctccttgccgacatcaccgatcattccaacatcagggacaatcgaacaacatccacctccaccttctgagccagtggtcccggcagtgatgatggcgacccacgagcctagcgctgatttagctcctaagaaaaaaccccgcaaatcctccatgcccgtcaaaatcgagaaggaaattatagacaccgccgatgagttcgacgatgaggatgacgaccccaacgatggtggcgcggttgtgaacgatatgtctcatgataatcactgtcactcacaggaagaaatgtcacctggtatgagtgtaaaagactttagcaagcataatcgaacacggtgtattagcaggacagagatcagaagagcagattctatgaccagtgaggatcaggagcccgagagagactacgagaatgaaagcgagagttccgaacccaagctcggtgaggagtcgatggagggcgacgaacacatccacagtgaggtttctgagaaagtgctgatgaactcagaaagaccagatgagaatcactccgaaccaagccaccaggatgtcatcaaggtcaaagaagaatttacagaccccacttacgacatgttctatatgagccagtacgggctgtataatggaggcggcgcaagcatggccgctttacatgaatccttcacctcttcgctgaactacggcagcccacaaaaatttagtccagagggggatttgtgttcctctccagatcctaaaatctgctacgtgtgtaagaaaagcttcaaatctagctattccgttaagcttcattatcggaatgtacacctcaaggaaatgcatgtatgcacggtggccggctgcaatgcagcctttccttctaggcgctcacgcgatcggcattcggcaaacataaatttgcataggaaactcttaactaaggaattggatgacatgggcctggatagcagccagccttcattgtccaaagatctcagggatgaatttctggtgaagatctacggcgcccagcaccccatgggcctggacgtacgagaggacgcatcctcaccagccggtacagaggactctcacctgaacgggtatggtcgggggatggctgaagactacatggtactcgatctttcaactacctcctctctacagtcatcatctagtattcacagttctagggaatccgatgctggaagcgacgagggaattctgctggatgatatcgacggtgcctccgacagtggagaatccgcacacaaggctgaggcaccagccctacctgggtctctgggggcagaagttagtggctccctaatgttctctagcttgagtggatctaacggcggcattatgtgtaatatctgtcataagatgtatagcaataaaggcacactgagagttcactacaagactgtacacctccgagaaatgcataaatgcaaggtgcctgggtgtaacatgatgtttagcagtgtgagatctagaaatcgccattctcaaaaccctaacctacataagaacattccattcacttctgtcgattag

SEQ ID NO: 109436 - DNA, 3300 bp, Artificial Sequence
  Description of Artificial Sequence: Synthetic coding sequence
atggctcacctcggccccacccccccacctcattccctgaattataaaagtgaggataggctgtctgagcaggactggccagcctatttcaaagtcccttgctgcggggtggacacctctcagatcgaaagtgaggaggccgaagtggacgttcgcgaaagggagacacagcgggacagagagccaaagcgcgcacgagatctgactcttagagacagctgtacggacaactcaatgcagttcggcacaagaacaaccactgcagaaccagggttcatggggacatggcagaatgcagatacaaacctgctctttcggatgtcgcagcaggcaattcgctgtacactggtcaattgtacgtgcgaatgtttccagcctggtaaaatcaatttgcggacctgcgatcagtgcaaacacgggtgggtggcacacgctctcgacaaattgtccactcagcacctctatcaccctactcaggtagagattgtgcaatccaacgtcgtatttgacatcagttcgctcatgctctacggaacacaggctgttcctgttcgactcaagattctgcttgacagactgttcagtgttcttaaacaggaggaagtactccacatcttacacggcctgggctggaccctgagggactacgtaagaggatacatcctgcaggatgccgccggcaaagtgctggacaggtgggcaattatgtctagggaagaggagattatcaccctccagcaatttctccggttcggcgagacgaaatcaatagttgaactcatggctattcaggaaaaggagggccaggccgtggctgtgccttcttccaagactgactccgacattcggacttttatagaatcaaataataggacgcgcagccccagcttactagcccacctcgaaaattccaacccgagctccattcatcatttcgaaaacatccctaactccttggccttcctgctgccatttcaatatattaatccagtctctgcaccattactgggtctcccccccaacggtctccttctggaacagccagggctgaggctgagagaacctagtttgagcacccagaacgagtataacgaaagctccgaaagcgaggtctctccgaccccctacaaaaacgatcaaactcccaatagaaacgctctaaccagtataactaacgtagagcccaaaacggagccggcctgcgtcagcccaattcagaattctgctcccgtgtctgacctgacaaagacagagcaccccaaatcctctttcagaatacacagaatgagaagaatgggctctgccagcagaaagggtagagtattttgcaatgcctgtggtaaaaccttttacgataagggaactctgaaaatccattacaatgctgttcacctgaaaatcaagcataggtgcactatcgaaggatgcaacatggtgttctccagtttacgttcgcgtaatcgacactcggccaacccaaaccctaggttgcacatgcccatgcttagaaataacagggacaaagatcttatccgtgctacaagtggcgctgccacccccgtgatcgcttctacaaaatcaaatctggccctgacgagcccagggcgccctcctatggggtttacaacgcctccattggatcctgtgctgcagaacccactacccagccaacttgtcttctccggcttaaagaccgtgcagccagtaccccctttttatcggtcactgcttacacccggagaaatggtgtccccaccaacgtctcttccaacatcaccaataatcccgacatcagggaccattgagcaacaccctccacctcccagcgagccagtggtaccggcagtgatgatggctactcacgagcctagcgccgacctggcacccaagaagaaaccacgcaagtcatctatgccagtgaaaattgaaaaagaaattattgataccgccgatgagttcgatgatgaggatgatgaccctaacgatgggggcgcggtcgtgaacgacatgagtcatgataatcattgtcattcgcaggaggagatgtctcccggcatgtctgtgaaggacttttctaaacacaaccgaaccagatgtattagcagaacggaaattcggagagctgacagtatgactagtgaagatcaggaaccagaacgagactatgagaatgaaagtgaaagtagtgagccgaaattaggcgaggagagtatggaaggggacgagcatattcactccgaagtttcagagaaggtactaatgaactcagaaaggcccgatgagaaccacagcgagccaagccaccaagatgtaatcaaagtgaaagaggagtttactgatcccacctacgacatgttctatatgtcgcagtatgggctgtacaatggaggaggcgcctccatggccgcactccacgagtcattcacatcttcactcaactacgggtcgccgcagaagttctctccagagggagatctctgttcctcccccgaccccaagatttgctacgtgtgcaaaaagagtttcaaaagttcctattcggtaaaattacactacagaaacgtccacttgaaggaaatgcacgtttgtactgtcgccggttgcaatgccgcatttccatctagacgcagcagggatagacactcagcgaacatcaatctccacaggaagctccttaccaaggagttggacgatatgggcctcgacagctctcagccttcgctctctaaggacctccgggacgagtttttggtgaaaatatacggggcgcagcaccccatgggcctggatgtgagggaagatgctagctccccagccggcactgaagactcccatctgaacggctatgggcgggggatggccgaggactatatggtgctggacctgagcactacatccagcttgcagtcatcaagtagcatacactcctcaagggagtccgacgctggcagcgatgaaggtatactactggacgatatcgatggcgctagtgattcaggagagagtgcccataaagccgaagcacccgcactcccgggtagcttaggtgccgaggtgagcgggagtctgatgttctcatcactttctggtagcaacggcggcataatgtgcaacatctgccataaaatgtatagcaacaaggggacgctgcgggtccactataaaaccgtgcatctccgggagatgcacaagtgtaaggtaccagggtgcaatatgatgttttcaagcgttcgatcacgaaaccgccattcacagaaccccaacctgcacaagaatatcccatttacatcagtcgactag

SEQ ID NO: 109437 - DNA, 984 bp, Artificial Sequence
  Description of Artificial Sequence: Synthetic coding sequence
ccatcagaacccgtggtgcctgccgtgatgatggccacccacgagccttccgcagacctggctcccaaaaagaaaccccgaaaatcaagcatgcccgtgaaaattgagaaggagatcatagataccgctgacgaattcgacgacgaggatgatgaccccaatgacggaggagccgtcgttaacgatatgtcgcacgacaatcactgccacagccaggaggaaatgagccctggtatgtcagttaaggatttttctaaacacaaccgaacaagatgcatttcccgcaccgaaatccgccgggctgactctatgacctccgaggatcaagagcctgagcgagactatgagaacgagtccgaaagtagtgaaccaaaattaggagaagagtctatggaaggggacgaacatatacattcagaagtgtcagaaaaagtcctcatgaatagcgagcgacccgacgagaaccactccgagcccagccaccaggacgtgatcaaagtgaaagaggaatttactgatcccacgtatgatatgttctacatgtcccagtatggcctttataacggggggggcgcttctatggccgcactccacgaatctttcacaagtagcctgaattacgggagtccacagaagttctctccagagggtgacctgtgttcatctccggaccctaaaatttgctatgtctgtaagaaaagcttcaagagcagttattcggtaaaactgcattaccgcaatgtgcacctgaaggaaatgcacgtgtgcactgttgctggctgtaatgccgcgtttccttcaagacggagcagggaccgtaatagaaacctgagaatggaaagaacaatcggtcccggacacagagatagtttgcacctgcggaggggtaattctaaccgcccaggcacatgttgtttgcataccggggacagcctcgaggaaagcgtcattgtccgcattagttgtaagcggctcgagagctag

SEQ ID NO: 109438 - DNA, 2583 bp, Artificial Sequence
  Description of Artificial Sequence: Synthetic coding sequence
tcggaggaggccgaggtagacgttagagagcgggaaactcagcgagatcgggaaccgaaaagagccagagatctgaccctgcgcgacagctgtaccgacaactctatgcaatttggaacaaggacaaccactgccgaaccagggttcatgggaacgtggcagaacgcagacactaaccttttgtttagaatgtcccagcaggccatcaggtgcacacttgtgaactgtacctgcgaatgtttccagccaggcaagattaacctgcgtacttgtgatcagtgcaagcatggttgggtggcccacgccctggacaagctgagcacacagcacctgtatcaccccactcaggtggaaatcgtgcagagcaacgttgtatttgatataagtagcttaatgctttatggcacacaggcggtaccagtgaggctgaagattctcctcgatcggttattctccgtactgaaacaggaagaagtgctgcacatcctgcatggtttgggttggaccctgcgggattatgtgcgcggatatattctccaagatgccgccggcaaggtgcttgatcgctgggccataatgtctcgggaggaagagatcattacactgcagcagttcttgcgctttggcgagactaagtccatagtcgagttgatggccatccaggagaaagagggtcaggccgtggctgttccttcaagcaagactgacagtgatatcaggacatttatcgagagcaacaacaggactcgcagcccttccctactcgcccacctggagaacagcaaccccagcagtatccaccactttgaaaatatcccaaattcgcttgcctttttactgccttttcaatacatcaaccctgtgagtgcaccactcctcggcttgcctccaaatggtctgctgcttgaacagccaggtctgagactcagggagccgtccctgtcgacacagaacgaatacaacgaatcaagtgagtccgaagtttcccctactccatataaaaacgaccaaacgcccaatagaaatgcgttaacttcaatcaccaatgtggaacctaagaccgaacccgcatgtgtgtctccaatccagaattccgcaccagtcagtgacctgacaaaaaccgagcatcccaaatccagctttcgaatccacaggatgcgcagaatggggtcagcctcgcgaaaaggccgggttttctgcaatgcttgcggaaagactttttacgacaaaggcacactaaagattcactataacgccgtacacttgaaaatcaaacaccggtgcacaattgaggggtgcaatatggtattttcatctctgcgtagcaggaataggcacagcgccaacccaaatccacgactgcatatgcccatgctacggaacaaccgcgataaggacctgattcgagcaaccagtggagcagcgactcctgtgattgcaagtactaagagcaaccttgccctgactagccccggacgaccaccaatgggcttcacaacccctccactggacccagtgctgcaaaaccccctacccagtcagctggtctttagcggacttaaaacagtccaaccagtgccccccttctacaggagtctgctcacacctggcgaaatggtgagtcctcctacgtccctgccgacaagccccataatacccacttccggaaccattgagcagcacccacccccacctagtgagcccgtggtgcctgcagttatgatggccacgcatgaacccagcgcagacctcgcccctaagaaaaagcctcgcaagtccagcatgccagtgaagattgagaaagaaatcatcgataccgcagatgagtttgatgatgaagatgacgatcccaacgatggcggtgccgtggtcaacgatatgtctcatgacaaccattgccacagtcaggaagagatgagccccgggatgtctgtgaaagactttagcaagcataatagaaccagatgcattagtcggacagagattcgtcgagctgatagcatgacctcggaggatcaggagcccgaacgggactatgaaaacgagtcagaaagtagtgaacctaagctgggtgaggagtctatggagggcgatgagcacattcactctgaagtctccgaaaaggtgctcatgaactccgagcgcccggatgaaaatcacagcgagccgtcgcaccaagacgtcatcaaagtgaaggaagagttcaccgatccaacatacgacatgttctacatgtctcaatatggtttgtataatggaggaggggcctcaatggccgcactacatgagagctttacatcctccctgaactacgggagcccacagaagttctcgcccgagggagacctgtgcagcagcccggacccaaagatttgttatgtgtgtaagaagtcatttaagtctagttacagcgtcaaactgcactaccggaatgtccacctgaaagaaatgcatgtctgcactgtggccggatgcaatgctgctttcccgagcagaaggagccgggaccgtaatagaaatctgaggatggaaagaactatcgggccaggccacagggactcactgcatctcctgccaacctag

SEQ ID NO: 109439 - DNA, 1206 bp, Artificial Sequence
  Description of Artificial Sequence: Synthetic coding sequence
atggcacatttgggacctaccccacccccacactcgctgaattacaaaagcgaggatcgcctttcagagcaggattggcccgcatactttaaagtcccctgttgcggagttgataccagccagattgaatcagaggaagccgaggtagatgtacgggaaagagaaacccaaagagatagggagcccaagagagcacgagacctcaccctgagagactcctgtactgacaatagcatgcagttcggaacaagaacaaccactgcagagccaggattcatgggcacctggcaaaacgccgacacgaacctcttattccgcatgtcacagcaggtaccactcgcctgcaccggtagggtgctgggggcggatttctgccctaatctcgaggaaccataccataggttggaggtccaggcaatccgctgcacactagtgaattgcacttgtgaatgtttccaaccggggaagatcaacctgcgaacttgtgatcagtgtaagcatggctgggttgctcatgctctggacaaacttagcacacagcacctgtatcacccaacgcaggtggagatcgtgcagagcaatgttgtgtttgatatatcctcgctgatgctgtacggaacccaagctgtccccgtgagacttaagattctgcttgatagacttttttccgtactcaagcaggaagaagtactgcacattctgcatggcctgggttggacattgcgcgactatgtccgcggctacatcttacaggacgccgccggtaaagtgcttgaccgttgggccatcatgagcagagaggaagagatcattaccctgcagcagttcttacgctttggggagactaaaagtatcgttgagctcatggctattcaggagaaggaggggcaggcagttgctgttccttcctcgaagacagactccgatattaggacttttatagaaagcaataacagaaccagatcaccaagtctcctcgctcatttagagaactcaaacccgtcctccattcaccactttgaaaatattcctaactccctggctttcctcctgccattccaatacatcaacccagttagtgcaccgctcctcgggctgccacctaatggacttctcctcgagcagccgggactgcgtctgcgcgagccatcactctccacccagaatgagtataacgaatcctccgaatctgaggtgtcaccttag

SEQ ID NO: 109440 - DNA, 306 bp, Artificial Sequence
  Description of Artificial Sequence: Synthetic coding sequence
atgtgtagacttcttgttcctctggcctgcaccggccgagtgctcggcgccgacttctgtccgaatcttgaagagccatatcatagattagaggtccaggctatcagatgtacactagtcaattgtacctgtgagtgtttccagcccggaaagatcaatctgaggacttgtgatcagtgcaagcacggctgggtcgcccacgcgttagataagctgtctacccagcacctttatcatcccacacaggtagagatcgtacagagtaatgtcgtttttgacatcagttcgctgatgttgtacggctag

SEQ ID NO: 109441 - DNA, 1233 bp, Artificial Sequence
  Description of Artificial Sequence: Synthetic coding sequence
atggctcatctcgggcctaccccacctccacactctctcaattataagtccgaagatagactatcagaacaggattggcctgcttactttaaggtcccatgctgtggggtggacaccagccagatcgaatcggaagaggctgaggtggacgtgagagagcgtgaaacgcagcgggatcgagaaccgaaaagagcacgagacctgacactgcgtgatagctgcactgacaatagtatgcagtttggcacacggacgaccacagcagaaccgggcttcatgggcacttggcaaaatgctgacaccaacctcttgtttcggatgagccagcaggccggcttgaagctcctaacaagtggagacccacctgtgctggatttccagtccgccggcattactggcgtgtctcactgcacacgcctgaaagtggcaatgatatccaaggcgatccgttgcacccttgtaaactgcacatgtgagtgcttccaacccggaaagattaacctacgtacttgtgaccagtgtaaacacggctgggttgcccatgctctcgataagttgagcacgcagcacttgtaccatccaacccaggtcgaaatcgtgcaaagcaacgtggtctttgatattagctcccttatgctgtacggaactcaggcggtgccagtccggctgaaaattctgctcgaccgcctatttagcgttctgaagcaggaggaggtcttacatattctacatggtctggggtggaccctaagggactacgtcaggggttatattctgcaagacgcagcgggcaaagttctggaccgctgggccattatgtcacgcgaagaagagataataaccctgcaacagtttctgagattcggagaaaccaaatctatcgttgagctgatggccattcaggaaaaggagggacaggctgtggctgtaccctcttccaagactgacagcgacattcggactttcatcgagtcaaataaccgcacaagatccccctctctactcgctcacttggagaacagtaatcccagcagcattcaccatttcgagaacatacctaactccctggcatttctcctacccttccagtacattaatcctgtctccgccccactgctgggcctccctcccaatggactgctcttagagcaacccgggctgaggctacgtgaaccctccctgtctacccagaatgagtacaacgaaagcagtgagagcgaggtatcaccatag

SEQ ID NO: 109442 - DNA, 2712 bp, Artificial Sequence
  Description of Artificial Sequence: Synthetic coding sequence
atggcccatctcggccccacccctccccctcattctctgaactacaaatccgaagaccgtctatcagagcaggattggcctgcctactttaaggtgccatgctgcggagttgatacctctcaaatagagtccgaggaagcagaagtggacgtgcgcgagcgcgaaacacaaagggaccgcgagcccaagcgggctcgcgacttaacccttcgcgatagctgcacggacaattccatgcaattcggcaccaggaccaccaccgctgagcctggatttatgggaacttggcagaacgcggacaccaatctactctttcgtatgtctcagcaggctattaggtgcacgctggtgaactgcacttgcgagtgttttcaacccgggaagattaacttgagaacttgtgatcaatgtaagcacgggtgggtggctcatgccctcgataagttgtcaacacagcacctttaccatcctacccaagtggaaatcgtgcagtcaaatgtggttttcgatatctcttcactgatgctctatgggacacaggcagtccccgtgagactgaagattttgttagacaggctgttctctgtactcaaacaggaggaagtacttcatatattgcacgggctcgggtggactctgcgggattatgtgcgcggctacattctgcaggacgcggccggcaaggtcctggatcgctgggccatcatgagtcgtgaggaagagatcattacccttcagcagtttttgaggttcggcgagactaagagcattgtcgagcttatggccattcaggagaaagaggggcaggctgtggctgttccaagcagcaaaaccgatagtgacatcaggacgtttatagagtccaataataggacacgaagcccaagtctattggctcatctcgaaaacagtaatccctctagtattcaccatttcgagaacattccgaacagcctcgcttttctgctgcctttccagtacattaatcctgtgtcagcccccctcctcggtttgccccctaatggcctgctactggagcagccaggactgcgcctgagggaacccagtttatcaacccagaatgagtataacgaatcatctgagagtgaggtgagtccaactccctacaagaatgatcagactcctaataggaacgctctgaccagcatcactaatgttgagccaaagactgagccagcatgcgtcagtccaatccagaacagcgcccctgtgagcgatctcacaaagaccgaacaccctaaatcgtcattccgcatccacagaatgagacgcatggggagcgcgtcccgcaagggacgagtattctgtaacgcatgtggaaagaccttttatgacaaggggacccttaaaattcactacaacgcggttcacctgaaaatcaagcaccgctgcactattgaggggtgcaacatggtgttttcttcactcaggtcaaggaatagacacagtgctaatcctaaccccagattacatatgcctatgctgcgtaacaaccgcgacaaggacctgattcgagctacgagtggtgcggctactccagtgattgcatcaactaagtctaacctcgctctcaccagtccaggcaggccaccaatggggttcaccacccctcccctggatcccgttctgcaaaacccacttccttcccagctggtttttagtggtttgaaaacagttcagcctgtcccacccttttataggtccttactgactcccggcgaaatggtttcccccccaacaagtctcccgaccagccccatcatccctacttccgggaccattgaacaacacccccctcctccctccgaacctgtggtcccagcagtcatgatggctacacatgagccttcagcagacctcgcccccaagaagaagccgcggaaaagttcgatgcctgtgaagatcgagaaagagatcattgacacagccgacgaattcgatgatgaagatgacgaccctaatgacggaggcgccgtggtgaacgatatgagtcatgacaaccactgtcattcacaggaggaaatgtcccctggcatgagcgttaaagacttctctaagcacaataggacccgttgtatctctcggaccgagatcagaagggctgactccatgacatcggaggatcaggagcccgagcgcgattacgaaaatgaaagtgagtcttcagagcccaagctgggcgaagagtcaatggaaggtgatgaacatatccacagcgaagtcagcgagaaagtcttgatgaacagtgaacgaccagacgagaatcactcagaaccctcccaccaagatgtcataaaggttaaagaggagttcaccgacccaacatacgacatgttttacatgtcacagtacggactgtataatggaggaggagctagtatggcagctctgcacgagtcgtttacatcctccctgaattacggaagtccacaaaaattttcaccagagggagacttatgttcatcgccggaccctaagatttgctacgtttgtaagaagagcttcaagtcatcctacagcgtcaagctgcattaccgaaatgtccacctcaaggagatgcacgtgtgcaccgtcgctggatgcaatgccgcctttcctagtaggaggagcagggaccggtactgggagaaaagtaatgaacagaacggccttcttgtgagctggggtgaaaccctgagctccctcaaatag

SEQ ID NO: 109443 - DNA, 2712 bp, Artificial Sequence
  Description of Artificial Sequence: Synthetic coding sequence
atggcccatctgggacccactccccccccacactctctgaactacaagagtgaggatcgccttagcgagcaggactggcccgcttacttcaaggtcccctgctgcggtgtggatacctcgcaaattgagagtgaggaggccgaagtagacgtaagagaacgagagactcagcgcgatagagaaccgaagcgtgccagggatctcaccttaagggatagttgcactgacaatagtatgcaattcggaactcgaaccacaactgccgaaccggggttcatggggacatggcagaacgcggacaccaaccttctgttcaggatgagccaacaggccatccgatgtaccctcgtgaattgcacttgtgagtgctttcagcctgggaagataaatctcaggacctgcgaccaatgtaagcatggttgggtggcccacgcgctggataaactctcaacacagcacctctaccacccaactcaggtcgagatcgtgcagtccaacgtcgtatttgatattagctccttgatgctgtacgggactcaggctgtgcccgtacggttgaagatattactggatcggctgttcagcgtccttaaacaggaggaggtgctgcacatcctgcatggcctgggctggactttaagggactatgtccgggggtacattctgcaggacgccgccggaaaggtcctggacagatgggcaataatgagtcgcgaggaagaaattataacactgcagcaatttctgcgtttcggggagacaaaaagtattgtggagctcatggcaatccaggagaaagaaggacaggccgttgctgtcccctcgtcaaaaacagacagcgatataagaaccttcatcgagtctaataaccggactcgctcgccaagtctcctggcacacctggaaaattcgaacccgtccagcatccaccacttcgaaaacatcccgaattccctcgccttcctgctcccctttcaatacatcaatcctgttagcgccccgctcttaggcctgccacccaacgggcttctactggaacagccgggactgaggctgcgagagcctagccttagtacccaaaacgagtataacgagtcatccgagtcagaggtctccccaactccttataaaaatgaccagacacctaaccgcaacgctctcaccagcattaccaacgtggagcccaaaacagagcctgcttgtgtgtcccccatccagaactcggctccagttagtgatctgaccaagacagaacaccctaagagttccttccggatccaccggatgcgtcggatggggtcagcctcaaggaaggggagggtgttctgtaatgcctgtgggaaaaccttttacgacaaaggaacattgaagatacactacaatgcagtgcacttgaaaataaagcatcggtgtaccatcgaagggtgcaatatggttttctccagtctaagatcaagaaaccgacactccgcaaacccaaatccccgcctgcacatgcctatgctgcgcaacaacagggataaggatttgatccgcgccacctctggcgctgccacaccagtgatagctagcacaaagtctaatctcgcactgacctcgccaggcagacctccaatgggctttaccactcccccacttgatccggttcttcagaatcccctgccgagccagctggtttttagcggactcaaaaccgtgcagccagtgcctcccttttatcggtccctgctcactcccggggagatggtgagcccacccacgagcttgccgacctctcctattatccccacctctggcaccatcgaacagcaccctccccctccctccgaaccagttgtgccagctgtcatgatggccacccacgagccttctgccgatctggcacctaaaaaaaagccacgcaagagctccatgcctgtgaaaatcgaaaaagaaatcattgataccgcagatgagtttgatgatgaggatgacgatcccaatgatggcggcgctgtggttaatgacatgagtcatgacaaccactgccactcacaggaggaaatgagtcctggcatgtccgtgaaagactttagcaagcacaatcgtaccagatgtatctcccgcactgagattagacgcgcagattccatgacgagcgaagaccaggagcctgagagagactacgaaaatgaaagcgagtcctcggaaccaaagctaggagaagagtctatggaaggagacgagcacatccacagtgaagtgtccgaaaaagttctaatgaacagcgagcgacccgatgaaaatcatagcgagcctagccatcaggacgttatcaaggttaaagaggaattcaccgaccccacctacgatatgttctacatgtctcagtatggcctgtacaacgggggcggtgcctctatggcagcacttcacgaatcctttacaagctcactgaactacggtagtcctcaaaagtttagcccagagggcgacctatgcagcagtcccgacccaaaaatctgttatgtgtgcaagaaatcattcaaatcatcttactccgtcaaactccactatcggaatgtacatttgaaagaaatgcacgtgtgcaccgtggccggatgtaatgccgcatttccctcacgacgaagccgggacaggaaccgaaatctgcggatggagcggactataggcccggggcatagggattctttacacctgcgaagcacctag

SEQ ID NO: 109444 - DNA, 1950 bp, Artificial Sequence
  Description of Artificial Sequence: Synthetic coding sequence
atgctctacggcactcaggccgtcccagttcgcttaaaaattctccttgacagacttttctctgtcctcaaacaagaggaagtgctgcacatccttcacggcctcggatggactcttagggactacgtccgaggatatattttacaggatgctgccgggaaagtgcttgatcgctgggctattatgagtagagaggaggagatcatcaccctgcagcaattcctacgatttggcgaaaccaagtctatagtggaattaatggccatacaggagaaggagggccaggcggttgccgtgccatccagcaagaccgatagcgacatccgcacatttatagagagcaacaatcgcacccggagccccagcctgctagctcacctcgagaatagcaatcccagcagcatccaccactttgagaatattcctaacagccttgcatttctgcttccctttcagtatattaatcccgtcagtgcccccctcctcggtctcccccccaatggcctgctcctggaacaaccaggtctgaggctccgcgaaccatctctgtccacccagaatgaatataacgagagcagcgaatctgaggtgagccccactccgtacaagaatgaccagacccctaatcgaaacgccctcacaagcatcacaaacgtcgaacccaaaaccgaaccagcctgtgtttcgccgatacaaaactcagcacccgtatccgatttgacaaaaactgagcacccaaaatcatcttttcggattcatcgcatgcgaaggatgggatctgcgtcgaggaaagggagagtattttgtaatgcatgcggtaaaactttttatgataagggcaccctgaagatccactataatgcggtgcacctgaaaataaaacatcggtgtacaatcgaaggatgtaacatggtcttctccagccttagatcacgtaacagacacagcgctaatcccaatccgcggctgcatatgcctatgcttaggaataacagagataaagaccttataagagccacttcgggggcagccactcctgtgatcgctagcacaaaatcgaacttggcccttacctcgcccggccggccccctatgggctttacaacacccccgctcgaccccgtgctgcaaaatccacttccaagtcaactggtgttttccggccttaagactgtgcagcccgtgccgccattttataggtccttgctgacacccggggagatggtcagccctcccacttccctccccacatcccctatcattccaacttccggaacgatcgagcaacatccaccacccccaagtgagcccgtagtccctgcggttatgatggccactcacgaacctagcgccgatctggccccaaaaaagaaaccccgcaagagctcaatgccggttaagatcgagaaggaaatcattgataccgccgacgagttcgatgatgaggatgatgatcccaatgacggaggggcagtcgtcaatgacatgtcacacgataaccattgccactcacaggaggaaatgtctccaggcatgtctgttaaggatttctcaaagcataatagaactcgctgcatttcacgaacagaaatccggcgcgctgattctatgaccagcgaagaccaagagcccgaaagggattatgaaaatgagtctgagtctagcgagcccaaattgggagaggagagcatggagggtgacgaacacatacactctgaagtcagtgagaaggtcctcatgaatagcgaacgcccggacgagaaccactccgaaccaagtcatcaagatgtcatcaaggttaaggaagagttcaccgatcctacctatgacatgttctacatgtcccagtacggcctatataacgggggtggagcatctatggccgctttgcatgagtcatttaccagctctctgaattatggctccccacaagttctacccagaagatag

SEQ ID NO: 109445 - DNA, 3015 bp, Artificial Sequence
  Description of Artificial Sequence: Synthetic coding sequence
atgaccgacgatgtgaaggagccctcaagattctccctgctactcgcgattcgatgcacattagtgaactgcacatgtgagtgtttccagccgggcaagattaatctaaggacatgtgatcagtgcaagcacggctgggtcgctcacgcactcgacaagttgtctacccagcacctgtatcatcccacccaggtcgaaatagtgcagtcaaatgttgtgtttgatatcagtagtcttatgctttatggaacacaggccgtgcccgtgcgtctcaaaatcttgctggataggttgtttagtgttctcaaacaggaagaggtgctccacatactccacgggctgggatggaccctccgcgactatgtcaggggctatatcctgcaggacgccgcaggcaaggtgctcgatcggtgggctattatgagccgcgaagaagaaatcattactctgcagcagtttttaagattcggagaaactaagtctattgtggagctcatggcaattcaggagaaggagggtcaggcggtcgccgtgccctccagcaagaccgattcagatattcggacgtttatcgagagcaataatagaacacggagcccaagcttgctggcgcaccttgagaacagtaacccttcctccattcatcacttcgaaaatattcctaactccctggcctttctgctccccttccagtacataaatccagtgtccgcaccactgcttggccttcccccaaacgggctgctgttagaacaacctggcctgagattgagggaaccgtctctgagcactcagaatgagtataacgagtcatccgaatcagaagtttcacccacgccctacaaaaatgaccagactcccaaccgaaatgcgttgacaagcattaccaacgtcgagcccaaaactgagccagcctgtgttagcccaatccagaattcggcaccagtgagtgacctgacgaaaacagagcacccaaagagcagctttagaatccaccgtatgcggcgaatgggtagtgcctccagaaaaggaagagtgttctgtaatgcctgtgggaaaaccttttatgataagggcaccctgaaaatccattacaacgctgtgcacctgaagataaagcatagatgcacaatcgaaggatgcaatatggtgttttcctcactgcggagccgcaacaggcacagcgccaaccctaacccccggttacacatgcccatgttacgcaacaatcgggataaagaccttatccgagctacctccggcgcagccactccggtaatcgcttctaccaagtcaaatcttgccctgacctcacccgggaggcccccgatgggcttcacaacacccccactggatcccgtactgcagaaccccctgccaagccagctcgtgttttcggggctgaagacggtgcaaccagtgcctccattctaccgcagcctattgacgcccggcgaaatggtatcccctcctacttccctccccacatctcccatcattcccacatcgggaactattgagcagcaccccccaccaccatcagagccggtggtgcccgctgtgatgatggctacccacgagcccagcgccgatctcgcacccaaaaaaaagcccagaaagagctctatgccagtcaagattgagaaggagataattgacacagcggacgaatttgacgatgaagacgacgatcccaacgatggaggagctgtggtaaatgacatgtcccacgataaccattgccattcacaggaggaaatgtcgcctggcatgagtgtgaaggatttctcaaaacacaacagaactcgctgtatctcacgcaccgagatccgacgggccgattctatgacttcagaagatcaggagcccgagagggattacgaaaatgagagcgagtcttccgaacccaagcttggagaggaatccatggagggcgatgagcatatccacagtgaggttagtgaaaaagtcttgatgaattccgaaaggcctgacgagaatcacagtgaaccaagccatcaagacgtgatcaaggtgaaggaagaatttactgacccaacatacgacatgttttacatgtcccagtatggcctttataatgggggcggagctagcatggccgcactgcacgaatcatttacttcctcactaaactacggcagccctcagaagttcagtcctgagggggacctgtgctctagtcccgacccgaagatttgttacgtctgtaagaagagttttaaatcctcctatagcgtgaaattacattatagaaatgtgcatctgaaggagatgcacgtctgtaccgtggcaggctgtaatgcagccttcccgtcccgccgctctcgcgacaggcactccgcgaacatcaacctgcaccggaaactacttacaaaagaattagacgacatggggctggactcttcacagccctcactgagtaaagacctgagggacgagtttctcgtgaaaatttatggcgcccagcaccctatgggcctagacgtgcgagaagacgctagcagtccagctggtacagaagacagccacctcaacggatatggacgcggcatggccgaagactatatggtgttggatctttccacgacttcatccctgcagagctcctcaagtatccattcgtcaagagagagtgatgcgggcagcgatgaggggattctgctggacgacatcgacggagcctccgatagtggagaatctgcccacaaggctgaagcacctgccctacccgggtcactgggcgccgaggtgagtggaagtttgatgttctcctctctctccggctcaaacgggggaataatgtgcaacatctgtcacaagatgtatagcaacaaagggacactcagggtgcattacaagacggtccacctgcgcgagatgcacaagtgtaaagtccctgggtgcaatatgatgtttagcagcgtccggtctcggaacaggcattcccagaatccaaacttacacaaaaatattccctttacaagtgtggactag

SEQ ID NO: 109446 - DNA, 11781 bp, Artificial Sequence
  Description of Artificial Sequence: Synthetic coding sequence
atggggaacgaggtgagcctggaggggggggctggagacggaccattgcccccgggtggcgctggcccagggcccggaccgggacctggacctggggccgggaaacccccatcagctcccgcaggcggagggcagctgcccgcggcaggggccgctaggagtaccgctgtcccgccagtgcctgggcccgggcccgggcctgggcctgggcctggccccggtagtacctcacgtagacttgatcccaaagaacctctcgggaaccagcgagccgcctcgcccacccctaagcaggcctccgcgacgaccccggggcatgagtcccctcgagagactcgggcacagggccctgcaggtcaggaggcggacggccctaggcgcacgctgcaggttgattcaaggactcagcgctccggccggtccccctccgtctccccggaccgggggtcaacccctacctcaccatatagtgtcccccagatcgcacctctcccctccagtacactgtgccccatttgcaaaaccagcgatctgacaagcaccccatcgcagccaaacttcaatacatgcactcagtgccataacaaggtgtgcaatcaatgtgggtttaaccccaacccccacctgacccaagtgaaggagtggctctgtttaaactgccagatgcagagagctctgggaatggacatgaccaccgcacctcgtagtaaatcccaacagcagctgcattccccagcactgtcacccgcacattcacccgctaagcaaccactggggaagccggaccaggaacgcagtaggggccctggggggccacagccaggtagccggcaagccgaaactgctagagcgacatcagtaccaggacctgcccaggcggctgcccctcctgaagttggtcgggtaagcccccaacctcctcaacctacgaaaccatctacagccgagcctaggccccctgccggagaagctcctgcaaagtctgccaccgcagtccctgccggtctcggtgctacagaacaaactcaggagggattgacaggaaagttatttggactgggggccagcctcctgacccaggcaagcacattgatgagtgtgcaacctgaggccgacactcagggtcagcccgcaccttccaaaggcactccaaagatcgtattcaacgatgccagcaaggaggctgggcccaagcccctaggatccggcccgggccccgggcccgcccctggcgccaagaccgaaccaggcgctcggatgggccccggttctggaccaggggcgctccccaaaacgggtggtactacaagtcctaaacacgggagggccgagcatcaggcggcttccaaggcagccgctaagcctaaaacaatgccaaaagagcgggcgatctgccccctgtgccaggccgagctcaatgtcggctctaagagtcctgccaattacaacacttgtacaacctgtcgccttcaggtctgtaacctgtgcggctttaaccccacgcctcatctggtcgaaaagaccgagtggctctgcctgaactgtcagaccaaacgactgttggagggatcactcggcgagccaacaccgttgccgccccccaccagccagcagcccccggtcggagcccctcatagagcatctgggacctcccctcttaagcagaagggcccacaggggctcggccagccttcaggtcccctacctgccaaggcaagtcctctgtcgacaaaggctagtccactgccctcgaaggcgtccccccaggctaagcctctgagggcgtcagaacccagcaaaaccccatcctcagtgcaggaaaaaaaaaccagggttccgactaaggctgagccgatgccgaagccgccccccgagactacccctactcctgccactcctaaggttaagtccggtgttcgccgggccgagcctgcaacccccgtggtcaaagccgttcccgaagcccctaagggcggagaagcagaggacctagtaggtaaaccctacagtcaagacgcatccaggagcccacagagcctcagcgacactggatattcctctgacggcattagctcatctcagtctgagattacaggagttgtgcagcaagaagtcgagcagctggacagcgcaggagtgacagggcctcacccaccatcacccagtgagatccacaaagtaggctcttctatgcggcctctgctgcaggcccaaggattggcgccttccgagcggagcaagcccttatcttccggaacgggtgaggagcagaagcagcgtccccattcattatcaattacgcccgaggcctttgactctgacgaagagttggaagatatactcgaggaagacgaggattctgctgagtggcgcaggcgtagagagcagcaagacacagctgaatctagtgatgatttcggctcccagctcaggcatgattatgtagaagacagtagcgaaggaggcttaagcccgctccctccacaaccccccgctcgggcagcagaattaacggacgaagatttcatgagaagacagattttagaaatgtccgccgaggaagacaacctggaagaggatgacaccgccacctccgggcggggcctggctaaacacggcacccagaaaggagggccaaggccccgccccgaaccttcacaagaacccgctgcactgccaaagcgtaggcttccccacaacgcaactacgggatatgaggaactgctaccagaagggggctctgccgaggccacggacggaagcgggacattgcagggtggactgcgccggtttaaaactattgagttgaactctaccgggagctatggtcacgaactagacctcggacagggccctgatccatctctggatcgggagcctgagctggagatggagagcctgacggggtcgcccgaagatcgatcgcggggcgagcattcgagcaccctgcccgcctccacaccttcatacacaagtggcacctcacccacatcactgtcaagcctcgaggaggactcggatagctctccctctaggagacaaaggctcgaagaggctaagcagcagagaaaggcacgccataggtctcatggccccttgctacctacaatcgaggattcgagcgaggaggaggagttgagggaggaggaggagcttttgcgggaacaggagaaaatgagggaggtggaacagcagaggattagatcgactgctaggaagacaagaagggacaaggaggaattgcgcgctcagcggaggcgcgagcgaagtaagacccctccttcaaatttatcccctatagaggatgccagtccaactgaagagcttaggcaagcagcagaaatggaggaactgcatcgcagtagctgttctgagtactcccccagtccttcactcgatagcgaggccgaggccctggacggaggcccttctaggctatacaagtctggctccgaatataatctacccaccttcatgtcattatatagccccacggagaccccctccgggagctccacgacgccctcttccggtaggccgctaaagagcgcggaagaagcttatgaagagatgatgcgaaaagccgagttactgcaacggcagcagggccaagcggccggagcacggggcccccatggaggcccctcccaacccactggacctagaggtctcggaagttttgagtaccaggatacaaccgaccgagagtacggtcaagccgcccaacctgcggccgaggggacacctgcttctttaggcgctgccgtgtacgaggaaatcctgcagaccagccagtctatcgttcgtatgcgtcaagcttcgtcccgcgatctagccttcgcggaagataagaaaaaggaaaaacagttcttgaacgccgagagtgcttacatggatccaatgaagcagaacgggggccctctcactcctggaacttcacccactcagttagctgctcccgttagcttctctacccctacatcctctgatagctcgggtggacgcgtgataccagacgtcagggttactcaacatttcgctaaagagacacaggatccactaaagctgcattccagtccggcaagccctagcagcgcatctaaagagatcgggatgccattttctcagggaccgggaacgcctgcaacaactgccgtagctccctgtccagccgggcttcccagagggtacatgacgcctgcatcacccgccggctcagagagaagcccatctccatcaagtacggctcatagctacggtcactcccccacaactgcgaactacggtagccaaaccgaagatctcccacaggccccatctggccttgcagctgccggaagggcagctagagagaagccactttccgctagtgatggagagggaggcactccgcagccaagccgggcctacagctactttgcttcatctagtccacccctgtcaccaagcagcccaagtgagtccccgacattctccccaggcaaaatgggccctagggcgacggccgaattctccacccagacgccttcccccgccccagctagcgacatgccaaggtcccctggagccccaactccatctccaatggtggcacaggggacccagactcctcatcggccaagcaccccgaggctggtctggcaggagagctcacaggaggccccctttatggttatcaccctggctagtgatgcctcttctcaaacacggatggtgcacgcttctgctagcacctcaccactctgttcccctaccgagacacagcctacaacccacgggtattcccaaacgacaccacccagcgtcagccaactgccgccggagccccccggtccccctggtttcccccgtgtgcctagtgccggcgcagacgggccactggccctctatggatggggtgccctgccggccgaaaacatctcactttgccgcatatcttcggtgccaggtacctctagggtggaaccaggtccccgtactcctggcactgctgtcgttgatctgcggacagccgtgaagccgacacctattatcttgacagaccagggcatggacttaacatcactggcagttgaagcacgcaagtacggcctcgcactcgaccctattcccggacggcagtccaccgccgtgcagcctttggttattaatctgaacgcacaagagcatacatttctcgccacagccactacagtatctataaccatggcaagttccgttttcatggcgcagcagaagcagcccgttgtgtacggcgatccctaccagagtcgtctcgacttcggtcaggggggcggtagcccagtctgtttagctcaagtgaaacaagtagaacaggctgtgcagaccgctccatacaggagtgggccccggggccgtccgagggaggccaaattcgcccggtacaatttgcccaatcaagtagctcctcttgcacgccgagatgtgcttatcacccagatggggactgcccagagcatagggctgaagcccggaccagtgccagagccgggcgctgaacctcatcgcgcgacccctgccgaactcaggtcacacgcattaccaggggcaagaaaacctcatacagtcgtcgtccagatgggggaaggaacggcgggcactgtcaccactttgctgcccgaggagccggccggagccctggatctgacaggcatgcgcccagagagtcagctcgcctgctgcgacatggtttacaaactgccgttcgggtcaagctgcaccggaacattccatcccgctccaagcgtgccagaaaaaagcatggcagacgccgccccccctggacaatcctcctctcccttctatgggccccgcgacccagagccccccgagccccccacctacagggcccaaggcgttgttggcccgggcccgcacgaggagcaacgtccctatcctcaaggtcttcctggccgcctgtattctagtatgagcgacaccaatctcgctgaggctggtctgaattaccacgctcagcggatcggtcaactttttcagggccccggaagagattccgctatggacctcagctctctgaaacattcctactctctgggctttgcagacggcagatacctgggccagggtctgcagtatgggtcggtcactgacctgcgtcatcctaccgatcttctcgctcaccctttacccatgagaaggtatagttcggtcagcaacatttactccgaccaccgctatggacctcggggtgacgcggtcgggtttcaggaagcgtcattggcacaatatagtgctaccacagcccgggaaatatcccgcatgtgtgccgctctgaacagcatggatcagtacggggggagacacgggtccggggggggtggacctgacctggttcaataccagccccagcacgggcctgggctatcggctccccagtccctggtgcccctcagacccggccttcttggaaaccccaccttccctgagggccatccttctcccgggaatttggctcaatacgggccagccgcggggcagggcaccgccgtgaggcagctgctcccttctacagcaaccgtgcgcgccgcagacggcatgatatatagtaccatcaatacacccatagcagcaacactgcccatcaccacacagccagccagcgtgctacgccccatggtccggggcggaatgtataggccgtacgcctcaggcgggattaccgcagtgcccctgacaagcctgacgagagtgcctatgatcgcccctcgggtcccccttggcccaactggcctctaccgttacccagcaccttctcgttttccaattgcgagtagtgttccccccgcggagggaccagtgtaccttggtaagcctgccgctgcaaaagcccctggcgcaggtggtccgagcaggccggaaatgcccgttggagcagcgcgcgaagagcccctaccgaccactaccccggctgcaatcaaggaggctgccggcgcacccgccccagccccattagccggacagaaacctcccgccgatgcagcacctggcggcggctctggcgccctgagtcgcccagggttcgagaaggaggaggcttctcaggaagagagacagagaaagcagcaggagcaattgctgcaactagaacgcgaacgagtggagctggaaaagttgagacaactaagactccaggaggagctggagcgagagcgagtggagctgcagagacatcgtgaggaagaacagttactcgtgcagcgagagttgcaggagcttcaaaccatcaaacatcacgtgctacagcagcagcaggaagaaaggcaggcccagtttgccctgcagcgcgagcagttagcccaacagagactccagctggagcagattcagcagctgcagcagcagctgcagcaacagttggaggagcagaagcagcgacagaaggctccttttcccgctgcctgcgaagcacccggccgaggcccacccctggcagcagcagagctcgcccagaacgggcagtactggccaccgctcacacatgccgcgttcatagccatggcaggaccagaaggactgggacagcccagagaaccggtgcttcaccggggcctgccgagtagtgcatctgacatgagcctccagactgaagaacaatgggaagcctctagatccgggatcaagaagcggcactccatgcctcgtctgagagacgcgtgtgagcttgaaagcgggaccgagccgtgtgttgtcagaagaatcgccgactcttcggtgcagaccgacgacgaggacggagaatccagatacttgctctcgagaagaaggcgggcccgtaggtccgcagattgctctgtgcagacagatgacgaagattcggctgaatgggagcaaccagtgaggcggcggaggtcgcggcttccacgccatagcgattccggttccgattcaaagcacgacgcgactgcttcaagctcatcagcagctgctaccgtgcgcgctatgtcaagtgtgggcattcagaccatatccgactgtagtgtccagactgagcccgatcaactgccccgcgtgtcacccgcaattcacattaccgccgccacagatcccaaagttgagatcgttagatatatttctgctcccgagaagacaggccggggagaatctctcgcctgtcagacagaacctgacggacaggcccagggtgtcgctggcccccagcttgtggggcctaccgctatcagtccatatctgcccggcatccaaatcgttaccccaggccccttggggaggttcgagaaaaagaaaccagacccccttgagatcgggtaccaggcacatctgccaccggaatcgttgtcacagttggtgagtagacaaccacctaaatcccctcaggttttatatagtccagtgtcacccttgtctccgcaccgactgctagacacgtccttcgccagcagtgagcgattgaacaaggcccacgtaagtcctcagaagcatttcactgcagattccgcgttacgtcaacagactctgccaaggccaatgaaaacactgcagagatccctgagtgacccaaaaccactgtcaccaaccgctgaagaatccgcaaaggagaggtttagcctctatcagcaccagggcggactgggctcacaagtgagcgccctgcccccgaattcactggtccggaaggtgaagaggaccttgccatcacctccccctgaggaagcgcacctccctctggcaggccaggctagcccacagctatatgcagcgtccttgcttcaacgcggcctgaccggccctacaactgtgcctgccactaaagcctctctgctcagggagctcgacagagacctgaggttggtggagcatgagtccacaaaacttcggaaaaagcaagccgaactagatgaggaggagaaggaaattgatgctaaattaaagtacctggagctcggcatcacccagcggaaggaatctctcgcaaaagaccgcggtggcagggattaccctccgttacgcggattaggggagcatcgtgactacctgagtgacagcgagctcaatcagttgcgacttcaggggtgcacgacgcccgctgggcaatttgtggacttccccgcaactgcggcggccccggccaccccttctggacctaccgcattccaacagccccgctttcagccccctgcaccccagtattccgccggctccggaggacccactcagaatggctttcccgcacatcaggcacccacatacccaggaccgtctacctaccccgcccctgctttcccgcccggcgcctcttatcccgcggagcccgggctgccaaatcagcaggctttccgccccaccggacattatgccggccagacacccatgccgactacccaatcaaccttgtttcctgtacctgcagatagtcgtgctcctttgcagaagcctagacaaacaagtctggccgatcttgaacagaaagtgcctaccaactacgaggtcatagcatctccggtggtgcccatgagcagtgccccaagtgaaacatcctactccgggccagcggtgtcctctgggtacgagcaagggaaggtgcccgaggttcctcgcgcaggtgatcggggatctgtgtcgcaatctcctgcccccacctatcccagcgatagtcattatacctctctggagcagaacgtgccgcgcaattatgtgatgattgacgacatctctgagctcacgaaagactcaaccagtacagcacccgacagccaacgactggagcctctgggccccggttcctccgggaggcccggtaaagagccgggagagccaggagtgcttgatggccccactctgccttgctgctatgccaggggggaagaagagtccgaggaagacagttacgatccgcgcggcaaaggagggcacctcaggtctatggagtctaacggccggcccgcctctacccattattatggagattctgactatagacacggtgcacgggtcgaaaaatacgggcccggtccaatgggcccaaagcacccgagtaagtcccttgcgcccgcagccatttccagtaagcgttcaaagcaccggaagcaaggaatggagcagaaaatctcgaaattttcaccaatcgaagaggccaaggacgtcgaatctgatctggctagctatccaccaccagctgtgtcctcatctctggtatctagaggacggaaatttcaggacgagatcacatacgggcttaagaagaacgtctacgagcagcagaagtactacggcatgtcgagtagagacgccgtagaggatgacagaatctacggtggctcaagccgatcccgcgctcccagcgcctactccggagagaagctcagttctcatgatttctctgggtggggaaaggggtacgagcgggagagggaagccgtcgagagactccagaaagccgggcctaaaccatcgtcacttagtatggcacactcaagagtgcgtccaccgatgcggtcacaagcctccgaagaagagtcccctgtgtctcctcttggacgcccaaggccggctggtgggccgctcccccctggcggcgatacctgcccacaattttgctcaagtcactcgatgccggacgtccaagagcacgtgaaggatggacccagagctcacgcctacaagagagaagaggggtacatacttgacgacagccactgcgtggtgagcgacagcgaggcttaccacttaggacaagaagagaccgactggttcgataaaccacgtgacgcgcgcagcgatcgcttccggcaccatggtggtcatgctgtctccagctcatcacaaaagcgcgggccagctcggcactcttaccacgactatgatgaacctcctgaagagggtctgtggcctcacgacgagggaggcccaggacgacatgcttctgctaaggaacatcgccatggtgatcacggcagacattctggccgccataccggcgaggaacctgggcgccgggctgcgaaacctcatgcgagggatttagggagacacgaagctagaccacacagtcagccctccagtgcacccgctatgcctaagaagggacagccaggatatccatcgagcgccgagtactcccagccgagccgggcgtcaagcgcataccatcacgcaagtgattcaaagaaagggtcgcggcaggctcatagtggccctgcagcattgcagtccaaggcagagccccaagcgcagcctcaactccagggtcgacaggcagccccgggtccccagcagtcacagtcgccctcttccaggcagattccctctggggcagcgagtcgtcaaccacagacccagcaacaacagcagggcttgggattgcagcctccccagcaggccctgacccaggcaaggctacagcaacagtctcagcctactactcggggttctgccccagctgcttcacaaccagctggaaagccacaaccgggcccttcgactgccacagggcctcagcccgccggacctcctagggcggaacagactaatggctccaagggcaccgctaaggccccacagcaaggccgggccccccaggctcagcctgccccaggtccgggccctgctggggtgaaggccggggccaggccaggcggcacacccggtgcccctgcaggccagcctggcgctgatggtgagtccgtttttagcaaaattcttccagggggtgcagccgagcaggcaggaaagctgacggaggctgtctccgccttcggaaaaaagtttagttcattctggtag

SEQ ID NO: 109447 - DNA, 702 bp, Artificial Sequence
  Description of Artificial Sequence: Synthetic coding sequence
atggaacccactgcccccagcctcacagaagaggacttaaccgaagtcaagaaagacgcgcttgagaacctgagggtgtacttgtgcgaaaagattattgctgaaagacattttgaccaccttagagcaaagaagatcttgtccagggaggatacggaggagattagctgtcggacctctagcaggaagagggcaggtaagctgcttgactatctccaggaaaaccccaagggccttgacactctggtggaaagtatccggcgcgagaaaacacagaactttctgattcagaagatcaccgatgaagtgctcaaactgcgaaatatcaagctggaacacttaaagggcctgaagtgtagtagttgtgagcctttcccggatggtgccacaaataacctctctcgctctaatagtgatgaaagtaacttctctgagaaactgagggcatccaccgttatgtaccaccctgagggcgaatcttccactacccccttcttcagtacaaattcttccttaaacctgccagtcctggaagtgggtcgcacagagaatacaatctttagttccacaaccctgcccagaccaggtgatcctggtgccccacccctgcccccggacctgcaattagaagaagagggcacatgcgcaaatagttctgaaatgtttctacccctccgctcacgcacggtgtcccggcaatag

SEQ ID NO: 109448 - DNA, 702 bp, Artificial Sequence
  Description of Artificial Sequence: Synthetic coding sequence
atggagcctacagccccctcacttaccgaagaggaccttaccgaggtgaaaaaggacgcacttgagaatctgcgggtgtatctatgtgaaaagatcattgctgagcggcacttcgaccaccttcgcgccaagaagatcctgtcccgggaggacacagaggaaatctcatgcagaacaagtagccgaaaacgggctggcaagctgctcgattacttacaagagaatcccaagggccttgacacactcgtggagtcaataaggcgcgaaaaaactcagaatttcctgatccagaaaattactgatgaagtgttaaagctgaggaatatcaagctggaacatctgaaggggctgaaatgctcctcttgcgagccgtttcccgatggtgctaccaataacctctcacgttctaactccgatgaatccaacttttccgaaaagctgcgggccagcaccgtgatgtaccatcctgagggggaatcaagcacaacgccctttttctccaccaacagttccctgaatcttccagtgctggaagtgggcaggacagaaaacactatattcagttcgaccaccctaccaagaccaggcgatccaggagctccgcccctccctccagacctgcagctggaagaggagggaacctgcgccaatagcagcgaaatgtttctccccctgagaagcaggacagtctcccgtcaatag

SEQ ID NO: 109449 - DNA, 471 bp, Artificial Sequence
  Description of Artificial Sequence: Synthetic coding sequence
atggagcctaccgccccgtctcttacagaagaggacttaacagaagtgaagaaagatgcactggaaaatcttagagtgtacctgtgcgagaaaatcatagctgaacgccacttcgaccatctgagggcaaaaaaaatccttagcagagaggatacagaagaaatctcctgcagaaccagtagccgcaagcgagctggaaagttactggattatctgcaggagaatcctaaggggctggacactcttgttgaaagtatccggcgggagaagactcagaatttccttattcagaagattaccgatgaagtcctcaagctgcggaatattaagctagagcatttaaaggatggtgcaaccaataatctgagcaggtctaattctgacgagtccaatttttcagagaaattacgggcctctactgtgatgtaccaccctgagggcgaatcctcaaccactccgttcttttactag

SEQ ID NO: 109450 - DNA, 2508 bp, Artificial Sequence
  Description of Artificial Sequence: Synthetic coding sequence
atgtcgagacggaagcagggtaaaccacagcacctctctaagcgcgagttttcccctgaaccgcttgaagccatactgactgatgacgagcctgatcacggacccctgggcgcccctgaaggggaccatgatctcttaacctgtgggcaatgtcagatgaatttccctctgggtgacatccttatattcatcgaacacaaaaggaagcagtgcaatggctcactgtgtctggagaaggcagtggataagccgccctcaccatctccaatcgagatgaaaaaggcctcaaaccctgtggaggtaggcatccaggtcactcccgaggacgacgactgtctcagtacaagctcccgtgggatctgtcctaagcaggaacacatcgccgataagctgctgcactggcggggcttgagctcccctcgaagtgcccatggagctctcatccccactcctggcatgtccgccgagtatgctccgcaaggtatctgtaaagatgagccctccagctacacttgcacgacctgcaaacagccctttacctccgcatggtttctcctgcaacatgcacagaacacccacggactgaggatttacctggaatcggaacacggcagccctttaacacccagggtcggtattcctagtgggcttggagcggaatgcccttcgcaaccccctttgcatggcatccatattgcagataacaacccatttaacttgctccgaatcccgggctcagtttcccgcgaggcgagcgggctggccgaaggacgattccctcccacccctccattattcagcccacccccacgacatcatctggacccacatagaattgagagactaggcgctgaggagatggccctagctacgcatcacccatccgctttcgaccgtgtgctgcggctcaatcccatggcaatggagcctccagctatggatttttcacgtcgcttacgggagctggctggaaatacttctagtccacctctctctccaggtaggccatcaccaatgcagaggctattacaacccttccagcccggctcgaaacctccctttctggccacccccccacttcctcccttgcaatctgccccacctccatcacagccccctgtaaagagcaaaagttgcgagttctgcggtaaaacgttcaagttccaatccaatctagtggtgcaccgcaggtcacatactggcgagaagccctataaatgtaatctctgtgaccatgcatgcacccaggccagcaaacttaaaaggcatatgaaaacccatatgcataagtcgagtcctatgacagttaaaagcgatgacggcctatccactgctagtagcccggaacccggaacatccgacctcgtggggagcgccagctccgcattgaaaagtgtagtggcaaaatttaagtctgagaacgaccctaacctcatcccggaaaatggagacgaagaggaggaagaggacgacgaagaggaggaagaggaagaggaggaggaggaagaggagctcactgagagcgaacgcgtggactatggtttcggcctgtcacttgaagctgcccggcatcacgaaaattcaagcaggggtgcagtcgttggagttggcgacgaatccagggccttgcccgatgtgatgcagggtatggttctctctagcatgcaacacttcagcgaggctttccaccaagtgctgggcgagaagcacaaacgcggccacctggcagaagccgagggccatcgggacacctgcgatgaagattcagtggctggagaatcagaccgcatcgatgacgggacagtaaacggcaggggttgtagccctggcgagtccgcgagcggcggactgtccaaaaagttgcttcttggtagcccgagttcgctttcgcctttctccaagagaattaaattggagaaggagtttgatctcccccccgctgccatgccaaacactgagaatgtctatagtcagtggctcgccgggtatgctgcgagtcggcaactgaaagacccctttctttccttcggcgactctcgacaaagtccgttcgccagctcttcagaacactctagcgagaatggatctttgaggtttagcacaccaccaggtgaactggacggtggtatctccggacgatcaggaaccggcagcggaggtagtactccacatatctccggcccaggaccaggaagaccctcatcaaaggagggccgccgttctgacacgtgcgagtactgtggaaaggtctttaagaactgttctaacctgacggtccaccgtcggagccatacaggagagaggccctacaagtgtgagttgtgcaattatgcatgcgcgcaaagctctaagcttacacgccatatgaaaacgcatgggcaagtgggaaaggatgtctataagtgcgagatatgcaagatgcccttcagcgtgtactctaccctcgaaaagcacatgaagaaatggcactctgatcgggtgctcaataatgatatcaagacagagtag

SEQ ID NO: 109451 - DNA, 2322 bp, Artificial Sequence
  Description of Artificial Sequence: Synthetic coding sequence
atgtctaggcgtaagcaaggcaaaccccagcacctctccaagcgggagttctcaccagagcctctcgaagccattttgaccgacgacgagccagaccatggccccctgggcgctcctgaaggagaccacgacttactcacctgcggacagtgtcagatgaatttccctttgggtgacattttaatttttatcgagcacaagagaaagcagtgtaatggatccctgtgccttgagaaagccgtggacaagcccccgagcccttccccaatcgagatgaagaaagcctctaatccagtagaggtgggtatccaagtaacaccagaagacgacgattgcttgtcgacctcgtccagaggaatctgccctaagcaagaacacatcgcagataaactcctccactggagagggctttcatctcctaggagtgctcacggggctctgatccctacccccggcatgtcggcagagtacgccccccagggtatctgtaaggacgaacctagctcttatacctgtacaacgtgcaagcaaccttttacaagcgcatggttcctactgcaacatgctcagaacacacatgggttgcgcatctacctggagtcagagcatggaagcccgctgacaccccgggttggaataccctccggactgggtgccgaatgcccatctcagcctccgctacatggaatccacatagcagacaataacccatttaatctgcttcgcatacctgggtcagtgtcacgtgaggcctcaggcctggcagaagggcgctttccgccaactccacccttgttcagcccgccaccccggcatcatctggacccgcaccgaattgagcgactgggcgccgaagagatggccctcgccacacaccatccctctgcttttgaccgggtgttacgtttgaaccctatggctatggagccaccagccatggatttttctcgccggctaagggagctggctggtaacacttctagcccccctctttcccccggcaggcctagtcccatgcagaggctgctccagcccttccagccgggcagcaaaccgccgttcctggccactccccctttgcctcccctgcagtcagcccccccaccttctcagccccccgtcaaaagcaaatcatgcgagttttgcggtaagacctttaagtttcagagcaacttggtggttcaccgccggtcccacacaggcgagaaaccgtacaagtgtaacttgtgtgaccatgcttgcacacaggcatccaaactcaaacgccacatgaagacacatatgcacaaaagctctcctatgactgtcaaatcagatgacgggctctccaccgctagcagccccgagcccggcacgagcgaccttgtgggatccgcctcaagtgccttgaaaagcgttgttgccaagtttaagagcgagaacgaccccaacctcattcctgagaatggggacgaggaggaagaggaggacgacgaagaggaggaagaggaggaagaggaggaggaagaggagctgaccgagtctgagagggtggattatgggttcgggctgagccttgaagcagcacgccaccacgagaatagttctaggggcgccgtagtcggcgtcggcgacgagtctcgagccctccccgatgtgatgcagggcatggtcctgagcagtatgcagcacttctccgaggcttttcatcaggtgctgggcgaaaagcacaagcgagggcacctagcagaagcagagggtcaccgggatacatgtgacgaagatagtgtggcaggggaaagcgaccgcattgatgatggtacggtgaacggccgcggatgtagtcccggggagagcgccagcggcggcctgtccaaaaagctgctcttaggatccccaagcagcctgtctcctttctcaaaaagaattaagctggagaaggagtttgacctgccccctgccgccatgcccaataccgaaaatgtttacagccagtggctggcggggtacgcagcctcacgccagctaaaggatccgttcctgagtttcggtgattctcgacagtctccatttgcatcttcttcagaacacagttccgaaaacggctcgctcagattctccacccctcctggcgagctcgacggcggaatctctggcaggagcggtaccggaagcgggggttccacccctcatatctcgggaccaggacccgggcgcccaagcagtaaagaaggtcgaagaagtgatacctgctccagccatactcctattcgccgcagcacccagcgggcacaggatgtgtggcagttctctgatgggtccagccgcgctttgaagttctag

SEQ ID NO: 109452 - DNA, 2406 bp, Artificial Sequence
  Description of Artificial Sequence: Synthetic coding sequence
atgtcccgaaggaaacaggggaagccccaacacctgtctaagagagagttctctcctgaaccgctggaggcgatccttaccgacgacgagcctgaccacgggcctctgggggccccggagggtgaccacgatctgctaacttgtggccagtgtcagatgaactttccactgggggacattttgatctttatcgaacataagcgcaagcagtgtaatgggtccttgtgccttgagaaagccgtggataaacccccttcaccatcccctattgagatgaagaaggcatccaatccagtggaggttgggatccaggtaacgcccgaagacgacgactgtctttccacttcaagtcggggtatatgtcctaagcaggaacacatagccgggaaagacgaaccatcatcttatacctgtaccacgtgtaaacagccgttcacttctgcctggtttctgttgcagcacgctcagaacacacacggattacgaatctatttggaaagtgagcacggatcacctttaacgccccgagtcggcatcccgtctgggctgggcgcagaatgtccctcccagccccctctgcacggaattcacatcgccgacaacaatcctttcaacctgttgcggatccccggaagtgtttctagagaggcaagcggcctagccgaggggagattccccccaaccccaccgctgtttagccccccccctcggcaccacctcgatccgcatcgaattgagcgactgggcgctgaagagatggctctggctacgcaccacccctcagctttcgaccgcgttctgcggctcaaccccatggccatggaacctcccgcgatggacttttccagaaggctgcgcgaactcgcgggaaatactagctccccaccgttgagccctgggcgcccaagccccatgcagcgtctcttacagccttttcagcccggcagcaaacctcccttcctggctacccccccactgccgcctcttcagagtgcaccaccccccagccagcctcccgtgaagagcaagagttgtgagttctgcggtaagacattcaaattccagtccaacctagtcgtgcaccggaggtcccacacaggggagaagccttataaatgtaatctgtgtgaccacgcatgtacccaggctagcaaacttaagcgccacatgaaaacacacatgcacaagtcttcccctatgaccgttaaaagcgacgacgggctctcaacagcttcttctccggagcccggaacatccgacttagtgggctcagcgtccagtgctttgaaatctgtggtggctaagttcaagagcgagaacgaccccaatttaatcccagaaaacggtgacgaggaggaggaggaggatgatgaggaagaagaggaagaggaagaggaggaagaggaggagctcacagaaagcgagagagtggactacggatttggcctttcgctcgaggccgctcggcaccatgagaattcttcacggggtgccgtggtgggagttggtgacgagtcccgcgcgttgcctgatgtgatgcagggcatggtcctgtcctcaatgcagcacttctctgaggcctttcatcaggttctgggtgagaaacataagcggggccatttggcggaagccgagggacatagggacacctgcgacgaggactcggtggcaggggagagtgatagaattgatgatgggaccgtgaacggccgcggctgttcacccggggagtccgcctccggaggactaagcaaaaagctccttctgggatctccatcttctctctccccattctcaaaacggattaaactggagaaagagttcgatttgcccccggctgcaatgcctaacaccgagaacgtatacagccagtggcttgctggctacgctgcttcacggcagttgaaagacccattcctctctttcggcgatagccgacagtctccattcgcttcctccagcgaacactctagcgaaaacggttcattgcgattcagtactccgcccggcgagctcgatggaggtatctccggccggagtggcacgggatctggaggttccactcctcatatatctggtccaggccctgggagaccatcatcaaaggaaggtagaagatctgatacttgcgagtactgtggcaaggtctttaagaattgttctaacctgacggttcatcgcaggagccataccggtgagcggccttataaatgcgagctgtgcaattatgcttgtgcccagagcagcaagttgacaagacacatgaagacacatggacaggtaggaaaggatgtgtacaagtgtgagatatgcaagatgcccttttcggtctattctacgcttgagaaacacatgaagaaatggcactctgatagggtcctgaataatgatataaagacagagtag

SEQ ID NO: 109453 - DNA, 732 bp, Artificial Sequence
  Description of Artificial Sequence: Synthetic coding sequence
atgtcaagacggaagcaggggaagccacagcatctctccaagagagagttcagcccagagccacttgaagcaattctgactgatgatgaacccgatcatgggcccctcggagccccagagggtgaccatgatctattgacatgcggacagtgtcagatgaatttcccactgggagacatactaatcttcattgaacacaagaggaagcaatgtaatggtagcctctgtctggaaaaagccgtcgacaaacctccgagcccatctccaattgagatgaaaaaggcttccaaccccgttgaagtgggaatccaagtcactccagaagatgacgattgcctgtcaacttcatcccggggcatatgtccaaaacaggagcacatagctgacaaactcctccattggcggggactgagctcccctagatcagcccatggtgcactcattcccacacccggtatgtcggccgaatatgccccgcaggggatctgcaaagatgagccgtcctcctacacttgcacaacctgtaagcagcctttcacatctgcatggttcctgttgcagcacgcacagaacacgcatggcctcagaatctacctcgaatcagaacacgggtctccgttaactcccagagtgttgcacacgcccccatttggggtggtcccccgcgagctgaaaatgtgtggctccttccggatggaagcaagggaaccgttatcgagtgagaagatctag

SEQ ID NO: 109454 - DNA, 2397 bp, Artificial Sequence
  Description of Artificial Sequence: Synthetic coding sequence
atgtcgaagggcaccgatgaagatattttctccggggtgtcattctttctgaccagactgtctaggtgcgaaccttctcggcggccgccaccagccccccaacctactatgtcaagaaggaaacaagggaaaccccaacacctttctaaaagggagtttagtcccgaaccccttgaagccattctgaccgacgacgagcccgatcatggccccttaggagcaccagaaggtgaccatgatttacttacatgtgggcagtgccagatgaatttcccactcggcgatatcctgatctttatagagcacaagcggaaacagtgcaatggctccctgtgccttgaaaaagccgtcgacaagccaccgtcaccctctcccatcgagatgaagaaggcctccaatcccgtggaagtagggatccaagtgacacccgaagacgatgactgcctgtccacatcgtctcggggcatttgtcccaagcaggaacatatcgccgacaagctgctacactggcggggtctcagctcccctaggtctgcccatggagcccttatcccgacccccgggatgtcagcagagtacgccccccagggcatatgcaaggacgaaccttcctcttacacttgcaccacatgtaagcagcccttcacctctgcgtggttcctccttcagcacgctcagaacacccatgggctgcgtatatatttggagtctgaacacggctcacctttgactccgagagtggggatcccgagcggcttgggggctgaatgtccaagccaaccccctctgcatggaattcacattgcagacaacaacccattcaaccttctgagaattcctggttctgtatcacgggaggcctccggcctcgccgagggtcgattccctccaacaccaccacttttctcaccaccacctcggcatcacctcgatccccacaggattgagagacttggggctgaggagatggccttagccacccaccatccttcagcctttgacagagtcctgagattaaaccccatggctatggagccaccagccatggacttttcgcggagattacgagagcttgccggaaacacatcctccccgccgctttctcccggaaggccaagtccaatgcagcggttactgcaaccctttcaacccggatcaaagcctcccttccttgccactccaccactacctccactccaaagcgctccccctccaagtcagcccccagtcaagtcaaagagctgcgagttttgtggaaaaacattcaaatttcagtctaacttagtggtgcaccgaagaagtcataccggggagaaaccctataagtgtaacctttgcgaccacgcctgcacacaggcttctaaactaaaaaggcatatgaaaacgcacatgcacaagtcttcgccaatgaccgtgaagtcagatgatggtttaagcaccgctagttccccagagccaggtacatcggacctggtggggagcgcctcctccgccctcaagtcagtggttgcaaagtttaaaagtgagaatgatcccaatctgatccccgaaaatggcgatgaggaggaggaagaagacgatgaggaagaggaagaggaagaagaggaagaggaggaggaactgacagagtcagagagagtggactatggatttggtctatccctcgaggccgtagtgggtgtaggtgatgagagtagagctctgcccgatgtcatgcaaggaatggtgttatcatctatgcagcacttcagtgaagcatttcaccaggtgctgggggagaaacacaagaggggacacctggccgaggcagagggacatagagatacttgcgacgaggacagcgtggccggagagtctgaccgcatcgatgacggtaccgtcaatggcagaggctgttcgcctggggagagcgcaagcggcgggctcagcaagaagctacttttagggtccccttcatcgctaagtcccttctccaaaaggatcaagctagagaaggagtttgatttaccaccagccgccatgccaaacaccgagaatgtgtacagtcagtggctagccggctacgcagcgagtcgacagctgaaggatccctttctgtccttcggcgatagccgtcagtcccctttcgcgagcagcagcgagcatagctctgaaaacggatctctgcggtttagcactcctcccggcgaactggacggtggcatttccgggcgatctggcaccggatccgggggctccactccacacatatccggaccagggccaggacggccatctagcaaagaaggcaggagatccgatacctgttcctcccacaccccaatccggaggagtacacaacgggcgcaggacgtgtggcagttttcggatggcagttctcgggccctgaagttctag

SEQ ID NO: 109455 - DNA, 1329 bp, Artificial Sequence
  Description of Artificial Sequence: Synthetic coding sequence
atgtcagcagagtacgcccctcaaggtatttgcaaagacgagcctagtagttatacctgcacaacgtgcaagcagcctttcaccagcgcatggttcctgctgcagcacgcccaaaatacacatggattgagaatttacctcgagtcggaacacggatccccgctgacacctcgatccaacctcgtcgtccataggagaagccatactggtgagaagccttacaagtgcaatttatgcgatcacgcctgtactcaagcctctaaactcaagagacatatgaagacacacatgcataagagttcaccgatgactgtgaagagcgatgacggactgtccacagctagctctccagagcccggtacatccgatctggtcggctcggcgtcgagcgctctgaagtccgtggtggccaaattcaagtctgaaaacgatcctaatctgatccctgagaacggcgacgaggaagaggaagaggatgacgaagaggaggaagaggaagaagaagaggaggaagaggaattgaccgaatctgagagagtggactacggattcggactctccctggaggctgcgcgacatcacgagaactcctccagaggcgccgttgtgggagtaggtgatgagagcagagccctgcccgatgtgatgcagggtatggtgctttccagtatgcagcacttttctgaggccttccaccaggtgctgggggaaaagcacaaacgcgggcatctcgccgaggctgaaggccatagagacacatgtgatgaagattccgtggccggtgaaagtgacagaatcgacgacggaacagtaaatggtcggggatgcagtccaggagagtcagccagcggcggcctttcaaagaagctgttgttgggcagcccgagtagtctatcaccatttagcaagaggattaaattagagaaggaatttgacttaccccccgctgcaatgccaaatacagagaatgtgtactcccaatggctcgctgggtacgctgcctcgcggcagctgaaggacccattcctttcattcggcgactccaggcagtctcccttcgccagttcaagtgaacacagtagtgaaaatggttccttgcgtttttccactccccccggcgaactggacggaggtatttctggccggagtggtacaggaagcggcggaagcactccacatatatcaggaccaggtcctggcaggccctcttccaaggaaggacgtaggagcgatacctgctcatcacatacccccatccgccgttccacccagcgagctcaggatgtatggcagttcagcgatggatcatcccgggcactgaagttctag

SEQ ID NO: 109456 - DNA, 2382 bp, Artificial Sequence
  Description of Artificial Sequence: Synthetic coding sequence
atgagcaggaggaagcagggcaagccgcaacaccttagcaaacgcgagttttctccagagccactggaggctattctgaccgatgacgagccggaccatggacccctgggtgctccagagggggatcatgaccttctcacatgcggacagtgccagatgaacttccccctgggcgatatcctgatcttcatcgaacacaagaggaaacagtgcaacgggtccctgtgcttggagaaagctgtcgataagcctcccagtccatctccaattgaaatgaaaaaggccagcaacccagtcgaggtcgggatccaggtgacccccgaagacgatgattgtctgtccacaagctcacggggaatctgtccaaagcaggagcacattgccggtaaagacgaaccctcttcctacacttgtacgacatgcaaacaacctttcacttcagcttggttccttcttcagcatgcacaaaatacccacggcctcagaatctatctggagtctgagcacggatctccccttaccccacgggtggggattccgtccggtttgggggctgagtgtcctagtcagccgccattgcatggaattcacatcgccgacaataaccccttcaatctgctacgcatccccggctcagtgtccagggaggccagtggtcttgccgagggcaggtttccaccaactccacctctgttctcccctcccccacggcaccacttagatcctcaccggatcgaacggctcggcgccgaagagatggcgctcgcaactcaccacccttcagccttcgatagggtgctgcgcctcaatcccatggctatggaaccccccgccatggacttctccagacggctccgtgagctggctggtaatacctcttcccctccactcagcccaggtcgcccaagtcccatgcagcggcttctccagccctttcaacccgggtccaaacctccctttctggcgaccccacctctgcctcccctccaaagcgcaccgcctccatcgcagcctccagtgaagtctaagagttgcgagttctgtggtaaaaccttcaaatttcagtccaatctcgtggtgcacagaagatctcatacaggcgagaaaccctacaagtgtaatttgtgtgaccacgcttgcactcaggcaagcaagctgaaacgacacatgaaaactcatatgcataagagctctccaatgactgttaagagcgacgatggtctgtccactgcatcctctcccgaaccaggaacttcagatctagtgggatcagcctcctccgcgctaaagtctgttgtggcaaaattcaaatcagagaacgatccaaatctcatccctgagaatggggacgaagaggaagaggaggacgacgaagaagaggaggaggaggaagaagaagaagaggaagagctaacagaaagtgagcgggtggattatgggtttggactatccctggaggccgccaggcatcatgaaaattcatcaagaggcgcggttgtgggagtcggcgacgaatcccgggcactgcccgacgttatgcaagggatggtgctatcatctatgcaacacttttctgaggctttccaccaggtcctcggagaaaaacacaaacgcgggcacctcgccgaggctgagggccaccgggacacatgtgatgaggactccgtggctggcgaaagtgaccgcattgatgatgggacggtgaatggccgcgggtgcagtcctggggaaagtgccagtggcggtttgagcaagaaactactactgggcagcccctcatcactgtcgcctttctctaagcgcataaagcttgagaaagaattcgatctgccaccagccgctatgccaaacactgagaatgtttattctcagtggcttgccgggtacgccgcatcacgtcagctgaaagaccctttcctttccttcggagattcccgccagagcccatttgccagttccagcgagcattcttccgagaacggtagcttaagattctctacacctcccggtgaactggacgggggcatcagcgggcggagtggcacaggttcaggtggttcaacaccccacatatctggacctggccccggccgcccgtcatccaaagaggggcggcgcagcgacacctgcgagtattgcggcaaggtgttcaaaaactgctcaaacctgacagtgcaccggcgctcacacaccggggagcgaccttataagtgcgaactgtgcaactatgcttgcgcacagtcctcaaagctgacgcgtcacatgaaaacccacggccaggtgttacatacaccaccttttggagttgttccaagagagttgaaaatgtgtgggtcctttaggatggaggccagggaacctcttagcagcgagaagatttag

SEQ ID NO: 109457 - DNA, 2472 bp, Artificial Sequence
  Description of Artificial Sequence: Synthetic coding sequence
atgtctcgtcgcaaacagggtaacccccaacacctatcacaacgggaactcattacccctgaggcggatcatgtagaggcagccatcctggaagaggacgaagggctggagatcgaggaacccagcggtttggggctgatggtaggtgggcccgaccccgatctcctgacatgtgggcaatgccagatgaactttccgctcggggacattctggtatttatcgaacacaaaaggaaacagtgtggaggctccctcggcgcctgttatgataaagcgttagataaggattcaccgccaccttcctcccgctccgagttaagaaaggtgtcagagcctgtggagatcggcattcaggtgactcctgacgaagacgatcaccttctgtcccctacgaagggaatatgtcctaaacaggaaaatatcgccggcaaagatgagccctcgtcatatatttgtaccacgtgcaagcagcccttcaactcggcttggtttctccttcagcacgcccaaaatacacacggctttcgtatttatctggaacccggtccagcttccagttctttgacacccagactcaccattccgccccccttagggcctgaggctgttgcccagagtccgctgatgaattttttgggtgactcgaacccgtttaatctgttacgcatgacaggcccaattctgcgcgatcaccctggttttggcgagggccgcctgcccgggacaccccccctattcagcccacctccgcgtcatcacctggatcctcataggctttcagccgaggaaatgggcctcgtcgctcaacacccctccgcttttgatcgtgttatgcgcctcaatcccatggccatcgacagtccagcaatggattttagcagaagactccgggaactcgccgggaattcctccactccaccgccggtgagtcccgggaggggcaatcccatgcatcggctgctcaatcctttccagccaagcccaaagagtcctttcctctcaacgcctcctttgccccccatgccaccgggcggcaccccacccccacagcctcccgcaaagagtaagagctgcgaattttgtggtaaaaccttcaaattccagtcaaatctgatcgtgcataggcggtcacatactggggaaaagccctataagtgtcagctgtgcgatcacgcatgcagtcaggcttccaaattaaaacgacatatgaaaacgcacatgcacaaggccggatccctggccgggcggtctgacgatggattaagcgcagcgagtagtccagagccaggcactagcgagctcgccggagagggcctgaaagccgcagatggcgatttccgtcaccacgaatcagacccaagccttggccacgaacctgaagaggaggatgaggaggaggaagaagaagaagaagaattgctactggaaaacgagagtaggcccgagagctctttctctatggactcagagctgtccagaaacagagagaacgggggcggaggcgtccccggcgtgccgggggcgggcggcggggcggccaaagcgctcgccgatgaaaaggctctcgtcctggggaaggtgatggagaacgtgggattgggcgcgttaccacagtatggagagctgcttgctgacaagcagaaaaggggtgcttttctgaaacgagctgctgggggcggggatgctggggatgatgatgatgccggcggatgcggggacgcgggggctggtggtgcagtgaatggcagaggcggaggtttcgccccgggcactgagccattccccggcctgtttccccggaagcccgcgcctttgccctccccggggctcaactctgcggctaaaaggatcaaagttgagaaagacctggaactgccgcccgccgcacttatccctagcgaaaatgtgtattcccaatggctggtgggatatgccgcatcgcggcatttcatgaaggatccttttctgggtttcacagacgcccgccagtctcccttcgccactagtagcgagcattctagtgaaaacggctctctccggttttccactcccccgggcgatctcctggatggcggactgtcaggtcggagcgggactgcctccggcggctcgaccccccacctgggtggcccaggcccaggcaggccgtccagtaaagaaggcaggaggtctgacacttgcgaatattgcgggaaagtttttaaaaattgcagtaatttgactgttcatcggcgatctcacaccggtgaacgtccatataaatgcgagctgtgcaactacgcgtgcgctcagagctccaagctaaccagacatatgaaaactcacggccagattggaaaggaggtgtatagatgtgacatttgccagatgccattcagtgtgtactcaactttggagaaacacatgaaaaaatggcatggcgagcacttactgacaaacgacgttaagattgaacaggccgagagaagttag

SEQ ID NO: 109458 - DNA, 2685 bp, Artificial Sequence
  Description of Artificial Sequence: Synthetic coding sequence
atgagccgaagaaaacaggggaatccccagcacctgtcacagagagagcttattactcccgaggctgaccacgtcgaggcagccatactggaagaagacgagggattagaaatcgaggagccctctggactgggcctgatggtgggcggccctgaccctgatctgctgacttgcggacagtgccagatgaatttccctctgggggatattctcgtgtttatcgaacataagaggaagcagtgtgggggaagtctgggagcttgttatgacaaagcgttggacaaagactcaccgccacccagcagtcgctccgagttgcgaaaggtgtccgagccggtggaaatcggaatccaggtcacacctgacgaagacgaccacctgctttctcccaccaagggaatctgtccaaaacaagaaaacatagccgggccatgtcgcccagcccagctgcctgccgtcgcaccaatagcggcaagttcccaccctcattcctcagttattaccagtccactgcgagccctcggcgcactgcccccatgcttgcccctaccatgctgcagcgcgaggcccgtctccggagacggaactcagggcgaaggacagactgaagccccttttgggtgtcagtgtcaactttccggaaaagacgagcccagctcctatatttgcaccacttgtaagcagccctttaactccgcctggtttctgctgcagcacgcgcagaacacccacggatttcggatctacctggagccgggccccgcaagcagctccctgaccccacgactgaccatccctcctcccctcgggcccgaagctgttgcacagtctcctctgatgaatttcctgggggatagcaaccctttcaatctgttgcgcatgacagggccgatcctgagggatcatcccggatttggcgaaggaaggctgccaggaaccccgcccttattttcccccccacctaggcatcacctggacccacacaggctgtccgccgaggaaatgggacttgtggcccagcatccttctgctttcgacagagttatgcgccttaaccccatggcaatagacagccccgctatggacttctctagaaggctcagggagctggcaggaaattctagcactccaccgccagtgagtcccggaaggggcaaccccatgcacagactcttaaacccctttcagccatcacctaagagcccatttctctccacgcctccattacccccaatgcctcctggcgggactcctccaccccagcctcccgccaaatcgaagtcttgtgagttctgcggaaagacattcaagttccagtcaaatctgatcgttcaccgcagatctcacacaggagaaaagccatataagtgtcagctttgtgatcacgcatgttcccaggctagtaagctgaagcgccatatgaagacacacatgcacaaggcaggcagcctggccggtagaagcgatgacggcctgtctgctgcctcctcaccagaaccagggacatccgagctggcaggtgaaggactgaaagccgccgatggggatttccggcatcacgagtccgatccatcactggggcacgagcccgaggaggaagatgaggaagaggaagaggaggaagaagagctgctgctagaaaatgaatctcggccagaatctagtttttccatggattccgaactgagtcgcaaccgggagaatggcggcggtggggttcccggcgttcccggcgccggaggcggtgcagctaaagcactggccgatgagaaagctttggtacttgggaaggtgatggaaaacgtaggcttgggggcgcttccccaatatggtgaacttctggccgacaagcaaaagcgcggcgcattcctcaaacgggctgctggtggaggcgacgccggcgatgatgacgatgctggaggatgcggcgacgcgggtgcgggaggggcggtgaacgggcggggagggggctttgcgcccgggaccgagccgtttccaggcctgtttccacgcaaacctgcccccctcccgtcacccggactgaactctgcggctaaaaggattaaggtggaaaaggacctggaactcccgcccgccgcccttatcccatctgagaacgtgtattcacagtggttggttgggtacgccgcatccaggcatttcatgaaggacccattcttaggctttacagatgctcggcagtccccatttgctacttcctccgagcacagctctgagaatggaagtctgcgcttttcgacgccacccggtgatctcctggacggcgggctgtccggacgttcaggtaccgcgagtggggggagtacacctcatttaggagggcccggtcccgggcgcccgtcctcaaaggagggaaggagaagtgacacttgtgaatattgcggaaaggttttcaagaactgttcaaaccttacagtccatcggaggtcccataccggcgaaagaccttacaaatgtgaactgtgtaactacgcctgtgcccagtcctccaagctgactagacacatgaaaactcacggccaaataggcaaggaagtgtaccgctgtgacatttgtcagatgcctttttccgtttatagcacgctcgaaaaacacatgaagaagtggcacggcgaacacctactgaccaatgatgtgaaaatcgaacaggcagagcgctcctag

SEQ ID NO: 109459 - DNA, 1365 bp, Artificial Sequence
  Description of Artificial Sequence: Synthetic coding sequence
atgcctcgttgtccagccggagctatggacgaggggccggtggatcttagaactagacctaaagccgccggcttgccgggtgccgcactgccactaagaaaaagaccacttcgcgcgccctctccagaacctgccgcccctcggggcgctgctggattggtggtacctctggatcccttaaggggcggctgtgatttgcctgcagttcctggccccccacatggccttgcccgccccgaggccctgtactaccctggagctttgctccctctgtatccaaccagggccatgggctccccctttccattagtcaacctgccaacccccctttatcctatgatgtgtcccatggagcatcccctgagcgccgacatagcgatggcaacgcgggcagatgaagacggcgacactcctctgcacattgcagtggtgcaaggaaatttgcccgcggttcaccgcctagttaaccttttccaacagggcggacgcgagctggacatctataataatctaaggcagaccccgctgcatcttgccgtgattacgacccttcccagtgttgtgagactgttggtcacagcaggtgccagccccatggccctggacagacatggccagacagccgcccacttggcatgcgagcacagaagtcctacttgtctccgggccctgcttgattccgctgcacccggcaccttggatctggaggcgcgcaattatgatgggctgacagccctacatgtggcagtcaatactgaatgccaagagacagtacaactcctccttgagcggggtgccgacatcgatgccgtggacattaaaagcgggcgatcaccattaattcatgccgtcgagaataattctctgagtatggtacagctcctcctccaacacggggcgaatgtgaatgctcagatgtactctggatcttccgcccttcactccgcatccggcagaggcctcctcccgctggttaggactctggtaaggtccggtgccgactcctctctcaagaactgtcataacgacacaccgctgatggtcgcccgctctagacgggtgattgatattttacggggtaaggccactagaccggctagtacatcccagcccgacccttcgcccgacagaagcgccaacacttcacccgaatcatctagtcggctttcgtccaacggcttactgtctgcatcgcccagcagttctccatcacagtcgcctcctcgggaccctcccggcttccccatggcaccgcctaatttttttctcccctctccgtctccgcccgcatttctgccatttgctggggtcttgaggggcccgggtcggcccgtgccaccatcccccgcacccggcggctcctag

SEQ ID NO: 109460 - DNA, 1071 bp, Artificial Sequence
  Description of Artificial Sequence: Synthetic coding sequence
atggaagaggggagggagcggaaccgcagttggcctcctgccgagtgccagagcctgcccagggtgcgccttttcaccccaacaaaagaggagactgctcaacggggagaggtgtttggacaaggccatccggctagagccctactcccactataccccacccgggccatgggttcacctttcccactagtgaacctgccaacacctctttacccaatgatgtgtccaatggagcaccctctctccgctgatatcgccatggctacccgggcagatgaggacggtgatactcctttacacatcgccgtggtccagggaaatctgccagccgtccacagactggtaaatctgttccaacaggggggaagagagctggacatttacaataatctgaggcaaactcccttacacctcgcagtaattaccaccctgccctctgttgtgcgattgttggtgaccgccggcgcctccccaatggctctcgatagacacgggcagacagcggcgcaccttgcgtgtgaacacaggtccccaacatgtctgcgggcactgctggacagtgccgccccggggactctggatttggaagcccgaaattatgatgggctgaccgccctgcacgtggccgtcaatacagagtgccaggagacagtgcaacttttgcttgagagaggcgccgacatcgatgccgtggacataaagtctgggcgaagccccctaatccatgccgtagagaataatagcttgagtatggtgcaactgctgctgcaacatggcgccaatgtgaatgctcagatgtactctgggtcttcagcgctccatagcgcttccggcaggggcttgctcccactagtgcgtaccctggtgagaagcggggcagactcaagcttgaaaaactgtcataacgacacacccctgatggtggccaggtctcgcagagtgtctcgcggaagctgtggtcacgcgccctgtaccagagtgtccgcgggttggctgcaggctagtgtgcctgagcggagaggtgtgagggtgtctgtcccactccgtgggggcgagtgggtctctctgtag

SEQ ID NO: 109461 - DNA, 1440 bp, Artificial Sequence
  Description of Artificial Sequence: Synthetic coding sequence
atgggcagccctgccgcgcccgagggcgctctggggtatgtgagagagtttacaagacactccagcgatgtgctgggcaatctcaatgaactacgcctgcgtgggatcttgactgacgtgaccctattggtgggtggccaacccctgcgtgcgcacaaagcagttctcatagcatgttccgggtttttctattcaattttccgagggagagcgggagtgggagtggacgtgctgtctttgccagggggccccgaagcgcgtggcttcgcacctctactagactttatgtataccagtagactcaggctatccccagcaacagcaccggccgtgttagcagcagctacatacctccaaatggaacacgtggtgcaagcctgtcacagattcatccaagccagctatgaacctctgggcattagcctacgccccctggaagctgaaccaccaacacctcccacggctccgcctcctggcagccctaggcggtcagagggccaccctgaccctcctaccgagtcacggtcatgcagccagggtccaccaagccccgctagcccagatcccaaggcgtgtaattggaagaaatataaatacatagttctgaattcccaggcaagccaggccgggtcattggtgggcgagaggagtagcggccagccatgccctcaggcaagattaccttccggagatgaggcatccagttcttcatccagctcctcaagcagcagcgaggagggcccaatccccggaccccagagtagactaagccccactgcagcaacagttcagttcaagtgcggagcacccgccagcactccctatttgcttacctctcaggcccaggacacatccggcagccccagtgaacgcgccaggccgttgccagggagtgaattcttcagctgccagaactgcgaggccgtggcaggatgctcaagcggtcttgactcccttgtgccgggtgacgaagataagccctacaagtgccaattgtgccggagttcctttcgttataaaggcaatctggcaagtcatagaactgtccatacgggggagaagccgtaccactgctccatttgtggagcccggtttaaccggcccgctaatctcaaaacgcattccagaattcactcaggagaaaaaccatacaaatgtgagacatgtggttctagatttgtacaagtggctcatctaagggctcacgtgctgatacatacaggagaaaagccctatccatgtccaacgtgtggcacccgtttccgtcatctgcagaccctgaagagtcacgtgaggattcacaccggcgaaaaaccctaccattgtgacccctgcggcctgcatttccgacacaaatctcaactccgcttgcatcttagacaaaaacacggagcagccaccaataccaaagtccactaccacattctgggtggcccatag

SEQ ID NO: 109462 - DNA, 129 bp, Artificial Sequence
  Description of Artificial Sequence: Synthetic coding sequence
attcataccggtgaaaagccatatccctgccccacctgtggcacaaggtttcggcatttgcagacactgaaatcccacgtgcggatccacactggtgaaaagccatatcatgaaccagtgacttcctag

SEQ ID NO: 109463 - DNA, 633 bp, Artificial Sequence
  Description of Artificial Sequence: Synthetic coding sequence
atgagcgggcgatctgtccgagccgaaacacggtcccgcgcaaaggacgacattaaaagagtcatggccgccattgaaaaggtgcgcaaatgggagaagaaatgggtcaccgtaggcgacacctcgctgagaatttacaagtgggtgccagtgaccgagcctaaggttgacgataagaacaagaataaaaagaaaggaaaggatgagaaatgtgggtccgaggtgactaccccagaaaattcctccagccccggcatgatggatatgcatgatgataatagcaaccaatcttctatcgctgatgcctcacctatcaagcaagaaaactcctctaactcttctccggcaccagagcccaattccgccgtccccagcgacggtactgaggctaaggtagacgaagcccaggccgatggaaaggagcaccccggggctgaggatgcctcagatgaacagaactcccagagctccatggaacatagcatgaacagtagtgagaaggtcgacagacagcccagcggcgatagtggcttagccgcagagacctctgccatttcccaggatctagagggcgtccccccctcgaaaaaaatgaagctggaggccagccagcaaaactctgaggagatgtag

SEQ ID NO: 109464 - DNA, 696 bp, Artificial Sequence
  Description of Artificial Sequence: Synthetic coding sequence
atgagcgggagaagtgtgagggccgagacaaggtcaagggcgaaggacgacatcaagcgagtcatggccgctatcgaaaaagtgcgtaagtgggaaaaaaagtgggtgaccgtcggcgatacgtccttgaggatatataagtgggtgccagtgactgagccgaaagttgacgacaaaaataagaataagaaaaagggcaaagacgagaagtgtggaagtgaggtaaccaccccagagaactcgtcttcacctggaatgatggatatgcacgatgacaacagcaaccaaagtagcattgccgatgcctcgcccataaaacaggagaatagcagtaattccagccctgccccggaacctaacagtgctgtcccctcagacggcacagaggctaaggtcgatgaagctcaagcagatggaaaagaacaccccggagcagaagacgcttctgacgagcagaactcgcagtccagcatggaacacagcatgaatagcagtgaaaaggtggatagacagccctccggtgattcagggctcgccgccgagacaagcgcgatttcacaggtgccacggtctcgatcccagagagggtcccaaattggccgagaacctatcggcctgagtggcgacctggagggggttcctccctctaagaaaatgaagctggaggcgtcccagcagaactctgaagaaatgtag

SEQ ID NO: 109465 - DNA, 528 bp, Artificial Sequence
  Description of Artificial Sequence: Synthetic coding sequence
atggccagtagaaaagcaggtacaaggggcaaagtggctgctactaagcaggcccagcgggggagcagtaatgtgttctccatgtttgagcaggctcagatccaagagtttaaagaggcttttagctgcatcgatcagaacagagacgggatcatctgcaaagccgacctgcgcgagacctacagtcagctgggcaaggtgagcgttcctgaggaagaactagatgccatgcttcaggagggtaagggtcctatcaactttactgtctttttaactctgtttggcgagaagctgaatgggactgatccggaggaagccattctttctgcttttcggatgtttgacccatccggtaaaggagttgtgaacaaagatgaattcaagcaactgctcctcacgcaggccgataagttcagtcccgctgaagtggaacaaatgttcgccctgacccctatggatctggcagggaacatcgattacaagagcttgtgttatatcatcacccacggcgacgaaaaggaggaatag

SEQ ID NO: 109466 - DNA, 438 bp, Artificial Sequence
  Description of Artificial Sequence: Synthetic coding sequence
atgtccggcaggtctgttcgcgccgagactaggtctcgagccaaggacgatatcaaaaaggtgatggcagccatcgaaaaagtgcggaaatgggagaaaaagtgggttaccgtcggcgacacgtcactcagaatctttaaatgggtgcccgttactgactcaaaagagaaagaaaaatctaagtccaactctagtgcggctagggaaccaaacggcttcccatctgatgctagcgccaattcgtccctcctactagaatttcaggaaccgtcactgccctcgtcagaagtggcagacgaacctccaacgctgaccaaagaagagccagtgccactggagacacaagtggtggaggaggaagaagactccggggcaccacctctgaagagattttgtgtggatcagcctaccgtccctcagacagcctcagaatcatag

SEQ ID NO: 109467 - DNA, 867 bp, Artificial Sequence
  Description of Artificial Sequence: Synthetic coding sequence
atgaaggatagaactcaggaattaaggagtgccaaggacagtgatgacgaggaagaggtggttcacgtggaccgcgaccactttatggacgagttctttgagcaggtggaagagattcgtggctgcatagagaaactcagtgaggatgtggagcaggtgaaaaaacagcatagtgctattttagctgccccgaaccccgacgagaagactaagcaggagctcgaggacctgaccgcagacatcaagaaaactgctaacaaagtgcggagcaaactcaaggcaatcgagcagagtattgagcaagaggagggtctgaaccgttcctcggcagatctgcgtattcggaagacacagcactcgacactttcccggaagttcgtcgaggtgatgaccgagtataatgccactcagagtaaatatcgtgatcgatgtaaagacagaatacagcgacagctagaaattactggaaggactaccaccaacgaggagctagaggacatgctcgagagcggaaaactcgccatattcacagacgatattaaaatggacagccaaatgactaagcaggccttgaacgaaatcgagacgcggcataatgagattatcaagctggagacgtccattcgggaactgcatgatatgttcgtcgatatggcgatgttagtcgagtctcagggcgaaatgatcgatcggatagagtacaacgtcgagcactctgtcgattatgtggagcgggccgtctccgataccaaaaaggccgtaaaataccaatccaaagcacgcagaaaaaaaattatgatcataatctgctgtgtcgtgcttggcgtggtgctagcctcatcaatcggagggaccctgggtctatag

SEQ ID NO: 109468 - DNA, 729 bp, Artificial Sequence
  Description of Artificial Sequence: Synthetic coding sequence
atggcagggcggacggtaagagccgaaacacgcagccgcgctaaggatgatattaaaaaggtcatggccactatcgagaaagtacgcagatgggaaaagcggtgggtgacagtaggagacacttctctgcgcatctttaaatgggtgccagtcgtagaccctcaggaggaggaaaggcggagagcaggcgggggggctgaaagatccagaggtcgggagcgcaggggtcgcggagcctcaccaagaggagggggccccctcatccttctcgacctaaacgacgaaaacagtaatcagagcttccattcagaaggctcactccaaaagggaacggagccctcaccggggggtacaccccagcccagccgcccagttagcccggctgggccccccgagggagtgcctgaggaagctcagcctcctaggctgggccaagaacgcgaccccggtgggatcactgctgggagcactgatgagcccccaatgctgacaaaggaagaaccggttcccgagcttctggaggccgaggactcaggggtgaggatgacacgtagggccctccacgagaagggcctgaaaaccgagccattgcggcgcctactcccgaggagaggcctcaggaccaatgtccggcccagcagtatggctgtccccgacactcgcgccccaggtggcggatcaaaggcccctagggccccgaggaccattccccagggtaagggaagatag

SEQ ID NO: 109469 - DNA, 1680 bp, Artificial Sequence
  Description of Artificial Sequence: Synthetic coding sequence
atgcattcgtttatacatgccgccatggggatggtcatggcttggtgcgccgccgtcatcactcagggccagtattcgtttttggtggtgccttgtactggcactaactccttcggatcgcctgcggcccaaacttgcctgaatgaataccacttgttcttcctcctgaccggggcattcatgggatatagttactcactgctctactttgtgaacaatatgaattatctgcctttccctattatccagcagtacaagttccttcgcttccgccggagcttgctgctccttgtcaaacatagctgtgtagagtcgctattcttagtacggaatttctgcatactttactactttcttggttatatcccgaaagcttggatcagcacagcgatgaatctccacatcgacgagcaggtacatcggcccctcgataccgtcagcggtctattgaatctttccttactctaccatgtctggctgtgcggagttttcctgctgacaacctggtacgttagctggatcttgttcaagatctatgcgacagaagcacatgtgttccccgtgcaaccgccattcgctgaagggtccgacgagtgccttccaaaggtcctgaatagtaacccaccccccataatcaaatatcttgccctacaagacctgatgttgctgtcccaatattcgcccagccgaagacaggaagtgttctccttgtcccagccaggcggccatccgcacaattggactgctattagtcgtgaatgtctgaacctcctaaatggcatgactcagaaactgattctctatcaagaggccgccgctactaatgggcgtgtatctagcagctatccagtggagcctaagaagttgaattcaccggaggagacagcctttcagacacccaaaagtagccagatgccccgcccaagcgtgcctccccttgtgaagacctccctgttctctagtaaactgagcaccccggatgtcgtgtctccattcggaactcccttcggtagcagcgtgatgaaccggatggcaggtattttcgacgtcaacacatgttacggcagcccccaaagtccccagctcatacggcgtggcccaagattgtggacatcagctagcgaccaacaaatgactgaattctcaaatccctccccaagtacatccatttccgccgagggcaagacaatgaggcagccctcagtgatctattcttggattcaaaataaaagggagcaaatcaagaattttctgtccaagagggtgttgataatgtacttcttctcgaaacatcccgaagcatcaattcaagccgtgttctcagacgcacagatgcacatttgggccctcgagggcttgtcgcatctagtcgccgcgtctttcactgaggatcgtttcggggtggtgcagaccactctccctgctattctgaacacactgctgactctgcaagaggctgtggataaatatttcaaactgcctcatgcatccagtaagccaccccggatctccggcagtctggtggatacatcttacaaaaccctgagattcgctttccgggcctctctaaagaccgctatctatcgcatcactacaacatttggcgaacacttgaacgccgtccaggcatcagccgagcaccaaaaaagactgcagcaatttcttgagttcaaggagtag

SEQ ID NO: 109470 - DNA, 4500 bp, Artificial Sequence
  Description of Artificial Sequence: Synthetic coding sequence
atgaggatcctcgcaaacaaaacccgtctgcctcatcctcggcggagagaagcccccggttctcctccgctgtcaccacgaggccactgtcctcccgcacctgctaaacccatgcatcccgagaacaagctgaccaaccatggaaagacgggcaatggcggggcccagtctcagcatcaaaatgtcaaccaagggcccacctgtaacgtggggagtaaaggcgttggcgctggcaatcatggagctaaagccaaccagatcagtccatctaatagcagcttgaagaacccacaagctggtgtaccgcccttttcctctctcaaagggaaggtcaagcgggatcgttccgtgtcagtggacagtggggaacagcgggaggccggaacaccatcgttggattcagaggcaaaagaggtcgctccgcggtcaaaacgacgctgcgttctcgagcgaaagcagccatacagcggcgatgaatggtgctcaggccccgattcagaggaggatgataagccaattggagccacacataattgcaacgtagccgaccctgccatggctgcgccacagttgggacctggccagacgacacagctgccactgtcagagtcatctgtgccgggagctccacacggacctccacccggtctccggcctgatgctccggggggaggtgggggcggtggtggggtccccggaaaacccccaagccaattcgtctacgtctttactactcacctggcgaatactgccgcggaagccgtcctccagggcagagctgatagtattttggcctaccaccaacagaacgtaccgcgtgcgaagctcgaccaggcacccaaagttccacctacccccgagcccctgccgctgtctacaccctctgcaggaaccccccagtcacagcctccccccctccctccccctccgccgccagccccagggagtgcgcccccggccctacctcccgaagggccacccgaagactccagtcaggatctcgcgccgaattcggtcggggcagccagcaccgggggaggaactggggggactcaccccaacacccctacggccacaactgccaataacccactgccacctggtggagatcccagctccgcgcccgggccagctctgctcggtgaagccgcggcaccaggaaatggacaaaggtcacttgtgggatcagagggcctctcaaaggaacaacttgagcaccgtgagcgctcactgcaaactctgcgggacattgaaaggctgttattaagaagtggggaaaccgagcctttcctgaagggccctccagggggtgccggcgagggaggcccacccgcacaggcccctcctcccccccagcagcctccaaccgctccaccaagcggattgaaaaagtatgaagagccactccaatccatgatctcccagacccagtcactgggggggccaccattggagcacgaggtacccggacatccccccggcggagacatggggcagcagatgaacatgatgatccagaggcttgggcaggattccttgacaccagagcaggtggcatggcggaagctgcaggaagagtactacgaagaaaaacggcggaaagaggagcagataggtctacatgggtcaagacctctgcaggatatgatgggcatgggaggaatgatggtgcgcgggccacctcccccctatcactcaaagccaggggatcagtggccccccggcatgggggctcaactcaggggccctatggatgtgcaggaccctatgcagctgagagggggtcctccttttcctggcccccgatttcccgggaatcagatccagcgagtcccaggattcggcggcatgcagagcatgccaatggaggtgcccatgaatgcaatgcaacgcccagtgaggccggggatgggctggactgaggacctccccccaatgggggggccgtctaacttcgcccagaatacgatgccctacccaggaggccagggagaggccgaaaggttcatgacacccagagtgagagaggagcttttgcgtcaccagttgctcgagaaaagatccatggggatgcaacgtcctttgggcatggccggttcaggcatgggtcagtctatggagatggagcggatgatgcaggcccaccgccagatggatcccgccatgttccccggacagatggctgggggggaaggtcttgctgggacgccaatgggaatggagttcggcggtggccggggtttgctctccccacctatgggccagtctgggttgcgggaagtggaccctcccatgggtccaggaaatcttaatatgaacatgaatgtgaatatgaacatgaatatgaatcttaacgtgcagatgactccccagcagcaaatgttaatgtcccaaaagatgcgcggaccaggagacctgatgggcccccaagggctgagccctgaggagatggctcgcgtccgcgcgcagaactcttccggggttatgggggggcctcagaagatgctaatgccctcccagttccccaatcagggtcagcagggattcagcggagggcaaggcccgtatcaggcaatgtcccaggacatggggaatacacaagacatgtttagccctgaccagtcctcaatgccaatgagcaacgttggaactacacggttaagccatatgccacttcctcccgctagcaacccccccggtacagtccactcggcccccaaccgtggcctcggaaggagacctagtgacctgaccatttccatcaatcaaatggggtcaccaggcatggggcacttgaagagtccaacactgagccaggtgcatagccccctggtgacatcaccaagtgctaacctgaagtctccacagacaccttctcagatggttcccctcccgagcgcaaatcctccgggacccctaaagtccccccaggtgctaggaagctccctgtccgttcggagtcctacggggtctccctcacggctgaagtctccttccatggccgtgcccagcccaggctgggtggcatcaccgaagaccgccatgccaagccccggagtgtcccagaataaacagccacccctgaacatgaacagcagtacaactctgtctaatatggagcaaggcaccctccccccctctggcccacgcagcagcagcagcgcacccccagcaaaccccccttctggcctgatgaaccccagcctgccctttacgtcatctccggaccccacgccaagtcagaaccctctctcactgatgatgacgcagatgagtaagtacgccatgccttcaagcacgccactgtatcataatgccatcaagacaatcgccacaagcgacgacgagcttctcccagatcgtccattactgccaccgccaccccccccccaggggtcaggaccaggcatatctaattctcagccctctcagatgcaccttaactcagccgctgctcagtccccaatgggaatgaacctacccgggcagcagccactgtctcacgagcccccccctgccatgcttccatccccgaccccactcggcagcaacataccgctgcatccaaacgcccagggaactggcggaccgccccagaactctatgatgatggctcccggaggccccgacagtctgaatgccccatgtgggccagtgccttctagcagccagatgatgccatttccaccgaggttacaacaaccccatggtgcaatggcacctactggcggtggcggtggaggaccaggcttacaacaacactaccccagcggaatggccctgcccccagaagatctgccaaatcagccgcccgggcccatgccaccccagcagcacctaatggggaaagccatggccggacgaatgggagatgcttatccccccggtgtattgcctggcgtagcctccgtgcttaacgaccctgagctctcagaggtcatcagaccaacacccactgggatccctgaatttgatctgagccgcatcataccttctgagaaacccagttccaccctgcaatacttcccaaagagcgagaatcaaccgccaaaggctcagcctcctaatctccacttgatgaatctgcagaacatgatggctgaacaaacaccctctcggccaccaaatctcccggggcagcagggggtgcagcggggcttaaatatgagtatgtgccatcccggtcagatgtccctgctcgggcgcactggggtgcccccccagcaggggatggttcctcatggcctgcaccaaggtgtgatgagtccccctcaagggcttatgacccagcagaattttatgctgatgaaacagcgaggcgtgggtggtgaggtttattcccaaccacctcacatgctctctcctcagggttccctaatggggcccccgcctcagcagaatctcatggtttctcaccctttgcgacaacggtccgtgagcctggacagtcagatgggctacttacccgcacccgggggaatggccaatctgccattttag

SEQ ID NO: 109471 - DNA, 4188 bp, Artificial Sequence
  Description of Artificial Sequence: Synthetic coding sequence
atgcggattctggcaaacaagacccggctgccccatccgaggcgccgggaagcccccggctctccacctctgagcccaagaggacactgtcctcccgcacctgcgaagcctatgcatcccgagaacaaactgactaatcatggaaagaccggtaacggaggagctcagtctcaacaccaaaatgtaaatcagggacctacctgcaacgtgggtagtaaaggcgtgggagccgggaatcacggagcgaaggctaaccagatctctccctccaacagtagcctgaaaaatcctcaggcgggtgttcctccctttagttcactcaagggcaaggtgaaaagagatcgatccgtctccgttgatagcggcgagcagcgagaggcgggtacaccgagccttgactcagaagccaaagaagtggcccctcgcagcaagaggcggtgcgtgttggagcgaaaacagccttacagtggcgatgagtggtgcagtggcccagacagcgaggaggatgataaaccaattggtgcgacacataactgtaatgtggccgatcccgcaatggccgcacctcaactcggtcctggtcagaccacccagctgccactctccgagagcagtgtcccaggtgcgccacacggaccccctcctggtctgcgacccgacgccccaggcggcggaggaggcggcggcggcgtgcctggaaagcctccctcgcagttcgtgtacgtttttaccacacatctggccaacacagccgctgaagccgtgctgcaggggcgtgctgatagcatcttagcttatcatcaacagaatgtgccaagggccaagctggatcaggctcccaaggtgcctccaacacctgaacccctgcctttatccacgcccagtgccggaactccacagtctcagcccccccccctgccacctccacctccacctgcgccaggttcggcgcccccagcccttccccccgagggcccccctgaagacagctcacaggatttagctcccaattctgtgggagccgcatctacgggcggtggcacaggtggcactcacccaaatactcctactgcaaccaccgctaacaacccccttccccccggcggggatccttcttccgctcctggcccagctctgttaggcgaagcagcagcccccggcaacggtcagcggagcctggtgggtagcgagggactgtccaaagagcagttagagcacagggaacgctctttgcaaactctgcgagacattgagaggctactgctgcggtctggcgagaccgagccatttctcaaaggacctccaggcggcgctggtgagggtggcccacctgcccaggctcccccacccccacagcagccgcctaccgcccctccctcagggcttaagaagtatgaggagcccctccaaagtatgatttctcaaacccagtcccttggcggcccccccttagaacacgaggtgccgggacaccctccaggtggggacatgggtcagcaaatgaacatgatgattcagaggctgggacaggactctctcactccagaacaggtagcctggcgtaaactccaagaggaatattatgaggaaaaaagacgcaaggaggagcagattggcttgcatggcagccggcccctgcaggacatgatgggaatgggaggtatgatggtgcgggggcctccgcccccgtatcatagcaagcctggagaccagtggcctcccggcatgggggcacagctgcggggccccatggacgtgcaggacccaatgcagctccgcggaggccccccttttcctggaccacgctttcctggcaatcagatccagagagtccccggatttggaggaatgcagagcatgcctatggaggtgcctatgaacgccatgcagcggccagtacggccgggaatgggatggaccgaagatctgcccccaatgggaggtccttcgaattttgctcaaaacaccatgccgtatcctggtggccagggtgaagccgaacggttcatgacaccgcgggtgcgggaagaacttcttaggcaccaactcttagagaagcgctccatgggtatgcagaggccactcggaatggcgggtagcggaatgggacagagcatggagatggagaggatgatgcaggcacacaggcagatggatccagccatgtttccaggtcaaatggcggggggtgagggcctggccggaacacctatgggtatggagtttggcggaggccggggactgctatcgccaccaatgggtcagagtggactgagagaggtagaccctcccatgggaccagggaatctcaatatgaacatgaacgtgaatatgaacatgaatatgaacctaaatgttcaaatgactccacagcaacagatgctgatgtctcagaaaatgcggggacctggtgatctgatggggccccagggcctgtccccggaggagatggcgcgcgttagggcacagaacagtagcggcgtcatggggggtccacagaagatgctgatgccttcccagtttccaaaccaggggcagcaggggttttccggcggacagggcccctaccaggcaatgtcgcaggacatggggaacacacaagatatgttttcccccgaccagtcttccatgccgatgagtaatgtagggactacacgcctgtcccatatgcccctgccacccgcctccaacccacccgggactgtacactcagcaccaaatagggggcttggtcgtcgacctagtgaccttaccatctctatcaaccagatgggctcccccggtatgggccacctcaagtctcctaccctatcgcaagtgcatagccccctggtgacatctcctagcgccaacctgaagtcccctcaaacaccttctcagatggtgccgttgccgtcggcgaatccaccaggccctttaaaatccccgcaggtgctagggagcagtttgtctgtgcggagtcctacagggagtccaagtcgcttgaaaagtccatcgatggccgtgccttccccagggtgggtggcttcccccaagacagcaatgcccagtccgggcgttagtcagaacaaacagccccccctcaatatgaatagctccactactctaagtaatatggaacagggtactctgcccccttcagggccacgaagctccagctccgccccacccgctaaccctccatctggtctcatgaaccccagccttcctttcactagcagtcccgatccaaccccatcacagaaccccctgtcactcatgatgacacaaatgtccaagtacgccatgcccagcagcacccccctttatcacaacgcaattaagactatcgctacctcagatgatgagctgttaccagataggcctctattgcccccaccacctccaccacaggggtctggccctggcatttcaaactctcagcctagccaaatgcacctaaatagtgccgcagcccagagtcctatgggtatgaacctaccaggccagcagccgctcagtcacgaaccccctccagcaatgctgccttctcctacaccattggggagtaatattccccttcacccaaatgcgcagggtacaggtggccccccacaaaacagcatgatgatggccccggggggcccggatagccttaatgcgccctgtgggcccgtgccctcgtcgagtcagatgatgccttttccaccgagactccaacagccgcacggcgccatggcaccaactggtggtgggggcggaggcccgggccttcagcagcattacccgtctggcatggctctaccccctgaggaccttcccaaccagcctccggggccaatgccccctcagcaacaccttatgggcaaagccatggccggcaggatgggagacgcctatccccctggcgttcttcccggcgtggcttcagtgctaaatgacccagagttgtccgaagtgattagacccacacccaccgggatccctgaatttgatctatcacggatcatcccttctgaattcctgcgtaccaggcctttcagcttttgtctgtacctactccgcattctttctctactgatgtggctcacccctctgccgcccctgcctgccggaggctggcctggcggtcaagtacccgctggcgcagttaacagggctctacgcttttgtgcgggtttgtgtgtctgttgcatctctgtgttttag

SEQ ID NO: 109472 - DNA, 4365 bp, Artificial Sequence
  Description of Artificial Sequence: Synthetic coding sequence
atgaggattttagctaacaagacccggctgcctcatcccaggagacgggaagcaccggggtcacccccgctttcgccccggggacattgccctccagctcccgcaaagcccatgcacccagagaacaaactcaccaatcacggcaaaacagggaatggcggcgcgcaaagtcagcaccagaacgttaaccaaggtcctacatgcaatgtaggcagcaagggggtgggtgcaggaaaccacggggcaaaggcaaaccagattagccctagtaactcttctctcaagaatccacaggctggagtccctccttttagcagcctgaagggcaaggtcaagagagaccggtctgtgagcgttgactcaggggagcagcgcgaagccgggaccccatccttggactctgaggccaaggaagtcgctccacgaagcaaacgccgttgtgtactggaacgaaaacaaccgtacagcggggacgagtggtgtagcgggcccgactccgaagaggatgataagcccatcggcgctacccataattgcaatgttgcggacccagccatggccgctccccagctgggcccagggcagacaacacaactgccactcagcgagagtagtgttcctggagctccccatggacctcctccgggactgaggccggacgcgcctgggggaggaggcggaggaggcggggtacccggaaagccccctagtcagtttgtctacgttttcaccacccatctggccaataccgcagctgaagctgttctacaaggtcgggcagatagcattctggcataccaccagcagaacgtacctcgagcaaaacttgaccaagcccccaaggtgccccctacgcctgagccattgcccttaagcaccccaagcgccggtacgcctcagagtcaaccgccgccgttgccacctcctccccccccagccccaggctcagccccaccagctcttccaccagagggcccgcctgaagacagttctcaggacttggctcctaatagtgtaggagctgcgtccaccggcggtggcaccggcgggacacaccctaacactccgacagcaacaaccgctaataatcccctgcctcctggaggtgaccctagcagcgcaccggggcctgctttactgggggaggcagccgcgccaggcaatggccagcgatctctcgtcggatccgaaggactgtccaaggaacagctcgagcacagggagagaagtttacagacattgcgggatatcgaacggctcttgcttagatctggtgagacagaaccgttcctcaaggggccacctggcggcgcaggagaaggcggcccccctgcacaggcccctccacccccccagcagcctcctaccgcacctcccagcggattgaaaaaatacgaggaacccctccaaagtatgatctcacagacccaatccctgggaggtccgcctctggaacatgaggttccaggtcaccctcctggcggggacatgggtcaacagatgaacatgatgatacagcgcctcggccaggacagtctcactccagagcaggtcgcctggcgcaaactccaggaagagtattacgaagagaaacgcaggaaagaggagcagatcggcctgcacggcagcaggcctctacaggatatgatggggatggggggtatgatggtccggggtccccctcctccctatcactcaaaacctggcgaccagtggccccccggcatgggcgcgcagttaaggggtccgatggacgtacaggaccctatgcagctgaggggaggacccccgttccccggtccacgcttccccggcaaccaaatacagcgagtaccaggatttggtggcatgcagtccatgcccatggaagtcccaatgaacgccatgcagagacccgtaagacccggaatggggtggacagaagatctcccccctatgggaggtcccagtaacttcgcccagaatactatgccttaccctggcggccagggggaggcagagcgttttatgacccctcgggtacgcgaagaactcctaaggcaccagctgctggaaaaacggtccatgggtatgcagcggcccctgggcatggccggatccggaatgggtcagtccatggagatggaacggatgatgcaggcgcatagacagatggatcccgctatgtttcctggccaaatggccggaggcgaaggactggcgggcacaccgatgggcatggagttcggcgggggacgaggccttctatcacctccaatgggccagagcggcttacgggaggttgaccctccaatgggcccgggtaaccttaacatgaacatgaatgtcaatatgaatatgaatatgaacttaaacgtgcaaatgacccctcagcaacagatgttgatgagccaaaaaatgaggggccctggcgacctaatgggcccgcagggattgtctcctgaagagatggcccgagtccgagcacagaactcatcaggcgtaatgggcggtccgcagaagatgctcatgccctcacagttccctaaccaaggtcagcagggttttagcggagggcagggcccctaccaggcgatgtctcaggacatgggcaacacgcaggacatgttttcacccgatcagagtagtatgcctatgtctaacgtagggacaaccaggctgagtcatatgcctctgccacccgcatctaacccacccggtaccgttcacagcgcacctaataggggactgggccggcgtccctcggatctcactatctcaattaaccagatgggttctcccggaatggggcatctcaaatcaccaactctgtctcaggtgcattctcccctcgtgacctctccctccgcaaatctcaaatctccccagaccccaagccagatggtacctctaccttccgctaatccacccggtcctctcaagtcaccacaagttctcggatcgtccctctcagtgcgatctcctacaggtagtcccagtcggcttaagagccccagtatggcggttccatcccctggatgggtggcctcccccaagacagccatgcctagccctggcgtcagtcagaacaaacagcctccccttaatatgaacagcagtactaccctgagtaacatggagcaagggacattgcccccatccggtccacggtcctccagctccgcacctccagcgaatccgccatcaggattgatgaacccatcactcccattcacttcatcccctgaccctaccccatcccagaacccgctgtcactgatgatgactcagatgtcaaaatatgcaatgccctcatccacccctctgtatcataatgcgattaaaactatcgctacgagcgacgacgaactgcttcccgatagacccctgctgccccccccaccccctccccaggggagtggaccggggatttcaaattctcagccaagccagatgcatctgaactcggccgcggcccagagtcctatgggaatgaacttgcccggacaacaacccctgtcccatgagccccctcctgccatgttaccctctcccacccccctaggctccaacattcccctccatccaaatgcccaaggaaccggcgggcccccccagaacagtatgatgatggctccggggggaccggactccctgaacgcaccatgtggtcctgtgccatcttcatctcaaatgatgcctttcccaccaagactccagcagccccatggcgccatgatggccgggcgcatgggagacgcttaccctccaggagtgctgcctggagtcgccagcgtgttaaacgaccccgaactttcagaagtgattcgcccgactcctaccggcattcccgaattcgatctgtccagaatcatcccctctgagaagccaagtagtaccctgcaatactttcctaagtccgagaatcagcccccaaaagcccagcccccaaatttgcatctaatgaatctgcagaacatgatggcagaacagacaccatcaaggcccccgaatctgcctggacagcagggtgtgcagcgtggccttaatatgagtatgtgtcaccccggccagatgagcctattgggtaggactggggtgcctccccagcagggaatggtgccccatgggttacatcagggcgttatgagtccgccccaggggcttatgactcaacaaaatttcatgctgatgaaacagagaggggtaggcggtgaggtgtactcccagccacctcacatgctgtcccctcagggatcattgatgggccctcctccccagcagaacctaatggtttcccatcctctaagacaacgctccgtgtcacttgattcccagatgggatacttacccgcccccggcggaatggctaacctgccgttctag

SEQ ID NO: 109473 - DNA, 1401 bp, Artificial Sequence
  Description of Artificial Sequence: Synthetic coding sequence
atgtcgacacggagcgtgtcatcaagctcatatcgtagaatgtttggtggtcccggtaccgcctccaggccttcctcaagtagatcctacgtcacaacctctactaggacctactctcttggttcagctttgaggccctcaacctcgagaagtctttatgcctccagccctgggggcgtatacgcaactaggagttctgcagtccggcttaggagttctgtgcccggtgtgcggctcctacaggattccgtcgacttcagcttagccgacgctatcaatacagaatttaaaaacacacggaccaatgagaaagtggagttgcaggaactgaacgatcggtttgcaaattatatcgacaaggtgcggtttttggagcagcagaacaaaatccttctcgccgagctggagcagttgaaaggtcagggcaaatcccgtttgggtgacctgtatgaggaagagatgcgggaactccgaagacaagtggaccaattgaccaacgacaaggcccgggtagaagtggagagagacaaccttgcagaggacatcatgcgcctccgagaaaagctgcaggaagagatgttacaacgggaggaggctgagaacaccctccagtcatttcggcaagacgttgataacgcgtctctggcgcgactggatcttgaaaggaaggtcgaatccctgcaagaggaaatagcattcctgaaaaagctccatgaagaagagatccaggagcttcaggcccaaattcaggagcagcatgtgcagattgatgtggacgtgtccaagcccgatcttactgccgctcttcgggatgtccgtcagcagtatgaaagcgtggccgctaagaaccttcaggaagctgaagaatggtacaagtctaagtttgcagatcttagcgaagccgcgaacagaaacaatgatgcgctcagacaggctaaacaagaatccaccgagtaccgtagacaagtgcaaagcctgacctgtgaggtggatgccctcaaaggcacaaacgaatccttagagcgccaaatgagggagatggaagaaaacttcgccgtggaagccgccaactatcaggataccattggccgacttcaagatgaaatccagaatatgaaggaagaaatggcacggcatctgcgagaatatcaagacctgctgaatgtgaagatggccctcgatattgagatcgccacttatagaaaactgctcgaaggagaggagagccgcatatcattgccactgcccaacttttcgtcacttaacctgcgggagacaaacttagattctctgcccctggtggatactcatagtaaacgtactctgctgatcaaaaccgttgaaactagggatgggcaggtaattaatgagacaagtcaacatcatgatgatctggaatag

SEQ ID NO: 109474 - DNA, 1302 bp, Artificial Sequence
  Description of Artificial Sequence: Synthetic coding sequence
atggacaagttgaacaagattactgtgcctgccagccaaaaactgaggcagctgcaaaaaatggtgcacgacatcaaaaataatgagggcgggataatgaataaaattaagaagcttaaggtgaaggcgcctccttcggtgcctaggagagactacgcgagcgaatctccagcagatgaagaggagcaatggtcggacgatttcgactccgactatgagaaccctgacgagcatagtgactccgagatgtatgtcatgcccgctgaggagaatgccgatgactcatatgagccaccccctgtcgagcaagaaacccgcccagtccaccccgcactacctttcgcaagaggcgaatacatagacaaccgctccagccagagacatagccccccgttttcaaaaacactgccttctaaaccttcttggccttctgaaaaagctcgcctcacatctacacttccggcacttacggcactgcagaaaccacaggtgcctccaaaaccgaagggacttctcgaggatgaagctgactacgtggtgcccgtggaagacaacgacgagaactatatccatccaaccgagtcttccagccctcctccagagaaaggtcggaatagcggtgcatgggagacaaagtctccaccaccagctgccccatcccctctacctcgagccgggaagaaacctactacccctctcaagaccacccccgttgcctctcagcagaacgcgtcaagcgtgtgcgaggagaagccaattcccgcagagaggcaccgcggctcttctcaccgccaggaggccgtgcagagtccagtctttcccccggctcaaaaacagattcaccagaagcccatccccctgccacggttcactgagggcgggaatcccacagtggatggcccactgccctctttctcctcaaactcaacaatctctgaacaggaggccggggtgctgtgtaagccatggtacgccggcgcctgtgaccggaagtctgcggaggaagcacttcacaggagcaacaaggacggttctttcctgattagaaaaagttctgggcacgatagcaaacagccttacactttggtcgtctttttcaataagagagtgtacaacattccggtccggtttatcgaggccactaaacaatacgccttaggccggaaaaagaatggtgaagagtatttcggcagcgtggcagaaattatccgtaaccaccagcactcacccctggttcttatcgattcccagaataatactaaagacagcacaagactcaagtatgccgtcaaagtatcctag

SEQ ID NO: 109475 - DNA, 525 bp, Artificial Sequence
  Description of Artificial Sequence: Synthetic coding sequence
atggataagctcaataagataaccgtgcctgcatctcagaaattgcgacagctccagaaaatggttcacgacattaaaaacaacgaaggcggcatcatgaacaagattaaaaagctgaaagtcaaggcccccccctcagtcccacggcgtgattatgcttctgagtcccctgccgacgaggaagagcagtggagcgacgatttcgactcggactacgagaacccagatgagcattctgatagtgagatgtacgtgatgcctgctgaagaaaacgccgacgactcatatgaacccccccctgttgaacaagagacacgcccggtacatccggctttacccttcgccaggggcgaatacatcattttcctctgtgacctgttgaagcagcagaataacatgccttgggctgagcgaaagatggttaaaagcactctggaggtgctgctgaagtctagcggaattatcaacattgtcctgtggttccttcttacagtcagaataacacagaaaatcccacccgactag

SEQ ID NO: 109476 - DNA, 558 bp, Artificial Sequence
  Description of Artificial Sequence: Synthetic coding sequence
atggataagctcaacaagattaccgtgccggcaagtcagaagctgcgccagctgcaaaagatggtgcatgatatcaagaacaacgaaggagggatcatgaacaaaattaagaaactgaaagtgaaggccccaccctccgtgccgcggagggattacgcaagcgagagccccgcggatgaagaagaacaatggtccgacgatttcgacagtgactacgagaatccggatgagcactctgattctgaaatgtatgtgatgcccgcagaggaaaacgcagacgacagttacgaacctcctcctgtggagcaagagacccggcctgttcacccagctctaccattcgcacgtggagagtacatcgacaacaggagctcacagcgccacagcccacccttttcgaagacgttgccaagcaagcctagctggccctctgaaaagtacttcgggagtgttgccgagattataaggaaccaccagcattccccattagtgctgattgactcccagaacaacactaaggactcaacacgcttgaagtatgccgtcaaggtaagctag

SEQ ID NO: 109477 - DNA, 204 bp, Artificial Sequence
  Description of Artificial Sequence: Synthetic coding sequence
ctcgactcgtattcatgtctgctgcagctgccgaatcgtatggataagctcaataaaataacagtcccagctagccagaagcttcggcagctgcagaagatggttcacgacataaagaataatgaaggcggcatcatgaacaagatcaagaaaacagccaccatgaagattcagatgagcactcgaactcaacgctgtacctag

SEQ ID NO: 109478 - DNA, 1215 bp, Artificial Sequence
  Description of Artificial Sequence: Synthetic coding sequence
atggataagctgaacaaaattacagtccctgctagccagaaattgcggcaactgcagaaaatggtccacgacatcaaaaataacgagggtggcatcatgaataagattaaaaaattgaaagttaaagcccctcctagcgtgcctcgcagagactacgctagcgaatctccggccgacgaggaggagcaatggtccgatgattttgacagtgactatgaaaaccccgatgaacactcagactcggagatgtacgttatgcctgctgaggaaaatgccgacgatagctatgagcccccccctgtggagcaggaaacgcgacccgtccaccccgccctgccttttgctaggggtgagtatattgacaacagatcttctcagagacatagtccaccattctccaaaactctcccttctaagcctagctggcccagtgagaaagcgagactgacttctaccttgccagcgctgacagctctccagaaaccccaggtgcctccaaaaccaaagggcctcctggaagacgaggctgattatgtggtgcctgtagaagacaacgatgagaattatatccatccgactgaaagtagtagcccaccacctgaaaaagccccaatggtaaacagaagtacaaaacctaactccagcacacctgcttcaccacccggaaccgcatcggggagaaattccggggcttgggagacaaaaagcccaccccctgccgcgccttcaccgcttccaagggcaggtaagaaacccacaacccctctgaagacaacacccgtagcatctcagcagaacgcctcgtccgtatgtgaggaaaaacccattcccgcggagcgtcacaggggcagtagtcaccgccaggaggcggtgcaaagccccgttttcccacccgcacagaaacagatccaccagaaaccaatccctttgcctcgctttacagaagggggtaacccaaccgttgatgggcccctgcctagcttcagttctaacagcacaattagcgagcaagaggccggagttctgtgcaagccatggtacgccggagcctgcgatcgtaagtctgccgaagaagctttgcatcgcagcaacaaatacttcggctcagtggccgagattattagaaatcaccagcacagtccattagttctcattgattcccaaaataatactaaggactccacacgcctgaagtacgcggtgaaggtttcttag

SEQ ID NO: 109479 - DNA, 1266 bp, Artificial Sequence
  Description of Artificial Sequence: Synthetic coding sequence
atggacaagcttaataaaataacggtgcctgcatcccagaagttgaggcagctgcagaaaatggtccatgacattaaaaacaatgaggggggcatcatgaataagatcaagaaactgaaagtcaaagcccctcctagtgtgccgcggcgggactacgcatcagagagccctgccgatgaagaagagcaatggtctgacgattttgactccgactatgaaaacccggatgaacactccgattccgagatgtatgtcatgccggcagaggagaatgccgacgattcttatgagcctccgccagtagagcaagagacaagaccagtgcatccggcgctgccttttgctcgcggcgaatatattgacaatagatcctcacagcggcactcaccccccttctccaaaacccttccctcaaagccatcatggcccagcgagaaggcaaggttaacatctacgctgcccgcactgactgccctacagaagccacaagtgcctcctaaacccaagggcctgcttgaagacgaagcggattacgtggtgccagtcgaagataatgacgagaactatattcatccaactgaatcaagtagcccgccacctgagaaggctcccatggtgaatcgcagtactaagccaaattcaagcacaccagcgtcaccacccggcaccgcatccggcaggaactccggcgcttgggaaactaagtctccacctcctgccgccccttctccattgcccagagccggaaagaaacccaccacaccactgaaaacgaccccggtggcgagtcagcagaatgcctcttctgtgtgtgaggagaagccgatcccagccgagagacaccggggatctagtcaccggcaggaggccgtgcagagtcccgtgtttccgccagcacagaagcaaatacatcaaaagcccattcccctgccccgctttacggagggggggaacccgacagtagacggccccctccctagttttagcagtaattcaacaattagtgaacaagaagctggagttctgtgtaaaccttggtatgcaggcgcttgcgaccggaaatccgcagaagaagcactccaccggagcaataaggatccccagcctcctctccccagcaagcaatgggaaacaaggaagctgcagtatttcgggtctgtggccgagataatccgcaaccaccagcactcccccttagtacttattgactctcagaataacaccaaagacagtacacgcctgaagtacgcggtgaaagtgtcctag

SEQ ID NO: 109480 - DNA, 630 bp, Artificial Sequence
  Description of Artificial Sequence: Synthetic coding sequence
atggataagctcaataaaatcactgttcctgctagccagaaactgaggcagctccagaagatggttcatgacataaagaataacgagggggggatcatgaataaaatcaagaaactgaaggtcaaggcgccacctagcgtgcctcggagggactacgctagtgagagcccagcagatgaggaagaacaatggtccgatgactttgatagtgattatgagaaccccgacgagcactctgatagcgagatgtacgtaatgcccgccgaggagaatgctgatgactcctatgaaccacccccggtagagcaggagacacgaccagtacacccggctcttccatttgcccggggcgagtacattgacaacagaagcagccagcggcattcaccacccttctccaagactctcccctctaagccctcctggccgagcgagaaagcacgcctgaccagcacactgccagctttgacggctctccagaagccacaggtgccacccaagcccaaagggctacttgaggacgaggcagattacgtggtgccagttgaagataacgacgagaactacatacatccaacggagagttcctctcccccgcccgagaaaggtaaaaatcagcggcaccattag

SEQ ID NO: 109481 - DNA, 900 bp, Artificial Sequence
  Description of Artificial Sequence: Synthetic coding sequence
atggataagttgaacaaaataactgtgccagcttctcaaaagttacggcagctccaaaaaatggtccatgatataaaaaacaatgagggcggcattatgaataagataaagaagctgaaagtgaaggccccgccatctgtgccgaggcgcgattacgccagtgagtcaccggccgacgaggaggagcagtggagtgatgacttcgactccgattatgagaaccccgacgagcatagcgatagcgaaatgtatgtcatgccagccgaggagaatgcagacgattcatatgaacccccccccgtcgagcaggagacacgccctgtacatccggctctgccgtttgcaagaggagagtacatcggcagaaacagcggggcctgggagactaaatcccctccaccagcagcgccttcgccactcccgcgggccggtaaaaagccaactacacccctcaagactaccccggttgcctcccagcaaaatgcttcatcggtgtgcgaagaaaaaccaattccagccgagagacatcggggctcctcccatcggcaagaggccgtgcaaagcccagtgtttccccccgcacagaaacagatccatcagaaaccaatacctttacctagattcaccgaaggcggcaacccgactgtggatgggccactcccctccttctcctccaattctacgatctctgagcaggaggccggagttctgtgcaaaccatggtacgccggggcatgtgatcggaaatcagccgaggaggccctgcataggtcaaacaagtacttcggctctgtagccgagatcattagaaatcaccagcactcccccttagtcctgattgattctcagaataacaccaaggacagcactagactaaagtatgccgtgaaggtgtcctag

SEQ ID NO: 109482 - DNA, 2358 bp, Artificial Sequence
  Description of Artificial Sequence: Synthetic coding sequence
atgttacccgcggccccaggcaagggccttggtagccccgaccctgccccctgtggtcccgctccgcccgggaacaccaaggacattataatgatatatgaagaggacgccgaagagtgggccctctacctcactgaagtgttcctgcacgtcgtcaaacgagaagccatactcttgtaccgcttagagaacttcagcttcagacatctcgagctactgaacctgacaagctataaatgtaaactcttgatcctgtccaattccctgctgagagacctgacacccaagaaatgccagttcctagagaagatactccatagccctaaatcagtggttacattgctgtgcggggtaaagtccagcgatcagctctacgaactgctgaatatttcccaatctcgctgggagatcagcaccgagcaggagcctgaagattatatttctgtgatccagtctatcattttcaaagattccgaggactatttcgaagtcaacattcccacagacttgcgcgcaaagcattccggtgagatcagcgagagaaaagaaattgaggagctgtctgaagcttcacggaacaccatccctctggccgtggtgttgcctaccgaaattccttgcgagaatccgggtgaaattttcattatcctccgggatgaggtcataggggacacagttgaagtcgaatttacctcatccaataagaggatccgaacacggccggcactatggaacaagaaagtgtggtgcatgaaggctctggaattccccgctggctcagttcatgtcaacgtgtactgcgatggcattgtcaaagcaacaacgaaaatcaaatactacccaaccgccaaagcgaaagaatgtcttttccggatggctgatagcggggagtccctgtgtcaaaactcaattgaggagctggacggggtgcttaccagcatcttcaaacacgaaataccatactacgagtttcagtccctgcagacagaaatctgcagccagaacaaatatacccacttcaaggagctcccgaccctcctgcattgtgccgccaagtttggcttgaaaaacctggcgatacatctgctgcagtgttcaggcgctacatgggctagcaaaatgaagaacatggaaggttctgacccagcacacattgcagaacgacacggacataaggagctgaagaagatttttgaagatttctccattcaggagatcgatatcaacaatgagcaggaaaacgactatgaagaggatattgcgagcttctccacatacattccctccacccagaaccctgcgtttcaccacgagagccggaagacgtacggacaatcagctgacggggctgaagccaacgagatggaaggtgaggggaaacagaatggctctggaatggaaacaaagcactcgcctctcgaagtgggttctgagtcatcagaggaccaatacgatgacctctatgtcttcatacctggcgcggacccggagaacaactcccaggaacccctaatgtcttcgagaccaccactgcctccccctaggcccgttgccaacgccttccagctcgagcgtccccactttactcttccaggtaccatggtggagggccagatggagaggagccagaactggggacatcccggtgtccgccaagagactggagatgaaccaaaaggcgaaaaggaaaaaaaagaagaggaaaaggaacaggaagaagaagaggacccatacaccttcgcagagatagatgatagtgagtacgacatgatcttggccaacctgtccattaagaagaaaacgggctctagaagtttcattatcaatcgacctcccgcccccacacctcggccaacatctatcccaccaaaggaggaaaccacaccctacattgcgcaggtgtttcagcagaagactgccaggcgacagtctgatgacgacaaattctgtggtttacccaaaaaacaagatagagcccgtattgaatcacccgcgttttctacccttcgggggtgtcttacggatggacaggaagagctgatcctgctccaggaaaaggtgaagaatggcaaaatgagcatggatgaggccctagaaaaattcaagcattggcagatgggaaaatctggtctggaaatgattcagcaggaaaagcttcggcagctgagagactgcatcatcggtaagcgaccggaggaggaaaacgtttacaataagctaaccatcgtgcaccaccccggagggaaagagaccgcgcacaacgaaaataagttctataacgtccacttttcaaataaactgccagctagacctcaggtcgagaaagagtttgggttttgttgtaagaaagatcactag

SEQ ID NO: 109483 - DNA, 1959 bp, Artificial Sequence
  Description of Artificial Sequence: Synthetic coding sequence
atgctgcctgccgcacccgggaaaggccttggctcccccgacccagcaccctgcggtcccgctccgcctgattccgaggattatttcgaggtgaatattccaactgatctacgggcaaagcactcgggtgagatttccgagcgcaaggagatcgaggagttgagcgaagcttcccgcaacaccatcccgctagccgtggtccttcctacagagataccttgtgagaatccaggggaaatttttatcatcctgcgggacgaggtgatcggggacaccgtggaggtcgagttcactagttctaataaacgcattaggaccagaccagcgttgtggaacaagaaggtttggtgcatgaaagccctcgagttccctgctggcagtgtgcacgtgaacgtctactgcgatgggatagtcaaggccacaaccaaaatcaagtactacccgaccgccaaggcgaaagaatgtttgttcaggatggccgacagcggggaaagcctgtgccagaactccatcgaggaactcgacggcgtgctaaccagtatcttcaagcacgaaatcccatattacgaatttcaatccctgcagactgaaatatgtagccagaataaatacacccacttcaaggagcttccgacactgttgcactgcgccgccaaattcggacttaagaatctggccatccacttattacaatgtagtggcgcaacatgggcttcgaagatgaaaaacatggaagggtcggaccctgcacatatcgcagagagacatggacacaaggagctgaagaaaattttcgaagatttttccatacaggagatcgacatcaacaacgagcaggagaatgattatgaggaagatattgcttccttctcgacctatatcccttccacacagaaccctgctttccatcacgaaagtcggaagacatacggtcagtctgccgatggggcggaggctaacgagatggaaggcgaaggaaagcagaatggaagcggaatggaaacgaaacactcgcctttagaggtgggtagcgaaagcagtgaggatcagtacgacgatctatacgtgtttatcccgggagccgaccctgagaacaattctcaagaacctttaatgtcttcccggcctcctctaccgcctccaaggcccgttgccaatgccttccagctcgaacgaccccacttcacccttcctggcacaatggttgagggccaaatggagcgaagccagaattgggggcacccaggtgtgcgtcaggagaccggcgatgagcccaagggagagaaagaaaaaaaagaggaggagaaggaacaggaggaggaagaggacccatacaccttcgccgagatcgatgacagcgaatacgacatgatattagctaacctgagcatcaagaagaagaccggaagccggtctttcatcattaaccggcctcctgctccaaccccacgacctaccagcattcctccgaaagaagaaaccaccccctacatcgcacaggtattccaacagaaaactgcccggagacaatctgacgacgacaaattctgtggtctgcccaaaaagcaggatcgggcgcgaattgagtctcccgccttttctaccctccgtggctgcctgactgacggacaagaggaactgattctgctgcaagagaaggtaaagaacggcaagatgtcaatggatgaggcacttgaaaaatttaagcactggcagatgggtaaatcaggccttgaaatgattcaacaggagaaactgagacagctgagggactgtatcatagggaaacggcctgaggaagaaaatgtgtataacaagttaacaattgtgcatcaccctggcgggaaggagactgcccacaatgagaacaaattctacaacgtgcacttctccaacaagctgcctgcccggccccaagtggaaaaggagttcgggttctgctgtaaaaaggatcattag

SEQ ID NO: 109484 - DNA, 2268 bp, Artificial Sequence
  Description of Artificial Sequence: Synthetic coding sequence
atgatatatgaggaagacgccgaggagtgggctctgtacctgacggaggtattcctgcatgtcgtgaagagagaggccatcctcctgtatcgacttgagaatttcagctttcgccatctcgaactgttaaatctgacatcttataagtgtaaattacttatactgtctaactcgctgctccgtgatcttacccctaaaaagtgtcagtttttggagaaaattttgcacagcccaaagagcgtggtgaccctgctttgtggcgtgaagtcatcagaccagttgtatgagctgctgaatatctcacagtccaggtgggaaataagcacagaacaggagcctgaagattatatatccgtgattcaaagtatcattttcaaggacagtgaagactacttcgaggttaacattccaaccgacttgagggctaaacattctggcgagatttcagagagaaaggagatcgaagagttgtcggaagcatctagaaatacgatccccctggctgttgtcctgcctaccgaaatcccctgtgagaaccccggcgagattttcataatattgcgcgatgaggtgataggcgacacagtggaagttgagttcacgagctcgaataaaaggatccggacgaggcccgccttgtggaacaagaaagtgtggtgtatgaaagccctggagtttccggccggcagcgtgcacgtcaatgtatactgtgacggcatcgtgaaggcgaccactaaaattaagtactatcccaccgctaaggcgaaggaatgcctgttcaggatggccgactccggggagtctctatgccaaaattctatagaggagctagacggcgttcttacctcaatattcaaacatgagatcccctactacgaattccaaagtctgcagactgagatttgttcacaaaacaaatacacacacttcaaggagcttcccacgctactgcattgtgccgcaaagtttggcctcaaaaacctggcaatccacctgctacaatgctccggtgcaacctgggcatctaagatgaaaaacatggaaggctctgacccagctcacatagctgagaggcatggccataaggaactgaaaaaaattttcgaggacttctccatccaagagatcgacatcaacaacgaacaggagaatgattacgaggaggacattgcttcgttttcaacatacattcccagtacacagaaccccgccttccaccacgaatctcgcaagacgtatgggcagtctgccgatggcgccgaagccaatgaaatggagggcgagggaaagcagaatggctcaggaatggaaaccaagcacagtcctttggaggtaggttccgaatcttccgaagatcagtatgatgatctctatgtgttcatcccaggcgccgaccctgagaacaacagtcaggaacctctcatgtcttcgcggcctccactcccacctccccgacctgtcgctaacgcattccaactggagcggccccattttacccttccggggacaatggttgaagggcagatggagcgcagccaaaactgggggcatcctggagttagacaggagacaggggatgagcccaagggagagaaagagaagaaggaggaggagaaggaacaggaggaggaggaggatccctatacatttgccgagattgatgactcggaatacgacatgatactggcaaatctgagcattaaaaagaagacaggatcgcgctctttcatcatcaaccggcctcccgctccaactccgagaccaacatccattccgcccaaggaagagactaccccgtacatcgcgcaagttttccagcaaaaaaccgcaaggcgtcagagtgacgatgacaagttttgtggtctgcccaagaagcaggaccgggccagaatcgagtctcccgcctttagcacactccgaggatgccttacagacgggcaggaggaattgattctgctccaggaaaaggtcaaaaacggaaaaatgagtatggacgaggctctggagaagtttaaacattggcagatgggaaagtccggcctggagatgatacagcaggagaagttaagacagctgagggattgtataattggtaagcgacccgaagaggagaacgtctacaataagctgacgatagtacaccaccccggtgggaaggaaaccgcccataatgaaaacaagttttacaacgtgcacttctcaaacaaactgccagcacgccctcaggtggagaaagaattcggattctgttgtaagaaagatcactag

SEQ ID NO: 109485 - DNA, 2313 bp, Artificial Sequence
  Description of Artificial Sequence: Synthetic coding sequence
atggtgaattgccacctgaaaatcggcaatactaaggatattatcatgatatacgaagaggatgcagaagagtgggcactgtatctaactgaggtcttcctgcacgttgtcaagcgagaggctatcttgctttacagacttgaaaatttttcctttagacacctggaacttctgaatctgacctcttacaagtgcaagttgctcatactgtccaactcccttctgagagacctgacccctaaaaaatgccagttcctggagaaaatacttcactctcctaaaagtgtagtgaccctgctttgtggggtgaaatctagcgatcaactatacgaactcttgaatatcagtcagagtaggtgggaaatctcaacagagcaggagccagaggactatatcagcgtaatccagtccataatatttaaagacagtgaagactattttgaagtgaacatccccactgacttgagggccaaacatagcggtgagatcagcgagcgaaaagagatagaagaattgtcggaggcctccagaaacactatacctctcgctgtggttctacccacagagataccgtgcgaaaaccccggggaaatcttcatcatcctcagagatgaagtgataggagacactgtcgaagttgagtttacgtcctccaacaagagaataaggacccggcctgctttgtggaacaagaaagtctggtgtatgaaagctctggagttccccgcaggctccgtgcatgtgaatgtgtattgtgacgggattgtcaaggctaccacaaaaatcaaatactatccaaccgctaaggcaaaggaatgtctgttccgaatggccgactccggcgaaagtctgtgtcagaattccatagaggaactcgacggggtgctgacatccatattcaagcatgaaatcccctattacgaattccagagtctccagaccgaaatctgctctcagaataagtatacacattttaaggagctacccacgctcctgcactgcgccgctaagtttggtttaaagaatctggcgattcacctgctccagtgttctggcgcgacgtgggcttctaagatgaaaaacatggaggggtcagaccctgcccacattgccgagaggcatgggcataaagaattgaagaaaatattcgaagacttctcaatccaagagattgacatcaacaacgagcaggagaatgactatgaagaggacatcgcctccttttcaacatatataccatccactcaaaaccctgcgtttcatcacgagagtcggaagacatacggccaaagcgccgatggagcagaggccaatgagatggaaggagagggaaagcaaaacggctccgggatggagactaagcattcacctctggaggtcggtagtgaatcaagcgaggatcagtacgatgatctgtacgtattcatcccaggtgcggatccggagaataactcacaggagccattaatgagctcccgcccaccccttcctccacctagaccagtcgctaatgcgttccagctagagaggccacatttcacactccctggtaccatggtggagggacagatggagagatcccaaaactggggccatcccggcgtgcgtcaagagacgggagatgagccgaagggggagaaagagaaaaaggaggaagagaaggagcaggaggaagaagaggatccttacactttcgccgaaatagacgattcagagtatgacatgattctcgccaacctttcaataaaaaagaagacaggaagtagatctttcattatcaaccgcccccccgcaccaactcccagacccaccagcatcccaccgaaagaggagaccacaccatacattgcccaggtgtttcagcaaaaaacggcgcgtagacagtcagatgatgacaaattctgcggtttgcccaaaaagcaggacagagcccgcatagagtcaccagctttcagcacactgcggggatgtctgaccgatggccaggaggagctcattttgctacaggagaaggttaaaaatgggaagatgagcatggatgaagctcttgagaagttcaagcactggcaaatgggaaagagtggcctggagatgatccagcaggaaaagctgcggcaactgcgggactgtatcataggaaaacggccggaggaggaaaatgtctacaacaaactgactatcgtgcaccacccaggcggcaaagagaccgcacacaacgagaacaagttttataacgttcatttcagtaacaagctgccagcaagaccgcaggtggagaaagaatttggattctgctgcaaaaaggaccactag

SEQ ID NO: 109486 - DNA, 1959 bp, Artificial Sequence
  Description of Artificial Sequence: Synthetic coding sequence
atgctgcccgctgccccaggtaaaggcctcgggtccccagatccagctccctgcggcccagctccgcctgactccgaggattattttgaggtcaacatcccaactgatctccgcgcaaaacattccggcgaaatctcagaacgcaaagagatcgaagagctgtcagaagcatctaggaataccattcccctcgccgtggtcctgccaaccgagataccatgtgagaatcctggggaaatctttattattctgcgcgatgaagtgattggggatacagtggaagtcgagttcacatctagcaataagagaataagaacaagaccagcactttggaataagaaggtgtggtgcatgaaagccttggagttcccagccggcagcgtgcacgtaaacgtatactgcgacggcatcgtaaaagctaccacaaaaatcaaatactaccccacagccaaagccaaagagtgtctattcagaatggccgacagcggagaatccctgtgccagaattctattgaagagctcgacggagtcttaactagtatctttaaacacgagatcccgtactacgaattccagagcctgcagaccgagatttgttcccagaacaagtatacccactttaaagagctccctacgttattacattgtgccgcaaagttcgggctgaaaaacttggccatacatttgttgcagtgtagcggagctacttgggcatcaaaaatgaagaatatggaggggagtgatcccgcccacatcgcagagagacatggccacaaagaactgaagaagattttcgaggactttagtatacaggagatcgacatcaataacgaacaagaaaatgactacgaggaggacatcgcaagtttttccacctacataccttccactcaaaaccctgcctttcaccatgaaagccgcaaaacctacggtcagtctgctgatggagctgaagccaatgaaatggagggagagggtaaacagaatggcagtggaatggagaccaaacactctcctctggaggttggctcggaatcctcagaagatcaatacgacgacctctacgtgttcatacctggcgctgatccagaaaacaattcacaggagcctttaatgagttctcgaccgccactgcctcccccaagacctgttgccaatgcatttcaactggaacgcccgcactttacccttccaggaaccatggtggaaggacaaatggaacgatcacaaaactggggccaccctggggtcaggcaggagacaggggatgaaccaaagggcgagaaagagaaaaaggaagaggaaaaggagcaggaagaggaggaagacccctacacgtttgctgagatcgatgattccgagtacgatatgattttggcaaatctttcaatcaagaaaaagaccggcagtcgatcattcatcatcaataggccccctgcaccaactcctcgaccaacatccattccacctaaagaagagactacaccttatatcgcacaggtgtttcaacaaaagactgcccgccgacagtccgatgatgacaaattctgtggactccctaaaaagcaagatagagcacggatcgaaagcccagccttcagtaccctgcgaggttgcctgaccgatggtcaggaggaactcatccttctgcaggaaaaggtcaagaacggcaagatgtccatggatgaggccctggaaaagtttaaacactggcagatgggcaagtcaggactggagatgatccaacaggagaaattgaggcaactgagggactgtataattggcaaacgaccagaggaagagaacgtttacaacaagctgaccatagtacatcatccaggcggtaaggagacagctcataacgagaataaattttacaacgtccatttcagcaacaagcttcctgctcgcccccaggtcgagaaggaatttggcttctgttgtaaaaaggatcattag

SEQ ID NO: 109487 - DNA, 516 bp, Artificial Sequence
  Description of Artificial Sequence: Synthetic coding sequence
atgcacccattttatacaagggccgcaacaatgatcggcgaaatagccgctgcagtgtcattcatcagcaaattcctcaggacaaagggacttaccagcgaacggcagctgcagacgttttctcagtcgcttcaggagctcctagcagaacattataagcaccattggtttcccgaaaaaccttgtaagggctccggctataggtgtatccgtattaatcacaaaatggatcctctgataggacaagcagcccagaggatcggactctctagccaggagctatttcgtctgttgccgtctgagctgactctgtgggtcgacccgtacgaggtctcttacagaattggcgaggatggctcaatctgcgtactctatgaagcttctcccgccgggggtagcacccagaacagcactaatgtccagatggtcgatagccggattagctgtaaggaggagctgctactgggccggacaagcccgtctaaaaactacaacatgatgacagtatccggatag

SEQ ID NO: 109488 - DNA, 672 bp, Artificial Sequence
  Description of Artificial Sequence: Synthetic coding sequence
atgagggacgaaattgcaacaaccgtctttttcgtgaccagactcgtcaagaaacacgataaactgtcaaagcagcaaattgaggattttgccgaaaagctcatgactattctgttcgaaacataccgctcccattggcatagtgactgcccctctaagggtcaggcattccggtgtattcgcatcaacaataaccagaataaggatcccattctggagcgggcctgtgtcgaatcaaacgtggatttcagccaccttgggctgccaaaggagatgaccatctgggtggatcccttcgaggtgtgctgcagatacggcgagaaaaatcatccatttacagtcgcaagtttcaagggaaggtgggaagaatgggaactctaccagcagatttcttacgcagtttcccgtgccagttccgacgtcagctccggaactagttgcgatgaggagagctgcagcaaggaacctagggtaatcccaaaggtatcaaacccaaaaagcatctatcaggttgaaaatttaaaacagccctttcagtcttggctgcagatccccagaaagaaaaatgtcgttgacggaagagtagggctcttgggcaatacttaccacgggtctcagaagcaccctaagtgttatcgtccagcaatgcaccggctcgatcgaattctctag

SEQ ID NO: 109489 - DNA, 483 bp, Artificial Sequence
  Description of Artificial Sequence: Synthetic coding sequence
atgcgggatgagatagccacaactgtgtttttcgtgacacgcctggtgaaaaaacacgacaaactgtctaagcagcaaatcgaggatttcgctgagaagttgatgacaatacttttcgagacataccgatctcattggcactcagactgcccttctaagggtcaggctttccgctgtattcgaattaacaataatcagaataaagaccccatcttggagcgggcatgcgtggagtcaaacgttgacttcagtcacctcggcctccctaaggaaatgactatttgggtggatccatttgaggtgtgctgtagatacggcgagaaaaatcatcctttcacagttgctagcttcaagggccggtgggaggaatgggaattgtatcaacagatttcatacgccgtttccagggccagcagcgacgtgagcagcgggacatcgtgtgatgaagagtcttgctctaaggaacccagagtgatcccctag

SEQ ID NO: 109490 - DNA, 1188 bp, Artificial Sequence
  Description of Artificial Sequence: Synthetic coding sequence
atgtctctggtggatctaggaaaaaagctacttgaagcggcaagggctggccaggatgacgaggtgaggattttgatggcgaatggagcaccattcaccaccgactggctgggtaccagtccactgcacttggctgcccagtatggccactactccaccaccgaggtgctgctgcgagccggcgtcagtagggatgcaaggacaaaagtggaccggactcccttacatatggctgcctctgagggccatgccagcatagtcgaggtcctactcaaacatggagccgatgtcaatgctaaggacatgttgaagatgaccgcattacattgggcaaccgagcacaaccatcaggaggtcgtggagctgctgattaagtacggggctgacgttcacacacaatcgaagttctgcaagactgccttcgacataagcattgacaatggcaatgaagacctcgcggaaatcctgcagattgccatgcagaatcagattaatacaaaccctgagtccccagataccgtaacgatccacgccgcgaccccacagtttatcatcggacccggcggtgtggtaaatctgaccggtctcgtcagttctgaaaactcctccaaggcaactgacgagactggggtcagcgccgtacaatttggcaatagctcaaccagcgtcctggccaccctcgccgctctcgcagaagcctcagctccccttagcaactcttcggaaaccccagtcgtcgccaccgaggaggtggtgaccgcagaaagtgtcgacggcgctattcagcaggtggtgagttcaggcggacagcaggtcattactatcgttaccgacggcatacagttgggaaatctccatagcatccccacctcagggatcgggcagcctatcatcgtgacgatgcctgatgggcaacaggttttgaccgtcccagccaccgacatcgctgaggaaacagttatatcagaggaacccccggctaaaagacagtgtattgaaattatagaaaatcgggtagaaagtgccgaaatcgaagaacgggaagctctacagaagcagctggatgaggcaaaccgagaagcacaaaaatatcgacagcaattactcaaaaaagagcaggaggctgaagcataccggcagaagctggaggctatgacccgcctgcaaaccaataaagaagcggtctag

SEQ ID NO: 109491 - DNA, 555 bp, Artificial Sequence
  Description of Artificial Sequence: Synthetic coding sequence
atggagcctagtcagtgcgttgaggaactggaggatgatgtttttcagcccgaagatggagaaccagtaacacagccaggtagccttctctccgctgatctgttcgcgcagtcgctacttgactgtcctctgtcaagactacagctttttccactcacacactgctgcggcccaggcctaaggcctacctcccaggaagataaagccacccagaccctgtcacctgcttcgccgtcccagggggtgatgctgccttgtggagtgacagaggaaccccagcgcttgttttatggcaacgccggctatagactccctcttccggcgagttttcccgcagttcttcctatcggtgagcagcctcctgaaggacaatggcagcatcaggcagaagttcagatcgccagaaagctgcagtgcatcgcggatcagttccaccgcttgcatgtgcagcagcaccagcagaatcagaaccgcgtgtggtggcaaatcctcctgtttctgcataacctcgccctcaacggcgaggagaatcgaaatggggccggcccccgctag

SEQ ID NO: 109492 - DNA, 555 bp, Artificial Sequence
  Description of Artificial Sequence: Synthetic coding sequence
atggagccatcacagtgcgtggaagagctggaagatgacgtgtttcagcccgaagatggtgaaccagtcacacagcctgggtccctgctttccgcagatctgttcgcacagagcttgctagattgcccgctgtctaggctccagctgtttcccctgacccattgttgcggcccgggtctcagacctacttcccaggaagataaagcaactcaaactctgtcaccagctagcccttcccaaggtgttatgcttccgtgcggggttaccgaagagccccagcgcctgttttacgggaatgcaggctacaggttacctctgccggcgtcattcccagccgtcctgcccataggagagcagcctcccgaagggcaatggcagcatcaagccgaggttcagatcgctcgaaagcttcagtgcattgctgatcagttccatagactccatgttcagcagcaccagcagaatcagaatcgggtgtggtggcagatcctcttgtttctgcacaacctcgctctgaatggcgaggagaacaggaacggtgcgggcccgcgctag

SEQ ID NO: 109493 - DNA, 492 bp, Artificial Sequence
  Description of Artificial Sequence: Synthetic coding sequence
atggagccctcgcagtgcgtggaggaactggaggatgacgtctttcagcctgaggatggcgaacccgttacccagccagggagcctgctatcggcggacctgttcgcccagtcactcttggactgtccactgtctcgcctccagctctttccactcacccactgctgtggcccaggcctgaggcccacctcgcaggaagacaaagccacacagaccctttcccccgcttctccaagtcagggggtgatgttgccttgcggcgtgaccgaggaaccgcaacgcctattttacggcaacgcgggatacagactgcctctgccagcctcttttcctgccgtcctgccaattggcgagcagccccccgaaggtcaatggcaacaccaggcagagcaccagcagaaccagaaccgcgtgtggtggcagatcctgctatttctgcacaacctggcactgaatggggaggaaaaccggaatggggcaggcccgcggtag

SEQ ID NO: 109494 - DNA, 186 bp, Artificial Sequence
  Description of Artificial Sequence: Synthetic coding sequence
atggagccctcacagtgcgttgaggagcttgaggacgacgtgttccaacccgaggacggtgagcccgtcacccaacctggcagcctgctctccgctgacctcttcgcacagagcttgctggattgtccactctcgaggcttcaactgttccccctgacccactgctgtggcccgggattacggtag

SEQ ID NO: 109495 - DNA, 390 bp, Artificial Sequence
  Description of Artificial Sequence: Synthetic coding sequence
atggagccatcccagtgcgtggaagagctcgaggacgatgtgttccagcccgaggacggggagccggtaactcaacccggcagtttgctgtcagctgacctattcgcacagtctctgcttgattgtcccctgtcacggttgcagctgttccccctcactcactgctgcggacccggtctgcgaccaacatcccaggaagacaaagcgacccagacactcagccccgcaagtccctcgcagggtgtgatgctcccctgcggagtgacagaggagccccagcgacttttttatgcccccgccgaacccaagtcgtgcgttgtcgccgaccctcccctaccagctcaaccttgtttcgagtggagaagagaacaggagcggggccgaccatag

SEQ ID NO: 109496 - DNA, 42 bp, Artificial Sequence
  Description of Artificial Sequence: Synthetic coding sequence
atggaaccttctcagtgcgtggaagaactggaagacgactag

SEQ ID NO: 109497 - DNA, 555 bp, Artificial Sequence
  Description of Artificial Sequence: Synthetic coding sequence
atggagccttcacagtgcgttgaagagctagaagacgacgtatttcagcctgaggacggagagccagtcacccagcctgggtctctccttagcgccgatctgtttgcacagagccttctcgactgccctctgagtagactccagttgtttccactcacccattgttgcggacccgggctgagaccaacttctcaggaagacaaggctacgcagaccctttcccctgctagtccaagtcagggcgtgatgctgccgtgtggcgtgactgaagagccccagcgcctcttttacggcaacgccgggtacagactgcccctgccagcctcttttcctgcagtcctgcctatcggagagcagcccccagaggggcaatggcagcatcaggcagaagtccagatcgctagaaaactccagtgtattgctgatcagttccataggctgcatgtgcaacagcaccagcagaatcagaacagagtttggtggcagattttactttttctgcataacttagcattaaacggtgaggagaacaggaacggcgcaggccccaggtag

SEQ ID NO: 109498 - DNA, 555 bp, Artificial Sequence
  Description of Artificial Sequence: Synthetic coding sequence
atggagcctagtcagtgcgtcgaagagctggaggacgatgtgttccagcctgaggatggagaacccgtaactcagccgggttcactactctctgcagatcttttcgctcagtccctgctcgactgccccctgtccagactgcagctgttccctctgacccactgttgtggaccaggccttcgccccacatcccaagaagataaagctacccagaccctgtctcctgcgtccccttcccagggcgtgatgcttccgtgtggagtcactgaagagccgcagcggctcttctatggcaacgcggggtatcgcctccctttgcccgcttcatttccagcagtactgcccattggagagcagccccccgagggacagtggcagcaccaggccgaggtacagatcgcacgcaagcttcaatgtatagccgaccagttccacagactccacgtgcaacagcatcagcagaatcagaacagagtgtggtggcagatacttctttttctgcacaatctcgcattaaacggtgaggagaacagaaatggcgcggggcctcggtag

SEQ ID NO: 109499 - DNA, 585 bp, Artificial Sequence
  Description of Artificial Sequence: Synthetic coding sequence
atgtctcagaacggcgcacctggtatgcaggaggagtcactacaaggttcctgggttgagttgcatttcagcaataacggcaacggaggctcggtgccagcatcagtttcgatttacaatggagatatggaaaagattctgctcgatgcccagcatgaaagcgggcgtagctcatccaaatcctcccactgtgactcaccaccgcggagccagacgccccaagatacaaaccgcgctagcgaaactgacacccactcaattggggaaaaaaacagcagccaatccgaagaggatgatattgaacggagaaaagaagttgagtcgatactgaagaagaattctgactggatctgggactggtcatcccggcctgagaatattcctcctaaggaattcctgtttaaacacccaaagagaaccgcaaccttgtccatgcgcaacacctccgttatgaagaaaggcggcatattcagcgcagagttcctaaaagtctttttaccttcccttctgctgagccacctgctcgctattggtctgggaatctacatcggcaggcgcctgactactagcacaagcactttttag

SEQ ID NO: 109500 - DNA, 543 bp, Artificial Sequence
  Description of Artificial Sequence: Synthetic coding sequence
atgtcacaaaatggtgctccagggatgcaagaagagtccctccagggctcttgggtggagctccatttctcaaataacggcaacggaggctcggtgcctgcctctgtgtctatatacaacggcgacatggagaaaatcctcctggacgcgcagcacgaaagcggcaggagttcctctaagtcctcccactgtgattcccccccacggtcccagactcctcaagatacgaatcgcgccagcgaaactgatactcatagcattggcgagaagaactcctcccaaagtgaagaagatgacatcgaaaggagaaaggaggtcgagtcgatcttgaaaaagaattccgactggatttgggactggtcttctcgcccagagaacattccgccgaaggaatttttatttaagcaccccaagaggactgccactttgagcatgagaaatacgtctgtgatgaagaaaggggggatcttttcagccgaatttctcaaagtttttctcccttcattactgttgtcccatctcctggctatcggcctggggtag

SEQ ID NO: 109501 - DNA, 1071 bp, Artificial Sequence
  Description of Artificial Sequence: Synthetic coding sequence
atgtcccggccattgctgattaccttcacaccagccaccgaccccagtgatttgtggaaggacggccagcagcagcctcagcctgaaaagccagagtcgactctggatggcgctgcagctttagctttctatgaagccctaattggtgatgagtccagtgcccctgactctcagcgaagccagacagaaccagcaagggagaggaagagaaagaaacggcgaattatgaaggctcctgctgcggaggctgtcgctgagggagccagtggcagacatggacaagggagaagtctggaagcagaagacaaaatgactcaccggatcttgcgagcggcccaggagggtgacctccccgagctccggagattgctggagccgcacgaagcagggggggctggcggaaatatcaatgcgagggatgctttttggtggacaccgctgatgtgcgctgctcgcgctggccagggcgccgctgtgtcatatttgctgggccgaggtgccgcctgggtcggggtctgtgagttatccggccgggacgccgcccaattggctgaggaggcgggctttcccgaggttgccaggatggtgcgagagtcccacggcgagaccagaagccccgagaatcgctctcccactccaagcctacaatactgcgagaactgcgatacacatttccaggactcgaatcaccgcacctccacagcccacctgctatctttgtcacaagggccacagccaccaaacctcccactgggtgtgccaataagttctcccggtttcaagctgctgctgcggggaggctgggaacccggaatgggactgggtccaagaggggaaggaagagcgaaccctatccccacagtcctgaaaagagaccaggagggactcggatatcggagcgccccacagccacgtgtaacgcacttcccagcttgggatacacgggcggtggccggaagagagcgaccccccagagttgccaccttaagctggagggaagaaagaagacgagaagaaaaagaccgggcctgggagcgggaccttagaacttacatgaacctggaattctag

SEQ ID NO: 109502 - DNA, 3399 bp, Artificial Sequence
  Description of Artificial Sequence: Synthetic coding sequence
atggagccgaacgactccaccagtacagccgtcgaggagcccgacagcctggaggtgctggttaagaccctcgactctcagactagaacgtttatcgtcggtgcacaaatgaacgttaaggagtttaaggagcacatagccgcttctgtttctataccatccgagaaacagcgcctgatttaccagggacgggtcctgcaggacgataaaaaactgcaagaatacaatgtgggcggaaaggtgatccacctcgtagaacgcgctcccccacaaacacacctaccatcaggcgcaagttctggcacagggtccgcctcagcgacgcacggaggcgggagtccccctggtaccaggggtcctggggcatccgtccacgaccggaacgccaatagctatgtaatggtgggcacatttaacctgccctcggatggaagcgccgtggatgtgcacattaacatggagcaggcccccatacagtcggaacccagggtccgccttgtcatggcacagcacatgatccgcgacatacagactctcctgagccggatggaaactttgccgtatctgcaatgccgcggaggtccccagccacaacattctcagcctcccccgcagcctcctgctgttacacctgagccagtcgctttgtcttctcagacctccgagccggtggaaagcgaagctccccccagagagccaatggaagcagaagaagttgaggagagagccccagcacaaaacccggagttaacccccggccccgcccctgccggcccgacccctgctcctgaaacgaatgcccctaaccacccttccccagccgagtacgtcgaagtgctgcaggagctccaacgtctcgagagccgactccagccctttctgcagcggtactacgaagtgctcggagcagctgccaccacagactacaacaacaaccacgaaggccgcgaggaggatcagcgtttgatcaatctggtcggagaaagcctgcggcttttgggtaacacgtttgttgcactgtcagacctccgatgtaatctagcgtgcacgccgccccgacatctgcacgtggtgcgccctatgagccactacaccacacctatggttctgcaacaggccgctatcccaatccagattaacgtggggactactgtgactatgactggcaacgggaccaggccccctcccacccctaacgcggaagcaccacccccaggcccgggccaggcctcctcggtggccccttcttctacaaacgtggagtcgagtgctgaaggagctccaccccccggtccagcacctccacctgcgacatcacacccccgcgttatacgcataagtcatcaatctgtggaacccgttgtcatgatgcacatgaacattcaggatagcggcactcagccaggtggtgtcccttcagcccctaccgggccactgggccccccgggccatggtcagacactcggacagcaggtgcctggcttccccaccgctccaacacgggtggtgattgctaggcccaccccaccacaagcacgcccttctcaccccggcggaccgccagtgtcaggaacattacagggagcaggtctcgggaccaatgctagcctcgcccagatggtcagcgggctggtaggccagctgctgatgcaacctgtcctagtcgcccagggcacccccgggatggccccaccccccgctcccgcaaccgcaagcgcatcagccggcaccacaaatacagctaccaccgcgggacccgccccaggtgggcctgcgcagcccccaccaacacctcaaccttctatggccgacctacagttcagccagctgttagggaatctgttgggccccgctgggcccggtgcaggaggttccggcgtggcatccccgaccattacagtggctatgcccggcgtgccagcattcctccaggggatgaccgacttcttacaggccacccaaacagccccaccccccccgccccccccccctccgcccccacctgcgccggagcagcagaccatgcccccccccggcagcccatccggcggcgccgggtccccggggggactgggactggagtctctctccccagaattcttcacctctgttgtccagggggtactctcatctcttcttggttccctcggcgccagagctggatctagcgaatccattgctgctttcatacagcgactctcgggatcgtccaatatattcgaacctggtgctgacggggccctggggttctttggagccttgctgtccttgctctgccaaaatttctctatggttgatgtagtgatgctacttcatggccatttccagcctttgcagcgtctccaaccacaattgcgctccttttttcatcagcattatcttggcggtcaggagcccaccccgagcaacattcgcatggcaacccacacgctaatcactgggttagaggaatatgtgcgggaatcattttctctggttcaagtccagcccggagtcgacattatcaggactaatctcgagttcctgcaggaacagtttaatagcattgctgctcatgtgctgcactgcacggattcaggctttggggctaggttactagaactatgcaatcaaggcctctttgagtgtttggctttgaacctgcactgcctgggaggacagcagatggagttggccgccgtaatcaatggtaggatcagacgtatgtctcgcggcgtgaatccatctttagtgagttggctcactactatgatgggactgcgtttgcaggtggtgctggaacacatgccagttggaccagacgcgattcttcgttacgtcagaagagtaggcgatccccctcagcctcttcccgaggagcccatggaagttcaaggagcagagcgcgctagcccggagccacagcgagaaaatgcatctcccgcccccggcactacagcagaggaggcgatgtctcggggacccccccctgctccagagggaggaagtagagacgagcaggacggagcctctgcagagactgaaccttgggcagccgccgtcccccctgaatgggtccccataatacagcaggatatccagtctcagcgcaaagtcaagccacaaccccctctgagcgacgcatatctgtctgggatgccagccaagcggaggaagacgatgcaaggagaagggccccagcttctcctgtcagaggctgtctctagagctgcaaaggccgcaggcgccagacccttaacttctccggagagtttgtcaagggatctggaggctccggaagttcaggagtcttacaggcagcagctgcgctccgacattcaaaagcggctgcaagaggatccgaactattccccacagaggttccctaacgctcagagagcctttgccgacgacccctag

SEQ ID NO: 109503 - DNA, 3234 bp, Artificial Sequence
  Description of Artificial Sequence: Synthetic coding sequence
atggagccaaacgattccacttccacggccgtggaagaacctgactctctggaggtactcgtaaaaacattggacagccagacccgaacattcatcgtgggtgcccagatgaacgtcaaggagttcaaagaacatatcgcagcatccgtctcaattccttccgaaaaacagagactgatctatcaggggagagtcctgcaggatgataagaagttacaagagtacaatgtgggagggaaggtcattcaccttgttgagcgggcaccaccgcagacacatctgccttccggagccagttctggcaccgggagcgcctcagcaacccacggaggcgggtcacctcctgggacccgaggaccaggcgcctcagtgcatgataggaatgccaacagttacgtgatggtgggtacatttaacttgcccagcgatggatctgcggtagatgtgcatattaatatggagcaggccccaatccagtccgaacctagggtgagactggtgatggcccagcacatgatccgagacatccaaacacttctttcccggatggaatgcagagggggccctcaaccacagcactcccagcctccaccccaacctcctgccgttactccagagcccgtggcactgagctctcaaacatcggagccggtcgagtctgaggccccgccacgcgaaccgatggaagccgaagaagtggaagaaagagctcctgcccaaaacccggagctaacacccggccctgccccagcgggtcctaccccagctcccgagacaaacgcacccaatcacccatcacccgcagagtacgtcgaggtgctgcaagaactccagaggttggagagtcgactccagccattcctgcagagatattacgaggtgctgggcgccgccgccacaaccgactataacaataatcacgagggtcgtgaggaggaccaacggcttattaacctggtcggagagtcccttagactcctggggaataccttcgtggccctgtctgacctgcgctgcaatctagcatgtacaccccctcgacacctgcatgtcgtgagacccatgtcccattacacaacccctatggtgctgcagcaggccgctattccaatccagataaacgtgggtactacagttaccatgacaggcaacggaacacgtcctcccccaacccctaacgctgaagccccaccccctggcccagggcaggctagctcggttgcacccagctctacaaatgtcgaatcatcagcagaaggtgctccacccccgggccccgcacctcccccagcgaccagccatcctcgggtgatcaggataagccaccaatccgtggagcccgtcgtgatgatgcacatgaacatccaggactcgggcactcagcccggtggggttcctagtgccccaacagggcctctaggcccccctggacacggacagactctcggtcagcaggtgcctggattcccaaccgctccaaccagagttgtgatcgcgaggcccaccccaccgcaggcccgcccttcacatccaggggggccaccagtgagtggcactctgcagggcgcgggtttgggaactaatgcaagtctggcccagatggtctcaggcctcgtggggcagctcctgatgcaaccagtcctagtggcccaaggtacaccggggatggcccctccgccagctcccgcaacagctagcgcaagcgcaggtaccactaatactgccaccacggcgggaccagcccctggcggcccggctcagcccccgcctacacctcagccctccatggcagatttgcagttttcccagttgcttggtaacctcctgggcccggccgggcccggcgcaggtgggtcgggtgtagccagcccaaccattacggtggccatgcctggtgtccctgctttcttgcaaggtatgaccgactttctgcaggcaacgcaaaccgcacccccaccacccccccctcctcctccccctcctcccgcaccagagcagcagacaatgccacctccaggtagtccctccggaggcgctggctccccgggcgggctgggcctcgaaagcctctcccccgaattcttcactagcgttgtccagggagtgctgtcatcactcttagggtcactgggcgccagggctgggagtagcgagagcattgccgctttcattcagaggctctctggatcaagcaatatttttgaacccggtgcggacggggccctcggattttttggtgccttgttgtctctcctgtgtcaaaatttctccatggtggatgtagtgatgctgctccatggacattttcagccacttcagcgactgcagccacagctgcgcagctttttccatcagcactacctcggcggtcaggagcccaccccatcaaacattaggatggccacacacactctgatcaccggcctggaagaatacgttagagaaagctttagtttggtgcaggtccagcccggcgtggatattatacgaaccaatctggaattcttacaggaacagttcaatagtatcgctgcccatgtgctccattgcaccgatagcggctttggagcccggcttttggagctgtgcaaccaagggctgtttgaatgcttggccctgaacctgcactgcctgggcggccagcagatggaactggccgccgtaatcaacgggcggattagacggatgtcgcggggggttaatcccagtttagtgtcgtggctaaccactatgatgggactccgcctgcaagttgttctggaacatatgccagttggcccggatgctatcctgcggtatgtgcgacgggtcggcgaccccccccagcctctccctgaagagcccatggaagttcagggcgccgagcgggctagtcccgaaccccagcgcgaaaacgcttctcctgctcccggtacgacggccgaggaggccatgagcagaggccccccccccgcccctgaaggggggtctagggatgaacaggacggagcatccgctgagaccgaaccatgggctgcagcggtgccacccgaatgggtaccaatcatccaacaggacatccagtcacagcgcaaagtgaaaccccagccacccctctccgacgcatacctaagtggcatgccggccaagcgaaggaagctgaggagcgacattcagaagagactccaagaagaccctaattattctccacagcgctttccaaatgcccagcgggcattcgcagacgacccatag

SEQ ID NO: 109504 - DNA, 3399 bp, Artificial Sequence
  Description of Artificial Sequence: Synthetic coding sequence
atggagccaaatgactccactagcacagcagtcgaagaacctgattctttggaggtcctggtgaaaaccctcgattcccagaccagaacgttcatcgtcggggctcagatgaacgttaaggaattcaaagaacacattgccgcttcagtatctattccttccgagaaacaacggctcatataccagggccgggtgctccaggatgacaaaaaattacaggaatacaatgtcggtggaaaagtaattcatttagtggaacgggccccccctcaaactcacctgccttcaggggcatcctccggcacaggctccgcttctgctacacacggaggtggatctcctcctggaaccaggggacctggcgcgagtgttcacgatcggaacgccaatagttacgtaatggtgggaacttttaatctgccttccgacggctcagcagttgacgtccatataaatatggaacaagccccaatacaatcggagccaagagtgcgtcttgtgatggctcagcacatgatccgtgacattcagaccctgctgagccgtatggagacactgccgtacttgcagtgcagaggaggaccccagcctcagcattcccaaccacccccccagccccctgcggtgacccctgaacctgtagcgctctctagtcagacctctgaacccgtggaatctgaggctcctccccgggaacccatggaggctgaggaggtggaagagcgtgctcccgcacaaaacccagaactgacgccagggccggctcccgctggtccgacacctgcacccgagaccaacgccccaaaccacccgagccctgccgaatacgtggaagttctccaggagttacagaggctcgaatcaagactgcagcctttcctacagcgatactatgaagtcctgggcgccgccgccacaactgattataacaataaccatgaaggccgtgaggaggatcagagacttattaacctggtgggcgaaagtttgcgactgctcggcaacacctttgtggcattgtctgatctacgttgtaacctggcatgtaccccaccacgtcatctgcacgtcgttagacccatgtcccactatacaacacccatggtactccaacaagccgccatacccatacagattaacgtgggtactacagtgacaatgaccggtaatgggacaaggcccccacctacacctaacgccgaggctccccccccagggcctggtcaggcctccagtgtagccccctcatctacaaacgtggagtcttctgcagaaggcgctccaccgccaggcccagccccccccccagccacgtctcaccccagggttatcagaatttcgcaccagtccgtcgagcctgtggttatgatgcatatgaacatacaggacagcgggacacaaccgggcggcgtcccgagtgcacccaccggccccctgggcccacccgggcacggccagacgctgggccagcaggtgccgggttttcccaccgcgccaactcgagtcgtgatcgcccgcccaacccctccacaggctcgcccatcccaccctggcgggccgcctgtctctgggactctgcagggtgcagggttgggaactaacgcttccctggcacagatggtatctggacttgtgggtcagcttctcatgcagcccgttctggtggcccagggtacacctggcatggcacccccccccgctccagcgaccgccagcgcctcagcgggcactaccaacaccgcaacaaccgctggacctgccccaggaggccccgcacaacctccaccgacccctcagccatctatggccgatcttcaattttcccagttactggggaatctgcttggaccagccggtccaggagcaggtggctccggggtggccagtcctactatcaccgttgcaatgcctggggtcccagcttttctgcaaggcatgaccgatttccttcaggctacccagaccgctccgccgccaccaccacccccccctccaccacctcctgcccctgagcaacagaccatgccaccacctggcagcccttctggcggagcaggaagcccgggtggtttgggcttggagagtctaagcccagagtttttcacatcagtagtgcagggcgtgctatcttccctactcgggagtctcggtgctagggccggaagctccgagagtatcgcagcattcatccagaggctgtctggatcatcaaacatttttgagccaggagccgacggtgctcttggatttttcggggcactgctgagcctcctgtgccagaatttcagcatggttgacgttgtaatgctcctgcacggtcacttccagcccctacagcgtctgcagccccaattgcgttcttttttccaccaacactatttaggcggccaggagcctacccctagcaacattagaatggctacccatactctaattactgggctggaggagtacgtccgggagagtttttcacttgtccaggtgcagccaggcgtggatatcattagaacaaaccttgagtttctgcaggaacagtttaacagtatcgccgctcacgtactccactgtacagacagtggctttggagctagactgctagaactgtgcaaccagggcctcttcgagtgcctagcgctgaatttacattgtttaggcggccagcagatggaattggccgccgtgataaacgggcgcatcaggcgtatgtctcgcggggtcaacccctccctggtatcttggctgaccacaatgatgggtttacgccttcaggtcgtgctggagcacatgcctgtagggccagacgcgatattgcggtatgtgaggagagtaggtgaccccccacaaccactgcctgaggagccaatggaggtccagggggcagagagggcatcacctgagccccagcgtgaaaatgcatctcccgccccgggaactacggccgaggaagctatgagtaggggccctcctcctgcacctgaggggggctcgcgggacgaacaggacggggcaagtgcagaaacggaaccctgggcggcagccgtgccgccggaatgggtgccaatcattcagcaagacatacaatcacagcgcaaagtcaagccacaacctcccttgagtgatgcctacctgagtgggatgccagccaagcgtagaaaaactatgcagggtgaaggcccccagctcctgctgtcagaagccgtgagccgcgccgcgaaggcagctggggcacgcccacttacatcaccggaaagtttaagccgtgacctggaggcaccagaagtacaggagagctaccgccagcaacttcgctctgatatccagaaaagattgcaggaagacccaaactatagtccgcagaggtttcccaacgcccagagggccttcgccgacgatccttag

SEQ ID NO: 109505 - DNA, 3381 bp, Artificial Sequence
  Description of Artificial Sequence: Synthetic coding sequence
atggaacccaacgacagcactagcacagccgtcgaggaaccggattcattggaggtcctggttaagacactcgatagtcaaactcgcacttttatcgtaggagcacagatgaatgtcaaagagttcaaagagcacattgcagcatctgtctccattccatcggaaaaacagaggttgatctaccagggtagggtgctgcaggacgataagaaattgcaggagtacaatgttgggggtaaggtcatccacctagtcgagcgtgccccacctcagactcaccttccatccggtgccagctctggcaccggctctgcttccgccacccacggcggcggcagcccacccgggacccgcggacccggggcttctgtgcacgaccgaaacgccaactcctatgttatggtcggtactttcaatctcccgtcagatgggtccgcagtagatgtccacattaatatggagcaggcacccatccagtcagagccccgagttagattagttatggcacaacacatgatccgcgacatacagaccctcctttctcggatggaatgtcgaggggggccccaaccccaacactcacaacctccccctcagccgcccgccgtgacaccagaacccgtcgcactgagttcccagacttccgaaccagttgagtccgaggcccccccccgagagcccatggaagcagaggaagtcgaagaacgggcacccgcccagaatcctgagctaacccccggtcctgctccagccggtccaacccctgcccctgagaccaacgcccctaatcatccctctcccgccgagtatgtggaggtgcttcaggaacttcaacggctcgaatcgagacttcaaccgtttctacagcggtattacgaagtactgggggccgcggccaccaccgactataataataatcacgagggccgagaagaagatcagcgcctgattaatctcgtgggagaatccttgcgcctgcttggtaatacgttcgttgcgcttagcgatcttcggtgcaatctggcttgcacacctcctagacacctgcacgtcgtacggccgatgtcacattataccacaccgatggtcttgcagcaagccgcaattcctatccaaatcaatgtcggcacaaccgtgaccatgactggtaatggcacgaggcctccccccacccccaacgcggaggcacctccaccagggcccgggcaggcttcatctgtagcaccaagttccactaacgtcgagtcttccgccgagggggccccaccccctgggcctgctcctcccccagcaacttcacatcctagagttatcaggatttctcaccaatcagtggaaccagtcgtcatgatgcatatgaatatacaggattccggtacacaaccgggcggggtgccttccgcgcctaccggccctctaggccctccgggacacgggcagacacttggccaacaggtgcctgggtttcctacggcaccgacgagggtggtcattgcccgaccaacaccaccacaggctcgcccatcacacccgggggggccaccagtgtccggcactctccagggggccggcctgggcaccaacgcatcgcttgcccagatggtatcaggacttgtcggccagcttttaatgcagccagtactcgtggcacagggcacaccggggatggccccgccccctgcacccgctacagcatcagcctcggcgggcaccaccaatacagctaccaccgctggcccagctcccggggggccggcacagccaccccctacccctcagccttctatggcagatctacagttttctcaactgctcgggaatctattgggtccagccggccccggggccggcggttctggagtcgcttccccaaccattactgttgctatgcccggtgtaccagccttccttcagggcatgacagacttcctgcaagcaactcagacagcaccacctccccctccacctccaccaccccctccaccggcgccggaacaacaaactatgcctccccccggctcaccatctggcggcgcaggaagccctggcggcctcgggctggaaagcctttccccagagttcttcaccagtgtggtgcagggtgtattgtcttcactcctgggaagtctgggagcccgggcaggttctagtgagtctatcgccgccttcatacagcgactctccggctcttctaatatattcgagccaggagctgatggcgccctgggtttctttggggctctcctgtcactactgtgtcagaactttagtatggtggatgtggtgatgctgctgcacgggcatttccaacccctgcagcggttgcagcctcagctgcgctctttcttccaccagcactatttgggaggacaggagcccaccccgtctaacataagaatggctacacatacactcataaccggcctggaggaatacgttagagagtccttttctctcgttcaggtccagcctggtgtcgacatcatccggactaacctcgagtttctgcaggagcagttcaactcgatcgcagcccatgtcttgcattgcaccgattccgggtttggagccaggctgctggagttgtgcaatcaaggcctctttgaatgtctggctctgaatctacattgcttaggtggacagcaaatggaactggccgccgtgatcaatggacgaatcagacgcatgtcacggggcgtgaacccatctcttgtgtcttggttgaccaccatgatggggcttcgactacaggtcgtcttggaacacatgcctgttgggcctgatgccatcctccgttatgtgcgacgggtgggagatcccccccaaccgctgcccgaggagcccatggaagtgcagggggccgaaagggcgagccctgaaccccagcgtgaaaacgctagtcctgcaccaggaaccacagccgaggaagccatgtcaagaggcccgccgccagcacccgaaggcggatcgcgcgacgagcaggacggcgcctctgccgagacagaaccttgggctgcggctgtaccacccgagtgggtcccaatcatccaacaggacattcaatctcagaggaaggttaagcctcaaccacctctctccgatgcctacttatccggtatgcctgcaaagcgccgtaagaccatgcagggggagggccctcagctcttgctctccgaagcggtctccagggctgccaaggccgctggagcacggcccctgacatctcccgagagtctctcccgcgaccttgaagccccggaagtccaagaatcataccgccagcagctgcgctcagacatccaaaagaggttacaggaagaccctaactactccccccagaggttccccaatgctcaaagagccttcgctgatgatccctag

SEQ ID NO: 109506 - DNA, 3381 bp, Artificial Sequence
  Description of Artificial Sequence: Synthetic coding sequence
atggagccaaacgattcaacctccacagccgttgaggagcccgatagcctcgaggttctggttaaaactctcgattcacaaacacgaacatttatcgtgggagcacaaatgaacgtaaaggagtttaaggaacacattgctgcttctgtcagcattccatctgaaaagcaacgtttaatttaccaaggtcgggtgcttcaggacgacaagaagctgcaagagtataatgtcggaggtaaagtaatccatctggtagagcgcgccccacctcaaactcacctgccatcaggtgcaagctcaggaactggctccgcgtctgccacccatggggggggctcacctccaggcacgaggggccccggcgccagcgtgcacgatagaaacgcaaatagttacgttatggtggggacctttaacctacctagcgatggctcggcggtggacgtgcatattaacatggagcaggcacctatccaatccgagcctcgggtgcgtttggttatggcacaacacatgatccgcgatattcagaccctgcttagccggatggaatgcaggggtggacctcagccacagcatagccagccaccacctcaaccacctgccgtgacacccgaacccgtcgccctctctagccaaacctccgaacccgtagagagcgaggccccacctcgagagcctatggaagcagaggaagtcgaagaaagggcacccgctcagaacccagagcttactcctgggcccgctccagctggcccaacaccagcccccgaaacaaacgctccgaaccatcccagccccgcggagtatgtggaagttctgcaggaattacagagactggaatctagacttcagccgttccttcagcggtactatgaagtcctgggcgcagccgctaccaccgactacaataataatcatgagggccgcgaggaagaccagaggttgattaacctcgtcggagaatctcttagactcctcggaaatacatttgttgctctttcagatctccgctgtaacttggcctgcaccccacccaggcaccttcacgtggtgcggccaatgagccattacaccacccccatggtcttgcaacaggcagctatccccatccagatcaatgtgggcactaccgtgaccatgacaggcaacggtactcgccctcccccgactcctaacgctgaggcacctccacctggccctggtcaggcctcgagcgttgcaccctcgagcacaaacgtcgagtccagcgcggagggcgcgccaccaccaggccccgctccaccgcccgcgacctcccacccacgcgtgatcaggatttcccatcagtctgtcgagcccgtggtgatgatgcatatgaatattcaggatagtggtacccagcccgggggcgtgccaagtgcgcctacagggcctctgggacctccaggccacgggcaaacactgggccagcaggtgccaggctttccgaccgctcccactagggtggtgatcgctcgaccaactccgcctcaggcccgtccttcccatccaggcggcccacccgtgtcagggaccctacagggcgcaggactggggaccaacgcttcccttgcacagatggtctctggacttgtgggccagctcctcatgcagccagtgttggtcgcccaggggacaccagggatggccccacccccagctccggcgacggcgagcgcctccgcaggaacaactaacaccgctactactgcaggcccagctcctggggggcccgcacagcctccgcccaccccgcagccttctatggctgacctccagttcagccaattgttaggcaatcttcttggtcccgccggacccggcgccggcggatctggcgtagcctctcccaccatcactgtagctatgcctggagttcccgcattcctgcaggggatgaccgattttctgcaggccacccagacagcacctccaccccccccaccacctccaccccctcctcctgcacccgagcaacagaccatgcctcctcccggatcgcccagcggcggcgcggggtccccaggcggactcgggctagaaagtctgtctcctgaatttttcactagcgtggtccagggagtattatcatccttactggggtctttgggggccagagctggttcttctgaaagcattgcggcgtttatccagaggctttcaggaagctcgaatatcttcgaacctggggctgatggtgccttagggttttttggcgccctgctaagcctgctctgtcagaacttttcaatggttgacgtggtcatgctcctccatggtcacttccagcctttacagagactgcagccacagctgaggtcgttctttcaccagcactacctcggcggccaggagccaactcccagcaacatccggatggccacccacacgttaatcaccggactcgaagaatatgtgagggagagcttttcactcgtgcaggtgcagcccggtgttgacatcattcgcacaaatctggaatttttgcaagaacagttcaatagcattgccgcccacgtgttacattgcaccgatagcggatttggcgccagattgctggagctctgcaatcagggcctgtttgagtgccttgctctgaatttgcattgtctcggaggtcagcagatggagctggcagccgtaatcaacgggcgcattcgaaggatgtcccggggggtgaacccttcccttgtgagttggctcaccacgatgatgggattaagacttcaggtcgtactggaacatatgccagtgggccctgacgcaatcctgaggtacgtccgaagagtcggggatccccctcagccgctgcccgaagagccgatggaggtgcagggggccgaaagagccagcccggaacctcagcgagaaaatgcatctcccgctccggggaccaccgccgaggaggcaatgtcacgcggtccccctcctgcccccgaaggcgggtctcgcgacgaacaagacggggctagcgcggaaactgagccatgggccgctgcagttcctccggagtgggtaccaattatccagcaggatatccaatcacagaggaaggtgaagccccagccgcctctgtcagacgcctacctcagtggtatgccagctaagcggcgcaagacgatgcagggcgagggcccacagctgctcctgtctgaagccgtgtctcgagccgcaaaagctgccggcgcacggcctctgacttcccctgagagcctctcccgcgacctcgaagctcccgaagtgcaggagtcctaccggcagcagctacgctctgatatccagaaacggctacaggaggatcccaactacagcccacagcggttcccaaacgcccaacgcgcctttgccgacgacccctag

SEQ ID NO: 109507 - DNA, 3381 bp, Artificial Sequence
  Description of Artificial Sequence: Synthetic coding sequence
atggagccaaacgattctacttcgaccgctgttgaggaacctgatagtcttgaggtacttgtcaagaccctggactcacagacgagaacctttatagtcggggcccaaatgaacgttaaggaattcaaggaacatatagcagccagtgtgagcataccttctgagaagcagagactgatctatcaggggcgcgtgttgcaagatgataagaaactccaggaatataatgttggggggaaggtgattcacctggtggagagagctcctccccaaactcatctcccaagcggcgcttcttccggaacgggttctgcctcggcaactcacggcggaggcagtccgcccggcacacgcggccctggcgcgtctgtgcatgataggaatgccaattcgtacgtaatggtggggacctttaacttgccgtccgacggttcagcagttgacgtgcacatcaatatggaacaggcccctatccaatcagagccaagagtgagattggtcatggctcagcacatgatcagggacatccagactcttctcagccggatggagtgtagaggaggtcctcagccccagcatagccaaccccctcctcagcctcccgcggtgacaccagagcccgtagccctgtccagtcaaacctccgaacccgtggagagtgaagcccccccaagggagcctatggaagcggaggaggtcgaggagagggcccccgcacagaatccagaactcacccccggccctgcccccgcaggtccgacccccgcccctgagaccaacgcacccaaccacccttcacccgcggagtacgtcgaagttctgcaggagctgcagcggctcgaatccagactgcaacctttcctgcagagatactacgaagttctgggcgctgccgccacgacggactacaataataatcacgagggacgggaggaggatcaacgccttatcaatctagtgggcgaatcactccgcttgctcggcaacaccttcgtggcattgtctgacctgaggtgcaacctagcatgtactccaccacggcacttgcacgtggtgaggccaatgtcccactacactacccccatggttttgcaacaggccgcgattccaatacagataaacgttggcacaaccgtgacaatgaccggcaacgggacacgcccccctcctaccccaaacgccgaggcccccccgccgggaccgggccaggcttcatcagtggctcccagcagcaccaacgtggaatcgtctgccgaaggcgctcctcctcccggtcctgcacccccgcctgccacctcccatcccagagtgatacgtatctcacatcagagcgtggagccagtcgtgatgatgcacatgaatatccaggactcaggaacccagcccggtggggtaccttcagctcccaccgggcccttaggcccccctggtcacggtcagacgctggggcaacaggtgcccgggtttccaactgcccccacacgggtcgtaatcgcccgccccacaccaccccaggcgcgtccgtcacacccgggcggaccaccagtgagcggcactctgcagggggccggcctgggaaccaacgccagcctggcccaaatggtatcaggacttgtggggcagctgcttatgcaacctgtcctcgtagcccaggggaccccaggcatggctccccctccagcgccagcaactgcttccgccagtgcaggtaccaccaacacagctaccaccgccgggccagcccccggaggcccagcacagccaccacccacaccacagccatcaatggctgacctgcagtttagccagctgttgggaaatctcctgggacctgccggacctggcgctgggggctccggcgtggcatcccctaccatcaccgtggccatgcctggcgttcccgcattcctgcagggcatgactgactttctccaggcaactcagacagccccacctcctcctcccccacccccacccccccctcccgccccagagcagcagaccatgcctcctcctggtagtccgagcgggggcgcaggatctcccggcgggctcggactggagtccctttcgccagaattcttcacatccgtggtacaaggagtcttgagttcactgttgggatcactaggggctcgggcgggcagctcagagtcaatcgctgcttttattcagaggttatccggctcaagcaatatcttcgagccgggcgcagatggggctctaggctttttcggcgccctcctgtcccttctctgtcagaacttctccatggttgacgtggtgatgcttttgcacgggcacttccagccactccagagactgcagccacagttgaggtcattctttcaccagcattatctgggagggcaggagcccacgcctagcaacatcagaatggccacgcacacactcattacagggctggaagagtacgtgcgggagtcatttagccttgtgcaggtccaaccgggcgtggacattatcaggaccaacctcgagttcttacaggagcaattcaacagcattgctgcccacgtcctgcactgtaccgatagtggctttggggcacggctgctcgagctgtgtaatcaggggttgtttgagtgtcttgcgctgaatctccattgcctgggtggacaacaaatggagttggcagcggtgatcaacggccgcatccgccggatgagtcgcggcgtgaatcccagtctggtgtcctggctgacaaccatgatgggcttaaggctccaagttgtccttgagcacatgccggtcggccctgatgccatcctgcgatatgtacgtagagtcggcgacccaccacagccattacccgaggaacctatggaggtacagggagccgagcgcgcatcccctgaaccccagcgcgaaaacgcctctccagcgcctggcaccacagctgaagaggccatgagcagggggcctccgccagctcctgaaggagggtctagggatgagcaagacggggctagcgcggaaacagagccttgggctgcagccgtgcccccagagtgggtgccaataatccagcaggatatccagagccagagaaaagttaaacctcagccaccactgtccgacgcgtacctttcagggatgccagcaaaacgtcgaaagaccatgcagggggagggtccgcagttactgctatcagaggccgtgagcagagccgccaaggctgccggtgcccggcccctcactagtccggagagcttgtcacgtgacttggaggctccagaggttcaggagtcctacaggcagcagctgcggtccgacatccagaagaggttgcaagaagatcccaactacagcccacagcgttttccgaacgcgcagcgcgccttcgccgatgatccctag

SEQ ID NO: 109508 - DNA, 3489 bp, Artificial Sequence
  Description of Artificial Sequence: Synthetic coding sequence
atggagcccaacgattcaacttccacagctgtggaagaaccggactcactcgaagtgttggtcaaaacattggattcgcaaacaaggactttcattgttggggctcagatgaatgtcaaagaatttaaagaacacatagcagcctcagtgtccattccatccgaaaaacagaggctgatctatcaaggccgggtcttgcaggacgataagaagttgcaagagtataatgtcggggggaaagtgatacatctggtagaaagagctccgcctcagacccacttgccaagtggggcatcctctggcaccggttctgccagcgcaactcacggtggcggctcaccccccggcacgcgcgggcctggtgcgtccgttcacgatcgcaacgcaaactcctatgtgatggtgggtacctttaacctgccgtcagacggatcggcagtggacgtgcatattaacatggagcaagcacctattcagtccgagcctcgggtgcgactggtgatggctcagcatatgattagagacatccagacactcctgtcaaggatggagtgcaggggggggccacaaccccagcatagtcaaccaccaccccaaccccccgccgtcacacctgagcccgtagcccttagttctcagacatcagagccagtcgaatcggaagcacccccgcgggagccgatggaggccgaagaggtcgaagagagggcaccagcccagaatcctgagctcactccaggccccgcccccgccgggcctaccccagcgcccgagaccaacgctcccaaccatccaagccctgccgagtacgttgaagtgctacaggagcttcagcggctggagagccggctgcagccttttttacagcggtattatgaagtgctgggagccgccgccacgacagattacaacaacaatcacgagggccgggaagaggaccagagactgatcaacctggtaggcgagagccttcgccttttggggaatacttttgtggctttgtccgatctaagatgtaatcttgcttgtactccccctagacatctccacgttgtgcgtcctatgtcacactataccacccccatggtgcttcagcaggccgccatcccaatccagataaacgtgggcaccacagtcaccatgactggaaatggcacgcggccaccaccaactccgaacgccgaggccccacctcccggacccgggcaagcttcgtccgttgccccttccagcacaaacgtggaatcatctgccgaaggggcaccaccccctggcccagcccccccccccgctacatcacacccgagagtgataaggataagtcatcagagcgttgaacctgtagtaatgatgcatatgaatatacaagactctgggacgcagccaggaggcgtgccctccgcccccactgggcccctgggtccacccgggcacggacaaaccctggggagtaccttaattcagctgccatctctgccccctgagtttatgcacgctgtggctcaccagatcacacaccaggccatggtggcagcggtggcttccgctgccgccgggcagcaggtccccggatttcccaccgcgcccacccgagtggtgattgcccggcctacgccccctcaggcgaggcccagtcacccaggggggccacccgtgagtggcacccttcaaggcgccggcttgggtacaaatgcaagtctggctcaaatggtgagtggtctcgtgggacagctgctgatgcagcctgtcctggtagctcagggaacacctggaatggcgccgcctccagccccagccacagcttctgcctctgcagggaccactaacactgcaacaacagcgggccccgcaccgggcggccctgctcagcctccccctacgccacagccaagcatggccgatctgcagttctcacagctgctaggaaacctgctgggaccggcagggccaggtgccggagggagcggcgttgcttcacctacgatcaccgtcgccatgccaggagtacccgccttcctccaggggatgacagattttctgcaggccactcagactgcaccaccaccccccccgccgccccctccgccccccccggcccctgagcagcaaaccatgccacccccaggtagtcctagcggaggtgcagggtcccctggggggcttggcttggagagcctctcacccgagttttttacaagtgtggtgcagggcgtgctaagcagcctgcttggatctctgggtgcacgcgcaggcagctcagagagcatcgctgccttcatacagcgactgagcgggtcctccaatatctttgaacccggagctgacggggctctggggttcttcggagctctgttatccttgctgtgccagaatttctccatggtcgacgttgttatgctcctccacgggcattttcaacccttacagagactgcagccgcagctgaggtctttttttcatcagcactatctgggagggcaggagccgaccccaagcaatattagaatggccacacatactctcatcactggactcgaagagtatgttagggaaagctttagtctggttcaggtacagccgggtgtcgacattatacggacaaacctcgagttcctgcaagaacagttcaatagtattgccgcacacgtcttgcactgcaccgatagtggctttggggcccgtctgctcgagctgtgcaatcaaggcctgttcgaatgcttggctctgaatcttcattgtttgggaggtcagcagatggagctggcagccgtgattaatggacggatcaggagaatgagcaggggagtgaatccatctctggtgagttggttgacgacaatgatgggcctgcgcctgcaggtcgtccttgaacacatgcccgttggaccagatgccatcttaaggtatgtgagacgcgtaggagaccctccccaaccgctgccggaggagcccatggaagtgcaaggggccgagagagcttcccctgagccacagagggaaaatgcttcccccgcacccggcaccacagcagaagaggccatgtctcgcggcccacctcccgcgcctgagggcggctctcgggatgagcaagacggggcttctgcggagacagagccttgggcagccgccgtcccaccagaatgggtgccaattatacagcaggacattcagtcacagcgaaaggtcaagccacaaccacctctgtcagatgcgtacctctccggcatgccagctaagaggagaaaaaccatgcagggagagggaccccagctgctgctcagcgaagccgtgagccgcgccgccaaagctgccggggccaggccattgacctccccagagtctctgagccgcgatctggaggctcccgaagtgcaggagtcgtaccggcaacagctgcgctcggatatccagaagcgcttgcaagaagaccctaactactcaccacaacgcttccccaacgctcaacgcgccttcgcagacgacccttag

SEQ ID NO: 109509 - DNA, 738 bp, Artificial Sequence
  Description of Artificial Sequence: Synthetic coding sequence
ccacctcgccaccttcatgtggtccggccaatgtcccactacaccacccctatggtactgcagcaggctgctatccctatccaaatcaatgttgggacgacagtaacaatgaccggaccggcccccccaccggctacttcccatccccgagtgatacggatttcccaccagtctgtagagcccgtcgtgatgatgcatatgaacattcaggatagtggcacacagcctggaggcgtgccaagcgctccaacaggacccctgggcccacctgggcatgggcaaaccctgggacagcaagtgcccggctttccaactgcaccaacgcgcgtagtgattgccaggcccactcctccccaggccagacccagtcaccccggaggtcccccagtatccgggacacttcagggggctggactcggcaccaatgcttcactggctcagatggtcagtggactcgtgggacaactgctgatgcagcctgttctagttgctcaggggactcccggaatggcccccccgcccgcccccgctactgcaagtgcgtctgccggtaccaccaacacagccacaactgcaggcccggcaccaggaggccctgcacaacctccccccacaccgcagccttcaatggcagacctgcaatttagccagttactgggtaacctgttgggcccagcgggtccaggagcagggggaagcggcgttgcctcacctactataactgtagccatgccctag

SEQ ID NO: 109510 - DNA, 3381 bp, Artificial Sequence
  Description of Artificial Sequence: Synthetic coding sequence
atggagcccaacgactctaccagtacagccgtggaggaaccggacagcctcgaggtcctcgtgaaaactttggattcccaaacaaggacatttattgtgggagcccagatgaacgtgaaagaattcaaggagcatatcgctgcttccgtctccatacccagtgagaagcaacggcttatctaccagggtcgtgtcttacaggatgacaaaaagttacaggaatataacgtcggcggcaaggtgatccatctggtcgagagggcaccgcctcagacccatcttccttccggagcatccagcggtacaggctcagcttcggccacccatggggggggctcccctcccggtacgagaggcccaggagcgagcgtgcacgatcggaacgccaacagttatgtgatggtgggtacctttaatttgccatctgatggatctgctgtagacgtgcacataaatatggagcaggcaccgattcagtcagaacctcgagtcagactcgttatggctcagcatatgatcagagatatccagaccctcttaagtcggatggaatgtcgaggcgggccccagccccagcatagccagcccccaccccaacctcccgccgtcacacctgagcccgtggctctgtcctcccagaccagcgagccggtagagtccgaggctcccccgagggaaccaatggaggcggaggaggtagaggagagggcaccagcgcagaacccagaactgaccccaggacctgcccccgcgggacccactcccgcgccggaaactaacgcaccaaaccaccctagcccggctgaatacgtggaggttctacaagagttgcagagactggagtcccgcttgcagccattcctgcagcggtactacgaagtgctgggggccgcagctactaccgattacaataacaaccacgagggcagagaagaagatcaacgtctgatcaacctcgtcggagaatctctgcgtctcctcggtaatacatttgtggctctgtctgatcttagatgcaacctggcttgcacaccacccaggcatctccatgtcgtccgtccaatgtctcactatacgacaccaatggttctacagcaggccgctatccctatccaaatcaacgtagggacaaccgtgacaatgacaggcaacggcaccagacccccgcccaccccaaatgctgaggcgcccccgccgggaccgggacaggcttcttcggtggcgccttccagcaccaatgtggagtcaagcgcagaaggcgccccccctcctggccctgcccctcctcctgccacaagccatccccgcgtgatccgaatctctcatcagtcagtggagcccgtggtgatgatgcacatgaacattcaagactctggcacacaaccaggtggtgtcccgtccgctcccaccggtccactaggccctcccgggcatggacaaactctcggtcagcaggttcccggctttccaaccgccccgacccgcgtcgtgatcgcaaggcctacaccccctcaggcccgccccagccaccctggtggtccgcccgtgagcgggaccctacaaggtgcggggctgggtacgaatgcgagcctggcccagatggtgagcggcctggtaggacagttgcttatgcaaccagttctggttgcgcagggtactcccggcatggcacccccccccgctcctgccactgctagtgcctctgccgggactactaacacagccactacggctggccctgctcctgggggccccgcccaaccgccaccaacgcctcaacctagcatggctgacctccagttctcccagctgttagggaatcttctaggccctgcaggacctggggccgggggtcctggcgttgcttccccaaccataactgtggccatgcctggggttccagcgttcctgcaggggatgaccgactttctccaggctactcagacggctcccccccctccaccacccccacccccccctccccctgctccggagcagcaaaccatgcctccccctggaagcccgtcaggcggcgccggcagcccagggggcctgggactggaaagcctgtcccccgaattttttacgtctgtggtacagggtgttcttagtagcctgctgggctccttgggggcgcgcgctggatcttctgagagtatcgccgcattcatacaacggttgagtggtagctcaaatatcttcgagcccggagccgatggggctctgggcttttttggggctctgctgtccctgctgtgccagaactttagcatggtcgacgtggtgatgctgttacacggccacttccagcctttgcagcggctccagccacaactgagaagtttcttccatcagcactatctgggaggccaggaacctactccttctaacattaggatggcaacccataccctgatcactggcttggaggaatacgtgagagaaagttttagcctggtgcaggtacagcccggggtcgacattatccgcaccaacctggagttcctacaggaacagtttaacagcattgctgcacacgtgcttcactgcactgacagcgggttcggtgcccgcttactcgagctatgtaatcaaggtttgtttgaatgcctcgcactgaacttgcattgccttggaggccagcagatggagttggcagcggtcataaacggcaggatcagacgaatgtccaggggcgtgaatcctagcctcgtgtcatggctaaccacaatgatggggctcagattgcaggtggtgttggagcacatgcccgttggtcctgacgcaattctgcgctacgttagacgtgtcggtgaccctcctcagccactgcccgaggaacctatggaggttcagggggccgagcgagcatctcctgaacctcagcgagagaacgcatcccctgcccccggcacaacagccgaagaagcaatgtcacggggtccgccccctgctcccgaaggtggctctcgggacgagcaggatggcgcatccgccgagacggagccatgggctgctgccgtgcctcctgaatgggtccctatcatccagcaggacattcagtcccagcgcaaagtgaaaccgcagccaccactgagcgacgcctacctgtctgggatgccagctaagcggcgcaagacaatgcaaggggagggaccccagctgctcctgtccgaggccgtgagcagagcagccaaggccgctggagccagacctctcacctctcccgaatcactctcccgagacctcgaggccccggaagtccaagagtcatatcggcagcaactgcggtccgatatccagaagagactgcaggaagatcctaattatagtcctcaacgctttccgaatgcccaacgggcattcgccgacgacccctag

SEQ ID NO: 109511 - DNA, 789 bp, Artificial Sequence
  Description of Artificial Sequence: Synthetic coding sequence
atggagccaaatgattccaccagcacagctgttgaagaaccggacagcttagaggttctcgtcaagactctggactcccagacacggactttcattgttggggcacagatgaatgtgaaagaattcaaggaacacatcgcagccagtgtctccattcccagtgaaaaacagaggttgatctaccaaggcagggttttacaagatgataagaaactgcaagagtacaacgtgggaggtaaagttattcacctcgtcgagcgcgcacccccgcagactcacctgccaagcggggcctcatctgggactgggagcgccagtgcgactcatggtggggggtccccccccggcactaggggtcccggtgctagtgttcacgatcgcaacgccaattcctacgttatggtgggcactttcaacctgccatccgacgggtctgctgtggatgtccacataaacatggagcaggcaccaattcagagcgagccccgggtacgtctggttatggcacagcacatgatccgggacatccagacacttctgagccgtatggaatgccggggaggtccacagccacagcacagtcagcctccaccacagccaccagctgttaccccagaacccgtagcattgagcagtcagacttcagagccagttgaatccgaggcaccgcctagggaacccatggaggcagaggaagtcgaagagcgggcccccgctcaaaaccccgagctcacccctgggccagctcctgccggacccacaccggcccccgagacaaacgctccatag

SEQ ID NO: 109512 - DNA, 717 bp, Artificial Sequence
  Description of Artificial Sequence: Synthetic coding sequence
tcttccgctgaaggtgcaccgcctccaggaccagctccgcctccagctacttcccacccgcgagtgatccgaatatcacatcagtccgtcgaaccagtggtgatgatgcatatgaatatacagggaccgttatcattaagcccttgtccagatagtggtactcagcctgggggtgttccatctgcaccaacgggccccctgggacctcctgggcatggacagactctcgggcagcaagtccccgggttccctacagcacctacaagggtggtaattgctcgcccaaccccccctcaggcaagaccctcccaccccggcggaccccccgttagcggaaccctgcaaggcgcaggcctgggaaccaatgctagtctggctcagatggtctccggccttgtcggtcagctcctgatgcagcccgtccttgtagctcagggtacccctgggatggcgccaccacccgctcccgcaacagccagcgcctccgcgggcacaacaaacaccgcaaccacggccggcccagccccggggggacccgcccagcctcctccaactccacagcccagtatggcggacctccagttctctcaactgctcggaaacctattgggccccgccggaccgggcgctggcggccccggagtggcctcacctactattacagtggccatgcccggggtcccagcgtttctgcagggcatgacggatttcctatag

SEQ ID NO: 109513 - DNA, 3381 bp, Artificial Sequence
  Description of Artificial Sequence: Synthetic coding sequence
atggagccaaatgattcaacatccaccgccgtcgaagaacccgactcgttagaagtgcttgtcaaaactctggatagtcaaaccaggacatttattgttggcgcccagatgaatgtcaaagaattcaaggaacatatcgccgcatcagtatccattccttcggaaaagcagcggctgatttatcaaggtcgcgtcctgcaggacgataaaaagcttcaggagtataacgttgggggtaaggtaattcaccttgtagaacgcgcccccccacaaacccacctacctagcggtgcctccagcgggaccggatcggcttccgccacacatggaggaggttctccccctgggacccgcggcccaggcgctagcgttcacgacaggaatgccaattcatacgttatggtcggcacctttaaccttcccagcgacgggtccgcggtagatgtgcacataaacatggagcaggctccgatccaatccgagcccagggtgcggcttgtcatggcccaacatatgatcagagacatccagacactgctgtcccggatggaatgcagaggtggcccgcagccacagcactcacagcctccaccgcagcctcccgcggtgacccctgagcctgtggcgctttccagccagaccagtgaacctgtggaatccgaggccccaccaagggagcccatggaagccgaagaagtggaggagcgcgcacctgctcagaaccctgagttgacccctggccccgccccagcaggacctacaccagcaccggagacgaacgcacccaatcacccatccccagcagagtacgtcgaggtcctacaagagctgcagcgactggagagcaggctgcagcctttcctccagaggtattatgaggtcctcggcgctgcagcaacgactgattataacaacaatcatgaaggacgggaggaagatcagcggctgataaacctcgtgggcgagagcctaagactgttgggcaatacttttgtggcgttgtcagacttaaggtgtaacctagcttgcaccccccctagacacctgcacgtggtgagacccatgagccattatactaccccaatggtcctacagcaggccgccatccccattcaaattaacgtcggcaccaccgttaccatgaccggaaacgggacccgaccacccccaactcctaacgcagaggctccacccccagggcccggccaggcttccagtgtggcccccagctccactaacgtcgaatcaagtgctgagggagcgcccccacccggcccagcgccacccccagccacaagtcatcctcgtgtgatcaggatctcccaccaaagcgtcgagcccgtcgtgatgatgcatatgaacatccaagactctggcacgcagccaggtggcgtccctagcgccccaacagggcccttgggccccccaggccacggacagaccctcgggcagcaagtccccggctttcctacagccccgactcgggtggtgatagctcgcccaacccctccacaagccaggccatcacaccctgggggccctcccgtctccgggacactgcagggagcgggactgggcaccaacgcaagcctcgctcagatggtaagtggattggtggggcaattgcttatgcagcccgtgctcgttgcccaggggacccctggcatggcccccccacctgcacctgccaccgctagtgcttccgccggaactaccaacacagccaccacggcagggcccgctcccgggggccccgcccagccaccccccaccccccagcccagtatggctgacttgcagttcagccagctgctcggaaacttactaggccctgctggccccggagcgggtggccccggcgtggcttcccccaccattaccgtggccatgcctggcgtgcccgcatttctgcagggaatgaccgacttcttgcaagcgacccagaccgccccccccccccccccccctcctcctcctccacccccagcgccagaacagcaaactatgcccccacccgggtcaccatcaggcggcgctgggagccctggagggcttgggctcgagagcctgagcccagaatttttcacctccgtggttcagggagtgttatcatctctactggggtcactaggcgctagggccggatcctctgagtccattgccgcctttatccaaaggcttagtggctcgagtaacatcttcgaacccggggcagatggagcactcggtttcttcggcgcactgctgagcctgttatgtcagaattttagcatggtggacgtggtcatgctcctccacgggcactttcagccgctccaacggctgcagccccagctgaggtctttcttccaccagcactacctggggggccaggaaccaacaccatccaacatacgcatggcgactcatacactgatcaccgggctcgaagagtatgtgagagaatccttttccctagttcaggttcagcccggggtcgacatcataaggactaacttagagtttctgcaggagcaattcaacagtatagcagcacatgttctacactgtacagactccggctttggcgcgcgactcctggaattgtgcaatcaaggcctgttcgagtgcctcgctctgaacttacattgcctggggggccaacagatggagctcgccgccgtgatcaatggaagaattagacgcatgagtcggggggtgaacccaagccttgtgagctggcttacgacgatgatggggttacggctgcaggtggtgctggaacatatgcccgtgggtcccgatgcaatcttgagatatgtgaggagggtcggtgatccgccccagccactcccagaggagcccatggaagtccagggggcggaacgcgccagtccagagccacagcgcgagaacgcctcgcctgctcccgggaccacagccgaggaagcaatgagcaggggaccacctccagccccagaaggtgggagcagagatgaacaggatggcgcatccgctgagaccgagccatgggccgccgcggtgccgcctgagtgggtgcctatcatccagcaggacattcagagtcaacgcaaggtgaagccccagccacccctgtccgacgcatacctgtctgggatgccggctaagcgccgaaaaactatgcagggggaaggcccccagcttcttttatctgaagctgttagtcgggccgctaaggcggctggcgcacggcctttgactagccctgaatctttgagcagggacctagaggcccctgaggttcaggagtcataccgccaacagctccgctcagacatccagaagagactgcaggaggatccaaactattctccacagcggtttccaaatgcccagagagcctttgctgatgatccgtag

SEQ ID NO: 109514 - DNA, 648 bp, Artificial Sequence
  Description of Artificial Sequence: Synthetic coding sequence
atggagccgaatgacagtaccagtacagcagtcgaggagcccgactctctcgaagtgttggtgaaaaccctcgacagccagaccagaacctttatcgtcggagcgcaaatgaacgtaaaggaatttaaagagcatatcgccgcctctgtttcaattccttctgaaaagcagcgcctaatctaccagggacgcgtcctgcaggacgacaagaaactccaggaatacaatgtcggcggcaaggtgattcatttggttgaacgggcccccccacagacccatctgccatcaggggcctcctcagggacaggctccgccagcgctactcatggcgggggatccccccccggtactcgtggcccaggagcctccgtgcatgaccggaatgcaaactcgtatgtcatggtcggtacattcaacctgcccagcgaacctcgcgtaagactggttatggcccagcacatgatccgtgatatacagacactccttagccgtatggagtgcaggggcggaccgcaacctcagcactcacagcctccaccccagcctcctgccgtaactcccgagcccgtggccttgtcaagccagacaagcgaacctgttgagagcgaagccccccctcgagagccaatggaagctgaagaggtgtag

SEQ ID NO: 109515 - DNA, 789 bp, Artificial Sequence
  Description of Artificial Sequence: Synthetic coding sequence
atggaaccaaacgatagtacctccactgcagttgaagagcccgacagcctggaggtgctcgttaaaaccctggactcccagacaaggacatttatagttggcgctcagatgaacgttaaagaatttaaagagcacatagccgctagcgtttcaatcccctccgagaaacagcggctaatctatcaaggccgtgtcctccaggatgacaaaaagctccaggagtataacgtcggcgggaaggtgatccacctcgtagaacgggctccgcctcaaacccaccttcccagcggggcttcttcagggactggatcagcatccgctacacatggcggcggtagcccccccggaacacgcgggcccggcgcaagcgttcacgaccgaaatgccaatagctatgtgatggtgggaacctttaatctgcctagcgacggttcagctgtggatgtccacattaacatggaacaggcccctatccagtcagagcccagggtcaggctggtgatggcacagcacatgatacgagacatccagacgctgttatcgcgtatggagtgccgcggcggcccacaacctcagcactcccaacccccaccccagccaccagctgtgacacccgagccagtggcactcagtagccagacgtccgaaccagtagagagtgaggctcccccacgggagcccatggaggcggaggaggtggaagaaagagcaccggctcagaatccggagctcacgcctggaccagcccctgcgggtcccacacccgcacctgaaacaaacgcgccctag

SEQ ID NO: 109516 - DNA, 2232 bp, Artificial Sequence
  Description of Artificial Sequence: Synthetic coding sequence
atggagcctaacgacagcacgtcaactgcagtcgaggaacccgatagcctcgaggtcttagtcaagaccctggactcacagacgaggacattcattgtgggggctcagatgaacgttaaggaattcaaagaacacatcgctgctagcgtgtctatcccttcagagaaacagaggctgatttaccaggggagggtgctgcaggacgacaagaagctgcaggaatataatgtgggcggcaaggtcattcacctggtcgagcgggctccacctcagacccatctcccctcaggcgcctcttccggtactggcagtgcctccgccacgcatggtggtgggtccccaccgggaaccagaggtcccggcgccagcgtgcatgataggaatgctaactcttacgtgatggtggggacattcaacttaccgtcagatggcagtgctgtggacgtgcacattaacatggagcaggcccctatccagtccgaacctagagttaggctcgtgatggctcagcacatgatcagggacatccagacactcctgtctcggatggagtgccgcggtggcccccagccacagcactcacagccaccgcctcagccccctgcagttacccctgagcctgtggccctgagcagccagacttcggaacctgtagagagtgaagcaccccctcgagaacctatggaggctgaggaagtggaagaaagagcgccagcacagaaccctgagcttacccccggcccagcccctgctggccctacgccggcccctgagactaacgccccgaaccacccttcacccgccgagtacgttgaagtgcttcaggaacttcagcgactggagtctcgactgcagcctttcctgcagagatactacgaggtccttggggctgccgccacaactgattataacaataaccatgaaggacgcgaggaggatcagaggctgattaacctagtgggagagagtctcaggctgctcggaaatacattcgttgctttgtcagacttgcgatgcaatctagcatgcaccccaccgagacacctccatgtggtgagaccgatgtcacactatacaactcccatggttctgcagcaggcggccattcccatccagattaacgtgggcactactgtgaccatgactggtaatggcacacggccaccacctacccccaacgcggaagcaccgcccccggggccaggacaagcaagttcagtagcccctagctccaccaatgtagaatccagcgccgagggagctccaccgccagggccagctcctccacccgcaaccagccacccaagagtcatccgaatatcccatcagagcgtcgaacccgtagtgatgatgcatatgaacattcaggatagcggcacccagcccggcggagtacccagtgcccccaccggacccctaggtccccctggccatggtcagacattgggttcgaccctgattcagctaccatccttacctcccgaatttatgcatgcggtggctcatcaaattacccaccaggccatggttgcagcagtggctagtgctgccgccgggcagcaggtgcccgggttccctactgcacccacaagagtcgtgattgcacggccaacccccccccaggccaggccgagccatcccggcggccctccagtgtcaggcacattacagggcgcagggttgggcactaacgcatccctggcacaaatggtcagtgggctggtggggcaactgctgatgcagcccgtactggttgcacagggaacgccgggtatggctcccccacccgcccccgccacagcctctgcctccgcaggtacaacgaacacggcaacaacagcaggaccagctcccgggggtcccgcccagcctccaccaacccctcagccctcgatggcagaccttcagtttagccagttgctgggcaacctcctgggccctgcagggcccggggcagggggccccggggtagcctcacccactataacagtggctatgccgggagtccctgcttttctgcaggggatgaccgatttcctgcaggctacacaaacagcccctcccccgcctccccctcccccgccccctcccccagcacctgaacagcagacaatgccccccccgggatcaccaagtggaggtgccgggtctcctggtgggctgggcctagagagcttgtcacctgagttctttacgagtgtcgtccagggcgtactgagtagcctgctttag

SEQ ID NO: 109517 - DNA, 3381 bp, Artificial Sequence
  Description of Artificial Sequence: Synthetic coding sequence
atggaacccaatgacagtacctcaaccgcagtggaggagccggactcactggaagtattggtaaagaccctggacagccaaacacgcacattcatcgtaggcgcccagatgaatgtgaaagaattcaaggaacatatagctgcgagcgtgagcatcccatcggagaagcagcggcttatctaccagggaagagtgctccaagatgacaagaagctgcaggagtacaacgtgggaggcaaggtgattcatttagtggagcgcgcccccccacagacccacctgccaagcggcgccagttctggaacaggctccgcctccgccacacacggtggaggctccccaccgggcactagaggtccaggtgccagcgtccacgaccgcaatgctaactcttatgtgatggtcgggacattcaacctgcccagcgatgggtcagccgtggatgtccacataaatatggagcaagcacccatacagagtgaacctagagtccgattggtgatggcccagcatatgatccgagacattcagacactactctccaggatggagtgccgcggcggtccccagccacagcacagccaaccccctccgcaaccaccagcagtcacgccagagcctgtggcgttaagcagccagacttcggaacccgtggaatcagaggcacctcctagagagccaatggaagctgaggaggtggaggagcgggccccagcacagaaccctgagttaacacccggccccgcacctgcggggcccacccctgccccggaaaccaacgctccaaaccaccccagccccgccgagtacgtggaggtgctgcaagagctgcagaggcttgagtctcgactccagccatttttgcagaggtattacgaggtcctgggcgccgctgcaaccacggattataataacaaccacgaagggcgtgaggaggatcaaagacttataaacctggttggggagagtctgcgactgctcggtaataccttcgtggcactcagcgacctgcggtgcaatctggcttgtacgcctcctcggcatttacacgttgtgcgcccaatgagccactataccactccaatggtgctccagcaggccgcgatccccatccagatcaacgtgggcacgactgtcacgatgaccggcaacggaacgagaccaccgcctacacccaatgcagaagcgcctcctcctggacccggacaggcttcatccgtcgcaccaagctcaaccaatgtggagagcagtgcagagggcgcaccaccaccggggcctgccccgccccctgccacctcacaccccagggtgatccgcattagccatcagagcgtggagcccgtggtaatgatgcacatgaacattcaggactccggaacccagccgggtggcgtgccgtcagcaccaacaggccctctgggtcccccaggacacggccaaacgctggggcaacaggttccaggctttccaacggctcccacccgggtcgtgatagcaagacctactccacctcaagctcgtccgtcacatccaggcgggccgccagtatcaggcacactgcagggagctggcctgggaaccaacgcctctctcgctcagatggtttccggactggtgggccagctgctgatgcagccagtgttagtcgcccaaggaacccccgggatggcgccgccaccagcgccggcaacggccagtgccagtgccggaactactaatacggcaacaaccgccggtccagccccaggaggccctgcacagcccccccctacacctcagcctagcatggctgacttgcagttctcccaattactgggcaatttgctcggtcccgcggggccaggcgcaggcgggcccggcgttgcctctccaaccataaccgtggctatgcctggtgtcccggcctttctgcaaggaatgaccgatttcctccaggccacccagactgcaccacccccccctcctcctccaccaccccctcctcctgcgcctgaacagcagaccatgccgcccccgggaagtccgagcgggggggccgggtcacccggggggcttggccttgagtccctgtcgccagaattttttacctcagtcgttcaaggcgtgctgagttccctgctcggctccctcggcgcacgcgccggctcctcagaaagcatcgccgcgttcatccagcgcctgagcgggtcgtctaacatatttgaacctggagccgacggcgcgcttggcttctttggggcccttttaagtctgctgtgccagaacttttccatggtcgatgtggttatgctcctgcacggccacttccagcccctccaacggctgcagccccagctgcgttcctttttccaccagcactatcttgggggccaggaacccacgccttcgaacatcaggatggctacacacacgttgattacaggactcgaggaatacgtacgcgaatctttttcattagtgcaggtgcagccaggcgtggatattattcgcacaaatcttgaatttcttcaggaacagttcaatagcatcgcggcacacgttctccactgcacggactctgggttcggggctaggctgctggaactgtgtaaccagggtctgtttgagtgcctagccttaaatttgcactgcttaggaggacagcaaatggagctggccgccgttatcaatggcagaatccgtagaatgagtcggggagtcaatccatctctggttagttggttgacgaccatgatggggctccgcttgcaagtcgtactggaacacatgcctgttgggcccgacgctatattgcggtacgtgaggagagttggtgatccaccccagcccctcccagaggaacccatggaggtccagggggcagaacgcgcgagcccagagcctcagcgtgagaatgcctcgcctgctcctggcacaacagcagaagaagccatgagccgggggcctccccccgcacccgaagggggaagccgcgacgaacaggacggggcctccgccgagactgaaccgtgggctgctgcagttccacccgaatgggtccccattatccagcaagacatacagtctcagagaaaagtaaagccacagcccccactatccgatgcctacctctctgggatgcccgccaagaggcgaaaaaccatgcagggggagggcccacagctactcctgtccgaggctgtgagccgggcagctaaggctgccggcgcccggccgctcacctccccagagtctctgtcccgagacctcgaggcacccgaagtgcaagagagctacagacaacagctacgctcagatattcagaagcggctgcaagaagaccccaattacagtcctcagagatttcctaacgcacagcgcgccttcgccgatgacccatag

SEQ ID NO: 109518 - DNA, 3381 bp, Artificial Sequence
  Description of Artificial Sequence: Synthetic coding sequence
atggagcccaacgattcgacttccacagcggtggaggagcctgattcacttgaagttctggtcaagacattggatagccagacccggacttttatagtgggtgcacagatgaatgtgaaggaattcaaagaacatatagccgcctcagtttcaattcctagcgagaagcagcgcctgatttaccagggaagagtgctacaggacgataagaagctccaggaatataatgtggggggtaaggtcattcacctggtggaacgagctccccctcaaacccacctcccaagcggcgcaagttcggggaccggttctgctagcgctacgcatggcggagggagtccccctggtacccgcggccctggcgctagtgttcacgaccggaacgccaactcatatgttatggttggaaccttcaatctgccatctgacggtagtgccgtggacgtgcacatcaacatggaacaggcacccatccagagtgagccgcgggtccggttagttatggcacagcacatgatccgggacatccaaacactgctttctcggatggaatgccgcggaggtccccagccgcaacatagtcagcctcccccacagccacctgctgtgacgcccgaacctgtggccctgtcctcccagactagtgaacccgtcgagtctgaagccccccctagagagccaatggaggccgaggaagtcgaggagcgtgcacctgcccagaatcccgaacttacacctgggcctgcaccagcgggcccgaccccagcccccgaaaccaacgcgccaaatcacccatctccagccgaatatgtagaagtccttcaggagttacaaaggctggagtcacggctgcagccgtttctgcagaggtactatgaggtgctcggggccgctgccacgacagattataataacaatcacgagggacgagaagaagaccagaggctcattaatctcgttggggagagtttgaggttgctgggtaacacttttgtggcactctcggaccttaggtgcaatctggcttgtacccccccgcggcatctgcacgtagtcaggccgatgtctcactatactactcccatggtacttcagcaggcggccatcccaatccagataaacgtgggcactacagtgactatgacaggtaatggaacaagaccgccacctacacccaatgcagaggcccctcctcccgggcccggacaggctagtagtgttgctccctcctctactaatgtggagtcgagtgccgagggggctccccccccggggccagctcccccgccggcgaccagtcaccctagggttatcaggatttcacatcaatcagtagagcccgtcgtgatgatgcacatgaacatccaggattcaggcacccagccaggaggggtgccttccgctcctactggccctctcggcccccccggacatggacagacgttaggccagcaggtcccggggttcccgaccgccccgacgagggtcgtgatagcccgtcccacccctccacaggctcgccctagccacccaggggggccgcccgtgagtggcaccctgcaaggggccggactggggacaaacgcttcattggctcagatggtatctgggctcgttggacaactactgatgcagccagtactggtggcccaagggacaccaggtatggcaccaccccccgcccctgccaccgcctccgctagcgccggaaccaccaatactgccaccacagctggacctgcacctggaggtcctgctcaaccacctccaacacctcagccgtccatggctgatctgcagttctcgcaattactggggaaccttttggggcctgccggaccgggagctggcgggccaggggtagcatcacccacaattaccgtggctatgcctggtgtgcccgctttcttgcagggaatgaccgatttcctgcaggcgacacagaccgccccccctccaccgcctccaccgccaccacctcctccagctcccgagcagcagacaatgcccccccctggaagtcctagcggaggagcgggatcaccaggcggcctggggctggagagtctctcccccgaatttttcactagtgtggtgcagggcgtcctgagttctctgcttggcagtctgggagcccgggctggctcatcggagagcatcgctgcgtttatccagagactctccgggtccagtaacatttttgagcccggtgccgacggcgctctgggcttctttggtgccctcttatcactcctgtgtcagaacttttctatggtcgacgttgtgatgctgttacacggacatttccagcctttacagagactccagccccagctccggagcttttttcaccagcattacctcggggggcaagaaccaacaccaagtaatatccggatggctacccataccctcataactggacttgaagagtacgtgagagaaagcttttcccttgttcaagtgcagccgggtgtcgatatcatccgcactaatcttgagttcttgcaggaacagtttaacagcatcgcagcgcatgtgctgcactgtactgatagcggcttcggagcaaggctgctagaactgtgtaatcaggggttgtttgagtgcttagcgctgaaccttcactgcttgggcggacagcaaatggagctggcagcggtgattaacggtagaatcaggaggatgtcacggggcgtcaatccttctttggtttcttggctcacgactatgatgggtcttagactccaggttgtgctggaacacatgccagtcggacccgacgccatcctacggtatgtgcgtcgcgtgggcgatcccccccagcctttacccgaggaacccatggaggttcagggcgccgagcgcgcctcccctgaaccccaaagagagaatgccagccctgccccaggcacaacagccgaggaggccatgtcacggggacccccccccgcccccgagggcggctcccgcgacgagcaggatggtgcgtctgctgaaacggagccatgggctgctgcagtccccccagaatgggtgcccattatacagcaggatatccagagtcagaggaaggtcaaaccacaaccacccctatccgacgcttacctgtcggggatgccagcaaaaaggcgaaaaacaatgcagggagaaggcccacagttgctgctctctgaggcagtctccagggctgctaaagctgccggtgcacgccctctgacttctccggagagtctgagcagggacttggaggcacccgaagtgcaagaatcttatcgacagcagctgcgaagtgatattcagaagagactgcaggaggatcctaactattccccacaacggtttcccaacgcccagcgggctttcgcagacgacccctag

SEQ ID NO: 109519 - DNA, 411 bp, Artificial Sequence
  Description of Artificial Sequence: Synthetic coding sequence
taaagaatgagtagaggagtaaacccatctctggtctcctggctaacgactatgatgggcttgaggctgcaagtcgtgttggaacacatgccagtggggcccgacgccattctgcgctacgttaggagagtcggagatccacctcagcccctgcccgaggaacctatggaggttcagggtgctgaacgggcatcacctgagcctcaggaatgggtccctatcatccagcaagatatacagtcccagagaaaagtcaaacctcagccgcccctctcggacgcctatttgagcggcatgcccgcgaaacgacggaagctcaggagcgatatacagaaaagactgcaggaggatcccaattactccccgcaaagatttcctaatgcccagcgcgcgttcgcagacgacccatag

SEQ ID NO: 109520 - DNA, 789 bp, Artificial Sequence
  Description of Artificial Sequence: Synthetic coding sequence
atggagccaaatgactcaactagtactgccgttgaagagccagactctttggaagtcctggtgaaaactttggacagtcaaaccaggacatttatcgttggtgctcagatgaacgttaaagaatttaaagagcatatagcagcttccgttagcatacctagtgaaaaacagaggcttatataccaaggacgggtcctgcaggatgataaaaagctccaggagtataacgtaggtggtaaggtgatccaccttgttgaaagggccccgccccagactcacctgccgagcggggcttcctcggggacgggctcagctagcgctacacacggcggcgggtcccctccagggactcgcgggccaggggcgagcgtgcacgatcgcaacgccaactcttatgtaatggtgggtacattcaatttgcctagcgatggatccgcggtggacgtgcatataaacatggagcaggcacccatccagtctgaaccaagggttaggttagtgatggctcaacatatgatacgagacatacagactttactctcccgaatggaatgtcggggggggccgcagccacagcacagtcagcctcccccccagcccccagccgtgaccccagagcccgtggcattgtcctcacagacttctgagcctgtggaatctgaggcacctccaagggagccaatggaagccgaagaggtggaagagcgggcccctgcacagaacccggagctcaccccagggcctgccccagccggtcccacacccgctccggaaactaacgccccctag

SEQ ID NO: 109521 - DNA, 735 bp, Artificial Sequence
  Description of Artificial Sequence: Synthetic coding sequence
atggaaccgaatgattccacttcgacagcagtagaagagccagattcattggaagtgctggtcaaaacgctggactctcaaacacgaaccttcattgtcggggcccagatgaatgtgaaagagttcaaagaacatattgcggcaagcgtgagcatcccctccgaaaagcagcggctcatttaccagggtagagtgctccaggatgataagaagttgcaggaatataatgtaggaggaaaagtgatccacttagtggagcgtgccccaccccagactcatctcccttccggagcctcttccggcactggttcagcctctgcaacacatggcggtgggagtcctcccgggaccagagggcccggcgccagtgttcatgaccgtaacgccaacagctatgtcatggtgggtactttcaacctgccatcggaacctagagttagactagtcatggcacagcacatgatcagagacatccaaacactactgtcgcggatggagtgcaggggtgggcctcagccccagcacagccagccacctccccaaccgccagctgttacgcctgaacccgtcgcactgtcaagccagacctccgagccggttgagtctgaggcccctccacgggagccaatggaggctgaggaagttgaggagagagctccagcccagaatcccgaactcacacccggacctgctccagccgggcccacccccgctccggaaacaaatgcgccctag

SEQ ID NO: 109522 - DNA, 594 bp, Artificial Sequence
  Description of Artificial Sequence: Synthetic coding sequence
atggagccaaatgacagcacctccacagcagtggaagagcccgactcattagaggtcctggtcaagacactggattcacagaccaggactttcatcgttggggcccaaatgaacgttaaggagttcaaggagcacattgcagcatctgtgtctatcccttctgagaagcagcgtcttatctaccagggccgagtcctccaagatgacaagaagttgcaggaatacaatgtgggtggaaaagtgatccacttggtggaacgggctcccccccagacacacttgcctagcggagcgtcaagcgggacaggttccgcctctgccactcatggaggggggtccccacctggcaccagaggtcccggagccagcgtgcacgatcgtaatgccaattcctatgtgatggtggggacgttcaacctaccatccgatggttcggctgtcgacgtgcatataaatatggagcaggcgcccatccagtccgagccccgcgtgaggttagtgatggcccagcatatgattagagacattcagactctgctctccaggatggaatgtaggggaggcccccagccacaacacagccagcctccatag

SEQ ID NO: 109523 - DNA, 621 bp, Artificial Sequence
  Description of Artificial Sequence: Synthetic coding sequence
atggagcccaacgatagcacctcgactgctgtggaagagcctgacagtcttgaagtgcttgtgaagacgctggactcacagacccgcaccttcatcgtcggggcccaaatgaatgtcaaagaatttaaggagcatattgcggcatccgtctcaattccttccgagaaacagcgcctgatctatcaggggcgggtcctgcaagacgacaaaaaactccaggagtataatgtagggggcaaggtgatccacctcgtggagcgggccccccctcagactcacctgccgtccggcgctagtagtggcacaggttcagcctctgccactcatggcggtggtagcccaccaggcacaagagggcctggggcaagcgtgcacgaccgaaatgcaaactcgtatgtgatggtgggcactttcaacctcccaagtgaacctagggtgcgcctagtgatggctcagcatatgattcgtgatattcaaaccttgctgtctcgtatggagtgcagggggggccctcagccccagcattcacagcctccgccgcaacccccagccgtaactccagagccagtcgcattatcatcgcagaccagcgagcctgttgaaagcgaagcaccaccatag

SEQ ID NO: 109524 - DNA, 735 bp, Artificial Sequence
  Description of Artificial Sequence: Synthetic coding sequence
atggaaccaaacgactccaccagcacggctgtagaggagcctgactctctcgaggttctggttaagacgctcgatagccaaacgaggacttttatcgtgggcgctcagatgaacgtcaaggaattcaaagagcacattgcagcctctgttagcatccccagcgaaaaacagagactgatctaccaggggcgtgtgttacaggacgataaaaaacttcaggaatacaatgtggggggtaaagtaattcacctcgtcgagagagccccacctcagacccatctgccgtctggcgcctccagcggtaccggcagcgcctcagccacgcacgggggaggctcccctccaggaacgcgggggccaggtgcatctgtgcatgaccgaaacgccaactcgtatgtgatggtgggcacgttcaacctgccgtctgagcctagagtgcgactggtgatggctcagcatatgatcagagacatccagacactactcagtagaatggaatgccggggagggccgcagccacagcattcacaaccccccccacaacctcccgccgttactcctgagcctgtcgcactgtctagtcagacttccgaaccagtggaatcagaggcgccccctcgggaacctatggaggcagaagaggttgaagaacgtgccccagctcaaaacccagagcttacaccaggccctgcgccagccggacccacccctgcccctgaaactaatgccccttag

SEQ ID NO: 109525 - DNA, 3381 bp, Artificial Sequence
  Description of Artificial Sequence: Synthetic coding sequence
atggagcccaacgattctacgagcaccgccgtagaagagcccgattccctggaagtactcgtgaaaacacttgatagtcaaacacggacattcatcgtcggcgctcagatgaacgtaaaggagttcaaagagcatatcgctgctagcgtttcaatacccagcgaaaagcagcgcctcatataccagggtcgagtgttgcaggatgataaaaagctgcaggaatataacgtgggcgggaaagttattcacctcgtagagagggcacccccacaaactcaccttccttctggcgcaagttctggaaccggttccgccagtgccacacatgggggcgggagccctccaggaactcggggccctggggcctccgtacacgacagaaacgcgaatagctatgttatggtaggaacattcaacttaccttctgatgggagtgctgttgacgttcacatcaacatggaacaggctcccatacaaagcgagcccagggtcaggctggtgatggctcaacacatgatcagggacatccagactctcctatcaagaatggagtgtcgtggaggcccccagccccagcacagccaacccccaccgcaacccccggctgtgacacctgagcctgtggctcttagtagtcaaacatcagagcccgtagagtctgaggctccgcccagggaacccatggaggccgaggaagtggaagaacgggccccagctcaaaatcccgagttgactccgggacctgctccagccggcccaacacctgcccctgaaaccaacgcccccaatcaccctagcccagctgagtatgttgaggtcctccaggaactccaaaggctggaatcgcggctccaacctttcctccagcgctactacgaggtgttaggcgcagcagcgacgaccgactataacaacaatcacgaaggacgggaagaagaccagaggctcatcaaccttgttggcgaaagtctgcgcctgctgggcaacacctttgtcgccttgtctgacttacgctgcaatctggcctgcactcctccccgccacctgcacgtcgttcggccaatgagtcactatacaacgcccatggtccttcaacaggctgctatccccatccagattaatgtcggtacaacagtcaccatgaccggaaatggcaccagaccgccaccaactccaaatgcagaggccccacctccaggacctggacaggcatcatctgtggcaccatccagtaccaacgttgagagctctgcagagggagcccctccacccgggccagctcctccgccagcaacctctcacccccgagttatacgaatcagccatcaatcagtcgagcccgtggtcatgatgcacatgaacattcaggactcgggcactcaaccggggggtgtccctagcgccccaacaggaccactgggtccccccggccatggccagacactcgggcagcaggtacctggctttcccaccgccccaacccgcgttgttatcgcacggcctactcccccgcaggcacgcccgtctcaccccggtggcccaccggtgtccggcactttgcaaggagccggattgggaaccaacgcttctcttgcacaaatggtgtcggggcttgtaggccaattactcatgcagcccgtgcttgttgctcaaggcacaccaggtatggcacctcccccagcacctgcaacagcttctgcctcagccggcactactaacaccgccactaccgctggcccagcccccgggggccccgcccagccacctcccacccctcaaccttcgatggccgacctacagttctcacagctactcggcaatctgttggggcctgcagggcccggagcaggtggtagtggcgtggcaagtccaacaatcacggtagcaatgcctggtgtgccagcatttttgcagggcatgacagactttctgcaggccacccagaccgccccgccacccccaccgccaccgccaccccctcctcccgcacccgagcaacagaccatgccaccaccgggttcccctagcgggggcgctggatcacccggcggcttagggctcgagagcctatcacccgagtttttcacatcggtggtccaaggcgttttatcctcgctgctgggatccttaggtgcacgcgccggctcctcggagtccatcgccgctttcatccagagactttctgggagcagcaacattttcgagcctggagccgacggagctctgggatttttcggcgcccttctgtctttgctgtgccagaattttagtatggtggatgtggtgatgctgctacacgggcattttcagccccttcaacgcctccagccccagcttcggagcttcttccatcagcattatctggggggccaggagcccacccctagtaacataagaatggctacgcacacactgattaccggtctcgaagagtacgttcgggagagcttctccctggtgcaggttcaacccggagtggacattatccggacgaacctcgaattcctacaggagcagtttaactccatagccgcccacgtactacattgtaccgattcaggattcggtgcgcgcttgcttgaactgtgcaaccaaggcttgttcgaatgcctcgctctgaatttgcactgcctgggcggccagcagatggaacttgccgccgtgattaacggaaggatcagacgaatgtctagaggcgtgaatccatctctagtctcctggctgaccactatgatggggttaagattacaagtggtgttagagcacatgccagtgggccctgacgccatcctaaggtacgttaggcgcgtgggggatcccccgcagccactccctgaggagccgatggaggtccagggggctgaacgggcctctcccgaaccccagagggagaacgcctcacctgcccccgggacaacagcagaggaggccatgtctagaggcccaccgcctgcccctgagggcggctctcgggatgagcaggatggagcctctgccgaaaccgagccctgggccgcagccgttcccccagaatgggtcccaatcatccaacaggatattcagtcgcagcggaaagtgaagccgcagcctccattgtcagacgcttacctgtcaggcatgcctgcaaagcgccggaaaactatgcaaggagagggccctcaactgttactctcggaagccgtgtcccgcgcagcaaaggccgccggcgctcgtccactgacaagtcctgagagcctgtccagagatctagaggcacctgaggtacaggaatcgtatagacagcagctcaggagcgatatccagaagaggctccaggaagatccaaactactcaccccaacggttccctaatgcacagagggccttcgctgatgacccctag

SEQ ID NO: 109526 - DNA, 735 bp, Artificial Sequence
  Description of Artificial Sequence: Synthetic coding sequence
atggagccaaacgattctaccagtacggccgttgaggaaccggactcactcgaagtgctggtcaaaactttggatagccagacacgcacatttatagtcggcgcccagatgaatgtgaaggagttcaaggaacatatcgccgcttccgttagcattccgtccgaaaagcagcgtctcatctatcagggccgagtccttcaggatgacaaaaagcttcaggagtataacgtgggggggaaggtcattcacctggttgagagagctccgcctcagacacatttacctagtggggccagttcagggaccgggagcgcctccgctacccatggaggcgggagtccaccaggcactcgcggtcccggagccagtgtgcatgatcgtaacgccaactcctacgtcatggtgggaacatttaatttgccttctgaaccccgtgtgcgccttgtcatggcccagcatatgatcagagacatccagacactcctgtcgagaatggaatgtcgcggtggtccccaaccacagcacagccagccacccccgcaaccgccggccgtgacccccgagccggtcgccctaagttcccagacgtccgaacccgtggaatccgaggccccccccagagagccaatggaggccgaggaggtggaagagcgcgccccggcgcaaaatcccgagctgactcctggccctgcccctgctggtccgactcccgcccctgaaaccaatgcaccttag

SEQ ID NO: 109527 - DNA, 717 bp, Artificial Sequence
  Description of Artificial Sequence: Synthetic coding sequence
agctccgctgaaggcgcaccaccaccagggcccgccccaccacccgcaacctcccacccaagagtaatccggataagtcatcagagcgtcgagccggtggtcatgatgcacatgaacattcagggccctctctcgttaagcccctgccccgactcagggacacaaccgggaggcgtgccatcagccccaaccggccctctgggcccccctggacatggccagactcttgggcagcaggtgcccgggtttcctacagctcccactcgggtcgtgatcgcccgacctactccacctcaggcacgccctagccaccccggcgggcccccagtgtccggaacattgcagggtgcgggcttaggcaccaacgctagcctcgctcaaatggtgtccggactggtgggacagttgctcatgcagcctgtgttagtcgcacaggggactccagggatggcaccacctcccgccccagcgaccgcaagcgcttccgccggtacgaccaacacggccacaacagctggccccgcacccggtgggcccgcccagcctcctccgacgccccaaccatctatggccgatctacagttttcacagttacttgggaaccttctgggcccagccggtccaggggcaggagggtctggcgtggcatctcccacgatcactgttgccatgcctggcgtgccagcctttctgcagggcatgactgacttcctatag

SEQ ID NO: 109528 - DNA, 735 bp, Artificial Sequence
  Description of Artificial Sequence: Synthetic coding sequence
atggagccaaacgactctacgtcaaccgccgtggaagagccagactcactggaggtgctcgttaagacactggattcccaaaccagaacgtttatcgtaggtgcacagatgaacgtgaaggagttcaaggagcacatcgccgcaagtgttagtataccaagtgagaaacaacgcttgatatatcagggtcgggtcctgcaggatgataaaaagttacaggaatacaacgtcggtggcaaagtcatccatctggttgagcgagctcctccacagacacacttaccaagtggcgcttcctccggaaccgggtcagcaagcgctactcacggcggtggcagtccaccaggaacaagggggcctggagcctcggtgcacgacagaaacgctaattcctacgtaatggtagggactttcaacctgccctccgaaccccgagtcaggctggtcatggcacagcacatgatcagggacattcagacgctgctttccagaatggagtgtcgcggcggaccacagcctcagcactcccaaccccccccacagccccctgcagtgacgcctgagccagtggctctgtcctcccaaacgagcgagcccgtagagtccgaggcccccccaagggagccaatggaggcggaggaggttgaggagagagcccccgcacagaatcctgagctgacacctggtccagcacccgccggacccactccagccccggagaccaatgctccctag

SEQ ID NO: 109529 - DNA, 2232 bp, Artificial Sequence
  Description of Artificial Sequence: Synthetic coding sequence
atggaaccaaacgactccacatctacagccgtggaagagccggattcattggaggtgttagtaaagactctcgattctcagactcgcacgttcatcgtgggagctcagatgaatgtcaaggaatttaaggagcatattgcagcatcagtgtctatcccatccgagaaacaacggctgatttaccaggggagggtcttgcaggacgacaaaaagctgcaggaatacaatgtcggcggcaaagtaatccacctcgtggaacgggccccgcctcagactcacctgccctctggcgcttcttccggcacaggcagcgcatccgctacacacggaggtgggtctccaccgggcacccgtggtccgggtgcctccgtacatgaccgcaatgccaattcctatgttatggtaggtacatttaatttgccctctgatgggagcgctgtggacgttcacattaacatggaacaagctccaattcaaagtgaacctcgggtaagattggtgatggcgcaacatatgatcagggacatccagacattgctgtctcggatggaatgcagaggggggccacagcctcagcacagtcagccccctccccagccccccgctgtgacacctgaaccagtggccctgagcagccagacctctgagccagtagagagcgaagcacctccaagggagcccatggaggccgaggaagtcgaagagcgcgccccagcgcagaatcccgagctaacccccggccctgccccagccggaccaacgccagcgcctgagacgaacgctccaaaccacccctccccagccgaatatgtagaggtcttgcaggaactccaacgcctcgagtctcgactgcagccttttctgcagcgctattatgaggtattaggcgcagctgccacaacagactataacaacaatcacgagggcagggaggaggaccagaggctgatcaacctggttggagaaagtttgaggctcttagggaacacatttgtggcgctgtctgatctgcgctgtaatctggcttgcacaccgcctcgacatttacatgtggtgcgtcctatgtcccactatacaaccccaatggtgcttcaacaggccgccattcccatccaaatcaatgtgggcacaactgtaactatgaccggcaacggaacacgccctccgccgacccctaacgccgaagcccccccaccaggtccgggccaagcaagtagcgtggcgccctcctcgaccaacgtagaatctagcgccgagggcgcccctccccccggtcccgcccctcccccagcaacatcccatccgcgggtgatcagaatcagccaccagagcgtggagcccgtagtgatgatgcacatgaacattcaggacagcggcacacagccgggaggggttccctccgctcctactggaccactgggaccccctggccatggccaaactctcggctcaacattgattcagctgcccagcttgcctcccgagtttatgcacgcggtggcacaccaaattacacaccaggcaatggttgccgcggtggcctcagctgctgccggccaacaggttcccgggtttcctacagcacccaccagggtggttatcgcccgacctacccccccgcaggcacgcccaagccatccagggggaccacccgtaagcggcacccttcagggagcaggcctcgggaccaacgccagtttggcacagatggtgtctggactggttgggcaactattgatgcaaccagttctagtggcccagggcacaccgggcatggccccaccacctgcgccagcgacagcgagcgccagtgctggcacaacaaatactgccacaaccgctgggcccgcccctgggggccccgcccagccaccccctactccccagccctcaatggccgacctgcagttctcgcagcttctagggaaccttctaggaccagcggggcctggcgctggtgggagtggggtggccagccccacaatcacagtagcaatgcctggcgtgccagccttcctccagggcatgacagattttttgcaggccacgcagaccgctccaccacctccaccaccacctcccccacctcccccagcacccgaacaacagaccatgcctccaccaggatccccttccggcggcgccgggagtcctgggggactgggattggaatccctgtcccccgagttcttcacttccgtcgtgcagggcgtcctctccagtcttctgtag

SEQ ID NO: 109530 - DNA, 477 bp, Artificial Sequence
  Description of Artificial Sequence: Synthetic coding sequence
atggagcctaatgacagcactagtaccgctgtggaagaaccagactccttggaggtattggttaaaacactggatagccagacgcggacctttatcgttggagcacaaatgaacgttaaagaattcaaagagcacattgcagcctccgtctcaattccaagtgagaaacagcgcctcatttaccaggggcgtgttctgcaggacgataagaagctgcaagagtacaacgtggggggcaaggtgatccaccttgtggagcgggcaccccctcagacccacctcccatccggggcctctagcggcaccggatccgcgtccgccacccacgggggagggtcccccccaggaacgcgaggaccgggtgcctcagtgcatgacagaaatgccaatagctatgttatggtgggtacattcaacctgccttccgatgggtcagctgtggacgtgcacatcaacatggaacaggcacccatctag

SEQ ID NO: 109531 - DNA, 681 bp, Artificial Sequence
  Description of Artificial Sequence: Synthetic coding sequence
tgaagtgggtttggagccagactgctcgaactgtgtaaccagggtctgttcgaatgtctggccctgaacctgcattgcctgggagggcagcaaatggaattggctgcagtgatcaacggccgcatccgaagaatgagtcgaggagtaaacccttcactggtatcatggctaaccaccatgatggggcttagactgcaggttgtactcgaacatatgccagtgggacccgatgctatactgcggtatgttagacgcgtcggggacccccctcagcccctcccagaggaacctatggaagtgcagggggcagagcgcgcctcccccgagccccagcgagaaaacgcatcaccagcccccgggactactgccgaggaggcgatgagtaggggcccccccccagcacctgagggcggctcaagggatgagcaggatggagccagtgctgagaccgaaccatgggccgcagcagtaccacccgagtgggttcccatcatccagcaggacatccagtctcagcggaaggtgaaaccccagcccccactgtcagatgcctacctcagtggcatgcccgccaagcgcagaaagcttcgaagtgacattcagaagcgcttgcaggaagatccaaactattctcctcagcgattccctaacgcacagcgagcctttgccgacgacccctag

SEQ ID NO: 109532 - DNA, 717 bp, Artificial Sequence
  Description of Artificial Sequence: Synthetic coding sequence
tccagtgcagaaggagccccccccccaggccctgcccctcctcccgccacctcgcatcccagagtcatcagaatcagccaccaatccgttgaacctgtcgtgatgatgcacatgaacatacagggaccattgtccctctctccatgcccggatagcggaacccagccgggcggagttccctctgctcccacgggaccattgggacccccagggcacggtcaaaccctggggcagcaagtcccagggttccctaccgcgcctactcgggtggtcattgcacgacctacccccccgcaagcacgacccagccaccccggcggcccacctgtaagcggcaccctgcagggtgccggattggggacaaacgcatccctggcccagatggtctccggactggtcggtcaactacttatgcagcctgttctggtggcacaaggcactccaggcatggccccgcctcccgcgcccgcgaccgccagcgcatcagccgggactacaaataccgctacaaccgcaggccctgctccaggcggccctgctcagcccccccccactccacagccatctatggccgacctgcagtttagtcagctgctcggaaacctactcgggcccgccggccctggggcgggcgggcctggggtggcaagtcccacaatcacagtggccatgcccggagtcccagcctttctgcagggcatgaccgatttcctgtag

SEQ ID NO: 109533 - DNA, 3381 bp, Artificial Sequence
  Description of Artificial Sequence: Synthetic coding sequence
atggagcctaacgacagcacctcgacagccgtggaggagccggatagcttggaagtccttgtgaaaactctggattcacagacaaggactttcatcgtcggagcccagatgaatgtgaaggaattcaaggaacacatcgccgcctcagtgagtataccgagcgagaagcagcgtctgatttatcaagggcgtgtcctccaggatgataaaaaactgcaggagtacaacgttggagggaaagtgatccacctggttgaaagggcccccccccagactcatctgccctcaggtgcctcttcaggtaccggtagcgcaagtgccactcatggcggaggatctccccctggaactcgaggacctggagcctcggtgcatgatcgcaacgccaatagctatgttatggtgggcacatttaatctgcccagcgatggctcggccgtggacgtccacattaacatggaacaggccccaattcaatctgaacctcgtgtgcgactggtgatggctcagcacatgatcagggatattcagacgctgctatcccgtatggagtgtaggggcggcccacagccacagcactcccagccccccccgcagcctcctgcagttacaccggagcccgtggcattgtctagccagacgtccgagcctgttgagagcgaggcccctccgcgtgaacctatggaagctgaagaagttgaggagcgagctcccgcccagaacccggaactcacccctggccctgctcctgccgggcctacccccgcacccgaaaccaatgcccctaaccacccctctcccgccgagtatgtcgaggtgctccaagaattgcagagactggagtcccggctccagccatttttgcagcgatactacgaggttctgggcgccgccgcgactacagactacaataacaatcacgagggcagggaggaagaccagcgcctgatcaaccttgtgggcgagagcctgcgccttctgggtaatacatttgtggccctgtctgacctgcggtgtaatttggcttgtactccccctcgacacctacacgtcgtgagacctatgtctcactacaccacccccatggtgctgcagcaggccgccataccaatccagatcaacgtcggaactactgtgactatgaccggaaatggcacccgcccgccaccgacgcctaacgccgaggcccccccaccaggccccggacaggctagctctgtggctccttcatccacgaacgtcgagtcaagcgccgaaggagcccctcctcccggacctgcgccaccccctgcaacatcacaccctcgggtgattcgcatctcgcaccaatcagtggagccggttgtgatgatgcacatgaatatccaggattctgggacccagcccggcggggtcccatctgcccctaccgggcccctgggcccgcccggtcacggccagacactcgggcagcaggtccctgggtttcctacagcaccaacacgggtggtgattgcacgacccaccccgcctcaggcaaggcccagccacccaggtgggcctccagtgtcagggacgctgcagggggccgggttgggcactaacgcatcactggcccagatggtatccggattggtgggtcagctgttgatgcagcccgtattagtagcacagggaacaccaggaatggcacctcctccagcgccggccacagcttcagcttccgccggcactacaaataccgccaccacagccgggcccgcaccagggggcccggcccagcctccccccacaccacagcccagcatggctgacctccagttctcacagctgttaggcaatttgctcggacctgctgggcccggggcggggggatccggtgtcgccagtcccactatcactgtcgctatgccgggcgttcctgctttcctgcaaggaatgacggactttttgcaagctactcagaccgcgcccccccctccaccgccgcctcccccccctcctcccgcgccggaacagcagacaatgcctcccccaggttctccctctggtggcgcgggctccccaggcggactcggcctagaatccttgagccctgagtttttcacaagtgtggtgcagggagtgctctcatctctgctcggatcccttggcgccagagcaggttcatctgagtcaattgccgcctttatccagaggctctcaggatcgagtaacatttttgaaccaggcgccgacggggccttgggattcttcggggccctgctgagtctactgtgtcagaatttcagcatggtagatgtggttatgctgcttcacgggcactttcagcctctgcagcggcttcagccacagcttaggtccttcttccaccagcactatcttggagggcaagagcctacaccgtccaacattcgcatggccacccacaccctgattaccgggctcgaagaatatgtgagagagtcctttagcctcgtccaggtgcaaccaggagttgacatcatccgcaccaacctggaattcttgcaggagcagttcaattccatcgccgcacacgtacttcactgcactgattccggttttggggctcgcctgcttgagctgtgcaatcagggattgtttgaatgcctggcgctgaacctgcattgtttaggaggccagcagatggagctggccgccgtgattaatgggcgtattagacggatgtctcggggtgtgaaccctagtttggtctcctggctgactacaatgatgggcctgcgcctgcaggtggtcctggaacatatgcccgtcgggccagatgccatcctgcgctacgtgagacgggtcggagaccctccccaacccctgccggaggagcctatggaagtacagggtgccgagcgggcatcccccgaacctcaacgcgaaaacgcttcacctgcccccggcacaaccgcagaagaggccatgagtagagggccacccccagccccggaaggaggcagccgggacgaacaggatggggcctcggcagaaacagagccctgggccgccgcagtgcctcccgagtgggtcccaatcatccagcaggacatccaatcccaaagaaaagttaagccccagcctcctttaagcgatgcgtacctcagtgggatgcctgccaagcgtagaaaaactatgcagggtgagggcccccagctcctactgagcgaagcggtctctagagcagccaaagcggctggtgcccggcctttgacctcacctgagtctctgtcccgcgacctcgaggcccctgaagtgcaggagtcttacaggcagcagcttagatcagacatccagaaaagattacaggaagacccaaattactctccccagaggtttcctaatgcgcagagagcatttgccgatgacccctag

SEQ ID NO: 109534 - DNA, 789 bp, Artificial Sequence
  Description of Artificial Sequence: Synthetic coding sequence
atggagcctaacgacagtaccagcaccgcggtcgaggagcccgatagcctggaagtgcttgtgaaaactctcgattcccaaacacgcacttttattgtgggggcccagatgaatgtgaaggagtttaaagagcacatagccgcgtctgtgtctatcccctctgagaagcagagactgatctaccaggggcgggtccttcaggatgacaagaagctccaggagtacaatgtggggggaaaagttattcacttggttgaacgagcccccccacagactcacttaccctcaggtgcatcatctggcaccggctccgctagcgctactcatgggggcggttccccccccgggactaggggacccggagccagtgtgcatgaccggaatgcaaactcatacgtcatggtggggactttcaatctcccaagtgatggctccgctgtggatgttcatatcaatatggagcaagcaccaattcagagtgagccaagagtacgccttgtgatggctcagcatatgatcagggatattcagactttactatctaggatggagtgccgaggtggcccccagccacagcatagccagccccctccccagcctccagccgtaacgcccgagccggtagcactaagcagccaaacatctgagcccgtggaaagtgaggctccccctcgcgagccaatggaagcagaagaggtggaggagcgagcccccgcccaaaaccctgaactcacacctggccccgcacctgccgggccaactccggcccccgagactaacgccccctag

SEQ ID NO: 109535 - DNA, 477 bp, Artificial Sequence
  Description of Artificial Sequence: Synthetic coding sequence
atggaaccaaatgactccacaagcactgctgtggaagaaccagacagcctggaagtgttagtaaaaacactggactcccaaacacggacattcatcgtgggtgcccaaatgaatgtgaaagaattcaaggaacacatcgccgcctctgtctccatcccatccgaaaaacaacgtcttatctaccaaggaagggtattgcaggatgataaaaagctgcaagaatacaacgtaggtgggaaagtgattcaccttgtagagcgggccccgccccaaacccacctgccgtcaggcgcctcgagtggcactggatctgccagcgccacacatggaggcggatcaccacctgggacacgcggcccgggcgcgtccgtccacgacagaaacgcaaatagctatgtcatggttggtacatttaatctgccttcagatgggtctgcggtggacgtgcacatcaatatggaacaggctcctatttag

SEQ ID NO: 109536 - DNA, 777 bp, Artificial Sequence
  Description of Artificial Sequence: Synthetic coding sequence
atggagccaaatgatagcacgtccactgcagtcgaggagccggatagcctggaggtccttgtcaagaccttagactcccagacccgcacctttattgttggggcccagatgaacgtcaaggagttcaaagaacatattgcggccagcgtctcgatacccagcgagaagcagcgcctgatctatcagggaagagtcttgcaagacgataaaaagcttcaggaatacaatgtgggagggaaagtgattcacctagtcgaacgcgcgccgcctcaaacccacctgcccagtggcgcctcatctggcactggatcagctagcgccacacacgggggcggtagtcctccgggcactcggggtcctggtgcttctgtgcacgaccgtaacgcaaacagctacgtgatggtgggcaccttcaacttgccctcagatgggagtgctgttgatgtgcatatcaatatggaacaagcgccaatacagagtgaaccaagggtgaggcttgtcatggctcagcacatgatcagagacatccagacgcttctctcaagaatggagtgcagaggcggaccccagcctcagcactctcaaccacctccccagccccctgctgtgacaccagaacctgttgcactatcatcacagacaagcgaacctgtggagtcagaagctcctccaagggagccgatggaggcagaggaggtagaggaaagagctccagcccagaatccagaattgacccccggcccagcccctgccggtccaactccagctcccgagtag

SEQ ID NO: 109537 - DNA, 735 bp, Artificial Sequence
  Description of Artificial Sequence: Synthetic coding sequence
atggagcccaatgattcaacatcgacggcagtggaggaaccagattccctggaagtcctggttaagacactagattcacagacgcgaacctttatcgtgggagctcaaatgaatgtgaaggagtttaaagagcacatcgccgcatcagtgtctatcccctctgagaaacagaggctcatctaccagggccgggttttacaggatgacaagaagttgcaagagtataacgtgggaggtaaagttatccacctagtggaacgggctcccccacagactcatctcccctcaggcgctagctccggcaccgggtcagcctcagccacccatggtggcgggagcccaccaggcacaagggggcctggtgcaagtgtccatgaccgtaacgcaaatagctatgtgatggttggaactttcaatctcccctccgagccccgcgttaggttggtaatggctcagcacatgatcagagacattcaaacactcctttctagaatggagtgccggggcgggccacagcctcagcactcccaacctcctcctcagccacccgctgtgaccccagaaccagtggcattatcaagccaaaccagcgaaccagttgagtccgaagctccaccgagggaacccatggaagctgaggaagtagaggagagagctccggcccagaatcccgagctgacccccgggccggcccccgcaggtcctactcccgcccctgagactaatgcaccatag

SEQ ID NO: 109538 - DNA, 1548 bp, Artificial Sequence
  Description of Artificial Sequence: Synthetic coding sequence
atggagccaaatgattccacgagcacggctgtcgaggagcctgatagcctcgaggtcctggtcaagactctagattctcagactcggacgttcatagtgggggcccaaatgaatgtaaaagagttcaaagaacatattgccgcttccgtctcaatacccagtgaaaaacaaaggctaatataccagggccgtgtgctgcaggatgacaagaaactgcaagagtacaacgttggcggcaaagtaatccaccttgtcgaacgggcccctcctcagacacatttaccaagcggtgcctcttccgggaccggaagcgcttccgcaactcacggaggaggcagtcccccaggcactcgcgggccaggcgcgtcagtgcatgataggaacgctaacagctacgtaatggtcgggacattcaacctcccgagtgacgggagcgccgtggacgtccacattaacatggagcaggcccccattcagagcgaaccccgcgttcgcctcgtcatggctcagcacatgatcagagatatccagacactgttgagtcgcatggagtgcaggggagggcctcaacctcagcattcccagccacccccacagccccccgccgtcacacccgagcccgttgccctaagtagccagaccagtgaacctgtggaatccgaggctcccccacgggagcccatggaggcagaagaggtggaggaaagagctcctgcacagaacccagagctaacccccgggcccgcgcctgctgggccaacccccgcaccggaaaccaacgcccctaaccacccaagcccagccgaatatgtcgaggtacttcaggagctgcagagactggaaagccgcctgcagccattcctgcagcgatactacgaggtgcttggggctgccgcgacaacagattataataacaaccacgagggcagggaagaagatcagaggctcatcaaccttgtgggagaaagtttgcggctgttgggtaataccttcgtggccctcagtgatttgagatgcaatctggcatgcacaccgccccggcacctgcacgtggtgcgtccgatgtcccactataccacacccatggttctccaacaagctgccatccccatccaaattaacgtaggaaccaccgtaaccatgaccggtaacgggacccggcctcctcccacgcctaacgcggaggcacctcctcctgggccagggcaggcgtcctcagtggctccgtcatccaccaatgtggaatctagcgcagaaggggctccccccccaggtccggcccctccccccgcgacctcccaccctcgagtcatccgaatttcacaccagagcgttgaacccgtcgtcatgatgcacatgaacatacaggacagtggcacccagcccggaggcgtccccagtgcgccaacagggcccctgggacctccgggacatgggcagaccctcgggtcaacccttattcagctgccctccctaccccccgaatttatgcacgccgtggcccaccagataacacatcaggctatggtggctgcagttgcttcttag

SEQ ID NO: 109539 - DNA, 702 bp, Artificial Sequence
  Description of Artificial Sequence: Synthetic coding sequence
atggaacctaatgattccacttccactgctgtggaggaacctgatagcctcgaggtccttgttaaaaccctggattctcagactcgcacattcatcgtgggagcgcagatgaatgttaaggaatttaaggaacatatagctgccagtgtgtccatcccctccgaaaaacagagattgatttatcaaggaagggttctacaggatgacaagaaactgcaggagtataacgttggtgggaaagtaattcatctcgtggagagagcacccccccagactcacttgccctctggcgctagttctggcacagggagcgcctcagcaacacacggaggggggtcaccaccagggacacgcggtcctggtgctagtgtacacgacagaaacgcaaatagctatgttatggtcggtacatttaacctacctagtgatgggagtgcggtggacgtgcacattaacatggaacaggcccctattcagtcagagccccgggtacgtctggtgatggctcaacatatgatcagagatattcagacattattgagtcggatggagactcttccatacctgcagtgtaggggcggaccccagccacagcattcacagccgccccctcagccccctgccgttaccccagagcctgttgctctgagtagtcaaacgtctgagcccgtggaatctgaagctcctcctagagagccctag

SEQ ID NO: 109540 - DNA, 3381 bp, Artificial Sequence
  Description of Artificial Sequence: Synthetic coding sequence
atggagcctaatgacagcacttcgacagctgtggaggaacctgactcgttagaagtgctcgtcaaaacattagactcacagacgcgtaccttcatcgtgggggcacaaatgaacgtaaaagagttcaaggagcatatagccgccagcgtctcaatcccaagtgaaaaacagcgacttatttaccagggaagagtcctgcaagacgacaagaagctgcaagagtataatgtggggggtaaagtaatccatctcgtggagcgcgcccccccgcagacccacctgccatcaggagcgagctcggggacgggctctgccagtgccacccacggtggggggtctccacctggaaccagagggcccggtgcttcggtccacgacagaaatgctaattcatatgtaatggtaggaacttttaaccttccaagcgacgggtctgccgttgatgtgcacattaatatggaacaagctccaattcagagcgagcccagggtgaggttagtcatggcacagcatatgattagggacattcagaccctgctatcacgtatggagtgcaggggcggtccacagccccagcattcccagccaccaccacagcctcccgcagtaactcccgagcctgttgcacttagtagtcagaccagtgaacctgttgaatcagaagcaccacccagagagcccatggaggccgaagaagttgaggagcgtgcaccagcacagaacccagaactgaccccaggaccggcccctgcaggacccacgccagcccccgagaccaacgcacctaatcatccgtcaccggcagaatacgtcgaggtattacaagaattgcagcgcctagagagccgcctgcagccattcctccagcgctattatgaagtgctgggggcggcagcgactacagattacaacaacaaccacgagggccgtgaggaagaccagcggctgataaacctcgtgggtgagtcattacgcttacttggaaatacatttgtagctttgtctgacctacggtgcaatctagcttgtacgccaccaagacacttgcatgttgtgaggccaatgagccactacacgaccccgatggtgttgcagcaagcagccattcctattcaaattaatgtgggcacgacagtaaccatgactggcaacgggacacgcccaccgccgactcctaatgccgaagccccacccccaggtcccggtcaggcatcttccgtcgccccctcaagcacaaacgtggagtccagcgcagaaggcgcgccaccaccagggcctgctcccccacctgccacatctcacccaagggtgatcagaatcagtcaccagagcgtggagccagtggtaatgatgcatatgaatatccaggatagcgggacccagccagggggcgtgcccagcgctcccacagggcctctcggtcccccaggccacggacagactttgggccagcaggtccctggattcccaacagctccaaccagggtggtgatcgctcgaccaaccccacctcaggctcgcccttcccaccctggtggcccacctgttagtggcactctccagggagctggcctgggaactaacgcctccctggctcagatggtctcaggccttgttggtcaactgctcatgcaaccagttttggtggcccaaggcactcccggcatggctcccccgcctgcaccggccaccgcatctgcctccgcggggactacaaacactgcaaccacagccggcccagctcctggaggacctgcacaacctcctccgacaccccagccttccatggctgacttacagttctcccagttactgggaaatctgttgggaccagccgggcctggtgctggtggtcccggagttgcttctccgactatcactgtcgctatgccgggggtgccggctttcctccaagggatgactgatttcttacaggcaacacagactgccccccccccccccccccctccacccccacccccacctgcccctgagcagcagaccatgccccccccgggttccccttctgggggagctggaagcccgggaggtctgggacttgaatccttgtctcccgagttttttacctccgtggtgcagggggttctgtcttcgctgctggggtcacttggggctcgggctggctcaagcgagtcaattgctgcatttattcagaggctttctggaagctcaaacatttttgagccaggtgccgacggggccctgggatttttcggagcactcctctcacttctgtgccaaaatttctctatggtggacgtggtaatgctgctgcatgggcactttcaacctttgcagcgcttgcagcctcagttgaggtcattttttcaccagcattatctgggaggccaggaacctacccccagcaatatccggatggctacccacacactgatcactggactggaggaatacgtaagggagtcgttttcattggttcaggtacaaccaggcgtcgatattatcaggacaaacttggagtttttgcaggagcaattcaattccattgctgcacacgtactacactgcaccgacagcggctttggcgcccgtctgcttgagctgtgcaaccaaggactatttgagtgcttagctctcaacttgcattgtctgggtggccaacagatggagctggcagcagttatcaatgggcggatcagacgcatgtcgcgaggtgtgaacccatccttggtaagttggctcacgacgatgatgggccttcgcctacaggtagtgcttgaacacatgcccgtaggccccgacgccatcctgcgttacgtgagacgggtgggagatccaccacagccacttcccgaagagcccatggaagtgcagggggccgagagagcttcaccagaaccccagagagaaaatgccagccccgccccggggaccaccgcagaggaagctatgagccggggccctccccccgccccggagggtggttctagagacgagcaagatggggcctccgccgagacggaaccctgggcagctgccgtgccgcctgaatgggtccctattattcaacaggacatccagagccagcggaaggtgaagccacagccccctctcagcgatgcctacttatctggcatgccggctaaaagacgcaagaccatgcagggggagggaccccagttgttgctaagcgaggccgtgtcccgagcagccaaagctgctggagcccgccccctcacctcccccgaatccttgagccgagacttggaagctcccgaggtgcaggagagctaccggcagcaactgcgctccgatattcaaaagcgcctgcaagaagacccaaactactccccccagcgattccccaacgcccagcgggcttttgccgatgatccatag

SEQ ID NO: 109541 - DNA, 789 bp, Artificial Sequence
  Description of Artificial Sequence: Synthetic coding sequence
atggagcctaacgactccacaagcacagctgtggaggagccggattcactggaggtgctggtcaagaccttggattcacagactcgtacattcattgtgggagcacagatgaacgtcaaagagtttaaagagcacatcgctgccagtgtgtctattccaagtgagaagcagcggcttatctaccagggcagagtgctacaggatgataaaaagcttcaagagtacaatgttggcggcaaagttatccatcttgtggagcgagctccccctcaaacacacctgccgtccggcgctagcagcgggactgggagcgcgagtgccacgcacgggggaggaagccctccaggaacaagaggtcctggcgccagtgtacacgataggaacgctaactcctacgtcatggtgggaactttcaacctgccaagcgatggatccgctgtcgatgtacatataaacatggagcaggcgccgatacagtctgaaccgcgcgtgaggcttgtgatggcccagcacatgattagggatattcagaccctgctgtcacgcatggagtgccggggtgggccacagccgcagcactctcagcctcctccccaacccccagctgtgacacccgagcccgttgcgctgagcagccagacaagcgaaccagtggagagtgaggccccacctcgagagccaatggaagccgaggaggtggaagagcgggcgccagcacaaaatcccgagctaacacctggtcccgccccagccggtcctacccctgctcccgagaccaacgccccttag

SEQ ID NO: 109542 - DNA, 411 bp, Artificial Sequence
  Description of Artificial Sequence: Synthetic coding sequence
tgacggatgtcgaggggcgtaaaccctagtcttgtatcttggctgaccacaatgatgggtctcaggctccaggttgtgctcgagcatatgcccgtggggcccgatgccatccttagatacgtgcgaagagtcggggatccaccccagccactgccagaggagccaatggaggtccaaggggccgagagagcttctcctgagccccaggagtgggtgcctattatacagcaagatatccagtctcaacggaaagttaagccccaacctcccctaagcgacgcttacttgtccggaatgccagccaagcgcagaaaactgcggagcgacattcagaagagactgcaggaggaccctaactatagtcctcagaggttccctaacgctcaaagggcatttgccgatgatccctag

SEQ ID NO: 109543 - DNA, 558 bp, Artificial Sequence
  Description of Artificial Sequence: Synthetic coding sequence
tgactggcatgtacccccccacgtcatctgcacgtggtccgacctatgtcacattacaccactccaatggtgctccagcaagcagccattccaattcaaatcaacgtaggtacgacagtgaccatgaccggaaacggaacacgacctccccccacccctaacgctgaagcacccccgccaggtcccgggcaggcttcttcagttgccccgtcttcaactaacgtggagagctcagccgaaggtgctccaccccctgggcctgccccaccgcccgccactagccacccacgcgttatcaggatttcccaccagagtgtggagcctgttgttatgatgcacatgaacatccagggccagcaggtgcctggattccctacagcccccacccgcgtggtaattgctcgccccactcctccccaggctcgacctagtcatcccggaggcccgcccgtctcggggactctgcagggagccgggctcgggactaacgcgtcccttgcacagatggtatcgggcctggttggtcagcttcttatgcagcctgtacttgtggcttag

SEQ ID NO: 109544 - DNA, 681 bp, Artificial Sequence
  Description of Artificial Sequence: Synthetic coding sequence
tgatcaggctttggcgctcgcctgctggaactgtgcaatcagggcttgtttgagtgcctcgcgctgaacctccactgtttagggggtcagcagatggagctggcagcggtcattaatgggaggattcgtcggatgtcgcgaggcgtcaatcctagcttagtatcatggttgacaactatgatggggcttaggctccaggtggtactagagcacatgcccgtgggcccagacgccatccttcgctacgtgagacgggtgggcgacccaccacagcccctccccgaagaacccatggaggtacaaggggctgaacgagcttctcccgaaccccagcgcgaaaacgcctcccccgcacccgggaccacggcagaggaggctatgtcccgggggcccccccccgcacccgagggtgggagcagagatgagcaagacggggcatcagctgaaacagagccctgggctgctgctgtgccgcctgaatgggttcctattatccagcaggatatacaatcacagcggaaggtgaaacctcagccgccccttagcgatgcttacctatctggaatgcccgccaagcgcaggaaattgagatccgatatccagaagcgtcttcaggaggatcccaactactcccctcagagatttcccaacgcccaacgggcattcgctgacgacccctag

SEQ ID NO: 109545 - DNA, 594 bp, Artificial Sequence
  Description of Artificial Sequence: Synthetic coding sequence
atggaacctaacgacagcacatccactgccgtggaagagcctgactcactggaggtgctcgtaaagactttagactcccaaactagaacttttattgtgggcgcacaaatgaacgttaaagagttcaaagagcatatagcggcctcagtttctattccatcagagaaacagcgcctgatttatcagggacgtgtgctgcaggacgacaagaaactacaggaatacaatgtgggtggtaaagtcattcatctggtggaaagggccccaccccaaactcatctaccctctggagccagcagtggaaccggtagtgcttctgcaactcatgggggtggcagtcctccgggcacgcggggacccggcgcgtccgtgcatgataggaacgcaaactcatacgtaatggtcggcacctttaacctccccagcgatggctctgcagttgatgtacatatcaatatggagcaagcccccatacaatccgagccacgtgtgaggctggtgatggcccagcatatgatccgtgatattcagaccctattatcgcgcatggaatgcaggggcgggccccagccacagcatagtcaaccaccttag

SEQ ID NO: 109546 - DNA, 648 bp, Artificial Sequence
  Description of Artificial Sequence: Synthetic coding sequence
atggagccgaatgattcgacttctacggctgttgaagaacctgacagtttggaagtgcttgtcaaaacactcgactcccagaccaggacttttattgttggagcccagatgaatgtaaaagaattcaaagaacacatagccgccagtgtctctatcccgtcagaaaagcagcgccttatctatcagggccgagtgctgcaggatgataagaagttacaggaatacaatgtgggagggaaggtgatccatctggtggagcgggccccaccacagacacacttgccaagtggtgcaagttcaggaacaggctctgcctctgcgacacacggcgggggaagtcctccaggcaccagaggacccggagcgtccgtgcacgatcgtaatgctaacagctacgtcatggtggggacattcaatctcccttctgagccccgggttcgactcgtgatggcccaacacatgatccgggatatccagactcttctatcgaggatggagtgtagagggggaccgcagcctcagcatagccagcccccaccccagccaccggccgttactcccgagccagtagctctgagctcccagaccagtgaaccagtggaaagtgaggcacccccacgcgagccgatggaggctgaagaggtgtag

SEQ ID NO: 109547 - DNA, 702 bp, Artificial Sequence
  Description of Artificial Sequence: Synthetic coding sequence
atggagccaaacgattctacaagcactgccgtggaagaacctgattctttagaagtcctggtcaagactctggattcccaaacccggacattcatcgtcggtgcgcagatgaatgtgaaggagtttaaggaacacatagccgcctcagtctccataccctccgagaaacaacgtctgatctatcaaggtcgggtgctacaagacgataaaaaactgcaggaatacaacgtaggcgggaaagtgatacatttggtggagcgcgcacctcctcagacacatctgccctccggcgccagcagcggcaccgggtctgcatccgcaacgcacggcggggggtctccaccaggtactagggggcccggggcttccgtgcacgatcggaacgcgaattcttatgtgatggtagggacattcaatctgccctcagacggtagcgctgtagacgtgcatataaacatggaacaggccccaattcagagcgagcctcgcgttagactcgtcatggcccagcacatgatccgcgacatccagactctgctctcaaggatggaaacattaccgtacctccagtgccgggggggaccacaaccgcaacatagccaaccaccaccccagccaccagcggtcacaccagagcccgtagcgctgtcctcccagacatcagaacctgttgaatccgaggcccccccccgggaaccctag

SEQ ID NO: 109548 - DNA, 777 bp, Artificial Sequence
  Description of Artificial Sequence: Synthetic coding sequence
atggaacccaacgactccacatcaactgccgtggaagagcctgattcactcgaagtgttggtaaagacactggactcccaaacccgtactttcatcgttggtgcccagatgaatgttaaggagttcaaagaacacatagccgctagcgtgtctatcccttctgagaaacaaagacttatttaccaggggagggtccttcaggatgataagaagcttcaggagtacaatgtgggcggcaaggtcattcacctggtcgagcgggcacctcctcagacccatctgccctcgggagccagtagtgggacaggtagcgctagcgcaactcatgggggaggatctcccccggggacaagaggaccgggagcatcggtgcatgatcggaatgccaacagttatgtgatggttggtacctttaatctaccctctgacggcagcgccgtggacgtgcacattaacatggagcaggctcctattcagtcagaacctcgggtgagattagtgatggctcaacacatgatccgagacatccagacgctgttgtctaggatggaatgccgagggggcccacagcctcagcacagccagcccccaccgcagccaccagcagtcacccccgagccggtggcgctttcttcacaaaccagcgagcccgttgaatcagaagccccgccaagagagcctatggaggccgaggaagttgaggagagggcgcccgctcaaaatcctgagctcacccctggccctgcccccgctggcccaacccccgcacccgaatag

SEQ ID NO: 109549 - DNA, 411 bp, Artificial Sequence
  Description of Artificial Sequence: Synthetic coding sequence
tgacggatgtccaggggagtcaatcctagcttggtgagttggttaacgacaatgatgggccttcgactgcaggtggtgttagagcacatgcctgtcggaccagacgccatcttgcgctatgtccgcagagtcggagatcctccacagcctttacccgaagaacctatggaagtgcagggcgccgagcgtgcatcgcctgagcctcaggagtgggtgccaattatccagcaggatattcagtctcaaaggaaggtgaaaccgcagccgcccctttcagatgcttatctgtcaggaatgccggctaagagacggaagctgcggagcgacatccagaagcggctccaagaagatcctaactactcccctcagcgcttccccaatgcacagcgcgcctttgccgatgatccatag

SEQ ID NO: 109550 - DNA, 780 bp, Artificial Sequence
  Description of Artificial Sequence: Synthetic coding sequence
atggagcccaacgattctaccagcacagcagtggaggaaccagattccctggaagtcctggtcaaaacactggattcccaaaccagaacttttattgtcggagctcagatgaacgtcaaagagtttaaggagcacatcgccgcatctgtttctattccatctgagaagcaaagacttatataccagggcagagtgctccaggacgataagaaacttcaggaatataatgtgggtgggaaggtgatccatctagtcgagagagctcctccacagacacacctgccctcgggggcatcatccggaaccgggtccgcctctgcaacgcacggcggaggctcaccacctggcactcgcgggcctggggctagcgtgcacgaccgaaatgctaattcgtacgtgatggtgggaacttttaatcttccctcagacggcagcgccgtggacgtccacatcaacatggaacaggcaccaattcagagtgaacccagagtccggctggtgatggcacagcacatgataagggacattcagacccttctgtcccggatggaatgcagggggggaccccagccccagcacagccagccacccccccaaccgcctgctgtcaccccagaaccagtcgctcttagtagccagacctccgagcctgttgagtcagaggccccgccccgtgaaccaatggaggcggaggaagtcgaggagagggcccccgcacaaaacccagagttgacgcctggacctgcgccagcggggcctactccggcacctgagacatag

SEQ ID NO: 109551 - DNA, 2232 bp, Artificial Sequence
  Description of Artificial Sequence: Synthetic coding sequence
atggagccaaacgacagcacgtctactgctgtggaagagcccgacagtctggaggtgctggtaaaaaccctggacagccagactcgtacatttattgtgggagcacaaatgaatgtgaaggaatttaaagaacatattgcagcatcggtctccattccatctgaaaagcagaggcttatttaccagggccgggtcctccaggacgataaaaagctgcaggagtataatgtgggaggcaaagtcattcacctggttgaacgagccccaccccagacccaccttccaagcggcgctagctcgggaacgggctccgctagtgccactcatgggggcggaagcccccccggaacccgcgggcccggagcgagcgtccacgataggaacgctaactcatacgtgatggttggcactttcaacctgccaagcgacgggtctgcggtggatgtgcacattaatatggagcaggcccccatacagtcagaacctcgagttagattggttatggcccagcacatgatcagagacatccagaccctgctgtccagaatggagtgccgagggggacctcagccccaacactctcagcctcctcctcagcctccggccgtgacgcctgaacccgtagccctgtcgtcacagacctctgaaccagtggagtcggaagcgccaccccgggaacctatggaggcagaggaggtggaggagagggctcctgcacaaaatccagagcttactccagggcccgcccccgcaggccctacaccagcaccagaaactaatgctcccaaccatcccagcccagccgaatacgtggaagtcctacaggaactgcagagactagagagccggctgcagccttttcttcagcgttactacgaagtgctgggggcagccgctaccaccgattacaataataatcacgagggtagagaggaagaccagcgtttgatcaacctggtgggagagtctctcagattgctcgggaataccttcgtggcactctccgacctgcgctgtaacctagcttgtacacccccccgacacctgcatgttgtccgccctatgagtcactacactacccctatggtcttgcagcaggcagccattccaattcagattaatgttggcactaccgtgaccatgacggggaatgggacacggccacctccaacccctaacgcagaggcccccccccccggccccggacaggcctcctcggtggccccaagcagcactaacgtagagtcaagcgcggaaggggcccccccccctggccctgcaccaccacctgccaccagccacccccgagtcattcggatttctcaccagtccgtcgaacccgtggtcatgatgcacatgaacattcaggacagcggaactcagcctggtggcgttccctctgctcctacaggccctctgggacctcctggtcacggccagacgctgggttcgactctgatccagcttccttcacttcctcccgaatttatgcatgctgtggcgcatcagattacccaccaggccatggttgccgcagtagcttccgccgcggccggacagcaggtgcccggcttccctacagcccctaccagggttgttattgcacgcccaactcctccacaggcacgccctagtcatcccggtgggccccctgtgtcaggcacccttcaaggcgccggcttaggcaccaatgcctccttggctcagatggttagcggcttggtaggacagctgctcatgcagccggtcctggtcgcacagggcacgcccggtatggctcccccccctgcccccgccacagcctccgcctcagctggtactacaaatacggctactacggcaggcccagcccctggcgggcctgctcagcctcctcctactccacaaccctcaatggcagatctgcagttttctcagcttctgggcaacctgctgggcccggccgggccaggcgctggcgggagtggagtagcttctccaaccataactgttgcgatgcccggggtccctgccttcttacagggcatgactgacttcctacaggcaacccagacggcaccaccaccaccacccccaccgcccccccccccgccagcaccggaacaacagacaatgccccctccggggagcccatcaggaggagcgggcagccctggaggactcggcctcgagtccctttctcccgagttcttcacctcggtggtgcagggcgtgctcagcagtctcctatag

SEQ ID NO: 109552 - DNA, 3399 bp, Artificial Sequence
  Description of Artificial Sequence: Synthetic coding sequence
atggagccgaacgatagcacctcaaccgctgttgaggagccggatagtctggaggtcctggtcaagaccttggacagtcagactaggacttttattgttggcgcccaaatgaatgtgaaagagtttaaagaacacattgccgcatccgtgagcattccttctgaaaaacaacgcctgatttaccaaggacgggttctccaggacgataagaaacttcaagaatacaatgtggggggcaaggtaatccacctggtagagcgggctcccccccagactcacctcccctccggtgcatcttccgggactgggtcagccagcgctacccacggggggggctctccccccgggactagaggccctggcgccagcgtccacgatcggaacgcaaacagttacgtgatggtcggcactttcaatttgccttccgatgggagtgcagtcgacgttcacatcaacatggagcaggccccaattcagtccgaacccagagttcgacttgtgatggctcagcatatgatcagagacatacagacccttctcagcaggatggagactcttccctaccttcagtgtcgcggcggtccgcaaccccagcactcacagcccccacctcagcctcccgccgtgacaccagagcccgtggcgctgtctagccagacaagcgagcctgtagagtctgaagctcccccaagagaacccatggaggctgaagaagtggaggagcgcgccccggcgcagaacccagagttgacccctgggccagccccggccggaccgactcccgcacccgagacgaacgctcccaaccacccctcacctgctgagtacgttgaagttttgcaagagctgcagcgcttggagtcacggttacagcccttcctccagcgctattatgaggtgctgggtgctgcagctacaaccgattataataataaccatgaggggagggaggaggaccaacgcctcatcaaccttgtgggagagtcactgcggctcctagggaatactttcgtagctctgtccgacctgagatgtaatctggcatgtacaccaccacgccaccttcacgtcgtgagaccgatgtctcattatacgaccccaatggtgctgcagcaggcagccatccctattcagattaatgtgggaaccactgtaacaatgaccggcaatggcacgaggccaccgcccacaccaaatgccgaggcaccacctcctggacccgggcaggcctctagcgtcgcaccatctagcaccaacgtcgagagttcagcagaaggtgcacctccgcccggcccggcccccccaccggcaacgtcacatcccagagtcataagaatctctcatcaaagtgtagaacccgttgtcatgatgcatatgaacattcaggattcagggacccaacctgggggcgtccccagtgcgccgacaggccctctgggacctcccgggcacggacagacgttggggcagcaggtacctggatttcctaccgcacccacgcgagttgtgatcgccagacctactcccccacaggccagaccttcccatcccggtggccctccggtgtctggcacgctgcaaggcgccggcctgggcacgaatgcctccctggcccagatggtgagcggtctggtgggccagttgcttatgcagcccgtcctggtggcgcaaggaactcctggcatggcccccccaccagcgcctgccactgcctctgcttccgcaggcaccactaatacagccacaacagctggtccagcccctgggggaccggcacaaccaccccccacccctcaacccagcatggccgatcttcaattcagtcagctcctgggcaacctgctgggacctgctggtcccggcgcagggggacccggtgtcgctagtcccacaattaccgttgccatgccgggggtgcccgcattcctgcagggcatgacagattttctgcaggctactcagacagccccaccaccccctccccctccacctccacctccacccgcgccagagcaacagaccatgccgcctcccgggagccctagcggcggagccggaagccctgggggcctgggactggaatctttatcccctgaattttttacctctgtggtgcagggagtgctttcaagcctcctaggcagtctgggggctagagccggaagcagcgaatcaattgctgccttcatacagcggctgagcgggagttccaacatttttgaaccaggagctgatggagccctgggattcttcggcgccctgctcagccttttatgtcaaaacttctcaatggttgacgtagtaatgttgcttcacggtcatttccagcctttgcaacgactgcaaccacagctgcgaagcttcttccaccagcattatctgggcggacaggaacccactccttctaacatccgcatggcgacacacacgttaatcacaggtctcgaggagtacgtgagagagtctttttcactagtccaggtccaaccgggggtcgacatcatcaggacaaacctcgaatttctccaggaacagtttaacagtatcgccgcacacgtgctccactgcacagactcaggcttcggcgctcgtttgcttgagctgtgtaatcaaggactgttcgaatgcctcgctctcaacctgcactgccttgggggccaacaaatggagctcgcagccgtgattaacggcagaatacgtagaatgtcgagaggcgtgaacccgagcctggtgtcatggctgacaacaatgatgggtcttcggcttcaggtagtcctagaacacatgccagtcggtccagatgcaatcctgcggtacgtgagaagggtgggtgatccaccgcagccactgccagaagaacccatggaagtccagggcgccgagagggcaagccctgaaccccagagagagaatgcttcccctgcacccggcactaccgccgaggaggccatgagccggggcccaccgcccgctcccgaaggtggaagtcgtgacgagcaagatggagctagtgccgagaccgaaccatgggccgccgccgtgccccccgagtgggttccaatcattcagcaggacatccagagtcagcgaaaggtcaaaccacagcccccactgagtgacgcttacctctctgggatgcccgcgaagcgcaggaagactatgcagggcgagggaccccagctgctgctgagcgaggctgtgtcacgcgccgctaaagccgccggcgctcggccactgacaagcccagaaagcttgtctcgggatttggaggccccggaagtccaggaaagctaccggcaacagctgaggtccgatatacagaagcggttgcaagaggacccaaattatagcccacagcgattcccgaatgcacagcgggccttcgctgatgatccatag

SEQ ID NO: 109553 - DNA, 594 bp, Artificial Sequence
  Description of Artificial Sequence: Synthetic coding sequence
atggaaccgaatgactcgaccagcacggctgtggaagaaccagattcccttgaggtgctcgtaaagacacttgatagccagactaggacattcatcgtaggagcccagatgaacgtaaaagaattcaaggagcatatcgcggcttcagtctccatcccttccgagaaacagaggctgatttaccagggacgtgtgctgcaagacgacaaaaaactgcaagaatacaacgtcggcggcaaggtcattcaccttgtggagagggctccgccccagacccacctcccatctggtgcctcatcgggcacaggcagcgcctccgccacccacggcggaggctcacccccaggaacacgagggcccggcgcctccgtgcacgaccgcaatgcaaattcctatgtgatggtaggtacctttaatctcccctccgatggctcagcggtggatgtgcacattaacatggaacaagctcctatacaatccgagcctagggttaggctagtgatggcccagcatatgatccgggatatacagacactgctatcccgcatggagtgccgcggcggcccacaaccacagcatagccaacccccatag

SEQ ID NO: 109554 - DNA, 735 bp, Artificial Sequence
  Description of Artificial Sequence: Synthetic coding sequence
atggagcctaatgatagcactagtactgcagtggaggagcctgattccctcgaggtgctggtgaagacgttagatagtcaaacacgaaccttcatcgtcggtgcccaaatgaatgtcaaagagtttaaggagcatatcgctgccagtgtaagcatcccatctgaaaagcagagactgatttatcaaggcagagttctgcaggacgacaagaaactccaggagtataacgtcggaggcaaggtaatccacctggtcgagcgtgctcctccccagacgcacctgccatctggagcctccagtggtacggggtcagcctcagcaacccatggtggcggatctcccccaggcactcgtgggcccggagcatccgtgcacgatcgcaatgccaatagctatgtgatggtggggactttcaatttaccctctgaacccagggtaagactggtcatggctcaacacatgatcagagacattcaaaccctcctttctagaatggagtgtcgggggggtccgcagcctcagcactctcagccccctccccaacccccggccgttaccccagagcccgtggcccttagtagccagacgtcggaaccggtggagtccgaggctcccccccgcgagccgatggaggcggaggaggtggaagaaagagctcccgcccaaaatcccgaattaacccccggaccagcccccgcgggccctacgcctgctcccgagacgaatgcaccatag

SEQ ID NO: 109555 - DNA, 594 bp, Artificial Sequence
  Description of Artificial Sequence: Synthetic coding sequence
atggaacccaacgactctacatccacagccgtagaggagccggatagtctggaggtgttggttaagacgttagactcccagaccagaacctttatagtcggagcccagatgaacgtcaaagagttcaaggagcacatagctgcctccgtgagcatacccagcgagaagcagcgtttgatctatcaggggagagtcctccaagatgataagaaactacaggaatataacgtgggcggtaaggtgatacatctggtggagagagcgccaccacagacccatctcccctcgggcgcgtcttctggtacaggaagtgcgagtgccacccatggcggaggttcgcccccagggactcgcgggccaggcgctagcgtgcatgaccgaaatgcgaatagttatgtcatggtgggtacgttcaacctaccgagtgacggcagcgccgtcgacgtgcatatcaatatggagcaggcacccattcagagcgaaccacgcgtccgactggtgatggcacaacacatgatcagggatattcagaccctcctttcacgaatggagtgccgtggtggacctcagccacagcacagccagcctccatag

SEQ ID NO: 109556 - DNA, 1548 bp, Artificial Sequence
  Description of Artificial Sequence: Synthetic coding sequence
atggaaccaaacgactcaaccagtaccgcagtcgaagagccagacagcttagaagtgctcgttaagacccttgactcacaaactaggaccttcattgtgggggctcagatgaacgtgaaggagttcaaggagcacatcgcagcttccgtaagtataccctcagagaagcagagactgatttaccaggggcgtgttcttcaggatgataaaaaactccaggagtataacgtaggggggaaagtgattcacttggtggagcgggcccccccccagactcacctgccctctggcgccagttccgggacaggctctgcctccgccactcacgggggcgggtctccacctggaacccgcggaccaggagcaagcgttcacgaccgcaatgcaaattcctacgttatggtgggtacattcaacttgccctcggatggcagcgccgtagacgttcacatcaatatggaacaggctcctatccagtctgaacctcgtgtccggctcgttatggctcaacatatgatcagagacatccaaaccctgttaagccggatggagtgcagaggcggacctcagccccagcactcacagccccccccccagccacccgcggtcactccagaacccgtggccctctcttcccagacttccgaaccagtcgagagcgaggcaccccccagagagcctatggaagctgaggaggtggaggagagagctccagcccagaaccccgaactgacaccaggacctgccccagccggcccaaccccggctcccgagaccaatgcaccaaaccacccatcaccagccgagtatgttgaagtgctgcaggagctgcagaggcttgagtcccgattgcagccgtttttacagcgctactacgaggtcctgggggcagctgcaaccacggattataataataaccacgaaggcagggaggaagatcaaaggctcattaacctcgttggtgagtcacttaggcttctgggaaacacattcgtcgccttgagcgacctacggtgtaatctcgcatgtacaccaccacggcacctccatgtggtgcgccccatgtcccactacaccacacctatggtgctccaacaggccgcgatccctattcagatcaacgtgggcactaccgtgacgatgactggcaacggtacacggccccctccaactccaaacgccgaagccccaccaccgggccctggtcaggcctcgtctgtagctcccagcagcacgaatgtagagtcatcggccgagggagcaccgcctcctggtccggcccccccccccgccacgagccacccgcgcgtaatcaggattagtcaccagtctgtagagcccgtggttatgatgcacatgaacatccaagatagtgggacgcaacctggaggagtgccctctgcgccaaccggtcccctgggcccaccgggtcacggccagactctaggctccaccctgattcagctcccctccctcccccctgagtttatgcacgccgtcgcacaccagatcactcaccaggctatggttgccgcagtggcctcctag

SEQ ID NO: 109557 - DNA, 735 bp, Artificial Sequence
  Description of Artificial Sequence: Synthetic coding sequence
atggagcccaatgatagcactagcaccgccgttgaggagcccgacagcctcgaggtcctggtgaagactctcgactcacagacccggacttttatcgtgggcgcccagatgaacgtaaaagagtttaaagagcatatcgctgcttccgtgtcgatcccaagtgagaagcaacgattgatctatcaaggtcgggtcctgcaagacgataagaaactccaagaatataacgttggagggaaagtaattcatcttgtcgagcgtgcgccgccccagacgcacctgccgagcggcgcatcctcaggaaccgggtctgcatccgcaacgcacgggggaggtagtccaccaggcacccgcggtccgggtgcctctgttcatgacaggaacgccaattcctacgtaatggtgggcacttttaacttgccttctgaaccgcgagtccgtctggtcatggcgcaacacatgattcgagacatacaaaccttactgtctagaatggagtgtaggggagggccgcagccccagcacagccaacccccgccccagccccctgcggtgacccccgagccagtggcgttgtccagtcagacgagtgagccggtggagtctgaagccccaccacgagagccgatggaggcagaggaggtggaggagagagcgcccgcacaaaatccggagttaaccccaggaccggcccctgctggacctactccggctcccgagacaaatgccccctag

SEQ ID NO: 109558 - DNA, 789 bp, Artificial Sequence
  Description of Artificial Sequence: Synthetic coding sequence
atggaacccaacgactccaccagtacagcggtcgaggagccagacagcttggaagttctggtcaaaaccttagatagccaaacccgaactttcattgtaggggcccagatgaacgtgaaagaattcaaggagcacatagccgcttcagtaagcattccctccgaaaaacagcgactgatctaccagggtagagtgctccaggacgacaaaaagctgcaggaatataacgttgggggcaaagtaattcatctggttgagagagccccaccacagacgcacctacctagcggagcctccagcggcacgggatctgcgtcagcaacccacggcggagggagtcccccaggcacccgtgggcctggtgcctctgttcacgatagaaacgcgaacagctacgtgatggtggggactttcaaccttccctcagacgggtctgctgtggatgtccacataaatatggagcaagccccaattcagtccgagccgcgcgtcaggctcgtgatggcgcagcacatgattagagatattcagacccttctaagcaggatggagtgcagagggggcccccaaccccaacactctcagcctccaccccagccacctgctgtcacgccggaacccgtagcgctgtcaagtcagacaagcgagcccgtcgagagtgaggcgccacctcgcgagcctatggaggctgaggaggtcgaggagagagcccctgcccaaaatccagagctgacgccaggccctgcccctgccgggccaacacccgcccccgaaacgaatgccccttag

SEQ ID NO: 109559 - DNA, 789 bp, Artificial Sequence
  Description of Artificial Sequence: Synthetic coding sequence
atggaacccaacgattcgaccagcaccgctgttgaagagccggacagcttagaagttttagtgaaaactctggactctcagacccgtactttcatcgtcggagcccaaatgaacgtaaaggagttcaaggaacatatagctgcttcggtgagcatcccctccgagaagcagagactgatctaccagggaagagtactgcaagatgataaaaaactgcaggaatacaacgtcggcggaaaggtaatccatcttgtggagagagcccccccccagactcacctgcccagtggcgctagctctggcaccggatctgctagcgctactcacggcgggggtagtccacccggcacaaggggacccggcgcttccgttcacgacaggaacgcaaattcatacgtgatggtggggacgttcaatcttcccagcgacggttctgccgtcgacgtgcatatcaatatggagcaggcaccgatacagtcagagccccgggtgaggcttgtgatggcccagcacatgattcgcgacatccagacccttctgtccaggatggaatgtagagggggacctcagccacagcacagccagccccccccccagccccctgctgttaccccagagcctgttgctttgtctagtcagacatccgagcccgtggagagtgaggccccgcctcgtgagcccatggaggcggaagaggtggaagagagggcccccgctcagaaccccgagctgacccccggtcctgcccctgccgggcctacgccagcaccagagacaaatgctccttag

SEQ ID NO: 109560 - DNA, 717 bp, Artificial Sequence
  Description of Artificial Sequence: Synthetic coding sequence
tcatccgctgaaggcgcgccgcctccaggccccgctccacctccggctacctcacacccacgcgttatcaggattagccaccagtctgtggaacccgttgttatgatgcatatgaatatccaagggcctctgtccctctcaccgtgcccggactccggaacccagcccgggggtgtgcctagcgccccaacagggcccctgggcccccctggtcacggccagacattaggtcagcaggtcccgggattcccgaccgcaccaacccgcgtggtcatcgcccggccaacaccaccacaagccaggcccagccatccaggaggcccccccgtgtcaggaaccttacagggtgccgggctcggtaccaacgcctccttagcacaaatggttagcggtctggtaggccagctgttgatgcaacccgtgctggtggcccagggaacccccgggatggcccccccacccgcaccagcgacggcctccgcatcagccggaaccaccaacaccgccactaccgctggcccagcacccggggggcctgcccagcctcctccaactcctcaaccttccatggccgacctgcaatttagccagctgctcggaaacctgctcggaccagctggacccggggccggcgggtccggcgtcgcctcccctacaattacagtcgctatgccaggagtcccagctttcctgcaggggatgactgactttttatag

SEQ ID NO: 109561 - DNA, 735 bp, Artificial Sequence
  Description of Artificial Sequence: Synthetic coding sequence
atggagccaaatgatagtacgtccaccgccgtggaagaaccggactctctggaggtgctggtgaagacactcgatagccaaactaggacattcattgtgggcgctcagatgaatgtgaaagaatttaaggaacacatcgctgcctcagtgagcattccttccgagaagcagagactaatctatcaaggccgcgtcttgcaggacgacaagaaattacaggaatataacgtaggtggaaaggtcattcacttagtggagcgagcccccccacagacgcatctgcccagtggggctagtagcggtacaggcagcgcatctgcaacgcacggcggtggcagcccccccgggactcggggccccggagcctctgtacatgacagaaatgctaattcttatgtgatggttggaacattcaatctgccatctgagccgagggtcaggctcgtgatggctcagcatatgattagagacatccaaaccttgctttccaggatggagtgtcggggcggaccccaacctcagcacagccagcccccaccacaaccgccagcagtgacccctgagcctgttgcactgtcttcccaaactagtgaacccgttgaatctgaggctcctccccgggagccgatggaagcagaggaggtggaagagagggccccagcccaaaaccccgagctgacacctggcccagcgccagcaggcccaacccccgcccccgaaaccaatgcaccttag

SEQ ID NO: 109562 - DNA, 621 bp, Artificial Sequence
  Description of Artificial Sequence: Synthetic coding sequence
atggagcctaatgattctaccagcacagcagtggaggagccagactccttggaggtgctggttaagacccttgactcccaaacccgaacctttatcgtgggggcacagatgaatgtgaaggagttcaaggaacacattgcagcttctgtcagcataccttccgaaaaacaacggcttatctaccaaggtcgcgtgctccaggacgataagaaactgcaggagtataacgtgggtggaaaagtcatacatctagttgagagggcgccgccccagacccacctgccttcaggtgctagttctggcaccggaagtgcatctgctacacatggagggggcagcccacccggtacgcgaggaccaggtgcttctgtgcacgataggaatgctaatagctacgttatggtaggtactttcaacttaccgtctgaacccagggtccgtcttgttatggcccagcacatgatccgcgacattcagacattactgtctcgcatggagtgccgcggcggaccgcagccccaacactcccagcccccaccccagcccccagccgtcactccggagcctgtcgctctgtccagtcagacatcagaacctgtcgaaagcgaggcccccccttag

SEQ ID NO: 109563 - DNA, 735 bp, Artificial Sequence
  Description of Artificial Sequence: Synthetic coding sequence
atggaacccaacgacagtacctcgaccgcggtggaagagcctgacagcctcgaagtgttggtgaagaccttggatagtcaaactcgtacatttatcgtgggagcacagatgaatgtgaaggaatttaaggagcacattgcagccagcgtgtctattccctccgaaaaacagcgacttatttatcagggtcgagtgctccaagatgataaaaaactgcaggaatacaacgttggcggtaaagtgatccatttggtagagcgcgccccccctcaaacacacctgccgagcggcgcctcgagcggcacgggcagcgcaagtgcaactcacggcggcgggtcccccccggggaccagagggccaggagcttctgtgcacgacaggaacgctaattcatacgtcatggtgggcaccttcaacctgccttctgaacccagagtgcgccttgttatggcccagcatatgattagggacatccagaccctgctatctcggatggagtgccgaggtggacctcaaccacagcattctcagcctccgccacagccaccagctgtgaccccagagcccgtagccttatcgtcacagaccagcgagccagtcgaaagcgaagcccctccccgagaaccaatggaagctgaggaagtggaggagagagctcccgctcagaacccagagcttactccagggccggcccccgccggccccactcctgccccagagacaaacgccccctag

SEQ ID NO: 109564 - DNA, 780 bp, Artificial Sequence
  Description of Artificial Sequence: Synthetic coding sequence
atggaacctaatgactctacctctacagccgttgaggaaccagatagcctcgaggtgctggtgaagaccctcgactctcagacccgtacattcatagttggcgctcagatgaacgtgaaagagttcaaggagcacatcgcggcaagcgtttccattccatcagaaaaacaacgcctgatctatcaaggccgagtgctgcaagacgacaaaaagcttcaggagtataatgttggcgggaaggtcatccatctagtggagcgagcgccacctcagacgcaccttcctagcggggcttcctcagggacaggcagtgcttccgccacacatggcggcgggtccccgcccggaactcgaggccctggcgctagcgtgcacgatcggaacgccaactcatacgtgatggtgggaaccttcaatcttcctagcgatggctcagctgtcgatgtgcacattaatatggagcaagcacctatacagagcgaaccaagggtaaggttggtgatggcacaacatatgattcgggacattcagaccctgctttcaaggatggagtgcagggggggacctcagccacagcattcacaacccccccctcagccccccgccgttacccctgagccggtggccttatcaagccagacatccgagcctgtggagagcgaggcccctccacgagaaccgatggaagccgaggaagtggaggagcgggcacctgcccaaaatcctgaactgacccctggccctgcgcctgccggacctactccagcccccgagacttag

SEQ ID NO: 109565 - DNA, 558 bp, Artificial Sequence
  Description of Artificial Sequence: Synthetic coding sequence
taattagcctgcactccccctcgccacctgcatgtggtgaggccaatgagccactacacaacgccaatggttctgcagcaggcagctatacccatacagattaacgtaggcactactgtaacaatgacaggaaatggcactcgccccccccctacacctaatgccgaggcaccccccccaggaccaggccaggcaagcagcgtggcccctagttcgactaacgtcgaatcttccgcagagggcgctccgcctccaggccccgctcctcccccagcgacaagtcaccctagggtcattcgaattagccaccagtcagtagaacctgtagttatgatgcacatgaacatccaggggcagcaggtgccggggtttccaacagctcccacacgtgtggtgatagcgcgcccaacccctccccaggctaggccatcgcaccctggcgggcccccagtcagcggaacacttcagggagccggtttgggtacaaatgcaagcctggcacagatggtgtccgggctggttgggcagttgctgatgcagccagtactagtggcttag

SEQ ID NO: 109566 - DNA, 621 bp, Artificial Sequence
  Description of Artificial Sequence: Synthetic coding sequence
atggagccgaatgattccactagcaccgccgtcgaagagcctgattccttggaggtgcttgttaagaccttagactctcagaccaggacatttatcgtgggcgctcagatgaacgttaaagaattcaaggagcacatagccgcctcggtttccatcccctccgaaaagcaacgcctgatttaccagggcagagttcttcaagatgataagaagcttcaggaatacaatgtgggcgggaaagtgatccatctggtggagagagcccctccccaaacccatctgcccagtggggcctcttcgggaaccggctctgctagtgccacgcatgggggcggctctccccccgggactcgaggccctggagcctctgtgcacgatcggaacgccaactcctatgtgatggttggcacttttaacctgccttccgaaccccgtgttagactggtaatggctcagcacatgattagagacatccaaacccttctttctcggatggaatgccgcggcggaccccaaccacagcacagtcagcctcctccgcagcccccagcagtcaccccggaacccgttgctctgagctcacagacttctgaacccgttgagagcgaagctcccccatag

SEQ ID NO: 109567 - DNA, 735 bp, Artificial Sequence
  Description of Artificial Sequence: Synthetic coding sequence
atggagcccaatgacagcacctcaaccgcagtcgaagagccagattctctcgaagtgctggtgaaaaccctcgactcgcagacccgtacttttattgtgggcgcgcaaatgaatgttaaagaatttaaggagcacattgccgcatctgtgagcatcccatccgagaagcagagactgatctatcagggaagggtacttcaggatgacaaaaaacttcaagaatacaacgtggggggcaaagtcattcacctggtcgaacgcgccccacctcagacccaccttccatctggtgcctccagcgggaccggcagcgcttcagcgacacacggcggggggagtcccccaggcaccaggggccccggcgcctccgtgcatgacagaaacgctaactcatacgtcatggttggaacattcaatctgccctccgaaccccgcgttcgcttggtaatggctcagcacatgatcagagatattcagaccttgttgtcccgcatggaatgcagaggcggtccacagccccaacattcgcagcccccacctcaaccacccgctgttacacccgagcccgtggccctgtcctcacagactagcgaaccagttgagagcgaggctcccccaagggagcctatggaggccgaagaggtggaggagcgggctccagcccagaacccagaattgactccaggccctgcccccgcaggacctacaccagcacccgagacgaatgctccctag

SEQ ID NO: 109568 - DNA, 1548 bp, Artificial Sequence
  Description of Artificial Sequence: Synthetic coding sequence
atggagcctaatgatagtacttccactgcggtagaagaaccagactccctcgaagttcttgtgaagacattggattcacagacacggacgtttatcgtgggagcccagatgaacgttaaggagtttaaggagcacattgctgcaagcgtttccataccttccgagaagcagaggctcatctaccagggccgtgtactccaagacgataaaaagctgcaagagtataatgtgggcgggaaagtgatacatctggttgagagggcccctcctcagacccatctgcccagtggggcctcgtccggcacgggctccgcctctgccactcacggggggggatcaccaccaggaacaagagggcccggcgcttccgtacacgatcggaacgcgaattcatacgtcatggtcggcaccttcaacctgccctcagatggcagtgcagtggatgtgcacatcaacatggagcaggcaccaattcagtctgaaccccgggttcgcttagttatggcccagcacatgatccgagatatccaaacactcttgtcccgtatggaatgcagaggtggacctcagcctcaacactcccagccccctccccaaccccccgctgtaacccccgaacctgtggcgctgtcaagccagacatctgagcccgtcgagtcagaggcacctcctcgggagcctatggaggccgaggaagtagaggaacgcgcccccgcccaaaaccctgagttgactccagggcccgcccccgcagggcccacccccgctcctgagactaacgccccaaaccatccctcccccgctgaatacgtggaggtgttgcaggagttgcagcgactcgagtctcgacttcaacccttcctccagcgttattatgaggtgctgggggcggccgctaccacagattacaacaacaaccatgaaggcagagaagaggaccagcgactgatcaaccttgtgggagagagccttaggctgttaggaaacacctttgtcgctctgagcgacctccggtgtaacctggcatgtacaccgcccaggcacctgcacgtggtcagacctatgtcgcattataccactccaatggtgctgcagcaggctgccatcccaattcaaattaacgtgggcacaacggttaccatgactggcaatggcactcggccaccaccgactccaaatgctgaggcaccacctcctggccctggacaagcttccagcgtcgcccctagtagcactaatgtggagagctccgcagaaggggcccctcctcccggtccagcgccccccccagcaaccagtcaccccagggtgataagaatctcccatcagtctgttgagcccgtagttatgatgcatatgaatattcaagactccgggactcaaccaggcggtgtgccttctgcccctactggtcctctcggccctccaggccacggacagaccctgggcagtaccctcatccagctgccgtcactgccccccgaattcatgcacgctgtggctcatcagataactcatcaggcgatggtcgcggccgtggcttcctag

SEQ ID NO: 109569 - DNA, 717 bp, Artificial Sequence
  Description of Artificial Sequence: Synthetic coding sequence
tcatccgccgaaggagccccgcctcccggccctgcacctcctccagccacatcccaccctcgcgtgatcaggatatcacatcagagcgtggaacccgtagtgatgatgcacatgaacattcagggacctttgagcctgagtccatgtccagatagcggcacccagccaggcggtgttccgtcagcccccaccgggccgctgggaccccccgggcacggtcagacgcttggccagcaggtacccggcttccccaccgctccgacacgggtagttatagcccggccgaccccaccacaggcccgtcccagtcaccccggaggtcctcctgtgagcggcacgctgcagggcgccggcctgggcacgaacgcatcactggcccagatggttagtggtttggtgggccagctattgatgcagcccgtcctggttgcccagggcacacccgggatggccccaccccccgcccccgctaccgcttccgcgtccgccggaacaacaaacactgcaactaccgccggtcccgcaccagggggacccgcccagccgcctccaaccccccagccatctatggcggacttgcagttctcccagctccttggtaatctgctcgggcctgcaggccctggcgcggggggtcccggagtagccagccccacgataaccgtcgctatgccaggcgtgcctgctttcctccagggtatgactgactttctctag

SEQ ID NO: 109570 - DNA, 648 bp, Artificial Sequence
  Description of Artificial Sequence: Synthetic coding sequence
atggagcccaacgacagcacctctaccgcagtcgaggagcccgactcgctcgaggttttagtcaagacactggactcacagactcggacgttcatcgttggtgcccagatgaatgtcaaagagttcaaagaacacatagccgcctctgtcagcatcccatctgaaaaacaacgtctgatttaccagggtagggtcctccaggatgataagaagctgcaggagtataatgtggggggaaaggttatccatttggtcgaacgggcccccccacagacccaccttccgagtggtgcgtcgtcggggactggcagcgcatccgcaactcatggggggggatcccccccaggcacaagaggtccaggcgcatctgtgcacgaccgaaacgctaattcttacgtgatggttgggacatttaatttacccagcgaacctagggttagactggtgatggcacagcacatgatccgcgatatccagaccctactgtctcgcatggaatgcagaggaggcccgcagcctcagcactcccagcccccaccacaaccaccggcggttaccccagagcccgtagcacttagttctcaaacctcagagccagtcgagtccgaagcccctccaagggaaccaatggaggccgaggaagtatag

SEQ ID NO: 109571 - DNA, 477 bp, Artificial Sequence
  Description of Artificial Sequence: Synthetic coding sequence
atggaaccaaacgactctacttccaccgcggtggaagagcctgattccttggaggtgcttgtgaagaccctggacagccagaccagaacgttcatcgtcggtgcccagatgaacgtgaaagaatttaaggagcatatagccgctagcgtaagcatcccctctgagaaacagcgtctgatttaccaagggagagtactgcaggacgacaagaagctccaagagtacaatgttggggggaaggtcatccatctcgtcgagcgggccccacctcagactcatctgccctctggagcctctagtggaacaggatccgcctcagcaacccatggagggggctcgccgccgggaacccgcggccccggagcgtccgtccatgaccgaaatgctaactcttacgtaatggtcgggaccttcaacctgcccagtgatgggtcagctgtcgacgttcacatcaatatggagcaagccccgatctag

SEQ ID NO: 109572 - DNA, 702 bp, Artificial Sequence
  Description of Artificial Sequence: Synthetic coding sequence
atggagcctaacgacagcacttctaccgcagtggaggaacctgacagccttgaggtcctcgttaaaactctggacagtcagacccgtacttttatcgtgggcgctcagatgaatgttaaggagtttaaggaacacattgcagccagcgtgagcattccctccgaaaagcagcgcttaatttatcaggggagagtgctgcaagacgataaaaagctccaagagtataacgtgggtggtaaggtgatacacctcgtggagagggccccaccccagacccacctgccctctggtgcctcatcgggaacgggctctgcctccgccacacatggtggggggtcacccccaggaacgcgcggacctggcgccagcgtacatgatcggaatgcgaactcatacgtaatggtgggcacatttaacctgccttcggacggttctgctgttgacgtccacattaacatggagcaggccccaattcaatccgagccacgcgttaggctcgtgatggcgcagcacatgatccgcgacattcagactctgttatcccgcatggagacacttccttacctgcagtgccgaggcgggccacagcctcagcattctcaacctccaccacagccacccgctgtgactccagagcctgttgctctgagtagtcagaccagtgaacctgtggagagcgaggcgcctccaagggaaccatag

SEQ ID NO: 109573 - DNA, 780 bp, Artificial Sequence
  Description of Artificial Sequence: Synthetic coding sequence
atggaacccaacgactctaccagtacggccgtggaggaaccagacagccttgaggtcctcgtgaagactctggacagccagacccgcaccttcattgtaggtgcccagatgaatgtcaaagaatttaaagaacatatcgcagcaagtgtcagtattccatcagaaaagcagagattgatttaccagggaagagtgctccaagatgataagaaactccaggaatacaacgtgggcggcaaagttatacacctggtggaaagggccccaccacagactcacctcccctcgggcgcttcatcaggcactggctctgctagtgccactcacggcggcggcagccctccgggcacacgtgggcccggggcgagcgtgcacgaccgcaacgcgaattcatatgttatggtaggcactttcaatctgccttccgacgggtccgccgtggatgtgcacattaatatggagcaggcacctatccagtcagagcctcgagtgcgcttggtgatggcgcagcacatgatccgggacattcagaccctgctgtccaggatggaatgtaggggagggcctcagccacagcacagccagccaccaccccagcctcccgctgtgacaccagaaccagtggcactctcctctcaaacaagtgagccagtagaatcagaagcacctccccgagagcctatggaggccgaggaagttgaggaaagggcccctgcccagaatccagagctcacacctggcccagcacctgcaggccctactcctgcccctgagacctag

SEQ ID NO: 109574 - DNA, 411 bp, Artificial Sequence
  Description of Artificial Sequence: Synthetic coding sequence
tagcggatgtcgaggggagttaatccgagtctggtgagctggttaaccaccatgatgggcctgcggctgcaggtggtcctcgagcatatgccggtggggcccgatgctatcctgagatacgttcggcgggtaggagacccaccacagcccctcccagaggagccaatggaagtacagggtgccgaacgcgcctctcccgagccgcaggaatgggtgccgattattcagcaggacatccagtctcagaggaaggtgaaacctcagcctcctctcagcgatgcctatctttctggtatgcccgccaaaagacgcaagctacggtcagacatacagaagcgtctgcaggaggaccccaattacagtccgcagcgatttcccaatgcccagcgagcttttgccgatgatccatag

SEQ ID NO: 109575 - DNA, 735 bp, Artificial Sequence
  Description of Artificial Sequence: Synthetic coding sequence
atggagccaaatgattccaccagtacagccgtcgaggaacctgactctctggaagttctggttaaaaccctggacagccaaacccgtacctttattgtcggggcacagatgaacgtgaaagagtttaaagagcacatcgcagcaagtgtgagcatacctagcgagaagcagcggctgatctaccagggcagggtgcttcaggatgacaagaaactgcaagaatacaacgttggtggaaaggtgatacatctcgtggaacgcgcccccccacagacccacttgccaagcggagcctcttccggaaccgggtctgcctccgccactcatggggggggctctcctcccggtacccggggtccgggcgccagcgtccacgaccggaatgcaaacagctacgtcatggtgggaacctttaacttgcctagtgaaccgcgtgtgaggctggtcatggctcagcacatgatccgggatatccagacgttgctgtctcgcatggagtgccgcggaggcccccagccccagcactcccaaccccctccacaacctcctgctgtgaccccagagccagtggctctctcctcccagacatcagaacccgtggaaagcgaggcccctccaagagagccgatggaggcagaggaggtggaggaacgcgcacctgcccagaatcctgagctcacacccggccccgccccagccggtcctaccccagcaccagagacaaatgctccttag

SEQ ID NO: 109576 - DNA, 3381 bp, Artificial Sequence
  Description of Artificial Sequence: Synthetic coding sequence
atggaaccaaatgactcgacctctacagctgtcgaagagcctgacagtctcgaagtgctggttaaaaccctggattcccagaccaggaccttcatcgtgggagctcaaatgaatgtcaaagagttcaaagaacacatcgctgctagcgtttcgattcctagtgagaagcagagattgatctaccagggccgagtcctacaggacgataagaagctgcaagagtacaatgtcggcggcaaagtgattcatctggtcgaaagagcccctccccaaacccatctgccttctggcgcatcaagcggaacaggcagcgcttccgccacccacggaggtggatcgccacccgggacacgagggcccggtgccagcgtgcatgataggaatgctaacagctacgtgatggtggggacgtttaacctgccttcggacggatctgcagtcgacgtgcatatcaatatggagcaggccccaatccagtcggagcccagggtaaggctggtgatggcccagcacatgataagggatattcagacattgctgagccgcatggaatgtagaggaggcccgcagcctcagcactctcaaccacctccacagccacccgccgtgacccccgagcccgtcgccctgtcatcacagacatctgagccggtggagtctgaagccccccccagagagcccatggaggctgaagaggtagaagaaagagcaccagcccagaaccctgagttgacgcccggcccagcacccgcagggcctacacccgccccagagactaatgcccccaaccaccccagtcccgccgaatatgttgaagtcctgcaggaacttcaaaggctggagagcaggttacaaccctttctgcagagatactacgaggtgctgggagccgcggccaccactgactataataacaatcatgaaggccgtgaagaagaccagagactgattaatctggtgggagaatcacttaggctgctcggcaacacatttgtcgccttgtccgacttaagatgtaatttagcttgtacgccgcctcgtcacctgcacgtggtccgtcctatgtcccattacaccacccctatggtcttgcagcaggccgctattcccatccagatcaatgttggcacaacagtgacaatgaccgggaacgggacccgccccccaccaacacccaacgccgaggctcctccacctggtcccggacaggcgagttcagttgccccttcctccactaacgtggaaagctccgccgagggtgctcccccacctggccctgcccccccccccgcaacaagccacccaagggtgataaggatctcccaccagagtgtagagcccgtagtaatgatgcacatgaatattcaggattctgggacgcagcctggcggcgtaccttctgccccaacaggccctctgggtcctccaggacacgggcaaacattgggtcagcaggtccccggcttccccacggcaccaaccagggtggtcatcgcacgaccaactcctcctcaggccaggccatcccatcccggcggaccgccggtatctggaactctccagggcgccggcctaggaacaaatgcctctctggctcaaatggtgtctggactggtcggacagctcctcatgcagcccgtcctggtggctcagggtacgccaggaatggccccacctcccgcccccgctacggcctcagcctcagccggtactaccaatacagcaacaaccgctggccctgcaccaggaggtccagcacagccacccccgaccccgcagccatccatggccgacctgcaattttcacaattgctcggcaatctcctggggcccgccggtcctggcgctgggggccctggagtcgcgagccctacaatcaccgtcgctatgcctggcgttcctgcattcctccagggcatgacggactttcttcaggctactcagaccgctccccccccacctcctccccccccaccacccccacccgcaccagagcagcagactatgcctccgcccggttccccaagtggaggtgcaggctcccccggcggcctgggtctcgagagcctgagccctgagtttttcactagcgtggtgcaaggcgtgctgtcgtccctgctaggctctcttggagcccgggcaggttccagcgaaagcattgctgccttcatacaacgcctcagtggatctagcaatatcttcgaaccgggcgctgacggcgcacttggtttttttggagctctgttgagcttgctgtgccagaatttttctatggtagacgtggtgatgctgttacatgggcactttcagcccctgcaaaggctccaacctcagttgcgctcttttttccatcagcactacctcggcgggcaggagccaaccccttccaatatccgaatggctactcatactctgataacaggccttgaagaatacgttcgcgaaagcttcagcctggtacaagtgcaacccggagtggacatcataaggaccaatctcgagttcctgcaggagcagttcaacagcatagccgctcatgtgttgcactgtactgacagcgggtttggggccagattgctggaactgtgtaatcagggtctgtttgaatgcctggcactgaatttgcactgccttggaggacagcagatggaacttgccgctgtgataaatggacgcatccgtcgcatgagccggggcgtgaatccttctctcgttagctggctgaccacaatgatggggcttaggctgcaggtggtcctggaacacatgccagtagggcccgatgcaatccttagatatgtccggagagttggagaccctccccagcccttgccagaggaaccaatggaggtgcagggtgccgagcgcgccagtcccgagcctcaacgggagaacgccagccccgcccctggaacaaccgctgaggaagccatgtcacgggggcctccgccagctcccgaggggggttcacgcgatgaacaggacggggcatctgctgaaaccgagccttgggctgctgcggtgccaccagagtgggtgccaataatacagcaagacatacagagtcagcgcaaggtgaaacctcagccgcctctgagcgacgcttacctctctggcatgcccgcaaaaagaagaaagaccatgcaaggcgagggtccacaactcctgctcagtgaggccgtttcaagggctgccaaagccgcaggagccaggcccctgacgtctccagaaagtctttctcgcgatctggaagccccggaagtccaggagtcatatcgccagcagctgagaagcgacattcagaagcggctgcaggaggacccaaattactccccacaacggttccccaacgcccaacgggcatttgcggatgatccatag

SEQ ID NO: 109577 - DNA, 411 bp, Artificial Sequence
  Description of Artificial Sequence: Synthetic coding sequence
tgaaggatgtcccgaggggtgaaccccagtcttgtgagctggctaacaactatgatgggtttgcgcttgcaggtggtcttagagcacatgccagtgggcccggacgcgattctgcgatacgtgagacgtgtgggtgatcccccacagccattgccagaggagcccatggaagttcagggagcagagcgggcttctcccgagccccaggagtgggtcccaatcattcaacaggatatacaaagtcagcggaaggtgaagccccagcccccgctcagtgatgcatatttgtccggcatgcctgcaaaaaggcggaaactgagaagcgacatccagaaacggttacaggaagaccccaactactcccctcaacggtttccgaatgcacagcgcgcctttgctgatgacccgtag

SEQ ID NO: 109578 - DNA, 648 bp, Artificial Sequence
  Description of Artificial Sequence: Synthetic coding sequence
atggaacccaacgattccacatcaacggccgttgaagagcccgatagtcttgaggtgctggtcaagactttggattcacaaactcgtacatttatagttggcgctcaaatgaatgtaaaggaatttaaggaacatatcgccgcttcagtttcgattcccagcgagaaacagaggctgatctaccaagggagagtgctccaggatgataagaagctgcaggaatacaatgtaggaggcaaagtgattcacctcgtagagcgggctccaccccaaacacacctcccaagcggggctagctcggggactggctctgctagcgcaacacacgggggggggagtccccccggaacccgaggacccggggcctccgtgcacgaccggaacgccaactcctatgtgatggtgggaacattcaacctgcctagcgagccacgggtgagactagtcatggcccagcatatgataagggacatccagacactgctgagcaggatggaatgtcgcgggggcccacagccccaacactcccagccccctcctcagcctcccgccgtgactcctgagccggtggcactgtctagtcagaccagcgaacctgtggagagtgaggctcctccgcgcgaaccaatggaggccgaagaggtgtag

SEQ ID NO: 109579 - DNA, 594 bp, Artificial Sequence
  Description of Artificial Sequence: Synthetic coding sequence
atggagcccaacgattccacgtcaacagcagtcgaggaacccgacagtttagaggtactggttaaaacccttgatagtcagactcggacctttatagtaggcgctcagatgaatgtgaaggaatttaaagaacacatagccgccagtgtcagtattccgagtgagaagcagcgactgatttaccaggggagagtcttgcaggatgacaaaaaactgcaggaatacaacgtcggcggaaaagtgattcacttagtagaacgggcaccacctcagacccacctgccgagcggggcaagttccggcaccggctcagcaagtgcaactcatggtggcggctccccacctggaacccgagggcctggcgcaagcgtccacgatagaaatgctaatagctacgtcatggttggtacttttaacctcccctccgacgggtcagctgtggatgtccatattaacatggagcaagcccctattcaatccgagcctagagttaggctagttatggctcagcacatgattcgagatattcagacacttctgtctcgcatggagtgccgcggcggaccccagccccagcactctcagcctccctag

SEQ ID NO: 109580 - DNA, 1548 bp, Artificial Sequence
  Description of Artificial Sequence: Synthetic coding sequence
atggagccgaacgatagtacttccactgccgtcgaagagcccgactctctcgaagtgctagtgaagactttggacagccagacgcgcacttttatcgtgggcgcacaaatgaacgtgaaggagtttaaggagcatatcgctgcctctgtcagtataccgtccgaaaaacaaagattaatctaccagggccgggtactgcaagacgataaaaagcttcaagagtacaacgttggagggaaggtgattcatctagttgagagagctcctccacagacgcacctgcccagcggcgccagtagcggcactgggtctgcctcagcaactcacggggggggctcaccccctggaaccaggggaccaggggcatcagtccatgatcgaaacgctaactcatatgtgatggtgggcactttcaatctcccctccgatggtagcgccgtggacgtgcacatcaatatggaacaggccccaatccagtccgagccccgcgtgcggctcgttatggcccagcacatgattcgcgatattcagacattactatcacgcatggaatgtagaggagggcctcagccccagcacagccagcccccaccccagcctccggccgtgactcccgagccagtcgcactttcaagccagacatccgaaccagtggagtcagaggcacctcctcgggagcccatggaagctgaggaagtcgaagagcgcgcgcctgcacaaaaccccgaactgacacctggacccgctcctgccgggcccactcccgcccccgagacaaacgccccgaatcacccctcacccgccgagtacgttgaggtgctacaagagctgcagcgacttgagtcacgactgcagccatttttgcaacggtactacgaagtgcttggcgcagcagcaaccactgactataataataaccatgagggtcgtgaagaagatcagcgcttaattaacttggtcggagagtcccttcggctgcttggtaatacctttgtggcacttagtgacctccgctgcaatctcgcctgtacgccccctagacatctccatgtggtgcggcccatgtctcattatacaacacctatggtgttgcagcaggctgccattcccatacagatcaatgtcggcacgaccgtcacaatgaccggaaacggtacccgcccgccacccacaccaaatgctgaggcacctcctcctggccctggccaagccagctccgtcgcgccctcaagcaccaacgtggaatcgagcgcggagggcgctccccctcctgggccagcacccccccccgcaacaagtcatcccagagtcattcggataagccatcagagtgtggagccggtcgttatgatgcacatgaatatacaggacagcgggacccaaccaggcggcgtaccatcggcacccaccggcccattgggaccacccgggcatgggcaaacccttggaagcactctgatccaattgccttccctccccccagaatttatgcacgccgtggctcaccagattactcatcaagctatggtggctgccgttgcctcgtag

SEQ ID NO: 109581 - DNA, 738 bp, Artificial Sequence
  Description of Artificial Sequence: Synthetic coding sequence
ccccctcgacatctgcatgttgtgcgtcccatgtctcactacaccacacccatggtgttgcagcaagctgccatccccattcaaattaatgtggggactacagtgacgatgacaggacccgcccctccaccagccaccagtcaccccagagtgataaggatttctcaccaatccgtggagccagtagtcatgatgcacatgaacatccaggattccggaacccaacctgggggagtgccttctgctcccaccggcccccttgggccgcccggccatgggcaaaccctgggtcagcaggtcccggggttcccaaccgcacccacccgggtagtgatagcaagaccgactccgccgcaggctcgcccatctcacccaggggggccacccgtcagtggaacactacaaggcgccggcctggggaccaatgcctcgctggctcagatggtgtcaggattggtggggcaattactgatgcagcccgtactcgtcgctcagggcacccccggcatggcccctccgccagccccagccactgcctcagcctcagcgggaacgactaacaccgctaccacagccggacctgccccagggggtccggcacagcctccccctacccctcagcctagcatggcagatctgcaattttcccaattgctcggaaacctgctgggacccgcaggacccggcgcaggaggccctggcgtggcctcccctactataaccgtggccatgccatag

SEQ ID NO: 109582 - DNA, 738 bp, Artificial Sequence
  Description of Artificial Sequence: Synthetic coding sequence
ccaccacggcacttgcacgtcgtaaggcccatgtcccactatacaaccccaatggtcctgcagcaagccgccatcccgattcagataaatgtgggcactacggtgacaatgacggggcccgcgcctccacctgccacctctcacccacgcgtgatcagaatctctcatcaaagcgtagagcccgtggttatgatgcacatgaacattcaggacagcggcacccagcctgggggggtcccctccgctcccactggccctttgggcccaccaggccatggtcagacattaggccagcaggtccccgggtttcccaccgcccctacaagagtcgtgatagcaaggcccactcctccccaggcgagaccgtcacaccctggtggccctccagttagcgggactctgcaaggcgcagggcttgggacgaatgcttccctcgcacaaatggtgtcaggtcttgtggggcaactgctgatgcagcctgtgctggtggctcagggcacacccggcatggctcccccccccgcaccagccaccgctagtgcctcggctgggaccacaaatactgctacaacagcaggacctgctcccgggggtccagcccagccgccccccaccccccagccaagcatggccgacctgcaattttcacaactacttggcaacctgcttggacctgccggacccggcgccggtggtagcggagtggcctcgccgaccatcactgtcgccatgccttag

SEQ ID NO: 109583 - DNA, 777 bp, Artificial Sequence
  Description of Artificial Sequence: Synthetic coding sequence
atggagccaaatgattcaacttcaacagccgtcgaagagcctgatagcctcgaagtgctggtgaagacacttgacagccaaacccgcacctttatcgttggcgcgcagatgaatgttaaagagtttaaggaacacatcgcagccagtgtgtccatcccaagcgagaaacagcgtctgatttaccagggaagggtccttcaggacgacaagaagttgcaggagtacaacgtgggtgggaaggtcatccatcttgtggagcgagctcctccacagacgcacctgcctagcggggccagctcaggaactggatcagcctccgccactcacggtggcggtagcccccctggaactcgtggacctggagcttctgtgcacgatcgcaacgccaactcctacgtcatggtgggcacctttaatctcccttccgatggttcagcggtagacgtacacattaacatggagcaggcccccatccagtccgaaccgcgcgtccggttggtgatggcgcagcatatgatcagagacattcagaccttgctgtcccgcatggagtgtagaggaggcccacagccccagcactctcaacctccccctcaacccccagcagttacgcccgagccagttgcactgagttcccagactagcgagccagtcgagagtgaggcccccccgagagagccaatggaagccgaggaggtcgaggagagagctccggcacagaaccctgagctcacacctgggccagcccctgcagggcctacgcctgcccccgaatag

SEQ ID NO: 109584 - DNA, 789 bp, Artificial Sequence
  Description of Artificial Sequence: Synthetic coding sequence
atggagccgaacgactccacttccaccgctgtagaggagccggactcactcgaagtgctggtcaaaaccttggatagccagacacgcaccttcatagtgggcgcacagatgaatgtgaaagagtttaaagagcatattgccgcttcggtgagcatcccgagtgaaaagcaacggctcatataccagggaagggtgttgcaggacgataagaaactgcaggagtataacgtaggcggcaaagtgattcacctcgtcgagcgagccccccctcagacccaccttccgagcggcgcttctagcggaacagggtctgctagcgctacccatggaggagggtcaccgcctggaacacgtggacccggcgcctctgttcacgaccgtaacgctaacagctatgttatggtgggcacttttaacctgccctctgacggcagcgccgtggacgttcatattaatatggagcaggcacccattcagagcgagccacgggtacggctcgttatggcccagcacatgatcagagatattcagaccctgctgtcccgaatggagtgtagaggggggccgcagccacagcacagtcagccacccccccagccacccgccgttaccccggaacccgtggctctgtcctctcaaaccagcgagcctgtagagtctgaggccccaccgagagaaccaatggaggccgaagaagtggaggaacgcgcccccgcccagaaccccgagctcacccctggacctgcgccagctgggcccacacccgctcctgagacaaacgccccatag

SEQ ID NO: 109585 - DNA, 2232 bp, Artificial Sequence
  Description of Artificial Sequence: Synthetic coding sequence
atggagccgaacgactctacttccacagccgtggaggaacccgattcactggaggttttggtaaaaacactcgatagccaaactcggacgttcatagtgggtgcacaaatgaatgtgaaggaatttaaggaacacattgcggcatcagtgagtattcccagtgaaaagcagaggctgatctaccaggggcgagtccttcaggacgacaaaaagttgcaggaatataatgtaggcggaaaggtgatccacctcgtggaaagggctcctcctcagacccacttgccctccggtgcaagttctggcaccgggtccgcaagcgcaacccatggtggtggttctccacctggcacacgcggtcccggtgctagtgtgcacgatcgcaacgctaacagttatgtcatggttgggacctttaacctgccaagcgacggttctgctgtggacgtgcatattaacatggagcaggcccctatccaaagcgaacccagggtgcggctggtgatggctcaacacatgattcgcgacattcagactctgctgagcaggatggaatgtagaggagggccccaacctcagcactcccagcctccgcctcagcctccagcagtgacccccgaacccgtggccctgtcttcgcaaacgagcgaacccgtcgaaagcgaagcccctccacgcgaacctatggaggccgaggaagtggaggagagagcgcccgctcagaacccagagctgacccccggccctgcacctgcaggtcccactcccgcgccagagactaatgcacccaaccatccctctcccgcagagtacgtcgaagttctgcaggagttgcagcggctggagtctcggctgcagcctttccttcaaaggtattatgaggtactaggcgcagctgcaaccactgactacaacaacaaccacgaggggcgggaagaagatcaaagactgatcaacctggtgggggagtccctgcgtctgttaggcaacacctttgttgcactttcagacctacggtgtaacctggcatgcacaccgccacgccacctgcatgtcgtgcgcccaatgtctcactatactaccccgatggtgcttcaacaggccgccatacctattcagattaacgtgggcactacagtaactatgactgggaatggtacacgtccccccccaacccctaatgctgaagctccaccaccaggacctggtcaggcgagcagtgtggctcctagctcgactaacgtggagtcttctgctgaaggcgcacccccccccggcccagctcctcctcccgctacctcacacccgagggttatcaggatctctcaccagagtgtagagcccgtggtcatgatgcacatgaatatacaggacagcggaacacagccaggcggtgtcccctccgcgcccactggtccactgggacctccaggccacggtcagaccctgggtagcaccctcatccagctccccagtctgccaccggagtttatgcacgccgttgctcaccagattacgcaccaggctatggttgcggccgtggcgtccgccgcagcgggccagcaggttccgggctttcccactgctcccactcgggtggttatcgccagaccaaccccacctcaggcccggccgagtcaccccggagggccccccgtgtcagggaccctgcagggagccgggctgggcacaaacgctagcctggcccagatggtcagcggtcttgtcggccagcttcttatgcagcctgtgttggtggcccagggcacccccggcatggccccaccacctgcgcccgccacagcctccgccagcgccggaacgaccaacaccgcgaccaccgctgggccggcgcccggcgggcccgctcaaccgccacctaccccccaaccaagcatggctgatctgcagttctctcaactgctggggaacctccttgggccagccggcccaggagcaggcgggagcggtgttgcttccccgaccatcactgttgctatgccaggggttccggccttcctgcagggaatgactgattttctgcaggctacccagaccgcaccacctccccccccaccacctcctccacccccaccggcacctgagcagcagactatgccaccacctgggagccccagcgggggagccgggagccccggcgggcttggtcttgaatccctctctcccgaattcttcacatctgttgtgcaaggcgtactgtcgtccctcctttag

SEQ ID NO: 109586 - DNA, 777 bp, Artificial Sequence
  Description of Artificial Sequence: Synthetic coding sequence
atggagcccaacgacagcacatccactgctgttgaggagccggactcactggaggtactcgtgaagaccctagattcgcaaactcgcaccttcatcgtgggggcgcagatgaacgtaaaggaatttaaggagcacatcgcagcaagcgtcagtatcccgtctgagaaacagaggctgatctaccaggggcgggtattgcaagatgacaaaaaactacaagaatataacgtcggaggcaaggtgattcatctagtggaacgagcccctccccaaacacacctgccttccggagcgtcttcagggacagggtctgcctccgccacccatgggggaggcagtcccccaggcactagggggcctggcgcctccgttcacgaccgcaatgctaacagctatgttatggtcgggacgttcaacctacctagcgacgggagcgccgtggatgtccacatcaacatggagcaggcacccattcagagtgagccccgagtccgtctagtaatggcccagcatatgatcagagatatccaaactttgctcagccgtatggagtgtagggggggccctcagccccaacactcacagccaccacctcagcctcccgccgtaactccggagcccgtggcgctcagcagccagactagtgaaccagtcgagtccgaagcaccacctagagaaccgatggaggctgaggaggtggaagaacgagcccccgctcagaaccctgagttaactccgggccctgccccagcaggcccaacgcccgccccggaatag

SEQ ID NO: 109587 - DNA, 558 bp, Artificial Sequence
  Description of Artificial Sequence: Synthetic coding sequence
taactggcatgcactccaccacgccacctgcacgtggtgagaccaatgagccactacaccacccccatggtcctgcaacaggcggcaatccctattcagatcaacgtgggaactacggtgaccatgaccggaaatggcactagacctccccccactcctaacgccgaggctcctcccccaggcccggggcaggcaagttccgtagccccctcttctacaaatgtcgagtcttctgccgagggggcacccccaccgggcccagctcctcctccagctacctcccatcctcgggttatccgcatctcccaccagtcggtggagcccgtggtgatgatgcatatgaacatccagggacagcaggtccccggcttcccaaccgcacctacacgggttgttattgcccggcccacacctccacaagcccgtccaagccacccaggcggaccacccgttagtgggactttacaaggggcgggcttaggtactaatgccagtctggcgcagatggtgagtgggctggttgggcagctgctcatgcagcccgtgctggtggcctag

SEQ ID NO: 109588 - DNA, 648 bp, Artificial Sequence
  Description of Artificial Sequence: Synthetic coding sequence
atggagcccaatgactctacttcaaccgccgttgaggagccggatagcctggaggtgctggtcaaaacactggacagtcaaaccagaacctttatcgtgggagcccagatgaacgtgaaagaattcaaggagcatattgctgcttccgtgtccatcccaagcgaaaagcagaggctgatctaccagggccgagtgcttcaggacgataagaaattacaagaatataatgtcggggggaaggttatccacctcgttgaacgagcccccccacagacacacctgccctctggcgcctctagcggcactggctccgcctcagcgacccatggcggcggctctccaccaggcactcggggtcccggggcatctgttcacgaccgaaacgcaaacagctacgtgatggtcgggactttcaatttgcccagcgaacccagggtgaggctcgtgatggcgcagcatatgatccgcgatatccagaccctcctgtccaggatggaatgcagggggggccctcagccccagcatagtcaacctcctccccagccccctgcagtgacacccgaaccagtggccctgagctcgcagacatcagaaccggtcgagtctgaggcccctcctagagagccgatggaggctgaagaagtttag

SEQ ID NO: 109589 - DNA, 780 bp, Artificial Sequence
  Description of Artificial Sequence: Synthetic coding sequence
atggagccaaatgatagcacatccaccgcagtcgaggaacccgactccctcgaggtactggtcaaaactctggattcacagacaaggacgtttatcgtgggcgctcaaatgaatgtgaaagagttcaaggaacatatcgcggcatccgtgagcatcccctccgagaaacagagactcatttaccagggtcgagttctccaggacgataaaaagctgcaagaatataatgtcggggggaaagttatccacctggtcgagagggcccctccgcaaacccatttgccgagcggtgcttcctccgggacaggctcggcgtcggcaacccacggaggtggaagtcctccaggcacacgaggtcccggtgctagtgttcacgatcgcaatgcaaactcttatgtaatggtcggcacatttaatctaccatccgacggaagtgccgtcgacgtgcacattaatatggagcaggctcctatccagtcggagcccagagttcgactcgtgatggcccagcacatgatacgcgatattcagaccctgctgagcaggatggaatgtcgaggcggcccgcagccccagcactctcagccaccccctcagccccctgccgttacccctgagccggtggccctcagctcgcagacaagtgagcccgtggagtccgaggccccccctcgcgagcccatggaggccgaagaagtggaagagagagccccagcccaaaatccagagctcaccccaggacccgcacccgctggtccgacacctgcgcctgagacctag

SEQ ID NO: 109590 - DNA, 477 bp, Artificial Sequence
  Description of Artificial Sequence: Synthetic coding sequence
atggaacccaatgactccactagcacagcggtggaggaaccggattccctcgaagtactggtaaaaactcttgacagccagacaaggactttcattgtgggggcgcagatgaatgttaaggagttcaaagagcacattgccgcatcagtttcaattcctagcgaaaaacagcgcctgatttaccaaggtcgggtgctgcaggacgacaaaaagctgcaggaatacaacgtgggcggtaaagtaattcacttggtcgaacgagctccccctcagacccatttgccttctggcgccagttccggtaccggcagtgcctcagccactcacggcggcggttcaccgccaggcacgcgaggaccaggagcttccgtgcatgataggaacgcgaactcatatgttatggtcggcacttttaacctacctagcgacggctctgccgtagatgtccacattaacatggagcaggctcctatatag

SEQ ID NO: 109591 - DNA, 621 bp, Artificial Sequence
  Description of Artificial Sequence: Synthetic coding sequence
atggagcccaatgattcaactagcaccgccgtggaggagcctgatagcctggaggtcctcgtaaaaaccttggacagccagacacggacattcatagtgggggcacagatgaatgtcaaggagttcaaggaacacattgcggcatctgtaagtataccttcagaaaagcagcggttgatttaccaggggcgggtactgcaggatgacaagaagctccaggagtacaatgtgggtggcaaggtgatccaccttgtcgaacgcgctcccccccagactcatctaccgtcaggagcttcgagcgggacaggttccgccagcgccacgcacggaggtggttccccgcctgggacccggggtcccggcgcctctgtccatgatagaaacgcaaactcctatgtgatggtagggacattcaatctcccgagcgagcccagagtgcggttagtgatggcgcaacatatgatcagggatatacagaccctcttaagtcgcatggaatgcagaggggggccgcaaccacagcattcacagccccctccacagcccccagccgtgacccccgagcccgtagccttgtcatcccagactagcgagccagtggaatctgaagcacccccatag

SEQ ID NO: 109592 - DNA, 2232 bp, Artificial Sequence
  Description of Artificial Sequence: Synthetic coding sequence
atggagcccaacgattccacaagtacagctgttgaggaacccgatagtctggaagtcctggtcaagaccctagattcccagactcggaccttcatcgtgggtgcccagatgaacgtgaaggaatttaaagaacatatcgcagcctccgtgagcatcccctcagaaaagcagaggttgatttatcagggtcgcgttctccaggatgacaagaaactccaggagtataacgtgggcggcaaagtgatccatctggtggagagagccccaccacaaacacatctccccagcggagcctcatcaggaacaggatctgcctctgctacacacgggggcggatctccaccgggtactcgcggaccaggggctagtgtgcacgatcgcaacgccaacagctatgtgatggtgggcaccttcaacttgccctccgatggatccgcagttgatgtgcatattaatatggaacaggcaccaattcaaagtgaaccgcgcgtgcgtctagtcatggcccagcatatgatccgcgatattcagacgctgttgtcccgaatggagtgtcggggcggcccccagcctcagcatagtcagccccctccacagcctccagctgtgacacccgagcctgttgccttaagttcacagacgtccgagcctgtcgaatctgaggcaccaccaagagaaccaatggaggccgaagaagttgaagagcgtgcgcctgctcagaatccagaactcacgccaggaccagcccctgctgggcccacccccgctcctgagacaaacgcccctaatcatccgagtcctgccgagtacgttgaggtcctgcaggagctgcagagattggagtctcgcctccagccattcctccagaggtattatgaagtgctgggtgccgcggcgactactgactacaacaacaaccacgagggtcgcgaggaagaccaacggttgattaatctagtaggagaatcactcagactgctgggtaatactttcgtggcactgagtgacctgagatgtaatctagcttgtacacctcctcgccacctgcatgtggttcgcccgatgagccactacaccacccccatggtgttgcagcaagcagccatccctatccagattaatgtgggcactacagtgacaatgaccggcaacggcaccaggcctcctccgacacctaatgctgaggctccacctccgggtccaggtcaagcttcttctgtggccccgtcttctactaacgttgagagcagtgccgagggagcgcccccacccggcccggcaccacctcccgccacctcccatccgcgcgtgattcgcatcagtcatcagagtgtggagcctgtagtaatgatgcacatgaatattcaggactccggcacacaacccgggggtgtgcccagcgcacctacaggcccccttggtccccccggacacgggcagacactgggctctactctcattcagctgccctccctgccgccagaatttatgcacgccgtggcccaccagatcacccatcaggcaatggttgccgccgtggcctccgccgcagcaggacaacaagtacctggatttccgacagccccgactcgcgtcgtcatagctaggcctactcctccccaagctagaccatcgcaccccggcggacctcccgtgtcaggcactctccagggcgccggacttggcaccaacgctagtttggcccagatggtgagtggactcgtcggacagttactgatgcagcctgtactggttgcacaaggcacaccagggatggctcccccccctgcccccgctacagcctctgcatccgctgggacaacgaacactgcgactaccgctgggcctgctccaggcgggcctgctcagccacccccaacccctcagccctccatggctgacctccagttcagccagctgctcgggaatctattgggaccagcagggcccggtgcggggggcagtggggtagcatcccccaccattacggtggcaatgccgggtgttcctgcattcctccagggtatgacagacttccttcaggccacacagactgcccctcctccaccaccaccccctccaccccccccaccagcacccgagcagcagacaatgccccccccagggtcaccctccgggggagccgggtcacctggcggcctgggcctggaaagtttgagccctgagttctttactagtgtagtgcagggggtgctatcatccttgctctag

SEQ ID NO: 109593 - DNA, 681 bp, Artificial Sequence
  Description of Artificial Sequence: Synthetic coding sequence
tagagtggtttcggcgctaggctcctggagctatgtaaccaagggcttttcgagtgtctggccctgaacctacattgtctgggcggccagcagatggaactggctgcggtgataaacggtaggatccgaagaatgtcacgaggagttaaccccagcttggttagctggctgacgacaatgatgggcttgcggctgcaggtagtgttagaacacatgcctgttggccctgacgccatactcaggtacgtgcgccgcgtcggtgaccctcctcagcctctgcctgaagagcctatggaagtccagggggccgaacgagcatcccccgagcctcaaagagaaaatgcaagccctgcccccggcaccactgccgaagaagcaatgagtagggggccgcctcccgcccctgaaggcggatctagggatgagcaggacggggcatctgccgaaacggaaccctgggccgccgcggtgccccccgagtgggtccctattatccagcaggacatacagagtcagaggaaagtcaaaccacagccaccgctgtcagatgcctacctatctggcatgcctgcaaaacgcagaaaactgaggtctgatatacagaagcggctgcaggaggatccaaactattcaccgcaacgttttcccaacgcccagcgtgccttcgccgatgacccctag

SEQ ID NO: 109594 - DNA, 594 bp, Artificial Sequence
  Description of Artificial Sequence: Synthetic coding sequence
atggagcctaacgatagcaccagcactgctgtggaagaacccgattctctcgaggtattagttaaaactctggactcccagacccgaaccttcatcgtcggggcgcagatgaacgtgaaggagttcaaagagcacatcgccgcaagtgtgagcatccctagtgaaaaacagcgcttaatttaccaggggcgtgtcctgcaggacgacaagaagctgcaggaatacaacgttggtggcaaagtcatacatttggtagagagggcccctccccagactcacctgccctcaggggcatcgtccggcaccggcagtgcatctgccacgcacggcggtggaagcccccccggcacaaggggccccggcgccagcgtgcacgaccggaatgcaaatagctacgtcatggtgggtacattcaatctcccctcagacggatcagccgtggatgtgcacatcaatatggagcaggctcccatacagtcagagccacgcgtacgcctcgtaatggctcagcacatgattcgtgacattcaaactttattaagcaggatggaatgcaggggcgggccccagccacagcattctcaacctccgtag

SEQ ID NO: 109595 - DNA, 717 bp, Artificial Sequence
  Description of Artificial Sequence: Synthetic coding sequence
tccagtgcggagggcgctccaccccctggtcccgcaccgccaccggcaaccagccatcccagagtgattaggatttctcatcagtctgtagaacccgtagtgatgatgcatatgaatatacagggacccctctccctgtccccgtgccctgattctggtactcaaccggggggggtgcccagtgctcctacaggcccgctgggtccacctggccacgggcaaacgctcggccagcaagtgcccggcttccctactgcacccactagggtggtcatcgccagaccaacacctccccaagctcgcccctcccacccaggcggaccgcctgtgagcgggacgcttcagggggctggacttggtacaaacgcctccttggcgcagatggttagcgggctcgtcgggcagctcttgatgcagcccgtgcttgtggctcagggaactcccgggatggctccacctcctgctcccgctactgcaagtgcatccgcgggtaccacaaatacagctaccacagctgggcccgcccccggcggcccggcacagccaccaccaacacctcagccatccatggctgacctgcagttctcacagctccttggcaaccttcttggtcccgcaggccccggcgccggagggtccggggtcgccagccccaccattacggttgccatgccgggggttccagccttcctgcagggcatgacagatttcttatag

SEQ ID NO: 109596 - DNA, 735 bp, Artificial Sequence
  Description of Artificial Sequence: Synthetic coding sequence
atggaacccaacgattcaacctcgaccgcagttgaggagcccgactcactggaagtcctcgtgaaaacactcgacagccagacaagaacattcatcgttggcgcccagatgaacgtcaaggagttcaaggagcacatcgctgcatctgttagtattccgagcgagaagcaacgtctgatttaccagggtcgtgtcctgcaggacgacaaaaaactgcaagagtataatgttggcggcaaggttattcatctggtggagagagctcctcctcagacacatctgccatccggcgcttcatctggcacaggatccgcatccgctacacacggcggcggctctccacctggcacgaggggaccaggagcctctgtgcatgatcgtaacgcaaattcttacgtcatggttgggacctttaacctgccaagcgagcccagagtgagactggtgatggcgcagcacatgattcgggacatacagaccttgctgagcaggatggagtgccggggaggaccacagccacagcactcccagcccccccctcagccacccgcagtcaccccggagccggtggctttgtcgtcccaaaccagcgagcccgtggaatctgaagctccgccccgtgaaccgatggaagctgaagaagtcgaggaaagggcgccagctcagaatcctgagctcacgccggggcctgctcccgcaggccccacacccgcccccgagacaaacgcaccatag

SEQ ID NO: 109597 - DNA, 789 bp, Artificial Sequence
  Description of Artificial Sequence: Synthetic coding sequence
atggagccaaatgactcaacttccacggccgtcgaagaaccggacagcttagaggttttagttaaaacactagactcacaaacacgcaccttcattgtgggagcacagatgaacgtaaaggagtttaaagagcatatcgctgccagcgtgagcatcccaagcgaaaagcagaggctgatctatcaggggcgggttctgcaggacgacaagaaactacaggaatataatgtcggagggaaagtgattcacctggtggagagggctccaccccagactcatctacccagtggcgctagttcgggcacagggagcgcaagcgccacccacgggggcggatcacctcctggcacaaggggtcccggcgcttcggtgcatgaccgcaatgccaattcatacgtcatggtgggtactttcaatctgccttcggatggcagcgctgtggatgtgcacattaacatggagcaggcccccatccagagtgagccccgagtccggctggtcatggctcagcatatgatccgggacatccagacacttctgagccgcatggaatgccgcggggggccacaaccgcagcatagccagcccccacctcagccccccgccgtgactcctgagcctgtggccctgtctagccagacctccgaaccggtggagtccgaggctccaccgcgagagccgatggaggctgaggaagtggaagagagggctcctgcccagaatccggaactaacacccgggcctgcgcctgccggccccacccctgcccccgaaactaacgccccctag

SEQ ID NO: 109598 - DNA, 2232 bp, Artificial Sequence
  Description of Artificial Sequence: Synthetic coding sequence
atggaacctaatgacagcacatcaacagccgtcgaggagccggactcgctcgaggtcttggtcaaaacactggatagtcagactcggacctttattgtgggggctcaaatgaacgtcaaggagtttaaggaacacatcgctgcaagcgtctcaattccgagcgaaaagcagaggctgatctaccaaggaagagtgctccaggacgacaagaaactgcaggagtacaacgtaggcgggaaggtgatacacctggttgagcgcgccccaccccaaacacatctgccaagcggcgcctcttccggtaccgggtctgcgtcggctacccatggaggcggctcaccacccggcactagggggcccggggcctcagtccatgaccggaatgctaattcgtacgtcatggtcggcacatttaatctaccttctgatggatcggcagtcgacgtgcatataaatatggagcaggccccaatccagagtgaacctcgcgtcaggcttgtgatggcccaacatatgattagagacattcagaccctgctgagtcggatggagtgtagagggggcccacagccacaacattcccagcctccgcctcaaccccccgccgtgaccccagagccagtggccctgtcctcgcagacatctgaaccagtcgagagcgaagctccaccacgagagccaatggaagctgaggaggtggaagagagagcacctgcccagaacccagaactgactcctggcccagccccagccgggccgaccccagcccctgaaacgaatgcccccaatcatcccagcccagccgaatacgtagaggtgttgcaggaactacagaggctcgaatcccgcctgcagcctttcctgcaacgatactatgaggtccttggagcagcagcaactaccgattacaataataatcacgaaggcagggaggaggaccaaagacttatcaatctggtcggtgagagccttcgattactgggcaacacattcgtggcactgagcgaccttaggtgtaacctagcctgcaccccgccacgacacctgcacgttgtgcgccccatgtcccactacaccaccccaatggtgctgcaacaagcggcaatacctatccaaatcaacgtcggaaccacagtgaccatgaccgggaatggaacaaggcctccgccaacccccaatgccgaagcgccccctcccgggcccgggcaagcctcatccgtcgctccaagttcaactaacgtagaatcatcagcagaaggggctcctccccctgggccagcaccgccccctgccacctctcatcccagggtcataaggatttcccatcagtcagtggaacctgtagtgatgatgcacatgaacatacaggattctgggacacagcccggaggcgtgccatccgctcccacggggccactagggccccccggacatggccagactttggggagtacactcattcagctgccttccctccctccagagttcatgcatgccgtggctcaccagataactcaccaggcaatggttgcagcagtggccagtgctgccgccgggcaacaggttcctgggttccccaccgccccaactcgggtcgtaattgccaggcctactccccctcaggcacgcccgtcgcacccaggtgggccacctgtctctggcactctccagggcgccggtctgggcacaaatgcatcactggcccaaatggtctcaggcctggtaggacagcttttaatgcagccggttctggtggctcaggggactcccgggatggctcccccccccgccccggcaactgctagcgccagcgcagggacgactaataccgctacaaccgctggcccggctcctggaggccccgcccaaccacctcctacgccacagccaagtatggccgatctccagttctcacaactccttggaaacctgctggggcccgccggccccggggccggcgggccaggggtggccagtccaactataactgtagctatgcctggagttccagccttccttcagggtatgacagacttcctgcaggcgactcagactgcccccccccctcccccacccccacctcctccaccacctgcacctgagcaacagacaatgcctccccctggatccccaagtggcggcgcagggagtccaggaggtctgggactggaatccctgagtccggagtttttcacaagtgtggttcagggcgtactctcctctctactttag

SEQ ID NO: 109599 - DNA, 735 bp, Artificial Sequence
  Description of Artificial Sequence: Synthetic coding sequence
atggaacccaatgacagcactagtactgcggtggaagaaccggactctcttgaggtgctcgtgaagacgcttgatagccaaacccgcacattcattgtcggggcccaaatgaatgtgaaggagtttaaagagcacatcgccgcgagcgtgtccatcccttcagagaaacagcggctcatctatcaaggacgcgtccttcaggatgataagaagctacaagagtacaacgtcgggggcaaagtcattcatcttgtggaaagggccccacctcagactcaccttcccagcggcgcttcctccggcaccggatctgccagcgctacccacggtggtggttccccacccgggacacgagggccaggcgcgagcgtgcacgacagaaatgctaacagctatgtgatggtagggacctttaaccttccttctgaaccccgggtcagactcgtcatggctcaacatatgattcgcgatattcagactttgttgtccaggatggaatgccgcggcgggccccagccacagcactctcagccacccccccagccaccagccgtgactcctgaaccagttgccctgtcatctcagaccagtgagcccgtcgagtccgaggctcctcccagagaacccatggaggcagaggaagtggaagagcgtgcccccgcccaaaaccccgagctgacccccggcccagccccggccgggccgactcctgcccccgagaccaatgctccgtag

SEQ ID NO: 109600 - DNA, 789 bp, Artificial Sequence
  Description of Artificial Sequence: Synthetic coding sequence
atggaacccaatgactccaccagtaccgctgtggaagagcccgactccctcgaggtgcttgtgaaaaccctcgactcgcagacccgcacgtttatcgtgggtgcccagatgaatgtcaaagagttcaaggagcatatagctgcatccgtgtccatcccatccgagaagcaaaggctcatctaccaaggacgggtgctccaagacgataagaagctgcaagaatacaacgtgggcggcaaggtgatccacctcgttgagagagccccaccacagacccatctgccctccggtgcgtcaagtgggaccggctcggcatcggcaactcacgggggaggttcacctcccgggacccgcgggccaggagcctctgtccatgatagaaatgccaacagctacgtaatggttggcaccttcaatctgcccagcgatggttccgccgtggacgttcacattaatatggagcaggcaccaatacagtccgagcctagggtgcgtcttgtgatggcgcagcacatgattagggacatacagactctgttgtcacggatggaatgtcggggcggccctcagccacagcactcccagccccctccgcagccccccgcagtgactccagagcctgtggcgctaagctcccagacttcagaacccgtagagagtgaagctccaccaagagagccaatggaagccgaggaggttgaggagagagccccagctcagaaccccgagctgacaccaggtcctgctcctgccggtcctacgccggcccccgagaccaacgccccttag

SEQ ID NO: 109601 - DNA, 2712 bp, Artificial Sequence
  Description of Artificial Sequence: Synthetic coding sequence
atggaacctaacgatagtacctctacagctgtggaagaaccggactctcttgaggttctggtgaagactctcgatagccagacacggacattcatcgtgggggctcagatgaacgttaaggaatttaaagaacatatagcagctagcgtgagcatcccctccgagaaacagagattgatctatcagggaagggtactgcaggatgacaagaaacttcaagagtataacgtaggcggcaaagtaatacatttggtggaacgagctcctccacaaacgcatctgcctagtggcgccagttctgggaccggatcagcgagcgctacccacggcgggggatctcctcccggaacaagaggtcccggggcaagcgtacatgacaggaacgctaactcctatgtgatggtggggacttttaatctcccgtccgatggttcagccgtcgacgtccatattaatatggaacaagctccaatacagtccgagccaagagtacggcttgtgatggcccagcacatgatacgcgatatccagaccctgctgtctagaatggagtgccgaggtggcccgcaaccgcaacacagtcagccgccaccacagccaccggcagtgacacccgaaccagtagcgttgtctagccagacaagcgagccagttgagagcgaagcaccacccagagaacccatggaggccgaggaagtcgaggagcgcgctcctgcacagaatcctgagctgactccgggccccgctccagcaggccccacgcctgcacctgagactaacgccccaaaccacccttcacctgctgaatacgtggaagtcctgcaggagctgcagaggctggagagtagactgcagcctttcctgcagaggtattacgaggtgctgggggccgcagctaccaccgattataataataaccacgagggcagagaggaagaccagcgacttatcaacctggttggagaatcactgagactcttaggcaacacattcgtcgccctctcagatcttagatgcaacctcgcatgcacgccaccaaggcacctccacgttgtgagacccatgagtcactacaccaccccaatggtacttcagcaggctgctattcctattcaaattaacgtgggtactaccgtgaccatgactggtaatggaacaagacccccgcccacacctaatgcagaggccccaccacctggccccggacaggctagcagtgtcgctcccagctccaccaacgtcgaatcctctgccgagggtgctccaccacctggcccagcaccaccccctgctacctctcatcctcgcgtgataaggatctcccatcagagcgtcgagcctgtagttatgatgcacatgaatattcaggacagtggtacacaacctgggggagtgcctagcgcaccaactggaccactcggaccccctggacacggccaaacgctggggcaacaggtgcccgggtttcctacagcgcctacacgcgtggtcatagcgcggccaacacctccccaggctcgtccatcgcaccccggaggcccacccgtgtctggcacattgggagcaggactcggcacgaatgccagcctggctcagatggtcagtggattggtgggccagctgctgatgcaacccgtacttgtggcacagggcactcccggttctcctggtggtctggggcttgagtctctgtctccggagttttttaccagcgtggtgcaaggtgtactttcaagtctcctcggctctctgggagcacgggcaggaagctcagagtctattgcagccttcatacaaaggctcagtggatcttccaacatatttgaacccggagctgatggcgcgctgggttttttcggggcactccttagcctgctgtgccagaacttttccatggttgatgtggtaatgctgctgcatgggcatttccagccccttcagcggctgcagccccagctgagaagctttttccaccagcattatctgggcggccaggagccgacaccatcaaacataagaatggctacccatacactaatcaccggcttggaagagtatgtgcgcgaatcgtttagtctggtgcaggtgcagccgggcgttgacatcattaggaccaatctagagtttctgcaggagcagttcaatagtatcgcggcgcacgttctgcattgtaccgacagcgggttcggagcgaggctgcttgaactgtgcaaccagggcctgttcgaatgcctggctctgaacctgcactgtctgggaggccagcaaatggagctggcagccgtgataaatggcagaattagacgcatgtcgaggggagtgaatcccagcctggtatcctggctcacaactatgatgggccttaggctacaagtcgtactcgaacacatgcctgtaggcccagatgctatcctgagatatgtaaggagagtgggggatccaccgcagcccctgcccgaagaaccaatggaggtccagggtgctgagcgcgctagtcccgaaccccaggaatgggttcccataatacagcaagacatccagagccagcgcaaagtgaaaccacagccaccactgtcagatgcttatttgagcggaatgccagcgaagagacgaaaactcaggagtgacatccagaagcgcctccaggaggatccgaattacagtccccaacgctttcccaacgctcagcgagcatttgctgacgacccctag

SEQ ID NO: 109602 - DNA, 558 bp, Artificial Sequence
  Description of Artificial Sequence: Synthetic coding sequence
tagttagcttgtacgcctcctagacaccttcatgtagttcggccaatgagtcattacacgacacccatggtactgcaacaagccgctattccaattcagattaatgtgggcactacagtgactatgacgggtaacggcactaggccaccccccacaccgaacgctgaagccccaccaccaggaccaggtcaggctagttccgtggccccatccagcaccaatgtggaaagttctgctgagggagcccccccacccggccccgctccgccaccagcaaccagtcatccacgggtgatccgcatatctcaccaatctgtagagcccgtcgtgatgatgcatatgaatattcagggccagcaggtgccaggcttccccaccgcacctacaagggtcgttatagcccggcctacgccgccacaggcgaggccttcacaccctggaggcccacccgtaagcggtacgctgcaaggagctggactgggtaccaatgcttcactcgcgcagatggtgtcggggttggtaggccagctgctgatgcagcctgtcttggtcgcctag

SEQ ID NO: 109603 - DNA, 789 bp, Artificial Sequence
  Description of Artificial Sequence: Synthetic coding sequence
atggagccgaacgatagcacttccactgctgtggaagagccagactcgttagaagttcttgttaagaccctcgatagccaaactaggaccttcattgtgggtgcacagatgaacgtcaaagagttcaaggagcatattgccgcatccgtgtccatccccagtgagaaacaaaggttgatctaccaaggtagggtactccaagacgacaagaagctccaagagtacaatgttggcggtaaggtgatacacttagtagagcgcgcgcctccgcaaacccacttaccttcaggagcttcgtctgggaccggctcagcctcagctacacatggaggtggaagtcccccaggcacgcggggacccggcgctagtgtgcacgatcgcaacgccaacagctacgtgatggtgggtactttcaatctgccgagtgatggcagcgccgtggatgtccatattaatatggagcaggctcccatccaaagtgaacccagggtgagactcgtaatggcccagcacatgattcgcgatattcagacactgctgtctagaatggagtgccgcggcggcccgcagccacagcattctcagccacccccgcagcccccagccgtgacgcccgagcctgtagctctgagctcccagacgtctgagccagtcgagtccgaagccccaccacgagaacccatggaggcggaagaggtggaagagagagcgcctgctcagaacccagagctgactcctggtccagcgccagcagggccaacacctgcaccggaaacgaatgcaccatag

SEQ ID NO: 109604 - DNA, 621 bp, Artificial Sequence
  Description of Artificial Sequence: Synthetic coding sequence
atggaacccaatgatagcacgtctacggccgtggaggaaccggactctttagaggttcttgttaaaaccctggacagccagaccaggacattcatcgtgggcgcacaaatgaatgtgaaggagttcaaagagcacatcgctgcaagtgtgtccatcccttcagaaaaacagcgtcttatctaccaggggcgggtcctgcaggatgataaaaagctacaggagtacaacgtgggcggcaaggtgattcacttagttgagcgcgctccaccacagacccacctgccgagtggggcttctagcggtacaggtagtgcatccgctacacacggcggcggatccccacccggaacaaggggacctggagcctcagtccacgatagaaatgcaaactcttacgtcatggttggtactttcaatctccctagcgaaccccgagtccgcctggtgatggcacagcatatgatccgtgatattcagactctgctgtcgagaatggagtgtcgcggggggccacaacctcaacactcacagcctcctccccagcccccggccgtgacgcctgagccagtggcactgtcctcacagacctctgagccagtggaatcagaggcccctccgtag

SEQ ID NO: 109605 - DNA, 681 bp, Artificial Sequence
  Description of Artificial Sequence: Synthetic coding sequence
taatccggctttggcgcacgccttcttgaattgtgtaatcagggcctgttcgagtgcctcgcacttaatctacattgtttgggggggcagcaaatggagttggccgcagtcattaatgggagaattcggcgcatgagtcgaggcgttaacccctcccttgtttcttggctaacgacaatgatggggttgcgtctccaggtggtgcttgagcacatgccagttgggcctgacgctatcctcaggtatgtgagacgggtcggtgacccccctcaacctttgccagaggaacccatggaagtgcaaggagccgaacgcgcaagcccagaacctcagcgcgaaaacgcaagtccagctcctggtactacagccgaagaggctatgagcagaggcccacctccagcccccgagggcgggtcacgcgatgagcaagacggcgcctctgcggagaccgagccatgggcagcagcagtcccccctgagtgggtacctattatacagcaggacatacagagccagaggaaagtgaaacctcaaccacctctgagcgacgcttacctctcaggaatgcccgccaagagaaggaaactccgatctgacatccagaaaaggctgcaggaggacccaaactacagtccgcagcggttcccaaatgctcagcgggcattcgcggacgatccctag

SEQ ID NO: 109606 - DNA, 780 bp, Artificial Sequence
  Description of Artificial Sequence: Synthetic coding sequence
atggagcctaacgatagcacgagcacagctgtcgaagagccagattctctcgaggtgctggttaagaccttagatagccagacaaggacattcatcgtgggtgcccagatgaatgtaaaagagtttaaagagcacatcgcagcttcagtgagtatcccgtctgaaaaacagcgtctcatctaccagggccgagtgcttcaggacgataaaaaattgcaggaatataacgttggtggtaaagtaatccacctggtcgaacgagctccaccacaaacccacctcccatccggcgcaagtagtggtaccggctcggcttctgccactcacggtgggggatcacctcccggcactcgcggccctggagccagcgttcacgacaggaacgcaaattcatatgtgatggttggaactttcaatttaccttccgatggcagcgcagttgacgttcatattaatatggaacaggcacccatccagtccgagcctagggttcgcctggtcatggcccagcacatgatcagagacatacagaccctgctatcccgaatggagtgccggggcggtccgcagcctcaacatagccaaccgccgcctcagccacccgctgtgacaccggaaccagttgccctgtccagccagacctctgaacccgtggagagtgaggccccaccccgagagcccatggaagccgaggaggttgaggagagagcacctgctcagaatccagaactgactcctgggcctgcacccgccggcccaacgccagcaccagagacatag

SEQ ID NO: 109607 - DNA, 777 bp, Artificial Sequence
  Description of Artificial Sequence: Synthetic coding sequence
atggaaccgaatgatagtacttcaaccgccgtcgaagagcctgactccctggaggtgctcgtgaagacactggactcacaaactaggacctttatcgtgggagcccaaatgaatgtcaaggaattcaaagaacatatcgcagcttctgtgagcatccctagcgaaaagcagcgcttgatctaccaggggagagtgctgcaggatgacaagaaactacaggagtacaatgtgggggggaaggttatccatctggtggagagggctccacctcaaacccatctaccctctggagcatcttccggcactgggagtgctagcgcaacacatggaggcggaagcccccctggcacgcggggcccgggtgcctctgtccatgacagaaacgccaattcttatgtcatggtcggcacttttaacctgccaagcgacggcagcgccgtcgatgttcatattaatatggaacaagcgcctatccagtcagagccgagagtccggctggttatggcccagcacatgataagagacatccaaactctcttaagcaggatggaatgtcggggaggcccgcagccccagcactctcaacctcctcctcagccccccgcagtgacacctgaacctgtcgctctgtctagccagacttccgagcctgttgaatccgaggcccccccgagagagccaatggaggcagaggaagtggaagagagggccccagcccagaacccagaactgactcctggaccagcacccgctgggcccactcccgctcccgaatag

SEQ ID NO: 109608 - DNA, 477 bp, Artificial Sequence
  Description of Artificial Sequence: Synthetic coding sequence
atggaacccaacgacagcactagcactgccgttgaagagcccgactctctagaggtacttgttaaaacgctggattctcagactcgcaccttcattgtgggtgcacagatgaacgtcaaagagttcaaggagcacattgccgcctccgtgtctattccatctgagaaacagcgactgatataccaaggccgggtgttgcaggacgataagaagctgcaggagtacaatgtggggggcaaagtgatccacctcgtggaacgcgcccccccgcaaacccacctcccatctggcgccagctcaggcacgggctcagcatccgcaactcacggaggcggttcccctcccggtacacgaggtcctggggccagcgtccatgatcggaatgccaattcttacgtgatggtgggaacttttaacctgccctcagatggctccgctgtggatgtgcacattaacatggaacaggctcctatttag

SEQ ID NO: 109609 - DNA, 735 bp, Artificial Sequence
  Description of Artificial Sequence: Synthetic coding sequence
atggagcccaatgactctacgagtacagccgtggaagaacctgattctctggaggtgcttgtaaagaccctagactctcagacaaggacattcatcgttggagctcagatgaacgtgaaggaattcaaagaacacattgcagcctccgtgagtattccctctgagaagcagaggctgatataccagggtcgcgtactgcaggatgataaaaaactacaggagtataatgtgggcggaaaggtgatccatctcgttgaaagagcacctcctcagactcacctgccaagcggagctagcagtggaactgggtccgcctccgcaacgcacggcggcgggagcccacctggaaccagagggcccggcgcaagcgtgcacgaccgcaacgccaactcttacgttatggtcggaacctttaatctccccagcgaaccgagagtccgactggtcatggcacagcacatgattagggatatccaaactcttttatctcgcatggagtgtaggggaggaccgcaaccacagcattcacagccacccccacagcccccggccgtcaccccagagccagtggccttgtccagtcaaacctccgagcccgtcgagtctgaggccccacctagagagcccatggaagcggaagaggtggaagagagggcccctgcgcagaaccccgaattaactcctggtcctgctcctgcaggcccaacaccagcgccggagaccaatgcaccctag

SEQ ID NO: 109610 - DNA, 3381 bp, Artificial Sequence
  Description of Artificial Sequence: Synthetic coding sequence
atggaacctaacgattcaacctccacagccgtggaggagcccgattcacttgaagtacttgtgaaaacattggattcgcagaccagaacattcatcgttggggctcagatgaacgtgaaggaatttaaggagcatatcgccgctagtgtgtctatcccctcagaaaagcagcgtctcatctatcagggccgcgtgctgcaagacgataagaaacttcaggagtacaatgtaggaggaaaagtgattcaccttgtagagcgggctcctcctcaaacccacctgccaagcggagcgagtagcggaaccgggagtgcctccgcgacacatggtggaggttcaccacctggcacccggggccccggggcatctgtgcatgatagaaacgctaacagttacgtgatggtgggaacgttcaacttgcccagcgacggaagcgccgtagatgtgcacatcaatatggaacaggccccaatacaatcggagcctcgggtgcgcctggtgatggcgcagcatatgattagagatattcagactctcctgagcaggatggagtgccgggggggtcctcagccgcaacactcccagccccccccacaacccccagcagtgactccagaacctgtggccctgagcagccagacatcagaacctgtagaatcagaggcccccccaagagagcctatggaggcagaagaggtggaggagcgcgcacctgcgcagaaccccgagctgaccccgggcccagccccagccgggccgacccccgcccctgagaccaacgctcccaatcatccctctcctgctgagtacgtggaagtgctccaagaattgcagcgactcgaatccaggctccagccattccttcagcgatattatgaggtacttggtgcggcggccacaactgattataacaacaaccacgaaggacgagaggaagaccagcgcttgataaacttagtgggtgaaagtctgcggctcctcggaaatacctttgttgcactgtctgacctgcgctgcaaccttgcatgcacaccacccagacacctgcacgtcgtgcgccccatgtcccattacaccacccccatggtcttacagcaagccgccattccaatccaaattaacgttgggacaactgtcacaatgacaggtaacggcacccgtccccctcctaccccgaatgccgaggctccaccaccagggccgggccaggcaagtagcgtggcacctagttctacaaatgtcgagagcagtgccgaaggggccccacctcccgggcctgctcctccgcctgcaacatcacacccaagagtgattaggatcagccaccaaagcgtcgagccagtagttatgatgcacatgaacatccaggattcaggcacccagcctggcggagtgccctctgcgcctactggccctctagggcctcctggtcatggccagacattagggcaacaggtccccgggttcccaaccgcacccactcgggtcgtgatcgccaggcctaccccgccgcaggcaaggccaagtcaccctggaggcccccccgtgtccggaaccctccagggcgccggacttggcactaacgccagtctggcacagatggtgtccgggcttgtgggacagttactaatgcagcccgttcttgtggcccagggcacgcccggcatggccccgccacccgcaccagccaccgcatccgcatccgctggcaccaccaatacagctaccacagccggacccgcgccaggcgggccagcacagccccccccaactccccaacctagcatggcggatctgcagttttcccagttgcttgggaatctgttgggacctgccggaccaggcgccggaggctcaggcgtggcaagtcccacaatcactgtagccatgcccggagttcccgcgttcttgcagggaatgactgattttcttcaggccacgcagacagccccgcccccaccacctccaccccctccacccccacctgcacccgaacagcagactatgccaccgcctggaagtccatccgggggagccggctccccaggcggcctcggtcttgagagcctcagccctgaattctttaccagcgtagtgcagggcgtgttgagctcactgctgggatctctgggagccagagcagggtcttcagagagcatagccgctttcatccagagactctctgggtcttccaatatcttcgaacctggtgccgacggagccttaggctttttcggtgcccttctgtccttgctttgccaaaacttctcaatggtggatgtagtgatgctgcttcacgggcacttccaaccacttcaaaggcttcagcctcaactcagaagtttcttccaccagcactatctgggaggccaggagcccacaccctccaacataagaatggcaacacataccctgattacaggcctagaggaatacgtaagagaatcctttagtctagtacaggtgcagcctggggtcgatattattcgaacaaacctggagtttttacaggagcaattcaattcgatcgcggctcacgtcctgcattgcaccgactcagggtttggcgcgagactgctagagttatgtaaccaggggttgtttgagtgtttggcactcaatcttcattgcctcggcggccaacaaatggaacttgctgctgtgatcaacggacggataaggaggatgtcccgaggcgtgaatccttctcttgtgtcatggcttacaaccatgatgggattgaggttacaggtggtacttgaacatatgccagtggggcctgatgcaattttacgatacgtccgacgagtcggagacccccctcagccactgcccgaggagcccatggaagtgcagggcgcggaacgggcatccccagaacctcaacgggagaatgcatctcccgcccctgggaccacagcagaagaagctatgtcacggggtcccccccctgcccctgaaggcggatccagggatgaacaggacggcgcctccgcagagaccgaaccctgggccgccgcagttcctccagagtgggttccgataatccaacaggacatccaaagccagaggaaggtgaagccccagccaccattatcagatgcctatctgtctggaatgcctgctaagcggaggaagactatgcaaggggagggccctcaactgctactgtccgaggccgtctcccgcgccgctaaagctgcgggcgctaggccacttacgagcccagagtcacttagccgggacctcgaagccccggaggttcaggaaagctatcgccagcagctcaggtctgacatccagaagcgcctgcaggaggaccccaattactctccccagagattccccaatgcgcagagagccttcgccgacgacccttag

SEQ ID NO: 109611 - DNA, 735 bp, Artificial Sequence
  Description of Artificial Sequence: Synthetic coding sequence
atggaacctaacgacagcacctccacggctgtggaagaacccgactccctggaagtactggtcaaaactctcgatagtcagacgcgtacttttattgtaggggctcaaatgaacgtgaaagagttcaaggagcatattgctgcctctgtcagcatcccatccgaaaaacagcgattgatttaccagggacgagtattgcaggatgacaaaaaactccaggagtataatgtgggcgggaaggtgattcatctggtagagagggctccccctcagactcacctgccctccggcgcttccagtgggaccggctctgcctccgctacccacggaggcggcagcccgcccggcactcgcggaccaggggcatcagtccacgacaggaacgccaactcttacgtgatggtggggaccttcaatctcccctctgagcctagagtcaggctggtcatggcccagcacatgatccgtgacatacagacactcttatcccgcatggaatgcagagggggaccccagcctcagcactctcagccccccccacagccccctgccgtcactccagagcccgtggctctgagttcccagacgtctgagccggtcgaaagtgaggctcccccccgagaacccatggaagcagaggaagtcgaagagagggctcctgcacaaaatccggagctcacccccgggcctgctcctgccggtcctactcccgcacctgagaccaatgcaccctag

SEQ ID NO: 109612 - DNA, 1548 bp, Artificial Sequence
  Description of Artificial Sequence: Synthetic coding sequence
atggagcccaacgactccacctccacggcggttgaggagcccgatagcctggaagttctggtcaagaccctggattcccagactcggacttttattgtcggagcacagatgaacgtaaaggagtttaaggagcacatcgctgcctccgtttccatcccatccgagaagcagcggctgatatatcagggacgggtgctccaagacgataaaaagctgcaggagtataatgtgggcggcaaagtaatccatctggtcgaacgggctccgccacagactcacctccccagcggggcttcttctggtacaggctccgcctccgcaacccatggcggggggtctcctcccggcaccaggggacccggagcgagcgtgcatgatcgaaatgctaactcttacgtgatggtcgggacattcaacctcccatcagacggatcagcagtggacgtgcatataaacatggaacaggctccaattcaatcagaaccgagggtaagactagtgatggctcagcatatgattagggacattcagactctgctgagtagaatggagtgccgcgggggaccacagcctcagcactcccagcctcccccccagccccctgcagttacgccagaacctgtggccctgtcatcacagacgtcagagccggtcgaatctgaagccccgccccgcgagccaatggaggccgaggaggtggaggagagagcccccgcccaaaacccggagctgacccccggcccagctcctgccgggccaacacccgccccagagactaatgcacctaatcatccaagtccagctgaatatgtcgaggtgctgcaggaactgcagaggctggagtccaggctccagcccttccttcagcgttactacgaagtgcttggcgcagcggccactacggactataacaacaaccacgagggaagggaagaggatcagagattaataaacctggtgggcgagtcactgcggctcctcgggaacaccttcgtcgctttgagcgatctgcgctgcaatctcgcctgtacccctccgcggcacctccacgtggtgagacccatgagtcattataccacacccatggtcctccagcaggccgccattccaattcagattaatgttggaacgacagtgacaatgactgggaacggtactcgcccgcctccaacacctaacgcggaggcgcctcccccggggccaggacaggcaagctcagttgcgccctctagtacaaacgtggagagttccgcagagggcgcacctcctccagggccagccccgccaccagccaccagtcatcctagagtgatccgcatcagtcatcagtcagtagaaccagtcgtcatgatgcacatgaatatacaggattccggcacacaaccggggggggtacccagcgctcccacagggcccttgggacccccaggccacggccagaccctggggagcactctgatccagctgcccagtctgccaccagaattcatgcacgccgttgctcaccaaatcactcatcaggccatggtcgcagccgtagctagctag

SEQ ID NO: 109613 - DNA, 3381 bp, Artificial Sequence
  Description of Artificial Sequence: Synthetic coding sequence
atggaaccaaatgactctacttctactgccgtggaagagcccgactctctggaagtgctcgttaagacactggacagtcagacccggaccttcattgtaggcgctcagatgaacgtgaaagagtttaaggaacatattgccgcttctgttagcataccgtcagaaaaacaacggctcatctaccaaggccgagtgctccaggacgataaaaagctacaagaatacaatgttggggggaaggttattcatctcgttgaacgggcgcccccccagacccacttgcctagtggtgccagttcggggactggttccgcttcggccacacatggaggcggttctcctcctggaacacggggtccaggtgcaagtgtccacgaccggaacgccaatagctacgttatggtcggcacattcaatctaccaagtgacgggtcagctgtggacgtccacatcaacatggaacaggctccgatccagtcagagcctcgcgtgcggctcgtaatggctcagcatatgatccgcgacatccagactctcttgtctcggatggagtgtcgcggcgggccacagccacagcactcccagccacccccacaacctccggccgtcacacccgagcccgttgccctgagctcccagactagtgaaccagttgagagtgaagcccccccacgagagccaatggaagcagaagaggttgaagaaagagcccctgcccagaaccctgagctgacccccggaccagccccggccggcccaaccccggcccccgaaacaaacgcccctaaccacccctctcctgccgagtacgtggaggtcttgcaggagctgcagcgcctcgagagcagactgcagcccttcttgcaacggtactacgaggtgcttggcgcagccgccaccactgactataacaacaaccacgagggacgagaagaagatcagagactgatcaacttggttggagagtccctgagactgctgggcaataccttcgttgcgctatccgatctcaggtgtaatctggcttgcacacctccaaggcacctgcacgtggtgcgacccatgtcacattacacaacaccaatggttctacagcaggcagctatccccatccagattaacgtcgggaccactgttaccatgacagggaacggcactcgcccgccccccactcccaatgccgaggcacctcctcccggacccggccaggcaagttctgtcgcccccagttcgaccaatgtcgagagcagcgcagaaggtgcccccccacctggtccagcccctccacctgccacgtcacatccgcgagtgatcagaatttctcatcaaagtgtggagcctgtagtgatgatgcacatgaatatccaggattccggcacccaacccgggggggtcccgtctgcaccaactggcccacttgggccgcctggccacgggcagacacttggacagcaggtgcccggttttccaaccgcacctactcgcgtagtgattgccaggccaacccctccccaggccagaccttcgcatccaggcggcccacctgtatcgggcacactgcaaggtgcgggtctagggactaacgcgagcctagcccaaatggtaagcggcctggtggggcagcttctgatgcagcctgtattggtcgcccaggggacacctggaatggccccacccccagcccccgccaccgcctctgcctctgccggaactaccaacacagcaacaacagcaggcccagccccagggggacctgcccagcctccccctactccacagccaagcatggcagatttacagttttctcagttgttaggcaatctactgggacccgctggcccaggagcaggtggctccggcgtggcctcccccaccatcactgttgcgatgccaggagtgccagcttttttgcaaggaatgacagactttctccaggcgacacagactgctcctccgcccccccctcctcctccacccccgccgcccgcaccagaacagcaaactatgccacctcccggcagcccatcaggtggagcgggatctcccggcggccttggtttagagagcctgagtcctgaattctttacgagcgtcgtgcagggcgttctctcctctctgctcgggagtctgggggcgcgagccggttcctccgaatcaattgccgcattcatccagagactttccggatcctccaacatcttcgaaccgggcgctgacggagccctgggctttttcggagctttgctgagtctgctgtgtcagaattttagcatggtggacgtcgttatgctgcttcatggccacttccagcctctacagcgtttgcaaccgcaactcagaagctttttccatcaacactacctgggaggccaggaacctacccccagcaatatcagaatggcaactcacaccctcatcaccggccttgaggaatatgtccgcgagagttttagcctcgtgcaggttcagccgggcgtcgatattatccgaacgaacctggagtttcttcaggaacagtttaacagcatcgccgctcatgttctgcattgcactgattccggattcggggcccgactgctggaactgtgtaatcagggcttatttgaatgcctggcgcttaatttgcattgcctgggggggcaacaaatggaactggccgcagtaatcaatgggcgcatcaggcgtatgagcaggggcgtgaatccatcactggtgtcttggctgactaccatgatgggcttgcgattacaagttgtgttggaacatatgccagtcgggcctgacgcgatactgagatatgtgagacgagtcggggatcccccacaacctctccccgaggaaccaatggaggtgcaaggagcggaaagggcctctcccgaacctcagagagagaacgcgtctcccgccccaggaacgaccgctgaagaggccatgagccggggccccccacctgcccccgagggtggctccagagacgagcaggatggggcctcagcagagacggaaccttgggccgccgccgtgccacctgagtgggtcccgatcatccagcaggacattcaatcccagcgcaaagtgaagccccagcctcctttgagcgatgcctacctgtctggcatgcccgctaaacgtcgcaagacgatgcagggagagggcccccagcttcttctgagtgaagctgtatccagggccgcaaaagcagctggcgccaggcctctgacatctcccgagtcgctttcaagagatctggaagcaccagaggttcaggagtcgtacaggcagcagctgcgatctgatattcaaaaacggctgcaagaagatccgaactactctcctcagcggttccctaatgctcagcgcgccttcgctgacgacccctag

SEQ ID NO: 109614 - DNA, 411 bp, Artificial Sequence
  Description of Artificial Sequence: Synthetic coding sequence
tgaagaatgtcgaggggcgtaaatccatcactggtgagctggttaaccacaatgatgggactgcgtctgcaagtggtgctcgaacatatgcctgtaggcccagacgccattttgcggtacgtaagaagggtaggcgacccacctcagcccctgcccgaggaaccaatggaggtccaaggagctgaacgagcctctccggaaccgcaagaatgggtgccaatcatccaacaagatatacaaagtcagaggaaagtgaagccacaaccaccactaagtgacgcgtatctgtccgggatgcccgcgaaaaggagaaaacttaggtcagacattcagaagaggctgcaggaagatcctaactatagtccccagcgattcccaaatgcccagcgagccttcgccgacgacccatag

SEQ ID NO: 109615 - DNA, 3399 bp, Artificial Sequence
  Description of Artificial Sequence: Synthetic coding sequence
atggagccaaacgatagtacctccaccgctgtggaggaacccgattcactcgaggttctggtgaaaactctggactcccaaacccgtactttcatcgtgggggcccaaatgaatgtcaaggagttcaaggagcacatagctgcatctgtctccatcccctccgagaaacagagactcatttaccagggtcgggtgctccaggatgacaaaaaacttcaggaatacaacgtaggtggtaaagtcatccatttggtagaaagggcgcctcctcagacgcacctccccagcggcgcctcctccggaaccgggtcggcctctgcaacgcacgggggggggtcaccgcctggaactaggggacccggcgcttcagtccacgatcggaacgctaactcttatgtcatggtcggtacatttaatctaccttcagatgggagcgcggtggacgtgcatatcaatatggaacaggcgccaattcagagcgaaccacgcgtccggctcgtgatggctcagcacatgatccgggacatccagacccttctgtcacgcatggaaaccctcccatacttgcaatgccgcggtggaccacagccgcagcactcccagccacccccgcagccacccgctgtgaccccagagcccgtggcattgagctcccagacgtctgaaccagttgagtctgaagccccacctcgcgagcccatggaggccgaggaggtggaggaacgggctcctgcacaaaatccagagctgacaccaggtcccgcccctgctggtcccaccccagctcctgaaacaaatgctccgaatcaccctagtcccgccgagtacgtcgaggttctgcaggaattgcagaggcttgaaagcagattgcagcctttcctgcagagatactatgaggtattaggagcggccgcaaccacggactataataataaccatgaaggcagggaggaggaccaacggttgatcaatcttgtgggagagagcctgagactgttgggtaataccttcgtggcattaagcgatctgagatgtaatctcgcttgtactcccccacgtcacctgcacgtagtgagacctatgagccactacacaacacctatggttctgcagcaggctgccatccctatccagattaatgtgggcaccactgtcacaatgacgggcaatggcactcggccaccgccaacacctaatgccgaagccccaccacccggccctggtcaagccagtagtgtggcgccttcgtcaaccaacgtcgagtcaagtgccgagggcgccccacctccaggtcctgcaccacctcccgcgactagccatccgagagtgatccgaatctcacatcaaagcgtcgagcccgtcgttatgatgcacatgaacatccaggacagcggcacccagcccggaggcgtacccagcgcacctacagggccactgggtccgcctgggcacggtcagaccctgggtcagcaggttcctgggttcccgaccgctcctaccagggtggtcatagccagacctacaccaccccaggcaaggccatcccatccagggggccctccagtgtcaggcactttacagggagctgggttgggtaccaacgccagtctggcacagatggtttcaggactggtcgggcagctgcttatgcaacctgtccttgtcgcccagggaaccccgggcatggccccacccccggcaccagctaccgcctccgcaagtgcgggtaccacaaatacggccactaccgccggacctgcacccggcgggccagcccagcctcctcccaccccgcaaccatccatggctgacctgcagttttcacagctactcggcaacctcctgggacccgccggacctggcgcaggagggcctggagttgcaagtccaaccattactgtcgccatgcccggggtacccgcctttctgcagggtatgactgacttcttacaggcgacacagacagcaccccctccacccccgcctcctccccccccgccgccagctcctgaacaacagactatgccccctccagggtctccatcgggcggcgccggttcccctggcggactgggtctggagtccctgtctccagaatttttcacctccgttgtgcagggggtgctgtccagtctgcttgggtccctgggtgcacgcgcagggagttctgagagcatcgccgcattcatccaacggctctccggctcctcaaatatctttgaacctggagctgatggggctttaggtttctttggagctcttcttagtctgctgtgccagaacttcagcatggtagacgttgtcatgttgctgcacgggcatttccagcctcttcagcggcttcagccacagctgcgcagttttttccatcagcactacttggggggtcaggagcccacaccgtctaacattagaatggctacacacactctcatcaccggccttgaggaatacgtccgcgaaagtttttcgttagtgcaggtccaaccgggagtggacattatacggacaaatcttgagtttctgcaggagcagttcaattctattgccgcccacgtgttacattgcaccgattccggctttggagctcgactgctggagctctgcaatcaggggctgttcgagtgcttagcattaaacctgcactgtctgggaggacagcagatggaactggcagccgtgatcaatggcagaatacggcgaatgtctcgcggagtcaacccctccctcgtcagttggctgacgacgatgatggggctgagactacaagtggttctcgaacatatgccagtggggccagacgcaatcctcaggtacgtaaggcgagtgggagatcccccacaaccactgcctgaagagcccatggaggtgcagggcgcagagagagcttcacctgagcctcagcgtgaaaacgcatcaccggcacctgggaccacagccgaagaagccatgtctcgtggtccgccccccgctccggagggtggcagtcgcgacgagcaggacggcgcctctgctgaaacagaaccctgggcagctgctgtgcctcctgaatgggtccctatcattcaacaggacatccagtcccagaggaaagttaaacctcagccacccttatcagatgcatacttgtcaggtatgcccgccaaacggcgcaaaaccatgcagggagaaggcccgcagttgctcttaagcgaagctgtcagtagagcggctaaggctgccggtgctaggcctctgacttcccccgagagcctaagccgtgatctggaagcaccagaagtccaagaaagttatcggcagcaactgagatccgatatccaaaagcgcctccaggaggaccccaactatagcccccaacgattccctaacgcccaacgagcgttcgccgacgacccatag

SEQ ID NO: 109616 - DNA, 702 bp, Artificial Sequence
  Description of Artificial Sequence: Synthetic coding sequence
atggagcctaatgacagcacttccactgcagtggaagagcctgattccttggaggtcctggtgaagactcttgactcccagacgcggacctttattgttggagcgcagatgaacgtgaaagagtttaaagaacatattgccgcctccgtgtctatcccctccgaaaagcagagactcatctatcagggacgcgtgctccaggacgataaaaagctgcaagaatataatgtgggcggaaaggtgattcacctggtggaacgcgccccgccccagacacacctacccagtggtgcctcctcaggaaccggttcggcctccgcgactcacggcgggggaagtccccctggcacaaggggtccgggtgcaagcgtacatgacagaaacgccaactcatacgtgatggtcggtacatttaatctcccttcagacggcagcgcagttgatgtgcatattaatatggaacaggcgccaatacagagcgaacctagggttagacttgtcatggcgcagcacatgatcagggatattcagacattactttcaaggatggagacattaccttacctccagtgccggggggggccccagccccagcactcccagccacctccacaaccacccgcggttacaccagaaccagtggcactcagctcccaaacatcagaacccgttgagtccgaggcaccccctcgcgagccatag

SEQ ID NO: 109617 - DNA, 558 bp, Artificial Sequence
  Description of Artificial Sequence: Synthetic coding sequence
tgattggcctgcacccctcccaggcatcttcacgttgtgcgtcccatgtctcattacacgacccctatggtactacaacaggcagccatcccgatccaaattaatgtgggaactacggtgaccatgaccggtaacggcaccagacctcccccgacacctaatgcagaggcccccccacccggtcccggtcaggccagcagcgtggcccccagctccacaaatgttgagagctccgcggagggagcccccccaccagggccagcaccccctccagcgacaagtcacccacgggtgatcagaatctctcaccagtcagttgagccagtcgttatgatgcacatgaacatccagggccaacaagtaccaggcttcccgaccgctcccacacgggtggtcatcgcccgacccactcctccccaggcccgcccaagccacccgggagggccccccgtgtctgggactctacagggcgccggtctgggcacaaacgccagtcttgcccaaatggtgtctggattggtaggtcagctgctgatgcagccggtgcttgtggcctag

SEQ ID NO: 109618 - DNA, 738 bp, Artificial Sequence
  Description of Artificial Sequence: Synthetic coding sequence
cccccacgacatctgcatgttgtgcgcccaatgtcccactacacaacgcctatggttctccagcaggccgctatacctattcagatcaatgtgggaaccaccgttacaatgaccggccctgcgccaccccccgctacgagccacccacgtgttattaggatctcccatcagagtgtcgaaccagtcgtgatgatgcacatgaatatccaggacagcggaactcagcccggcggggtgccgagtgcccctactgggcctctgggacctcccggccacggtcaaactctgggacaacaggtaccaggcttccccaccgcccccacgcgcgtcgtgatcgctcggccaactccacctcaggcacgccccagccaccctggcggcccaccggtttcaggcaccctgcagggtgccggcttagggacaaatgcttcactagcacagatggtgagtggtctcgttggacaactgctcatgcagcctgtgcttgtggcccaaggaacccccggcatggctcctcctcctgcgcctgccacagcaagcgcttccgctggaacaaccaacactgccacaactgccggtcccgccccaggcggcccggcccagccaccccctacgccacagccaagtatggctgatctgcagttttctcagctgcttggtaatctgctgggaccagcaggccccggcgcagggggacccggggttgcaagcccaacaatcaccgtagccatgccatag

SEQ ID NO: 109619 - DNA, 702 bp, Artificial Sequence
  Description of Artificial Sequence: Synthetic coding sequence
atggagcctaacgactccacctctacagccgttgaagagcccgactccctcgaagtgttggtcaagacgctggatagccagacaaggactttcatcgtgggggcccaaatgaacgtcaaggagttcaaagagcacattgctgcctctgtgtccatccccagtgaaaagcaacgcctgatttaccagggcagggttctccaggatgataaaaaactgcaagaatataacgtaggggggaaagtgatccatcttgtggaaagggccccacctcagactcatttacccagcggggcgagcagcggtacaggaagcgcatcggcgacccatggtgggggtagcccacccggcacccgcggccctggagctagtgtccatgatagaaacgccaattcttatgtgatggtcggcacgtttaacctgccttcagatggtagtgccgtcgatgtacacatcaatatggaacaggcccccattcagtcagaaccccgagttcgtctggtgatggcccagcacatgataagagacatccagacattactttcccggatggaaacgctgccctacctgcagtgtcgtggaggaccccaaccccagcatagccagccaccaccacagccacccgccgtgaccccggagccagtagccctgagttcacagactagtgagcctgtggaaagcgaggctcccccacgagagccatag

SEQ ID NO: 109620 - DNA, 780 bp, Artificial Sequence
  Description of Artificial Sequence: Synthetic coding sequence
atggaacccaatgatagtactagcaccgccgtggaggagccagattcattggaggtgctggtgaaaactctcgactcacagacgaggactttcatcgttggggctcagatgaacgttaaagaattcaaggagcacattgcagctagcgtgagtattccatcagagaaacaacgactgatctaccagggacgagtgctgcaggatgacaaaaagctccaggaatataacgttggaggaaaggtgattcacctggtcgaacgggcgcccccacagacgcatctgccttcaggggcttcctctggcactggctctgctagcgctactcacggcgggggttccccacctggcactagagggcctggcgcatcagttcacgacaggaatgctaactcctatgtaatggtgggcacatttaatctaccatcggatggctctgctgttgatgtgcatataaacatggaacaggctcctatccagtccgagcctcgcgtgcggctggtgatggcacagcatatgattcgggatattcagactcttctgtcccgaatggagtgccgaggcggcccacagcctcagcactcccagccaccaccccagccccctgcagtgactcctgagcccgtcgccctgtcttcccagacttccgagcccgtcgagtcggaagccccacctcgggaaccgatggaagccgaggaggtggaagagagagcccctgcgcagaatcctgaactcacccctggaccagcccccgcaggtccaactcccgcgcccgaaacctag

SEQ ID NO: 109621 - DNA, 702 bp, Artificial Sequence
  Description of Artificial Sequence: Synthetic coding sequence
atggagcctaacgactccacctctaccgccgtggaggaacccgatagccttgaggtactcgtcaaaacactggactctcaaacccggacttttattgtcggcgcacagatgaatgtcaaggagttcaaagagcacattgcagcaagcgtcagtatcccatcagagaaacagcggctcatctatcagggcagggttctccaggatgataagaagctgcaagagtataacgtgggtggcaaggtgatacatcttgtagagagagcacctcctcaaacccatctgccctccggcgcaagttccggcactggttctgcgtctgcgacgcatggtggcggatcgcctcctgggactagagggccaggagcctcagtgcacgataggaatgcaaattcctacgtaatggtgggcacgtttaacctgccctctgatgggtcggccgttgatgttcacatcaatatggagcaagcacccattcagtcagaaccccgcgttcgcctggttatggcccagcatatgatccgcgacatccagactttgctgtctagaatggaaaccctgccctatctccagtgtagaggggggccacagcctcagcatagtcagccccccccccagccaccagccgtgacccccgagcccgtggctcttagctcgcagacctctgagcctgtggagtctgaagcaccaccccgcgagccgtag

SEQ ID NO: 109622 - DNA, 1548 bp, Artificial Sequence
  Description of Artificial Sequence: Synthetic coding sequence
atggagcccaatgattccacatcaacagctgtagaagaacccgattccctggaggttttggttaaaaccctggactcacaaacgaggacattcatcgtcggcgcccagatgaatgtgaaggagttcaaggaacacatcgcagcctctgtcagtatcccctcagagaaacagcgccttatttaccaagggcgcgttcttcaagacgacaaaaagctccaggaatacaacgtaggggggaaagtcattcatctggtggagagagcccccccgcagacacatctgcccagcggcgcctctagcggcactggctccgccagcgccacccacggcggcgggagccctccaggcactagagggccaggtgcctcggtgcacgatagaaatgcaaacagttatgtcatggttgggacgtttaatctgccttctgacggctccgccgtcgacgtccatatcaatatggagcaggcaccaatccagtcggagccgcgagtccgactggtaatggctcagcacatgatacgggatatacaaactctcctctcgagaatggagtgtcgcgggggcccacagccacaacattcacaaccccccccacagcctccagccgttacgccggagcccgtagctttaagctctcagacctccgagcccgttgaatctgaggctccaccgcgggagcctatggaggctgaggaagttgaggagcgagctccagcccagaatcctgaactgacccccggacctgcgccagctggcccgacccctgcgcctgagaccaacgccccaaatcatcccagccccgcggagtatgtggaagtgttgcaggaattacaaagactggagtcccgcctgcagcctttcctgcagcgctattacgaggtgctgggggcagccgctaccacagattacaataataatcatgaagggcgggaagaagaccagcggttaataaacctggtcggagagagcctcagactgctgggcaacaccttcgtggcattgtcagacctccggtgtaacctagcctgcactccgccacggcacctccacgtggtacgacctatgagccactacactaccccgatggtgctgcagcaggctgctattccaatacagattaatgtgggaactaccgtgaccatgactggcaacggcacaaggcctccacctacccctaatgccgaagcgccgcccccaggccctggtcaagctagttctgtcgctccatcctcgacaaacgtggaatcctccgctgaaggtgcccccccaccgggtcctgcgccacctcccgcaacctcgcatccccgagtcattcgaatctcgcaccagagcgtggaacccgtcgtgatgatgcacatgaatattcaggactcgggtactcagccaggaggcgttccgtccgcacctacaggccccttagggccaccaggccatgggcaaactctggggtcaacgcttattcaactgcctagcctcccgccagagttcatgcatgccgtcgcgcaccaaatcacccaccaagccatggttgccgccgtggcttcttag

SEQ ID NO: 109623 - DNA, 477 bp, Artificial Sequence
  Description of Artificial Sequence: Synthetic coding sequence
atggagccaaacgacagtacctcaacagcagttgaggaaccggattctctagaggtgcttgtcaaaaccttggacagccagacgagaacattcattgtgggagctcagatgaatgtcaaggaattcaaggagcatatcgccgcgtcagtcagcatccctagtgaaaagcagcggctgatctaccaaggccgggtgctgcaggacgataaaaaactgcaagagtacaacgtgggaggaaaggtgatccacctggtcgagcgtgcgcctccacaaacgcacctcccaagcggggcctcaagcggtacgggaagtgcaagcgctacccacggaggcggctcgccacccggcacgagggggcccggggccagtgtccatgaccggaacgcgaactcctacgttatggtgggaacctttaacctgcccagcgacggttctgccgtcgatgtccacattaacatggaacaggctccgatttag

SEQ ID NO: 109624 - DNA, 702 bp, Artificial Sequence
  Description of Artificial Sequence: Synthetic coding sequence
atggaacctaatgactccactagcaccgccgttgaagagcctgactctttggaggtgctcgtgaaaaccttagactcgcagaccagaacatttatcgtgggcgcacagatgaatgtgaaagaatttaaggagcacatcgccgcctccgtatcaatcccaagcgaaaagcaaagactgatctaccagggccgggtcctccaagatgacaagaaactccaggagtacaatgttggtggcaaagtcatacacctggtggagagggccccgccccaaactcacctacccagcggtgcatcttcaggcaccggatcggcctctgcaacgcatgggggtgggagtcctcccggaactcgaggccccggcgcttctgtgcatgatagaaatgctaacagctacgtgatggttgggacctttaatctgccttccgatggctctgcagtcgatgtgcatattaatatggaacaggcgcccattcagtctgagccccgggtaagactggtgatggcccagcacatgattagagatattcagaccctgctctcaaggatggagacactaccttacctccagtgtcggggaggacctcagccacagcactcccaaccccccccccagccccccgcggtaaccccggagccagtagccctgtcgtctcaaacgtccgaacccgtggagagtgaggcacctccacgcgaaccttag

SEQ ID NO: 109625 - DNA, 735 bp, Artificial Sequence
  Description of Artificial Sequence: Synthetic coding sequence
atggaaccgaacgattccactagcactgctgtggaagagccagacagtctcgaagtcctcgtgaagaccctggattcgcaaactaggacattcatagttggggcacagatgaacgtcaaagagttcaaggagcacatagctgcctctgtctccattccttcagagaaacagaggttaatataccagggaagggtgttacaggatgataagaagcttcaggaatacaacgttggagggaaagtgatacacctggtagagcgtgcgccccctcagacccatctaccaagcggcgctagtagtggcacggggtccgcttccgcaacccatggagggggtagccctcccggcactcgaggtcccggggccagtgtccacgaccggaatgctaactcatacgtgatggtcggtaccttcaatttaccctcagaaccgcgagtacgcctggtgatggctcaacatatgattcgggacatccagaccctactttcgagaatggagtgccgggggggcccccaaccccagcattcacaaccgcccccacagcccccggctgtaacgcctgagccagtggccctgtccagccagacttccgagcctgtggaaagcgaagctccaccaagggagccaatggaggcagaggaagtggaagaacgcgcccctgcgcagaatccagaactgacacctggccctgctccagcaggaccaacgcccgcgcccgaaaccaatgcaccatag

SEQ ID NO: 109626 - DNA, 3399 bp, Artificial Sequence
  Description of Artificial Sequence: Synthetic coding sequence
atggaaccgaatgacagcacatctacggctgtcgaagagccggattccttggaagtactggtgaaaacattagacagtcagacaagaacttttattgtgggcgctcaaatgaatgtgaaagaattcaaagagcacattgcggcatctgttagcatcccctctgagaaacaacgcctgatctaccaaggacgagtgctgcaggatgataaaaagctgcaggagtacaacgtcggcggaaaggtgattcacctggttgaaagggctccacctcagacccacctcccgagcggggccagctccgggactggaagtgcgtcagccacccacggaggcgggagtccacctggtacaaggggcccaggtgcgagtgtccacgatcggaacgccaacagttatgtaatggtggggaccttcaatctgcctagcgacggaagtgctgtggatgtgcacatcaacatggagcaggcgcccatccagtctgagccacgcgttcgtctggtgatggctcagcacatgatacgggacatacagacattactgtcacggatggaaaccctaccttatttgcagtgtcggggggggcctcaaccccaacattcacagcccccaccacagccgcccgcagttaccccagagcctgtggccctgagttcccagacttccgaacccgtcgagtctgaggcaccacctagggagcccatggaggccgaggaggttgaagagcgagctcccgcccaaaatcccgaactgacgccaggaccggcccccgctggacctacgcctgcgccagagacaaacgcccccaatcacccatcaccggcagaatacgtggaggttctccaggagcttcagaggctagaatcccgactccaacccttcttgcagagatattacgaggtgcttggcgctgcagcaaccaccgactacaataataatcatgagggtcgggaggaggatcagagactgataaatctggtaggtgagtctctgaggcttctgggtaacaccttcgttgctctgagcgatctgcgatgcaatttagcctgcactccccctaggcacttgcacgtggtgcggccaatgtctcactacacgaccccaatggtgttgcagcaagccgccattcctatccaaatcaacgtggggaccactgttacgatgacaggcaacgggacaaggccacccccaactccgaatgctgaagctcctcccccagggccaggacaagctagctcagtggcccccagctcaacaaatgtcgaatcatccgctgaaggggcacccccccccggccctgccccccctccggcgacatcgcatcctagagtcattaggatcagtcatcagtctgtagaacctgtggtaatgatgcacatgaatatacaagatagcggaactcagccaggcggggtgccatccgctcccacaggccctttgggcccacctggacatggccaaacgttaggccagcaagttccaggctttcctaccgcccccacaagagtggtgatcgctcgcccaacgccgcctcaggcacgcccttcccaccccgggggaccccccgtgagcggcacgctccaaggggcagggctcgggaccaacgcgtccctcgcccagatggtttccggtcttgtgggacagctgctgatgcagcccgtgctggttgcccaaggaacccctggcatggcccccccaccagccccagccaccgcatctgctagtgcaggaaccacaaatacagcaacgacggctgggcccgcgccaggaggcccggcccagcccccgcccactccccagcctagcatggccgacctgcagttcagccaattgctgggcaatctgttgggcccggccggcccaggcgcggggggctccggagtagctagccccacaattactgtcgctatgcccggggtccctgctttcctccagggcatgactgacttccttcaggcaactcagactgcgccacccccccccccccctccgccccccccccccccggctcctgaacaacagactatgccaccccccgggtcgccgagcggtggtgcgggcagtcccggcggattggggcttgaatctcttagccccgagttttttacttcagtcgtacagggcgttctcagcagtctgctggggtccctgggtgctcgtgcggggtcctcagaatccatcgctgccttcatccagaggctgagtggtagctctaacatctttgaacctggggcagatggggctctcggattctttggggccctactgagccttctgtgccaaaatttttcaatggtggatgtagtaatgctgctgcacggacacttccagccactgcaaagattacaaccgcagctgcgatctttcttccaccagcactatcttggaggacaggaacctacgccttccaatataaggatggctactcacactcttattaccggtctggaggaatacgttcgcgagagctttagtctggtccaagtgcagcccggtgtggacattatcagaacaaaccttgaattcctgcaagagcaatttaattctatcgcagcccacgtgttgcactgtactgactccggatttggagctcgcctcctcgaactgtgtaatcagggcctcttcgagtgtctggcactgaacctacactgcctgggagggcagcagatggagttggcagctgtaattaacggacggattcgcaggatgtctaggggcgtaaatccctctcttgtgagctggctgactacaatgatgggcctacgcttacaggtcgtgctggagcacatgcctgtgggccccgacgccattctgcggtacgtcaggcgcgtgggggacccgcctcagccccttcccgaggaacctatggaagtacaaggtgccgagagagcttctccagagccccagcgcgaaaatgctagtcccgctccaggtacaacagcagaagaagctatgtcacgcgggccacccccagcgccagaaggcggaagccgggacgagcaggatggcgccagtgctgaaacagagccttgggccgctgccgtaccccccgagtgggtgcctattattcagcaagacatccaatcacaaaggaaagtgaagccccagccacccttgagcgatgcctacttgagtggcatgcctgctaagcggaggaaaaccatgcaaggtgaggggccacagctgctgttgtccgaggccgtatcccgcgccgcgaaggcagcaggcgcccgacctctgacctcacccgaatcactgtcgagggatctcgaggcacctgaagtccaagagagctatcggcagcagctccgcagtgacatacagaaaaggctgcaagaggaccctaactactctccacaaagatttccaaacgcacagcgcgcctttgcggatgacccctag

SEQ ID NO: 109627 - DNA, 1548 bp, Artificial Sequence
  Description of Artificial Sequence: Synthetic coding sequence
atggaacctaatgattcaactagcaccgctgtcgaggagcccgatagcctggaagttcttgtcaaaacactcgatagccagactagaaccttcatcgttggcgcacagatgaacgttaaggaatttaaggagcacatcgcagcaagcgtgtctattccaagtgagaagcagcgtcttatctatcaaggaagggttttacaggacgacaaaaagctgcaggagtataatgtcggcggcaaagtaatccatctagtggagagggcccctcctcagacccatctgccatcaggcgcatctagcgggaccggtagcgccagtgctacacacgggggcggtagtccgccaggaacccggggtccgggagcatctgtgcacgatcgtaacgcaaatagttatgtcatggttggcacctttaacctaccctccgacggatcagcagtcgacgttcatattaatatggagcaggcgcccatccagagcgaaccccgcgtgcgcctagtgatggcacagcatatgatccgcgacatccagactctcctaagcagaatggaatgcagaggtggaccccagcctcagcatagtcaacccccaccacaacctcccgccgtgacgcccgagccagtggccctatcttcccagacttccgagcccgttgaatctgaggcccctccccgggagcccatggaggcggaggaagtggaggaaagagctcccgcacagaaccctgaactgacaccggggccggcccctgcggggcctacacctgcccctgagacaaacgctcctaaccacccttccccagccgagtacgtggaagttctccaggagctgcagagactggagtccagactccaaccatttctccagagatactacgaggtgttgggggccgccgcaactacagactataacaacaatcatgagggccgggaagaagatcaacgactcatcaacctcgtgggggagtctctgcggctgctgggaaacacctttgtcgccctcagcgatctgcgctgtaacctagcttgtaccccgccacggcacctccacgtggtgaggccaatgtcgcactacaccactcctatggttctgcagcaggccgctatcccaatccaaattaatgtaggaacaactgtaacaatgaccggaaacggaacacgcccccctccgactcctaatgcagaggcaccccctccgggtccaggccaggcatctagtgtggccccatcttccaccaacgttgagagctcagccgagggcgctccacctccggggccggcccctcctcccgcgacttcccaccccagagtaataaggatcagccatcagtccgtcgagccggtggtgatgatgcacatgaatatccaagactccggcacgcagccagggggcgtcccaagcgctcctactggacctttaggcccaccgggccatggccaaacgctagggagcaccttgatacagctcccaagccttccaccggaattcatgcacgcagtggcccaccagatcacccatcaggcaatggtggccgctgtagcctcttag

SEQ ID NO: 109628 - DNA, 735 bp, Artificial Sequence
  Description of Artificial Sequence: Synthetic coding sequence
atggagcctaatgacagcacctctacagctgttgaggagcctgacagcctggaggttctggtgaagacgctggacagccagacaaggacattcattgtgggagcacagatgaatgttaaagaattcaaagaacacatagctgcttctgtgtcgattccatccgagaaacagagactgatttaccaaggaagagttctgcaggacgacaaaaagctgcaggaatacaatgtggggggaaaggtgattcacctcgtcgaaagagccccaccccaaacacatttgccatcaggggcctcgtcaggcacaggttctgcgagcgccacccatggagggggatccccccctggcacacggggacccggtgccagcgtacatgatcggaacgctaacagttatgtcatggtgggaacattcaatctcccttctgagcctagagtacggctcgtgatggcccagcacatgattcgtgacatccagactttgctctcgcgtatggaatgccggggtggacctcagccccagcacagccagccacctccacagccacctgctgtcactccagaacccgttgctcttagtagccagaccagcgagccggttgagagcgaagcacctccacgggaacctatggaggctgaggaggtggaagagcgagcccccgctcagaatcccgaacttacccccggacccgcaccagctggcccaaccccagctcctgaaacaaatgcaccctag

SEQ ID NO: 109629 - DNA, 2232 bp, Artificial Sequence
  Description of Artificial Sequence: Synthetic coding sequence
atggaacccaacgactctacttccacggcagtggaagagcctgacagcctcgaagttctggtgaagacgctcgactcacaaacccgtacctttattgtgggagcgcagatgaatgtgaaggagttcaaggaacacatcgcggcttctgtgtctatcccttcagagaagcagcggctgatttaccagggacgagtgctgcaggacgataaaaagctccaagagtacaacgtgggggggaaagtcattcaccttgttgaaagggcacccccgcaaacgcacctgcccagtggcgccagcagcggaaccggctccgcatctgctactcacggaggaggctccccccccggcacaagaggacccggtgcttctgtccacgaccggaacgcgaactcgtacgtgatggtgggcacgttcaatcttccgtctgacggctcggcagtcgatgtgcacatcaatatggagcaagcccctatccagagtgagccccgagttagactggtgatggctcagcacatgattagagatattcagactctgctttcccgtatggagtgcagaggtggtccgcagccacagcatagccagcctccaccccaaccaccagccgtcactcctgaacctgtggctctgtcctctcagactagcgagcccgtggaatctgaagctcccccacgagagcctatggaagccgaggaagtggaagagcgcgcgcccgctcagaaccccgagctgaccccgggaccagcccccgctgggcccacccccgcacccgagacaaatgccccaaatcacccctctccagcagagtacgtggaggtgctgcaagaacttcagagactggagtcgagactgcagccctttcttcaaaggtattacgaggtactcggagcggcagccaccactgattacaacaacaatcacgaggggagggaggaggaccagagactgatcaacttagttggagagagcctgcggctgttagggaacacctttgtggccctttccgaccttcgctgcaatctcgcttgtactcctccccgtcacctccatgtggtgcgacccatgtctcactacaccacacccatggtgctacagcaggctgccatacccatccagataaacgtcggaactaccgtaaccatgacgggtaacgggacaagacctccccccacccctaatgcagaggcaccgcccccagggcctggccaggcatcctctgtggcaccatccagtaccaacgtggagagcagcgccgaaggcgcacctccgccgggccccgctccaccccccgctacttcgcatcctagggtaatcaggatttctcatcagagcgtggagccggtggtaatgatgcacatgaacattcaggattcaggaacccagccgggtggcgtgccctccgccccgacaggtccactggggcccccgggacatgggcagactttaggcagtactctcatccagctcccaagcctacccccggagtttatgcacgccgtcgctcaccagataactcaccaagccatggtcgccgccgtggcttctgccgcagccgggcagcaggtgccagggttccctacagcaccaacccgggtcgtgatcgctcgcccaactccgccccaagctaggccctcgcatcccggcggacccccggtgtctggcacactccagggagcagggctggggactaatgctagtctggcgcagatggtcagcggcttagtgggacagctcctgatgcagccggttcttgtcgctcaagggacacccggaatggcacccccccctgcaccagccacagcatctgcgagtgcaggtaccaccaacacagcaacaacagctgggccagccccgggcggccctgcacagcctccccctacgccgcagccaagtatggctgacctgcagttcagtcagctgttgggtaacttactgggcccagctggaccaggtgctggaggccctggtgtcgcgtcaccaacgattaccgtggccatgccgggagtacccgctttcctgcagggtatgacagattttctgcaggcgactcagacggcgcccccaccccccccaccacctccccctcccccaccagcacccgagcagcagactatgccccctcctggctctccttcagggggggcagggtcccctgggggactcggattagaaagcctatctccagagttttttacaagtgtcgtgcagggggtgttgtccagtttactgtag

SEQ ID NO: 109630 - DNA, 735 bp, Artificial Sequence
  Description of Artificial Sequence: Synthetic coding sequence
atggaacccaacgattcaaccagcacagccgtcgaagagcctgacagcctggaggtcctagtgaagaccttggacagccagacccgtacgttcatcgttggggcccagatgaatgttaaagaatttaaggaacacatcgctgcctcggtgtctattccaagtgagaaacagcgcctgatttaccaggggcgtgtgctccaggacgacaagaaactacaggaatataacgtcggggggaaggtcatccatttagttgagagagccccacctcagacccacctgccttcaggggcgtcatccgggactggcagcgccagcgccacccacgggggggggtcaccccctggcacacgaggacctggcgcctctgtgcacgacagaaatgccaactcttacgtcatggtgggtactttcaatcttccctcagagcctagagtccgtctagttatggctcaacatatgatcagggacatccaaacactgctttctcggatggagtgtagaggcggcccgcagccccagcattcccagcccccaccccaaccaccagctgttacacctgagcctgtcgctctgagcagccagacgtcagagccagtcgagtccgaggctcctccaagggagccgatggaagcggaagaggtggaagaaagggccccagcccagaaccctgagctaacgcccggtccagcccccgctgggcctaccccggctccagagacgaacgccccatag

SEQ ID NO: 109631 - DNA, 735 bp, Artificial Sequence
  Description of Artificial Sequence: Synthetic coding sequence
atggagccaaacgattccacatccaccgctgtagaggagcctgatagtcttgaagtgctcgtcaagacactggattctcaaacccgaacattcatcgtgggcgcccagatgaatgtaaaggagtttaaggagcacatcgccgccagcgtaagcatcccaagcgagaaacagcggttaatctatcaaggccgcgtgttgcaggacgataagaaactgcaagaatacaatgtgggtggcaaggtgattcacctggtggagcgggcgccgccccagacacacctccccagcggtgctagctccggcaccggatctgcgtccgccacccatggcggaggcagtccacccggaacccgcggccctggggcttccgtgcatgaccgaaatgcaaactcatacgtgatggtgggtacatttaatcttccttcagaaccacgcgtgaggttggtgatggcccagcacatgataagggatattcagacacttctgagtcggatggaatgtcggggcgggccacaaccgcaacattcccagccccccccccaaccccccgctgtaacacccgagccggtggcactgagttcacagacaagcgagccagttgaatccgaagctcctccccgagagcctatggaggccgaagaggtggaagaaagagcgccagcacagaatccagaactgacccctgggccagctcctgctgggcctacgcctgctcccgagaccaacgccccatag

SEQ ID NO: 109632 - DNA, 3399 bp, Artificial Sequence
  Description of Artificial Sequence: Synthetic coding sequence
atggagcccaacgattctacatctaccgccgtcgaggagcctgactcacttgaggttttggtcaagactctggatagtcaaaccaggactttcattgtcggcgcccaaatgaacgtcaaggaatttaaagagcatatcgcagcctccgttagcatcccctccgagaagcagcgactcatctatcaggggcgcgtgttgcaggatgataaaaagctccaggagtacaacgtgggagggaaagttatacatctcgtcgagagggccccaccacagactcacttaccatctggtgcctcatcaggaaccggttcggcctccgcgacacatgggggagggagccctccaggaacacggggacccggcgccagcgtccacgacagaaacgccaattcctacgtgatggtggggacattcaacctaccttccgacggtagcgccgtagatgtgcacattaacatggaacaggcccccatccagagcgagccccgggtacgccttgtgatggcccagcatatgatccgggatattcagaccctattatctcggatggagacactgccgtatctgcagtgtcgaggggggccacagccacagcatagccaacctcctcctcagccacctgccgtgacaccagaacctgttgctttgtctagccagacatcggagcccgtcgagagcgaagcgccaccccgcgagcctatggaagccgaagaggtagaggagcgcgcccccgctcaaaatcctgagctgacccctggacccgctcccgctgggcctacacccgcccctgagaccaacgccccaaatcacccttccccggcagagtacgtcgaagtgctccaggaactccagagactcgagtccaggttacagcctttcctccagagatactacgaggtgctgggtgcagccgccactaccgattacaacaacaaccatgaaggtagggaagaagaccagagactgattaacttggtgggagagtctttaagattgttgggaaacactttcgtggccctgagcgatctgcgctgcaatctagcttgtacccctccaaggcatctgcacgtggtgagaccgatgtcccattataccactccgatggtgctgcaacaggccgccatccccattcagatcaatgtagggacaaccgtcactatgacaggcaacggaactagacctccaccaactcctaatgccgaggcgccaccacctggacctggccaggcgtcttcagtggctccttcctcgaccaatgtcgagtcaagcgctgagggagcgcctccccccggtcctgccccccctcctgctacttctcaccccagagtaattaggatctctcaccagtcagttgagcccgtggtcatgatgcatatgaacattcaagatagcggtacacagccaggaggcgtgccgtctgctccaaccggccccctcggtcccccgggacatgggcagactctgggtcagcaggtacctggcttccctacagcaccaactcgtgtcgtaattgcccgccctacacccccgcaggcacgacccagccaccccggggggccacctgtttcgggcaccctccagggggctggcctgggcaccaatgcaagtttggctcagatggtgagcggccttgtgggccagcttctgatgcagcccgtgttggtcgcacaggggacacctggaatggccccaccccccgccccagccaccgcttctgcttccgccggcacaaccaatactgcaactacagcgggtcctgctcccggaggccccgcccagcctcccccaacccctcagccctctatggctgaccttcagttttctcagttgttaggcaacctgctggggcccgctgggccaggagctggcggcagtggcgtggccagtcccactatcactgtggccatgccgggagttccagcttttctgcagggaatgacggattttcttcaggcaacccaaacggctccacctccgcctccaccccccccccctccacctccggcccctgaacagcaaactatgcctccccccggatcaccaagtggtggagccgggtcccccggtgggctcggcctcgagtcactgtccccagagtttttcacctccgtcgtgcagggggtgttgtcttccctcctcggcagcctgggagcaagggcagggtcttctgagtccatcgctgcattcattcagcggctctccggttcaagcaacatttttgaaccaggcgctgacggcgcccttggtttcttcggggcattattatcacttctgtgtcagaacttctcgatggtagacgtagtgatgttattacacggccactttcagcctctccagagactacagccccaactgcgcagcttcttccaccaacactatctgggcggccaggagcccacaccctcaaacattaggatggccactcataccttaatcaccgggctcgaagaatatgtccgggagtctttctctctggtacaggtccagcccggcgtggatattattcgtacgaacctagaatttctccaagaacagtttaactcaatcgccgcacacgttttgcactgcactgattccggatttggtgctcgcttgctggaactgtgtaaccagggccttttcgagtgtctcgctctcaatcttcactgcctcggaggccagcagatggaacttgcagcggtgatcaatggccggatcaggcggatgtcccgcggggtaaatccatctcttgtttcctggctgactactatgatgggtctgagactgcaggtagtgctggagcatatgccagtgggcccagacgcaattctgaggtacgtcagaagagtgggggatcccccacagcccctgcctgaagaacctatggaagttcagggcgctgagcgagcaagtccagagccacagcgggaaaacgccagtcctgcgcccggaacgactgctgaggaggccatgagtcgggggcccccgccagcccctgaaggggggagccgcgatgagcaagatggtgcatccgcggaaaccgaaccatgggccgcagcagtgcctcccgagtgggtgcccatcattcagcaggatattcagtcacagcgcaaggtgaaaccgcagcctcctctgtccgacgcctacttaagtggaatgccggccaagcgccgcaaaaccatgcaaggcgaaggtccccagctcttgttaagtgaggcggtcagtagagctgctaaggctgctggcgcccggccactcacatcccccgaatctttatccagggaccttgaggccccagaggtccaagaatcataccgccagcagttaagaagcgacatccaaaaaagactgcaagaggacccaaattactccccccaacgtttccctaatgcccagcgggcttttgcggatgacccttag

SEQ ID NO: 109633 - DNA, 738 bp, Artificial Sequence
  Description of Artificial Sequence: Synthetic coding sequence
ccgccccgccacctacatgtggttagaccaatgagtcattataccacacctatggtcctccaacaggcagctatacctatccaaatcaacgtcggcactacagtgacgatgactggtcctgccccacctccagctaccagccatccccgcgtgattcgcattagccaccagagtgtagagcctgtggttatgatgcatatgaatattcaggactccggcactcagcccggaggcgtgccttccgcacctaccggaccgttaggaccccccggccatggccagaccctagggcagcaagttcccggcttcccaaccgcccctacccgcgtagtgatcgcccggcctacaccccctcaggcacgccctagccacccaggcggcccaccagtttcgggaaccctccagggcgcaggccttggcactaacgcgtcactcgcccagatggtgagtggcctggtcgggcaactactgatgcagcccgtcttagttgcccaagggacacctggtatggccccgccaccagcaccagcaacagccagtgcgagcgccggtaccaccaacactgccaccaccgctggacccgcaccgggcggtcccgcccagccacctccaactccccagccatctatggcagacctgcagtttagccagctgctgggcaacctgcttggcccggcaggccccggggcaggagggccaggtgttgcctctcccacaatcactgtcgctatgccctag

SEQ ID NO: 109634 - DNA, 777 bp, Artificial Sequence
  Description of Artificial Sequence: Synthetic coding sequence
atggaaccaaacgacagtacgagcactgctgtcgaagagcccgatagcctggaggttctcgtgaagacgcttgacagccagacacgcacatttatagtaggcgcacaaatgaatgtgaaggagttcaaggaacatatcgctgcaagtgtaagcatcccaagcgagaaacagcgcctcatctaccaaggtagagtcctacaggacgataaaaaactacaggaatataatgtcggcggaaaagtgatacaccttgtcgaaagggcacccccacagacccacctcccctccggcgcaagttccggaacgggcagcgcctccgcaacccatggcggtggaagtccccccggaacccgcggtcccggtgcttccgtgcacgaccgcaatgcaaacagttatgtaatggtagggactttcaacttgccatcagacgggtcagcagtggatgtgcatatcaatatggagcaagctcccattcagagcgaaccacgggtccgcctggtgatggctcagcacatgatccgggacatccagaccctgctcagccgcatggagtgtcgtgggggtcctcagcctcagcactcccaaccccctccccaaccgcctgccgtgaccccggaacccgtcgcactgtcttcccagacaagcgaacctgtcgaatcagaagctccaccaagagagccaatggaagctgaggaagttgaggaaagggcacccgcccagaaccctgaactgaccccaggaccggcccccgccggaccaacccctgcccctgagtag

SEQ ID NO: 109635 - DNA, 789 bp, Artificial Sequence
  Description of Artificial Sequence: Synthetic coding sequence
atggagcccaatgactccacttctactgctgtagaggagcccgatagcctggaggtgttggtgaagactcttgacagccagacaagaacgttcatagtgggggcacagatgaatgtcaaggagttcaaagagcatatagccgctagtgtgagcatcccaagcgaaaaacagaggctcatttatcaagggcgagtacttcaggacgacaagaaactccaggaatacaacgtcggcggcaaagtaatccacttagtggagcgggcaccaccacagacccaccttcctagcggcgcgagtagcggcacagggtctgcatcagcaacccacggaggcgggagtccccccggcacccggggcccaggcgccagcgtgcacgaccggaacgctaactcctatgtcatggtaggcactttcaatctgccgtctgatggttctgcggttgacgtgcacatcaatatggagcaagctcctatccagtccgagcctcgggttcgcctggtgatggctcagcacatgattagggacatccagacactgttgagtcggatggagtgcagggggggcccccagccccaacatagtcagccgcctccgcagcccccagccgtgacaccagagcctgtcgctctttccagccagacttcagagccggtggagtctgaagctccacccagggaacccatggaagccgaagaggtggaagagcgggcacccgcccagaacccagaactgacccctgggccagccccggcagggcccacgcccgcccccgaaaccaatgctccttag

SEQ ID NO: 109636 - DNA, 789 bp, Artificial Sequence
  Description of Artificial Sequence: Synthetic coding sequence
atggaaccaaatgacagcacaagcacagccgttgaagagcctgattcccttgaagtccttgttaaaaccctggacagtcagacgagaacttttatcgtaggcgctcagatgaacgtgaaggaattcaaagagcacattgccgcatctgtaagtatcccaagcgagaaacaacgtcttatttaccagggtagggtgctccaggatgataaaaaattacaggagtacaatgtcggaggaaaggtcattcacctggtcgagcgcgccccccctcagacccacctgccatcaggcgctagctcaggcaccgggtccgccagcgcgacacacggaggcggctcaccaccaggcacacgtggccctggagcctccgtgcatgatagaaacgccaactcctacgtcatggtgggtacctttaacttgcccagtgatggctccgccgtcgatgtgcatatcaatatggagcaggcacccattcaatccgaacccagagtaagactggtgatggcccaacatatgattagggacatccagactcttctaagcagaatggagtgtcgaggcggcccgcaaccacagcatagccagcctccgccacaaccccccgcagtgacccccgagcccgtagcactgtcaagccagacaagtgaacccgtggaatccgaagccccccctagggaacctatggaggctgaagaggtagaagagcgagcccctgcccaaaacccagaattgacccccggacccgcacccgcgggtcctaccccagctcctgagacaaatgcaccatag

SEQ ID NO: 109637 - DNA, 738 bp, Artificial Sequence
  Description of Artificial Sequence: Synthetic coding sequence
cctcccaggcacctgcacgtggtacgacctatgtctcattacacaacccccatggttctgcagcaggccgctatacccattcagattaacgtgggcacaactgttaccatgaccggacccgcgcccccccctgcaacctcacaccctagggttataagaataagccatcagtcggtcgaaccagtagttatgatgcatatgaacatacaagattctggcacgcaacctggtggcgtgccaagcgctccaacaggccccttgggcccccccggtcacggacagaccctgggacagcaagtgcccgggtttccaaccgctcctacgcgggtggttatcgccagacccacaccaccacaagcaagaccttctcaccccggagggccacccgtgagcggcacccttcagggcgctggactgggaaccaatgcgtcccttgctcagatggtgtccggtcttgttggtcagctcctcatgcagccagtactggtcgcccagggaactcctggtatggcccccccacccgcacctgctaccgcgtctgcatctgccggaactacaaacactgccacaaccgctgggccggcgcccggaggccccgcccagcctccaccaacgccccaaccttcaatggcggatctccagttctctcagttgctcgggaatctgctcggcccagccgggcctggcgccgggggatccggcgtggcatccccaaccatcactgtggcgatgccttag

SEQ ID NO: 109638 - DNA, 648 bp, Artificial Sequence
  Description of Artificial Sequence: Synthetic coding sequence
atggaacccaacgatagcacctccactgccgttgaagaaccagactctcttgaagtgttggtgaaaaccctagacagtcagacaaggacatttatagtcggcgcgcaaatgaatgttaaagaattcaaggagcatatcgcagcctctgtttcaatcccatccgaaaagcagcgtctgatttatcaggggagagtgctccaggacgacaaaaagctgcaagaatacaacgtaggaggaaaggtcatccacctggtggagcgcgcaccgccgcagacccaccttccctcaggtgcctcttcaggcaccggtagcgcaagcgcgacccatggaggaggaagcccacccggaacacgcggacctggcgccagcgtgcacgacagaaacgccaatagctacgtaatggtcggcaccttcaatctcccatctgagcctcgggtacggctggttatggcccaacacatgatccgagatattcaaaccttgctgagccgcatggagtgccgcggggggccccagccacagcattctcaaccaccacctcagccgcctgcggtgactcctgagcctgtcgcgctgagctcgcaaacaagtgagccagtggaaagcgaggccccaccgagagaaccgatggaggctgaagaggtctag

SEQ ID NO: 109639 - DNA, 735 bp, Artificial Sequence
  Description of Artificial Sequence: Synthetic coding sequence
atggaacctaacgactctactagcactgccgtggaagaaccagactccctggaggtactggttaagaccctcgattcacagaccagaacttttatcgtgggcgctcagatgaatgttaaagagttcaaggagcacatagctgcttcagtctccattccctcagagaaacaacgactgatttatcagggtcgcgtcctgcaggatgataagaaactccaggagtacaacgtgggcggaaaagtaattcatctcgtcgaaagagcccccccccagactcatctgccctcaggcgccagctctggtacaggcagcgccagcgctacccacggaggtggcagccccccaggcactcgaggccccggcgccagcgtgcacgaccggaacgccaattcctatgttatggttgggacattcaacttaccaagcgaaccccgcgtgcgactggttatggcccagcacatgatcagagacatacagaccttgttgtcaagaatggagtgcagagggggaccacagcctcagcactcacagccccctccccagccacccgcagttacgccagaacctgtagccctgtcgtcacaaacctctgaacctgttgaatcagaagccccaccaagagaacccatggaggcagaggaagttgaggagagggcacccgcacagaatcctgagctgacccctgggccagccccagccgggcctacacctgcccctgagaccaacgctccatag

SEQ ID NO: 109640 - DNA, 558 bp, Artificial Sequence
  Description of Artificial Sequence: Synthetic coding sequence
tgactggcttgcactccccctagacatcttcatgtagtccgtccaatgtcccattacacaactcctatggttctccagcaggcagctattccaatccagattaatgtcggcacaactgtgaccatgaccggcaacggaacgagaccaccacccacacctaacgcagaagcccctccaccgggccctggacaagcatcctccgtcgccccgtctagtaccaatgttgaatctagcgccgaaggagctccaccccccggccctgccccccctccggccacttcacaccctcgagtgattcggatatcacatcagagcgtcgagcctgtggttatgatgcatatgaacatccagggacagcaagttcccggcttcccaactgccccaactagagtcgtaattgcccgtcctacccctcctcaggcccggccatcacaccctggcggaccccctgtcagcgggacattgcaaggagcaggtctcggtaccaacgcaagtctagcacagatggtgagtggcctggtcgggcaactccttatgcagcccgtgctagtagcttag

SEQ ID NO: 109641 - DNA, 780 bp, Artificial Sequence
  Description of Artificial Sequence: Synthetic coding sequence
atggagcccaatgattctacttcgaccgcagtggaggagcctgactcactggaagtgctggtaaagacacttgactctcaaaccagaacgtttattgtgggagcgcagatgaatgtgaaagagttcaaggaacatattgccgcctcagtttccattccaagcgaaaagcaaaggctgatttatcaaggtagagtgctccaggacgacaaaaaactacaggagtacaatgtgggtgggaaggttatacacttagtcgaacgcgccccccctcagacccacctcccaagcggagcgagctcaggaacaggtagcgcttccgccactcacggagggggcagccctcctggtacccgtggtcccggtgctagcgtacacgatcgcaacgccaactcatatgtgatggttggcactttcaatctccccagcgatgggtctgccgtcgatgtgcacatcaacatggagcaggccccaatccagtccgagccacgggtgcggctggttatggctcaacatatgattcgggatattcagacactcctttcccggatggagtgtagggggggaccccagccacagcatagccagcctccacctcagcccccagcagtgacacccgaaccagtggctctgagttcgcagaccagtgagcccgtggagtcggaagcgccgccaagggagccaatggaagcagaggaagtagaagagagagccccagctcagaaccccgagctgacaccaggacctgcccccgccggaccaacaccagctcctgagacctag

SEQ ID NO: 109642 - DNA, 477 bp, Artificial Sequence
  Description of Artificial Sequence: Synthetic coding sequence
atggaacctaacgactctacaagcacagccgtggaagagccggattcattagaagtcctggtgaagactctggacagtcagacacgaacctttattgtcggcgcccaaatgaatgtgaaagagttcaaggaacacattgcagcatcggtctccattccttctgagaagcagagacttatctaccagggtcgagtgcttcaggatgacaaaaaattacaggagtacaacgtaggaggtaaggtaatacacctggtcgaaagagctcctccccaaacacacctgccgtctggggcttcgtcaggaaccgggagcgcctccgctacacatggcggcggatctccccccgggacccgcggcccaggcgcatcagtgcacgaccgcaatgcaaattcttacgtgatggtaggaacatttaacctaccctctgatggcagcgctgtcgacgtgcatatcaatatggagcaagcccctatttag

SEQ ID NO: 109643 - DNA, 621 bp, Artificial Sequence
  Description of Artificial Sequence: Synthetic coding sequence
atggagccaaatgactctacttcaacagccgtggaggaacccgacagccttgaggttctggttaagaccttggattcacagacacgcacttttatagttggcgcccaaatgaatgtgaaagaattcaaagagcacatcgcagcaagcgtttccatcccatcggaaaagcagagactcatctaccagggcagagtactgcaggacgataaaaaacttcaggaatacaatgtgggaggaaaggtgatacatctggttgagcgcgcacctccacagacacacctgccctcaggggccagctcaggcaccggctcggcaagcgccactcatggaggaggcagtccacccgggaccaggggacctggggcctcagtgcacgatcgcaacgcgaatagttatgtcatggtaggaaccttcaatttgccatcagaacctcgcgtcagactggttatggcccagcatatgatcagagacatccaaacactgctgtcaagaatggagtgcagagggggccctcagccccagcactcacagccccctccgcagcccccagccgtcacaccggagcctgtggccctgtccagccagaccagtgagcctgtcgaatctgaggcacccccctag

SEQ ID NO: 109644 - DNA, 3399 bp, Artificial Sequence
  Description of Artificial Sequence: Synthetic coding sequence
atggagcctaatgatagcacatctaccgccgtggaggagcccgacagtctggaggtcttggtcaaaaccctggacagtcagacgaggacattcatcgtcggagctcaaatgaatgtcaaagagtttaaagagcacattgcagctagcgtctccattccttcggagaaacaacggctgatataccagggacgtgtcttgcaagatgataaaaagcttcaggagtacaatgtgggcggaaaggtcatccacctggtggagagagcacctccgcagacccatcttccgagtggggctagctccggaacagggagcgcatccgctacccacggcggggggtcgcctcctggcacgcgtggcccgggcgccagtgtgcatgatagaaacgcaaactcttacgtgatggtgggtactttcaatctacccagtgacggctctgccgtggatgtacacattaacatggaacaggccccaatccagagcgagccgcgggtgcgccttgttatggctcagcatatgattcgcgatattcagactttgctctctcgcatggagacactcccctacctgcagtgtcgcggtggcccgcagccacagcacagccagccccctccgcagccccccgcagtgacccctgaacccgtcgccttatcatcccagacgagcgaacccgtggagtctgaagcccctccgagagagccaatggaggccgaggaagtcgaagaacgcgcacctgcccagaatcccgagctgacgccgggtccggcccccgccggtccaactcctgcacctgagactaacgctccaaaccatccatcacctgccgagtacgttgaggtgcttcaggaactgcagcgattggagtcaagactgcagccgttcctgcagcgctactatgaagtgctgggagcagccgctaccactgactacaataacaaccacgagggacgagaggaagatcagagattgattaatttggttggagagtcgctgcggctgttaggaaacacctttgtcgccctgtccgacctcaggtgcaacttagcgtgtactccaccaaggcatttgcacgttgtacgccctatgtctcattacaccacccccatggtattgcaacaggcagctatcccaatccagataaatgtcggcactacagtgacaatgaccggcaacgggacccgtccaccgcctacgcctaacgccgaggcccctccccccggacccggccaggcaagtagcgttgctccctctagtaccaatgtagagagtagcgctgaaggcgcccccccacccggacccgcacccccccctgcaaccagtcacccccgggtcataagaatcagccaccaatcagtcgaacctgtcgtaatgatgcacatgaacatccaggacagcgggacccagcctggaggagtgccatccgctcccactggcccattgggaccccccgggcacggacaaactctgggccagcaagttcctggttttcccactgctcccacaagggtagtcatagctcggcccacacctccccaggcgcgtccctctcaccctggcgggccccctgtttcaggaacattgcagggggcaggtttaggtaccaatgcctcactcgcgcagatggtgagcggcctggtcgggcagctgttgatgcagcctgtccttgtggcacaaggcacccctggtatggcccccccgccagcccctgccaccgcaagcgcatcagctggcactaccaacactgcgaccacagcaggaccagctcccggtgggcctgctcagccccctcctaccccgcagcccagcatggccgatcttcaattctcacagctgttgggcaacctgcttgggcccgccggacctggcgccgggggcccgggcgtcgcctcccccaccattacagtcgccatgcccggtgtgcctgcctttttacagggcatgacagactttttgcaggcaacccagaccgccccaccacccccaccccccccgccacccccccctccagcgcccgagcagcagactatgcctcccccaggcagtccctctggcggcgccggctcacccggcggtctgggcttggagtctctgtcgcccgagttctttacttctgtggtgcagggggtcttaagtagccttctggggtccctgggggcacgcgctggctcatccgaaagtatagccgcctttatccagcgactaagcggtagctcaaacatctttgagcctggagcagatggggctctaggctttttcggggccctgttaagtctcctctgccaaaacttttccatggtggatgtcgtgatgcttctccacgggcattttcagcctctgcaaaggcttcaacctcagctccggtcttttttccatcagcactaccttggaggccaggagcctacgccttctaacataaggatggccacccatacactgatcactggtcttgaggaatatgttcgtgagtccttttccttagtgcaggtccagccaggagtcgacattattcgcactaatctggaatttctccaagaacagttcaacagcatcgctgctcatgtcttacactgcaccgactcggggtttggagcgaggctgttagaactgtgcaaccagggcctgttcgagtgcctggcactaaatctgcactgtctggggggacaacagatggagttagccgccgtaattaacggccgcatccgaagaatgagtcggggcgtgaacccttcgcttgtgtcatggctaactaccatgatgggactccgcctccaggttgtgctggaacacatgcctgtgggcccggatgccattctacgttacgtccggagagtgggtgatccaccacagccgctcccggaagagccaatggaagttcagggcgcagagcgtgccagcccagagcctcaaagggagaacgccagcccagctcccggcacaaccgctgaggaagccatgtcaagagggcctcctcccgctcctgagggggggagcagggatgagcaggatggcgcctcagctgagaccgaaccatgggcagcagccgttccccctgagtgggtgcccataattcagcaggacatccagtcacagaggaaggttaagccacaaccaccactcagtgatgcttatctgagtgggatgcccgccaaaagacgcaagacgatgcagggtgaaggtccgcagctcctgctttctgaggcagttagtcgagctgctaaggccgccggcgccaggcccctcacttcaccagaaagcctgagcagggatctggaagctcctgaggtgcaggagtcctatagacaacagctgagatcagacatccagaagagactgcaagaggatcccaactactcaccccagagatttccaaacgcacagcgggcatttgcggatgacccctag

SEQ ID NO: 109645 - DNA, 717 bp, Artificial Sequence
  Description of Artificial Sequence: Synthetic coding sequence
agtagcgccgagggggctccaccacccggccctgctccccccccagccacctcacatcctcgcgtgatcaggatttcccaccagagcgtagaacctgtggtcatgatgcacatgaatatccagggccccttgtccttatctccgtgtccggatagcggcacccagcccggaggcgttccctcagcccctacgggacccctcggtcctccagggcacggacaaacacttgggcagcaggtgcccggcttcccaacagctcccactcgcgtggtgatcgccaggccaacgccaccacaggcccggcccagccaccccggcggcccaccagtgagcgggaccctgcagggcgctggccttggaacaaacgccagtctggcgcagatggtgtctggtctggtggggcagctcctgatgcaacccgtgctcgtggcccagggcactcccggcatggctccaccccctgcgcccgccactgctagtgcatcggccgggaccactaacaccgccacaaccgccggcccggcgcccggaggaccagcccagcctcctccaacgccgcagccttctatggcggatctgcagttctcccaattgctggggaacctcctaggtcccgcagggcccggggccggcggctcgggagtggcctccccgacaattaccgtggccatgcccggcgtgccagcttttctgcagggcatgaccgatttcctttag

SEQ ID NO: 109646 - DNA, 621 bp, Artificial Sequence
  Description of Artificial Sequence: Synthetic coding sequence
atggagccaaatgacagtacttccactgcagtcgaggaaccggactccctggaggtccttgtgaagactctggattctcagactagaacttttattgtcggcgcccagatgaatgtcaaagaattcaaagaacacatcgctgccagtgtgtcgatcccctcagagaagcagcgtctgatttaccaaggcagagtgctccaggatgataaaaaattgcaagagtacaacgtaggcggtaaagtaatccatttggtcgaacgggctccgccacaaacacaccttccaagtggggccagctcaggcactgggtccgctagtgccacccacgggggtggctcccccccaggcacgcgcggccctggcgcttccgttcacgacagaaacgccaattcctatgtcatggtgggtacatttaacctgcctagcgagccacgtgtccgcctggttatggcccaacacatgattcgggatatccagacactactaagcaggatggagtgtcgaggcggcccgcaaccacaacattcacagcctcctcctcagccccccgctgttacacctgaacccgttgctcttagttctcagacgagcgaaccggtggaatccgaagccccaccttag

SEQ ID NO: 109647 - DNA, 558 bp, Artificial Sequence
  Description of Artificial Sequence: Synthetic coding sequence
tagcttgcctgcacaccgccacgccacctgcatgtggtgagacccatgagccactatacaacccccatggtcctacagcaagctgctataccaatccagatcaatgttgggacaaccgtcaccatgaccgggaatgggactagaccgcccccaacccctaacgccgaagccccacctccagggcccggccaagcctcttctgtggccccctctagcacaaatgtggaatcgagtgccgagggcgcccctcctcctgggcccgcccctcctccggccacaagccacccccgcgtgattaggatcagccatcagagcgtcgagcctgtggtgatgatgcacatgaacatacagggacagcaagtgcctggattccccacggcccccaccagagtggtaatcgcgcgccccaccccgccgcaggcgaggccatctcaccctggtggcccgcccgtatcaggcactctgcagggtgcaggtctcgggacaaacgccagcctggcccaaatggtcagcggactcgttggccagctcctgatgcagccagtgctggttgcctag

SEQ ID NO: 109648 - DNA, 648 bp, Artificial Sequence
  Description of Artificial Sequence: Synthetic coding sequence
atggagccaaacgattccactagcacggccgtcgaggaacctgacagcttagaggtcttagtgaagacactcgactctcaaactcgcacattcatcgtgggagcccagatgaacgtgaaggagttcaaagaacatatcgcggcatctgtcagcatccccagtgagaaacagaggctcatctatcagggacgcgtactacaggacgataaaaagctccaagagtacaatgtcggcggaaaagtgattcatctcgttgagcgcgcacctccacagacacatctgccctccggggcctcatcgggaacgggaagcgcctcagcaactcacggggggggcagccctccgggaacaaggggccccggcgcatccgtccacgaccgaaatgctaattcttacgtgatggttggaacgtttaatcttcctagcgagccacgagtccgtctggtgatggcccaacatatgatccgcgacatccaaaccctgttgtctaggatggagtgtaggggcggccctcagccgcagcactctcagccccctcctcagccccctgccgtgacgcccgagccagtggccctgtcttctcagacatctgagcctgtcgagtcagaggcaccgcccagagagcccatggaagccgaggaagtatag

SEQ ID NO: 109649 - DNA, 789 bp, Artificial Sequence
  Description of Artificial Sequence: Synthetic coding sequence
atggagcccaacgattctaccagcactgccgtcgaggaacccgactcattagaagtcctcgttaagaccctggacagccagactcgcacatttatcgttggcgctcagatgaacgtcaaagagttcaaggagcatattgctgcgagtgtgagcataccctcagagaagcaacgtctcatttatcagggccgcgtcctccaggacgacaagaagctgcaggaatacaatgtaggtggtaaagtgatacacctggtggagcgcgcaccgccccagactcacctgccttctggtgccagttctggcacagggtccgccagcgcaacacatgggggcggttcaccaccaggaactagggggcccggagctagcgtacacgatagaaacgctaacagctacgtgatggtaggaacttttaacctgccttcagacggaagtgccgtggatgtccacatcaacatggagcaggcaccaatccagagcgagccccgggtcagactggtgatggcacagcatatgatccgggacatacagaccctactgtcccgcatggagtgcagaggcggcccccagccccagcacagccagccaccacctcagcctccagccgtgacacccgaacctgttgctctctcaagccagacctccgagcctgtggagtctgaggcacctccacgcgaaccgatggaggccgaagaggtcgaggaaagggccccagcccagaatcccgagctgaccccagggcctgcgcccgcgggtccgacgccagcgccagagaccaatgcaccctag

SEQ ID NO: 109650 - DNA, 594 bp, Artificial Sequence
  Description of Artificial Sequence: Synthetic coding sequence
atggagcccaacgatagcacctccaccgcagttgaagaaccggactcgctggaggtcttagttaaaacgctcgactctcaaacacgcaccttcattgtgggagcccagatgaatgtgaaggaatttaaggagcacattgccgcatcggtgtcaatcccatcggagaagcagaggctcatctaccaaggtagggtgctccaagacgataaaaagttacaggagtacaatgtcgggggcaaagtgattcacctggttgagcgtgctcccccccagacccatttaccaagtggcgcgtcatctgggaccggaagcgcctctgctacacacggcgggggctcaccaccggggactcgaggacccggtgcgagcgtgcacgaccgtaacgctaactcatatgtgatggtcgggacgttcaatcttcctagcgacggaagtgctgtagacgtccacatcaatatggaacaggctcctattcagtccgagccccgcgtgcggctcgtgatggctcaacatatgattcgcgacattcagacactgttatcccggatggagtgtcgaggagggcctcagccccaacattcccagccaccatag

SEQ ID NO: 109651 - DNA, 735 bp, Artificial Sequence
  Description of Artificial Sequence: Synthetic coding sequence
atggagcctaacgactccaccagcacggctgtcgaggaaccagacagtctcgaagtactggtaaagactctcgactcccagactcgcacattcatagtcggtgctcagatgaacgtgaaagagttcaaggaacacatcgccgcctccgtgtcaatcccaagcgaaaagcagcgcctgatttaccagggtagagtgctacaagatgacaagaagcttcaggaatacaacgtagggggtaaggtgatccatttggtcgagcgggctccccctcaaacccacctcccaagcggcgctagttcgggcacaggatcagcttccgccacgcacggcggtggctccccgcctggaacccgaggcccaggggcatccgtgcatgacaggaacgctaattcatacgtaatggtggggacatttaacctcccctctgaacctcgagtgaggttagtcatggctcagcacatgatcagggacatccagacactactgtcacggatggagtgtaggggggggccccaaccgcaacattctcaaccacccccacagccgcccgctgttaccccagaacccgtagctctctcttcccagacttctgaaccagtggagagcgaagcccccccgcgcgaaccaatggaggcagaggaggtggaagaacgagctcccgctcaaaatccagagctcaccccaggtcctgctcccgccgggcccacccccgcaccagaaactaatgcgccttag

SEQ ID NO: 109652 - DNA, 681 bp, Artificial Sequence
  Description of Artificial Sequence: Synthetic coding sequence
tagtccggctttggggcgaggttgttagaattatgcaatcagggtctcttcgagtgccttgctctgaatttgcactgcctaggaggacagcagatggaattggccgcggttatcaatggaagaatacgacgcatgtcaaggggtgtcaacccaagtcttgtgtcctggctgactaccatgatgggtcttcggcttcaggtggttctcgaacacatgcctgtgggtcctgatgcaattctgaggtacgtgaggcgagttggagacccccctcaacctctgcctgaagaacccatggaagtacagggagctgaacgagcatctccggagcctcagcgggaaaatgcaagtcccgctcctggtactaccgccgaggaagccatgagtagaggcccaccccctgcccccgaaggagggagcagagacgagcaggatggcgctagtgccgaaaccgagccttgggccgccgctgtgccaccagaatgggtgccaatcatccagcaggacattcagtctcagaggaaagtaaaaccccagccccctctctccgatgcttacctctctggcatgccagccaagcgccgtaagctacgctccgacattcagaaacggctccaggaggaccccaactactcaccgcagcggtttccgaatgcgcaacgtgcatttgcagatgatccctag

SEQ ID NO: 109653 - DNA, 738 bp, Artificial Sequence
  Description of Artificial Sequence: Synthetic coding sequence
cccccgcgccacctgcacgtcgtgagacctatgagtcactatactacacccatggtgctgcaacaggccgctataccgattcagattaatgtgggcaccactgtgacaatgacagggcctgcacccccccccgcaacctctcatccccgcgtcatcagaatcagccaccagtccgtggaacctgttgtgatgatgcatatgaacattcaggatagtggcactcagcctggtggagtgccttccgcacctacggggccacttggaccacctggacacggacagacacttggccagcaggtccccggttttccaacagcgccaacaagagtggtaatagcacggcccaccccaccccaggctagaccctcacacccaggaggtccccctgtaagcggcacccttcagggtgctggactgggtaccaatgcaagcctggcgcaaatggtgtccggactggtagggcaacttctcatgcagccggtcctagtcgcccagggcacccccggcatggctcctccccccgccccagccacagcatcagccagcgccggcactactaacactgcaactaccgccggtccagcaccagggggacccgctcagcctcctcccacccctcagcctagcatggccgatttgcaatttagtcaactgctcgggaatttgcttgggcctgctgggccaggggctggaggcagcggagttgcctctcctactattacagtggctatgccctag

SEQ ID NO: 109654 - DNA, 681 bp, Artificial Sequence
  Description of Artificial Sequence: Synthetic coding sequence
taaagcggctttggagctcggctgctggaattatgtaaccagggccttttcgagtgcctcgccttaaatcttcattgcctggggggccagcagatggaacttgccgccgtgattaatggaagaatcaggcgcatgagccgaggcgtcaacccatccttggtaagttggctgactactatgatgggcctgaggctccaggtcgtactggaacatatgccagtgggaccagacgcaatattgcggtatgtgcgcagagtgggagatcccccccagcccctgccagaggaacccatggaagtacagggcgcggaacgggcttcccccgagcctcagcgggaaaatgcaagccccgcgcccgggacaaccgccgaagaagccatgtctcgaggacctcccccagctcccgaaggaggatcacgggatgaacaggatggggcaagcgccgaaactgagccctgggcggctgccgtgccgccagagtgggtgccgatcatccagcaggatattcagagccagaggaaagttaagccccagccacccttgagcgatgcatatctgagcgggatgcctgctaaacggaggaaactccggagcgacatacaaaaaaggttgcaggaagatcccaattattcgccccagagattccccaacgcccagcgggcgtttgcagacgatccgtag

SEQ ID NO: 109655 - DNA, 681 bp, Artificial Sequence
  Description of Artificial Sequence: Synthetic coding sequence
tgatcaggcttcggtgcccggctgctggaactgtgcaaccagggcttattcgaatgcttggctttgaacctccattgcttgggtggtcagcagatggaacttgcagcggtaattaacggccgaataagacgaatgtcaaggggcgtcaaccccagcctagtcagttggctgaccaccatgatgggcttacggctccaggtggtcctggagcacatgcctgttggacctgatgcaatcttgcgctatgtcaggagagttggtgatcccccccagccactcccggaggaacccatggaagtacaaggagctgaacgcgccagtccagagccgcagcgggagaatgcatctccagcccctggcacaactgccgaagaagccatgagtagaggtccacccccagcacccgagggagggagccgcgatgaacaagatggggcttccgcagaaaccgagccctgggcagccgcagtaccaccagagtgggtccccattatacaacaggatatccaaagtcagcgtaaggtgaagccccagcctcctctctctgatgcgtatctttccggcatgcctgccaaacgtaggaagttgagaagcgatatccaaaagcgactacaggaagatcccaactacagtccacagcggttcccgaatgctcaaagggccttcgctgacgatccttag

SEQ ID NO: 109656 - DNA, 777 bp, Artificial Sequence
  Description of Artificial Sequence: Synthetic coding sequence
atggaacccaacgacagcactagcacagctgtggaggaacccgattccctcgaagtgttagtaaaaacactcgacagccagacaagaacttttatcgtaggggcccagatgaatgttaaagaatttaaggagcacatcgcggcttctgttagtatccctagcgagaagcagcgactgatctaccagggtcgagtactccaagacgacaaaaagctccaggagtacaacgtgggagggaaagtcattcacctggtagaacgcgcccctccccagacgcatctgcctagcggtgcatccagtggaactggctccgcttctgccacccacgggggcggatccccacctggaacccgaggacccggcgcgtctgtacatgatagaaacgccaacagctatgttatggtgggcacctttaacttaccctccgatggatctgccgtggatgtgcacattaacatggaacaggccccaatccagtctgagccacgtgtgcggctggttatggcccaacatatgattcgggacattcaaactttgttgtccaggatggagtgtcgtggaggaccacagccacaacattctcagcctcctccccagccacccgcagttactcctgagccggtggcactgtcttcacagacctccgaacccgtagagagcgaagcacccccccgggagccaatggaggccgaggaggtggaggagcgtgctccagcccagaaccctgagctgactccaggtccagcgcccgctgggcctaccccagctcctgagtag

SEQ ID NO: 109657 - DNA, 411 bp, Artificial Sequence
  Description of Artificial Sequence: Synthetic coding sequence
tagcgaatgtctagaggtgttaacccaagtctagtctcctggctgaccaccatgatggggttgagacttcaagtcgtgctggagcacatgcccgtgggacctgacgcaatcctgcgctatgttagaagggtaggagatcctccccaacctttgcccgaggaaccgatggaagtgcagggtgccgaacgcgcttcccccgagcctcaggagtgggtgcctatcatccagcaggacatccaatcacagcggaaggtcaaaccgcagcctcctctaagtgatgcctacctgagcggaatgcctgccaagaggcgcaagcttcggagcgacatccagaaaaggctgcaggaggatccgaattatagtccccagaggttccctaatgcgcagagagcctttgcagacgatccatag

SEQ ID NO: 109658 - DNA, 3489 bp, Artificial Sequence
  Description of Artificial Sequence: Synthetic coding sequence
atggagccaaatgatagtaccagcaccgctgttgaggaacccgactccctggaggtgttggtcaagactctggactcccaaactagaacatttatcgtgggcgcccagatgaacgtgaaggaatttaaggaacacattgcggcttcagtctccataccttccgaaaagcagcgactgatttaccagggacgagtgctgcaggatgataagaagctccaggagtataatgttggaggcaaagttatccacctagtggaaagagctcctcctcagacccacctgccgagcggagccagctcgggcaccggatccgcctccgcaacccatggcggtggaagcccacccggtacccgggggccaggggcctcagtgcacgatcggaacgccaattcctatgttatggtggggaccttcaatcttccttccgacggatcagcagtggacgtgcacatcaatatggagcaggcccccatacagagtgagccccgtgttcgccttgttatggcgcaacacatgattcgcgatattcagactttattatctcgcatggagtgccgcggcggtccacagccccaacactcccagccccctccgcaacccccagccgtgactccagaacctgttgcactttcgtctcagaccagcgagccagttgagagcgaggctcctccgagagagcccatggaagccgaggaggtagaggaaagggcacctgcccagaacccagagctaacccccgggcccgcccctgctggccccaccccagcaccggaaacaaatgctccaaaccacccctcccccgcggagtatgttgaggtgctccaggaactccagaggttagaaagtcgactgcagcctttccttcaaagatactacgaggtgctgggcgctgccgctaccacagattacaacaacaaccacgaggggagggaggaggatcagagactgattaatctggttggagaatcactgcgcctcctgggaaatacgttcgttgccctcagcgacttgagatgcaacctggcctgcaccccccctaggcacttgcacgtagtccgaccgatgtcacactacacaacgcctatggttcttcagcaggccgcaatccctattcagataaatgtggggacaacggtgactatgactggtaacgggacgagaccgccaccaacacctaatgcagaggctcctcccccagggccgggacaggctagctccgtcgcacctagctccacaaacgtcgaatcatccgctgaaggtgctcctccacccggacctgctccaccacccgcaacttcacatccccgcgtcatccggatcagtcaccagtctgtggagccggtggtgatgatgcatatgaacattcaagattctggcactcaacctggtggcgtgccttctgcacctaccgggccattaggtccacctggacacggccaaaccctcgggagtacccttatacagctgccctctctccccccggaattcatgcatgccgttgctcatcagatcactcaccaggcaatggtggcagccgtcgccagcgcggcggcaggccagcaagtccctggatttcccacagccccaactcgcgtagtaattgccagaccaacacccccacaggcccggccatctcaccccggcggccctcctgtctccggtacactgcagggggccgggttgggcacgaatgctagtcttgcccaaatggttagtggactggtgggtcagcttctgatgcaaccagttctcgtcgcccaaggaacccccggaatggcaccaccccccgcacctgccaccgctagcgcctctgctggaacgaccaataccgctactacagccggtcccgcaccaggaggacctgcacagccaccgccaacgccccaaccatcgatggctgatctccaattcagccaactgctgggtaatctcctgggccctgcaggaccaggcgctggtggacccggggtggcctctcccacgattaccgtggcgatgcccggcgttcctgcctttctgcagggaatgacagacttccttcaagccacacagactgctccaccgccgcctccgccaccgccccctccgccacctgcccctgaacagcaaaccatgcctccacccggctctccttcaggcggagcagggagtccgggcggcttaggtcttgagtcgttgagccctgagttctttacatctgtcgtccagggagtgctctcttccctgttgggaagtcttggcgctagagctgggagcagcgaaagtatagctgcttttatccagcgtttgagcggcagttctaatatcttcgagcctggagccgacggcgcactcggattttttggagctcttctttccctattatgccagaatttctcaatggtggacgtggtgatgttgctacacggtcattttcagccactccagcggctccaaccgcaattacgcagcttcttccaccagcactacctgggcggtcaggagcccacaccaagcaatatacgcatggctactcatactctgattaccggcttggaggaatacgtaagagagtccttttcgcttgtgcaagtccagcccggagtggacattatccggacaaacctcgaatttttgcaggagcagtttaactccatcgctgcccatgtactacactgcacagatagtggcttcggggctcggctgttggaactgtgtaatcagggtttattcgagtgcctggcgctgaacctccattgtctcggcggccagcagatggagctcgccgcagtgattaatgggaggatacgaagaatgtcacggggagtgaacccatcactggtgagctggctcactaccatgatgggactccggctccaggttgtgctggagcatatgccagttggaccagatgccattcttaggtatgtgcggcgcgtcggcgacccaccccagcccctgcctgaggagcctatggaggtgcaaggtgcggagcgcgcctcgcctgaacctcagcgcgaaaacgcctctcccgcccccgggactacagctgaagaagcaatgagtcgcggcccccctccagccccagagggggggtcgcgggatgagcaggacggagctagcgccgaaactgagccctgggcagcagccgtgccacctgagtgggtgcccataattcaacaagacattcagagccaaagaaaagtgaaaccacaacccccactgtcggatgcatacttaagcgggatgcccgcaaaacgacgcaaaactatgcaaggggaagggccccagctgttgttgtctgaggctgtgtctcgggccgctaaggcagctggggctcgtcctctgacctctcctgaatcactttccagagatctggaggcacctgaagtccaagagagctatcggcagcagctccggagtgacatccaaaagcgtctacaggaggatccaaactatagtccccaacgctttccaaacgcgcagagggcttttgcggacgatccatag

SEQ ID NO: 109659 - DNA, 2712 bp, Artificial Sequence
  Description of Artificial Sequence: Synthetic coding sequence
atggagcccaatgattctacctctaccgctgtggaagagccagatagcctcgaggtcctggtgaaaacgctggattcacagactagaacgttcattgtgggcgcgcagatgaatgtgaaggaatttaaggagcatatcgcagcctccgtaagcatcccctctgaaaaacagaggctgatctaccaaggcagggttctgcaagacgataagaaactgcaggagtacaatgtcgggggcaaggttatccacctggtcgagcgcgcacccccccagacgcacctcccgagcggggcctcgtccgggacaggcagtgccagcgcgactcatggagggggttcgccaccaggtacacgcgggccaggcgcatcagtacacgatagaaatgcaaatagctacgtgatggtgggaacctttaatttgcctagcgatgggtccgccgtcgacgtgcacatcaatatggagcaggcaccaatacaatccgaaccccgcgtccgcctcgttatggcacagcacatgatcagggatatccagaccctgctatctaggatggagtgtcggggggggccccagccacagcactcccagcctccgccccagccaccagccgtgactccggagcctgtggccctgtccagccagactagtgaacccgtcgaaagtgaggcaccccctcgcgagcctatggaagcagaggaagtggaggaacgagctcccgcacaaaacccggagctgactcctggccccgcccctgctggccctactccagctcctgagaccaacgctcccaaccatccctctccagccgagtatgtagaggtcctacaggagctgcagcggcttgagtcacgactgcaaccctttctccagagatactatgaggttctgggcgctgccgctactacagactataataataatcatgagggacgggaggaggaccagaggctcatcaacttggttggagaatccctgagattgctcgggaatacttttgttgccttgagtgacctgagatgcaatctggcctgtactcccccgcggcacctgcatgttgtcaggcccatgagccactacaccacaccgatggttctccagcaggctgccattcctatccagatcaacgttggcacgacagtgacaatgaccgggaatgggacccgacccccgcctacccctaacgctgaggcgcctccccctggacctggccaagccagtagtgtggcgccaagttctaccaacgtggagagtagcgccgaaggggctccacccccagggccagccccccctccggcaacttcacaccctcgagtgatccgaatatctcatcagtccgttgagccggtagtcatgatgcacatgaatattcaagactccgggacgcaaccgggtggcgtgccatctgcacctacgggtcctctggggccaccagggcatggacagactctaggacagcaagtccccggcttccccaccgcccccacaagagttgtaatcgccaggccaacacctccccaggcgcggcccagccatccaggtggtcctcctgtcagcggcacgttgggagccggccttgggaccaacgcatctttagcacagatggttagcggtctggtaggtcagttgctaatgcaaccggttcttgtggcccaaggtacacccgggtcacccggcggcttgggccttgagtctctctctcccgaatttttcacgagtgtagtgcagggcgtgctgagctctctgctgggatctctcggagccagggccggctcatccgaatcaattgctgcattcatccagcgtctgtctgggagttcaaacattttcgaacccggtgccgatggtgccctgggtttttttggcgctctactgtcgctgttgtgtcagaactttagtatggtagatgttgtgatgctgctgcacgggcattttcaacctcttcaaaggctgcagccacagcttagatcatttttccatcagcattacctggggggtcaggagccaacgccatcaaacatcaggatggcgacccacaccctgatcactggattggaggaatacgtgcgagaaagcttcagtcttgtccaggtgcaacctggtgtcgacataatcagaacgaacctggagttcctccaggaacaatttaattccatcgccgctcacgtcctgcactgcacggattcggggttcggggcccgcctcctagagctctgtaatcagggcctgttcgagtgcttggcactgaatctgcattgccttggcgggcagcagatggagctcgcggccgtgattaacgggcggatcagacgaatgtcgcgcggagtcaatccttctttggttagctggttgacaacaatgatgggactccgcctccaggtggtgttagaacatatgccagtcggccccgacgcaatactgcggtatgtccgcagggtaggggatcctccccaacctctccccgaagaacctatggaagtccagggagccgagcgtgcatctccggaaccccaggaatgggtgccaatcatccagcaggacattcagagccagcgaaaagtgaaaccgcagccacccctgagtgatgcctacctgagcggtatgccagcaaaaagacgaaagttgagatctgacatccagaaacggctacaggaggatccgaactattcgccacagagattccctaatgcccagcgagcgtttgcggatgacccatag

SEQ ID NO: 109660 - DNA, 2712 bp, Artificial Sequence
  Description of Artificial Sequence: Synthetic coding sequence
atggagcccaacgatagtacgtcaaccgctgtggaggagcccgatagcctggaggtcttggtgaaaactcttgatagtcagactagaacttttatcgtgggggctcagatgaatgtgaaggagtttaaggaacacatcgccgcaagcgtgagcattcctagtgagaaacagcggcttatctatcaggggcgagtgctccaggacgacaagaaattgcaggaatataatgtagggggcaaggtgattcaccttgtagaaagggcacctccacaaacacatctgccaagcggcgcatctagcggaactggttctgcatctgctacacatgggggggggagtcccccaggtacccgagggcctggtgcaagtgtgcacgatcgaaacgccaattcctacgtcatggtcgggaccttcaacctccccagcgacggatcagcggtggacgtccacattaatatggagcaagctccaatccagagcgaaccgcgggtacgcctagttatggcccagcatatgatccgagacattcagactctcctgtccagaatggaatgtagaggggggcctcagcctcagcactcacaaccaccccctcagccacccgccgtgactcctgagcccgtcgccttaagctcacagaccagcgagcctgtggaatccgaggcaccacccagagaaccaatggaagccgaagaagtggaagagagggctccagctcagaaccctgagctgacacccggtccagcacccgctgggccgactcctgctcccgagacaaacgctcctaaccatccttctccagccgagtacgtggaagtcctgcaggaactacaaaggctggagtcccgtctgcaaccatttctgcagcgatactacgaagttctcggagctgcggccacaaccgattacaacaacaatcacgagggtcgagaggaggaccaacggctgatcaacctcgtgggagagtccctgaggttgctgggaaacacatttgtggctctcagcgatcttcgatgtaatctggcttgcacgccgcccagacacctccatgtagttagacctatgtcgcactacacaactccaatggtcttacagcaagccgcgataccaatccagatcaacgtcgggacaactgtaaccatgactggaaatggaacaaggcccccacccactcccaacgccgaggccccaccccccgggccagggcaagcaagcagcgttgccccatcgtcaaccaacgttgagtcctctgctgaaggcgcccccccgccgggacctgcgcctccccctgcaaccagtcatccccgggtgatccgaatctcccatcagagcgtcgaaccagtggtgatgatgcatatgaatatccaggacagcggaacccagcccggtggggtaccgtctgcgccaacgggccccctaggtccacccggacatgggcagactctggggcagcaagtgcccggtttcccgacggctccaacccgagtagtaattgcgagacccacaccgcctcaggccaggcccagccatcctggcgggccgcctgtttcaggaactcttggcgcaggcctgggaaccaatgccagtctggcccagatggtgtcgggcctagtggggcaactcttgatgcagccggtgctggttgctcaggggactcccggctcacccggtggactgggcctggaaagcctgtcaccagaattcttcacaagcgtcgttcaaggggtcttgtcatctctgctgggatctctgggagcccgggcaggcagcagcgagagtatcgctgctttcatacagcggctatcagggtcatccaatatcttcgaacccggagccgacggggcgctcggcttcttcggcgccctgctcagcctgttatgtcagaactttagtatggtagacgtagtcatgctccttcacggccattttcagcctttacagcgcctccagccacagctgcgatctttctttcatcaacattatctagggggccaggagcccacgccaagcaatatacgcatggctactcatacactgatcaccggtctggaggagtacgtgagagaatccttcagcctagtccaggtgcagcccggtgtggatatcattaggacaaatctcgaatttctgcaggagcagtttaatagcatcgccgctcacgtgctgcactgcacggattccggattcggcgcccgccttttggagctctgtaatcagggtctgtttgagtgcttagccctgaacctccattgtcttggtggccaacagatggagttggcagcagtgatcaatggcaggattcgcagaatgtccaggggcgtgaatcctagtctggtgagctggttgaccaccatgatgggactcaggttacaggtggtcctggaacatatgcctgtaggtcctgatgcaatcctacgttacgtgcgcagagtcggcgacccgccccaaccactgccagaggaaccaatggaagttcagggagcagaacgtgcttcccctgagcctcaggagtgggtccccattatccaacaggacatccagagccagaggaaggtaaagccccagccccctttgtccgatgcttacctgagcggtatgcccgcaaaacgcagaaagttgcgaagtgacattcagaaaaggctgcaagaagatccgaactactcgccccaacgatttccaaacgctcagcgagcctttgccgatgatccttag

SEQ ID NO: 109661 - DNA, 3234 bp, Artificial Sequence
  Description of Artificial Sequence: Synthetic coding sequence
atggaaccgaacgattctacctccactgccgtagaggagccagattcactggaagtgctggtgaagactctggacagccaaactagaacgttcatcgtcggcgctcaaatgaatgttaaagaattcaaggagcacatagctgcctctgttagtatcccttctgaaaaacaacgtctgatataccagggccgggttctgcaagatgacaaaaagctccaggagtacaatgtgggcgggaaagtgatccatctggtcgaaagagcgccacctcagacacacctgccctcaggcgccagcagtggtaccgggagcgcctctgccacccacggaggtggaagtcctccaggcaccagagggcccggagcctctgtgcatgaccgtaatgctaactcctacgttatggtaggaaccttcaatctgccctccgatggatccgcggtcgacgttcatatcaatatggagcaggccccgattcaaagcgaaccacgcgtgagactagtcatggcccagcatatgatcagggatatccagaccttactcagtcgaatggagtgccggggaggcccgcagccccaacattctcaacctcctccccagccacctgctgtcacccccgagcctgtcgctttgagctcacagaccagtgagcccgtggagagcgaagctccacctagggaaccaatggaggcggaggaagtagaggagcgtgcacccgctcagaaccccgaactgacccccggccccgccccagccgggcccacgccagcgcctgagacaaacgctcccaaccacccctcccccgccgaatacgttgaggtactgcaggagctgcagagattggaatccagattacaaccctttcttcagcgttactacgaggtcttgggagcagccgctactacagattataacaataaccacgagggaagagaagaggaccagcgcttaatcaacttagtgggtgaaagtctacgcttgctgggcaacactttcgtcgcactgtccgatttaaggtgcaatctggcttgcacccccccacgtcatcttcatgtcgtccgtcctatgtcccactataccacacccatggtgttgcagcaagctgcaatcccgatacagattaacgtcggaactacagttaccatgaccggcaacggaaccagaccaccgccaaccccgaatgccgaggcccccccccccggccccggacaggccagctcagtggcaccatcgtccaccaatgtggagagctccgccgagggagctcccccgcccgggccagccccaccccccgccactagtcaccctcgagtgataaggatcagtcatcaaagcgtagagccggttgtgatgatgcatatgaatattcaagactctgggacgcagcccggcggtgtgccttccgcaccaaccggtccattgggaccacccggccacggccagaccctcgggcagcaggtgcctggattccccaccgcccccacacgcgtcgtgatcgctagaccaactccccctcaagcccgacccagtcatccgggcgggccgcctgtttccgggactctgcagggcgcaggcttggggacaaacgcttcgctcgcccaaatggtgtccggtctggtgggccagctgctgatgcaaccagtgctcgttgctcaaggaacacccgggatggctccccccccagctccagctaccgcctctgccagcgcagggacaactaacaccgcaactacagcaggccctgccccggggggccccgctcagcccccaccaaccccacagccatcaatggcagatttgcagttcagccagctgctgggcaaccttcttgggcccgcagggcccggggccggggggtcaggtgtggcttccccgacgattactgtggccatgccaggcgtgccagctttcctccagggcatgacagacttcctgcaggctacccagaccgccccccccccaccgcctccaccgccacctcctccaccagctccagagcagcagacgatgcccccacccgggagcccttccggtggggccggtagcccaggaggtctggggctggagagtttgtctcctgagttcttcacttctgttgtccagggggtattatcaagtctgctcgggagtctgggtgcccgtgccggctcctctgaaagcatcgcagcctttatccagaggctttcagggtcctctaacatttttgagcctggggccgatggagctctggggttttttggcgccctcctgtcgctcttgtgccaaaacttcagcatggttgatgtcgtcatgctgctacatggtcacttccagccacttcagagattacagccgcagctgaggtctttcttccaccagcattacctgggaggtcaagagccaacgccatccaacatccgtatggctacacatacccttataaccgggttggaggagtacgtgagggaaagctttagcctcgtccaggtgcaaccgggcgtggacatcattcggaccaatctggaattcttgcaagaacagtttaatagtatagctgcccatgtccttcactgcacagactctggatttggagctcgccttctcgaactctgcaaccaggggttatttgagtgcctggccctaaatctgcactgcctcgggggacaacagatggaactggctgccgttattaacggcaggatccgtagaatgagcaggggggtgaatccctctttggttagttggctgaccactatgatgggcctgaggctgcaggtagtcctggaacatatgcctgtgggtcccgacgctatcctgcgctacgttaggagggtcggggacccgccacagcccctccccgaggaacccatggaagtccaaggagccgagagagcctctcccgaaccccagcgcgagaacgcttcccccgcccctggcacaaccgccgaagaagctatgagcagaggaccaccacccgctcctgagggaggatcccgggatgaacaagatggtgccagcgccgaaacggagccatgggcagccgccgtcccacccgagtgggtgcccataatacagcaggatatccagagccagcgtaaagtgaaacctcagccaccgctcagcgatgcgtacctctcaggaatgcctgccaagcgccgaaagctccggagcgatattcagaagagactccaggaggacccaaactatagtccccagaggtttcctaatgcccagcgcgcctttgccgatgatccttag

SEQ ID NO: 109662 - DNA, 3234 bp, Artificial Sequence
  Description of Artificial Sequence: Synthetic coding sequence
atggagcctaacgactccacgagtaccgcagttgaagagccagacagcctggaagtactagtcaaaacactcgactcacagactcgcaccttcatagtgggagcgcagatgaatgtgaaggagtttaaggagcacattgcggcaagtgtgagtataccctccgaaaaacagcgcctgatctaccagggcagagtcctgcaggatgacaagaagcttcaggaatataacgtcggtggcaaggtgattcacttggtcgagcgggccccacctcagacccatctcccaagtggagcctcttccgggacgggcagtgcatccgccacccatggagggggctcacctcctggcacacggggacctggagcaagcgtacatgataggaatgctaattcctacgtgatggtggggaccttcaacctgccaagtgacggcagcgctgtagacgtccatataaacatggaacaggcgcccatccaatctgagcctcgtgtccgcctggtcatggcccagcacatgatacgagacatccagaccctcctgtcacggatggagtgccggggcggcccccagccacagcactcacagccacccccccagcctccagctgtcacccccgagcccgtggcattgagtagccagacctcagagcccgtggaatctgaagcccctccgcgcgagcccatggaagctgaggaggttgaagagagagctccagcccagaatcccgaactgactccaggcccagcgccagccggccctacaccggcccccgaaacaaacgcgcctaaccaccctagccccgctgaatatgtggaagttctccaagagttgcagaggctggagagtcgattgcagccttttctgcagcgttactatgaggtgctgggggctgctgctaccaccgattataacaataatcacgaaggcagggaggaggatcagaggcttatcaacctcgttggcgaatctctccgactcctgggaaacacctttgtagctttaagcgacttgcgatgcaacttggcctgtacacctcctcgccacctgcacgtggtgcgccctatgagtcactacactacaccgatggtgctgcagcaggcagctattccaatccagattaacgtgggaaccaccgtgaccatgaccgggaacgggactcgtcccccgcccacccccaacgcggaggcacccccacctggtccaggccaggccagctccgtggcaccgagcagcaccaacgtggaaagtagcgctgagggtgcccctcccccaggtcctgctccaccacctgctaccagccatcctcgagttatccgaatctcacaccagtctgtagagccagtggtgatgatgcacatgaatattcaggattccggcactcagcctggcggcgtgccctctgcgcccaccggacccttggggcctccgggacacgggcaaacacttggacagcaggtacctggcttccctaccgccccaacccgggttgtaatcgcccgccccactccaccccaagctcggcccagccatcccggcggaccgcctgtttctggtacacttcagggggcaggcctgggaacaaacgcaagcctggcccagatggtttccgggttggtggggcagctgctgatgcagcccgtcctagtggcacagggtacacccggcatggcgccaccgccagccccggctaccgctagtgcctctgcagggaccaccaacaccgccactactgccgggcccgcccctggcggacccgcacaaccgccacccacccctcaaccatccatggctgatctgcagttctctcagcttcttggtaacctcctgggcccagccggtccgggggctggggggccaggggtggcctccccgacgataaccgtggccatgccaggcgtcccagcctttctccagggaatgaccgatttcctccaggctacacaaactgcccctcctcccccaccgccacctcccccccctccaccagcacccgagcaacagactatgcctccccccggttccccttcgggcggggctggctcacccggtggcctcggacttgagtccttgagcccagagttctttacatctgtcgtccagggtgtgctcagtagcctgctgggcagcctgggcgcccgggctgggagctctgagtctatcgccgctttcattcaacgactgagtggctcatccaatattttcgagcctggcgctgacggggcattggggttcttcggcgccctccttagtctcctttgtcagaacttctcgatggtggacgtggttatgctcttacacggccatttccaaccattgcaacggctccagccacagctccggagtttcttccatcagcattacttaggcggacaggagccaacaccttccaatatccgaatggccactcacacactcattactggacttgaagagtacgttagggaaagtttctcactcgtgcaggttcagccgggcgtggacataatccgtaccaatctggagtttctgcaggagcaattcaattcaatcgccgcccatgtactgcactgcaccgattctggattcggagctcgtttattagagctttgtaaccagggtttgtttgaatgtctagccctcaatctgcactgtttaggggggcagcagatggagctcgctgcagtgattaatggacggatcaggcgtatgtccagaggggtgaacccaagcctggtttcttggctcactaccatgatgggcctgcggctacaagtcgtgctagagcacatgccagtcggacctgacgcgatactgcgttacgttcgtagggtgggagatccccctcagccactgcccgaggaacctatggaagtgcagggcgcagagcgcgcctcaccggaaccccagcgggagaacgctagtccggctccaggaactacagccgaggaggcaatgtctagagggccgccgccagctcctgaggggggcagcagagatgaacaagatggggcatctgcggagacagaaccctgggctgccgctgttccacccgaatgggtcccgataatccagcaggacatacagagccaacgcaaggtaaagcctcagcctccactatctgatgcctatctgagcggaatgcctgccaaaaggagaaagctgcgctctgacatccagaagcgcctgcaggaggatcccaattattccccacagcgctttcccaacgctcaacgagctttcgctgatgacccttag

SEQ ID NO: 109663 - DNA, 3489 bp, Artificial Sequence
  Description of Artificial Sequence: Synthetic coding sequence
atggagcccaacgatagtaccagcaccgctgtcgaggagccggactccctggaggtgctcgttaaaacactggattctcagacaaggactttcatcgtgggtgcacagatgaacgtcaaggagtttaaagaacatatcgcggctagcgtgtccatcccaagtgagaaacagaggcttatctaccagggacgcgtacttcaggatgataaaaagctgcaggaatacaacgtgggtgggaaggtgatacacctggtggaacgtgccccaccacagacccacctgccttccggcgcctccagtgggacaggatctgcatccgccacccacggggggggctccccacctgggacaagggggccaggggcaagtgtacatgaccgtaacgcaaacagctacgtaatggtgggcaccttcaatttgccttccgacggatctgcagtcgatgtacacatcaacatggaacaggccccaatccagtccgaacctcgcgtccgcctggttatggcccagcacatgatcagggacatccagacgctgctgtcgagaatggagtgtcgcggaggaccgcaacctcagcacagccagcccccgccacaaccccccgccgtgacgcctgaacccgttgcactgagttcccaaacttctgagcccgtggagagtgaggccccgcctagggagccaatggaagcagaggaggtggaggaacgggcacctgcccagaacccagaactcacacccggtcccgctcccgccggacctacacctgctccagaaacgaatgcccccaaccacccatcccccgccgaatatgtcgaggtcttacaggagttgcaaagactggaatccagactccaacctttcctgcagaggtactatgaagtcctcggggctgctgcaactacagattataataacaaccacgagggacgcgaggaggatcagcgcctgatcaacctggtgggcgaatctttgagactcttgggaaacacattcgtcgcactaagtgatctgcggtgtaacctggcatgtactccacctagacatctgcatgttgtacggcctatgtctcactataccacccccatggtactccagcaggccgcgattcctatacagataaacgtcgggacaactgtaaccatgacgggtaacggcactaggcctccgcccacgcctaacgcagaggccccacctccaggtcccggccaggcgtctagcgttgcccccagctccaccaacgtggagagtagtgcagagggggccccaccccctggcccagcccctccaccagcaacttcccacccgcgcgtgattcgcatcagccatcagtccgttgagcccgtggtgatgatgcacatgaacattcaagattcaggcacccagcccggaggcgtgccttctgcacccacaggccctttaggtccccctggccacggccagacactcggtagcaccctgattcaactgccatcgcttcccccagaattcatgcatgctgtggctcaccaaatcacccaccaggcaatggtggcggcagtagcctcagccgccgctgggcagcaggtgccagggttcccaacggccccaacgcgggttgtcatagccagacctactccgccccaggccaggccgtcgcaccccggcgggccgcctgtgagtggaacacttcaaggtgccggtcttgggaccaacgcttcactggcccagatggtgtctgggctggtcggccagcttttgatgcagcccgtgctggtggcccagggaacaccagggatggctccacctccggcccctgcaactgcatccgcatccgcgggaacaaccaacaccgctacaaccgccgggcctgcacctggcggcccggctcagcctcccccgaccccacaaccaagcatggccgatttacagttctcgcaactactggggaatttgctgggaccagcaggccccggagctggtggccctggagttgctagtcccaccataactgtggccatgcccggcgttcccgctttcctacagggaatgaccgactttctgcaggcaacacaaactgccccccccccaccaccccctccccctccacccccaccagcccccgagcagcagaccatgccgcccccaggttcaccctcgggaggggcggggtccccgggcgggctggggttggagtccttgtcgcccgagttttttacgagcgtggtgcagggtgttcttagctcattacttggctcactcggagcccgcgccgggagctctgagtcgattgcagcctttatccagcggttatccggcagcagcaatatttttgaacctggagcggatggcgctctggggttctttggagccctgctgagcctgctgtgtcaaaatttctcaatggtggatgtcgtcatgctcctccacggacactttcaacccctccaaaggttacaaccacagcttagatctttttttcaccagcattatttgggaggccaggaaccgacacccagcaatattcgaatggccactcacacgttaataactgggttggaggagtatgtgcgcgagagtttctcgttggtgcaagtgcagcccggagtggacataatcagaaccaacttggagtttctgcaggaacaattcaattccatcgcggctcacgtgctgcattgcaccgatagcgggttcggcgccagacttcttgaactctgtaatcaggggctgttcgagtgcttggccctgaacctgcactgcctcgggggacagcagatggaactggcagctgttattaacgggcgcataagaagaatgtcccgtggcgtgaacccatctctcgtgagctggctaactacaatgatggggctgcggctgcaggtagtcctggagcacatgcccgttggtcctgacgcaattttgcggtatgttcggcgtgtgggtgaccctcctcagccgttgccagaagaacctatggaggtgcagggcgccgagcgcgcctccccggaaccccagagagagaacgcctcccctgctcccgggacaaccgcagaagaggccatgtcacgcggacctcccccagcaccagagggcgggagtagggatgagcaggatggggcgtccgccgagacagagccttgggcagccgccgtgccgcccgagtgggtgcctattatccagcaggacatccagagccagcgcaaagtcaaacctcagccacctttgagtgacgcctacctgtcaggtatgcctgccaaacgccggaagacaatgcagggggaggggccacagttactccttagtgaggctgtttcaagggctgctaaggccgctggcgcccgtccgctgacctcaccagagagcctgagcagggatctggaggccccagaagtgcaggaatcatataggcaacagcttcgttctgatattcagaagaggctgcaggaggatccaaattacagcccccaacgcttcccaaacgcacagagagcctttgctgacgacccttag

SEQ ID NO: 109664 - DNA, 3234 bp, Artificial Sequence
  Description of Artificial Sequence: Synthetic coding sequence
atggagcctaatgattcaacctccaccgcagtagaggaacccgacagcctggaagtgttggtgaagactctggattcacagacaagaaccttcattgtcggagcccagatgaatgtgaaagagttcaaggaacacattgcagccagcgtgtccatacccagcgaaaaacaacggctgatctaccaagggagagtgctccaagatgataaaaagctccaggaatataatgtgggagggaaggtaatccacttggtggagcgggccccaccgcagacacacctgccttccggtgcttcttcggggacaggctctgccagcgctactcacggaggcggaagccctcccgggacccgaggccctggagcctccgtgcacgaccgaaacgcaaactcctatgtcatggtgggcaccttcaatctgccttctgacgggagcgccgtcgatgttcatattaacatggagcaggcacccatacagtcggagccccgcgtgcggctggttatggctcagcacatgatccgagacattcagactctgctctcaaggatggagtgtcgaggaggaccccagccccagcacagccagcctccacctcagccccccgctgtcacccctgagcctgtggccctgagcagtcagacatcggagcctgtagagagcgaggcgccccccagggagccaatggaggccgaggaagtggaggagagagctcccgcccagaatcccgagcttacacctgggccagcgcccgccggacctactcccgcacccgagaccaatgcacccaaccatccatctcctgccgagtacgtggaggtcctgcaggaattgcagcggttggagagtaggcttcagcccttcctgcagcgatactacgaagtcctgggagcggcagcgacgaccgactataataataatcatgaaggtagagaggaggatcagcgactcattaacctcgtgggcgagtccctgaggctattgggtaatacattcgtggccttgtcagacctccgatgcaatctcgcttgcacccctccacgccacctccacgtggtgaggccaatgagccactacactacacccatggtgctccagcaggcagcgattcccattcagattaatgtcgggacaacagttactatgaccggcaatggaacaaggccacctcccactcccaatgcggaagcccctccacccggtccaggccaggcaagtagcgtggccccatcgtctacaaatgtggagagttccgcagagggtgccccacctcccgggccggctcctccacccgccacctcacacccacgtgttatccggatttcccatcaatcagtggagcctgtggttatgatgcacatgaacatacaggattctgggacacaacccggaggggtgccatcagcccccactggcccacttggcccccctggtcacggacaaactctcggtcagcaggtgccaggtttccccaccgcgcccacccgcgtcgtgattgcaagacctacaccaccacaagcaagacccagccacccaggcggcccacctgtatcaggcaccctgcagggcgccgggctgggtacgaacgcctcgttggcccagatggtgtcaggcctggtggggcagctgctgatgcagccagtgctggtggcccagggaacaccaggaatggcccctcctcctgcaccagcaactgcatccgctagcgccgggacaaccaatactgccaccacagccggaccggcaccaggcggccccgcacaaccccctcccacaccgcagccgtctatggctgatctgcaattttcgcaactgctgggaaatctgctggggcccgccggtcccggcgccgggggaagcggtgtcgcatcaccaacgatcacagtcgcaatgccgggcgtaccggccttccttcaagggatgaccgatttcctgcaagctactcagactgcccccccccccccacctccccctcctcctcctcccccagccccggaacagcagaccatgcctcccccggggagcccctcaggcggcgcagggagtccgggggggttggggctggagtcactctcacccgagtttttcacgtcggtggttcagggcgtcctgtctagccttctgggttccctgggcgcaagagcgggcagctctgagtcaatcgcagcctttatacagaggttgtcgggctcctcgaacatattcgagccaggcgccgatggcgcacttgggttctttggagctctcctgtcactcctctgtcaaaatttttccatggttgacgtggttatgctgctccacggacatttccaacctctccagagactgcagcctcagctgcgatctttcttccaccagcactaccttggcgggcaggaaccgaccccctccaacatccgcatggctacccacaccctcatcactgggttagaggagtacgttagggaaagtttctcacttgttcaggtgcagcctggggtagacataatccgtaccaatcttgagtttcttcaggaacagtttaacagcattgccgctcatgttttgcattgtaccgacagtggtttcggggcccggctattagagctgtgcaaccaggggctcttcgagtgcctggccctcaacctacattgtttgggagggcaacagatggaactggccgcagttatcaacgggcggatccgccgcatgagccgaggggtgaatccctccttagtaagctggctcactacaatgatgggactcagactgcaggttgtgctcgaacacatgcccgttgggcctgatgcaatcttaagatacgtccgccgggtgggtgaccccccccaaccactgcctgaggagccgatggaagtgcagggcgccgagcgtgcctcacctgagccccagagggagaacgcatctccagcccctggaactactgctgaagaggctatgtctcgcggcccaccacctgcccccgagggcggcagcagggacgaacaggacggtgcgtctgccgagacagaaccatgggccgccgccgtgcctccggaatgggtgccaatcatccagcaagatatccaaagtcagaggaaggtgaagccccagccacccctgagcgacgcctacctgagcggcatgcccgccaaacgccgaaagctccggtcagatatacagaagcggctccaggaggaccccaactacagccctcagaggttcccaaacgctcagcgggcatttgctgatgacccctag

SEQ ID NO: 109665 - DNA, 2712 bp, Artificial Sequence
  Description of Artificial Sequence: Synthetic coding sequence
atggagccaaacgatagcactagtacagcagtggaagagccagatagtctcgaagtgttggtgaaaaccctcgactcgcagacccgaacgttcattgtaggcgctcagatgaacgtgaaggagtttaaggagcacattgctgcgagcgtatctatcccatcggagaagcagaggctgatctatcagggccgggtactgcaagacgataagaagttacaggaatacaacgtgggtggtaaggtcatacatctggtggagagggctcctccacagacccacttgccctcgggtgcatcgagtggaaccggctctgcatcagcaacacacggcggcggcagtcccccagggactcgcggtcctggcgcttcagtgcatgaccgcaacgcgaattcctacgtgatggtgggtacctttaacctgcccagcgacgggtccgccgtggacgtgcacataaatatggaacaagcgcctattcagagtgaaccaagggttagacttgttatggctcagcacatgatcagagatattcagacacttttgtcacgcatggaatgtcgggggggaccccaaccacaacacagtcagccccctccccagcctcctgccgttacaccggaaccagtggctctgagcagtcaaacctctgagccagtagaatctgaagccccgcccagagaaccaatggaagctgaggaggtggaggaaagagcaccagcccagaatccagagcttactcccggacctgcaccggctgggcccacaccagccccagaaactaatgctcccaaccacccctctccagcagaatacgtggaagttctgcaggagttgcagaggctcgagagcagactccagccatttctgcagcgatactatgaggtcctcggtgcagcggccacgactgactacaacaacaaccacgagggcagagaagaggatcagcgcctgattaatcttgtgggtgagagcctccggttgttggggaacacttttgtcgccctaagcgacctgcgttgcaacctggcttgtaccccgccgaggcatttacacgtcgtgcgccctatgtcacactacacgacccccatggttttacaacaggccgcgatcccaatccagattaacgttggtaccacagtgacgatgacggggaatggcacaagaccaccaccaacccccaacgctgaggcacccccgcctgggcccggtcaggcatcctcagtggccccctcgagtacaaacgtcgagtcctcagctgaaggagctcctcccccaggcccggcacctccgcctgccactagccaccctcgagtcatacggatttcccatcaaagcgtggaacccgttgtaatgatgcacatgaacattcaggattccggcacccagcctggcggtgtaccttccgcacccacagggccactcggcccacctggtcacggacagactttagggcagcaggtaccaggcttccctacagcccccacacgcgttgtgatagcgcggcctacgcccccccaggccagaccctcccatccggggggaccacccgtgtctgggacccttggagcgggcctgggcactaacgcttcactcgcccaaatggtctcaggactcgtaggccagcttctgatgcagccggtcttagttgctcagggtactcccggaagccccggtggactcggcttggagagtctttctccagagtttttcactagcgtagtgcaaggcgtgttatcaagcctgttgggtagcctgggagcgagagctgggagctctgagtctatcgccgcatttattcagcgactttcgggatccagtaatatctttgagcccggggcggatggtgccttgggcttcttcggggcgctgcttagcttgctgtgccagaacttcagcatggtcgacgtggtgatgcttttgcacggtcatttccagccactgcagagattgcaaccccagctgaggtctttcttccaccagcattaccttggaggccaagaacctaccccttcgaatatacggatggcaactcacaccctgataactgggttggaagaatatgtgagagaaagcttctcccttgtccaggttcagcccggcgtcgacatcatccgtacaaacttggagttcctccaggagcagttcaacagtatcgctgctcacgtgttacactgtaccgattcggggtttggagctcgcctgcttgaactgtgcaatcagggacttttcgagtgcttggctctcaaccttcactgcctgggcggacagcagatggaacttgctgccgtgataaacggacggatccgaagaatgagcagaggggtgaatccaagcctggtctcatggttaactaccatgatgggcctgcgtctgcaggtcgtcctggagcacatgcccgtgggtccagacgctatcctgagatatgttaggcgggtgggagatccacctcagcccctgcccgaggaacccatggaagtccagggagctgagcgggccagtcccgaacctcaagagtgggtgcctataatacagcaagacatccagtcacagcgcaaagtgaagcctcaacccccccttagtgacgcttatctgtctggaatgcctgctaagcggcgaaagttaagaagtgacattcagaagagactgcaggaagaccccaattattcccctcaacggttccctaacgcccagcgagccttcgccgacgacccatag

SEQ ID NO: 109666 - DNA, 3489 bp, Artificial Sequence
  Description of Artificial Sequence: Synthetic coding sequence
atggagccaaacgattccacctccaccgcggtggaagagcccgatagtcttgaagtgcttgtgaagaccctggactcccagaccaggacttttatcgtcggggctcagatgaacgttaaagagttcaaagagcacatcgcagcctctgtcagcatcccctcggaaaagcaacgactcatctatcagggtagggtgctccaagatgacaagaaattgcaggaatataacgtaggtggaaaagtgattcatctcgtggagagggccccacctcagacccatctcccaagtggcgcgagttcaggtactgggagcgctagcgccacccacggtggcggatccccaccaggaacccgggggccaggggcatccgtgcatgaccggaacgcaaattcttatgtgatggttggaacctttaacctgcccagcgatgggagcgccgtcgatgttcatatcaatatggaacaggctcccattcagtccgagccccgcgtgcggctggtaatggcccaacatatgatcagagatatacagaccttactctcaaggatggagtgtagagggggacctcagccacagcattcacagccgccgccgcaaccgcccgctgtgactcctgagccagttgctctgtcatcccagacatctgagccagttgagagcgaggcacctccgcgtgagcccatggaggcagaagaggtggaagagcgcgcacccgcccagaaccccgaactgactcccggacccgcgcccgccgggccgaccccagcgcccgaaacaaatgctccaaatcatcctagccctgccgagtacgttgaggtgctacaggaacttcagcggctcgagtctcggctgcaaccattccttcaacgatactacgaggtcttgggggcagcagctaccacggactataataacaatcatgaggggagggaggaggaccagagactgattaatttagtcggcgaatctttgcgactactgggcaatacctttgtggctcttagtgatttgcgctgtaatctggcctgtaccccaccacggcacctacacgtcgtgaggcccatgtcgcactacacaacacccatggtgttacagcaggccgctattccgattcagatcaatgttggcacaacggtgacgatgactggcaacggcaccagaccaccacctacgcctaacgctgaggcccccccccccggacctggccaggcaagtagcgttgccccttccagcaccaatgttgagagcagcgccgaaggcgctccaccccctgggccagctcccccacctgccacaagccatccgagggtgatccggataagccaccaaagcgtggaacccgtggttatgatgcacatgaacattcaggatagcgggactcagcccgggggagtcccgtccgcccccactgggcccttagggcctccggggcacggacagaccctgggttctactttgattcagctgcctagtttgccccccgagttcatgcatgcagtcgcccaccagatcacgcatcaggctatggtagccgccgtcgcctccgcggcagcaggacaacaggtgcctggttttcccacagcacccactcgtgtagtgatcgcaagaccaactcctccacaggctaggccttcgcaccccggtggcccccccgtcagcggcactctgcagggagcaggcctcggcacgaatgcatctctggcacagatggtgtccgggctggtaggacaactgctgatgcagcctgtactggtcgcgcagggaactcccggcatggcccccccgccggcgcccgcgacagcttccgcctctgccggaacaacaaataccgctaccactgcagggcccgccccagggggtcccgcgcaaccacccccaaccccccagccttctatggccgacctgcagttttcccagttactagggaacctgctgggccctgctgggcctggggctgggggctctggggtcgcgtcacccactattacagtcgctatgcctggtgtgccagcctttttgcagggcatgacagactttttacaagcaacccagaccgccccacctccgccgccaccacccccaccgcccccccccgcaccagagcagcagaccatgccacctccaggaagcccaagcggcggcgcgggctcacccgggggactcgggctcgaaagcttatcaccagaatttttcacatccgtggtacagggagtgctgtctagtctcctcgggtccctcggagcacgtgctgggtcaagtgaatccatagcagccttcatacagagactcagcgggtctagcaacatcttcgaaccaggagctgatggagcattaggattttttggagccctcttgtcacttctttgtcaaaacttttccatggttgatgtggtgatgttactacacggccatttccaaccactccagagacttcagccacagctccggagtttcttccaccagcattacctcggcggccaagagccgacccccagtaacatccgaatggcaacccacacgctgattacagggctcgaggagtacgtgcgggaaagcttttctctcgtgcaagtgcagccaggtgtagacatcatccggaccaaccttgagttcttgcaggagcagttcaacagcattgcagctcatgtgctgcattgtactgacagcgggttcggcgcacggctgctggagctctgtaatcaagggctgtttgagtgcctggccctgaacttacactgtctcggaggccaacagatggagctggccgccgtaatcaacggccgaatcaggcgcatgtccagaggtgtgaatccaagtttagttagctggcttacaaccatgatgggcctgcgactccaggttgtgctggagcatatgcctgtgggacccgatgcaattctgaggtatgtgcgtagagtgggagatcccccacaacctctgcccgaagagcctatggaggtacaaggagccgaacgggcaagccccgagccccagcgcgagaatgcctccccggctcctggcactacagctgaagaagccatgagccgcgggccgcccccagcacccgaaggtgggagcagagacgaacaggatggggcctcggctgagaccgagccctgggctgccgccgtgccccctgagtgggtgccgattatccagcaggacatacagtctcagcgaaaggtcaagccgcaaccccccctctcggacgcgtatctgagcggcatgcccgccaagcggcgaaagacaatgcaaggcgagggtccacagctgctgttatctgaggccgtgtctagagctgccaaggcggctggggccaggccgctgacctctcccgagagtttaagcagagacttggaggccccagaggtccaggaatcttacagacagcagctgcggagcgacattcagaaacgtcttcaagaggatcctaactacagtccccagcggtttccgaatgctcagagggccttcgccgacgacccttag

SEQ ID NO: 109667 - DNA, 3234 bp, Artificial Sequence
  Description of Artificial Sequence: Synthetic coding sequence
atggaacccaacgactcaaccagtaccgctgtagaggaacccgacagcctagaagtgctcgtgaaaactctcgacagtcagacacgcacattcattgtgggagcacaaatgaacgtgaaagagtttaaagagcacattgccgcgtccgtgagcattcctagcgaaaaacagaggctcatctaccagggtcgcgtgctccaggacgataagaagctccaagagtacaatgttgggggaaaggtgattcatctggtggaacgggcaccaccgcagacccacctgccctccggcgcgagctcgggcaccggttccgcatctgctacacacggaggtgggtctccaccaggcacccgtgggccaggcgcctccgtgcacgacagaaacgccaattcgtatgtcatggttggtacctttaaccttcccagcgacggctctgccgttgacgttcacataaacatggaacaggccccaatccaatccgaaccacgcgttcgactggtgatggcacagcacatgatcagagatattcagacgctcctctctcgaatggagtgtaggggcgggccccagccccaacacagccagccaccaccccagccccccgctgtcacacctgaacccgttgccctgtcctcacagacttctgagcctgtagaatcagaggccccacctcgcgagcccatggaagccgaggaggtggaggaacgggctccagcccaaaatcccgagctgacgcctggccccgcccccgccggccccaccccggcccccgaaaccaacgctccgaatcacccatcacctgcggaatacgttgaagttttacaggagctccagaggctggagtccaggcttcagccttttctccaaaggtattacgaggtactaggcgccgctgcaactacagattacaacaacaaccacgaaggccgtgaggaagatcagcgactgattaatctggtgggcgagagccttcgccttctgggaaatacatttgtcgccctgtcagatctgaggtgtaacctggcatgcaccccaccccgccacttgcacgtcgtccgccccatgtcgcactacacaacgccaatggtactgcaacaggcggctatccccattcagataaacgttggaacaaccgtgactatgactggaaatggaacgcgaccccccccaactccgaatgcagaagcacccccgcctggacctgggcaagctagctctgtcgcaccttcatccaccaacgtggaaagcagcgccgaaggcgccccacccccaggtcctgccccaccgccggcaacatcccatccccgggttatccgtatttcacatcagtcggtagaaccggtagtcatgatgcacatgaacattcaggactctggcacacagcccgggggcgtgccgtctgctcctactgggccactaggcccccccggacatgggcagaccctcggacagcaggtgcccggcttccctactgcccccacccgcgtggttatcgccagaccaactccaccacaggctcgaccatcccaccctggaggcccccctgtgtccggaaccctccagggggccggccttgggactaacgctagtctcgctcaaatggtgagcgggctggtgggtcagttgctaatgcagcctgtcctggtggcccaggggacccccggcatggcaccgcctccggcccccgccaccgccagcgcttccgccggcactactaacacagctactaccgccggcccagctcccggcggcccagcgcagccaccgcccaccccacagccctcaatggcagatctgcagttcagccaactgctcggtaatctgttgggcccggctggaccgggagccggtggtcctggtgttgcaagtcctacaattactgtggccatgcccggtgttccggccttcttgcagggaatgaccgacttcctacaggccacgcagacagctccaccccccccccccccccctcctcctccgccccccgctcctgagcagcagacaatgccccctccaggctcaccaagcggcggagctggaagtccaggtggactgggccttgaatcactctctcccgagtttttcacatccgtcgtgcagggagtgctttcttctctgctgggtagccttggggctagggcaggctccagcgagtctatcgccgcctttatacagaggctgtcagggtcctctaacatttttgagccaggcgcggacggcgctctgggcttttttggagccttgctgtcactgctgtgccagaatttttccatggtggacgtggtgatgcttctacacggtcacttccaacccctgcagaggctacagcctcagcttcgcagtttttttcaccaacattacctgggaggccaggaacccaccccgtccaatatccgaatggccacacacacgctaattaccggactggaagagtatgtacgggaaagctttagcctggtccaggtgcaacccggggttgatattataagaacaaatctcgagttcctccaagagcagtttaactcaatcgcagctcacgtcctgcactgtacagactccggattcggggctcgcctgttggaactgtgcaaccaaggcttattcgagtgcctggccttaaatctgcactgtttaggaggtcagcagatggagctcgcggcggtgattaatggcaggatcagacgaatgtccaggggcgtgaacccatctctcgtttcctggctgacaaccatgatggggttgagactccaggtggtcttagagcatatgcctgtgggacccgacgctatactgagatacgtccggcgagtgggcgatcctccacagcctttgcccgaggagcccatggaggtacagggagcagagagagctagccctgaacctcaaagggagaatgcgtctccagcacccggcacaactgccgaggaagccatgagtaggggcccaccaccagcccccgagggaggaagcagagacgagcaggatggcgctagtgccgagaccgaaccatgggctgccgcagtgccccctgagtgggttccaatcatccagcaagatatacagtcgcagagaaaagtcaagcctcagcccccgctgtctgacgcatatttgagtggtatgcctgcgaaacgccgaaagctcagaagcgatatccagaagaggctccaggaggaccccaattactccccacaacgctttcccaacgcccagagggcctttgctgatgacccctag

SEQ ID NO: 109668 - DNA, 2712 bp, Artificial Sequence
  Description of Artificial Sequence: Synthetic coding sequence
atggagcccaatgattccacgagcactgcggtggaggaaccagactctctggaagttttggtgaagacattggattcccaaacgcgaaccttcattgttggggcccagatgaacgtaaaagaattcaaggagcatattgccgcatctgtgtctataccatccgagaagcagcgattaatttatcagggccgcgtattacaggacgacaagaagctgcaagagtataatgtgggtggaaaggtgatccatctggtggagagagccccccctcagacccacctgccctcaggcgcttcgagcgggaccggcagcgctagcgccacccacggcgggggctctccacccggcacacgcggccccggtgcatcagtacatgaccgcaacgccaactcatatgttatggtgggcacctttaacctaccatcagacggctctgcggtagacgtacacatcaacatggaacaggccccgattcagagcgagcctagggtgaggctggtaatggcgcagcacatgattcgagacatacagaccctcctgagccgaatggagtgcagagggggtccacagccacagcacagccagccacctcctcagccgcccgccgttaccccagaacctgttgcactcagtagtcagacaagcgagcctgtagagagcgaagccccaccgagggaaccaatggaggcagaggaggtggaggaaagggcccccgctcagaatcctgaattgaccccagggcctgcaccagcaggtccgaccccagcccccgagacgaacgcgcctaatcatccatcacccgcggaatacgttgaggttctgcaggagctgcaacgcttggagtccagactgcagccttttctccagcggtactacgaggtgctgggggcagctgccacaaccgactacaacaacaaccacgaaggaagggaggaggaccaaagacttatcaacctcgtgggcgaatccctacgactgctcggcaacactttcgtcgctcttagtgacttgaggtgcaatctggcttgcacacccccacggcacctccacgtggtacggccaatgagccactacacaacacctatggttctgcaacaggcagctatccccatacagataaatgtgggcacaactgtaaccatgactggcaatggcaccagaccaccgcccactcccaatgcagaggcgcctcccccaggaccagggcaagcttctagcgtggctccatcctctacgaacgtggagtcctctgcagagggagcccctccgccaggccctgcacccccccctgcaacctcacacccaagggtgattcgcatctcccaccagagtgttgaacccgtcgtgatgatgcatatgaacatccaggatagtggtacacaaccggggggagtgccttccgctcctacaggcccattgggcccccccggtcacggtcagacattgggacaacaggtgccaggtttcccaaccgctcccacacgcgttgtcatagcgcgtcctaccccaccccaagctcggcctagtcatcccggaggcccacccgtgagcggcactttgggggctggcctgggtacaaacgcttccttggctcaaatggtctcggggctggttggtcagttactgatgcaacccgtgctggttgcccagggcacaccaggttctcctggcgggctaggattagagtctttatcacctgagttctttacctccgtagtccagggagtactgtcctccttattgggttcactaggggcacgcgctggatccagtgaatcaatcgccgctttcattcagaggctgtccggatcaagtaatatcttcgagcccggagctgacggggccctagggttttttggggcgttgctttctctcctttgccagaacttcagtatggttgacgttgtgatgctccttcacgggcactttcaacccctccagcggttgcagccacagctgagaagttttttccatcagcattatctgggaggccaagaaccaaccccatcaaatatacggatggcaactcacactttaataacaggcctagaggagtacgtgcgagagtcttttagcctggtccaagtgcagcccggcgtggacatcattaggaccaacttggaattccttcaggagcagttcaactccatcgccgctcacgtgctgcattgcaccgattctggattcggcgcacgcctcctggagctgtgtaaccaggggttgtttgagtgcctcgcccttaacctacactgcctgggcgggcagcagatggagctcgccgccgttattaacggtcggattcgccgcatgtctcgcggggtgaacccaagcctcgtaagctggttgaccaccatgatgggattgcggctgcaggtcgtgctagaacatatgccggtagggcctgacgcaattctgagatatgtacgccgggtgggcgatccacctcaaccccttcctgaggaacccatggaggtgcagggggcagagcgggcctctcccgaacctcaggaatgggttcctattatccagcaggacattcagagtcagcgaaaggtgaagccccagccaccactgagcgacgcctatctgtctggcatgcctgctaagagaaggaagctcaggagtgatatccaaaagaggttgcaggaggaccccaactatagtccgcagagatttcctaacgctcagagggccttcgcagacgacccgtag

SEQ ID NO: 109669 - DNA, 2712 bp, Artificial Sequence
  Description of Artificial Sequence: Synthetic coding sequence
atggaaccaaacgactccacctccactgccgtggaagagccagatagtctggaggtgctagtcaaaaccttggatagccagactcggacatttattgtgggggcacagatgaacgtcaaggagtttaaagagcatattgcggcatcggtgtcgataccgtctgagaaacagagattaatctaccagggccgagtgctgcaggatgacaaaaaactccaagaatataatgtaggtggtaaagtcattcatttggttgagcgcgccccgccgcagacgcacctgcccagcggagcttcctctggcacgggcagcgcttcagctacccacggcggaggcagcccacctgggaccaggggccccggagcctcagtacacgaccggaacgcaaattcatacgtgatggtcggaacgtttaatctgccctccgacggaagcgcagtggatgtccacatcaacatggagcaggctccaattcagagtgagccacgggtcaggctcgtaatggcccagcatatgatcagggacatacaaactctgcttagcaggatggaatgtcgcggtggccctcagcctcagcatagccagcctccccctcagccccccgctgtgactcctgaaccagtcgccctatcatctcagactagcgagcccgtggagagtgaagctccccctcgcgagcccatggaggctgaggaggtcgaagagcgcgcccccgcccagaatccagagctgaccccaggacctgcgccagcaggcccaacccccgcacccgagactaacgcgcctaaccatccaagccctgcggagtacgtggaagttcttcaagagctgcagagacttgagtctcgccttcagccttttctgcagcggtactatgaagtactgggagcagccgccactacagactacaataataaccacgaggggagagaggaagaccagcgactaattaatctggtgggtgaatccctgcgtttactggggaacacatttgtggcactatcagaccttcgctgtaacctggcatgcacgcccccacgccacctgcatgtggtccggccaatgtcacactatactactcctatggtgctgcagcaggccgccatacccattcagatcaacgtcggaacaacggttactatgacaggcaatggaacgcgcccaccccccacacccaacgcagaggccccaccgccggggccaggccaggcgagctctgtggcaccctcctctaccaacgtcgagtcgtctgctgagggagctccaccccctgggcctgctccacctccagctacaagtcacccacgcgtgattaggatctctcaccagagtgttgaaccggtcgtgatgatgcacatgaacatccaggactctggcacacagccgggaggcgtgcccagtgcgccaaccggcccactggggcctcccggtcacggacaaacactagggcagcaggtacctggatttcctactgcccctaccagggtcgtgatcgctagacctactccaccacaggctcgaccttcccaccctggcggaccgcccgtcagtggcacgctgggagccggactcggaactaatgcatctttggcacagatggtgagtgggctcgtcgggcagctgctgatgcagccggtgctggttgcacagggcacccccggctcacctggcggactagggttggaaagtttgagccccgagtttttcaccagcgtcgtgcagggcgtgttgtctagtctgctgggttccctgggggcacgagcgggctcatctgaatctatcgccgcattcatccagagactttccggcagttctaatatctttgagcccggagccgatggagcactgggcttttttggcgcccttctctccctgctttgccaaaactttagtatggtggatgtcgtgatgctcctacacggccacttccagcctctgcaaagactgcaaccccagcttaggagcttctttcatcagcactacttgggcggccaggaacctacgccctctaatatccggatggccacacacactctcataacaggtctcgaggagtacgtccgggaatcattcagcctcgtccaggttcaacccggcgttgacataatcagaacaaacctcgagtttttacaggaacagtttaacagcattgccgcgcacgtgttgcactgcaccgactccggattcggggcccggctgctggagctgtgtaatcagggactgtttgagtgccttgccctaaatcttcattgccttgggggacaacagatggagctggcggcagtaatcaacgggcggatcaggaggatgagcagaggcgtcaacccatctttggtgtcttggttgaccactatgatgggcctgaggctccaggtggtcctggagcatatgcctgtgggccccgacgccattctcaggtacgtgaggagggtaggtgacccgccccagccacttcctgaggaacctatggaagtgcagggagctgaaagggcatcacccgaacctcaagagtgggttccgataatccagcaggatatccagagtcagaggaaggtcaagcctcaacctcctctgtcagatgcttacctgtccggcatgccggctaagagacgtaagctgcggtctgacatccagaagagactgcaggaggaccctaattacagcccacagcggtttcccaatgctcagagggccttcgccgacgacccgtag

SEQ ID NO: 109670 - DNA, 3489 bp, Artificial Sequence
  Description of Artificial Sequence: Synthetic coding sequence
atggaacccaatgatagcacctcaacagctgtggaggaaccagattctctcgaggtacttgtaaagaccttggattctcagactcgtactttcatcgtgggggcccagatgaacgtgaaggaattcaaggagcatatagctgccagcgtgagcattcccagcgaaaagcaaagactgatttatcaaggacgcgtgctccaggatgacaagaaactccaggagtacaatgttgggggtaaagtcatccatttggtggagagagctcccccccagactcacctgcctagtggcgcaagtagcgggacgggctctgcctctgcaacgcacggcggaggaagtccacctggaactagaggccccggcgcttctgtgcacgacaggaatgccaacagctacgtaatggtaggtaccttcaatcttcccagcgacggcagcgccgtcgacgtccatattaacatggaacaggcgcccattcagtccgaacccagagtgagacttgtcatggctcaacatatgattagggatatccaaactctcctctctcgcatggaatgccgggggggacctcagccccagcacagtcaaccacctcctcagcctccggctgtgactccagagccggttgcgttatcatcccagacttccgaacctgtggagtctgaagcacccccacgcgagcctatggaagccgaagaggttgaggaacgcgcaccagcgcaaaaccccgaactgacccctggcccagcacccgccggaccaaccccagccccagagaccaacgccccaaaccatcctagcccagctgaatacgttgaagtgctacaggagctgcagcgactagagtcccgactgcagccattcctccagcggtactatgaggtactaggggcagccgctaccacggattacaacaataaccatgaaggccgagaggaagaccagcggctgattaacttggtgggcgagtcgttgcgattactggggaacacctttgtcgccctcagtgacctgagatgcaatctcgcttgtacccctccacgtcacctgcacgtggtgagacccatgtcccactacacaactcccatggttctacaacaggccgcgatcccaattcaaatcaacgtcggcaccacagttaccatgactggcaacggcacgcgacctcctcccacacctaatgccgaagctcccccacccggacccggacaggccagctcggtggcccccagtagcaccaatgtagaaagcagcgctgaaggtgcaccccctcctgggccagctcctcctcccgctacgtcccatccaagagtcattagaatttcccaccagtctgtggaacctgttgtgatgatgcacatgaacattcaagacagtggaacgcaacctggtggcgttccctccgcacctaccgggccccttggccccccgggccacgggcagactctaggatccaccctgatccaactcccaagcctgccaccagaatttatgcacgctgtcgcccaccagattacccatcaggctatggtagctgcagttgcctctgctgcagctggccagcaggtgcccggctttcccactgcccccacacgggtggtaatcgcgcgcccaacacctccccaagcccggccctcccacccaggcggcccgccagtgtccgggacattgcagggtgccgggctggggactaacgcgtccctcgctcagatggtttctggcctcgtgggtcagcttctgatgcagcccgttctggtagcacaagggacaccaggaatggcaccacccccggctccagccactgccagtgcttcagctgggactactaacacagccacgacagccggccccgcacctggaggtcccgctcagcctccgccgacaccccagccatccatggccgacctgcaatttagtcagctgctcggcaacctcttgggaccagcaggaccaggggccggaggatcaggagtggcctccccgacaatcacagtcgctatgccaggagttcccgcgttcctgcaggggatgacagattttctccaagcgactcagactgcccctccaccaccacctcccccaccccccccaccaccggcaccagagcagcagacgatgcctcccccgggcagcccttcaggaggcgcagggtcaccggggggtcttggcttagagtctctgtctcccgagtttttcacatccgttgttcaaggggtgctaagttccctgctgggctctctaggggcccgggccggttcatcagagtccattgccgccttcatacaacgcctgtcgggaagctcgaacatattcgagcccggcgccgatggcgccctgggttttttcggtgccctactgtcattgttgtgccaaaatttctctatggtggatgtggttatgctgttgcatgggcacttccaaccactgcagcggctgcagccacaattacgctctttcttccaccagcattaccttgggggccaggagcccaccccaagcaacataagaatggctacccacaccttgatcacgggtctggaagaatacgtaagggaatccttctccctggtccaggttcagcccggggttgatatcatcaggaccaatctggaattcctgcaggagcaatttaattccatcgccgctcatgtcctgcactgtacggattctggctttggggcgcggctgttagagctgtgcaatcagggattatttgagtgcctggccttaaatctccattgtctcggcgggcagcaaatggagctggcagccgttatcaatggcaggattcgacgcatgagccggggagtgaatccaagccttgtcagctggttgacgaccatgatgggtttacggctgcaggtggtattagaacacatgccggtaggaccggatgcgattctccggtatgtaagaagagtaggggaccctccgcagcctttgccggaggaaccaatggaggtccagggcgccgagagagcctcccctgaaccccagcgggaaaacgccagtcccgcgcctggaactacggcggaagaagccatgtcaagaggcccccctccagctcccgaaggaggaagtagagatgagcaggatggcgcatcggccgaaacagaaccttgggccgccgcggtgccaccggaatgggtccctatcatacagcaggacattcaaagccaaaggaaagttaagccgcagccacccctatctgatgcatatctgagtggcatgcctgctaaaaggagaaagacaatgcagggggagggtccacaattgctactttcagaggctgtcagccgggctgctaaggcagccggggcccgacccctcacatcacccgaatctctctctagggatttggaggctcccgaagtccaggagtcttataggcagcaactccggagtgatatccaaaagaggctgcaggaagatcccaattactctcctcagcggttccccaacgctcaacgtgcctttgccgatgatccgtag

SEQ ID NO: 109671 - DNA, 3489 bp, Artificial Sequence
  Description of Artificial Sequence: Synthetic coding sequence
atggaaccgaacgacagcaccagcactgccgtcgaggagcccgacagtctggaagtcctcgtaaaaactctggacagccaaacacgaaccttcatagtcggtgctcagatgaatgtgaaggaatttaaggaacatattgccgcctccgttagcatcccaagcgagaagcagcgcctcatttaccagggtcgcgtgctccaggacgataaaaaactgcaggaatacaatgtcggcggcaaagttatccatctagtggagcgcgcgcccccacagacacatcttcccagtggggcttccagcggcacaggctctgcatctgccacccatgggggaggatccccgcccggcaccagaggtccaggagctagcgtgcatgatagaaatgctaactcctacgtcatggtgggcactttcaacctgccctccgatggctccgcagtggacgtccacattaatatggagcaggctccaattcagtcagaacctcgagtgcggctggtaatggctcagcacatgattagagacatccagacattattgtctaggatggagtgccgcggaggcccacaaccacagcattctcagccacctcctcagcctccggccgtcactcccgagcccgtggcactgagctcgcaaacatctgagccggtcgaaagtgaggcccccccccgagaaccaatggaggccgaggaagtggaggaacgcgctcccgcacagaatcctgaattgacacctggacctgcccccgcaggacccacgcctgcaccggagacgaacgccccaaatcacccttccccggccgagtatgtggaggtcctccaggagttgcagcgcctggagtcaagacttcaaccttttctccaacgctactatgaagtgttgggagcagccgctactaccgactataacaacaatcacgaaggccgggaggaggaccagcggctaatcaatctggttggcgagtccctcaggctgttgggaaatacattcgtcgccttgtccgacctgaggtgtaatttggcctgcacgccaccacgccatttgcacgttgttaggcctatgagccactacacaacaccaatggtgctacagcaggctgccattccaatccagattaacgtaggcacgacagtcacaatgaccggcaacggaactcgccctcctccaactccgaacgcagaagcccctccaccaggcccaggtcaagcctcctccgtggctccctcctccaccaatgtcgagtcttcggccgagggtgctcctccacctggccccgcccctcctccagccacgtcacatccccgcgtgatacgcatctcacatcagtccgtcgaacccgtggtgatgatgcacatgaacattcaggactctgggactcagcctggaggcgtccccagcgcaccaactgggcctctcgggcctcctgggcacgggcagactttgggttcaacccttattcagctcccgtcactacctcctgagtttatgcacgcagtcgcacaccagattacacatcaggccatggtagctgccgtcgcatctgccgcagcaggacagcaggtgcccggctttccaactgctcctactcgggtcgttatcgcgcggcctacaccgccacaggctcgccctagccaccctgggggcccaccagtgtccggcactttacagggtgcagggctcggcactaacgcgtctctcgcccaaatggtctccgggcttgtggggcagttactgatgcagccagtcctggtcgcccaagggaccccgggcatggccccgcctccagcaccggcaaccgctagcgcaagcgccggaacaactaatacagccaccaccgccggccccgcaccgggtgggccagctcagccaccccctaccccacaacctagcatggcagacctgcagttttcccaactgctgggcaaccttctggggccggccggacctggcgctggcgggcctggcgtggctagccctacaataacggtggcaatgcctggtgtaccagcattcttacaggggatgactgatttcctgcaggcaacccagaccgcaccccctccacctccgcctcctccaccacctcctcctgcccccgagcagcagacaatgcctccaccaggcagccctagcggaggtgccggctcccccggaggacttgggttggaatcacttagcccagagttttttaccagcgtagtccagggggtcttgagcagtttgctaggttctcttggagcccgcgcaggctccagcgagagtattgcagcatttatccagagactcagcggatcctccaatatcttcgagccaggagccgacggggcactgggcttcttcggtgcattgctaagtctgttatgccaaaatttctcaatggtggatgtcgttatgctactgcatggacactttcagccactccaaaggttgcagccacagctgcggagtttttttcatcagcactacttgggaggacaggagcccactcctagtaacatacggatggccacccacacactaatcaccgggctggaagaatacgttagagagtccttcagtctggtccaggtgcaacctggcgtggacatcattagaacaaatcttgagtttctgcaagaacagttcaacagtatagccgctcacgtgcttcattgcactgactccgggtttggcgctagactcctggagctatgcaatcaaggattgttcgagtgtctggcactgaatctccactgcctggggggacagcaaatggagctagcagccgttatcaatggaagaatcaggaggatgtctcggggggttaacccaagcctggtctcatggctgaccaccatgatgggactccggttacaggtggttcttgaacatatgcccgtgggtcctgatgcaatcctgcgatatgtaaggagggtgggggatcctccgcagcccctgcctgaggaacccatggaggttcagggcgctgagagggccagtccagaacctcagagggaaaacgcctctcccgcgccggggactaccgctgaggaagctatgtctcgcggaccacctccggctcctgaaggcggatcacgcgatgaacaggatggcgcttccgcagagaccgaaccttgggctgccgcagttccgcccgaatgggtgccaattatacagcaggacattcagtcccaaaggaaggtgaagccgcagccccccttgagtgacgcctacctcagcggcatgccagccaagcgtcgtaaaacgatgcagggtgagggaccccaactcctgctgtccgaggcagtgagtcgggcggcgaaggcagccggagcgagaccgcttacctctcctgaatctctctcgagagacttagaggctcccgaagtgcaggagagttacagacagcagctgaggagcgacatccagaaaaggcttcaggaagatccaaactatagcccacaaagatttcccaacgcacagagagccttcgccgatgatccatag

SEQ ID NO: 109672 - DNA, 3489 bp, Artificial Sequence
  Description of Artificial Sequence: Synthetic coding sequence
atggaacctaacgattctaccagtacagccgtggaagaacccgactctctggaggtccttgtgaaaaccctagattcacagacaaggacatttattgtgggagctcagatgaatgtgaaggagttcaaagagcacatcgccgcctccgttagtatcccctcagaaaagcaaaggctgatctatcaagggagggtcttgcaagacgacaagaagttgcaggagtacaacgtgggtgggaaggtgattcacttggtcgaacgtgccccccctcagactcacctgcccagcggggccagttctggaactggcagtgcgtctgctacccatgggggaggctcacctccaggcacacgcggtcctggggctagcgtccacgatcgcaatgctaatagctacgtgatggtgggaacgtttaatttaccgagcgacggctccgctgtggacgtccatatcaatatggaacaggcacccattcagagcgagccaagagtgaggctggtgatggctcagcacatgatcagagacatccaaacactgttgagccggatggaatgccggggaggaccacagccgcagcactctcagcccccgcctcagcctcccgcagtgacccccgagcccgtagcactctcatcacagacctctgaaccagtggaatctgaagctcccccacgcgagcccatggaggccgaagaagtcgaagagcgggcgccagcccagaatcccgagctaacccctggcccagctcccgcgggccctacaccggcaccagaaactaatgcaccaaatcacccaagccccgccgagtacgtcgaggtgctgcaggagctgcagcgccttgagtctagactccagccgttcttacaacggtattacgaggtcctcggcgcagcagctacaactgattataacaataaccacgaaggccgcgaagaggatcaacggctaatcaacctggtgggggaatccctccggctcctcgggaacacctttgtggccctgagtgacctgcgatgtaatctggcttgtacccccccccgacatctccatgttgtccggcccatgagtcactacactaccccaatggtactacaacaagccgctatcccgatccagatcaacgttgggaccacagtaaccatgaccggaaatggaactcggccaccaccgacaccaaacgccgaggcaccaccccccggccccgggcaggcctcctctgttgctcctagtagtaccaacgtagaaagctcagccgagggggctcctcctccaggcccggcacccccacccgccacctcccacccgcgggtcatacggatcagccaccagtcagttgagcctgtcgtgatgatgcacatgaatatccaggacagtgggacccaacccgggggtgtcccctccgcaccaacaggaccattgggacccccaggtcatggtcaaacactgggcagcacgttgattcagctcccgagtctgccacccgaattcatgcacgcagttgcccatcagatcacccatcaagccatggtggcagcagtggcctctgctgctgctggccagcaggttccagggttccccacagcccccacgcgggtggtaatcgcacgccctacaccacctcaggccagaccttcacaccctggcggaccccccgtgagtggaactctccaaggcgccggtctgggaacaaatgcgagcctcgcccaaatggtgagcgggcttgtgggccagctgctcatgcaaccagttctcgtggcgcagggcacccctggaatggccccaccccctgccccggccaccgcttctgcaagcgccgggacaaccaacaccgcgactacagctgggcccgcacccggggggcccgcccagcctccacctactccccagccctctatggccgatctccagttctcacaactgctgggtaatctgctggggccagctgggcctggcgcgggtggatccggcgtggcctcgccaacaattactgtggccatgcctggagtgcctgcattcctccaaggcatgacagatttcctgcaggccacacagactgcaccaccccctcccccgccccccccacctccacctcccgccccagagcagcaaacaatgcctccccctggaagcccctcaggaggagccggttctccgggaggtctcgggctcgaaagtctgtcacctgaattcttcactagtgtcgttcagggggtgctatcttcacttctaggatctcttggggcgcgcgccggcagctctgagtccattgccgccttcatccagaggctctcaggctcatccaacatttttgaacctggagccgacggcgcactcggcttcttcggagcactgttaagcctactatgccagaacttcagcatggtcgatgtggtgatgctgttgcacggtcactttcagccactgcaaaggctacagcctcagctgcgctctttcttccatcagcattacctggggggtcaggaaccaaccccctcgaacatcaggatggctactcataccctcattacaggactagaagagtacgtgcgggagtcattcagcttggtgcaagtacagcctggagttgatattatcagaactaatctggaatttctccaggagcagtttaacagcattgctgctcacgttttgcactgcacggattccgggttcggggcgcgccttttggagttatgtaatcaaggcctgttcgaatgcctggctctcaacctccactgcctcggaggacagcagatggaactggctgcagtcatcaatgggcgaattcgtcgaatgagccgcggcgtgaaccctagtctggtctcatggctcacaactatgatgggccttagactgcaagtagtgctagagcacatgcccgtgggtcctgacgccatccttaggtacgttcggcgagttggcgatccaccacagcctctgcccgaagagccaatggaagtgcaaggcgcagagagggcaagtccagaacctcaacgggaaaatgcgagtcccgcacctggcaccacagccgaagaggccatgagcagaggcccccctccagcaccagagggagggagccgcgacgaacaagacggggctagcgccgaaacagaaccctgggccgccgctgtgcctcctgaatgggtccccatcatccagcaggatattcagtctcagcgcaaggtgaagccccaaccacccctctctgatgcttatctgagcggaatgcccgcgaagcgacgaaagacaatgcaaggggagggccctcagctgctcctctccgaagcagtgtcccgcgctgctaaggccgcaggcgccagacccctgacctctcccgagtctttgtcccgggatctggaagctcctgaggtgcaggagtcataccgtcaacaattgcggtctgatatccagaagagactccaggaggatccgaactacagcccccagcgatttcctaacgcccagcgggctttcgcggacgacccatag

SEQ ID NO: 109673 - DNA, 3234 bp, Artificial Sequence
  Description of Artificial Sequence: Synthetic coding sequence
atggagcccaacgactcaacaagtacagccgtcgaagagcccgattccctggaggtactggtcaagacactagatagtcagacccggacctttatagtgggtgcccagatgaacgtcaaggagttcaaagagcacattgccgcttccgtgtcgatcccatctgagaagcaacggctgatttatcaaggacgggtcctccaggacgacaagaaattgcaggagtacaacgtggggggtaaagtgatccatctggtcgaacgggccccaccccagactcatctccccagcggagcctcctctggcacagggtcggcctcagccacgcatggcggggggtcaccaccaggcaccaggggacctggcgcgagcgtacatgataggaacgccaatagttatgtgatggttggaacctttaacttacccagtgatggcagtgctgtggacgtccacattaatatggagcaagcacccattcaaagtgaacctcgtgtccgccttgtgatggcccagcatatgatccgggacattcagaccctgctctccaggatggagtgccgcggcggaccacagccacagcatagccaaccaccaccacagccccctgccgtcacgcctgaaccggtggcactgagctctcaaacaagtgaaccagtcgaatcagaggcacctccgcgtgaacccatggaggccgaggaggtggaagagcgggcacccgcccagaatcccgagctgactccaggtccggctcccgctggccctacaccggctcctgagaccaatgctccaaatcacccttcccccgccgagtacgttgaagtccttcaggaactccagcggttagaatccagactccagccattcctgcagcgctactatgaagtgttgggcgcagccgcgacaaccgactacaataataatcatgaaggacgagaagaagaccagaggctgatcaacttagtgggcgaaagtctacggctacttggcaatactttcgttgccctcagtgatctgcggtgtaatctagcctgtacaccaccacggcacctccacgtggtgcgtccaatgtcccactacaccacaccaatggtgcttcagcaagctgccattcccattcaaatcaatgttggcaccacagtgaccatgaccggtaatgggacccgcccccctccgactccgaatgccgaagccccacccccaggccccggacaggcaagcagcgtagcgccttcatccactaacgtggagagcagcgctgagggagctcctcctccaggccctgccccaccacccgcaacaagccaccctagagtaattagaatttctcaccaatcagttgagcctgtggttatgatgcacatgaatattcaggattcaggaacacagccgggcggggtgcctagcgcccccaccggccccctgggcccaccgggccatggccagacgctgggccagcaggtgcccggcttcccaactgcacccaccagggtcgtgatcgcgaggccaacccccccccaggcgcgcccctcccatccaggggggccacctgtctctggcacattgcagggcgccggattgggcactaacgcttctctggcacagatggtcagcggactggtcgggcagttactgatgcagccagtgctggtagcacagggcacacctggcatggctcctcctcccgccccagcaaccgcaagcgcgtcagcaggcacaaccaacacagccacaactgcgggacctgcacccggtgggcctgcccaaccgccacctactccgcagccaagcatggctgacctacaatttagtcagctactaggaaatcttcttggacccgccggtccaggggccgggggacctggtgtggctagccctaccatcaccgtggccatgccgggtgtgccagcgttcttacagggtatgactgacttcttacaggcaacccagactgctccacccccccctcctcccccgcccccaccacctcccgcccccgaacagcagaccatgccccctcccggcagtccatccggcggcgctgggtcccctggcgggctgggtctggagtccttgtcaccagagttctttacgtccgttgtccagggtgttctctccagcctcctgggcagcctcggcgcaagagctgggagctccgagagcatagccgctttcatccagcgcctgagtgggagtagcaacattttcgaaccaggtgcggacggcgccctgggtttctttggagccctcctatccctcttgtgtcaaaatttctctatggttgacgtggtgatgcttctgcatgggcatttccagcccctgcagcgcctccaaccccagctacggagcttcttccaccaacactacctgggtggacaggaacccacaccctccaatatccgtatggctacccacactttgatcacaggcctagaggagtacgtcagagagtcctttagtctagtgcaagtgcagccaggcgtggatataatccgcacaaaccttgagtttcttcaagaacaattcaacagcattgcagcccacgtgttgcactgcactgactctggctttggggcaagactgttggaactatgcaaccaggggctgttcgaatgtctggcgctgaacctgcactgtttagggggacagcaaatggaactcgctgccgttatcaatggtagaattcgcagaatgagtcgcggagttaatcccagtttggtgtcatggctaacaacgatgatgggccttcgccttcaagttgtgctggagcacatgccagtaggccccgacgcaatcctgcgatatgtgcgcagagtgggggaccccccacaaccactccctgaagaacccatggaagtccaaggggccgagagagccagcccggaaccacaacgcgagaatgctagccctgctcctggtacgacagccgaggaggccatgagccgcgggcccccgccagcccctgaaggcggaagcagggatgagcaggatggcgccagcgcggaaactgagccttgggctgccgccgttccaccagaatgggtcccaatcatccagcaagacattcaatctcagcgaaaagtgaaacctcagcctcctttatcagacgcctacttgtcaggtatgcctgcaaaaagacggaagcttcgctccgacattcagaagcgtctgcaagaggatccaaattatagcccacagagattcccaaatgcgcagcgagcattcgccgacgacccctag

SEQ ID NO: 109674 - DNA, 3234 bp, Artificial Sequence
  Description of Artificial Sequence: Synthetic coding sequence
atggagcccaatgacagcacatcgactgctgtggaagagccagacagtctcgaggtgcttgtgaaaacactcgactcacaaacaaggaccttcatcgtcggtgctcagatgaatgttaaagaatttaaggaacatatcgccgcctctgtctctatcccatccgagaaacagaggctgatttaccaggggagagtgctacaggatgacaaaaagctgcaggaatataatgtcgggggcaaggtcattcacctcgtcgaacgggcccctccacagacccacctcccatctggcgcatcttcgggtactggatccgcttccgccactcatggcggcggaagtccacccggaacgagagggcccggggctagcgtgcacgatcgaaatgcaaatagttatgtcatggtggggacatttaacctcccctccgatggttctgctgtcgacgtccatatcaatatggaacaggcccccatccagtccgagccaagggtccgcctggtgatggcgcagcacatgatccgagacattcagactctgctgtccagaatggagtgccggggcggtcctcagccacagcattctcaacctccacctcagccacctgccgtcacgcccgagccagttgccctgagtagtcaaacatccgaaccagttgaatccgaagcacctcccagagagcccatggaggcggaggaggtggaggagagggctccagctcagaaccccgaactcacacctggtcccgctccagctgggcctacccctgctccagagaccaacgcgcccaatcatccctcccccgccgagtatgtggaggttctgcaggagcttcaaagactcgagtccagactgcagcccttcctccagcggtactatgaagtattgggtgccgccgcaacgaccgattataacaataaccatgaggggagagaagaagatcaaagactgattaacctggtcggcgagtccctacgcttgctgggaaatacatttgtagcactgagtgacctgcgatgtaacctggcctgcaccccgcccaggcacttacacgtcgttcgccccatgagtcactatactacaccaatggtactccagcaggccgccatacccatacagattaatgtaggcaccaccgtgaccatgacaggcaacggcactagaccccctcctactcctaacgctgaagcccctccccctggcccagggcaggcttcatccgtggcgccatcaagcaccaatgttgagtccagtgctgaaggagcccccccccccggtccggcacctccccctgccacatcacatcctagagtcatcaggatttcacatcaaagtgttgagccagttgttatgatgcatatgaacatccaggacagcggaacccagcctgggggcgttcctagtgctccaactggacccttgggcccccccggtcacgggcagacactcgggcagcaggtgcccggctttcctaccgccccaactagggttgtgatcgcccggccaacacctccacaggctcgcccgagccaccctggtggccctccagtctctgggacgctccagggagctggactgggcaccaacgcaagcctcgcacaaatggtgtctggactggtgggccagctgcttatgcaaccagtgctcgttgcccaaggaaccccgggtatggctccgcctcccgctcctgccaccgcctccgccagtgcaggtacaaccaacactgccactaccgccggcccagcacccggcggtccagcacagcctccccctacacctcagcccagtatggctgacctgcagttctcccagctccttgggaacctgttaggccccgccggaccgggcgctgggggatctggagtggcaagccccacaatcactgtggcaatgccaggcgtgcctgctttcctccagggaatgacagattttcttcaagccacacagactgcccccccaccaccccctcctccgcctccccccccccccgcaccagaacagcagacaatgcctccaccagggagcccgtctggaggcgcaggttctcccggcggactcggtctggagagcctttctccagagttcttcacgagcgtggtgcaaggcgtcctgtccagtctgctgggctcactgggcgctagggctggctcctccgagagcattgccgcttttatccaaaggttgtcgggctcttcaaacatcttcgaaccgggtgctgatggtgctcttggtttttttggggctctacttagtcttctgtgtcagaacttcagcatggtagacgtggtgatgctcctccatggacattttcagcccctacagcgcttgcagccacagctgcgctcattttttcaccagcattacctgggaggtcaggagccaactccgtccaacataaggatggccacacacaccctgatcaccggtcttgaggagtatgtgcgtgagtcattctcacttgtgcaggttcagcccggggtggatataattcgtacgaacctcgaatttctgcaggagcagttcaattctattgctgcccacgtattgcactgcacagattctggattcggtgctaggttacttgaactatgcaatcaggggctgttcgagtgccttgccctcaatttgcattgcctgggcggccagcagatggagctggcggccgtgattaatgggcgaatccggcggatgtcccgaggcgttaatccatctctcgtttcctggttgacaacaatgatgggcctgcgcttgcaggtagtccttgagcacatgccagtgggaccagacgcaatactgaggtatgtcagacgcgtgggagacccaccgcagcctctccccgaagagcctatggaagttcagggcgcagagcgcgccagtcccgagccccaacgagagaatgcaagcccagcgcccggcacaaccgcagaggaggcaatgagccgggggccgccccccgcacccgaggggggcagcagagatgagcaggatggcgctagcgctgaaactgagccctgggcagcagcagtgcctcctgagtgggttcccatcattcagcaggatatccaaagccagaggaaagtaaagccccaaccacctttatcagacgcctatctgtcaggtatgcctgccaagcggaggaagctcaggtcagatatccagaagagactgcaggaggaccccaactactctccccagagattcccaaacgcccaacgagcttttgccgacgacccctag

SEQ ID NO: 109675 - DNA, 2712 bp, Artificial Sequence
  Description of Artificial Sequence: Synthetic coding sequence
atggaacccaatgatagcacatcaactgccgttgaagaacctgatagcctcgaggttctcgtgaagacactggacagccaaactcgcacattcattgtgggggcccagatgaacgtgaaggaattcaaggagcacatagcagcatccgtgagcataccgagcgaaaagcagcggcttatctatcaaggccgggtgttgcaggacgacaaaaaactccaggagtacaacgtgggcgggaaggtgatccatttagtggaaagagcccctccgcagacacatttgccgtccggtgcaagttctggaaccgggagcgcctctgccacccatggaggggggtctccaccaggaacccgcggacctggcgcgtccgtacacgaccgaaatgctaattcatacgtgatggtgggcacgttcaacctccccagcgacggttcagccgtagatgtccacataaatatggagcaggcaccaatacagtcagagccacgggttagactcgtaatggcccaacacatgatccgagatatccaaaccctgctgagcagaatggaatgcaggggcggtccacagccccagcacagccaacctcctcctcagcctcctgccgtgaccccagagcccgtcgcgctgagctctcagacttccgagcccgtggaatcagaagccccaccccgggagccaatggaagccgaggaggttgaggaaagggcccccgcccagaatccagagctcactccagggccagcccctgccggccctacaccggctccggagaccaacgctcccaaccacccctcccctgccgaatatgtagaagtgcttcaagaattgcaaagacttgaatcaaggctgcaaccttttctccagaggtactacgaagttctcggcgccgccgcaactactgactacaataacaatcacgaagggagagaagaggatcagcggcttattaatctcgtgggtgaaagtttgcgcttgctaggcaatacattcgtggccctgtccgatctgagatgcaaccttgcctgtacacctcctagacatcttcacgtcgttagacccatgtcacactacactacacctatggtgttacaacaagctgccatccccatccagattaatgtcgggacaacggttacaatgacggggaatggaacaaggcctccacctacacctaacgccgaggcacccccaccgggaccaggtcaagcatccagcgtagccccatcaagcaccaatgttgagtcctctgcagaaggagcaccacctccaggcccagccccccctcccgccacctcacacccaagggttattcgcatttcgcaccagtcagtggaacccgtggtgatgatgcacatgaatattcaggatagcggtactcagcctggaggggtgccttcagcacctaccgggcctctcgggccaccaggccacggacagaccctggggcagcaggtcccaggattccccaccgctcctacgcgcgtcgttatagcaaggccaaccccgcctcaggcccgtccttcccaccccggaggtcctcccgtgtccggcactctgggcgctggacttggcaccaacgcctcgcttgcccagatggtatcaggcctggtggggcaactcctgatgcagcccgtgctggtcgcccagggcacgcctggaagccccggcggtctcggcctggagtctctgtccccagaatttttcaccagtgtcgtccagggcgtactgagcagtcttctggggtcactgggagctcgggctggatcctccgagtccattgccgcttttatccaaagattgagcggctccagcaatatattcgagcccggtgcggatggcgcgctcggcttctttggcgcgctgctttctctgctctgccaaaatttctctatggttgatgtggtcatgttgctccacgggcactttcaaccgctgcagcgtttacagcctcaactgcggagtttcttccatcagcactacctggggggccaagaaccaactccctccaacattcggatggcaacacatacgctgatcaccgggttagaggagtacgtcagagaatcgttttcattggtccaggtccagcccggagtcgatatcatcagaaccaaccttgagtttttgcaagagcagttcaattcgatcgcggcacacgtgctgcactgcactgattctggcttcggggcgcgacttttggagttatgcaaccagggcctgtttgaatgtttggccctgaatctgcactgcctgggtggtcagcagatggaactcgcagctgtgattaacggacgaattcgccgaatgagtaggggagtgaatccctcccttgtctcctggctcactaccatgatgggtttgagattacaggtggtgctggagcatatgccagtaggccctgacgctatcttaaggtacgtccgccgagtgggagaccccccccagccgctgccagaagagcccatggaagttcaaggagcagaacgtgccagccctgagccccaggagtgggtgcctatcattcagcaggacattcagtcacagcgaaaggtaaaacctcaacctcctctctctgatgcctatctcagcggcatgccggcaaaacgccggaaactgcgaagtgacatacagaaaaggctgcaagaggaccccaactatagcccccagaggttccctaatgcccagcgggcctttgccgacgatccatag

SEQ ID NO: 109676 - DNA, 417 bp, Artificial Sequence
  Description of Artificial Sequence: Synthetic coding sequence
atgaaggaatactctgggtttgctggcgtgagccggcctcggggtactttctttaggattcggggtaggggccgggccagaggcgtctttgctggaaccaatactgggcccaacaacagtaatactaccttccaaaagcgacccaaagaagaggagtgggaccctgagtatactcccaagagcaaaaaatacttcttgcatgatgatcgcgatgacggggtcgattactgggccaagaggggcagaggaagagggacatttcagcggggccgaggccgatttaattttaaaaaatccggcagtagcccgaaatggacacacgacaaataccagggcgacggcattgtcgaagatgaagaggagactatggaaaataatgaggagaagaaggacaggcggaaagaggaaaaagagtag

SEQ ID NO: 109677 - DNA, 2610 bp, Artificial Sequence
  Description of Artificial Sequence: Synthetic coding sequence
atgggtaggagtaactcacggtcgcattcatcacgctcaaagtctcggtctcaaagctcatctagaagtagaagtcgctcccactcccggaaaaaaagatatagatcccgaagtcgaacatacagcaggtccagatctcgagacaggatgtactcccgggactataggagagattacaggaacaaccggggaatgcgcaggccatacgggtacagggggcgcggcaggggatattaccaaggaggcgggggtcggtaccacagaggaggctaccgtcccgtgtggaaccgaaggcactccagatccccgcggagaggtaggtcgcggtctagaagccctaaacgaagatcagtgtccagccagcgctctagatctcggagtaggagatcctacagatccagccgctcgcctagatctagcagtagcaggtcctcctccccatattcgaaatccccagtgtcgaagagaagggggtcccaggagaagcagacgaagaaggctgagggagagccccaggaggaaagtccccttaaaagtaaatcccaagaagaaccaaaggacacattcgagcacgacccttctgaaagcatagatgaattcaacaagtcctcagccacatcaggggatatctggccgggcctgagcgcttacgacaattccccgagatcaccgcactccccatcaccaattgccacgcctccatctcagtcgtcctcttgttctgacgcccccatgctcagtacggtgcactcagccaagaacactccctcacagcatagccatagcatacaacatagcccagagagatcaggctcaggtagcgtggggaacggaagctctcgatacagcccgagccagaatagtcctattcaccacattccaagtcggaggtcccccgcaaaaacaattgctccacaaaatgccccaagggacgaatcgagggggcggtccagcttctatccggatggaggcgaccaggagacagccaaaactggtaagtttctaaagcgcttcactgatgaagagagcagggtttttctactggatcgagggaatacaagggataaggaggccagtaaagaaaagggatcagaaaaaggtagggctgagggcgaatgggaggaccaagaagctctggactatttcagcgacaaggagagcggaaagcagaaattcaacgattcagagggagacgacacggaagagaccgaggattaccgacagttcaggaaatccgtgttggcagaccaaggaaaatcttttgctactgcgtcacacaggaatacagaggaagaaggcctcaaatataagagcaaagtgtccctaaaaggaaatcgcgagagtgatgggttcagggaagaaaaaaattacaaactgaaagagactggctacgtggttgagcgcccatcaactacgaaagacaagcataaggaggaggataagaactcagagcggataacggtcaagaaggaaacacagagtcctgaacaagtcaagagcgaaaaacttaaagatttatttgattatagtccccccctacacaaaaatttagacgctcgggagaagtctacattcagggaggaaagccccctgcgaatcaagatgatcgcatctgattctcaccgacccgaggtgaagctgaagatggcacctgtgcctctggatgattcgaacagacctgcttcattgaccaaagataggctgctggctagcacccttgttcactctgtgaagaaagagcaggaattcagatcgattttcgatcatatcaagctgccacaggccagcaagtcaacttctgagtctttcatccaacacatagtgtcgctagtccaccacgtaaaggagcaatatttcaagagcgccgcgatgaccctcaacgagaggtttacatcataccagaaggccacagaagagcactcaactcggcaaaagtctcctgagatccatagaaggatcgacatcagtcccagtaccctcagaaagcataccaggctggcgggggaagagagggtctttaaagaagagaatcagaagggtgacaagaagctgcgctgcgacagcgccgatcttcgccacgatattgatcggcggcgtaaagagcggtctaaagagcggggggactcgaaggggagccgagagtcttcaggctcccgtaagcaggagaagacccccaaagactacaaggagtataagtcttacaaagacgacagcaagcacaagagagaacaagatcacagtcgctcctcctccagctctgccagccccagcagcccgagtagtagagaggaaaaggagagcaagaaagaacgcgaggaggagtttaaaacgcaccacgaaatgaaggaatattctggctttgctggcgtgtcaagacctagaggaactttccatgacgaccgggatgacggagtcgactattgggctaagcggggaaggggccggggtacctttcagaggggaagagggcgctttaatttcaagaagtctggaagtagtcctaagtggacacacgacaagtatcaaggagatggaatagtagaagatgaagaggagactatggaaaacaacgaggagaagaaggatcgtcgaaaggaggaaaaagagtag

SEQ ID NO: 109678 - DNA, 2610 bp, Artificial Sequence
  Description of Artificial Sequence: Synthetic coding sequence
atggggaggtctaactcgcgaagccactcctctcgcagcaagagccggagccaatcaagctctaggtctagatcccgaagccattctcgcaaaaagcgttatcgatctcgatctagaacatactcacggagccggagtagagaccgcatgtactcgcgcgattacaggagagactaccgaaacaatcgtggtatgaggagaccctatggatacagaggtaggggtcggggttactaccagggaggtggtggtagatatcatcgtggtggataccgacccgtgtggaacaggcgccacagccggtccccacggcgcggacgctctagaagtcgcagcccaaaaagaagatccgtcagcagccagcggagtcggtcacggagtcgacgctcctacagaagcagccgctccccacgatcttctagctcccgctccagtagcccatattccaagtcgcccgtgagtaaaaggaggggcagtcaggaaaagcagaccaaaaaagctgaaggagaacctcaggaagagtcccctctgaagtccaaaagccaggaagaaccaaaagacacctttgaacatgacccttctgagtccatcgacgagttcaacaagagcagcgcgacgtccggcgatatttggccgggcctttccgcctacgataattcccccaggtctccgcattctccctctcccatagccacccccccctctcagagcagcagctgctctgacgcacctatgctatccacggtgcatagtgcaaaaaacacccctagtcagcactctcactctattcagcactcacctgagagatcgggttcaggaagtgtcggcaatggttcatccagatactccccttctcagaatagcccgatccaccacatccccagccggaggtctcccgcgaaaacaattgcccctcagaacgccccccgcgacgaaagcaggggtcggtcatctttttatcccgacggcggggaccaggagacggcgaagaccgggaagttccttaaacgattcaccgatgaagaatccagagtgttcctgctcgatagaggcaatacccgagacaaggaagcctctaaggagaaaggctctgaaaagggtcgtgctgagggcgagtgggaggaccaggaagctctggattatttctccgacaaagagtcagggaagcagaagttcaatgacagtgagggcgacgataccgaagagacagaagactaccgccaatttcggaagtccgtcttggcggatcaaggaaagtctttcgcaaccgcctcccatagaaacacggaggaggaagggctcaaatataagagtaaggtttccctgaaagggaaccgtgagtcggacggatttagggaggagaagaattacaaactgaaagaaactgggtatgttgtggagcgcccgagtactactaaggataagcacaaggaggaggacaagaattcagagcgcattactgtgaagaaagaaacccagtccccagaacaggtgaagtcggagaaattgaaagacctatttgactacagccctccacttcacaaaaatttggacgctcgggaaaaatctactttccgcgaggaatcgcccctgagaatcaaaatgatcgcatctgacagccaccggccggaagtaaagctcaagatggctcccgtacctctggatgactctaatcgtccagcatctcttactaaagaccggctgcttgcatcaactcttgtacattcagtaaagaaagaacaagagtttagatccatctttgaccacattaaactgccccaagctagcaaatcgacctccgagagtttcatccagcatatcgtttcactggtgcaccacgtgaaggaacaatactttaagagtgccgctatgacacttaatgagcgcttcacaagctaccagaaggctaccgaggagcactccaccagacagaagtcccccgagattcaccggaggatcgatatctccccgtcaacactacgaaagcacacgaggctggccggggaagagagggttttcaaggaggaaaaccaaaaaggagacaaaaagttgcggtgtgactccgctgatctgagacatgatatcgaccgcaggcgtaaagagcgaagtaaagagcggggcgatagcaagggcagcagagagtccagcggatctagaaagcaggaaaaaacacctaaggattacaaggagtacaagtcctataaggatgactctaaacacaaaagagaacaggaccactctcgcagttcgtcttcttctgccagccctagctctccgagctccagggaggagaaggagtctaagaaggagcgagaggaggagttcaagactcaccatgagatgaaagagtacagcgggtttgcaggggtgagtcgaccgcgagggacatttcatgatgacagggatgatggggtggactactgggccaaacggggccgaggtcgtggcacttttcagaggggaagaggtaggttcaattttaaaaagagcggcagtagcccgaagtggactcatgacaaataccagggcgatgggatcgtcgaggatgaagaggagaccatggaaaataatgaggaaaaaaaagacaggcgtaaagaggagaaggaatag

SEQ ID NO: 109679 - DNA, 2757 bp, Artificial Sequence
  Description of Artificial Sequence: Synthetic coding sequence
atgggcaggtccaactcccgctcgcactcttcgaggtcaaagtctaggagccaaagtagctcacggtctaggagcagatcccacagcaggaagaagcgctataggtccaggtccaggacgtactcaagaagccggagcagagaccgaatgtatagcagagattataggcgggattatagaaacaacaggggaatgagacgtccatacggataccgtgggcgaggtcgcggctactatcaaggaggcggcggcaggtatcatcggggggggtatcgccccgtgtggaacaggcggcacagtaggtcaccccggcgagggcgatccagatcccggtcccccaaacgacgaagcgtctctagccagcgctctcggtctaggtctaggcggagttacaggtcaagcagatctcctcggagctcctcaagtaggagcagttccccttacagcaagagcccggtatctaaaagaaggggttcccaggagaaacagacaaaaaaggcagaaggcgaacctcaagaggaatctcctttgaaaagcaagtcacaggaagagcccaaggacacctttgagcacgacccctcggaatccattgacgagttcaataaatccagtgcgacgtctggagatatttggcccggcctctctgcatacgacaatagccctcgttctccccactcccctagcccaatcgccaccccaccaagccagagctcttcctgtagcgacgccccaatgctgtctaccgtccacagtgctaaaaacaccccctctcagcatagccacagcatccagcatagtcccgaacgatctgggagcggctctgttggtaatggctcttcgcgatactctccttcacagaacagtcccattcaccacatcccatcaaggagaagtccagctaagactatagctcctcaaaacgcccctagggatgagtcgcgcgggcgttccagtttctatccggatggaggcgatcaggaaactgccaaaacaggtaagttcctgaagcgctttaccgatgaggaatcacgagtgtttctactggaccgagggaacactagagacaaagaggcctcgaaagagaagggtagtgagaagggccgggccgagggtgaatgggaggatcaagaggcattggattacttttcagataaggagtcgggcaaacagaaatttaacgattctgaaggcgacgacaccgaggagactgaagactaccggcagtttaggaaaagcgtactggcagaccaaggcaaatcctttgctacagcttcccatcggaataccgaagaggaagggctgaaatacaaaagtaaggttagcctgaagggaaacagggagtcagacgggtttcgggaggaaaaaaattataaactgaaggagaccggctatgtcgtagagcgacccagtactaccaaggataagcataaagaagaggataagaacagcgagaggattaccgtgaaaaaggagactcaatcccccgagcaggtaaaatctgaaaaattaaaggatttgttcgattattcccccccattgcataaaaacctggacgcgcgggagaaatctacctttagggaggagagcccactacgcattaaaatgattgccagtgattcccacaggcctgaggtcaagctgaagatggccccggtgcctctggatgatagtaacagaccggccagtctgactaaggaccggctcctagcttccacattggtgcactctgtgaagaaggagcaggaattccgctctatatttgatcatattaagctgccccaggcctctaaatcaacaagcgaaagctttattcagcacatcgtatctctggtccaccatgtgaaagagcaatacttcaaaagtgcggcgatgacattaaatgagcgattcacctcttaccagaaggccacagaggagcatagtacgagacaaaagtctcccgaaattcataggcgaattgacatcagtccatctacgctcagaaagcacacccgcctggccggggaagagagagtatttaaggaagaaaatcagaaaggcgacaaaaaactccgatgcgattctgcagatctacgacacgacatagatcgaaggcgaaaagaaagaagcaaggagaggggagatagcaagggctccagagagtcctcgggctctaggaagcaagagaagactcccaaagactataaagaatataaatcatacaaagacgacagcaaacataaacgggagcaagaccacagtcgatcatcctcttcttcagcctccccctcaagtccttcatctagagaggagaaggagtcgaaaaaggagcgagaagaggagtttaaaactcatcatgagatgaaagaatattccggctttgccggagttagtcgtccgcgaggcaccttcttccgaatccggggaagggggagagccaggggggtgtttgcggggaccaacactggcccaaataactcaaacacaacatttcaaaagcgacctaaggaggaagaatgggaccctgagtacacccccaaaagcaagaagtattttctgcacgatgatcgagacgatggtgtagactattgggcgaagcgaggccgagggaggggaacattccaaaggggacgcggccgattcaacttcaagaagtctggcagctcccctaagtggacccacgataagtaccaaggggatgggatcgtggaggatgaagaggaaactatggaaaacaatgaggaaaagaaggatagacgtaaggaagagaaagagtag

SEQ ID NO: 109680 - DNA, 2244 bp, Artificial Sequence
  Description of Artificial Sequence: Synthetic coding sequence
atgggtaggtcaaatagtcggtctcactcttctcggagcaaatccagatctcaatcaagcagccggtctaggtccaggtctcattcccggaagaaacggtattcctctcggtcacgcagtcgtacctatagtagatcacgctctagggacaggatgtatagtcgggactacagacgagactatagaaacaatcgcggtatgaggcggccttatggctaccgcggacgggggcgcgggtactatcaaggaggtggaggccgataccatagagggggatacagaccggtgtggaacaggaggcatagtcgcagtcctagacgcggtcgatcacgtagccggtcacctaagcgacgctctgtcagctcccagcgctcaaggagccggtctcgccgttcataccgctcatcaagatctccacgttccagctctagcagatcatcatccccctacagtaagtccccggttagcaagcgcagaggcagccaggaaaagcagacaaaaaaagcagaaggggagccccaggaagaatccccgctcaaatccaagagccaagaagagccaaaagatacttttgagcatgacccatcagagagtattgacgagtttaacaagagtagcgcaacctctggtgacatatggcccggactgtctgcttatgacaatagcccccggtctcctcattctccaagtcctattgcaacgcccccaagtcagtccagttcatgcagtgacgcccctatgttgtcgaccgtgcattctgccaaaaatacaccaagtcaacactcccattccatccaacattcaccggaaaggtccggctctgggtcggtgggcaacgggtcgagtaggtatagtccttcccagaacagcccgattcaccatatcccatctcggagatctccagctaaaacaattgcaccacagaatgcaccgcgagatgagagcagaggcagatcgagcttctatcccgacggcggagatcaggaaaccgccaaaaccggtaaattcctcaaatcaccaccacttcacaagaaccttgacgcacgcgagaagagcacattcagagaggaatcaccgctcaggataaaaatgatcgcctcagatagccataggcctgaggtgaagcttaagatggcccctgtccctctggacgacagcaaccggcctgcctcactcaccaaagaccggctgcttgcttctacccttgttcactcagttaaaaaggaacaggagttcaggtccattttcgaccatattaagttaccacaggcatcgaagtctacatccgagtctttcatacagcacattgtgagcttagtgcaccatgttaaagagcagtactttaaaagcgctgccatgacacttaatgagagattcacctcgtatcaaaaagctaccgaggagcactcgactcgacagaaaagccccgagattcatcgccggatcgacatcagtcccagcacgctgagaaagcacactaggctggcaggggaagagagggtgttcaaggaagaaaaccagaaaggcgacaaaaaactgaggtgtgacagtgctgacctgaggcatgatatcgaccgcagacggaaagagcgcagtaaggagagaggtgactctaagggctcacgtgaatcttcaggatcacgaaaacaggagaaaactcccaaggactacaaggagtataagtcctacaaagatgacagcaagcacaagcgtgaacaggaccactcccggtcaagttcttcatctgctagcccctcctctccatctagcagagaagaaaaggaatcaaagaaagaacgcgaagaagagttcaaaacccaccatgagatgaaggaatattctggtttcgcgggtgtgtccagacctcgcggaactttcttcaggataaggggccgcggccgggcacggggagtcttcgctgggacaaataccgggcccaacaactcaaacactaccttccagaaacggcccaaggaagaagagtgggacccagagtatactccaaaatccaagaagtactttcttcatgacgaccgggacgacggagtggattattgggcaaaacgaggtaggggcagggggaccttccagcggggcagggggagattcaatttcaaaaaaagcggaagttccccgaagtggacgcacgacaaatatcaaggcgacggcatagtagaagacgaagaggaaaccatggaaaacaatgaagagaagaaagacaggcgcaaggaagaaaaagaatag

SEQ ID NO: 109681 - DNA, 2763 bp, Artificial Sequence
  Description of Artificial Sequence: Synthetic coding sequence
atgggcagatcaaatagccgctctcattcttccaggagtaagagccgctctcagagctcctcaagatcacggagtcgctcccatagccggaagaaacggtattcatcacggagtaggagcagaacttacagtcgttccaggtcacgggaccggatgtatagccgggattaccgaagggattacagaaacaatcggggaatgaggcggccctatggctatagaggcaggggccggggatattaccaaggtggggggggccgctatcatcggggaggctatcggccggtgtggaacagaaggcactctcgatccccccgccggggccgttccaggagcagaagccccaagcgcaggtcggtttcttctcaacgcagtcggtccaggtcccggagatcttataggagcagtagatcccctcgttcctcttccagccgatcgagtagtccttattctaagtcacccgtgtccaagaggcgcggaagccaggagaaacagacgaaaaaggcagagggtgagccgcaggaggaatctccactgaaatccaagtcccaggaggagcctaaggatacattcgaacacgatcccagtgagtcgattgatgagttcaataaatctagtgcgactagcggggacatttggcctgggctgtccgcatacgacaactcacctcgtagcccccatagcccctcacccattgcaactccccccagccagagcagcagttgctccgatgcaccaatgctctccaccgtgcattctgcaaaaaacaccccctcacagcactcccactctatccagcactcccccgaacggtccggcagtggttcagttggcaacggctccagccggtatagtccatcacagaacagccccattcaccatatccccagtcgcaggagtcctgccaaaacaattgctcctcagaacgcccccagggatgagtcaaggggccgcagctcattctaccctgacggaggcgaccaggaaacagcgaagaccggcaagttcctcaaacggttcaccgatgaagagtcccgtgtttttctgctcgacagaggcaatacccgtgataaggaggcaagcaaagaaaaaggcagcgagaaggggagagcggaaggagaatgggaggaccaggaagcactggactacttttccgacaaagaatctggtaagcagaagtttaatgatagcgagggtgacgatacagaggaaaccgaagactaccggcaatttcgcaaatctgtcctcgccgatcaaggtaagtccttcgctacggcaagtcacaggaacactgaagaagagggactgaaatacaaaagcaaagtgtcgctgaaaggtaatagagagagcgacggctttagagaggagaaaaattacaagttaaaggaaactggatacgtggtggagcggcccagtactacaaaagacaaacataaagaggaagacaagaattccgagaggattaccgtgaagaaagagacacaatcccccgagcaggtgaagagcgagaagttaaaggatttgtttgattatagcccaccactgcacaaaaacttggatgcccgggagaaaagcacgttcagggaagagagtcctctgcggatcaaaatgattgcctctgactcacacaggcctgaagtgaaacttaaaatggcacctgtacccttagacgattcgaatcgaccggcatccctgacaaaagatcgcctcttggcctctacactggtgcactctgttaagaaggagcaggaattcaggtctatcttcgatcatattaagttaccccaggcatccaaaagtacctccgaatcgttcatccaacacattgtgagcctcgttcaccacgtcaaagaacaatattttaaatcagccgccatgacgctcaacgagagatttacttcctatcaaaaagccaccgaggaacactccactagacaaaagagccccgagattcacagaagaatcgacatttccccgtctaccctgagaaagcacacccggcttgcaggcgaggaacgcgtgtttaaagaagagaaccagaagggggacaagaaactgagatgtgattctgccgatctgagacatgatatagatcggcggaggaaggagagaagtaaagagcggggggatagtaaaggaagcagagagtcatctggatccagaaagcaagaaaagacacctaaagactacaaagagtataagtcatacaaggatgactccaagcataaaagggagcaagaccatagtcgctcttcgagttctagtgcaagtccatcaagtccgtcgtcacgagaggagaaagagtctaaaaaggagagggaggaggagtttaagacccatcatgagatgaaggaatatagtggctttgctggtgtgtcgcgacctaggggtacattctttagaatcagaggtcggggccgggccagaggtgtgttcgctgggactaatacagggccaaataacagcaataccacttttcagaagagaccgaaggaggaggaatgggacccagagtatactcctaagtctaaaaaatattttctacatgatgatagggacgacggagtggactactgggctaaaagagggcgtggccgtgggacttttcagcgcggcagaggaagatttaactttaaaaaatcgggtagctcaccgaagtggacccatgataaataccagggcgacgggatcgtggaagacgaagaagagactatggagaacaatgaggagaaaaaagaccgccgcaaggaagagaaggagtag

SEQ ID NO: 109682 - DNA, 531 bp, Artificial Sequence
  Description of Artificial Sequence: Synthetic coding sequence
atgggtcgccctgctggccttttccctcctctgtgccccttcctaggatttagaccagaggcctgttgggaacgccacatgcagattgaaagggccccttcagtgccaccttttctcagatgggcaggttacaggcctgggcccgtgagaaggagggggaaagtggagctcatcaaattcgttcgcgtacagtggcgtcggcctcaagtggagtggcgcagaaggcgctggggccccggaccgggggcctcgatggctggttccgaggaactggggctgcgtgaggatacactgagggttctggcagcctttcttagaagaggggaggccgccgggtctcccgtacccactccacctaggcctagctatagccggttgctttgcttcggtgggcccgccgccggaacagctggcccgagggccgctgaaatttctgcccagccaaggattaccggaagccccatcgacagagaggggagccacacagcagaggccggaggacctgctggcggaggcggacggagccattag

SEQ ID NO: 109683 - DNA, 1005 bp, Artificial Sequence
  Description of Artificial Sequence: Synthetic coding sequence
atgggccgtccggctggcctcttcccccctttgtgtccctttctgggattccggccggaggcctgttgggaaagacatatgcagatcgaacgagctcctagtgtgccaccatttctccgttgggccgggtatcgtcccggtcccgtgagacggcggggcaaggtggagttgatcaagttcgtacgcgtacaatggagaaggccccaggtggaatggcgaagaaggcggtgggggccaggacccggtgcatccatggcaggtagcgaggaactagggctgcgtgaggatacattgagggtgctcgcagccttccttcggaggggcgaagcggcagggtcacctgtcccaacacctcctagatctcccgctcaagaggagccaaccgattttctgtctcgcctgcgcaggtgtctcccttgctcactgggccgcggcgccgctccatccgaaagcccgcgcccttgctcgttaccgatcagaccatgttacggcctggaacccggtcccgccacgccagacttttacgccctcgtcgctcagaggctggagcaactagtccaagaacagcttaagagccccccgtcacctgaacttcagggacctccctccaccgagaaggaggcgatcctgcgaagactggttgcactgctcgaggaagaagcagaggtgataaaccagaagctcgcgagtgatcccgcactacgcagcaagctggtgagactatcatcggatagcttcgctcggttggtcgagctcttttgtagccgagacgattcaagtcgaccaagccgggcctgtcccggacctcctccccctagtcccgagcccctagctagactcgccctggcaatggagctatcgcgacgggtggctgggctgggcggcacgctggcgggcctaagcgtcgagcacgtccactcttttacaccctggatacaagctcacggtggctgggagggtatccttgcagtgtctcccgtggatctcaacttaccccttgactag

SEQ ID NO: 109684 - DNA, 1002 bp, Artificial Sequence
  Description of Artificial Sequence: Synthetic coding sequence
atgggtcggcctgctggattgtttccccccctgtgcccttttcttggatttagaccagaggcatgttgggaaagacacatgcagatcgagcgcgctccttcagttcccccttttctaaggtgggccggttacaggccaggccctgttcggaggaggggaaaggttgagttaatcaaatttgtgcgagttcagtggaggaggccacaagtggaatggaggaggcgcaggtggggcccgggccctggggcctcgatggccggcagcgaggaactcgggctaagagaggacacactccgagtcctggcagcatttcttcgacggggcgaggccgccgggtctcccgtgcccactccacccagtcctgcgcaagaagaacccactgacttcctctccagactaagacgctgcctgccatgttcgctagggcgtggcgccgcaccgtctgaatcaccacggccgtgtagcctgccaatacgcccctgctacgggctggagccagggcctgctactcctgacttctacgctctagttgctcagagactcgagcaactggttcaggagcagttaaagtccccaccatcgccagagttacagggcccccccagtaccgagaaagaagcgatcctgaggcgcctggtggctctcttggaggaagaggcagaggtgattaaccagaagctggcttctgacccggcactgagatcaaaactagtccgtctctcgagtgactcctttgcaaggctcgtagagctcttctgttcgagggacgacagttccagaccctcgcgcgcctgccctggacccccccctccaagtccagaacccttagctaggctggctttggcgatggagctttctcggagagtagccggcttggggggaaccctcgctggcctgtccgttgagcatgtgcactcctttacgccgtggatccaggctcatggtgggtgggaggggatcttagccgttagccctgtagacctcaacttgccactggattag

SEQ ID NO: 109685 - DNA, 5166 bp, Artificial Sequence
  Description of Artificial Sequence: Synthetic coding sequence
atgttgagtgcaactcccttatacggaaatgtgcactcttggatgaatagcgaaagagtccgaatgtgtggcgcatctgaagaccgcaagattctcgttaatgacggcgatgcctcaaaagcccgcctagaactcagggaagaaaacccgctgaaccacaacgtggtcgacgccagcaccgcgcataggatagacggtcttgctgcactgtctatggacaggacgggcttaataagagaaggtttaagagtcccagggaacatcgtttattcctcgctgtgcggtttgggaagcgaaaagggtcgggaggccgccacgagtaccctcggcggactggggttcagcagcgagaggaatccagaaatgcaatttaagcccaacacgcccgagactgtcgaggcgtctgccgtgtctggcaaaccacccaacgggttcagtgctatctataaaacaccacctgggatacaaaagtccgccgtcgccactgctgaggcactcggcctcgaccggcccgctagcgacaagcagtcacccctaaacatcaatggggctagctaccttaggttaccttgggtaaatccatatatggagggggccacacccgctatctatccgttcctcgactccccaaacaagtactcactaaacatgtataaggcattgctgccccagcagtcatattccctcgcccagccgctgtactctccggtgtgcacaaatggagagcgattcctgtaccttcctcccccccactacgtaggcccacatatcccaagctcgctggcgagccctatgaggctgtcgacaccatccgcctcacccgctatccccccactggttcactgcgcggataaaagtctcccatggaagatgggcgtgagccccggtaaccctgtagatagtcacgcttacccccatatacaaaatagcaagcaaccccgggtgccctctgccaaagccgtaacaagcggattgcccggggacacggctctgctcttgcccccaagtccacggccaagcccacgagtgcacctgcccacccaacctgccgccgatacgtattcggaatttcacaaacactatgctcggatcagcacaagccctagtgttgcgctgagcaagccgtatatgacagtcagctcggagttcccggccgctcgcctgtcgaacggcaagtaccctaaggcccccgagggcggcgaaggtgcacagcctgtgcccgggcacgcccgaaagactgccgtccaggaccgcaaagacggaagtagtccacccctgctggagaaacagacagtcacaaaagacgtcaccgataagcctctggatcttagcagcaaggtcgtggacgtagacgcatcaaaggccgatcacatgaagaagatggctcctactgtgttagtgcattccagggctggctctggtctggttctaagtggaagcgagattccaaaagaaacactctcccctccgggaaacggatgcgcaatatatagatcagagataataagcactgcaccaagtagctgggtggtcccaggaccctccccgaacgaggagaacaacggcaaatctatgtcgttaaaaaataaggcactggattgggctatcccccagcagcggtcttctagctgcccgagaatgggggggacagatgcggtgatcaccaacgttagtgggtctgtgtccagtgcgggaagaccagccagcgccagtcccgctcctaacgccaatgcagacggcactaagacatctcgctcctctgttgaaaccacgccgtctgttattcagcacgtgggccaaccaccagctacgcccgccaaacactcgagtagcacctctagtaaaggagctaaggcgtctaacccagagcctagtttcaaagccaacgagaacgggcttcccccttcttctatttttctgagccccaatgaggcttttaggtcccctcccatcccatatccccgaagctatttaccttatcccgcacctgaaggaatcgcagtttcccctctgtctctgcacggcaaaggcccagtgtacccacaccccgtcctgcttccgaacgggtcactgttccccgggcacctggcaccgaagcccgggctcccatacggacttccaaccggccgccctgaatttgtcacataccaggatgccctaggtctgggaatggtgcaccctatgttgatcccccacactcccattgaaatcacaaaggaagagaagccagagcggcggagtagatcacacgaacgggcccgctatgaggatccgacactgaggaacagatttagcgaaatcctggagactagctcaacgaaactgcatcccgacgttcctaccgacaaaaacctgaaaccgaatcctaactggaaccagggcaagaccgtggttaaaagcgataagctggtgtacgtggacctgctgcgcgaggagcctgacgccaagacagataccaacgtgtcaaagccttcctttgcggctgagtctgtcggacagagtgccgagccacctaaaccctctgtggaaccagcattacagcaacatagagatttcatagctttgcgcgaggagctcggccgtatctctgacttccacgagacctacaccttcaaacagccagtcttcaccgtcagtaaggatagtgtacttgccggcaccaataaagaaaatctcggactgccggtgtctactccttttctggagcccccccttggctctgacggacccgctgtgaccttcggaaagacccaggaagaccccaagcctttttgtgtcggaagcgcacccccctccgtcgacgtcacacccacatatacaaaggatggagctgatgaggccgaatcaaacgatggcaaggtcttgaagcccaagccttccaaactggccaagagaatcgcgaactctgccggttacgtgggagaccgatttaagtgcgtgacgaccgaactctacgccgacagctcgcagttgtccagagagcaacgagccttacagatggagggcctgcaggaggactctattctgtgtttgccggctgcatactgcgagcgcgcaatgatgagattctccgagttagagatgaaagaacgggagggaggccatccagcaacgaaagacagcgaaatgtgcaaattttcccctgccgattgggaacggcttaaggggaaccaggataagaagcccaaaagtgtaaccttagaagaggccattgccgaacagaatgaatctgaacggtgtgagtattcagtgggaaacaagcacagggatcctttcgaggcccctgaagacaaggacctgcctgtggagaagtactttgtggaacgtcagcccgtcagcgagccgccggcggaccaggtcgcaagcgatatgccgcacagtcccactctacgcgttgatcgcaagcggaaagtgtcaggcgatagcagtcacacggagaccacagcggaagaagtacccgaggaccctttgctgaaagcaaagcggcgaagagtatctaagggcctgcaccctaagaagcagcggcatttactccatttacgcgaaagatgggagcagcaagtatcggccgccgatggcaagcccgggcggcagagtaggaaagaagtcacccaggccactcagcccgaagccatccctcaggggaccaatattacagaggaaaaacctggtcgaaaacgcgcagaagccaaagggaaccggtcatggtcggaggagtctcttaagccctctgacaacgagcagggcttgccagtcttctctggctcaccccctatgaagagccttagcagcacttccgctggtggcaagaaacaagcccagccgtcctgcgccccagcatctcgccccccagcgaagcagcaaaagatcaaggaaaatcagaagacagacgtgctctgtgccgacgaggaagaggactgtcaagctgccagcctgttacagaaatatactgacaattcagagaagccaagcgggaaaagactctgtaagaccaagcatctaattccacaggagagccgtagaggcttgccactgaccggggagtattacgtggagaacgctgatgggaaagtaactgtccgacgatttcggaagcggccagagccatctagcgactacgatttatcccctgctaaacaggaaccgaaacctttcgaccgcctgcagcagttactccccgcatcccagtcaacacagctgccatgcagcagctcaccacaggagaccacccagtcccgccccatgccaccagaggctaggagactgattgtgaataaaaatgctggagaaactctgctgcagcgtgcagctcgcctggggtacgaagaggttgtgctctactgtctggagaataagatctgtgatgtaaaccacagggataacgcaggctattgcgccctacacgaggcttgcgccagaggttggctcaacatcgtgagacacctgctggaatacggagcggacgtaaactgctccgctcaggacggcactaggccactccacgatgccgtggagaacgatcatctggaaatagtacgcctcctacttagctatggagccgacccaacactggccacctatagtggacggaccataatgaaaatgacccattcagagctgatggagaagtttctgaccgattatctgaatgacctgcagggtcgcaacgatgacgacgcttctgggacatgggatttctacggatcttctgtgtgtgaacccgacgacgaaagtggctacgacgtattagccaatcctcctggacctgaagatcaggatgacgatgacgacgcctactccgacgtgtttgagtttgagttctccgaaacccccctgttgccctgctacaatattcaggtatcagtcgctcaagggcccaggaactggttactgctgtcagacgtgttaaaaaagctcaagatgtcttcaaggatcttccgttgcaacttccccaacgtggagatcgtgactattgcagaggctgagttttatcgtcaggttagtgcttccctgctcttctcatgctctaaagatctagaggcctttaaccctgagagcaaggagctgttagatttagtggaatttacaaacgagatccaaactctgcttggcagctccgtcgaatggctgcatccgtctgacttggcttcagacaattattggtag

SEQ ID NO: 109686 - DNA, 5268 bp, Artificial Sequence
  Description of Artificial Sequence: Synthetic coding sequence
atgctgagtgctactccactgtacgggaatgttcacagctggatgaacagtgagcgggtgcggatgtgtggcgcttctgaagacagaaaaatactggtgaacgatggcgacgcttccaaggcccgtctggagctaagagaggaaaatcccctgaaccataacgtagtggacgcttctactgcccacagaattgatggcctcgcagccctgagcatggacaggacaggcctgatacgagagggactgcgagtgccaggcaatatcgtgtactcttcactctgcggcctgggatcagagaagggacgcgaggcagcaacatctactttggggggcttgggcttttctagtgaacggaatcccgaaatgcagtttaagccgaatacgccagaaacagtggaggcctctgccgtttccgggaagcctcctaacgggttctctgccatctataagacgccccctggcatccagaaatctgctgtggctacagcggaagctctagggctggatcggccggctagcgataaacagtcacctcttaacatcaacggggccagttacctgcgtctgccttgggtgaacccctacatggaaggtgctacccctgccatctatccatttcttgactctcctaataaatactctttaaatatgtacaaagcactgctgccgcagcagtcctactccctcgcccaaccactgtactcacccgtgtgtacgaacggagaaaggtttttgtacttgccaccccctcactatgtcggcccccatattccttcttccttggcctctcccatgagactaagcaccccgagtgcgtcccctgccatcccaccgttggtgcactgtgcggataagagcctaccctggaaaatgggggtctcacccgggaacccggtggacagtcatgcttatcctcatatccagaacagtaaacagccaagggttccgtccgcaaaagcagtgacctctggcctacctggagatactgccctgctgttgccaccatccccccgaccatctcccagggttcatttgccaacccagcctgccgcagacacatatagcgaatttcacaagcattacgccaggataagcacaagccccagtgttgctctatccaagccgtacatgaccgtgtctagtgagtttcccgcagctcgcctgtccaatggaaagtacccaaaggctccggaagggggcgagggtgcgcagccggtgcctggccatgccagaaaaactgcagtgcaagatcggaaggacggctcttcaccacccttacttgagaagcagacggtcacaaaagacgtaacggataaacccctggatctgtcctccaaggttgtcgatgtggacgcaagcaaggcggatcacatgaaaaaaatggccccgaccgtgctcgtgcatagccgagccggatcagggctggtactttcaggctctgagataccaaaggagaccttgtcaccccccgggaatggctgcgcaatctacagatccgagattatctccaccgcaccatcaagctgggttgttccaggcccctcccccaatgaggaaaataacggtaaatctatgtccctgaagaacaaggccctcgactgggcaatcccacaacagcggagctctagctgcccgaggatgggcggcactgatgccgtgatcacaaatgtgagcgggagtgtatcctcagccggtagacccgctagcgcaagcccagccccgaacgctaacgccgatgggacaaaaacctcaaggagcagcgtggagactaccccctcagtcattcaacatgtgggccaaccgcccgcaactcctgccaagcactcttcctcgacttcctccaagggggccaaagcttccaatcctgagccctcctttaaggctaatgagaacggcctgccgccttctagtatctttctctctcctaacgaggcttttcggagccccccgatcccgtaccccagaagctatctcccttatcccgcgcctgaggggattgcagtgtcacctctcagccttcacggaaagggtcctgtctacccgcacccggtcctccttccaaacggtagtctgttccctgggcacctggcgcctaagcctggcctaccttacggccttcctacggggcggcctgagtttgttacttatcaggacgctttgggactagggatggtacacccaatgctgataccccacacgcccattgagattacaaaggaagagaagccagagcgacgaagccgaagtcacgaaagggccaggtacgaagacccgaccttgagaaaccggttctccgagatcctggaaacttcatccacaaaactacatcctgacgtaccaacagataaaaatctcaaacccaaccccaactggaatcagggaaaaacagtggtgaaatctgacaagttagtctacgttgatctcctgagagaagagcctgacgcgaaaacggacaccaacgtgagcaaaccttctttcgcggccgaaagcgttggccagtcagccgagcctccaaagcctagtgtggagcccgccttacagcagcatcgagactttatcgctcttcgtgaggagctcgggcgaatcagcgatttccacgaaacgtatacgttcaagcaaccagtgttcaccgtgagtaaggacagcgttctggccgggacaaataaagaaaatctcggcttacccgtttctacgccatttctggagccccctctcggtagcgacggacctgctgtgacatttggcaagacacaggaggaccctaaacctttctgtgtgggaagtgccccacccagtgtggatgtgaccccgacatataccaaagatggcgccgatgaagctgagagcaacgacggaaaagtccttaaacccaaaccctcaaagttggccaaaaggatagcaaatagcgctggatacgttggggacagatttaaatgcgttactaccgagctctatgcggattctagccaactgtctcgggagcagagggcactgcagatggagggattacaggaagacagtatactctgcctcccagcagcatactgtgagcgcgctatgatgcggttcagcgagttggagatgaaggagagagaaggagggcatccagccactaaagattcagagatgtgcaagttctctcccgctgattgggagcggctaaaggggaaccaggataaaaaaccaaaatccgtgacccttgaagaggcaatcgccgaacagaatgagagcgagagatgtgagtacagcgtggggaataagcacagagaccctttcgaggcgcccgaggataaagatctccctgttgaaaagtactttgtcgaaaggcagcccgtgtccgagccacctgccgaccaggtggcctcagatatgccccacagccccacactgcgggtcgatcggaagcgcaaggtaagcggagacagctcccacacagagactaccgcggaagaagtgccagaggatcccctcctgaaagccaagcggaggagggtgagcaaggacgattggccggaacgtgagatgacaaactcttcctccaaccacctggaggacccgcactacagtgaactgacaaacctaaaagtctgcatcgaacttacagggctgcaccctaagaagcagcgacatctgctgcacctccgcgaaagatgggaacagcaggtgtcagcagcagatgggaaacccggccgccagtccaggaaggaagtgactcaggctacgcagccagaagccatcccacagggcactaatataactgaggagaagcccggcagaaagcgggcagaagctaaagggaaccgcagctggagcgaggagagcttaaaacctagcgataatgagcagggtctgccagtcttctcgggtagcccgccaatgaaatccctctcctctaccagtgcagggggtaaaaagcaagcacagccttcttgcgcaccagcgagccgccctcctgctaaacaacagaaaatcaaggagaatcagaagacggacgtcttgtgtgccgatgaggaagaagattgtcaagcggcatcccttctccagaaatataccgacaatagcgagaagccgtccggaaaacggctgtgcaaaaccaaacacctgattccgcaggagtcccggaggggcctaccccttactggcgaatattatgtggaaaacgcggatggaaaagttacagtgcgccgtttccgcaagagacccgaaccttcttccgactatgatctgtcaccggccaagcaggagccaaaacctttcgataggctacaacagctgctccccgcaagtcagagcactcaactcccttgcagctcatcccctcaggaaacaacgcagtcccgccccatgccccccgaggcaagaagactaattgtcaacaaaaatgcgggagagacgctgttgcagcgggcagccaggctgggatatgaggaggttgtcctgtactgtttagagaacaaaatatgcgatgtgaaccatcgcgacaacgctgggtattgcgctctgcatgaggcctgcgcaaggggctggctgaacatcgttcggcacctgctagagtatggggcagatgttaattgttcggcacaggatggtacacgcccactgcatgacgcagtggagaatgatcatctggagatcgtgcgcctattgctgagttacggagcggaccctacgttagctacctacagcggcagaacgattatgaaaatgacccactccgagcttatggagaagttcctgacagactatctgaacgacctccagggcaggaatgacgatgacgccagtggcacctgggatttctatggtagctccgtttgtgaaccagacgacgagagcggatatgacgtactcgcgaatcccccaggacccgaagaccaagacgatgacgacgatgcctattctgatgtcttcgagtttgagttctctgaaactcctcttctgccctgctacaatatccaggtgtcagtggctcaagggccaaggaactggttactgttgtccgacgtgctgaagaagcttaagatgtcatcccggatcttccgctgcaactttccgaacgtcgaaattgtgactattgccgaggcggaattctataggcaagtgtctgcgtcccttttgttttcctgttctaaggatctggaagccttcaacccggagtccaaagaactgctggatttagtggaatttactaatgagatccaaacacttctgggaagcagtgtggagtggttgcaccccagcgacctggcctctgacaattactggtag

SEQ ID NO: 109687 - DNA, 5112 bp, Artificial Sequence
  Description of Artificial Sequence: Synthetic coding sequence
atgctgagcgccactcctttgtatggaaacgtacactcctggatgaattcggaacgcgtgcgaatgtgcggggcaagtgaggaccgaaagattctagtgaatgatggtgacgccagcaaggcgaggttggaactcagggaggagaatcctctgaatcacaatgtggtggacgccagcacggctcatcgcattgatggccttgctgccctttccatggacaggacagggctgatacgcgagggcctccgcgtcccaggcaatatcgtgtatagctctttgtgcggcttgggatccgaaaagggccgggaagctgctactagtactctgggagggctggggttctctagtgagaggaatcctgagatgcaatttaagccgaacacacccgaaacagtagaggccagcgcagttagcggcaaaccacctaatggtttcagcgcaatttacaagacgcctccgggcattcagaagtccgcggtggcgacagccgaggccttgggactggatcggcctgcctctgataagcagtcgcccctgaacattaatggggcttcctatttaaggctcccgtgggtaaatccgtacatggaaggtgccacacccgcgatctatccattcctcgattcgccaaacaaatatagcctgaatatgtacaaagcgctgctacctcaacaatcatacagcttagctcagcccctgtacagcccggtgtgcaccaacggagagagattcctctatctgccccctccacactacgtggggcctcacatcccatcatcgttggcaagtccaatgcggctctcaaccccatcagccagtcctgctatacccccccttgtgcactgcgcggataaatccctcccttggaaaatgggagttagcccgggaaatcctgtggacagtcatgcatacccccatatccagaattcaaagcagcctcgtgtgccttcggcgaaagccgttacctcaggactgccaggagacacggctctgttactcccgccaagcccccggccttcccctagggtgcaccttccaacacaacccgcggcggatacctacagtgaattccacaagcactatgccaggatcagcacatccccgtctgttgctctttcaaagccttacatgacagtgagttctgagtttcccgccgctagactgtcaaatggtaaatacccgaaagctcctgagggaggggagggcgcccagcctgttccaggacacgcgagaaagacagccgtccaagacagaaaagacggatcctcaccacctctactcgagaaacagaccgtcacgaaagatgtgaccgacaagcccctcgatttgagcagcaaggtcgtcgatgtagatgcctcaaaagcggaccatatgaagaagatggcacctacagtgcttgtccacagtcgagctggttcagggctcgtgttgtcagggtcagaaatccctaaagagacgctgtcaccacccggcaatggttgtgcgatctatcggagtgagatcatcagtaccgctccaagctcctgggtcgtgcctggcccttccccaaatgaagagaacaacggaaaatcaatgtcacttaaaaacaaggcgctggattgggcgataccacaacagaggagcagtagttgccctcgtatgggcggcacagatgcagtgataaccaatgtctcgggatctgtctcctcagcgggtaggcccgccagcgcctccccagctccgaacgccaacgcggacggaacaaagacatctcgcagttcagtcgaaacgacccctagtgtgattcagcacgtggggcaacctcccgccactccggccaaacactcgagctccaccagttccaagggggcaaaggcttccaacccagaaccatccttcaaagcaaatgagaatggactacccccatcatctatattcctgtctcccaatgaggcgtttcgatctcctcctataccttacccccgaagctatctgccctatccagcacctgaggggattgccgtcagcccactgtcattacatggtaagggacccgtgtacccacatcctgtgctactgcctaacgggtcccttttccccggccacctggccccgaaacctggactgccatatgggctgcctaccgggcgccccgagtttgtcacctatcaggacgcccttggcttaggcatggtacatcctatgttgattccgcatactcctatcgagattacgaaggaagaaaagcccgagcggagatctcgctcacacgaacgggcaaggtacgaggaccctactcttagaaatcgatttagcgagattctcgagacctcctccactaaacttcatcccgacgtccctacagataagaacttaaaacccaatccaaactggaatcaggggaaaacggtcgtcaagagtgataagctggtatacgtagacttactgcgggaggagccagacgcgaagactgacaccaacgtctccaagccatcctttgccgccgaaagcgtcggccagtcggccgagccgcccaagcctagcgtggagcccgctctgcagcagcaccgcgatttcatcgcccttagagaggaattggggaggatttccgacttccacgagacctatacctttaagcagcctgtattcaccgtgagcaaggattccgtactggctggcacaaataaagaaaatctgggcttgcccgtttcgacacctttccttgaaccccccttgggctccgatgggccagccgtcactttcgggaaaactcaggaagaccctaagcctttctgtgtggggtctgctcctccttccgtggacgtcaccccgacctacaccaaggacggggcagatgaagccgagtcaaatgacggcaaagtcctcaagcctaagcccagtaagctcgccaaacgcattgctaatagtgcggggtacgtgggcgatcggttcaagtgcgtgaccaccgagctgtatgcggattcctcccagcttagtcgggaacaaagggctcttcagcgggccatgatgagattttcggagcttgaaatgaaagagagagaaggagggcacccagccacaaaagatagcgagatgtgcaagttttctccggccgactgggaaagactgaagggcaaccaagataaaaaacccaaaagtgtgacgctcgaggaggccatagctgaacagaacgaaagcgagaggtgtgagtattctgtgggaaataaacatagggatccgtttgaggcgcccgaggacaaggatttgcccgtcgagaagtattttgtggagcggcaacctgtctctgaaccgcctgctgaccaggttgcctcagacatgcctcacagtccaacactacgagtggaccgaaagcggaaagtgagtggcgattctagccacactgaaaccacggctgaggaggtgccagaagaccccctgctgaaggctaagaggcgacgggtgagcaagggcctgcaccccaaaaaacagcgtcatctgcttcacctgcgggaaagatgggaacagcaagtgagcgccgcagacggcaagcctggccggcaaagccggaaggaggttacccaggccacacagcccgaagctattccccagggaacaaacatcaccgaagaaaagccgggtaggaaaagggcagaagctaaaggtaacagaagctggtcagaggaaagcctgaaaccctcagataatgagcagggtctgccagtgttttccggaagccctcccatgaaaagcctctcatccacctcagcggggggcaagaagcaggcccaacctagctgcgcccctgcctcaagaccacccgctaaacagcagaaaatcaaagaaaaccagaagaccgacgtgctttgcgccgacgaggaggaggactgtcaggccgccagcctcctgcaaaagtacacggataattctgaaaagccatcgggtaaacgcctctgcaagaccaagcatctcatccctcaggagagccggcgagggctcccactcacaggcgaatactacgtggaaaatgcggacggtaaggtgacagttcgtagatttaggaagcgtcccgagccatccagtgattacgatctgagcccagcaaagcaggaacctaaaccattcgatcggcttcaacagttgcttcccgcatcccaatctacacaactaccttgctccagctctccacaggaaacaactcagagtcgccctatgccaccagaagcccggaggctgatcgtcaataagaatgccggggagacgctgcttcagcgagcagcccgtttagggtatgaagaagtggtcctctattgcctggagaataagatatgtgatgtcaaccatagggacaacgccggatattgcgcgttgcatgaagcctgcgcccgcggatggctcaacatagtaaggcacctgctcgagtatggtgctgatgtgaattgcagcgcccaggacggcacccggccccttcacgatgccgttgagaatgaccacctggagatagtgagacttctgctgtcctacggggctgatccgacactcgccacctacagtggccgcaccatcatgaaaatgacccactcagagttgatggaaaagttcctgaccgactacttgaacgatctccaaggcagaaatgacgatgatgcctctggtacatgggacttctacggcagtagtgtgtgcgaacctgacgacgagagcggatatgacgtcttggccaatcctcccggccctgaagaccaagacgacgatgatgatgcctacagtgacgtttttgaattcgagttttcggaaacacccctactgccctgctacaatatccaggtttcagttgctcaggggccacgtaactggctgcttttgtccgatgtcctgaaaaagctgaagatgtctagccggatttttcgctgcaatttcccaaatgtcgagatcgtcaccatcgccgaggcagagttctatcggcaggtatctgcatccctcctattctcatgcagcaaagacctggaagctttcaatcctgagtcgaaagagctccttgatctggtggagttcacaaatgagatacaaacattattgggcagttctgtggaatggctacaccccagcgacttagctagcgataactattggtag

SEQ ID NO: 109688 - DNA, 1869 bp, Artificial Sequence
  Description of Artificial Sequence: Synthetic coding sequence
atgcctcactctcctacactacgtgtcgatcggaaaaggaaggtctccggagactcatcccacacagagacaacagcagaggaggtcccagaggaccctcttcttaaggccaaaaggcggcgagtgagcaagggcttacacccaaagaaacaaaggcatttattgcaccttcgtgagcgctgggaacagcaagtaagcgcagctgacgggaaaccaggcagacagtctagaaaagaggtgactcaggccacccagccggaggccatcccccaaggtacaaatattacagaggagaagccgggaaggaagagagcagaagctaaagggaataggtcttggagcgaagagagtcttaaaccctctgacaatgaacagggactgccagtcttctccggcagccccccaatgaaatccttgtcaagcacaagcgcgggcggtaaaaagcaggcacagccctcatgtgctcccgcttcccggccacctgctaaacagcagaagattaaggagaatcagaaaaccgacgtgctctgtgcagatgaggaggaggattgccaggccgccagccttcttcagaagtacactgacaattctgagaagccttcggggaagcgactgtgtaaaactaaacacctgatcccacaagaatctcgtagggggctgccactgacaggagagtattatgttgaaaacgccgacggaaaggttacagttcgcagatttagaaagcgccctgaaccgtctagtgactacgatctgtcgcccgccaaacaggaacctaaaccatttgaccggttacagcagttgttgcccgcatctcagtccacgcagctgccctgctcaagcagcccccaagagactacacaaagtcggcccatgccccccgaggcccgcaggttaatagtgaataaaaacgcaggcgagaccctcctgcagcgagctgcaaggctggggtacgaagaagtcgtactgtactgcctcgaaaacaagatctgtgatgtgaaccatcgtgacaatgccggatactgcgccctgcatgaggcctgcgcccgcggctggctgaacattgtgagacatttgctcgaatacggagctgacgtgaattgcagcgcccaggacgggactagacccctccatgacgctgtggagaatgatcacctggaaatcgtgaggctgctgctatcatacggcgccgacccaacactggccacttactcagggcggaccataatgaagatgacacattcagaactgatggagaaatttctgaccgattacttgaatgatctgcagggtaggaacgacgatgacgcctctgggacctgggacttctatgggtcgtctgtgtgtgagcctgacgatgagagcggctatgacgtactggccaatccaccgggccccgaagaccaggatgatgatgacgatgcttactctgatgtgtttgaattcgagttttcagaaaccccactgctgccttgctataacatccaagtctccgtcgcacagggcccccgcaactggctcttgctttccgatgtcctaaagaagctaaaaatgagctcgagaatatttaggtgtaactttccaaacgtggaaatcgtcaccattgctgaagccgaattttaccgtcaagtcagcgcctccctcctgttcagttgcagcaaggaccttgaagctttcaatcctgagtccaaagaactcctcgacctggttgaattcaccaacgaaattcagactttactgggcagctctgtggaatggctgcacccaagcgacctcgccagcgacaattactggaaatcaccgcagattgcacgcggcagcgtggaaggtaagaagacagacgacaagacttccaagaccgatctctag

SEQ ID NO: 109689 - DNA, 5166 bp, Artificial Sequence
  Description of Artificial Sequence: Synthetic coding sequence
atgctttcggcaacccccctgtacggcaacgttcactcgtggatgaactctgagcgagtgaggatgtgcggtgcatccgaggaccgcaagattctagtgaacgatggagatgcttcgaaggcgcgcctggaacttagggaggagaacccactgaaccataacgtcgttgatgcaagtactgctcatcggatagacggccttgcggccctgagtatggaccggacgggacttattcgtgagggcctgcgagtaccaggcaacattgtgtattcttcgctgtgtgggcttggttcagagaagggccgcgaggcagccaccagcacactgggaggcctcggcttctcctccgagcgtaacccagagatgcagtttaaacctaacactcccgaaactgtggaggcgtccgccgtttctgggaaacctcccaacggtttctcagctatctataagacaccccctggcatacagaagagcgctgtggcgacagcagaggctctggggctcgaccgccccgcaagcgacaagcagtcacctctgaacattaatggcgcgtcatacctgagacttccatgggtgaacccatacatggagggggccacccctgccatctacccttttctcgacagcccgaacaaatatagcctgaatatgtataaagctctattgccacagcaatcttacagcttagctcagcctctctactcgcccgtttgcactaatggtgagcgctttctgtacctgccgccccctcattacgtgggcccccatattccttcttcgctggctagccctatgagactatccaccccaagcgcgtctcccgcaattcctcctctggttcattgtgctgacaagagcctgccatggaagatgggggttagtcctggcaaccctgttgactcccacgcatatccacacatacagaactccaaacaacccagggtgccatcagcgaaagctgtcacatctggactccctggcgacaccgccctcttgttgcccccatcccctcgccctagtccaagggtgcacttgccaacacagccagccgctgacacctattccgaattccataaacactatgctcgaatttctactagcccctccgtcgcactctccaaaccatacatgaccgtgtcttcagaatttccagccgcccggctcagcaacgggaaatatccgaaagctccagagggcggcgagggtgctcaacctgtccccgggcatgctcggaaaacggccgtgcaagacaggaaggacgggtcttccccgccactcctagaaaagcagactgttacaaaagatgtgaccgataagccactagacctgagcagcaaggtggtggatgtggatgctagcaaggcagatcatatgaagaagatggcgccgactgtgttggtccatagccgcgccgggtcaggtctggtgctgtcaggctccgaaattccaaaagagacactatccccgcccggaaatggctgcgcgatctaccggtccgaaatcatttccactgccccaagttcatgggttgttccggggccctcccctaacgaagagaataatggaaaatccatgagcctgaaaaataaggcattggactgggctatccctcagcagagatcttccagttgccctagaatgggagggaccgacgccgtcattactaatgtgtctgggagcgtctcaagtgctgggcgccccgcttcagcgtctcccgcgcctaacgcaaacgcagacggcactaaaacctcccggtctagcgtcgaaacaaccccgtcagttatacagcatgtgggtcagccccccgcaaccccagctaagcacagttcgtcaacgtccagcaagggtgccaaggccagtaatccagagccatctttcaaggcgaatgagaatggtctcccaccatcctctattttcctgtcgcctaatgaggcttttcggtcgccgcccatcccctaccctcgctcttacctgccttaccccgctccagagggcatagctgtgtctcctttgagtctccatggaaaggggccggtatatccccacccagttcttctgcctaacggttctctatttcccggacacctggcccccaagcccggccttccctatggtctcccgacggggagacccgagttcgttacgtaccaggatgctttaggcctggggatggtgcacccgatgctgatcccccacacccccatagagattactaaagaggagaaaccagaaagacgcagcagaagccatgaaagagcgcgttacgaggatccgacgctgcgtaatcgctttagtgaaatcctggagacctcttcaaccaagctccatccagacgtgccaacggataagaatctgaagccgaatccgaactggaaccaagggaagacagttgtgaagtccgacaaattggtttatgtcgatttattacgggaggaacccgatgctaaaactgacaccaacgtctctaaaccttcctttgctgccgagtcagtgggtcagagcgccgagccacctaagcccagcgtggagccggcacttcaacagcaccgggatttcattgcgttacgggaggagctcgggcgtatatcagacttccacgaaacatacacattcaagcagcccgttttcactgtctctaaggactccgtgttggcgggcaccaacaaggagaatctaggcctgcccgttagcaccccattcctcgaaccacctctgggaagcgatggacctgctgtgacatttggcaaaacgcaagaggaccctaagcctttctgtgtcggcagcgctcctccaagtgttgacgtgacccccacttatactaaggatggcgccgatgaggccgagagcaacgacggtaaggtgctgaagccaaagccatctaaactggcaaagaggatagcaaattccgcagggtatgtgggggacaggttcaagtgcgtgacgactgaactgtacgccgactcctcccagctgagtagggaacagcgggccctccagatggaagggttgcaagaggactcgatcttgtgcctccccgcggcctactgtgaacgcgccatgatgagattttcagaactcgagatgaaggagagggaaggaggacaccctgctactaaggactctgaaatgtgtaagttctcaccggccgattgggagcggctgaaaggcaaccaggacaagaaaccaaagtctgtgacgctggaagaagctatcgctgagcagaatgaaagcgagcgctgcgagtacagtgttgggaacaagcaccgcgatccgttcgaggcacccgaggacaaggacctgccagtggagaagtattttgtggagcgtcagcccgtctccgagcctccagcagatcaggtggctagtgacatgcctcacagccccacccttcgtgtggacaggaagcgtaaagtaagtggggactcttcccacaccgagacaacagcggaagaggtccctgaggaccctctcttaaaagccaagcgacgacgagtttcaaaagggctgcatcctaagaagcaacgccacctgttgcacttaagagaacgttgggagcagcaagtgagcgctgcagatggtaaacctgggcggcagtctcggaaggaggttacacaagccacccagcccgaggcaattccccagggaacaaacatcaccgaagaaaagccaggaagaaaacgcgctgaagccaaagggaatcgctcatggagcgaggaatctctgaaaccctccgataatgagcaggggctgcccgtgttttccggaagcccacccatgaagagcctgagttccacctctgctggcggcaagaagcaagctcagcctagctgcgcccccgcatctagacctccagcaaaacagcagaaaattaaagagaatcagaagacagatgtcctgtgtgccgatgaagaagaagactgtcaggccgcgagtctgctgcagaagtatacagacaacagcgaaaaaccatccggcaagcgcttgtgcaagacgaagcatcttattccccaggagagtcgcagagggctccctcttactggggaatactacgtggagaacgcggatggcaaagtgactgttaggcgatttcgcaagcggccagagccctcatccgactacgacctgagccctgccaagcaggaaccaaagccattcgaccgattgcagcagctgttgcctgcaagccaaagcacccagctaccctgttccagttctccacaggaaactactcagtctcgtccgatgccacccgaggcccggaggctgattgttaacaaaaatgccggggagaccctcctgcagcgcgccgcccggcttggatacgaggaggttgtcctctactgcctcgaaaacaaaatctgcgatgtaaatcaccgggacaatgccggctattgcgcactgcatgaagcttgcgcacgcggctggttgaacatcgtccggcacctcctggagtacggcgccgatgtgaattgctcggcccaggatgggacaaggcccctgcacgacgccgtcgagaatgaccacttggagattgtgcgtctgctgcttagctatggagcagacccaactcttgctacttacagcggcaggactatcatgaaaatgacccactctgagttaatggagaaattcctgaccgactacttgaatgatttgcagggcaggaatgatgatgacgccagcggcacgtgggacttctatggcagctccgtgtgcgagccagacgatgagtctggatatgatgtactcgccaatccacctggacccgaagaccaagatgatgatgatgacgcatactctgacgtgtttgagttcgagttcagtgagacccccctgcttccctgttacaatattcaggtgagtgtggcacaaggtcccagaaactggcttcttctgtcagatgtcttgaagaagctcaaaatgagttcacgtatatttcgctgtaatttccccaacgtggagatagtcacaatcgcagaggccgaattctatcgacaggtaagcgcctctctgttattttcatgcagcaaggacctggaagctttcaacccggagtccaaagagctgctggatctcgtcgaattcacaaacgagatacagaccctgctgggcagcagtgtagaatggctgcacccttcagacttggctagtgacaattactggtag

SEQ ID NO: 109690 - DNA, 87 bp, Artificial Sequence
  Description of Artificial Sequence: Synthetic coding sequence
atgctctccgccaccccactctacggcaacgtgcattcctggatgaattccgagagagtgcggatgtgcggggcctctgaagactag

SEQ ID NO: 109691 - DNA, 1236 bp, Artificial Sequence
  Description of Artificial Sequence: Synthetic coding sequence
atgacacggccggcttttcaaccgccagctacacccgccaagcatagctcttccacctcgtctaagggagcaaaggcatccaacccagagccgagcttcaaagcgaacgagaatggcttgcctccctcctcgatttttctgagtcctaatgaagcattccgaagtccccccatcccctaccccagatcttacctgccctatcctgctccagaaggaatcgctgtttccccgctgtccctgcatggcaaagggcccgtttatccacatcctgtcctgttgccgaacggatccttgtttccgggtcacctcgctcctaaacccggtctgccttacgggctgcctacaggccggcccgaatttgtcacgtaccaggatgccttaggactagggatggtgcacccaatgcttattcctcacactcccatcgaaatcaccaaagaggagaaacccgaacgcaggtctaggagccacgagcgtgcacgttacgaggaccccacacttagaaataggttctcagagatcttggagaccagctccaccaaactccaccctgatgtgccaactgataagaatttgaagccaaacccgaactggaaccagggcaaaacggtggttaaatctgataaactagtgtatgttgaccttctgcgagaggagccagatgccaagaccgatactaacgtttctaagccctcctttgccgcggagtccgtgggccagagcgccgaacccccaaagccaagcgtggaacccgcccttcaacagcaccgcgattttattgcgttgcgggaggagttgggcaggatctctgattttcacgaaacatatacatttaagcagcctgtgttcacagtctctaaagactcggtgctagctggcactaataaagagaatttgggtctgcctgtgagcactccatttttagagccgccattgggctcggatgggcctgccgtgacctttgggaaaacccaagaagatccaaaacccttctgcgtcgggtccgccccaccttccgttgatgtcactccaacgtacaccaaagatggcgcagacgaggccgagagtaacgacgggaaggtcctgaagccgaagcctagcaagctggctaaacgaatcgctaattccgccggatacgtgggcgataggttcaagtgcgttaccactgagttatacgccgattcttctcagttgtctagagaacagcgtgctctccaggtctcccctcccacttag

SEQ ID NO: 109692 - DNA, 2238 bp, Artificial Sequence
  Description of Artificial Sequence: Synthetic coding sequence
atgccagtcttgagcagaccaaggccgtggcgaggcaacaccctgaagagaactgccgtgctactagccctcgcagcttatggcgcccacaaagtgtaccctctggttcgacagtgtcttgcccctgctagagggctccaggcacccgctggagaaccgacccaggaggcctccggcgtagcggccgcaaaagccggtatgaatagggttttcttgcagagactattatggcttctgaggctcctcttcccacgtgtgctctgtcgggaaacaggtctgctcgcgcttcacagtgcagctctggtcagccgaaccttcctgtctgtatatgttgcaagacttgatggaagacttgccagatgtatcgttcgaaaggatcccagagcctttggatggcagttactgcagtggcttctgattgcgcttcccgctacctttgtgaattctgccatccgttacctggaggggcagctggccctgagcttcaggtctagacttgtagcccatgcgtatagactgtacttctcacagcagacctattaccgagtctccaacatggatggccggctcagaaatccggaccaatccctgaccgaggatgtggtagctttcgccgcatctgtggcccatctatactccaacctcaccaaacctttactggatgtagcagtgacttcttataccctcctgagggccgccaggagcaggggagcgggaacagcatggcccagcgcaattgccggtctggtagtattcctcacagcgaacgtcctcagagcgttcagccccaagtttggcgaactggtcgctgaggaggctagaagaaagggtgaactgcgttatatgcactcacgcgtggttgcaaatagcgaagagatagccttctatggcggccacgaggtggaactggcgttgcttcaacggagctaccaggaccttgcatcacagatcaacctcatcttgttagaacgtttgtggtatgtgatgctggagcagtttctgatgaagtacgtgtggagcgcaagcggcttgctcatggttgccgtccctattatcactgccactggctacagcgaatctgacgcagaggcagtgaagaaggccgctctggagaagaaagaagaggaattggtttccgagaggaccgaagcgtttacaatcgcccgtaatttactgacagccgctgctgatgctatcgaaagaattatgtcttcatacaaggaagtgaccgaactggccggctacactgccagagtccacgaaatgtttcaagtcttcgaggatgtgcagcggtgccacttcaagaggcccagggaactggaagacgctcaagccggctctggtaccattggccggtccggcgtacgcgtggagggccccttgaagattcggggtcaagtagtcgacgttgaacagggaatcatttgtgagaacatccctatcgtgactcccagcggagaagtggtggttgcgagcctgaatatccgagtggaggaggggatgcacctcctcatcactggacccaacgggtgcggtaaaagttcactctttcggattttaggaggattatggccaacctatgggggggtgctttacaaacctccgccacagcgtatgttctacattccgcagcggccctacatgagtgtcgggtcactgcgagaccaggtgatctatcctgatagcgtggaagacatgcaacggaagggctacagtgagcaagacctggaagctatcctggacgtggtgcatctgcaccatattctgcagcgggaaggagggtgggaagccatgtgtgattggaaggatgtgctgtctggcggagagaagcagcgaattgggatggccagaatgttttaccatcgcccaaaatacgccctcctagacgagtgcacatcagcggtgagcatcgatgtggaaggtaaaatttttcaggcagctaaagacgccggcattgccctgctgagtatcactcacaggcctagtttatggaaatatcacacccacctgctgcagttcgatggagaaggtggatggaaattcgaaaaacttgacagtgctgcaagactgagcttgactgaggaaaaacagcgtctcgagcagcagctcgccggaatacctaaaatgcagagacggctgcaggaactgtgtcagatactgggcgaggcagtggcccctgctcacgttcctgcacccagcccacaaggaccgggagggcttcagggcgctagcacctag

SEQ ID NO: 109693 - DNA, 5358 bp, Artificial Sequence
  Description of Artificial Sequence: Synthetic coding sequence
atgattagcactgcccccctgtatagcggggtccataactggactagcagtgatagaatccggatgtgtggtattaatgaagaacgtcgtgcaccactctctgacgaggaaagcacaacgggagactgtcagcacttcgggtcgcaggagttttgtgtgtcttcctctttttctaaagtggaactgactgcggtcgggtccggaagcaacgcccgcggagctgacccggatggttccgctaccgaaaaactgggtcataaatcagaggataaaccagatgacccacaacccaagatggattatgccggaaatgtggccgaggcggaggggttcctcgtgccactgtcctctccaggagatggcttgaaattgccagcatcagattctgcagaagcttctaactccagggctgattgctcctggacccctctgaacactcagatgtcaaaacaggtggattgcagtcctgctggcgtgaaggccctggactcgagacagggcgtgggtgagaaaaacacgtttattctggctacactgggaaccggcgttcccgtggaaggcacacttcccctggtcactactaacttcagtcccctgcccgcaccaatctgtcccccggccccaggcagcgccagtgtgccacacagcgtccccgatgcattccaggtcccgttgagtgttccagcccctgtgccccatagcggcctagtcccagtgcaggtcgccactagcgtgcctgcaccctctccacccctcgctccagtgcccgcactggctcctgcccccccttccgttcccacgttaataagtgatagcaaccctctttcagtctccgccagtgtcctcgtgccggtacctgcaagtgcaccaccgagcggcccagtcccactatccgctcccgctcctgctccactgagtgttcccgtttcagccccacccctggccctgatccaagccccagtcccaccatccgctccaaccctggtgctggctcctgtacctaccccagtcttagccccgatgcccgcaagcaccccacccgctgctcctgcgcccccctcggtccccatgccaacgcccactcccagttctggccctccgtccacacctactctgatcccagccttcgcccccacccccgttcctgctccgacacctgctccaatcttcaccccggcgcctacacccatgcctgctgcgacaccagcagctatccccacgtccgcgcctatcccagctagtttcagcctctcacgcgtgtgtttcccagccgcccaggcccccgcaatgcagaaagttcccttgagtttccaaccaggcacagtgctcacaccatcccaacctttggtctacatacctcctcctagttgtggtcagccactgtcagttgctacccttccaactactctcggcgtgagctcgaccctcaccctgcctgtgctgccttcatacctgcaggataggtgtttgccaggcgtactggcctccccagaactgcggagctacccgtatgccttttcagtcgcgaggcctctcacatctgattccaagctagttagcctggaggtaaaccgtcttccctgtacaagcccatctggatctaccactacacagcccgcccctgatggtgtgccagggcctttggccgatacaagtttggtaaccgcttccgctaaggtgctacccactccacaacccctcctgcccgcccccagcggctcctcagctcctcctcacccagccaaaatgccgtctgggactgagcaacagactgaaggcacatccgttacctttagcccactgaagagccccccacagttagagagagagatggccagtcccccagagtgcagcgagatgccgctcgacttatcatctaagtccaaccgacagaaactcccgctgcctaatcaaaggaagacaccgcccatgccagtgctgacccccgtccatacaagcagtaaggctctgctgtccacagtcctgagccgtagtcagcgaacaacgcaggccgctggcgggaatgttacaagctgcctcgggtcaacaagtagcccattcgtaatcttcccggagattgtgagaaatggcgatccctccacctgggttaagaattcgaccgcactcattagcaccataccaggtacttatgttggggtcgccaatcctgtgccagcctcactgcttttgaataaggatcctaacctcggactaaatcgagatcctcgtcaccttcccaagcaggagccaatctccattatcgaccagggagagcccaagggaacaggcgccacctgcggaaaaaagggaagtcaggcgggagctgaaggtcagccatccaccgttaagaggtacacccccgcgagaattgctcccgggctgcccggatgccagaccaaagagctctccctttggaagccaacggggccggcgaacatctacccacgatgtagcgtgaacggcaaacctacctcaacccaggtgttgccggtcgggtggtctccttaccaccaggcctccctgctttcgataggcatctcttccgcaggacagctgactccctcccaaggcgctcctattcgccccacgtccgttgtttcagagttctccggagtccccagcctttccagctcggaggcggtccatggtcttccagaaggtcagcccaggccaggcggtagctttgtccctgagcaagacccagtgactaaaaacaagacttgtagaattgctgctaagccatatgaagagcaggtgaacccggtgctgctcacattgtctccacagacagggacattagcgctaagcgttcagccttccggtggggacatccggatgaatcagggcccagaggaaagcgaatctcacctgtgctcggattccacgccaaaaatggaggggcctcagggggcctgcggtctgaagttggccggggacacaaaacccaagaaccaggtcctggctacttatatgtctcacgagcttgtgcttgcaactcctcagaaccttccaaagatgccagagctgcctctcctgccacacgatagccaccctaaagagctcatcttagatgttgtgcccagtagccgacgaggtagctcaaccgaaaggccgcagctcggaagtcaggttgatctggggagggtgaaaatggaaaaagtggatggcgacgtagtgtttaatctggctacctgttttcgagccgacggcctgcccgtggccccccagagaggacaggccgaggtcagagccaaagcaggacaagccagagtaaaacaggaaagcgttggagtattcgcgtgcaagaataagtggcagcccgatgatgttaccgaaagcctcccccccaaaaagatgaagtgtgggaaggaaaaagatagcgaagagcagcagttgcagccccaggcaaaagcggttgtacgctcaagtcataggccaaagtgcaggaaactaccctccgatcctcaagaatcaaccaaaaaaagtccacggggcgcttccgacagtggtaaagaacacaacggcgtgcggggcaagcacaagcatcgcaagcccaccaaacccgagtctcaatccccggggaaaagggctgatagccacgaggaaggctcactcgaaaagaaggctaaaagttcattcagagacttcattcctgtggtattatccacacgcacgcggagtcagagcggctcaatttgttcaagcttcgctgggatggccgacagcgacatgggaagccaggaagtgttcccaacggaggaggaggaggaggtgacaccaacaccagccaagaggaggaaagtgaggaagactcaacgtgacacccagtacagatcacatcatgcacaggataagtctctgttaagccaaggccgacggcacttgtggagggctcgggaaatgccctggcgcacggaagccgcacgccagatgtgggacacaaatgaagaggaagaagaagaagaggaggaggggcttcttaagcgcaaaaagaggcggagacaaaagagccggaagtatcaaacaggagaatacctcacagagcaggaagacgaacagcgccgcaagggacgcgctgaccttaaggcccgtaagcagaaaacatctagtagccagagtttggagcatcgtctccggaaccggaaccttcttctgcctaataaggtgcagggaataagcgattcacctaacgggttcctccccaacaacttggaagagccggcatgcctggagaatagcgagaagccgtctggcaagcggaagtgtaagaccaagcatatggctactgtctctgaagaggccaagggtaaggggcggtggtctcaacagaagacaagaagtccgaaatcacctaccccagttaagccaacagaaccctgcaccccttcaaagtcgaggagtgcctcatctgaggaggcttctgaaagccctactgctcgccagattcctcccgaggcacgacgtctaatcgtgaataagaacgctggcgaaactctcctccagagagccgcacgattggggtataaggacgtggtgttatactgcctgcaaaaagattccgaagacgttaatcatagggataatgcaggatacacagccctgcacgaggcctgtagccggggctggactgacatcttgaatattctactcgaacacggtgctaatgtcaactgtagcgcgcaggacggcacaaggccagttcacgacgccgtcgtaaacgacaatctggagacaatttggctcctcctctcttacggcgccgaccccaccctggctacctacagtggacagaccgctatgaagcttgctagctcagacaccatgaaaaggtttctcagtgaccacttgagtgacctgcagggaagagcagaaggagatcccggggtcagctgggatttctacagctcatcggtgcttgaggagaaagacggctttgcctgtgatctgttacacaatcccccaggctcttccgatcaggagggtgatgaccctatggaggaggatgactttatgttcgagctctctgacaagcccctgctgccttgttataacctgcaggtgtctgtatctaggggcccctgtaactggttcctcttttctgacgttctgaaacggctgaaactgtcaagcaggatcttccaggcccgctttccacactttgagattacaaccatgccaaaggctgaattttatcgccaagtcgcaagttctcagctgctcacgcccgctgaacgccccggagggttagacgacaggagtccccccgggtccagcgagacagttgagctggttcggtacgagcccgacctcttgagactgttggggagtgaagtggaatttcagtcctgcaactcttag

SEQ ID NO: 109694 - DNA, 4746 bp, Artificial Sequence
  Description of Artificial Sequence: Synthetic coding sequence
atgatatccaccgcccccctttactcaggcgtgcacaactggacatcttcagatagaattcgcatgtgtggtattaacgaggagcgccgggctcccctttccgacgaggagtcgacaactggagactgccagcatttcggcagtcaggaattctgcgtatcctcaagtttttctaaagtcgagttgactgccgtgggttccggctccaacgctcgaggagccgatcccgatgggtcagctaccgagaaactcggtcacaagagcgaggacaaaccggacgacccccagccaaagatggattacgcagggaatgtggccgaagcagagggcttcctggtgccactctcatcacctggcgatgggctgaaattacctgctagcgattcggccgaggctagcaacagcagagctgactgctcctggactcccctcaacactcagatgagcaagcaggttgattgttcaccggctggagtgaaagccctggactcaagacaaggtgtgggggagaagaatacgttcatcttggccactctcggaacaggggtcccggttgaagggacgttaccactggtcaccactaattttagccctctccctgcccctatttgccctcccgctcctggttccgcttccgtcccccacagcgtgccagacgcatttcaagtgcccctgagtgtacccgcacctgtcccacatagcgggcttgtgcctgtccaagtagccacatctgtgcccgctccttctccgcccctggcaccggtgcccgctttggccccagctccgcccagcgtacccactctgatctctgatagcaatcccctgagcgtctccgcaagtgtgctggttccagtgcctgcgtccgcccctcccagcggccctgtcccgctttccgcacctgcccctgcccccctttccgtgcccgtgagtgcaccacccctcgcactgatccaggctcctgtgcccccaagtgctccaaccctggtccttgcccccgtcccgactcctgtcttggcgccgatgcctgcctcaacccctcccgccgcgccagcccctccctccgtccctatgcctacccccacgccttcatcaggcccacccagtactcctacactcatccccgcttttgcgccgacacccgttccagcacctactccggcacctatctttacccccgctccgacgcctatgcctgctgccacaccagccgcaatccctaccagtgcgcccatcccagcctcattctcactttcaagagtgtgcttccctgctgcccaggcccctgctatgcagaaagtcccactgagtttccaacctggtactgttcttacaccctcccagcctcttgtatatatccctccgccatcgtgcggacagcccctgtctgtcgctacattgcctactaccttgggtgtgtcatccactttgaccctgccagtgctgccgtcatatctgcaggatcggtgtctcccaggggtattggccagcccagaactgcgaagttatccctacgccttctctgtagcacgaccactcaccagtgattctaaattagtgtctttggaggtgaatcgactcccttgtacatccccttctgggtcaacgactacacaacctgcgccagacggtgtgccgggccccttggccgacacatccctggttaccgcctccgcgaaggtcctgccaactccccaaccactgcttcccgccccatccggaagctctgccccgcctcacccagccaagatgcctagcgggaccgagcagcagactgagggcacttcagtaaccttctcaccactgaaaagtccccctcaactcgagcgtgaaatggcttctcccccagagtgttccgagatgcctctcgatctgagcagcaaatccaaccgccagaagttgccactccccaaccagcgcaaaaccccacctatgcctgtcttaacccccgtacatacttcttctaaggctttgttatctacagtgctgtctaggtcccagcgtaccactcaggctgcagggggcaacgtaacttcgtgtctggggtctacctcatctccttttgtgattttccctgaaatcgtgcgcaatggcgatccttcgacctgggtgaaaaattcgaccgcgttaatttccacaatccccgggacctatgttggcgtggctaaccctgttccggcctccctgcttctgaataaggaccccaatcttggcttaaaccgtgatccacgccatctgcccaaacaggagccaatcagtatcattgatcagggggagcccaaaggcactggggccacgtgcggaaaaaaggggagtcaggcaggcgctgaaggacagccatctaccgttaagagatacacaccagcacggattgcacctgggctcccgggttgccagactaaagagctgtctctgtggaaaccaaccggccctgcgaatatttaccctcgatgtagcgtgaacggaaagccaacatccacccaggttttgcctgtgggatggagcccatatcaccaggcatctctgctgagtatcggcattagcagcgccggacagctcactccttcccagggggctccaatccgacctacctcagtagtgagtgaatttagcggtgtgccatcattgagctcaagcgaggctgtacacgggctacctgaagggcagccccgaccaggggggagcttcgtgcctgagcaggaccccgttactaagaacaagacttgccgaatagccgcaaagccctatgaggagcaagtgaatcccgtgctgctgacactgagccctcaaacaggcactctggccctgtctgtgcagcccagtgggggtgatattcgaatgaaccaaggccctgaggaatctgaatcacatctctgcagtgatagcactccgaagatggaggggccgcaaggtgcttgtgggctcaaactggctggtgacactaagcccaagaaccaagtgcttgccacctacatgtcacacgagttggtgctggccacacctcagaaccttccaaaaatgccggaattgcccttacttccacatgacagccatccaaaagaactcattctagacgttgtgccaagctcaagacggggtagtagcaccgagcgcccccagctcggctctcaggtggacctaggaagagtgaagatggagaaagttgacggagacgttgtgttcaacctcgctacatgcttcagggccgacggactccctgtcgcccctcagcgtggacaagcagaggtaagggcgaaggccggccaagcccgggtgaaacaggagtctgtcggtgtgttcgcgtgtaaaaataagtggcagccagacgacgtgaccgagtcgttgccccctaagaagatgaagtgcggtaaggaaaaagatagcgaggaacagcagctgcagcctcaggcgaaggccgtggttcgctcgtcccataggcctaagtgcagaaagctgccatccgatcctcaggaaagcaccaagaagtcgcctcgaggagcgtcagacagtggcaaagagcacaacggggtgcgcgggaagcacaagcaccgaaagcccacaaagcccgagtctcaatcccctgggaagcgggctgactctcacgaggaaggaagtctggaaaaaaaagctaaaagctcattcagagactttattcctgtcgtactgtcaacaagaacgaggagccagtccgatttgaaggcaagaaaacagaagacctcaagttcccagtccctcgagcaccgtctgagaaataggaacctgctgctacctaataaagtccaaggaatatccgattctccaaacgggttcctgccaaataacctggaagagcccgcgtgtctagaaaactctgaaaaaccctcaggaaagcgcaagtgtaagacaaagcacatggccactgtctctgaagaagccaaggacgttgtgctttattgtctgcagaaagatagtgaagatgtgaatcaccgcgataatgctggctacactgccctgcacgaggcctgtagcagaggatggactgacatcttgaatatcctgctggagcatggcgctaatgtcaattgtagcgcccaggatggaaccagacctgtacatgacgccgtcgtgaatgataatctggagactatttggttgctcctctcttacggggccgaccccaccctggctacttactctggtcagaccgctatgaagctcgcaagcagtgatactatgaaacgctttctgtccgaccacctgtccgacctgcaggggcgtgctgaaggtgacccaggcgtcagttgggatttctattcatcctcggtactcgaggaaaaggatggattcgcctgcgatctgttacataacccacctggcagctcagatcaggagggggatgacccaatggaagaggatgactttatgttcgaactcagtgacaaaccattgttaccatgttataacctgcaggtctccgtgagcagagggccatgcaactggttcctgttctcggacgtccttaaaaggctcaagctgtccagcagaatctttcaggctcggtttccacactttgagattacgacaatgccaaaagctgagttctatcgtcaggttgcgtctagccagctcttgactccggcggaaaggcccgggggcctggacgataggtctcctccaggatctagcgagactgtggagctggtgcgctatgaacctgacctcctgcggctcctgggaagcgaagtagagttccaatcttgcaacagctag

SEQ ID NO: 109695 - DNA, 2226 bp, Artificial Sequence
  Description of Artificial Sequence: Synthetic coding sequence
taacccttactgccagccccaagtggttcatctgctccacctcatcctgccaaaatgcccagtggcactgaacagcaaactgagggcacctctgtgactttctcgccgctcaaaagtcctccccaactggagcgtgagatggcgtctccaccggagtgctcagagatgccacttgatctgtctagcaagtctaacaggcaaaaactccccctcccaaaccagcgtaaaacccctcctatgcccgtactaacacccgttcatacttcttctaaggcactcttgtccactgttctctccagatcccagcgcacaacccaggcagcaggaggcaacgtgaccagttgtctaggatccacttcaagccccttcgtcatatttccagagattgtcaggaacggcgaccccagcacttgggtgaagaactcaacagccctcatatcgacaattcccggcacgtacgtgggcgtcgcgaacccagtcccagcttccttgctgttgaataaagacccaaatctgggcctgaatagggatccgcggcatctccccaagcaagaaccaatcagtatcatcgatcagggggaacctaaaggaacaggcgcaacctgcggtaagaaagggagtcaggcaggcgctgaagggcagccaagcaccgtcaagcgatatacccctgcccgaattgcaccaggtctaccggggtgtcaaactaaggagttgagtttatggaagccaacggggccagctaacatttatccaaggtgttctgtgaacggtaaacccaccagcactcaggtcctgccagtgggctggagcccttaccatcaagcttccctcctcagcatcggtatcagctcagctggacagctgactccttctcagggggcccccatcaggcctacctctgtggttagtgaattcagcggcgtgcctagcctctcaagctctgaagcggtgcacgggctgccagagggccagcctcggccgggcggcagtttcgttccagaacaggaccctgttaccaaaaataaaacctgccgaatcgctgccaagccatatgaggagcaagtgaaccccgtgttactcaccctcagcccccagacaggaactcttgctctctcggtacagccttcaggaggggatatcagaatgaatcaaggccctgaggaaagtgagagccacttatgcagtgattccacccctaagatggaagggccccagggggcttgcggcctgaagcttgctggagatactaagcccaagaatcaggtcctcgcaacgtatatgtcgcacgagcttgtgctggcaaccccccagaatcttcccaagatgccagaactaccactgttacctcatgactctcatcccaaggaactgatcctggacgtggtccctagttcaaggcgcggctcatccaccgaaagaccccagctgggctctcaagtcgacctcggtcgtgtgaaaatggaaaaagtggacggggatgttgtttttaacttagcaacttgctttagagcagacggcctgcctgttgcaccccagagggggcaggcggaggtccgcgccaaggccggccaggctagagttaaacaggagagcgtgggagttttcgcttgcaagaataagtggcagcccgatgacgtgactgagtctctacctcccaagaagatgaaatgtggcaaagaaaaggacagtgaagagcagcagttgcagcctcaggctaaggcagtcgtccgctcctcccatcgcccgaagtgcagaaagctgccctctgatccacaggagtccacgaagaaatcaccccgcggcgcaagtgactcagggaaagagcacaatggagtgcgtgggaagcacaagcatcgtaaacccactaagccagaatcacagagtcctgggaaaagggcagactcgcacgaagaggggtccctggaaaagaaagccaagagttcctttcgggattttatcccagttgttctttctacccgcacccgctcacagtctgaccttaaggctcgtaagcagaagacatcaagttcgcagtctctcgagcatcgactcaggaataggaatcttctgttgccaaacaaggtgcaggggatttccgattcccccaatgggttccttccgaataatctcgaggaaccggcctgtctggaaaactccgagaaaccctctgggaaacggaaatgcaagacgaaacatatggcaaccgtgtctgaggaagccaaatag

SEQ ID NO: 109696 - DNA, 4158 bp, Artificial Sequence
  Description of Artificial Sequence: Synthetic coding sequence
actcccgcggccattcccacatccgcccccatccccgcctccttttcactcagtcgggtctgctttcccgctgcacaggcccctgccatgcagaaggtccccctgtctttccagccggggacagtcctcaccccttcccagcccctggtgtatattccaccaccaagctgtggccagcccctgagtgtggccaccctgcccaccacccttggtgtgagcagcaccctcacactgcctgtgctgccgagttacctacaagatcgatgtctgccaggggtgctcgcgagccctgagctgcggtcctatccctacgctttctccgtagcccgacctctcacctcagattctaagttagtgtctctggaggtgaataggctgccgtgtacctccccttccggttctactaccacccagcccgcccccgatggcgtgcccggaccactggcagatacaagcttggtaacagcctctgcaaaggttcttcctacgcctcaacctctcttgccagccccctctgggagctccgcaccaccacatcccgcgaagatgccatcgggaaccgagcaacagactgagggcacttctgtgacattcagcccgttaaaaagccccccccaattagaacgtgaaatggcgtcccccccagaatgttctgaaatgccgttggacctgagctcaaagagtaaccggcagaagctgccccttcctaaccagcgcaaaaccccccccatgcccgtattaacacctgtacatacctcgagcaaggccttactcagcactgtactatcgcggagccagcgcaccacccaggccgccggcggaaacgtgacaagctgtctcggttcaactagttccccattcgttatttttcccgagatcgtaagaaatggcgatccttccacctgggtgaagaactccacggcgcttatcagcacgattcctggcacctatgtgggcgtcgctaaccccgtgccagcctccctgttgctgaataaagacccaaatttaggcttgaatcgtgatccgagacacttgccaaagcaagaacctatctccatcatcgaccagggtgagccaaagggaacaggtgcaacatgcgggaagaagggctcacaggccggcgccgagggacagccttcaactgtgaagcggtacactccggcaaggattgccccagggctcccgggctgccagaccaaagagctgtccttgtggaagccaacgggaccggctaacatttatccacggtgcagcgtgaacggtaagcccaccagcacccaagtgcttcctgtagggtggagtccgtaccaccaggccagcctgctgagtattggaatttcaagcgcaggccagctgaccccctcccaaggtgcacccattcggcccacgtccgtcgtgagtgaattctcaggggtaccctctctctctagctcagaagcggttcacggattgcctgaaggtcagccacggccaggcgggtccttcgttccggaacaggatccagtgacgaagaataagacatgccgcatcgcagctaagccgtatgaagaacaggtcaatcccgtcctcctgaccctgtccccgcaaacggggaccttggccctaagcgtacaaccatcaggaggcgacatcagaatgaaccaagggcccgaagagagcgagtctcacctctgcagcgattctactccgaagatggaggggcctcagggagcttgcgggctgaaactggccggcgacacgaagccgaagaaccaggtgctggccacctacatgtcacacgagctggtgctggccactccacagaacctgcccaagatgccagagcttccgctcctgccccatgacagccaccccaaggagctcatcctcgacgtagtcccaagctcccggcgggggagctcaaccgaacggccccagctcggctctcaggttgacctgggcagagttaagatggagaaggtcgacggagatgttgtgtttaatcttgccacctgctttagggcagatggtctacctgttgcaccgcagagagggcaagccgaggtgagagccaaagccggacaggcccgcgtgaagcaggaatcagtgggcgtctttgcctgtaagaataaatggcagcctgatgatgtgactgaatcactgccaccaaaaaagatgaagtgcggcaaggagaaggattccgaggagcaacagcttcagcctcaggctaaagccgttgtgagatccagccaccgtcctaaatgcagaaaactgccttcagatccacaagagagtacaaagaagagcccccgcggcgcctccgacagtggcaaagagcataatggagtacgcgggaaacataagcaccgaaaacccaccaagccagagtcacagagccctggcaaacgcgcagactcacatgaggagggcagtctagaaaagaaagcgaaaagcagtttcagagatttcattccagttgtactctccactcgcaccaggagccagagcggcagtatttgctctagcttcgcgggcatggctgacagcgatatgggtagtcaggaagtctttccaactgaagaggaagaggaagtgactcctacacccgccaagcgtcgtaaggttcggaagacccagagggacactcagtaccggtctcaccacgcgcaagataagagccttctgtctcagggcaggcgtcacctgtggcgggcccgagaaatgccttggcggaccgaggctgccaggcagatgtgggataccaacgaagaggaagaagaagaggaggaggagggactgcttaagcggaaaaagaggagacggcaaaaatccaggaagtaccagacgggcgagtaccttaccgagcaggaggacgaacagaggagaaaagggagagccgaccttaaagcaagaaaacaaaaaacatcttcttcgcagagccttgagcatagactcagaaaccgtaacctgcttcttcctaacaaggtacaaggtattagtgactctcccaatggctttttacccaataacttggaagagcctgcctgtttggaaaactccgaaaagcctagcgggaaacgcaagtgcaagactaagcatatggccactgtctctgaggaagcgaagggaaaaggccgctggagtcagcagaagacccgcagcccaaagtccccaaccccagttaagcccacagaaccttgcaccccctccaaaagcaggtcagctagcagcgaagaggcctctgagagcccaactgcccgtcagataccgccagaggcaaggcggctgattgtcaacaagaacgcaggcgagaccttgctgcagcgcgccgctaggctcggatacaaagacgttgtgctgtactgcctccaaaaggattcagaggacgtgaaccatagggacaacgccgggtataccgccctccacgaggcatgctcacgaggctggactgacatcctgaacattttattggagcatggcgctaacgtgaattgttcagcccaggacgggacacgcccggtacatgatgctgtggtgaacgataacctggaaacgatttggcttcttctctcttatggcgccgatcccaccctggcaacctactctggccaaacggccatgaagctagcaagttcagataccatgaagcgatttcttagtgaccacttaagtgatctgcaaggccgagctgagggtgatccaggtgtatcctgggatttttactcttccagcgttctggaggaaaaggacggtttcgcttgcgacctacttcacaaccccccggggtcatcagaccaagagggtgacgaccccatggaggaggatgattttatgtttgagctgtccgacaagcctctcctgccatgctacaatctgcaggtatccgtgtcaagggggccatgcaactggttcctgttttcggacgtgctaaagagacttaaacttagcagtaggatttttcaagctaggttcccccactttgagataactacaatgccaaaagctgagttctacaggcaagtcgcttcttctcagctgctcacgcctgccgaacggcccggaggcctggacgaccgctcccccccaggatcctccgagaccgtcgaactcgtaaggtacgagcctgatctgcttcgcctgctgggtagcgaggtagagttccagtcgtgtaatagttag

SEQ ID NO: 109697 - DNA, 5136 bp, Artificial Sequence
  Description of Artificial Sequence: Synthetic coding sequence
atgatttccaccgcaccactttacagtggcgttcataactggaccagctcagaccgcattaggatgtgcggcatcaatgaggaacgccgcgcaccactgagcgacgaagagtccactaccggggactgccagcacttcggctcgcaggagttttgtgtctcaagcagtttttccaaagtagagctgaccgctgtggggagcggctccaatgcccgtggtgccgaccctgacggaagcgccacggaaaagttgggccataaatcagaggataaacccgatgacccccagccaaagatggactatgcgggtaacgttgccgaagccgagggcttcttggtccccttgagttctcccggagacgggttgaagttacctgcatctgattccgctgaggcctccaattccagagccgattgttcatggacgccacttaacacccaaatgagcaagcaggtggactgcagtcctgcgggcgtgaaggccctcgacagccgccagggcgtgggggagaagaatacatttatcctggctaccctgggtaccggcgtgccagtggagggcaccctacccttggtcacgacaaatttctcacctttgcccgcccctatttgtcctcccgctcccggctctgcctcagtcccgcatagcgtgcctgacgcgtttcaggtaccactgtccgtcccagccccagtaccccactcagggttagtgcccgtccaagttgcaactagtgtgccagccccctccccaccactggctcccgtacctgctttggcccccgcaccaccatcagtgcccacgctgatctccgattctaacccattatcagtgagcgcttccgtcctggtcccggtcccagcttccgcaccccctagcgggccggtacctcttagcgcccctgcccccgcccccctgagcgtgccagtgtccgcccctccactggctctcattcaagccccagtgccccctagtgcccccaccctcgtgttggcgccagtgcctactcctgtgcttgcaccaatgcctgcctcaactcccccagcggcccccgctcccccttcagtgccaatgcctaccccaacacctagctctggtcctcctagtaccccgactctaatccctgcctttgccccgactccggttcctgccccaacccctgcgcccatctttaccccagcccccactccaatgccagccgccacacccgctgccatccccacatccgctcctattccagccagcttcagcttgagccgcgtctgtttccccgctgcgcaggcaccagcaatgcaaaaggtgccattgagttttcaaccaggcaccgtcctgacaccctcccaaccgttagtgtatataccccccccttcatgtggccagcctctgagcgtcgctactttaccaacaaccttgggcgtgtcaagtactttaacgttaccagtgctcccatcttatcttcaggacaggtgtttgccaggtgtgttggcttctcccgaattgcgaagttatccttacgccttctccgttgcccgccctctaaccagcgactctaaactcgtttccttggaagtcaaccgtctgccctgcacatctccaagcggatcaacaacaacacagcctgcgcccgatggggtgccggggccacttgcggacacttcactggtgaccgcaagtgccaaggtgttgccaacaccacaaccgcttttgccagccccgtccggctcttccgcaccaccccatcctgccaaaatgcccagtggcactgagcagcaaacagagggcacctctgttaccttcagtcctctcaagtcacctccacaattggagcgggaaatggccagcccccctgagtgcagcgaaatgccactggatttgtcatctaaatctaaccgacagaaactgcccctcccgaaccagagaaagacaccaccaatgcctgtgctcactcctgtgcacacttcttctaaagcacttttaagtactgttctctcccgatcacagaggaccacccaagccgccggtggcaatgtgacatcttgtttgggatcaacatcttctccattcgtcatcttccccgagatcgtccgcaatggggaccctagcacatgggtgaaaaattcaacagccctcatttcaaccattccaggaacatacgtcggcgtagcaaaccccgtgcctgcctccctgctcctgaacaaagatccaaatctgggtctaaatcgcgacccccggcaccttccgaagcaggagccaataagcataatcgaccagggtgaaccaaaggggaccggcgctacgtgcggcaaaaaaggcagccaggccggtgccgagggccagcctagcaccgtgaaaagatatactcccgcgcggatcgcccccggtttgcccgggtgccagacaaaggagctgagcttgtggaaacctaccggaccagccaacatttatcctaggtgcagtgtaaacggcaagcccacatctacccaagtcttgccagtcggctggtcgccttaccatcaggcctccctcctgtcgatcggaatttctagcgctgggcaactcacgccgagccagggcgctccaattagacctacctccgtcgtgtccgagttttccggagtcccgtccttaagcagctcagaagccgtgcacgggttgcccgagggacaaccgagaccagggggctcgtttgtgcccgagcaagaccctgtgacaaagaataaaacttgccggatcgccgccaagccttatgaggaacaggttaacccagtgctcctgactttaagcccgcagactggcaccctcgctttaagcgtccagccatctggcggtgacatcaggatgaaccaggggccggaggaaagcgagagtcatctatgttcagatagtactcctaagatggagggcccacagggtgcatgcggcttaaagctcgcaggggacactaaaccaaagaatcaggtgctcgcaacatacatgagccatgaattagtcctggcgactccgcaaaacctgccgaagatgcccgagctgccactcctacctcacgatagccatccgaaagagttaatactggacgttgtcccaagcagcaggaggggcagcagtacagagcgccctcagttaggctcccaggtagatcttggtagggtcaagatggagaaagtggacggcgacgtagttttcaacctcgcaacttgcttccgcgccgacgggctccccgtagccccgcaaaggggacaggctgaggtgcgggctaaggctggccaggctcgagttaaacaggagagcgttggtgtgttcgcttgtaagaacaaatggcagccagatgacgttacagagagtctgccgcctaagaaaatgaagtgtgggaaggagaaagatagcgaggaacagcagctccagcctcaggcaaaggctgttgtgaggtcctcgcaccggcctaagtgtaggaagctgccgtccgatccccaagagtctactaaaaaaagtcctcgcggggcatcggattcgggtaaagagcataacggcgtaagaggcaagcacaaacatcgtaagcccacaaagcccgagagtcaatctcccggtaaacgggccgattcccacgaagagggtagtttggaaaaaaaagcaaagagttcattccgtgacttcatccctgtggtgctgtcaactcgaaccagatctcagagtggatctatctgttccagtttcgctggaatggccgactcagatatgggcagccaggaggtgtttccgaccgaagaagaagaggaggtcacgcccactccagcaaagcggagaaaagttagaaagacacagcgagatacccagtaccgctctcaccacgcccaggacaaatctcttctcagccaggggcgacgccatttatggcgagcacgagagatgccatggagaactgaggctgcccggcagatgtgggatacaaacgaggaggaggaagaggaggaggaggaggggctccttaaacgcaagaaaaggaggcgccagaaatctcgcaaataccagacaggggagtatctcactgagcaggaggacgaacagaggcggaaggggcgggcagacctgaaagctcgcaagcagaagactagtagcagccagtcactagaacacagactacggaatcggaacctcttgctcccgaacaaagtccaaggaatctcggactcacccaacggcttcctacccaataaccttgaggagcctgcatgcttggaaaattctgagaaaccttcaggcaagcgtaaatgtaagacaaaacatatggctacggtcagcgaagaagccaaggacgttgtcctgtactgtttacagaaagatagtgaagatgtgaatcaccgcgataacgccggttataccgccttgcacgaagcgtgttctagggggtggaccgacatactcaacatcctccttgagcatggcgcgaatgtgaattgttctgctcaggacgggactagacctgtccatgatgcggtggtcaacgacaatctagaaaccatctggttattgctctcctacggagctgaccccacgttggccacctacagtggacagacagccatgaagttggcatcctccgataccatgaagcgattcctgtccgatcacttaagtgacctgcaaggtcgcgcagaaggcgaccctggggtgagctgggacttctactccagttcagtgctggaggaaaaagatggtttcgcctgtgacttactccacaatcccccaggatctagcgaccaggagggagatgatcctatggaggaagatgacttcatgtttgagctgtcagacaagccattactaccatgttacaatctgcaggtgtcagtcagccggggcccatgtaactggttcttgttcagtgacgtcctgaaaagactgaagctgagctcgagaatcttccaggcaagatttccacatttcgagatcaccacaatgcccaaggccgagttttaccgccaggtggctagcagtcaactcctaacaccagctgagcggccaggaggactggacgacagatcccccccaggaagctctgagacagtggaacttgtgaggtacgagcccgacctactcagactactggggagtgaagtcgagttccagagttgtaactcatag

SEQ ID NO: 109698 - DNA, 1260 bp, Artificial Sequence
  Description of Artificial Sequence: Synthetic coding sequence
atgccactgtcagatttcatcttagcactgaaagataacccttatttcggcgcgggatttgggctcgtcggggtcggcactgctctggccctggcccgcaaaggagtacagctcggccttgtggccttcagacgccattatatgattactttagaggttccagcgcgggacagatcatatgcatggttactttcatggctcactcggcacagtacaaggactcagcatctctccgtggagactagctatctccagcacgagtcaggccgcatctccactaagttcgagtttgtgccatctccgggcaaccattttatctggtacagaggaaagtggattcgggttgagcgatcccgcgagatgcaaatgatagacctgcaaactggaaccccgtgggaaagcgtgacattcactgctcttggcaccgacaggaaggtgtttttcaacattcttgaagaggctcgagagttggctttacagcaggaggaaggcaagaccgtgatgtacaccgcagtgggcagtgaatggcggccatttgggtatccacgacgtagaagaccattgaatagtgtggttctgcaacagggcctggcggaccgtatcgtgagagatgtccaggaattcattgacaatccaaagtggtacactgataggggcattccctatcgcagaggatacctgttgtacggtcctcccgggtgcgggaagtccagcttcatcacagccttggctggagagctggagcattccatctgcctgcttagtctgacagactcaagtttatcagatgaccgactcaatcacctgctgtccgtggccccccagcaatccctggtgcttctggaggacgtggacgccgcgtttcttagcagagatctcgctgttgagaacccggtgaagtaccaggggttaggcaggctgaccttttcaggactgttgaacgccctggatggcgtggcgagcactgaggctcgcatcgtgttcatgacgacaaatcatgtggaccgactagatcccgctttgattcgccccggccgggtggatctgaaggagtacgttggttactgctcccactggcaactcacgcagatgtttcagcgattctaccctggacaagcccccagcctcgcggaaaacttcgctgagcacgtgttacgcgctaccaaccaaatttctcctgctcaggttcaggggtattttatgctgtataaaaacgaccccgttggtgcaattcataatgcagagtccttgcggaggtag

SEQ ID NO: 109699 - DNA, 1260 bp, Artificial Sequence
  Description of Artificial Sequence: Synthetic coding sequence
atgcccctgtctgattttatcctggccctgaaagacaatccttactttggagcaggctttggccttgttggagtggggactgcactggctctggcacgcaaaggcgtgcagctggggctcgtggccttcaggagacactatatgattacgctggaggtacctgcccgggacagatcttatgcctggctgctgagctggctaactcgtcattcgacccgtacccaacacctatctgtggagacctcctatttacaacatgagtccggcagaattagcaccaaattcgaatttgtaccttcacccgggaaccacttcatctggtacaggggaaagtggatcagagtagagcgctcccgcgagatgcagatgattgacctccaaacaggcacaccttgggagtccgtgacgttcactgcgctcggaaccgatcggaaagtcttttttaatatcctggaggaggcaagggagctggcattgcagcaggaagaagggaaaacagtaatgtacaccgcggtgggatctgaatggcgtccattcggttacccacgtaggcggcggccgctgaactccgtcgtactccagcagggactggccgaccgtatcgtccgggatgtgcaggaattcatcgataacccaaagtggtataccgatcggggaattccctataggcgggggtacctactgtatggcccgcctggctgcgggaaaagctctttcattaccgcccttgcgggcgaactggagcactctatctgcctattgtccttgaccgactctagcctctccgatgacagacttaaccacttattgtccgtggcaccccagcagagcctcgtcttactcgaggacgtcgatgcagccttcctgagccgagatctcgcggtggagaatcccgtaaaataccaaggcttgggccgactgacattcagcggactcttgaatgctttggacggtgtcgcgtccacagaggctcggatagttttcatgacaacgaatcatgtggataggctggaccctgctttgatacgcccaggtagggttgatctgaaagagtatgtcggatactgttcacattggcagttgacgcaaatgttccaacgtttctatcccggacaggcaccctccctggccgaaaatttcgctgagcatgtgctcagggctacaaaccagatttcccccgctcaggtgcaaggctatttcatgctgtacaaaaatgatcctgtgggtgccatccataatgccgaatccctcagacgctag

SEQ ID NO: 109700 - DNA, 1260 bp, Artificial Sequence
  Description of Artificial Sequence: Synthetic coding sequence
atgcctttaagtgactttatcctggcccttaaagataatccttacttcggagccggattcggactggttggggtgggaactgctcttgccctggcccgaaagggcgttcagctcggtttggtagcgtttcgcagacactacatgatcacattggaggtgcctgctagagaccgcagctacgcctggctgctcagctggctgacacgccactctactcgcacacaacatctctccgtcgagacatcttatttgcaacacgaatctggcaggatctccacgaaatttgagttcgtcccctcacctgggaaccattttatctggtaccgtggcaagtggattagggttgaacggtctcgagagatgcagatgattgacctgcagaccggcacaccctgggagtctgtgacttttaccgcattgggaactgacaggaaggtttttttcaatatactggaagaggctcgtgagcttgccctccagcaggaggagggtaagacagttatgtacaccgcggtgggaagcgagtggcggcccttcggatatccgagaaggagaaggccactgaacagcgtggtgctgcagcaaggactggccgaccgcatcgtgcgggatgtgcaggagttcattgataatccaaaatggtatacagacagaggaatcccttataggcgcggctatctactgtacggcccacccgggtgcggtaagagcagtttcattaccgccttggctggagagctggagcacagtatatgcctcctttcactgacagactcctccctgtctgacgacaggctgaaccatcttttatcagttgccccgcaacaaagtctggtgctgctggaagatgtcgatgccgcctttttatccagggatctggccgtcgaaaacccggtaaagtatcagggattgggccggttgacatttagtggactgcttaatgcacttgacggagttgcctctacagaggcccgcatcgtatttatgaccacaaaccacgttgatcgtttggacccggcgctgattaggccaggtcgcgtcgacctgaaggaatatgttggctactgctcacactggcaactcactcagatgtttcagagattctatcccgggcaggccccgtccctggctgagaacttcgccgagcacgtgctgcgcgctaccaaccaaatttccccggcccaggttcagggctacttcatgctgtacaaaaatgaccccgttggcgctatccacaatgcagagtcactgcgcaggtag

SEQ ID NO: 109701 - DNA, 1260 bp, Artificial Sequence
  Description of Artificial Sequence: Synthetic coding sequence
atgccactgagtgattttatcctcgccctaaaagataatccatacttcggcgccggctttggacttgtcggcgtgggcacagctctggccctggcgcgtaaaggggtgcagctcggacttgtggcttttcgtcgccattatatgattacactagaggtgccggccagggataggagctatgcttggctcctgtcctggcttactcggcactcaacccggacacagcatctttctgtggaaacttcctacttgcagcatgaaagcggaaggatctctacaaagttcgaattcgtgccttcccctgggaatcatttcatttggtaccgcgggaagtggatccgggtggagagaagtcgggagatgcagatgatcgacctgcaaacgggcaccccttgggagtcagtaacattcacagcattgggcacggatcgcaaagtgttcttcaatattctggaagaggccagagaactcgccctgcagcaggaggaggggaaaacggtcatgtacaccgccgtgggctctgagtggaggccatttggttatcctaggcgtaggcggcccctgaatagcgtggtcctgcaacagggccttgccgatcggatcgtgagagatgttcaggaatttatcgacaaccccaagtggtacaccgatagagggattccatacagacgcggttacctgctctatgggccccctggatgcggcaaatctagcttcatcactgctcttgcaggagagctcgagcacagtatctgcctgctgtctttgacagacagttcactgtcagatgatcgcctgaatcatttacttagcgtggcaccacagcagtcgctggtgctactcgaggatgtggacgccgcctttctctctcgtgatcttgctgtggaaaatccagttaagtaccagggcctcgggaggctgaccttcagcggtctgcttaatgccctggatggcgtcgcctcaacagaggctcgtattgtgtttatgactactaaccacgtggacagacttgatccggcgctaattaggcctggccgcgtggatctcaaggaatacgtgggatactgcagtcattggcagcttacacagatgttccaacgattttacccgggacaagcaccttctctggcagaaaacttcgcggaacacgtgttgagggctaccaaccagatttctcctgcacaggtccaaggctacttcatgctatacaaaaacgatcccgttggagctatacacaatgcagaatcactaaggagatag

SEQ ID NO: 109702 - DNA, 1260 bp, Artificial Sequence
  Description of Artificial Sequence: Synthetic coding sequence
atgcctctctcagacttcattctcgcactgaaggacaacccctactttggtgcaggcttcgggttagtgggggtggggaccgcccttgctcttgcgagaaagggggttcaactgggtctagttgcgtttcgtcgccactacatgataactctcgaagtcccagcccgagatcggtcttatgcctggctgctttcctggctcacccggcacagcacaagaacccagcacctgtcagtggagaccagctacttgcagcacgagagtgggcgtatcagcacaaagttcgaatttgtgccttcccccggtaaccatttcatctggtataggggtaagtggatccgggttgagcgcagtcgtgagatgcagatgattgacctgcagaccgggaccccctgggaatctgtcacctttaccgccctgggcactgatcggaaggtgttctttaacatcttagaagaggccagagaactggctctccagcaagaagaagggaagacagtgatgtacaccgctgtgggttctgagtggcgcccgtttgggtatcccagaagacgccgacccctgaatagcgtggttctccagcagggcttagcagacagaatcgtgagggatgtgcaggagttcatcgataacccgaagtggtacactgaccgtggcattccctatcgcaggggctaccttttatatgggccacctgggtgtggtaaaagttcattcatcactgcactggccggagaactggagcacagcatttgcctgctgtccctgacagattcatcactatccgatgacagactcaatcatctgctgagtgtggctcctcagcagagcctggtgttgctggaagacgtcgacgcggctttcctgtccagagatctagctgtggagaatccagtgaaataccagggactggggcggctcacctttagtgggttgctcaatgccctcgatggggtggcgtcgaccgaggccaggatcgtattcatgacaactaaccacgttgacaggttagacccggccctcatacgacccggccgcgtcgacctgaaggaatacgttggatactgtagtcactggcagttgacacagatgttccagcggttctatcccggccaggccccctcgctggctgagaacttcgctgaacatgtacttcgggcaacgaatcagatctctccagcccaggtgcagggttatttcatgctgtataaaaacgatccagtgggcgctatacacaatgcagagagtctgaggcgctag

SEQ ID NO: 109703 - DNA, 333 bp, Artificial Sequence
  Description of Artificial Sequence: Synthetic coding sequence
atgcccttatccgattttatcctggcacttaaagacaacccctacttcggagcggggttcgggctggtgggggttggcacagctttggctcttgcaaggaagggggtgcagcttggactcgtagcatttaggcgacattatatgatcacactggaggtccctgcacgggacagaagctatgcttggctgctttcatggttgacaaggcatagcacccgcacacaacaccttagcgtggaaacaagctacttacagcacgagagtgggagaatttctactaaattcgagttcgttccgtcccctgggaaccactttatatggtataggggatag

SEQ ID NO: 109704 - DNA, 234 bp, Artificial Sequence
  Description of Artificial Sequence: Synthetic coding sequence
atgccgctgtctgactttatactagctctgaaggacaatccctatttcggcgcgggctttggcctcgtgggcgttggaaccgccctcgcactggctagaaagggtgtccaacttggtctcgttgcatttcgaagacattatatgatcacgctcgaagttccagcacgcgacaggagttacgcctggctgcttagctggttaactaggcacagtacgaggacccaacacttatag

SEQ ID NO: 109705 - DNA, 621 bp, Artificial Sequence
  Description of Artificial Sequence: Synthetic coding sequence
atgccactgagcgacttcatcctggccctgaaggacaacccttacttcggagctggcttcggcctggtgggagtggggaccgccctggccctggcacgcaaaggagtgcaactggggctcgttgcatttaggaggcactatatgataaccctggaggtcccagcaagagacaggagctacgcttggctcctctcatggcttactcgccactcaaccaggacgcagcacctgagcgtcgaaacaagctatctgcagcacgaatcaggcaggatttccaccaaattcgagttcgtgccctcccctggcaaccactttatttggtatcgcggcaaatggatcagggtggaaagaagtcgcgagatgcagatgatagacctgcagaccggtaccccttgggagtcagtgacctttacagctctaggcacagataggaaggttttctttaatattctcgaagaggcgagggaactggcattgcaacaagaggaaggtaaaaccgtcatgtacactgctgtggggagcgaatggagacccttcggctatccgagacgtcgtaggcctctcaacagcgtggtgctacagcagggtctggctgaccgaatcgtgagagacgttcagtag

SEQ ID NO: 109706 - DNA, 1260 bp, Artificial Sequence
  Description of Artificial Sequence: Synthetic coding sequence
atgcctctgtccgactttattctggcactgaaagataatccctacttcggggcaggattcgggctcgtgggagtggggactgcgctggccctggctcgaaaaggcgtacagctgggactggttgctttcaggagacactatatgatcaccttagaggtgcctgctcgtgaccgcagctatgcttggctcctaagttggctgacccggcactcaactcggacgcagcacctttcagtagagacatcatacttacagcacgagagtggccgcataagcaccaagtttgaattcgttccctcccctgggaaccacttcatctggtaccgggggaaatggataagagttgagcgatctcgggagatgcagatgatcgatctccagacaggtactccttgggaatctgtaacctttactgctttagggacagatagaaaagtgtttttcaacatcctcgaagaggctcgagagctggccctgcagcaagaggagggcaaaactgtgatgtacacagccgttggcagcgagtggagacccttcggctatccacgtagacggcggcctctgaactctgtggtgctgcagcaagggctcgcagatagaatcgtgcgcgatgtgcaggagtttatcgataacccaaaatggtataccgatcggggcatcccatatcggaggggatacttgctgtacggcccaccgggatgcggtaagagtagctttattacagccctggccggagaactggagcatagcatctgcctcttatcccttacagattcctctctgtctgatgacagactgaatcacctgctcagtgtggcaccccaacagtcgttagttcttctagaggacgtcgacgctgctttcttatcaagagatctggccgttgaaaatcctgtgaaatatcaggggttgggcagactaaccttttcaggactgttgaatgccctggatggcgtcgcgagcactgaggcccgaattgtgtttatgacaacgaatcacgtcgacagactagaccccgccctgatacgacccggccgcgtcgacctgaaggaatatgtgggatactgttcccattggcaattgacacagatgttccagcgtttctatccaggacaggctcctagcttagcggagaatttcgctgaacacgtcctccgcgccacgaaccagatttcccccgcacaagtgcaaggctacttcatgctgtacaagaacgacccagttggagccatccataacgctgagagtctccgcaggtag

SEQ ID NO: 109707 - DNA, 1260 bp, Artificial Sequence
  Description of Artificial Sequence: Synthetic coding sequence
atgcccctgtctgatttcatcctggccctcaaagataatccttacttcggcgccggtttcggacttgtgggcgttgggactgctttggccctggctcgaaagggtgtgcagttgggactcgtggctttccggcgacactatatgatcactctcgaggtgcccgccagggacagatcctacgcctggcttctgtcatggctcacccggcatagtactaggacacagcatctatcagtcgagacttcatacctccaacatgaatctggaaggatctcaaccaagttcgaatttgtaccatcaccagggaaccattttatttggtaccgggggaagtggatcagagtagagaggagtcgcgaaatgcagatgattgacttgcagacaggtaccccatgggagtccgtcaccttcaccgcactcggtactgataggaaagtattctttaatatcttggaggaagctcgggagctagcccttcaacaagaggaaggaaagacagtgatgtatacagctgttggcagcgagtggcggccattcgggtacccacgacgcaggcgccctcttaattccgtcgtgctgcagcagggcttagcagaccgcatagtgagggacgttcaggaatttatcgacaaccccaaatggtatactgatcgtggaattccttatcgaagaggctatttgctctacgggcctccaggctgtggtaagtcctctttcattaccgcactggcaggtgaactggagcactcaatttgcctgctttccctgaccgactcttccctctcagatgacaggctgaatcacctgctgtccgtcgctccacaacaaagcctggtactgctcgaggatgttgacgcagctttcctgtcacgagaccttgctgtggaaaacccagttaaatatcagggattgggcaggctgaccttttcagggctcctgaatgctctggacggagttgcaagtacggaagcccggattgtgttcatgacgactaaccatgtggatagactcgaccctgctctgatccgcccgggcagagtggacttaaaggaatatgtgggctactgcagccactggcagcttacccagatgttccagcggttttatccaggccaggcacccagtctcgctgaaaatttcgccgagcacgtgctgcgggcaactaatcagatctctcccgcacaggttcagggttacttcatgctttacaagaacgatcctgtaggggcgattcataacgctgagtctttacggcggtag

SEQ ID NO: 109708 - DNA, 621 bp, Artificial Sequence
  Description of Artificial Sequence: Synthetic coding sequence
atgccactgtccgactttattctggctctgaaagataatccttattttggcgcaggcttcggcctcgtcggcgtggggacagccctagccctggcccgcaaaggcgtccaactggggctcgtcgccttccgaaggcattacatgataacacttgaggttccagccagagatagatcttacgcctggctgctgtcttggctgacccgccactctacgagaacccagcatttatcggtggagacaagctacctgcagcatgaatctggacgcatttctactaagttcgagttcgtaccatctcctgggaaccattttatttggtatcgcggcaagtggatccgtgtggagcgctctagggaaatgcagatgatagatctccagaccggcacaccctgggagtccgtgacttttaccgctcttgggactgaccggaaggtgtttttcaacattctggaggaggcgagagaactggctctgcagcaggaggagggcaaaacggtgatgtataccgcagttggcagcgaatggcgaccattcggctaccctaggagaaggcggccattaaatagcgtcgtcttacagcaaggcctggccgaccgcatcgtgagggacgtacagtag

SEQ ID NO: 109709 - DNA, 1623 bp, Artificial Sequence
  Description of Artificial Sequence: Synthetic coding sequence
atgtatgagaacgaatgtgagtgtcagctgcttttgaaagagatgttagagcggttaaataaggaagctgatgaagccctgttgcataacctgagacttcaattggaagctcagtttttacaggacgacatttctgcggccaaagatcggcataagaaaaatctgctggaggttcagacttacatctcaatactacagcaaatcatccataccacaccaccagcaagcatcgtgacatcagggatgcgggaggagaagttgctaacagaacgtgaggtcgcagccctccgttcgcaactcgaggagggacgggaggtgctgtcccacctgcaggctcagcgggttgagttgcaggcacaaaccaccacactcgaacaggccattaagtctgcacatgaatgctatgatgacgagatccagctttataatgagcagatcgaaacactgcgtaaggagatagaggagacggaacgcgttctggaaaagtcttcatatgactgcagacagctggccgtggctcagcagactttaaaaaatgaactagacaggtaccacaggatcattgagatcgagggaaacagacttacttccgcctttattgagaccccaatccccctgtttacccagtctcacggcgtaagcctgtccactggatccgggggcaaagatctgacaagagcactgcaagacattacggcagcaaagcccagacagaaagcattgcccaagaacgttcctaggcgaaaagagatcatcaccaaagataaaacaaatggggcactcgaagacgctcctttgaaaggactggaagacaccaagctcgtgcaggtggtgctgaaagaggagtccgagtctaagtttgaatcggagtcaaaagaggtgagcccattgacgcaagaaggcgcccctgaagacgttccagacggggggcagatttcaaagggatttggaaagctctatagaaaggtgaaggagaaagtcagaagccctaaggagccagaaactcccactgaactatacactaaggagagacacgtgctggttacaggcgacgctaattacgtggaccccagattctatgtatctagtataacagccaaagggggggtggccgtgagtgtggccgaggattctgtgttatacgatggccaggtggagccctcgccggagtctcctaaaccccctctggaaaatggacaggtcggcctacaagagaaggaggatggacagcccatcgatcagcagcccattgataaggagatcgagccggacggagctgagctggaaggcccggaggaaaaacgcgagggcgaggagcgcgatgaggaatcacggagaccttgtgccatggtcaccccaggcgcagaggagcccagcatacctgagccacctaagccagccgctgaccaggacggggctgaggtgttgggaacccgcagccggtcattgcctgaaaaagggcctcccaaggcactggcctacaaaacagttgaagtggtggaaagtatcgagaaaatttctacggagagcatccagacgtacgaagaaactgcggtgattgtggagactatgattggtaagaccaagtctgacaagaaaaagtctggggagaaatcatcgtag

SEQ ID NO: 109710 - DNA, 1998 bp, Artificial Sequence
  Description of Artificial Sequence: Synthetic coding sequence
atgtaccgccggtcctatgtgttccagactcggaaggagcaatacgagcacgccgatgaggcgtctcgggccgccgaacctgagagacccgcagacgagggatgggccggagcaaccagcctcgctgcactccagggtctgggtgaacgagtggccgcgcacgttcagcgcgcacgagctctcgaacagagacacgctgggctccgcaggcaactggatgccttccagcgcctcggggagctcgccggtccagaagatgcgctggcccgtcaagtggaatctaaccgacagagagttcgagatctggaggctgaacgcgcacgattggagcgtcaaggaactgaggcacagcgggcattggacgaattccgatcaaagtatgaaaatgagtgcgagtgtcaactgttgctcaaggagatgctcgaacgactgaacaaagaagcggacgaggcgctactccacaatcttagactgcagctcgaggcgcagtttctgcaggatgacatcagtgccgcaaaagacagacataaaaaaaatcttctggaagtgcagacatacatctcaattttgcagcagattatccataccaccccccccgcctcaatcgtgacgagtggaatgcgggaagaaaaacttctgaccgagagggaagttgcagccctgagatctcagctcgaggaaggcagggaggttctgtcccacctgcaagcacagagagtagagctgcaggcccaaaccaccacccttgagcaggccataaagtcagcccatgagtgctacgatgacgagatacaattatataacgaacagatcgagaccctgaggaaggaaattgaggagacagagcgcgtgctggaaaagagctcctatgactgtcggcagctcgccgttgcccaacagacactgaagaatgaactggatcgctaccacagaattattgagatcgaagggaatcgcttgaccagtgccttcatcgagacccccatccctctgttcacccagtcccacggcgtatcattgtctacgggctctggagggaaagatctgacacgcgcgcttcaggatataacggctgccaagccgaggcagaaggcgctgcctaaaaatgttccccggagaaaagagatcatcaccaaagacaagactaacggggccttagaagatgcccccctaaagggtcttgaggatacaaaactcgtacaggttgtcctgaaggaagaaagtgaatcaaagttcgaatccgagagcaaggaggtatccccattgactcaggaaggggcccctgaggacgtgcctgatggcggccaaatctcaaagggcttcggaaaactctacaggaaggtaaaagagaaagtccggtcccccaaagagccagagactcccaccgagctctacaccaaagagcggcatgtgctggttacgggggacgcaaactatgttgacccacggttttatgtttcatcaatcacagccaagggcggggttgctgtcagtgtggcagaggactccgtcctgtacgatggacaggtcgagccgtcccctgagagtccaaagcccccgctcgaaaacggccaagtcgggctgcaggaaaaagaagacggacagccgatcgaccaacaacccatagataaagaaatcgagcccgatggcgccgaactggagggacccgaggagaaacgagagggagaggaacgcgatgaggagagccggaggccttgtgctatggttacaccaggtgcagaggagcccagcattcccgaaccgcccaagcccgcggcagatcaagacggagcggaggttttgggcacccggagtcgtagccttcctgaaaaaggaccccccaaagccctggcgtataagaccgtcgaagtggtggaatctattgagaaaatctctacggagagcattcagacatacgaggagactgccgttatagtggagacaatgatcggcaagactaagtccgataaaaagaagtcaggggagaagagcagctag

SEQ ID NO: 109711 - DNA, 1581 bp, Artificial Sequence
  Description of Artificial Sequence: Synthetic coding sequence
atgctcgagcgactgaacaaagaggccgacgaggctctgctgcacaacctgcgcctgcagttggaggcccagtttttacaggatgacatctcggccgctaaagatcgccataagaaaaacctgcttgaggtgcaaacgtacatttctattcttcagcagattatccacaccactccacccgccagcatcgtcacaagtggcatgcgggaggaaaagctgttgactgaacgggaagtggcagccctgaggtcccagcttgaggagggcagggaggttctgtctcacttgcaggcacagagagtggagctccaggctcagactacaacccttgagcaggcaattaagagcgcacacgaatgttatgatgatgagatccaactttacaacgaacagatcgaaaccttgcgtaaagaaatcgaggaaaccgaaagagtgctggaaaagagcagctacgattgtagacagttagctgtcgctcaacagacgcttaagaacgagctcgatcggtatcataggatcatcgagatcgagggtaaccggctgacgtctgccttcatagagactcccattccactgtttacccagagccacggcgtatctctgtcaactggcagcggtggcaaggatctaacacgcgcattgcaagacatcacggcggctaagccaaggcaaaaggcactgcctaaaaatgtgcctcggaggaaagaaatcatcacgaaggacaagacaaatggcgccctggaagacgcacccttaaagggtctcgaggacaccaagctagttcaggtagtgctgaaggaggagtctgagtcaaagtttgagagcgagtcaaaagaggtcagccccttgacgcaggagggggcgccagaggacgtgccagatggggggcagatatcaaagggattcggaaaactgtatcggaaggtgaaagagaaagtacgttctcctaaggaacctgagaccccaactgagctgtataccaaagagagacatgtacttgttaccggggacgctaactacgtcgaccccagattctatgtgtctagcatcacggccaaaggaggggtggcagtctcagtggccgaggattcggtactctatgatggccaagtggagccttcaccagaatctcctaagccccccctggagaacggccaggtaggcctgcaggaaaaggaagacggacaaccaattgatcaacagcccattgacaaagaaatagagcccgatggagctgaactcgaaggacccgaggagaaacgagagggggaggagagggacgaagagagcaggaggccttgcgccatggttacccctggggccgaggaacccagcattcctgaacctcccaagcccgcggccgatcaagatggggctgaggtgttgggcactagatcacgctcccttcctgaaaaaggcccccccaaagctctcgcatacaagacagttgaagtggtggagtccatcgagaaaatcagcaccgaatcaatccagacttacgaagaaaccgcagtcatcgtcgagaccatgattggaaaaactaaaagtgacaagaaaaaatctggtgaaaagagcagctag

SEQ ID NO: 109712 - DNA, 1581 bp, Artificial Sequence
  Description of Artificial Sequence: Synthetic coding sequence
atgcttgagcggctgaataaagaagccgatgaagcactgctccacaatctgcggttgcaactagaagcccagtttctgcaggatgatatcagtgctgccaaagatcgccacaagaagaatctgttggaagtgcagacatacatcagtatcctgcaacagattattcacacgacacctcctgcaagcattgttacatccggcatgcgggaagaaaaactgctcactgaaagggaagttgcagcactgagatcacagctagaggaagggagagaagtgctgtcccatctccaggcccagagagtggaattgcaggcgcagaccaccacccttgagcaagcaatcaaatcagcgcatgagtgttatgatgacgagatccagctttataacgagcagatcgagaccctgcggaaggagatcgaagagaccgaacgagttctcgagaaatcgagctacgattgtagacagctggcagtcgcgcaacagacactcaaaaacgagctggatcggtatcatcgtatcattgaaattgaaggaaatagactgaccagtgcgttcattgagactcctattcccctcttcacgcagagtcacggcgttagcctgagcaccggctccggaggcaaggatttgacccgggcgctgcaggacattaccgccgctaagcctaggcagaaagccctgccaaaaaacgtgccacggaggaaggaaataataaccaaggataagacaaacggtgcactcgaggacgcgcctctcaaagggttagaggacaccaagcttgtccaggtggtgttgaaagaggaatctgagagcaaattcgagtcagagtccaaggaggtgtcccccctgacccaggagggggctccagaggacgtacccgacggcggccaaatttcaaagggcttcggaaagctgtaccggaaagtcaaggaaaaggtgcgttcacctaaggagcccgaaacacctacagagctgtatacaaaagagcgacacgtgctcgttacaggtgatgccaattacgtggaccctcgtttctatgtaagctctattaccgcaaaaggaggcgttgcagtgtcagttgcagaagattcagtcctctatgacggtcaggtcgagccttccccagagtcccctaaaccacccttggagaatggacaggtcggtctccaggagaaggaagatgggcagccaattgaccagcagccgatcgacaaggagatcgagcccgatggtgcagaactggaaggtcctgaagagaagcgtgaaggtgaagaacgcgatgaggagtcccgacgaccatgtgccatggtgactcccggcgccgaggaaccgtccatccccgagccgcccaagcctgctgcagaccaagatggtgccgaagtgttaggaaccagatcccggtcactccctgaaaaaggtccacccaaggctttagcctacaagaccgttgaggtggtggagagtatcgaaaagatctccacggagtccattcagacctacgaggagacagccgtaatcgttgagacaatgatcggtaagacgaaaagtgacaagaaaaagtccggcgagaaatcatcttag

SEQ ID NO: 109713 - DNA, 1248 bp, Artificial Sequence
  Description of Artificial Sequence: Synthetic coding sequence
atgtctgaacgacgggtggtagttgacctcccaacttctgcaagttcctccatgcccctacagcggcgccgcgcctcttttaggggcccgcggtcgagcagctctctggaaagcccccctgcctctcgtacgaacgcgatgtccggtcttgttcgcgcacctggggtttatgtcggcactgctccaagtggatgcattggaggcctcggcgccagggttacgagacgggccttaggcatcagctccgtcttcctgcaaggattgaggtcgagcggtttagcaacagtcccagcgcctggtctggaacgggaccatggggcagtcgaagacctgggaggatgcctggtcgaatacatggccaaggtacatgcactcgagcaggtttcccaggagcttgaaacccagctgaggatgcatttagaaagtaaggcaactcggagcggtaactggggcgcgctacgcgccagttgggcctcctcttgccagcaggttggagaggccgtactggaaaatgcgcgtctgatgctccagaccgaaacgatccaagccggtgcagacgactttaaggagcgctatgagaacgagcagcccttcaggaaagctgccgaggaagaaattaacagcctctacaaggtcatcgacgaggcgaacctgaccaaaatggacctcgaatcacagatagaatcgcttaaggaggagcttggaagcctgtcccggaactacgaagaagacgttaaacttcttcataagcagctcgccgggtgtgaactagagcaaatggacgccccgataggtaccgggctcgatgatattctggaaaccataagaattcaatgggagcgcgacgtggagaagaatagggtagaagccggcgctctgctccaagcaaagcaacaggctgaggtagcgcatatgtcgcaaacccaggaggaaaagctcgcagcggccctccgggtagaactgcacaacactagttgccaggttcagagtttgcaggctgagaccgagagcttacgtgccctgaaaaggggcttagaaaatacccttcacgatgctaaacactggcatgacatggagcttcagaacctgggcgcagtggtgggccgactcgaggccgaacttagagaaattcgcgccgaggccgagcagcagcagcaagagagagcgcacctgttagccaggaagtgccaactccagaaagatgtggcctcataccacgccttgctggacagagaggagtctgggtag

SEQ ID NO: 109714 - DNA, 1353 bp, Artificial Sequence
  Description of Artificial Sequence: Synthetic coding sequence
atggagggaagcaagacaagtaacaactccactatgcaggtgtcatttgtgtgtcagagatgtagccagcctcttaaacttgacacgagctttaagatcttggaccgggtaactatccaggagctgaccgctccccttttaacaacagcccaggcaaagccgggcgaaacccaagaagaagaaactaactctggagaagaaccatttatcgagaccccccgtcaggacggagtttcgcgccgctttattcctcccgctaggatgatgagtaccgagagtgccaactctttcacactcatcggcgaggcttcagatggaggcactatggaaaatctgtccaggcggcttaaggtaaccggtgatctgtttgatattatgtcgggacagacggacgtcgatcatcctctgtgcgaagaatgtaccgacacattgctcgatcagctcgacacacagttaaatgtcacagagaacgagtgtcagaactataagcggtgcctggagatcctggagcagatgaacgaggatgattccgaacagctgcagatggaattgaaggaactggcactcgaggaggagcgacttatccaggagttggaagatgttgaaaaaaaccgcaagattgtggctgagaacctggaaaaagtacaggccgaagctgagaggcttgaccaggaagaggcacagtatcagcgtgaatattcggaatttaagaggcagcaacttgaacttgacgatgaacttaaatctgtggagaatcagatgcgctacgcccaaacacagctggataagcttaagaaaacaaatgttttcaacgccacttttcatatttggcactcaggccaattcggcacaattaataactttcggctaggccgcctcccttctgtaccggtcgagtggaatgaaattaacgctgcttggggacaaaccgtgctcctgctgcatgccctggcaaacaagatgggcctgaagttccagagataccgcttagtgccgtacgggaatcattcctatctggaaagtctgacagacaaaagtaaagaactcccgctctattgctctggtggcttgcgcttcttttgggacaataaattcgatcacgctatggtggcttttcttgattgtgtccagcaattcaaagaggaggtagaaaagggtgagacacgcttctgcctgccctacaggatggacgtagagaagggcaagattgaggataccggtggcagcggcggatcttactctataaagactcagttcaactccgaagaacagtggactaaggccctgaaatttatgctgactaatctcaagtggggcctggcctgggttagctctcagttctacaacaagtag

SEQ ID NO: 109715 - DNA, 840 bp, Artificial Sequence
  Description of Artificial Sequence: Synthetic coding sequence
atggagggttccaagacatctaataacagcacgatgcaggtctcttttgtttgtcagaggtgctctcagcccctcaagctggataccagctttaaaatattagatagggtcacaatccaggaactcactgctcctctacttactacagcgcaggcaaaaccgggggagacccaggaggaggagacaaattctggtgaggagccgttcattgaaacccctaggcaggatggcgtatctagaagatttatccccccagctcgacgctgcctggaaatcctcgaacagatgaacgaagacgacagtgaacagcttcagatggaattgaaggagctcgcactggaggaagaacggcttatccaggagctggaagacgtggaaaagaataggaagattgtggctgagaacctggagaaagtgcaggcggaggctgagcgtcttgaccaggaggaggcacagtatcaaagagaatatagcgagtttaagcgacagcagctcgaattagacgacgagctaaagtccgtggagaaccagatgaggtatgctcagacacagctcgacaagctgaaaaagactaacgtatttaacgccacattccacatctggcacagcggacagttcggtactataaataactttagattaggcagactgccatctgtgccggtggagtggaatgagataaatgcagcctggggccagacagtactcttattacatgctcttgctaacaagatgggactcaagttccagcgttatcggctcgtgccgtatggaaaccattcatatctagaaagcctcaccgacaaaagtaaggacggctgtggcgaaaggcaggactag

SEQ ID NO: 109716 - DNA, 1092 bp, Artificial Sequence
  Description of Artificial Sequence: Synthetic coding sequence
atgatgtctaccgaaagcgcaaatagcttcacactgatcggggaggcatctgacggcggcaccatggagaatctgagtagacggctgaaagtgactggcgacctctttgatataatgagtgggcagacagacgttgaccaccctctttgcgaggagtgtaccgatacactcctcgaccagctcgacacacagcttaatgtgactgagaacgagtgtcagaactacaagcgatgtctcgagatccttgaacagatgaatgaggacgacagcgaacagctgcagatggagctcaaagaattggcactggaagaagagcgcctgatccaggagcttgaggatgtggagaaaaaccggaagatagtcgccgagaatctcgagaaagtgcaggctgaagcggagcgtctggatcaggaggaggctcaataccagagagagtacagtgagttcaagagacaacagcttgagcttgacgacgaattgaaatccgtcgagaaccagatgcgctacgctcaaactcagcttgataaactgaagaagacaaacgtcttcaatgccacatttcatatatggcactctggtcaattcgggactattaacaactttaggcttggccgactcccctctgtgccagttgaatggaacgaaatcaacgcagcatggggccaaacagttcttctcttacacgcgctggccaataaaatggggttaaaattccagcgctataggctagtgccctacgggaatcactcgtaccttgagagcttgacagacaagagcaaagagctgcccctgtactgttctggcggactacggtttttttgggataacaaatttgaccacgcaatggtggctttcttggattgcgtacagcagtttaaagaggaagtcgagaagggtgagaccaggttttgtctgccctatcgcatggatgtggagaagggaaaaatcgaggatacaggtggcagcgggggatcttatagcatcaagactcagtttaattcagaagaacaatggacaaaggccctgaaatttatgcttacgaatctgaaatggggattggcctgggtttctagccagttttataacaagtag

SEQ ID NO: 109717 - DNA, 5394 bp, Artificial Sequence
  Description of Artificial Sequence: Synthetic coding sequence
atggaacagctcacaaccttaccaaggcccggcgatccaggcgccatggaaccatgggctcttcccacctggcacagttggactccagggagagggggtgaaccctctagtgccgccccatcaatcgccgacacaccacccgctgccttacagcttcaggaactgcgctcagaagaaagcagcaagcccaagggcgatgggtccagtaggcccgtgggcgggaccgatccagagggggctgaagcttgcttgcctagcctgggacagcaggcctcttccagcgggcctgcctgtcagcgtccagaagatgaagaggtggaggccttcctgaaggctaaactgaacatgtcgtttggggaccgacccaaccttgagctgctccgagctctgggagagttaaggcaaaggtgtgccatcctgaaggaggaaaatcagatgctgcggaagtcatcttttcccgagactgaggagaaagtgcgtcggctgaaaaggaaaaatgctgagttggcagtgatcgccaaacgtctggaggagagggccaggaagttacaggagacaaacctccgagtcgagggccctcagtggcttcacgtgagggatttcgatcggctacttagggaatcccagagagaggtgctgcggctgcagcggcagatcgccctacgaaatcagcgagagacacttccccttcctccatcgtggccccctgggcctgctctgcaggcccgggcaggagctccagccccaggggcaccgggggaagcgacccctcaagaagacgccgacaaccttcctgtcattctcggcgagcccgaaaaagagcagcgggtgcagcagttagaaagtgaactttcaaagaaaagaaaaaagtgtgagtcactggaacaggaggcacggaagaaacaacgaaggtgtgaggagctggagttgcaacttcgccaggctcagaacgagaatgcccgcctcgtggaagaaaacagtaggttgagcggccgggctactgaaaaagaacaggtggaatgggagaacgcggaactgcgaggccaactgctgggcgttacccaggaaagggattctgccctccggaagtcccagggcctgcagtctaaactggagagtcttgagcaagtcctcaagcacatgagggaagtggctcaaagacgtcaacagttagaagttgagcatgagcaagcaagattatccctgcgggaaaagcaggaagaggtgcgaaggctccaacaggcgcaggccgaggcacagagggagcacgagggggcagtgcagttgctcgagagcaccctggactccatgcaggcgcgcgtccgcgaactcgaggaacagtgtaggagccagaccgagcaattctcattactggctcaggagcttcaggcctttcgactccatcccggacctctggatcttttaactagtgccctggattgcgggtcacttggcgattgcccccctccaccttgttgttgttcaatcccccagccgtgcagagggagcggcccgaaggacctggacctcccccccggatccccaggaagatgtacaccgaaaagcagtgagccagcacctgcgaccctgacgggggtccctaggcgcactgccaaaaaggccgagtctctgagtaattccagccactctgagagtattcacaactccccaaagagttgcccaacccccgaggtcgatacagcaagcgaggtcgaagaattggaagctgacagcgtctcccttctgccggccgctcctgaggggtccagaggcggcgccagaatccaggtgttcctcgccagatactcttacaatcccttcgagggcccgaatgagaaccctgaagccgagctcccactgacagcaggggagtacatctacatttacggtaatatggacgaggacggcttcttcgaaggagagctgatggacggccggcgcggcctggtgccaagcaactttgtggagcgggtgagcgacgacgatctgttaacttcacttccccccgagttggcggacctgtctcactcaagtggtcccgagctctcatttctgagtgtgggtggcggagggtcctccagcggcggccaatcttccgtaggccgctcccagccgcggccagaggaagaagacgcaggggacgagcttagcctgtcacctagtccggagggcttgggcgagccaccagctgtgccgtatccgaggagactggtggttctgaaacagcttgcccactctgtcgttctagcatgggagccccctccagagcaggtcgaactgcatgggttccatatctgcgtgaatggcgagttaaggcaggcactgggacccggcgctccacctaaggcagtgcttgagaacctggacctctgggctggtcccttgcacatctccgttcaggctttaacttcccggggatcaagcgacccgctacggtgttgtctggccgttggtgcccgagccggagtggtcccctctcagctgcgcgtacataggttgacagcaaccagcgcagagattacttgggtgccgggcaattctaacctagcccatgctatttatctgaacggagaagagtgtcccccagcatcccctagtacctattgggctaccttctgtcatcttagaccagggacgccttatcaggcacaggtggaagcacaacttccaccacagggtccctgggaaccaggatgggagcggttggagcaaagagctgctacacttcagtttaccacgcttcctgcagggcctcccgatgccccgctggacgtgcagatcgaaccaggcccaagccctggcatcttaataatcagctggttgcccgtaaccattgatgctgccggaacctccaacggagtacgagtgacagggtatgcgatctacgcagatggccagaagattatggaggtcgccagtcctacggcaggcagcgtattggtggagctgagccagctgcagttgctccaagtgtgtcgcgaggtggtggtcagaaccatgtcacctcatggcgaaagtgctgatagcattccagctccaattacccccgccttggcccctgctagcctccctgcacgcgtctcctgtccaagtcctcacccatctcctgaggccagggccccactggcctccgcatctcctggtccaggcgatccctcctctcctttgcagcatcccgcccccctgggaacgcaggagccccccggagcaccaccagctagtccatctcgggagatggcgaagggctctcacgaagacccccccgctccgtgctcacaggaggaggccggggcggctgtgctgggcacctcagaggaacgaaccgcttctacctccaccctaggcgagaaggacccaggcccagctgctccgagccttgcaaagcaggaagctgagtggaccgcaggcgaagcctgtccagcaagttctagcacccagggcgccagagcgcagcaggccccaaacacagagatgtgccagggcggggacccgggctctggccttcgacctcgagccgagaaggaggataccgccgaactcggtgtccatctggtgaattctttagttgaccatgggagaaattccgatctgtccgatattcaggaggaagaggaggaggaggaagaggaggaagaagaggagctgggctctagaacgtgcagcttccaaaagcaggtagctggtaactcaattcgcgagaatggggcaaaaagccagcctgaccctttttgtgagaccgatagtgacgaagaaattctggagcagatcctagaattacccctgcagcagttttgcagtaagaagctgttttcgattccggaggaagaggaggaagaggaggaagacgaagaagaggaaaagtctggcgcaggatgttccagcagagaccccggcccacccgagcccgccctactgggactgggttgtgacagtggccagccccgcagacccggccagtgcccattatcgcctgagtcttcgcgtgcaggcgattgtctagaggacatgcccggcctggtcgggggctctagtcggagacgcggtggcgggtcacctgaaaaacccccttcccgcaggagaccacccgatccaagggaacactgttctaggctattgagcaataacggacctcaagcaagcggaagacttggacctactcgggagcgggggggattgccggtgattgagggacctaggactggactggaggccagcggaagaggccggctggggccctcccggcggtgttcccgcggacgggcactggagcccggacttgcctcgtgcctcagtcctaagtgcctcgagatatccatcgagtacgacagcgaggacgagcaagaggctggctccggcggaatttctatcacatccagctgttatcctggcgacggagaagcctgggggactgcaacagtggggcggccacgaggtcccccgaaagcaaacagcggcccaaagccctacccaagactgccggcttgggagaagggagaaccggagcgcagagggaggagcgcgaccggcagggctaaggaacctttgtcccgggcaacagaaacaggagaagcgcgcggacaggacggcagcggccgacgcggaccccagaagcggggcgtgcgggtgttgcggcccagcacagcagaactggttccagctaggtcgccaagcgagacacttgcctaccaacacctgcctgtccgcatcttcgtggcactcttcgactatgacccagtctcaatgagtcccaatcccgacgccggggaagaagaacttccttttcgtgagggccagatcctgaaggtgttcggtgacaaggatgctgacgggttctaccagggggaggggggcggcagaacggggtacattccttgcaacatggttgccgaagtggccgtggattctcccgcaggcagacaacaactgctgcagcgtggttatctatcccccgatatcctgttggaggggtcagggaacgggccctttgtttattctactgcgcacaccacagggcccccacccaagcctcgacggagcaaaaaggccgagtcggagggccctgctcagccatgtcccggacctcccaaattagtgccctctgccgatctcaaggcccctcactcaatggtcgccgccttcgactataatccgcaggaatccagtcccaacatggacgtggaagcagaattgccgttccgtgcgggggacgtgatcactgtattcggaggtatggatgacgacggattctactatggtgaactcaacgggcaaagagggctcgtaccttccaacttcttggagggccccggtcccgaggcaggaggtctggatcgagaaccacgcacaccacaggcagagtcacagcgcactcgccgtcgccgggtgcagtgctag

SEQ ID NO: 109718 - DNA, 5574 bp, Artificial Sequence
  Description of Artificial Sequence: Synthetic coding sequence
atggagcaacttaccaccctcccgcgaccgggcgacccaggcgcgatggaaccgtgggccctcccgacgtggcattcctggactcctggcagggggggcgaacctagttctgccgcccctagtatcgccgatacccctcctgcggctcttcaattgcaggaactgcgaagcgaggagagctcaaagcccaaaggcgatggctcatctaggcccgtgggcggtacggatccagagggcgcggaggcatgtctgcccagtctggggcagcaagctagtagtagcgggcccgcctgtcaaaggcccgaggacgaagaagtcgaggcttttttgaaggctaaactgaatatgtcttttggtgatcggcctaacctagagcttttgcgagcgctcggtgaactgagacagaggtgtgctattttaaaggaagaaaatcaaatgctgcgcaagtccagctttccagagacggaggaaaaagtccgccgtctgaagagaaaaaatgctgagcttgccgtgatagccaagcgactcgaagagcgagctcggaagctgcaggagactaatttaagagtcgtttccgctcccctgcctcgaccgggaaccagcctagaactgtgtagaaaagcgctcgcgagacaaagagctcgtgacctgtcggagaccgcttccgccctgctcgctaaggataagcagatcgcagctctccagagggagtgtcgcgaactccaggcccgcttgacactggttgggaaggaaggaccacaatggctacacgtgagagactttgataggctcctgcgtgaatcacagcgggaagtgctcaggttacagcggcagatagctctccggaaccaaagagagactctcccactccccccatcctggccgcctggccccgctctgcaggccagggcaggcgctcccgctccaggggctcctggagaggccaccccccaggaggacgctgataatctgcccgtcatcctcggggagccggagaaagaacaaagagtccagcagctggagtcggagctgagtaagaaaaggaagaagtgtgagtccttggaacaggaggccagaaaaaagcagcggagatgtgaagagcttgagctacagctgagacaggctcagaacgaaaacgccagactagttgaggaaaactcgaggctctcggggcgggctacagaaaaggagcaggtggagtgggagaacgcggagctgagaggccagctcctgggtgtgactcaggagcgtgattcagctctcagaaagtctcaaggtctgcagtccaagctggaatctctcgagcaagttttgaagcatatgcgtgaagtcgcccaacggcgtcagcagctcgaagtcgaacacgagcaggccagactcagtttgcgcgagaagcaggaagaggtgagacgccttcagcaagcacaggctgaggcacagcgtgagcacgagggggcggtgcagctgctcgagagcacgctggacagcatgcaagctcgggttcgcgaactcgaggagcagtgccggtctcagactgagcagttcagcctgctcgcacaggagttgcaggcatttaggttgcatcccgggcccctcgatcttctcactagcgcattggattgcggcagcctcggggactgcccaccgccaccatgctgctgtagcatccctcaaccctgcaggggcagcggcccaaaggatcttgatcttccgcccggtagtccgggacgatgcacgccaaagagctccgagccggcgccagccacgctgacaggggtgcctagacgaaccgccaagaaagccgagtcactttccaacagcagccatagcgaatctattcataactctcctaaaagttgtcctacccctgaggttgacactgcaagtgaggtagaagagctcgaagctgacagcgtctcactcctgcctgctgctcctgaagggtcccggggaggagcaaggatccaggttttcctggctcggtatagctacaatccattcgagggacccaacgaaaatccagaggctgagctgcctctcactgcaggagagtatatctacatttacggaaacatggacgaagatgggtttttcgagggtgaactcatggacggcagaagagggcttgttccaagcaattttgtagaaagggtctctgacgatgacctgctcacaagtttgcctccagaactggcagacttgtcccacagcagcggccctgagctgagcttcctgtcagtggggggtggtggctcctcttctggcggccagtctagtgtcggccggtctcagcctagacccgaggaggaggatgccggagatgaattaagtctgtcaccaagccccgaaggccttggggagccccccgcagtgccctatccgcgtcgtctcgtggtgctcaagcaactggcccacagtgtagtgctggcatgggaaccaccacccgagcaggtggagctccacggcttccatatctgcgttaacggtgaactccggcaagcattgggccccggagcacctccaaaggccgtcttggagaacttggacctgtgggcgggtcccttgcacatctctgtgcaggctctcacctcacgaggctcctctgatcccttgcgctgctgcttggccgtcggtgctcgagccggagttgtccccagtcaactgcgcgtgcatcggttgacggccacctccgcagagatcacgtgggtccccgggaacagtaacttagcccacgcaatctatctgaatggcgaggagtgtccgcccgcctcaccctccacatattgggccactttttgccatctgaggcccggcacgccgtatcaggctcaggtcgaggcacaactgcctcctcaggggccatgggaaccggggtgggagcggctggaacagcgcgcggcgaccctccagttcaccaccctcccagctggcccacccgacgctcctctagatgtgcagatcgaacccggaccttccccaggcatacttattatctcctggctgcctgtcaccattgacgcggcaggaacttccaacggcgtgagggtgactgggtacgccatttatgccgatggtcagaaaatcatggaagtggcatcccccactgccggctccgtgctggtggagctatcacagctccagctgctgcaagtatgtcgcgaagtcgtagtgaggacaatgagtccgcatggcgaaagcgccgactccatcccagcccctattactcctgccctggctccagccagcctgccagcgcgagtgagctgcccgtccccccaccccagtcccgaggctagagcacccctggcatccgcttctcctggacctggggatcccagctcccccttacagcatcccgcacctcttggcactcaggagccccctggcgcccctccagcgagtcccagtagagagatggcgaaggggagtcacgaggatcccccagcgccctgctcacaggaggaagctggcgccgcagtgctgggcacctccgaggaacgcaccgcaagcacctccaccttgggcgagaaggatccaggtcccgctgcaccctctctggcaaagcaggaggccgagtggaccgctggagaggcctgccccgccagcagtagtacacagggcgcacgtgcccagcaggcccctaataccgagatgtgtcaaggtggggacccaggtagcggactgcggcctcgggctgagaaggaagatactgccgagttgggcgtgcacctagtgaactccttagtggaccacggcaggaactctgacctcagtgacattcaagaggaggaggaggaagaggaggaagaggaggaggaagagctaggctcccgaacatgcagcttccagaagcaagtcgcgggcaattcaatccgagaaaatggagccaaatcccaaccggaccccttctgtgagaccgattctgatgaggagattctggaacagatccttgagctgcctctacagcagttctgttccaagaagctgttctccatacctgaagaagaagaggaggaagaggaggacgaggaggaagagaagagcggagctggatgttcctcccgggacccaggcccaccagaacctgcactgttgggcctcggctgtgactccgggcagcctcggagaccaggccagtgccctctgtctccggagagcagtcgcgctggcgactgcttggaagatatgccgggactggtcggcggctcctccagacgacgcggtggtggctcgcctgagaagcccccgtctcgacgcaggccacccgatcctagggagcactgcagccgattactctctaataacggtccccaggcatcaggacgcctgggtccaaccagagagcgcggcggactccccgtgatagagggacctcggactggcctggaagcctccggcaggggacgccttggaccttctaggagatgttctagaggaagggctttggagcccggcctcgcgtcctgtctgtcaccgaagtgcctcgaaatttcaatagaatacgattcagaggacgagcaagaggcgggatctggcggaatcagcattacgagtagctgttacccaggggatggcgaggcatgggggaccgcgacggttggcaggcctcgtggaccaccgaaggctaactctggccctaagccgtaccctaggttgccagcctgggaaaagggtgaacctgagaggaggggccggagcgccaccggtagggccaaggaacccctgagcagggcgactgaaaccggagaggccagagggcaggacggaagtgggcgtagaggtccgcagaagcggggagtgcgcgttctgcgaccaagcaccgccgaattagttccagccaggagtccaagcgaaacactggcttaccagcacttgccagtgaggattttcgtggcactgtttgactacgaccctgtgtccatgtcccctaatccagatgctggcgaagaagagttgcccttcagggaaggacagatcctaaaagtcttcggggataaagatgccgatggcttctatcaaggagagggaggaggtagaaccgggtatatcccatgtaacatggttgcagaggtagccgtagactctcctgctggacgtcagcagctactccaaaggggatacctgagcccggacattctgctcgaaggttctggaaacggaccctttgtatactctacggcacataccacaggcccacctcccaagccccggcggagcaaaaaggccgaaagcgaagggccagctcagccctgcccaggtcctccaaaactggttccatccgccgacctgaaggctccgcacagtatggtggctgccttcgactacaatccccaagaaagctctcctaatatggacgtggaagccgaattacctttccgggccggggacgttatcactgtattcgggggaatggacgatgacggcttctactacggggagcttaatggccagcgggggcttgtgccgagcaacttcttagagggtccagggcctgaagctggcgggttagaccgggaacccaggactccccaggctgagtcacagaggacacggcgccggcgcgtccaatgttag

SEQ ID NO: 109719 - DNA, 5724 bp, Artificial Sequence
  Description of Artificial Sequence: Synthetic coding sequence
atggagcaattgaccactttgcctcggcccggcgaccccggggccatggagccctgggccctgcctacctggcactcctggaccccaggtaggggaggggagcctagctctgcagctccttcaatcgccgacacacctcccgcagccctgcaattgcaggaactgagatctgaggagtcaagtaagccgaagggcgatgggtcatccaggccagtcggaggaacggacccagagggggcagaggcttgcctgccaagcctcggacagcaggcttcaagctcaggaccagcctgtcagagacctgaggacgaggaggtggaagcattcctaaaggcaaaactcaacatgtcgttcggggatcgccctaatctcgagctccttcgagcactgggggagcttagacaacgctgtgctatactcaaggaggagaatcagatgctgcggaagagttcatttcccgagaccgaggagaaagttagaagattgaaaaggaaaaacgcagagttagccgtgatcgccaaacggctggaagaaagggctcggaaattgcaggagacaaacctacgggttgtgtccgctccgctgcctagacccggcacgtcacttgaactctgccgtaaggcactggcaaggcagcgcgcccgggacctgtctgagaccgccagcgccctgttggccaaagataagcagatcgctgccctacagcgcgagtgtcgcgagttacaggcaagactgacccttgtggggaaggaggggccccagtggctccacgtccgagactttgataggctgctgcgcgagtctcaaagagaggtccttagactgcagcgtcagatcgcccttaggaatcagagagaaaccttgcccctgcccccctcatggccacccggcccagcactgcaggcacgcgcaggagctcccgcaccaggagctcctggcgaggccacacctcaggaagacgcagataatttgcccgtgatcctgggcgaacccgagaaagagcagagggttcaacagctcgaatcagaactgtccaagaagagaaagaaatgcgaatcactggaacaggaagcccggaaaaaacagaggagatgtgaagagctcgagttacagctgcgccaggcccaaaatgaaaacgcccgtctggtggaggagaactccaggctgtccggcagagctacagaaaaagaacaggtagaatgggaaaacgccgaactgcggggacagttgctgggggtgactcaggagcgagactccgccctacgcaagagccaaggtctacaatccaaacttgaatcgctcgaacaggtgctgaaacacatgcgcgaagtggctcagagaagacaacagctcgaggtcgaacacgaacaagccaggctctcgctacgagagaagcaagaggaggtgaggcgtctgcagcaggcacaggcggaggcacaacgggagcatgaaggcgcggtgcagttattggagagtaccctggactctatgcaggctcgagtccgggaactcgaagagcaatgtaggtctcagactgagcaattctccctgttggcacaggagctacaagcattccggctccaccccgggcccctggaccttttgacctctgctctcgactgtggatccctgggggattgcccacctcctccctgctgttgttccatcccacagccatgtaggggcagcggtccgaaggatctggacctgcccccggggtccccaggaagatgcactcctaagtctagtgagcctgcccccgcgactctcaccggcgtgccgcgcagaactgccaagaaagccgaaagcttatcaaactcatcccacagcgaatccatacacaactcccccaaatcgtgtcccacgcctgaagtagataccgctagcgaagtggaggaactggaagcggatagcgtgtctctgctgcctgctgcccccgagggctcccgagggggggcgaggattcaggtctttctcgcccggtactcctataaccctttcgagggtccaaacgaaaaccctgaagcagagcttcctctgactgcaggagaatacatctacatctacgggaacatggatgaggacggatttttcgaaggagaattgatggacggccggcggggtctggtaccatctaattttgttgaaagggtctccgacgacgacctgcttactagcctccctcctgaacttgcagatctgagccatagttctggccccgaactgagctttctgtcggtcggcggagggggcagtagttcagggggacagagctctgtcggccggtctcaacctcgaccggaagaagaggacgctggcgatgaactgtctctgagcccctcaccagagggattgggagaaccaccggccgtcccataccccagacggctggtggtgcttaaacagttggcgcattccgtcgtgctggcttgggaacccccccccgaacaggtcgagctgcacggcttccatatctgtgtgaatggtgaattaaggcaggccctgggtcccggggcacctccaaaggccgtgctggaaaatttagatttatgggcagggccactgcacattagcgtgcaagcactaacgtctcgcggctcttctgaccctctgaggtgctgtcttgcggttggcgcaagggccggagtcgtcccaagccagctgcgcgtacaccggcttactgctacatccgccgagatcacgtgggttcccggaaatagtaacctcgctcacgcaatctacttgaatggggaggagtgtccaccagcctcaccttcgacatattgggccacattttgccacctgcggcccggcaccccctaccaagcacaagtggaagcccagctgccccctcagggcccgtgggagcctggctgggaaaggctagagcagagagcagccaccttgcaatttaccaccctgcccgcaggcccaccagatgcgcctctggacgtccagatcgaacctggaccatcacccggaatcctaattatttcttggttgcccgtcacaatcgacgccgctgggaccagcaacggcgtgcgcgtaaccggctacgccatctacgccgacggacagaagatcatggaggtagccagcccaacagcaggttctgtgctggttgagttaagccagcttcagttactccaagtctgccgcgaggttgtcgtccgcacaatgagtccccatggggaaagcgcggactcgatcccagcccctatcaccccagccctggcacctgcatccctgcctgccagggtgagttgcccgagcccccatccctctccagaagctcgagcccccttggcctcagcaagcccagggcctggcgaccccagcagccctctacagcacccagctccattggggacccaggagccgcctggagctccaccggcatcccccagcagagagatggcaaagggatcccacgaagatccgcctgctccctgtagccaggaagaggctggcgcagccgttctgggcacctcagaggagcgaacggcctcaacatcaactctgggggagaaagatcctgggccagctgctccttcactggctaagcaggaagctgagtggactgctggggaggcttgcccagccagttcaagcacccagggagccagggcacaacaagccccaaataccgagatgtgccaaggcggagaccccggatcaggactcagacccagggctgaaaaagaagatactgcagagttgggggtgcacctggtgaattcactggtggaccatggcaggaactctgacctgtccgatatccaggaggaagaggaggaagaggaggaagaagaggaagaagagctcggctcaagaacctgctctttccagaaacaggtggccggcaactcaatccgagagaatggtgctaagagccagccagacccattctgtgagaccgacagtgatgaagagatcctcgagcagattctggaactgccattgcaacaattttgctccaagaagctcttttccattcctgaggaagaagaagaggaggaggaagatgaagaggaggaaaaatcgggtgccggatgtagcagccgggacccaggaccccccgaaccggcccttttagggctcggctgcgatagcgggcaaccacgccgccccggtcagtgccccctgtcacctgaatcctccagggcaggcgactgcctcgaggatatgccggggcttgtgggggggtcctctagaagacgcggtgggggctctccagaaaagccacccagtaggcggcgccccccagatccgcgggagcactgctctcgcctgttgagcaataacggccctcaggcgagcggacgactgggcccgacacgggaacggggcggactgccggtgatcgaaggccctagaaccggccttgaggcctcaggcaggggccggctgggtccctcaagacgatgcagtaggggtcgcgcactggagcccggcctggccagctgcttgtcccccaagtgcctggaaatctcaatcgaatacgactcagaggatgaacaggaagccggttcagggggaatctcaattacctcatcatgctacccaggggatggagaggcatggggcacagccactgttggtagaccccggggccccccgaaggctaacagcggaccaaaaccctatcctcggttgccagcttgggaaaagggggaacctgagaggcgcggacgctccgcaacaggaagagccaaggaacccctcagcagagcaaccgagacaggagaggctcgggggcaggatggaagtgggaggcgcggccctcagaagcggggagttagggtactccgcccctctaccgccgagctggtgcctgcccgctcgccttctgagacactggcttaccaacacctgcctgtgcggatatttgtggccctcttcgattacgatcccgtcagcatgtcaccaaatcccgacgctggcgaggaggaacttccatttcgggaaggccaaattctgaaggtatttggcgacaaggacgccgacgggttttatcaaggggaaggtggtgggcgaacaggctacatcccatgtaatatggtggcggaagtcgccgtggactcccccgcggggcgccagcagctcctacagcgtggatatctgtctccggatattctattggagggctccggcaatggaccttttgtttactccaccgctcatactaccggcccccctcccaagccgcgaaggtctaaaaaggccgagtctgaaggtcctgctcagccctgccccggaccacccaagctggtgccatcggccgacttaaaagcaccccatagcatggtggcagccttcgattataatcctcaggagtcttctcccaacatggacgtcgaggcagagctgccatttagggccggagatgtcatcaccgtgttcggcggcatggacgacgacggcttctactacggagagctaaatggtcagagaggactggtccccagtaactttctcgaaggcccaggtcccgaggcaggaggccttgatagggagccccgaactccacaggcggagtcacaggattggggctgcacaacacaagggtcacccggaccacccggaggcccatgcaccccatcatctgggagcgctcctcggatagagaggggtgagccccagggtcggagcgagaaagtttggggattttttagtaagggcaagcagttattgcgccggttggggtctggtaaaaaagagtag

SEQ ID NO: 109720 - DNA, 864 bp, Artificial Sequence
  Description of Artificial Sequence: Synthetic coding sequence
atggtgaacgacccaccagtccctgctctgttgtgggcccaagaggtcgggcaggtactggccggtagggctcggcgactgcttttgcagtttggagtcctgttttgcacaattcttctcctcctgtgggtcagtgtttttctatacggatcattctactactcctacatgcccactgtgagccatctaagtcctgttcacttctactaccgtaccgattgtgacagcagtaccacaagtctatgcagcttcccggtggctaatgtcagtctgaccaaaggaggacgggatcgggtcttaatgtatggccagccctacagggtgacgttagaactagaacttcctgagtcccctgtaaatcaagacctggggatgttccttgtaaccatttcatgctatacccggggcggacggatcatcagtacctcctcccggtcagtgatgcttcactatcgatccgacctccttcagatgctggacaccctcgtctttagcagcctcttgctgttcggctttgccgaacagaagcagctcctggaggtcgagctgtacgccgattatcgcgaaaactcatacgtgcccactaccggtgccattatcgagatccattcgaaacgaatacaactttacggcgcatacctaaggatccacgctcactttacagggctcagattaacctcagagaaggaaactatcccgggaagaaagagtaatgagggctctctcctaatttcccagggactgaaggcacgccggtcacaactgcggaatcaaatgctccagaggatggtccgcgctcttaagattccccaaggacaacgcgtgtcttgccctcgccgacgtaatcagatctctagtccatag

SEQ ID NO: 109721 - DNA, 1389 bp, Artificial Sequence
  Description of Artificial Sequence: Synthetic coding sequence
atgagcacggaaaaggtcgaccagaaagaggaggcgggggaaaaggaggtgtgcggggatcagataaagggtcccgataaagaagaggaaccccctgctgccgcctcgcatgggcagggttggagaccaggagggcgtgcagcacgaaacgccaggccggagccaggtgcccgccacccggctctgccagcgatggtaaatgaccccccagtgcccgcgctgctgtgggctcaggaagtgggtcaggtcctcgccggtagagctaggcggcttctgttgcagtttggggtgctgttttgtaccatcctgctgcttctgtgggtgtcagtgttcctttacggctccttttactatagttatatgcctactgtatcccacctgagtccagtacacttctattaccgcactgactgtgactcttccactacaagtctgtgctcattccctgtggctaacgtgtccctcacaaaggggggcagagatcgagtgctgatgtatggacagccatatcgcgtgaccctggaactggaattacctgaaagccccgtcaatcaggacctggggatgtttttggtgacaattagctgttataccaggggtggaaggatcatttccacttccagtaggagtgtcatgttgcactatcgtagcgacctgctccaaatgctggacactctagtgtttagttcattactgttatttggttttgctgagcagaagcagctcttggaagtcgagctgtacgcggactacagagagaattcttacgtgccaactacaggcgcaatcattgagatacatagcaagaggattcagctgtacggcgcgtatctgcgcatccacgctcacttcaccggccttagatacctcctgtacaattttccaatgacttgcgccttcatcggagtggcctccaactttacgtttttgtcagtgatcgtgctcttctcttacatgcaatgggtgtggggaggaatttggcctcggcataggttctcgttgcaagtgaacatcaggaagcgggacaactcaaggaaagaagtacaacggagaatttctgcgcaccagcccggtcctgagggtcaggaggaatccactccccagagcgacgttactgaagacggggaatcccccgaagacccaagcggcaccgaaggacagctgtctgaagaagaaaagcccgatcagcaacctctgagcggagaggaggagcttgaacctgaggcgtccgatggcagtggctcctgggaggacgctgcccttctcaccgaagcaaacctgcccgccccggccccagcttcggccagcgcaccagttctggagaccttgggaagttccgagccagctgggggagctctcaggcagcgccctacctgctctagctcctag

SEQ ID NO: 109722 - DNA, 1197 bp, Artificial Sequence
  Description of Artificial Sequence: Synthetic coding sequence
atggtaaacgacccacctgtgcccgccctgctgtgggctcaggaagttggccaagtgctggccggcagagcccgcaggttattactgcagttcggcgttctgttctgtacaattctcctgctcctttgggtaagcgtctttttatacgggtccttctattatagttatatgccaactgtgtcccacctaagccctgtgcacttttactacaggactgattgcgatagctcaacaacctcactttgttccttccctgtggccaatgtgtctctaactaaaggaggcagggatcgcgtgttgatgtatggccaaccctatcgcgtgaccctcgagctggagctgccggaaagtccagtgaaccaagaccttgggatgttcctggtcactatcagctgctacacaaggggaggccggatcatttccacttcttcccgctcagtgatgttacactatcgttccgacttgctgcagatgttagatacgctggttttctcttctctcttactgttcggttttgctgagcagaaacaattactcgaagtggagctgtacgcggactacagagagaatagctacgtacccaccacaggtgccatcatcgagatacactctaaaaggatccagctgtacggcgcgtacctgcgcatccacgcccactttaccggcctccgctatctcttgtacaacttcccaatgacctgcgcattcatcggagtggcttccaattttacgttcctgagcgtgatcgtactgtttagttatatgcagtgggtctggggcgggatctggccgaggcacaggttctcactccaggtaaatattcgtaaaagggataattcgagaaaagaagtgcagcgaagaatctccgctcatcaacccgggcccgaaggccaagaggaaagcacaccccaaagcgacgtgaccgaggacggagaaagtcccgaggacccatccggcaccgaaggtcagttgtcagaggaggaaaaacccgatcaacagcctttgagcggggaagaagagctggagcccgaagccagcgacggttccggctcttgggaagacgcagcactgctcaccgaagccaatttgccagcccccgcccccgcatccgcaagcgcaccagtgctggagactcttgggtcaagcgagcccgctggaggcgcactgagacaacgtccgacgtgcagtagcagttag

SEQ ID NO: 109723 - DNA, 1197 bp, Artificial Sequence
  Description of Artificial Sequence: Synthetic coding sequence
atggtgaacgatcctcctgtgcccgctcttctatgggctcaagaggtgggccaggtgctcgctggtcgagccagacgcctcttgctgcagtttggcgtacttttctgcaccatcctgctactgctgtgggtgtccgttttcctgtatggatctttctattatagctacatgcccaccgtgtcccacttgagtcctgtgcacttctattataggaccgattgtgatagttccaccactagcctgtgttccttccccgtggctaatgtgtcccttactaaaggcggccgcgaccgagtcctgatgtatggacagccttatcgcgtgaccctcgagttggaattacctgaaagcccagttaatcaagatctgggcatgttcctggtgaccatctcctgttatactcgcggaggtcgaatcatcagcaccagcagccgctcggtgatgctccattatcgaagcgacctcttgcagatgctggacaccctcgttttctcctctctgctgctcttcggctttgcagagcagaaacaactacttgaagtcgagctgtatgccgactaccgggagaatagctatgttcctaccacgggggcaataatcgaaattcacagcaagcgaatccagctgtatggggcctatctaagaatacatgcccacttcaccggtctacgttacctgttgtacaacttcccaatgacatgcgctttcatcggcgtggcctctaatttcactttcctatcagtgatagtgttgtttagctacatgcagtgggtctggggtggaatatggccaagacataggtttagcctgcaggtaaatatcagaaagcgcgacaattctcgaaaggaggtccagcggcggatctcagctcaccagccaggcccagaaggtcaagaagagtctacacctcagtctgacgtcactgaagatggggagtcaccagaggatccatccggaactgagggacagctgagcgaagaggaaaaacccgaccaacagccgttgagcggcgaagaggagctcgagcctgaagctagtgatggtagcggctcctgggaagatgccgccctgctgactgaggcaaatcttccagcacctgcacccgcaagcgcctccgcccccgtgcttgagactctcgggtcctctgagcctgccggtggcgccctccgccagagacctacctgctcatctagctag

SEQ ID NO: 109724 - DNA, 1197 bp, Artificial Sequence
  Description of Artificial Sequence: Synthetic coding sequence
atggtgaatgatccacccgttccagccctgctttgggcccaggaggtgggccaggtgctcgccggtagggctcgccggttgctactccagttcggagtacttttttgtacaattctactgctgctttgggtgagcgtgtttttatatggaagtttttattactcttacatgcccaccgtgagccacctcagtcccgtacacttctactatcgtactgattgtgacagctccacaacaagcctctgctccttccctgtggcaaacgtctctctgacaaagggagggcgcgaccgcgttctgatgtatggtcagccttatagagtcacattggaactcgagttacccgaaagcccagttaaccaggacctggggatgttcctagtgactatcagttgctacacaagaggagggcgtataatttccacctcctctcgatccgttatgctgcactatagatctgacttactgcaaatgttggataccctggtgttcagctctctccttctgttcggatttgcagaacagaagcagctgctggaggtggagctttatgccgactatcgcgagaacagctacgtgccaaccacaggggccatcattgagattcattccaaacgcatacaattgtatggggcttacttgcgtatccatgctcacttcacagggctgagatacttgttatataattttcctatgacatgtgcctttatcggtgtcgcaagtaacttcacgtttttatctgtgattgtattatttagctacatgcagtgggtttggggcggcatctggcctcggcataggttttcccttcaggtgaatatccgaaagagggataattccaggaaggaagttcaaaggcgaatttctgcacatcaacccgggcctgaaggacaggaggaaagtaccccgcagtccgacgttaccgaagacggcgaaagcccggaagacccttccggaacagaggggcagctttctgaagaggaaaaaccagaccaacaacctctgagcggagaagaagagctggaacctgaggcctccgacggctctggtagctgggaagacgcagccttgcttaccgaggccaatcttccagcaccagctccagcatccgcctcagcccccgtgctggagactctaggttcatctgagcccgccggcggagccctcaggcagcggccaacatgttcttccagctag

SEQ ID NO: 109725 - DNA, 1389 bp, Artificial Sequence
  Description of Artificial Sequence: Synthetic coding sequence
atgagcactgagaaggtcgaccagaaggaagaggctggcgaaaaggaggtctgcggggaccagatcaaaggaccggataaagaggaggaaccacctgccgctgctagccatggacagggctggagaccagggggtagagccgctcggaacgctagaccagaacctggtgccagacacccagcccttcctgcaatggttaatgaccccccggtgcccgccctgctttgggcccaagaggtgggccaggttctcgccggtagagcccggcgactgttgttgcagttcggagtgctgttctgcacgatcctactgctgctatgggtgagtgtttttctgtatggtagcttttactatagttacatgccgacagtctcgcacctgagtcccgtgcacttctactataggaccgactgtgacagcagcaccacatctctgtgttcttttcccgtggcaaacgtgtccctcactaagggagggagagacagagtgctgatgtatggccagccatacagagttacacttgaactggaacttcctgagtccccggtgaatcaggacctgggtatgtttttggtgactatctcatgctatacccgcgggggccgaattatatctacaagttctcgctcagtgatgctccattacaggtccgatctgcttcaaatgctcgacaccctggttttcagttctctcctgctttttgggttcgctgagcagaaacagctccttgaagtggagctgtacgcggattaccgagaaaattcatacgtgccaaccactggcgccatcatcgaaatccacagtaagcgaatccagctgtatggggcttatctgagaattcatgcacatttcacagggcttcgttatctcctgtacaatttcccaatgacatgcgccttcatcggcgtcgctagtaatttcacatttctctcggtgattgtgctgtttagctacatgcagtgggtgtggggaggaatttggcccagacacaggttcagcctccaggtcaatattcggaagagggataatagccgcaaagaagtgcagcgcaggatcagcgcgcaccagcccggacccgagggccaggaagagtcaacacctcagagcgatgtaactgaagacggagagagtcctgaagacccaagcgggacagaaggtcagctctctgaggaagagaagccagatcagcagccactgagcggcgaggaggagctcgaacccgaagctagcgacggcagcggttcttgggaggatgcagcactgttaactgaggctaacctgcctgccccggcccccgccagtgcatcagcccccgtgttggagaccctcgggagttccgagccagcgggtggcgcactgcggcagagacctacttgctcctccagttag

SEQ ID NO: 109726 - DNA, 672 bp, Artificial Sequence
  Description of Artificial Sequence: Synthetic coding sequence
atggtgaacgacccacccgtgcctgccctgttgtgggcacaagaagtgggccaggttctggctgggagggcacgcaggcttctcttacagttcggagtcctcttctgtactatactgctgctcctgtgggtgtccgtttttctgtatggaagcttttactactcgtatatgccaaccgtctcccacctcagtcccgtccacttttattaccggaccgactgtgatagctccactacctctctttgcagctttcccgtggccaatgtgtctctcacgaagggcggtagggatcgcgtccttatgtatggccaaccataccgggtcaccctcgaactcgaactgcccgaaagtccagtcaatcaggacctcgggatgttcctggtgacaatatcctgctacactcgaggcgggaggatcatcagcacttctagcaggtcagtcatgctccattatcgttctgacctgttgcagatgctagataccctcgtattctcttctcttcttctgttcgggttcgcagagcagaaacaattgttggaggtggaactttacgcagactatcgcgagaattcttatgtccccacgacgggagccattattgagatccacagtaagagaattcagctttacggagcctatctgcgaatacacgcacacttcacaggcctctag

SEQ ID NO: 109727 - DNA, 282 bp, Artificial Sequence
  Description of Artificial Sequence: Synthetic coding sequence
atgtccacagaaaaggtagatcagaaggaagaggctggggaaaaagaagtgtgcggtgatcagattaaaggccctgacaaggaagaagagccacctgctgctgcgtcacacggccagggatggcgcccgggcggaagagcggcgcgcaatgccagaccagagcccggtgctcggcatcccgccttgcctgccatggtcaacgacccccctgttccggccctgttatgggcgcaggaggttggacaggtactggcaggtagggctaggaggctgctgttatag

SEQ ID NO: 109728 - DNA, 681 bp, Artificial Sequence
  Description of Artificial Sequence: Synthetic coding sequence
atgtcaacagagaaggtggaccagaaagaggaagccggggagaaggaggtctgtggcgaccagatcaaggggccagataaagaggaagagccgccagcggctgcatcacatggacagggctggcgtcccggtggtcgcgctgcgaggaatgcgagacctgaacccggagcacgtcaccccgctctgcctgcaatggtcaatgatccacctgtgcccgctctgctttgggcgcaggaggtcggccaggtgctggctgggagggctagacgcctgcttttgcagtttggcgtactgttttgtacaatcctgctattgctgtgggtatcagtgtttctctatggttcattttattactcatatatgcccaccgtgtctcacctgagtcccgtgcacttctattatcggacggactgtgattctagcacaacgagtctctgttcatttcctgtagccaacgtctcactaactaaaggagggcgcgatagggtgcttatgtacggtcagccatatagagtgacattggaacttgaactcccagagagtccggtgaatcaggatctcggcatgtttctggtcaccatatcatgctacaccagaggggggaggattatttctaccagctcaagaagcgtaatgctacattataggtcagatctgctccagatgctagatacactatag

SEQ ID NO: 109729 - DNA, 72 bp, Artificial Sequence
  Description of Artificial Sequence: Synthetic coding sequence
atgtcaacagagaaggtcgatcagaaggaggaggccggtgagaaggaggtctgtggggaccagattaaatag

SEQ ID NO: 109730 - DNA, 87 bp, Artificial Sequence
  Description of Artificial Sequence: Synthetic coding sequence
atgtcgacagagaaagtagatcagaaagaggaagccggcgaaaaagaagtctgtggggatcagatcaaaggcccggacaaagaatag

SEQ ID NO: 109731 - DNA, 372 bp, Artificial Sequence
  Description of Artificial Sequence: Synthetic coding sequence
atgtcaaccgagaaagtggaccagaaagaggaggccggcgagaaggaagtgtgcggagaccagatcaaaggccctgataaagaagaggaaccccctgcagctgcctctcacggccaagggtggcgtcccggcgggcgcgccgctagaaatgcccggccagaacctggtgcccggcacccggccctgcccgccatggtaaatgaccctcccgtccccgcgctgttatgggcacaggaagtgggccaggtgctcgccggacgggctcgccgcctgttgctccaatttggtgtcctcttttgtacaattctgttgcttctgtgggtcagcgtgttcctatatgggtccttttactatagctacatgcccacgtag

SEQ ID NO: 109732 - DNA, 300 bp, Artificial Sequence
  Description of Artificial Sequence: Synthetic coding sequence
atggtcaacgatccacccgtacccgcgttactttgggcgcaggaggtaggccaggtactggcaggtcgagcacggagactgttactgcagtttggagtcctgttttgcaccatcttgttgttactatgggtgtcagtgttcctctacggttctttttactacagctatatgcctacagtaagtcaccttagccctgtgcatttctactaccgcaccgattgcgacagtagcactaccagcctgtgttcattcccagtggcgaacgtgtcacttaccaaaggcggtcgggaccgcgtgtag

SEQ ID NO: 109733 - DNA, 879 bp, Artificial Sequence
  Description of Artificial Sequence: Synthetic coding sequence
atggagttccagcccaaccaggaggatgaggaagacgctcacgcaggaattattggacgatttctcgggctgcagagccatgatcaccaccccccccgggcaaactcccgcacgaagcttttatggccgaagagagagagcctcctgcacgaaggtctgcccaaaaatcataaagccgctaagcaaaacgtacgcggacaagaagacaacaaggcctggaaactcaaagccgtggatgctttcaaatctgcgcccctatatcagcgccccggatattactctgctcctcagaccccgctgagtcctactcctatgtttttccccctagaaccttcagccccctccaagctgcacagtgtaaccggcattgatactaaagacaaatctcttaagaccgtctccagcggggccaaaaaaagcttcgagctgctctcggaatctgatggtgcactgatggaacacccagaagtttcgcaggtgagaaggaagaccgtggagtttaacttgactgacatgccggaaatccctgagaaccacctgaaagaacctctcgagcagagccccaccaatattcacactaccctgaaagaccacatggacccttactgggccctggaaaataggtctgtcctacatctaaatcagggacactgtatagccttgtgccctacccccgctagtttggccctgtcactgccgttccttcacaacttcctgggctttcatcactgccagtctactttggacctgagaccagcactagcatggggtatttatctcgcaaccttcacaggaattcttggaaagtgctctgggcccttcctgacttccccatggtaccatccggaagacttcctgggaccaggggaaggccggtag

SEQ ID NO: 109734 - DNA, 1497 bp, Artificial Sequence
  Description of Artificial Sequence: Synthetic coding sequence
atgtttgagaaactgacattgtattgtgactcttacattcagttgattcccatcagcttcgtactgggattctatgtgacccttgttgtgactcggtggtggaatcagtacgagaacctgccgtggcctgatcgactgatgtcgctggtgtccgggtttgtggagggtaaggatgagcagggaaggttgttgagacggacactcatacgctacgccaacttgggaaatgtgctgatcctgaggtctgtgtccacagcagtttacaaaagattcccatctgctcagcacctcgtgcaggccggtttcatgaccccggccgagcataagcagctggagaaattatccctgccccacaacatgttttgggtgccttgggtgtggtttgctaacctgagcatgaaagcctggctaggtggcagaatccgcgacccaatactcctacagagtctgctcaacgaaatgaatacccttagaacacagtgtggccacctgtacgcatacgattggatttccatccctttagtgtatacccaggtggtgaccgtggcagtatatagcttctttctgacgtgtctagtgggtaggcagtttctgaaccctgccaaggcatacccgggacacgagctcgacctggtcgtgcctgtcttcaccttcctgcagttttttttttacgtcgggtggctgaaagtgtcactgctggccgttgacgagatgcaccaagaccttcctcggatggagcccgacatgtactggaataagcccgagccccagcccccatatactgctgccagcgcacaatttagaagggcaagttttatgggttctactttcaacatcagtttaaataaagaggagatggagtttcagccaaatcaggaggatgaagaggatgcacacgccggaatcattggacgatttctggggctgcagtctcatgaccatcatccacccagagcaaacagtagaacaaaactcctgtggccaaagcgagaatcattgctacatgaggggctacccaagaaccacaaggccgcaaaacagaacgtgcgtggacaggaggacaataaagcatggaagctcaaggcagtggatgcctttaagagtgctcctctgtaccagaggcccggctactacagcgcaccacagactcccctttctcctacgcccatgtttttcccactggaaccctctgccccctcaaagctgcattcagtgacaggaatcgatacaaaggacaagtctctgaaaactgtgagtagcggagccaaaaagtcctttgaattgctgtcagagtctgacggcgcattgatggagcaccctgaggtgtcccaggttaggcggaaaaccgtcgaattcaacttaaccgatatgccagagattccggaaaatcatctcaaggaacctttagagcagagtcctacaaatatacacaccactctaaaggaccacatggatccgtactgggccttggaaaaccgcgatgaagcacatagctag

SEQ ID NO: 109735 - DNA, 1758 bp, Artificial Sequence
  Description of Artificial Sequence: Synthetic coding sequence
atgaccattacatacactagccaggtcgccaacgcaaggctggggtccttctcccggctgttactctgttggcgcgggtctatctacaagctcctgtacggcgagtttctcatctttctgctttgctactacattatcaggtttatatacaggctggctctcacagaagagcagcagctcatgtttgaaaaattaactttatactgcgacagctacatccaacttatcccaatttcgttcgtcctgggtttctacgtgacacttgtggtcacacgatggtggaaccaatacgaaaatctgccatggccggaccggctcatgagccttgttagcgggtttgttgaaggcaaggatgagcagggccgcctcctccgacggactctaataaggtacgccaatttaggaaatgtcctgattttaagatccgtttccacagctgtttacaaacgcttccccagcgcacagcaccttgtgcaggcagggttcatgactcccgccgaacacaagcagctggaaaaattgtcattaccgcataacatgttctgggttccgtgggtatggtttgctaatctgagcatgaaggcctggctcggcggtcgcattagagacccaatcttgttgcaaagcttgcttaatgagatgaatacactgcgcacccaatgtggtcatctctacgcctacgactggatcagcattccgttagtgtatacacaggtggtcaccgtcgccgtctattcattttttctaacttgcctcgtaggtcgacagtttcttaaccccgccaaagcctatcccggtcatgagttagatctagtcgtcccagttttcactttccttcagttttttttctatgtcggctggctgaaggtggccgaacagttgatcaatcctttcggagaagatgacgatgatttcgagactaactggattgtggacaggaatctgcaggtatcgctgctggcagtcgatgaaatgcaccaggaccttccgagaatggagcccgacatgtattggaataaaccagaacctcagcctccttataccgctgcctccgctcagttccgacgagctagctttatggggtcaacatttaatatatccttaaataaggaagaaatggagttccagcccaatcaggaggacgaggaagacgcacatgcggggattatcggtcgctttttaggccttcagtcccatgaccatcacccacccagagccaactctcgcacaaaactgctttggcccaaaagggagagcctacttcacgagggcttgcccaaaaaccacaaagccgctaaacagaatgttcgcggacaggaagacaacaaggcgtggaagctgaaggccgtagacgcctttaaatccgcccctctataccagcgacctggatactacagcgctccccagacgccactgtcacccacccctatgtttttccctcttgaaccaagcgccccgtccaaacttcattccgtaactggtatagatactaaggacaagagtttaaaaaccgtgtcttctggagccaaaaagtcattcgagctgctgtcggagagtgacggggctctgatggaacatcctgaagtctcccaggttcgtcgcaagacggtggagtttaatctgaccgacatgccagagatcccggagaatcacttgaaggagcctctggaacagtcacccaccaacatccacacgaccttaaaggatcacatggatccttactgggctctagagaaccgagacgaagcacacagttag

SEQ ID NO: 109736 - DNA, 813 bp, Artificial Sequence
  Description of Artificial Sequence: Synthetic coding sequence
atgacgattacgtacactagtcaagtagcaaacgctagactggggagcttctcccgtcttctcctgtgttggaggggttcgatttacaagctgctgtacggagaattcttgattttcctgctgtgctattacattatccgcttcatatatcgattggcactaactgaggaacaacagctgatgtttgaaaaattgaccttgtactgcgacagctacatccaactcatcccgatcagctttgtgcttgggttctatgttacgttggtcgtcacaaggtggtggaatcagtatgagaatttgccatggccagaccgcctgatgagtttggtgtcaggtttcgtcgaaggaaaggacgaacaggggagactgctcagacgaaccctcatacgatacgcgaacttaggcaatgtgcttatcctcaggtccgtaagcaccgcagtttacaagagattcccctctgctcaacacttggtacaggcaggttttatgactccggctgagcataagcaactggaaaagttatccctaccacataatatgttctgggtgccttgggtatggttcgccaatctaagtatgaaagcatggctgggtggtagaattagggacccaatactgctgcaatcactgttaaacgagatgaacaccctgcgaacccagtgcggacatctctacgcttatgactggatttcaatacccctcgtctacacccagcccgagcagagaggggatggagtgccagcacagagcggtggccggggagggtgctcacggtggcaccactggccactgccgcggcccgcggtgccgtag

SEQ ID NO: 109737 - DNA, 1815 bp, Artificial Sequence
  Description of Artificial Sequence: Synthetic coding sequence
atgtttgagaagttaaccttgtactgtgattcgtacatccaactcattccaatatcttttgtgcttggcttctacgtgactttggtcgtaacccgttggtggaaccagtatgagaatctgccttggccagataggctgatgtctctcgtcagcggctttgtggaagggaaagacgaacaaggccggttactgagacggaccctaattaggtatgctaacctcggtaacgtattgattctgcgcagtgtgagcacagcagtatataagcgcttccccagcgctcaacacctggtgcaagcaggtttcatgacacccgcggaacataaacagctggagaaactcagcctaccccacaatatgttttgggtcccgtgggtgtggtttgccaatctctctatgaaagcttggcttggcggtagaatcagggatcccatactgctgcagtccctcctgaatgagatgaatacccttcgaacccagtgcggccacttatacgcttatgattggatttctatccccttggtctacacacaagtcgttacagtggccgtgtacagcttttttctaacgtgtcttgtggggaggcagtttctgaatcccgccaaagcgtatccaggccacgaactggatctcgtggtccctgtgttcacgttcctgcagtttttcttctatgttgggtggctgaaagtcgctgagcaactgattaatccatttggcgaagatgacgacgattttgagacgaattggattgtggaccgcaatctccaagtctcgctgctggcggtcgacgagatgcaccaggatctgcccaggatggagccagacatgtactggaacaaaccagaaccacagcccccctacacagcagcatccgcacagttcaggcgggcttcctttatgggctccactttcaacatttcactgaacaaagaagaaatggagttccagccaaaccaggaggacgaagaggatgctcatgccggaatcatcggaaggttcttagggctccaatcacatgaccatcatcccccgagggctaatagtcgcactaagctgttatggccgaagcgagagagcctgctccacgagggcttgccaaaaaaccacaaggctgcaaagcagaacgtgagaggtcaagaggataacaaggcttggaaactcaaggccgtcgacgcatttaaaagcgccccattatatcagcggcctgggtattattcagcccctcagacgccattgagtcccacacctatgttttttcctctcgagccttccgccccaagcaaacttcactctgttactggaattgacactaaagacaaaagcctgaagacagtttcctccggagctaagaagtcctttgagctcttgagcgagtccgatggcgctttaatggagcaccctgaagtgagccaggtccggcgcaagactgtcgagtttaaccttacagatatgcctgagattcccgaaaatcacctgaaggagcccctggagcagagcccgacaaatattcataccaccttgaaggatcatatggacccctattgggccctcgagaaccgatccgtgctgcacctaaaccaggggcactgtatcgccctgtgtccaaccccagccagcctagctctgtctcttcccttcttgcataatttcttggggttccatcattgtcaatcaactctggatctccgccctgccctggcctggggaatctatctggcgacctttactggaattctaggaaaatgttcagggccttttttgacctccccttggtaccatcccgaagatttcctcgggccaggcgagggaagatag

SEQ ID NO: 109738 - DNA, 1530 bp, Artificial Sequence
  Description of Artificial Sequence: Synthetic coding sequence
atgactgtgacatacacagcaagggtcgccaatgctcggtttgggggattctctcagttgcttctattatggagaggctctatctacaaactgttatggagagagttgttatgcttcctcggtttttatatggccttaagcgctgcctatcggttcgtccttaccgagggccagaaacgctatttcgagaagctggtcatttattgtgatcagtacgcaagcctgatacctgtcagcttcgtcctgggtttttacgtgacattggttgtgaatcgctggtggtcccagtacttgtgtatgccactcccagatgcccttatgtgcgtggtcgcaggaactgtccacggtcgggatgatcgcggccggttgtatagaaggactttaatgcggtatgccggtctctcagcagtgctgatccttaggtccgtgagcacagcagtgttcaagagattccccacaatcgaccatgtagtggaggcaggtttcatgactcgcgaagagcgtaagaaatttgagaacttgaattcctcttataacaagtactgggtgccctgtgtgtggtttagcaatcttgctgctcaggcccggagggagggaagaatccgggacaattccgccttgaagctgcttcttgaggaactgaatgtattcagaggtaagtgcggaatgctctttcattacgactggatatccgtgcccttagtctacactcaggtggtaaccattgctctgtattcttattttctggcatgtctgattgggagacaattcctggacccagcccaaggttataaggatcacgatctggacctctgtgttccaatctttactcttctccaatttttcttctacgccgggtggctcaaggtggccgaacagctaattaacccctttggtgaagacgatgatgatttcgaaacaaattttctcattgatcggaactttcaggtgtctatgctcgccgtcgacgagatgtatgatgacttagccgtcctggagaaagatctgtattgggatgccgctgaagcgagggctccttatacggccgcgacagtgttccagttacgccagccctctttccagggtagcactttcgacatcacattggccaaagaagatatgcagtttcagcgcctggatggcttggatgggcctatgggggaggccccaggagattttctccaacgactcttgcccgcgggcgccggcatggtggctgggggaccgctgggtagaaggttatcctttctgctccgtaaaaacagctgtgtgagtgaagcctccaccggggcaagctgttcttgcgctgtggtgcccgaaggggccgcgcctgagtgctcttgcggggatcctcttttggaccccgggctgccggagccagaggcacccccccccgcaggaccagagccactgacactgattccgggacctgtggagcccttcagtattgtcaccatgcccgggcctaggggccccgcccctccctggctcccctctccgatcggggaggaagaggaaaacctagcctag

SEQ ID NO: 109739 - DNA, 1530 bp, Artificial Sequence
  Description of Artificial Sequence: Synthetic coding sequence
atgaccgtgacttacaccgccagggtggctaatgccaggtttggcggtttctcccagttgctcctgctgtggcgaggctccatttacaaattactatggagggaattgttgtgcttcctgggcttttacatggcccttagtgcggcctacagattcgtcttgaccgaaggacagaagcggtatttcgagaaactcgttatttactgtgaccagtatgcttctttgatcccagtttccttcgtgctcggattctacgttaccctggttgtgaaccgctggtggagtcagtacctgtgtatgccgctgccagatgcactgatgtgtgttgtagctgggaccgtacatggccgggacgaccgcggtaggctatatcggagaaccctgatgaggtacgcaggcctatctgccgtcctgatcctgaggtccgttagtactgcggtgtttaaacggttccccacaatcgaccatgttgtcgaggcaggatttatgaccagggaagagcgtaagaaatttgaaaaccttaattcatcttacaacaaatattgggtcccttgcgtgtggttttctaaccttgcagcccaagcccgaagagagggcaggatccgagataattccgcgctaaagttgctgctcgaggagctcaatgttttcagggggaaatgcggaatgctcttccactacgactggatctcagttccactggtatacacacaggtggtcaccatcgcgttatattcatatttccttgcctgccttattggccggcaattcctggatcccgcccaaggatacaaagatcacgatttggacctatgcgtacccatatttacactgttacaattcttcttttacgcagggtggctaaaggttgcagaacagctcatcaacccttttggtgaggatgatgacgattttgagaccaacttccttatcgatcgcaatttccaagtttcaatgctcgccgtcgacgaaatgtacgacgacctggcagtcctggagaaggacctttactgggacgccgcagaggccagggccccctacaccgccgccaccgtgtttcagttgcgccagccctcattccaaggatccacattcgatattactcttgctaaggaggatatgcaatttcagcgcctagacggcctagatggacctatgggagaagctcctggcgacttcttgcagaggctcctccccgccggcgcaggaatggtggctgggggcccactgggaaggcgcttgtcttttctcctgaggaaaaactcttgcgtgtcagaagcctccactggagcctcttgcagttgcgctgtggtaccagaaggtgctgctcccgagtgctcctgcggggatcctctgttagatccaggtctgcccgaacccgaagctcctccacccgccggcccagaaccactgaccctgatccccggacctgtggagcctttcagcatcgtcactatgcccggaccccggggccccgcacctccttggctcccgtcaccgataggggaggaagaggaaaatttggcctag

SEQ ID NO: 109740 - DNA, 1530 bp, Artificial Sequence
  Description of Artificial Sequence: Synthetic coding sequence
atgaccgtgacatacaccgcgcgggtagctaacgcacggtttggcggcttttctcagctcttgctcctctggagggggtcaatctataagttgttatggagggagctgctgtgctttctgggcttttacatggcactctcagccgcatacagattcgtgctcactgaggggcagaaaagatactttgaaaagctcgtgatctattgtgatcagtacgcgtcattgattcccgtgagcttcgttctgggattctacgtgactctggttgtgaataggtggtggagtcagtatctgtgtatgcctttgccagacgctttgatgtgcgtggttgctggaactgtgcatggaagagacgaccgggggcggctctaccgacgtacacttatgcgatatgcaggcctgtcagcagtgctgatccttcggtctgtcagcaccgctgtctttaagcgattcccaactattgatcacgtggtagaagctggtttcatgacccgcgaggagagaaaaaaattcgagaatttgaatagtagttacaacaaatattgggttccgtgcgtttggttcagtaacctggcagcgcaggctcgaagagagggtcgcataagagacaatagcgcgctcaaactcttactggaggagctcaacgttttcagggggaagtgtgggatgctctttcactacgactggatctctgttcctctagtgtatacacaagtggttaccatcgccctttactcatacttcctggcatgccttatcggcaggcagtttcttgacccagcgcaaggttacaaggaccacgacctggatttgtgcgtccccatcttcaccctgctacaattttttttctatgctgggtggctcaaggtggccgagcagctgattaaccctttcggcgaggacgacgacgatttcgagactaacttcctcatagatcgtaattttcaagtgtccatgctcgcagtagatgaaatgtacgatgacctcgcagtgctggaaaaagacctgtattgggacgccgccgaagccagggctccctatactgccgccacagtgttccagctaaggcagccctcgttccagggaagtacatttgatataacactggcaaaagaggacatgcagttccagcgcctcgatggcttggatggccccatgggcgaagcgcccggcgatttcttgcagagactgctgcctgccggagcgggcatggtggctggaggccctttggggaggcgtttaagcttcttactgcgaaaaaacagttgcgtctcggaggcctccactggggcctcgtgctcctgtgctgtggttccagagggcgccgcacccgaatgtagctgcggcgaccctctgctggatcccggattgcctgagcctgaggctccccctcctgccggtcctgaaccacttactttgatacctggacctgtagaacctttcagtatcgtcactatgcctggcccccgcggccccgccccaccttggctcccctcccctatcggagaagaagaggaaaacctggcctag

SEQ ID NO: 109741 - DNA, 219 bp, Artificial Sequence
  Description of Artificial Sequence: Synthetic coding sequence
atgtttcttatctcctcgagcgtccatggtagtgatgagcacggtagactcctcagaagaacgctcatgcggtatgtgaatctcactagccttttgatatttcgatcagtttctactgccgtctacaagaggttcccaaccatggaccatgtggtcgaggctgaaaggacggggatgaaaccgatactgccttctagctttgagatgcagagcttctag

SEQ ID NO: 109742 - DNA, 2007 bp, Artificial Sequence
  Description of Artificial Sequence: Synthetic coding sequence
atgaccgttacatattccagtaaagtggctaatgctaccttcttcggttttcatcgactcctgctgaaatggcgcggaagcatatacaagcttctgtacagagaattcatcgtgtttgctgtgctgtatacggctatcagcctggtgtacagactgctcctgacgggagtgcagaaacgttacttcgaaaagttgagcatctattgcgacagatacgccgagcagataccagtgaccttcgtgttgggcttttacgttaccctggttgtgaaccggtggtggaatcaattcgtgaacctgccttggcctgacagattaatgtttttgatcagttcgtccgtgcacgggtccgatgagcacggcagactgttgaggaggactctcatgcgctacgtgaacctcacatccctgctaatcttcagaagcgtgagcaccgccgtgtacaagcgtttcccaaccatggatcatgtcgtggaggctggtttcatgactacggatgaacgcaagctattcaatcacttgaagtcacctcatctgaagtattgggtgccgtttatttggttcggcaacttggccaccaaggcccgaaatgaaggccgcattcgggattcggtcgacctccaatctttaatgaccgagatgaatcgataccgaagctggtgctcactgctgttcggttatgactgggtaggcattccactcgtgtatacgcaagttgtcacgcttgccgtgtacacttttttttttgcctgccttatcggtaggcaattcctggatcccacgaagggctacgctggccatgacctggacttgtacattcctatctttaccctgctgcagttctttttctatgccgggtggctgaaagtggcggaacaactgatcaacccattcggtgaggacgatgatgacttcgagaccaactggtgcatcgatcggaatcttcaggtttccctgctggctgttgatgaaatgcacatgtcccttcctaagatgaaaaaggatatttactgggatgacagcgccgcgagacccccctatacgcttgctgcagcagattactgcatccctagttttctggggtccacagtgcagatgggattaagcggtagcgattttcccgacgaggagtggctgtgggattatgaaaaacatggtcacaggcacagcatgatccgacgcgttaagaggtttctctctgcccatgagcacccatccagccccaggagacgcagctacagaagacagaccagcgactcctccatgttcttgccccgcgatgatcttagtcccgctcgggaccttctcgacgtcccctcacgaaaccctcctcgggcctcccccacatggaagaaatcctgcttccctgaggggtcaccgactctacacttcagcatgggggagttatccaccatacgcgagacatctcagactagtactctgcagagcctaaccccacagagctccgtccggactagccccatcaagatgcctctggttccagaagtgctaatcaccgctgctgaggctcccgtcccaacctccggaggataccatcacgattcagccactagcatcctgtcaagcgagttcaccggggtccagccgagcaagaccgagcagcaacagggaccgatgggttcaatcctgtccccgtcagaaaaggagacacctcctggcggcccttccccacagacagtgtctgcttctgccgaggaaaatatattcaactgcgaggaggatccaggtgatacttttctaaagagatggagtttgcctggattcctgggctctagtcatacctcgctcggaaacctctcgcccgaccctatgagctcccaaccagcactgctcattgacaccgagacttccagtgaaattagcggaatcaatatcgtggccgggtcacgggttagttctgacatgctgtacttaatggaaaatcttgacacaaaggagaccgatatcatcgaactcaacaaggaaacagaagagtccccaaaatag

SEQ ID NO: 109743 - DNA, 1197 bp, Artificial Sequence
  Description of Artificial Sequence: Synthetic coding sequence
atgacggtcacctatagttcaaaagtggcaaatgccacatttttcggcttccatcggctcctgctaaagtggagaggcagcatttataagcttctgtatcgggagttcattgtcttcgcagtgctttacacagcgatctctttggtataccgcctgctgctaacaggagtccagaagaggtactttgagaagctttccatctactgtgatagatatgcggaacaaattccagtgacttttgttctcggcttctacgtgacgctggtcgtgaacaggtggtggaaccagtttgtcaatctcccatggccagaccgcctaatgtttttgattagttcttcagtgcacggatctgatgagcatggtaggctgttaagacgcacgctgatgcgttatgtgaatcttacctcactgcttatcttcagatcagtgtctacagccgtttacaagcggtttccaaccatggatcacgtcgtggaggccggcttcatgacaaccgacgaacggaagctcttcaaccaccttaaatcaccacatttgaagtactgggtcccatttatatggttcggcaatctcgcaactaaagcaaggaacgaaggcaggatccgagacagtgtggaccttcagtcactgatgaccgagatgaatcgctatcgaagctggtgtagtctcttattcgggtatgattgggtcgggatccccctcgtatacacccaggtggtgacacttgccgtttacacctttttctttgcatgcctcatcgggaggcaattcctggacccgacaaagggctacgccggccacgaccttgatctgtatattcccatcttcacgctcctacagttctttttttatgccggatggctgaaggttgccgagcagttgattaatccctttggcgaggatgacgatgactttgaaactaactggtgtattgacagaaacctgcaggtaagcctgctggccgtggatgagatgcacatgagtctgcccaaaatgaagaaagacatttactgggacgacagtgcagcgaggccgccctacacactggccgcagccgactactgtatcccttcattccttggcagtacggtgcagatgggaaagcagatgcccaaaaacgagtggaagatggaggacatcaaaattcctctgccccagccccagtttcagtgcgctaagtcagacccaggaggatag

SEQ ID NO: 109744 - DNA, 219 bp, Artificial Sequence
  Description of Artificial Sequence: Synthetic coding sequence
atgttccttatctcatcttctgttcacggctctgacgagcacggccgcctgcttagaagaacgttgatgcgatatgtcaatctgacaagcctgctcatattcaggagtgtttcaaccgcagtgtacaagcgatttcccactatggatcacgtggtggaggctgaacggactggcatgaagcccatcctcccttcctcttttgagatgcagtccttctag

SEQ ID NO: 109745 - DNA, 1368 bp, Artificial Sequence
  Description of Artificial Sequence: Synthetic coding sequence
atgactacggatgagagaaagcttttcaatcatctgaagtctcctcacttgaagtactgggtccccttcatatggtttggcaacctcgcaaccaaggctcgcaacgaggggagaatcagggactcagtcgacctacagtccctcatgactgaaatgaaccggtacaggagttggtgttcacttctgtttggctatgactgggtgggaatccccctggtgtatactcaggtggcagagcagttaatcaatccctttggcgaggatgacgatgactttgagaccaactggtgcattgatagaaatctgcaggtcagtcttcttgcggtggatgaaatgcacatgtcgctccctaagatgaagaaggacatttattgggacgacagcgctgcgcgccctccatataccctcgccgcggctgattactgcatcccctcatttttaggatccacggtgcaaatgggactgagcgggtcagatttcccagatgaggagtggttgtgggactatgaaaaacacgggcatcggcacagcatgatcagaagagtaaaaaggttcctgtcagcccacgaacaccccagctccccccgtcgaaggtcgtacaggcgccagactagcgactcttctatgttccttccacgggatgacctgtctcctgcaagagatttattggatgtaccgtcccgcaacccccccagagcctcacctacttggaagaagtcctgcttcccagaaggctcccccaccctgcatttctccatgggagagttatcaaccattagggagacctctcagactagcacgctgcagtcactcaccccccagtcctccgtgagaacctcccccattaagatgccccttgttcctgaagtactgataacagcagcagaagcacctgtgccaacgagtggggggtatcaccatgattctgctaccagcatattgtccagcgaattcaccggggtccagccttccaagaccgagcagcagcaaggacctatggggtcaatcttgtcaccctccgaaaaagagactccgccaggggggccctctccgcaaaccgtttccgcgagcgctgaggaaaacatcttcaactgtgaggaggaccccggagatacatttctgaaaaggtggtccctccccggatttctgggatcaagccatacgtctctgggcaacctctcgccagaccccatgtcatcgcagcctgctctactgatagacacagagaccagcagcgaaatcagcggaattaatatcgtcgctggtagccgcgtgtcgtctgacatgctttatctgatggaaaacttggatacaaaggaaaccgacataatcgaactgaacaaagagactgaagagagtcctaaatag

SEQ ID NO: 109746 - DNA, 219 bp, Artificial Sequence
  Description of Artificial Sequence: Synthetic coding sequence
atgttcctgatctctagcagcgtccacggaagcgatgaacacggcagacttctcaggagaacacttatgaggtacgtgaacctgaccagcctgctgatctttcggagcgtgagcacggctgtctataaacgcttccctaccatggatcacgtagtggaggccgagcgcaccgggatgaaacccatcttacctagttctttcgaaatgcagtcattttag

SEQ ID NO: 109747 - DNA, 1422 bp, Artificial Sequence
  Description of Artificial Sequence: Synthetic coding sequence
atgactgtatcatatactctcaaggtcgccgaggcccgtttcggtggtttctccggtctgctgctcaggtggaggggttccatatacaagcttctgtacaaggagtttcttctttttggagctctctacgccgtgttaagtatcacctatagactgctgttgacacaggagcagcggtatgtttacgcgcaggtagcaaggtattgcaacaggtcagccgatttgattcccctgtcatttgtcctcgggttttatgtgaccttagttgtgaatagatggtggagccagtacacctcgattcctcttcctgaccagctcatgtgtgtgatcagcgcctccgtgcacggggtggaccaaaggggacggctgcttagacgaaccctgatcagatacgccaatcttgcctctgtgcttgtcctgagaagcgtgtcaacccgcgtattaaaacgttttcccacaatggaacacgtagtagatgccggattcatgtcccaggaggaacggaagaagttcgaatcactgaagagtgatttcaataagtattgggtgccttgtgtttggttcacgaacttggccgctcaagcccggcgtgacgggcggatcagagacgacatcgctctttgcttgctcctcgaggagctgaacaagtaccgcgcaaaatgcagcatgttatttcattatgattggatttcaatcccgctagtatatacgcaggtcgtaacaatcgccgtgtattctttctttgctctgtctttagtcggccgccagtttgtggagcccgaagccggagcggctaagccccagaagctgctgaagccgggccaggaacccgcccccgctctgggagatcctgacatgtatgtgcccctcacgactctgctacagttcttcttctacgcaggctggctgaaggtggccgagcaaatcatcaatcctttcggcgaagatgacgatgattttgagactaatcagctgatcgatcggaacttgcaggtttctctgttatcagtcgatgagatgtatcaaaatcttcctcctgcagaaaaagatcagtactgggacgaagatcagcctcaacctccctacacagtggctacagctgccgaatccctgcggccctctttcctgggaagcacatttaatctgagaatgagtgacgaccctgagcagtcgctccaggtggaggcctctcccggaagtgggcgcccagctcctgcagcacaaacgcctcttctcggccgtttcctcggagtgggtgctcctagtcctgctattagtttgcgcaatttcgggcgggtgcgcggcactcctcgaccccctcacctgcttcgcttccgggccgaagagggcggcgatccggaggccgccgctcggatcgaggaggagtcagccgagtccggggacgaggctctggaaccatag

SEQ ID NO: 109748 - DNA, 294 bp, Artificial Sequence
  Description of Artificial Sequence: Synthetic coding sequence
atgtacttgggaattactccaagtgtgacttgcaataatagctctaagaacgagttttctctcatccttgaaaagaatcccctggtagagttcgtggaagaattaccagctggtaggtcttcactctgttactgcaacctgctttgcgggatcattagaggtgcactagaaatggtgcatctagctgccgacgtgactttcttgcaggaccggctgaagggcgattcagtgaccgagattgggattacgttcttgaaaaagcgggatgagaagaagtaccggggaaagaagtag

SEQ ID NO: 109749 - DNA, 546 bp, Artificial Sequence
  Description of Artificial Sequence: Synthetic coding sequence
atgagccgcccagcccatcgcaggcctgaatatcacaagataaacaaggacctgttcgtgctgacatatggagcgttggtggcacagttgtgcaaagattacgagaaagatgaagatgtgaaccagtatctggacaaaatggggtatggtatcgggaccagactcgtggaagacttcctcgctcgttcgtgtgtcgggagatgtcatagctatagcgagatcattgacatcatagcccaagtggcattcaagatgtatcttggcatcaccccttccgttacatgtaataatagctctaaaaatgagttctctctcattcttgagaaaaacccacttgtggagttcgtggaggagcttcccgccgggagatctagtctatgttactgcaatttactgtgcgggatcattagaggagcccttgagatggtccacctggccgcagatgtcacattcctgcaagatcgactcaagggggattcagtcactgaaatcgggatcacattccttaaaaagcgggatgagaagaagtaccgcggaaaaaagtag

SEQ ID NO: 109750 - DNA, 504 bp, Artificial Sequence
  Description of Artificial Sequence: Synthetic coding sequence
aataaggacctgttcgtgctcacttacggcgcccttgtagctcagttgtgtaaggactatgagaaagatgaggatgttaaccagtacctggacaaaatgggatatggcatcggaacgcgtttggtcgaggacttcctcgccagatcatgtgtcggacggtgtcatagctacagtgagatcatcgatatcatcgcgcaggttgcttttaagatgtatctgggcatcacaccttcggtcacttgcaataactcatccaaaaacgaattttctctaattctggagaagaaccccctggtggaatttgtggaggaactccctgctggaagatcatctctctgctattgtaacctcctgtgtggtataatccgtggagccctggaaatggtccacttggccgctgatgtcacctttctccaggacagactaaagggagacagtgtgacggagatcggcattacattcttaaagaaacgagacgagaaaaaatacaggggaaagaagtag

SEQ ID NO: 109751 - DNA, 1497 bp, Artificial Sequence
  Description of Artificial Sequence: Synthetic coding sequence
atgcgaccccctgcctgctggtggctactcgcaccccccgccctcctggccctgttaacatgttcactcgcctttggcttggcctcagaagatactaagaaggaggttaagcaaagtcaggacctggagaaaagcggcatctcccgaaagaacgacatcgacctcaaggggattgtgtttgtgatccagtctcagtcaaactcatttcacgccaagcgggcggagcaattaaagaaaagtatactcaaacaagcggccgacctgacccaagaactcccatcagtgctcctgctccaccagctggccaaacaggaaggggcttggactatcttgcctctgctaccacacttttccgtgacatactcgcgaaactcaagttggatctttttctgtgaggaggagactaggattcagataccgaagctgttggaaactctgcgtcgttatgatccctcaaaggagtggtttttgggtaaggctctgcacgacgaagaggcaaccataatccatcactacgcctttagcgagaatcctacagtgttcaagtatcctgacttcgccgcagggtgggcactgagtatccctctggtgaacaaactaactaaacgcctgaaatccgagtcccttaagtctgattttacaattgaccttaagcacgaaatcgctctatacatctgggataaaggagggggccctccccttacaccagtgcctgagttctgcacaaacgacgtcgacttttactgtgcgaccacatttcattcttttctcccactgtgtcgtaaaccggtgaagaagaaagacatttttgttgcggtgaaaacctgcaaaaagttccacggggaccgcattccaattgtgaaacagacttgggaaagccaggcttctctgatcgagtattatagtgattataccgaaaacagtatcccgacagtggacctcggcatcccgaatacggatagggggcactgcgggaagactttcgctattctggaaagattccttaacagatcacaggacaagaccgcgtggctagtgatagtggatgacgataccctgatcagcatcagtcgcttgcagcatctcttgtcctgctacgattccggcgaaccagtatttttgggggagaggtacgggtacggattggggacagggggatattcttacatcaccggcgggggtggcatggtattctctcgggaggccgttcgtagactgctagcctcaaagtgtcggtgttatagtaatgacgccccggacgacatggtactgggtatgtgcttttctggactgggcatccccgttacacatagtcccctctttcaccaggcacgacctgtggactatccaaaagattatctgtctcaccaggtgcctatcagttttcataaacactggaatatcgatcccgttaaagtttacttcacttggttagcaccctctgacgaggataaggcacgtcaggaaacacaaaaaggcttccgtgaggagctgtag

SEQ ID NO: 109752 - DNA, 1005 bp, Artificial Sequence
  Description of Artificial Sequence: Synthetic coding sequence
atgccaaagcgtagggatatcctcgctatagtattaatcgtgctgccgtggacactgctgatcaccgtgtggcatcaatcaactttagccccactcctggccgtgcacaaggatgagggcagcgacccccggagagagactccccctggagccgatcctagagaatactgcactagcgacagagacattgtcgaggtggttagaacagaatacgtgtatactaggccacctccttggtcagacacacttcccacaattcacgttgtaacccccacgtattctcgtcccgtccaaaaagccgaattaacgcgaatggccaatacgctcctgcatgttcccaatctccattggctggtagtcgaggacgccccccgccggacacccctgacagctagactacttcgcgatacggggctgaactatactcacttgcacgtggaaacgcctcgcaactacaaactgcgaggagatgcacgggaccctaggatcccccgaggaacaatgcagcggaatttagccttgaggtggttaagagagacctttccacggaattcctcccaacccggggtggtgtatttcgctgacgatgataatacgtattcactggaactctttgaagagatgaggagtacgcgccgggtgtctgtgtggcctgtggcattcgtaggaggcctgcgatatgaggcgcccagagtcaatggggccgggaaggtggttggctggaagacagtttttgacccccataggcccttcgcaatagatatggccggtttcgctgttaacctaagacttatcctgcaaagaagtcaggcatatttcaaactgagaggcgtcaagggtggataccaagagagcagtttgcttcgggagctggtcactctgaacgacctagagcctaaggccgcgaactgcactaaaatccttgtgtggcacactcgcacagagaagcccgtgctggtgaatgaggggaaaaaaggattcactgatccatcagtggagatatag

SEQ ID NO: 109753 - DNA, 1005 bp, Artificial Sequence
  Description of Artificial Sequence: Synthetic coding sequence
atgcccaaacgccgggatatccttgccattgtcttaattgttctgccatggacacttctaattaccgtctggcaccagtctacattggctccattactggccgtccacaaagacgagggttcagaccctaggagggagacgccacccggcgcagatccgcgggaatactgcactagtgaccgcgatatcgtggaagtggtccgtaccgaatacgtgtacacaagacctcccccgtggtctgacactctgcctaccatacatgtggtaacaccaacttattctagaccagtgcagaaggccgaactgacacgcatggcaaatacccttcttcatgtccccaatctgcactggctcgtggtggaagacgcccctagaaggacgcccctgactgcccgcctgctccgcgataccggactgaactacacccatctgcacgtcgaaaccccaagaaactacaagctgcgcggagacgctcgcgacccacgcattcctcggggcacgatgcaacgaaatctcgcactgagatggctgcgggaaacctttccccgcaattcttcccaaccaggagtcgtctatttcgcagacgatgataatacatatagcctcgagttgtttgaggaaatgaggtctacgcggagggtcagcgtgtggccggtcgcttttgtagggggacttcggtatgaagcgcccagagtgaacggagccggcaaggtggtggggtggaaaactgtttttgatccgcaccgcccgttcgctatcgacatggcaggtttcgccgtgaatctccgcctgatattgcaacggtctcaggcctattttaagcttcgcggcgtcaaaggcggttatcaggagtcatctttactgcgagaattggttacactcaatgacctggagccaaaggcggctaactgtaccaaaattttggtatggcacacgcgcacagaaaaacctgtccttgtgaatgaaggaaagaagggatttaccgatcccagcgtggagatttag

SEQ ID NO: 109754 - DNA, 1005 bp, Artificial Sequence
  Description of Artificial Sequence: Synthetic coding sequence
atgcccaaacgcagggatatattggccatcgtcctgatagttctgccatggaccctactcattacagtctggcaccagtccacactcgctcctctgctggcagtgcacaaagatgaaggaagcgaccctcgccgggaaacaccacctggggccgatcccagagaatattgcacctctgatcgagacatcgtggaagtcgtcaggactgaatatgtgtacactcgcccccccccctggtccgacaccttgccaacaatccatgtggtcacccctacctatagtcggcctgtccagaaggcagagctgacgagaatggcaaataccctgctgcatgtgcccaacctccactggttagttgtggaagatgcaccccgacgaactcccttaaccgctagactgttaagggacacaggactgaactatacacatctccacgtcgagaccccaagaaactataagctaagaggtgatgccagagatccccggatccctcgagggactatgcagcggaatctggccctgcggtggctcagagagacgttcccccgcaacagctcacagccaggcgtggtttattttgccgatgacgacaacacttacagcctagaattgttcgaggagatgcggtctaccaggagagtgagcgtgtggcccgttgcctttgtggggggactgcgatacgaggcacccagggtgaatggagctggcaaagtggtgggatggaaaactgtgtttgaccctcacagaccttttgctatagatatggctggtttcgcagtgaaccttcgcctcatcttgcagaggtcccaagcctactttaagctgcgtggggttaaaggaggctatcaggagtcatccttgctcagggagctagtgacattgaatgacctggaacctaaggccgccaactgtaccaaaattctcgtgtggcatactcgcacagagaaacccgtgctggtgaacgaaggtaagaagggatttacagacccttcagtcgagatttag

SEQ ID NO: 109755 - DNA, 1044 bp, Artificial Sequence
  Description of Artificial Sequence: Synthetic coding sequence
atgggaaacgaagaaccttgggtgcagcctgccctggagatgcctaagaggcgggatattctagctatcgtactcattgtgcttccctggacgttactgatcacagtctggcaccagagcacactggctccactgttggctgttcacaaggatgagggcagcgacccaagacgggagacccctcccggagccgaccctcgagaatactgcacttctgatcgggatatcgtggaagtcgtaagaactgagtatgtgtacactcgacctcccccctggtcggacactctaccaaccatacacgtagtgacacctacttactcacggcccgtccagaaggccgagttgactagaatggccaatacactgttgcatgtgccgaatcttcattggttggtggtggaggacgctcctcgccgcacaccattaactgccaggcttcttagagacactgggttaaattatacccatctacatgtcgagactccacgaaattataagctgcgcggtgacgctagggacccaagaatccccaggggcactatgcaaaggaatttggcactcaggtggctcagagagacatttcctagaaacagcagccaacctggggtggtatatttcgccgatgatgacaatacttacagcctggaactgtttgaggagatgagatctactaggagggtgagcgtgtggcccgttgctttcgtcggcggactgagatatgaggccccccgcgtcaatggtgccggcaaggtcgtgggatggaaaactgtcttcgatccacacagaccatttgctattgacatggcaggatttgctgttaatttgagactcatcctccagcgcagtcaggcttacttcaagctgcggggagtcaaaggcggttaccaggaatccagtctgctgagggaactggtgacattgaatgacttggaacccaaggcagccaattgcactaagattctggtgtggcatactagaacagagaagccggtgctggtgaacgagggtaagaagggatttacggacccctccgtagagatctag

SEQ ID NO: 109756 - DNA, 1008 bp, Artificial Sequence
  Description of Artificial Sequence: Synthetic coding sequence
atgaagctgaaactcaaaaacgtattcctcgcatacttcttggtgtccatcgctgggctcttgtatgcactggtgcagctgggacaaccgtgcgattgcctgccccccctcagagccgcggccgagcagctgcggcagaaggacctgaggatctcgcagcttcaggctgagttgcggaggcccccgccagctcctgcccagcctccagaacctgaggctctgccaacgatttacgtggtgacacccacatatgctaggctcgttcagaaagccgagttggttcgattatctcagacgctcagcttagtacctcgcctacactggctgctcgtggaagatgctgaggggcccacccccctggttagcggcctgctggcggctagcggactcctgtttacacaccttgttgttctaacacccaaggcgcagcgcctgagagagggggagccgggttgggtgcacccccggggtgttgagcaacgaaataaagctttggactggctcagggggcgggggggcgctgtgggcggggagaaggatccccccccaccgggaacccagggagtggtgtattttgccgacgacgataacacctatagccgcgaattgttcgaggagatgcgttggacaaggggtgtgagcgtttggcctgtggggctcgtaggggggctccgcttcgaagggccacaggtacaggatggaagggtggtcgggttccacactgcctgggagccaagcaggccttttccagtggatatggccggtttcgcggtcgcactgcccctcctcctggacaaacccaacgcacagttcgattcaacagcccctcgcggccacctcgagagctcactcctgtcacatctggtggacccaaaggacctggaacctagggcagccaactgtacccgagttcttgtgtggcacacaagaactgaaaagccaaaaatgaagcaagaggagcaactgcagaggcagggcagaggatccgacccagccatcgaggtatag

SEQ ID NO: 109757 - DNA, 948 bp, Artificial Sequence
  Description of Artificial Sequence: Synthetic coding sequence
atgaagctcaagcttaagaatgtgttcctggcctactttctcgtttctatcgccggtcttctttatgccctggtgcaattgggacaaccatgcgactgcctccctccacttagagcggcagcagaacaactgcgtcagaaagacctccgaatcagccagctccaggcagaactccgacggcccccccccgcacctgctcagcccccagagcccgaggccttgccaacaatttatgtggtcacacctacctatgcccgcctagtacagaaagccgagcttgtcagactttctcagacactgagtctggtgccacgcctgcactggcttctcgttgaggatgcagagggcccgactccactggtgagtggcctgttagcggcaagcggcctgctgttcactcacctggtcgtgctgacaccgaaggcacagagactgagagagggggagccagggtgggtccacccccgcggtgtggaacagagaaataaggctttggactggcttcgaggccgtggaggagcagtcggaggcgaaaaggaccctcccccacctggtactcagggtgtggtgtatttcgccgatgatgacaacacctactccagagaactttttgaagagatgaggtggacacgcggagtctccgtctggccagtcgggctcgtcgggggactgcgcttcgagggaccacaggtccaagatggccgggtcgtcggcttccatacagcctgggaacctagtcgtccattccctgtcgatatggccggcttcgcagtcgcactgcccctcctgcttgacaaacccaacgctcagttcgattccactgcaccccgggggcacctagagagttcactcctgagtcacttggtggacccaaaggacctggagccacgggcggctaactgcaccagaactgagtctcgatgtgttactcaggccggggtccagtag

SEQ ID NO: 109758 - DNA, 2997 bp, Artificial Sequence
  Description of Artificial Sequence: Synthetic coding sequence
atggggtccccaagagctgcacggcccccccttctcctgcgaccggtcaagctattaaggaggaggttcagactccttctggccttagccgtggtgtctgtgggactctggacactatacctggaactggtggcaagcgcacaggtcggtggaaatccgctgaatcggcggtacggctcctggcgggaacttgctaaggctttggcttcacggaacataccagccgtggacccgcacctacagttttatcatccccagcggctgtctctagaggatcacgatattgatcaaggggtctcttccaatagtagttaccttaagtggaacaaacccgtcccctggctcagcgaattccggggtcgtgctaacttgcacgtatttgaggattggtgtggctccagtatacaacagttacgtcgcaatttacacttcccactctatccacatataagaaccactctgcgcaaactggccgtgagtcccaaatggacaaattatgggctgaggatcttcgggtatctgcatccattcacagacgggaagatccaattcgctatcgccgctgatgacaatgctgagttttggctgagtcttgacgatcaagtgtctggcttacagctcctggcaagcgtgggcaaaactggtaaagagtggacagctccgggggagttcgggaaattccggtcccaaatcagtaaacccgtgagtctaagcgcaagccacagatactatttcgaggtgttgcataaacaaaacgaggaaggaaccgatcatgtggaagttgcctggagaaggaacgacccgggcgccaagtttacaattattgactccctgtctctgagcttattcacgaatgagacctttctgcagatggacgaagtgggtcatatcccacaaacagcagctagccatgtcgattcatccaacgctctcccaagggacgagcagccaccagccgatatgctcaggcccgacccacgcgataccctctaccgcgtacctctcattcctaagtcccatctgagacatgtgttgcccgactgtccatacaaaccaagttacttggtggacggcctgcccttgcaaaggtaccaggggctgcgttttgtccacttatcttttgtgtaccccaatgattacactcgcttgagccacatggaaacccacaacaaatgcttctaccaagagaacgcctactaccaagatagattttcgttccaggaatatatcaagatagatcaacctgaaaaacagggactagagcagcccggtttcgaggagaacctcctggaagagtctcagtacggggaggtggctgaagagacgcctgcctctaacaatcagaatgcacgaatgttggagggacggcagacacctgcatcaaccctggagcaggatgccacagactaccgactgcgtagcctgcgaaaactgctcgcccagccccgtgagggactgctcgctcccttttcaaagagaaactcgactgccagtttcccaggacgcacttcacacattcctgtccagcagccagaaaaaagaaaacagaaaccttcccctgaaccttcacaagattccccccactcagacaagtggccacccggccaccctgtgaagaaccttccccagatgcggggaccaagacccagacccgccggtgactcccctaggaagacccaatggctaaatcaggtcgagagctatatcgcagaacagagacgcggggacaggatgaggccgcaggcgcccggccgcgggtggcacggcgaagaagaggtggtggcggccgccgggcaggaaggccaagtggagggagaggaggagggcgaagaggaggaagaagaggaggatatgtcagaggtcttcgaatatgtgccagtgtttgatcctgttgttaattgggaccaaacattcagcgctaggaatctcgatttccaggccctgcgcaccgattggatcgacctctcatgcaacacctccggtaacctgctgcttcctgaacaggaggctctagaggtgactcgcgtgtttctcaagaagctcaatcagcggagtcgtggacgttatcaattgcagcggattgtgaacgttgagaaacgacaagatcagcttcgaggagggcggtacctactcgagctggagttattggagcaggggcagcgtgtcgtcaggctctccgagtatgtgagcgcaaggggctggcagggcattgaccccgctgggggtgaagaagtcgaagcgagaaatcttcaggggcttgtgtgggatccccataaccgacgacggcaggttctgaatacgagggcccaggaaccaaagttatgctggcctcagggctttagctggagtcatcgggccgtggtgcatttcgtcgtgcctgtgaagaatcaggcccgctgggtgcagcagttcataaaagacatggaaaaccttttccaggtgaccggcgacccgcattttaacatcgtcattactgattattcttccgaagacatggacgtggagatggcactgaagagatccaagctgcgcagctaccaatatgttaaactgagtggaaatttcgaaaggtctgctggactccaggcaggaattgacctggtaaaggatcctcactccatcatattcctttgcgacctgcacatccacttccctgctggggtgatagatgcgattagaaaacattgtgtagaagggaagatggcctttgctccaatggtgatgcgtctgcactgtggtgccacaccccagtggcccgaagggtattgggaagtgaacggctttgggttattaggtatttacaaatcagatctggatagaataggcggaatgaacaccaaggagttccgcgacagatgggggggcgaagattgggagcttttagatcgcatactccaggctggcctggacgtggagaggttaagcttacggaacttcttccaccacttccacagtaagcgcgggatgtggagtagaagacagatgaaaactctctag

SEQ ID NO: 109759 - DNA, 306 bp, Artificial Sequence
  Description of Artificial Sequence: Synthetic coding sequence
atgtcgcggtccgtggcactcgctgtgctcgccctcctcagcctgtctggccttgaagcaattcaaagaacccctaaaatccaggtgtactctagacatccagcagagaacggtaagtccaatttccttaactgttacgtgtccggattccatccgagtgacatcgaggtggatctgttaaagaacggtgaacgcatagaaaaggtagagcactcggacctgtctttctcaaaggactggtctttttacctgctctactacactgagtttacaccaaccgaaaagatgtccatgcctgcagtctag

SEQ ID NO: 109760 - DNA, 369 bp, Artificial Sequence
  Description of Artificial Sequence: Synthetic coding sequence
atgagccggagcgtggccttggctgtgctggctctactgagtctgtctggcttggaggctatacagagaacccccaagatacaggtgtacagtaggcaccctgccgagaacgggaagagtaactttctgaattgctacgtgagcggttttcacccctccgatatcgaagtagatttactgaagaatggagaacggatcgaaaaagtggaacacagcgacttatcgttttcaaaagactggtcattctatctactgtattataccgaattcacaccaacagaaaaggacgaatatgcctgcagagtaaaccacgtcaccctgagccaacctaagattgttaaatgggggaagtcttacatactgctctag

SEQ ID NO: 109761 - DNA, 360 bp, Artificial Sequence
  Description of Artificial Sequence: Synthetic coding sequence
atgagccggagcgtggccctggctgtcttggccttactctcattatccggcctggaagctattcagaggacacccaagattcaagtgtatagccgccacccagcggagaatgggaaaagtaacttcttgaactgctatgtaagcggctttcatccttctgacattgaggtggatttgctgaagaatggggagcgtattgaaaaggtagaacattctgacctgtccttctcaaaagactggtccttctacctcctctactacacagagttcaccccaactgaaaaggacgaatatgcatgccgagtgaaccacgtcacactcagtcaacccaagatcgtgaaatgggaccgcgatatgtag

SEQ ID NO: 109762 - DNA, 369 bp, Artificial Sequence
  Description of Artificial Sequence: Synthetic coding sequence
atgtccaggagtgttgcgctcgccgtactagccctgctctccctcagtggattggaggccatacagagaactccgaaaatccaggtctattcacgtcaccctgctgaaaacgggaagtccaacttcttaaactgctacgtgtccggtttccatccttccgacatcgaggtggacctgctgaaaaacggagaacggatagaaaaagtggagcattcagatctttccttctctaaggattggtcgttttatcttctgtattacactgaatttactcccaccgagaaagacgaatatgcctgtcgcgtgaatcacgtcaccctgagccagcctaagatcgtaaaatggggcaagagttatatactactgtag

SEQ ID NO: 109763 - DNA, 360 bp, Artificial Sequence
  Description of Artificial Sequence: Synthetic coding sequence
atgagccggtcggtcgcactcgctgttctggcgctgctctcactgtctgggttggaggccatacagaggacgcctaagatccaggtgtactccaggcatccagctgagaacgggaagtctaacttcctcaattgttacgtcagtggattccatccatctgacatcgaggtggatctgctgaaaaacggagagcggattgaaaaggtggaacacagcgatctctctttctcgaaggattggtcattctacctactctactacaccgagtttactcccactgaaaaagatgaatatgcatgtagggtgaatcatgtcacactctcgcagccaaagatagtgaaatgggacagggatatgtag

SEQ ID NO: 109764 - DNA, 360 bp, Artificial Sequence
  Description of Artificial Sequence: Synthetic coding sequence
atgagtcggtccgtggcgctcgccgtcctggctcttctttccctgagcggactcgaggccatccagcgcacaccgaagattcaggtatactcccgtcaccctgccgagaacggcaagagcaattttctgaactgttacgtgtctggattccatcctagcgacattgaagtggacttattgaaaaacggagaaagaatcgagaaggtggagcactccgatctttctttctcaaaggactggtctttctacctgctgtattatactgaatttacacctaccgaaaaggacgaatacgcttgtagagtcaatcacgtcaccctcagccagcccaagatcgtcaagtgggaccgcgacatgtag

SEQ ID NO: 109765 - DNA, 1644 bp, Artificial Sequence
  Description of Artificial Sequence: Synthetic coding sequence
atggacattatctttggccgtaatcggaaggagcaactggagcctgtaagggccaaagtaaccggcaaaattcctgcatggctacaaggcactctgctacgaaacggcccgggcatgcacaccgtgggggagagtaggtataaccactggtttgatgggctggccctgcttcactcattcacaattagagatggagaagtgtactatcgatccaagtacctccggagtgacacttacaatactaacatcgaggctaatagaatagtggtgtctgagttcgggactatggcctatcccgacccatgtaagaacatctttagcaaagcctttagctatttgtcccacactattccagactttactgataattgcttgattaacataatgaagtgcggcgaggatttctacgccacctcagagactaactacattcggaagattaatcctcagaccctcgaaactttggaaaaggtggattaccgcaagtacgtggccgtgaatttagcaactagccaccctcactatgacgaggccgggaacgttcttaacatgggcacgagcatagtggagaaggggaaaactaagtatgttatcttcaagatacctgccaccgtgccggagggcaagaaacaaggcaagtcgccttggaagcatactgaggtgttttgctcaatcccgtctcggagtttgctctcacccagctattaccacagcttcggggttaccgagaactatgtgattttcctggaacagccatttagattggatattctgaagatggctacagcgtacattaggcgaatgagttgggcatcatgcttggcctttcacagggaggagaagacatacatccatattattgaccagcgtacccgacagcctgtccagacaaagttctacactgatgcaatggtggtgtttcatcatgtaaatgcatacgaggaagatgggtgcatcgtcttcgacgtgatcgcctatgaagataactccctttaccaactcttctacctggccaacctgaaccaagacttcaaagagaactctcgccttacatcagtgcctaccttaagaagatttgccgtgcctctccacgtcgataaaaacgctgaggtgggaaccaatctgatcaaggtcgcatcaaccactgcgacagccctcaaggaggaggatgggcaggtctactgtcagcctgaatttttgtacgagggattggagttgcccagggttaattacgcccacaatgggaaacaatatcgctatgtgttcgcaactggggttcagtggagtcctattcctaccaaaatcataaagtacgatatcctgacgaagtcaagtctaaagtggcgtgaggacgattgctggccggctgagcctctttttgtacccgctcctggcgccaaagatgaggacgacggagtcattcttagtgctatcgtgtctacggatccgcagaagcttcccttcctcttgatcctagacgcgaagtcatttaccgagctggctagggctagcgttgatgtggacatgcatatggatcttcacgggctctttattacagacatggattgggacacgaaaaaacaggccgcctctgaggagcagcgcgatcgtgcttcggattgccacggagcgcccctcacctag

SEQ ID NO: 109766 - DNA, 1437 bp, Artificial Sequence
  Description of Artificial Sequence: Synthetic coding sequence
atggctgccggcaaccccgcgcctcaatgggcctgggacgcgcattcttggggcgtgcaaatccagcccctcgtgcgtcgaccatgccctgccccccagctgcatcaccagagacgcgccttcagctacctgtcacacaccatccccgatttcaccgacaactgtctgattaacatcatgaagtgtggcgaagacttctacgccacatcagaaaccaattatatccgcaagatcaaccctcagaccttagagacgttagagaaggtcgactatagaaagtacgtggctgtgaatctggccacaagccatccacactacgatgaagccggtaatgtactgaatatgggaacttctattgtcgagaagggcaaaaccaaatatgtgatattcaaaatcccagcaaccgtgcccgagggaaaaaaacagggcaagagcccctggaaacataccgaggtattttgtagcatcccgtctagatcgttgctgtctccttcctactaccactctttcggagtcaccgaaaactatgtgatcttcttggagcagccatttcggctggacattttgaagatggccaccgcatacatacgacgcatgtcttgggcgagctgtctggccttccacagggaggagaaaacttacatacacatcatagatcaacggacaagacagcctgtgcaaacaaaattttacaccgacgccatggtagtttttcatcatgtcaacgcctacgaggaagacggctgtattgtcttcgacgtcatcgcctatgaggacaacagcttataccagctgttttatctggctaacttgaatcaggactttaaggagaacagcagactgacctctgtcccaactttaagaagatttgccgttcccctgcatgtagataaaaacgcagaggttgggaccaacctgatcaaagttgcatctactacagccacagccctaaaagaagaggatggtcaagtgtattgtcagcccgagttcctttacgaggggcttgagctgccaagagtaaattacgcccacaatgggaaacagtatcggtacgtgttcgccacaggtgtacaatggtcccctataccaacaaaaataatcaagtacgatatactcaccaagagtagcttaaagtggagggaggacgattgttggccagctgagcctctgttcgtgcctgcacccggggccaaggatgaggatgacggcgtgatcttgagcgccattgtgagtacagatccccagaaactgccttttctgctcatcctggacgcgaagtcctttacagagctcgcacgagcgtctgtcgatgttgacatgcatatggacctgcatggactctttattactgacatggactgggatacaaagaagcaagccgcatccgaggagcaacgcgatagagcttccgactgtcacggagcgccgcttacctag

SEQ ID NO: 109767 - DNA, 1740 bp, Artificial Sequence
  Description of Artificial Sequence: Synthetic coding sequence
atgttctttagggtatttttacatttcattaggagccatagtgccactgctgtagattttttaccagtcatggtgcacaggctccctgtctttaaaagatacatgggtaacacaccccagaagaaagccgtgttcggtcagtgtcgtggtctcccttgcgtcgctcctctgctcactaccgtggaagaagcaccacggggaattagcgctcgagtgtggggacattttccaaagtggctgaatggctcactgctcagaatcggacccggcaaatttgagttcgggaaggataaatataatcattggttcgatggcatggccctgttacaccagtttcgcatggcaaaggggaccgtgacctaccgcagtaaattccttcagagtgatacgtacaaagcaaattcggccaaaaatcgcatcgtgatctccgagttcggtactctggctctaccagacccctgtaagaatgtatttgagcggtttatgtctcggttcgaactgcccggaaaggccgccgcaatgacagacaatacaaatgtcaattatgtgcgctataaaggtgattactatctgtgtacagaaaccaactttatgaacaaggtagacatcgagactttggaaaaaactgaaaaggtggactggtccaagtttattgccgtaaatggagcaactgctcacccccattacgaccttgacggtaccgcatacaacatgggtaactcttttggtccctatggtttcagttataaagtaattcgtgtcccgcccgagaaggtcgatctgggagaaacgatccacggagtgcaggtgatctgctctattgcctctaccgaaaaaggaaagccatcgtactaccatagcttcggcatgacaaggaactacattatctttatcgaacagcccctgaagatgaatctctggaaaattgccacttctaagatccgcggcaaagccttcagtgacggcatcagttgggagccccagtgtaataccagatttcacgtggttgagaagcgcaccggccagctcctccccggccggtactactcaaaaccttttgtgacctttcaccagattaatgcattcgaagatcaggggtgcgtcatcatcgacttgtgctgtcaggacaacggccggacgttggaagtttaccaactgcagaatcttaggaaggcaggggaaggattagatcaggtgcataactccgcggctaaaagtttccctcggaggtttgtactgccacttaacgtctcacttaacgctccagaaggtgataacctgtctcccttgtcttatacctccgcctccgctgtgaaacaggctgatggtactatttggtgcagccatgagaacctgcatcaggaggatttagagaaagagggagggatcgaattcccacaaatatattacgataggttctccggcaagaaataccatttcttttatggttgcggcttccgccacctggtaggggactctttgataaaggtcgatgtggtgaacaagaccctcaaggtgtggagggaggacggcttttatcctagcgagcccgtgttcgttccggctccgggtacaaatgaggaggacggtggtgttatcctgtcagtggttatcacgccaaaccagaacgagagtaattttatccttgtgctcgatgccaaaaactttgaagaactgggcagggcagaggtcccagtccagatgccctacggctttcatggtacctttattcctatctag

SEQ ID NO: 109768 - DNA, 1638 bp, Artificial Sequence
  Description of Artificial Sequence: Synthetic coding sequence
atgggtaacaccccccagaagaaagccgtcttcggacagtgccgtggactgccctgtgtcgctcctctgctcacaaccgttgaagaggctccacggggaatctcagcgagagtgtggggtcacttccctaagtggcttaacggaagcctcctgcgaattggacctggcaagttcgaatttggcaaagacaagtataaccactggtttgacggtatggcattattacatcagtttcggatggccaagggcaccgtgacataccgttcaaaattcttgcagtccgacacctacaaggccaacagcgcaaagaatcgtattgtgatctcagaattcgggactctggcactcccggacccatgcaaaaacgtttttgaacgctttatgtcccggtttgagctgcctggaaaggccgcagccatgacggataataccaacgtgaactacgtccgttataagggtgattactatctatgcaccgagaccaactttatgaataaggtggatatagaaactcttgagaaaaccgaaaaggtggactggtctaaatttatcgccgtcaacggggcaactgcgcatcctcattatgacttagacggcaccgcatataacatgggcaacagttttggaccctatgggtttagttacaaggtgattcgcgttcctccagagaaggtggacctaggtgaaacaattcacggcgtgcaagtcatatgctccatcgcctctactgagaagggaaagccctcttattatcattctttcggcatgacacggaactacatcattttcatcgaacagccattgaagatgaacctatggaagatcgcaaccagcaagattcggggcaaagcattctccgatggaatctcttgggaaccccagtgtaataccaggttccacgtagtcgagaagaggaccgggcagctcctgcctggaagatattactccaagcccttcgtaacatttcaccagatcaatgcctttgaagaccaggggtgcgtcatcatagatttatgctgccaggacaacgggaggacgctggaggtttaccagctgcaaaacctgcgcaaagcaggggaaggactagatcaggtgcacaacagcgcggctaagtccttcccaagaaggtttgtcctaccactgaacgtttcactgaatgccccagagggggacaacctctcaccactgagctacacttctgcttctgccgttaagcaggcagacggcacaatttggtgttcccacgaaaacctgcaccaagaggatcttgaaaaggagggtggcatcgagttcccacagatctattacgacagattctcaggaaagaaatatcacttcttctatggctgtgggttccggcatctagtcggggatagcttaatcaaagtcgacgtggtcaacaagacccttaaagtgtggagagaagatggtttctacccatctgagcctgtgtttgtacctgcaccaggaaccaacgaagaagacgggggcgtgattctttctgttgttataacgcctaaccagaatgagtctaacttcattcttgtcctagatgcaaaaaattttgaagagctcggcagggcagaagtacccgtgcagatgccttatggtttccacggcacatttatccctatttag

SEQ ID NO: 109769 - DNA, 1638 bp, Artificial Sequence
  Description of Artificial Sequence: Synthetic coding sequence
atgggaaatacaccgcagaagaaggcagtgttcggtcagtgtcgtgggcttccctgtgtcgcccctctgttaactacggtcgaggaagcacccaggggaattagcgccagggtctggggccactttccaaagtggcttaacgggtcactgctacgcattggccccggtaagttcgagttcggtaaggacaaatacaaccactggttcgacggaatggcgctcctccatcagttccgtatggcgaaaggcaccgtgacctaccggtctaagttcctgcagagtgacacgtacaaggccaactctgcaaaaaaccgaatcgtgataagcgagttcggcactttggccctgccagatccttgcaagaacgtctttgagcgcttcatgtcgcgcttcgagcttcctggcaaagcagctgccatgacagacaataccaatgtgaattatgtgagatacaaaggggactattatctgtgcacggagactaactttatgaataaagtggacattgagacactggagaagactgagaaagttgactggtcgaaatttatcgcagttaatggcgccaccgctcatccgcattatgacttggacggaaccgcgtacaacatgggaaatagtttcggcccctacggcttttcctataaagtaatccgcgttcctccagagaaagtggatttgggagaaaccatacatggggtgcaggtcatctgttctattgccagcaccgagaagggaaagccttcctactaccactctttcggcatgacgaggaattacatcatttttatagagcagcctctgaagatgaatctttggaagattgctaccagcaagattcgtggcaaagcgtttagcgacggtatttcttgggaacctcaatgcaatacccgcttccacgtagtggagaagcgtactggccaacttctgcccgggagatactatagtaaaccctttgtcaccttccaccaaatcaacgccttcgaagatcaggggtgcgtcatcattgacctctgctgtcaggacaacggccgcaccctggaagtttaccaacttcaaaaccttcgcaaggctggcgaagggttagatcaggtgcacaactcagcagccaaaagcttccccagacgcttcgtactgccgttgaatgtctctcttaacgccccagaaggcgacaacctgagccccctgtcctacacctcagcctctgctgtcaagcaggctgatggaaccatttggtgttcacatgagaacctgcaccaggaagatctggagaaggaaggggggattgagttcccccagatctactacgataggttcagtgggaagaaataccactttttctatggttgcggtttccgccatctggttggcgactcactgattaaggttgatgttgtcaataagacattaaaagtgtggagggaggatggcttctaccccagtgagccagtttttgtgcccgcccctggcaccaatgaggaggatggcggcgtgatcctgtcggtagtgattacgcccaatcaaaacgagagcaatttcatactagtacttgacgccaaaaacttcgaagaactgggcagggctgaggtgcctgtgcagatgccatacggttttcacggaacctttatcccaatctag

SEQ ID NO: 109770 - DNA, 1620 bp, Artificial Sequence
  Description of Artificial Sequence: Synthetic coding sequence
atggggaacaccccccagaagaaggccgtatttggtcagtgcagaggtctgccatgcgtggcaccccttctgaccacggtggaggaagccccaaggggcattagcgccagagtgtgggggcattttcctaaatggctgaatgggtccttgttacgtatcgggcccggcaaattcgaattcgggaaagacaagtacaaccactggtttgatggcatggccctgctgcatcagtttcggatggcaaaaggtaccgtgacttatagaagcaaatttttacagagtgacacatataaggccaatagcgcaaaaaatagaattgttatcagcgaattcgggacactggcactgccggacccatgcaagaacgtcttcgaaaggtttatgtcgcgttttgaattacctggaaaggccgcagccatgactgacaacacaaacgtcaactacgttcgctataaaggggattattatctttgcaccgagacaaatttcatgaacaaagtcgatattgaaactctggagaagactgagaaggttgactggagcaagtttattgccgtaaatggtgctactgcccacccgcactatgaccttgacggaacggcctataacatgggtaactctttcggaccttatggcttttcctataaggtgattagagtccctccagaaaaggtcgatctgggtgagaccatccatggcgtgcaggtgatctgctctatagccagcacggaaaaaggtaaacccagctattaccactcctttggtatgaccagaaactatatcatattcatcgagcagccacttaagatgaacctttggaagatcgctacaagcaaaatcaggggcaaggccttttcagacggaatttcatgggagccccagtgtaatacgcgtttccacgtcgtggagaagaggacaggccagctgctgcctggaaggtattatagcaagccttttgtaacgtttcaccagatcaatgcgttcgaggaccagggatgtgtgatcattgatctgtgttgtcaggataatggtagaaccctcgaggtctatcaactgcagaatctcagaaaggcaggtgagggtctcgaccaggtgcacaacagtgcagctaagtccttcccgagacgattcgtgctccctttaaacgtctcactcaacgcgcccgagggggacaatctgtctccattgtcgtacactagtgccagcgcagttaaacaggcagatggcactatatggtgtagtcatgaaaacctgcaccaggaagacctagagaaggagggtggtattgaattcccacaaatatactacgacagattctctggaaagaaataccacttcttctatggctgtggcttcaggcacttggtcggagactcactcatcaaggtagatgtcgtctggagagaggacgggttctacccgtcggagccagtgtttgtacccgcgcccggtaccaatgaggaagatggcggagtgatcttgtctgtggttatcacccctaaccagaacgagagcaacttcatactcgtgttggatgcaaaaaatttcgaagagttaggccgtgccgaggtgcctgtccaaatgccctatggattccacggtacattcattccaatctag

SEQ ID NO: 109771 - DNA, 1638 bp, Artificial Sequence
  Description of Artificial Sequence: Synthetic coding sequence
atggggaacaccccccagaaaaaggcagtctttggacaatgtcgtggacttccttgcgtagcccccctgttaaccacagtcgaggaggcaccacgcggcatctccgctagagtctgggggcacttcccgaaatggctcaacggctccctactacggatcggcccaggcaagttcgaattcggtaaggataagtacaaccactggttcgacggcatggctcttctgcatcagtttagaatggccaagggtactgtgacataccggagtaagtttcttcagtccgacacgtacaaagcaaactctgccaagaaccgcatcgtgatttctgaattcggcacactcgccctcccagacccatgcaagaatgtttttgagagattcatgtcccgatttgaactgcccgggaaagcagctgccatgacggataatactaatgtgaattacgtccgctataaaggagactactacctttgcacggaaaccaattttatgaacaaagtggacatcgagacactcgaaaagaccgagaaagttgattggagtaaattcattgctgtgaatggtgccaccgctcatccccactatgatttggatggaacagcatataatatgggaaactccttcgggccttatggtttttcatataaagttattagagtaccaccagagaaggtcgacctcggagaaacaatccatggcgtgcaggtgatctgttctatcgcctctacagagaagggaaagccatcctactaccattcctttgggatgactcggaactatattattttcatcgaacaacccctgaagatgaatctgtggaagatcgctactagcaagatccgagggaaggcatttagtgacggtataagttgggagccccagtgcaatactcggttccatgttgtggagaagagaacaggccagttgttgccagggcgttactactccaagccctttgtaacctttcatcagataaacgcatttgaagaccaggggtgcgtcatcattgacctgtgctgccaggacaatggccgaacactcgaggtgtaccagctgcagaacctacgaaaggcaggagaaggcctcgaccaggtgcataattcagcggcgaagagcttccctcggcggtttgtgctgcccctcaacgtaagtctcaatgcccccgagggagataatctgagccctctgtcctacaccagcgctagcgctgtcaagcaggcagatggtacaatatggtgttcacacgagaacctacaccaggaggatctggagaaagagggagggatcgaatttcctcagatttactacgacagattcagcggcaagaaataccattttttctacggatgtggttttaggcatctagtgggagactcactaataaaagtggacgttgttaacaaaacgttgaaggtgtggcgagaggatgggttctacccaagtgaacctgtgtttgtgccagccccaggcacaaacgaggaagacggcggtgtgatcctctccgtggttatcacaccaaatcagaacgaatccaactttatattggtgctagatgctaagaatttcgaggaactcgggagagccgaagttccagtccagatgccctacggcttccatgggacattcatccccatttag

SEQ ID NO: 109772 - DNA, 1221 bp, Artificial Sequence
  Description of Artificial Sequence: Synthetic coding sequence
atgcctccagtcggagggaaaaaggcgaaaaagggtatactggaaaggttgaacgccggtgagattgtgattggagatgggggtttcgtttttgccttggaaaagcgcgggtacgtgaaagctgggccatggacgccagaagctgccgttgagcacccggaggccgtgcgccaactgcatcgggaatttctcagagctggctcaaatgtgatgcagacctttacattctatgcctccgaggacaagctggaaaatcgggggaattacgtactagagaaaatctccggacaggaagtgaacgaagccgcttgtgatatcgcccggcaggttgccgacgaaggggatgcacttgttgctgggggcgtgtctcagacccccagctatctgagctgtaaatccgaaacagaagtcaagaaagtgttcttacaacagttggaggtgtttatgaagaaaaacgtggacttcctcattgcggagtatttcgaacacgttgaagaggcagtctgggcagtcgagaccctgatcgccagtggtaaacccgtggcagctaccatgtgcatcggcccagagggagacctgcacggagtgcctccaggggagtgtgccgtgaggttagtaaaggcaggtgcaagcattataggggtgaactgtcactttgatcctaccatttccttgaagactgtgaagctcatgaaggagggtctcgaggcggccagattgaaggcccatcttatgagccagcctctggcatatcatacgcctgactgcaacaaacagggcttcattgacctgcccgagttccccttcgggctggagccaagagtagctacccgctgggatatccagaaatacgccagggaagcttacaacctgggcgttcgatatatcggcgggtgctgtggattcgagccatatcacattagggccatcgcagaggagcttgcccccgaacgagggttcttgccccctgcaagcgagaaacacggatcctggggtagtgggctagacatgcacactaaaccctgggtgcgcgctagggcaagaaaggagtattgggagaatttgaggatcgcgtccggccggccctacaacccaagcatgtccaagcctgacgggtggggagtcactaagggaactgctgaactgatgcagcaaaaggaagcgaccaccgagcagcagctaaaggagctcttcgagaagcagaaattcaaaagtcagtag

SEQ ID NO: 109773 - DNA, 612 bp, Artificial Sequence
  Description of Artificial Sequence: Synthetic coding sequence
atgccccctgtgggtgggaagaaagcaaagaagggcattttggagcggctgaacgcgggggaaattgtgatcggcgacgggggtttcgtgttcgccctcgagaaaagaggctatgtcaaggccgggccctggacacctgaggctgccgtggaacatcctgaggccggagcgtccattatcggcgtcaactgtcattttgaccccactatctcgctcaaaacagtgaaattgatgaaggaagggttggaggccgctagacttaaggcccatctgatgagtcagccactggcttatcatactccggactgcaataaacaaggatttattgatctacccgagttcccatttgggctggaacctgagctcccccctgatggcatcttcaaaaacacccccgagcgcccaaccacttggggctctgggacattggcgggggcggtagacctttcacccaccaccagcggccagctgcaacgctcctggccccagaaaggagccttctgtcaccagctgcagaaaaatatggccgctggagaggtggtgtggacttgcacacccaatccgggattggagcaggggcccggaaggaacactgggcgtatcttcggatag

SEQ ID NO: 109774 - DNA, 1092 bp, Artificial Sequence
  Description of Artificial Sequence: Synthetic coding sequence
atggctccggcgggccgcccgggcgcgaaaaagggcatcctggagaggttggaatcaggtgaggtcgtaatcggcgatgggtccttcctgatcaccttggaaaaacgtggctacgtgaaagccgggctctggacccccgaggcggttatagagcatcccgatgccgtgagacagctgcacatggagttcttgagagcaggcagcaatgtgatgcagacctttacgtttagcgccagtgaggacaatatggagtccaagtgggaagacgtcaacgctgccgcctgcgacctggcccgggaggtggctgggaagggagacgcattagttgcagggggcatctgccaaacctctatttataaataccaaaaagacgaagctcggatcaagaagctttttcgccagcagctggaggtgttcgcctggaagaacgtggatttcttaattgctgagtacttcgagcacgttgaggaagcggtatgggcagttgaggttctgaaagaaagcgacagacccgttgctgtgaccatgtgtatcgggcccgagggggacatgcatgacattacgccaggtgaatgcgcggtgcgattggtgaaggccggggcgtcaatagtcggcgtaaattgtagattcgggccggatacaagtctgaaaaccatggagctcatgaaagagggactagagtgggccggcctgaaggcgcatctcatggttcaacccctggggttccatgcccccgactgtggcaaggaggggtttgtggacctaccagagtatccttttggtctcgaatcaagagtcgccacacgatgggacatacagaaatatgctcgcgaggcctataacctcggagtacgttatatcggtgggtgctgcggatttgagccataccacatacgggctatcgccgaagaactggcccctgaaaggggcttcctgccgcccgcgagtgaaaagcatgggtcctggggtagtggcttagatatgcatacaaagccatggatcagggcgcgagcccgccgagagtactgggaaaatctgctcccggcaagtggccgccccttctgcccatcactgtctaagcctgatttctag

SEQ ID NO: 109775 - DNA, 900 bp, Artificial Sequence
  Description of Artificial Sequence: Synthetic coding sequence
atggctccggctggccggcccggtgctaagaaggggatcctggagaggttggaatcgggagaggttgtgattggcgatggatcgttcttgatcaccctggagaagcggggctatgtgaaagcaggcctgtggacgcctgaagcagttatcgagcaccctgacgcagtgcgccagctgcatatggagttcctcagggctggctccaatgttatgcaaactttcactttttcggcttcggaggacaatatggagagcaagtatttcgagcacgtggaggaagccgtatgggcggtggaagtactgaaagaatccgatagacccgtggccgtgaccatgtgtatcgggcccgagggcgatatgcatgacatcactcctggagaatgtgccgtgcggctggtgaaggccggtgcctcaattgtcggcgtgaactgcaggtttggcccagatacaagcctgaagaccatggagctgatgaaagagggcctggagtgggcaggtttaaaagcacatctcatggttcagccgcttggcttccacgcccctgattgtggcaaggagggctttgtagacttgcctgagtaccctttcggtctggagtctcgagtggcaacaagatgggatatccagaaatatgctcgggaggcctacaatttaggggtgcgctatatcggaggatgttgcggatttgagccttaccatattcgtgcaatcgccgaggaactggcacccgagcgtgggttcctgcctccagcttcagagaaacacggttcctggggctccggccttgacatgcataccaagccatggataagagcaagagctagacgggaatattgggagaatttgctgcctgcttcaggcagacccttttgcccatccctgtctaaacctgacttctag

SEQ ID NO: 109776 - DNA, 639 bp, Artificial Sequence
  Description of Artificial Sequence: Synthetic coding sequence
atgatcataggcgggatcgatcacagtctctacacaggatccctgtggtatacacccattagaagagagtggtactacgaggtaatcatcgtacgcgttgagatcaatgggcaagatctaaagatggattgcaaggagtataactacgacaagagcatcgtcgactccgggactactaacctgcggttgccaaaaaaagtgtttgaggcagccgtgaagagtatcaaggcagcctcatctactgaaaaatttccagacggcttttggttaggcgagcagctagtgtgttggcaggctggtacaacaccttggaacatcttccctgttatctctctgtatcttatgggggaagtcactaatcagagcttcagaattactattctgcctcagcaatatctgcgatggaagatgtggccacggcccaaaaccactgtaacttgccacctgacggtaattcacgggcactgttatggcagttgctatcacgggggtctgctcctcagtctgataggccccgaaaacgagctggccctattgtccgcattggcgatgtgcactatgtcttctggtaggcagcgctggaaggcatgccacttaggacatggccggctctggcttcagcattccacagacagatag

SEQ ID NO: 109777 - DNA, 1506 bp, Artificial Sequence
  Description of Artificial Sequence: Synthetic coding sequence
atggcccaggctctcccttggctccttttatggatgggtgccggagtgctgcctgcacacggcacgcagcatggtatccggttgccactccgctctggactaggtggcgcccctctgggcttgagactgccccgtgaaaccgacgaagaacctgaggaacctggacggcgggggtctttcgttgagatggtggacaatcttcgtgggaagtctgggcagggatattacgtcgagatgacagttggcagtccaccacagaccctgaatatacttgttgacactgggtcaagtaactttgccgtcggggcggctccacatccgttcctgcatcgatattaccagcgccaactctccagtacctaccgcgatctccgtaaaggagtctatgtgccttatactcagggcaagtgggagggagaactgggcacagacctcgtgagcatccctcatggaccgaacgtgactgtgcgcgccaacatcgcagcaatcaccgagtcagataagttttttatcaatggatctaactgggaaggcatactcggcctggcatacgccgagatcgctagaccagacgacagcctggaaccgtttttcgattccctggttaagcaaacccatgtccctaaccttttttccctccagctgtgcggcgccggattccccctgaaccagagcgaagtcctagcaagtgttgggggttcaatgatcatcggcggaattgatcattccctctataccggctcgctgtggtatacacccatcaggagagagtggtactacgaggtcataatcgtccgtgtggaaatcaatggacaggatttaaaaatggactgtaaggagtataactacgataaaagtatcgtggactcaggcactacaaacctacggctgccaaagaaagtttttgaggcggctgtgaaatctattaaggcggcttccagtacagaaaaattccctgacggattttggttaggtgagcaactggtgtgttggcaggcgggcaccaccccctggaatatcttccctgttatttcgctgtacctgatgggtgaagtaacaaaccagtcctttagaataacgattctgccacagcaatatctgcgccctgtggaggatgtggccacatctcaggacgattgctacaagttcgccatctcccagagctccaccggcaccgttatgggcgcggtgatcatggaaggcttttacgtggtgtttgacagagctcgcaaacggattggcttcgccgtttccgcttgtcatgtccatgatgagtttcgcactgccgcagttgagggcccctttgtcacccttgacatggaagactgcggatacaatatcccacagacagatgagagcaccctgatgactatcgcctacgtgatggcggccatctgcgcactgtttatgctgccattatgtctgatggtttgtcaatggtgttgtctcaggtgtctccggcagcagcatgatgatttcgccgacgatatttccctcttgaaatag

SEQ ID NO: 109778 - DNA, 1299 bp, Artificial Sequence
  Description of Artificial Sequence: Synthetic coding sequence
atggctcaagcattgccttggctgctgctttggatgggagcgggcgtgctacctgctcacggtacccagcatggcattcggttgccactacgctccggactcggcggtgcccctctgggactcaggttgcccagagagactgatgaggagccagaggagccagggcgtcgcggctccttcgttgaaatggttgataatctaaggggcaaaagcggtcagggctattatgtggagatgacggtgggctcccccccacagacacttaatattctggtcgataccggttcttcaaatttcgcagtgggggctgccccacatcctttcctgcatcggtattaccaaagacagcttagcagtacatatcgcgatctgcggaagggcgtgtacgttccttatactcaggggaagtgggagggagaattgggcactgatttgctctgcggagcaggatttcccctgaatcaatctgaggtgctggccagcgtcggtggttcgatgatcattggcggcatcgatcattctctttatacagggtcactgtggtacacacctatccgcagggagtggtactatgaggtcattattgtgcgcgtggaaatcaatggacaggatctgaagatggactgtaaggagtacaactatgataaatccattgtagactctggcacgacaaatctcagactccctaagaaggtgtttgaggcagcggttaaatcgatcaaggctgctagttcaaccgaaaaatttcctgatgggttctggctgggtgagcagttggtgtgctggcaggcaggcactaccccttggaacatcttcccagtgatatctctatacctgatgggagaagtgacaaaccaatctttccggattaccattcttcctcaacagtatttgcgcccagtggaagatgtggccacttcccaggacgattgctataagttcgctatcagccagagctctacaggcaccgtgatgggcgccgttataatggaggggttttacgtggtgttcgatcgagctcgaaaaagaatcgggtttgccgtgtctgcttgtcacgtccacgacgagttcagaactgccgctgtggagggccccttcgtaacgctggacatggaagattgcggctataacatcccgcagacagacgagtctacactgatgactatcgcttatgtgatggcagccatctgcgcactcttcatgcttccactctgtttaatggtttgtcagtggtgctgtctgaggtgcttaaggcagcaacacgacgattttgccgatgatatctccttgctcaaatag

SEQ ID NO: 109779 - DNA, 1374 bp, Artificial Sequence
  Description of Artificial Sequence: Synthetic coding sequence
atggcccaggccctgccctggttgctgctctggatgggcgctggggttttgccagcccatggtacacagcatgggataaggctccctcttaggagcggattgggcggcgcgccactggggcttaggctgccacgcgaaactgacgaagagccggaggagccaggcagacgcggctcctttgtcgaaatggtggataacctcaggggtaaatcaggacaaggttactacgtggaaatgaccgtcggatctcccccccagacacttaatatcctcgtggatacagggagctctaactttgccgttggggcagctccccaccctttcctgcaccggtattatcaacgccagctgtcaagcacttatagggacctgaggaaaggcgtgtacgtgccatacacccaggggaaatgggagggggaactcggtaccgacctcccagatgacagcctagagccctttttcgacagcctcgtgaaacagacacatgtgcccaatctgttctcgctgcagttgtgcggcgctggcttccccctcaaccaatccgaggtgcttgcttccgtcggggggtcaatgattatcggcggcatagatcacagcctgtatactggatccctgtggtacaccccaattagaagagagtggtactacgaggtgatcatcgtaagggtggaaatcaatggacaggaccttaagatggactgtaaggagtacaactatgataagagtattgtggactcgggcacaactaacctgaggctccctaagaaagtgttcgaagccgctgtcaagtcaatcaaagctgcgtcttcaacagagaagtttcccgacggcttttggttaggggagcaactcgtttgctggcaggccggtacgaccccgtggaatatctttccggttatctcgctctacttaatgggggaggtcaccaatcagagcttcaggatcaccatcctcccacagcagtacctgagaccagtggaggacgtggctactagccaagatgattgctataagttcgcaatttctcagtcctccacgggcactgtaatgggtgcggtgatcatggaaggtttctatgttgtctttgatcgtgccagaaagcgaatcggctttgccgtgtctgcctgtcacgtccacgacgagttccggactgccgctgtggaggggcccttcgttacattagacatggaggattgcggctataacatcccgcagactgatgagtctaccctgatgacaatagcctatgtgatggcagcaatctgcgctctgtttatgcttcctctctgcctgatggtctgccagtggtgctgcctgaggtgcctaaggcagcaacatgacgactttgctgacgatatcagcctattgaaatag

SEQ ID NO: 109780 - DNA, 1431 bp, Artificial Sequence
  Description of Artificial Sequence: Synthetic coding sequence
atggcccaagccttgccttggctcttgctttggatgggggcaggcgtgcttccagcccacgggactcaacacggaatcaggctaccattacggtcaggtctgggcggggccccactggggttgcgccttccgcgtgaaaccgatgaagagcctgaagagcccggcagacgaggatcttttgtggaaatggtcgataatctgagaggaaaaagcggccagggctactacgtggagatgaccgtaggttccccaccccaaaccctgaacattctcgtcgatactgggtcctccaattttgccgtgggagctgccccgcatccctttcttcacaggtactaccagaggcagctctctagtacgtaccgagatctgcgcaagggcgtctacgtgccgtatacacagggaaagtgggagggggaactgggaacagatctcgtgtctatacctcacggtcctaacgttactgtcagagcaaacattgcagctattacggaaagtgataagtttttcatcaacggatccaactgggaagggattttgggcctcgcttacgccgagattgcccgcttatgcggggccgggtttccactcaaccagagcgaggtactggcttccgtaggtggatcgatgatcatcggagggatcgatcatagtctatacactgggagtctctggtacacccctatccggagggagtggtactacgaagtgattattgttcgggtggagattaacggtcaggacctgaagatggattgcaaagaatacaactacgacaaatccattgttgatagcggaacgaccaacttgcgcctgcctaagaaagtcttcgaggctgcggtgaaatctatcaaggcagcctcctctaccgaaaaatttcccgatggattttggctgggcgaacaactggtttgctggcaggccggtaccaccccttggaacattttccccgtgatctccctgtatttgatgggcgaagtgaccaaccagtcattcaggattaccatcttacctcagcaatacttgcggccagtggaagatgtggccacatctcaggacgattgctataagttcgccatatcgcagagcagtaccgggactgtcatgggggcagtaatcatggagggtttctatgttgtgtttgacagagcccggaagcggatcgggttcgcggtgtctgcatgccatgtacatgatgagttcagaacagctgctgttgaaggtccatttgtgacactggatatggaggattgtggatacaatatcccgcagaccgatgaaagcaccctgatgaccattgcttacgttatggctgccatatgcgctcttttcatgttgccattgtgtctcatggtgtgccagtggtgttgcttaaggtgcctgagacagcagcacgacgactttgcggatgacatctctctcctgaagtag

SEQ ID NO: 109781 - DNA, 1131 bp, Artificial Sequence
  Description of Artificial Sequence: Synthetic coding sequence
atggtccctttcatttatctgcaggcgcacttcacactgtgcagcggctggtccagcacctaccgtgacttgcgcaagggagtgtatgtgccgtatactcagggaaagtgggagggagagctcgggactgatctggtttcaatacctcacgggcctaacgtgactgtgcgtgctaacatcgccgccatcacagagtcagataaatttttcattaacggctcgaattgggagggcatcctcggcctcgcttacgccgaaattgccaggctctgcggagccggttttcccttaaaccaaagtgaggtattagcaagcgtaggtgggtctatgatcatcggagggatagatcatagtctgtacaccggcagcctgtggtacactccaattaggagagagtggtactacgaagtgatcatagtgcgtgtagagatcaatggtcaggatctaaagatggattgtaaggagtataattacgacaaatccattgtagacagtggcacaaccaatctgcgcttgccgaaaaaggtgtttgaggccgctgtgaagagcatcaaggcagcctcatcaaccgaaaagttccccgacggattctggctcggcgagcagctggtttgttggcaggccggaacgactccttggaatatcttcccagtaataagcctctacctcatgggtgaagtcaccaaccagagctttcgcatcacaatcttgccccaacagtaccttagacccgtggaagatgtcgccacctctcaagatgattgttataagttcgctatttctcaatcctccacaggtacagtcatgggcgcagtgatcatggaggggttttacgtagtattcgaccgcgccagaaagcggattggctttgcagtttcagcctgccacgtgcacgatgagttccgtaccgcggccgttgaggggcccttcgtgaccctggacatggaggattgtgggtacaacatccctcagactgacgagagcacacttatgaccatcgcatacgtcatggcagccatttgtgccctgttcatgctaccgttgtgcctgatggtttgccagtggtgctgccttagatgcttgcgtcagcagcacgacgatttcgccgacgacattagtctcttaaaatag

SEQ ID NO: 109782 - DNA, 1191 bp, Artificial Sequence
  Description of Artificial Sequence: Synthetic coding sequence
atgggcgcattggcacgcgctttgctgctgcctctcttggcccagtggttgctaagagctgcgccagaacttgcacccgctccatttaccctgcctcttcgggtcgcagcagctactaacagggtggtggccccaactcccggtcccggcacccccgccgagcggcacgctgatggcctggcgctagcccttgagccggcactcgctagccccgctggggccgccaacttcctggctatggtagataacctacaaggcgatagtggacggggttattatctggagatgcttatcggcacacccccccagaaattgcaaattttggtggatacagggagctccaatttcgccgttgccggcacaccacattcatacatagacacttacttcgataccgagcgcagcagtacttacagaagcaaaggctttgacgtgaccgtaaagtacacacagggaagttggaccggattcgtcggagaggatttggtgactatacctaaagggttcaacacaagcttcctggtgaacattgctactatttttgagtccgaaaacttttttctcccagggattaagtggaacggtatcttaggtctagcctacgcaacacttgctaaaccatccagctctttagaaacgttctttgattcacttgtcacgcaagccaatattcccaatgttttctcgatgcagatgtgcggcgccggactccccgtggcgggtagcggaacaaatggcggctcactggtgctgggagggattgaaccaagtctctataaaggcgatatatggtatacaccgatcaaggaagagtggtactaccagatcgaaattttaaaattggaaattggggggcagagtcttaatctggactgtagagagtataacgccgacaaggcaatagtggactccgggacgaccttgctccggttgccccaaaaggtgtttgatgctgtcgtggaagccgtggcccgagcttccctcattcccgaattttcagacggtttctggaccggcagtcagcttgcctgctggacaaatagtgaaacaccctggtcttacttccccaagatctcaatttacctcagggacgaaaattctagtaggtctttcaggatcactatcctccctcagaaactccaggtgctgcagtgcttgaagttcccgggtctctcccagcagcgtatgtag

SEQ ID NO: 109783 - DNA, 1557 bp, Artificial Sequence
  Description of Artificial Sequence: Synthetic coding sequence
atgggcgctcttgctagagcactgttgctgcccctgctggcacagtggttactccgggctgcacctgagctcgccccagcacctttcacgttgccactgagagtcgctgccgctacaaaccgggttgttgcccccacccctgggcccggtacacccgccgagcgccacgctgatggcttggctttggccctagagcctgccctggcctcacccgccggcgcagcaaactttctggccatggtggataacctccagggtgacagtgggagaggatattatttagaaatgctgatcggcacaccccctcaaaagctccagatccttgtcgatactggtagctctaattttgccgtcgccggcaccccgcacagctacatcgatacatactttgacaccgaaagatctagcacttacaggtccaaaggattcgacgtgactgtcaaatatactcaagggagttggacggggtttgtgggggaggacctcgtgactattcccaagggatttaacacatcttttctggtcaatatcgccaccatttttgaatccgaaaacttctttctgccaggtatcaagtggaacggcattctgggcctggcgtacgcaaccctggctaaaccttccagtagtcttgaaacattttttgactccctcgtcacccaggctaacatcccaaacgtcttcagcatgcaaatgtgcggtgcaggtctgcccgtggcagggagcgggactaatggcggatccctggtactgggcggcatcgaaccgagcttgtacaaaggtgacatctggtacacacccatcaaggaggaatggtactatcagattgaaatcctgaaacttgagataggtggacaatcacttaatctggattgtcgagaatacaatgccgataaagccatcgtggattctggtacaactctcctacgactccctcagaaagtattcgatgcagtagttgaggcggtggcccgggccagcttgatcccagagttctcagacggattttggacgggcagccaactagcctgctggacaaactccgagaccccatggtcctacttccccaagatttccatctacctgcgagatgagaattcctctcgatccttccggatcacgatcctgccgcagctgtatatccagcccatgatgggagctggtctgaactacgaatgttaccggttcggcatttcaccttcaacgaacgctctggttataggcgccaccgtgatggagggtttttacgtcatctttgatagggcacagaaacgcgtgggcttcgccgcgtccccctgcgcggagattgctggggcggcagtaagcgaaatttcgggtccattctcaaccgaagacgtggctagtaactgtgtgcctgcccagtcgttgtccgaaccgatcctgtggatcgtgagttacgccctcatgtctgtatgtggagccatcctcttggtgctgatcgtgctgctcctgttaccatttcggtgtcagcgccgaccgcgcgaccctgaggtggtcaacgatgagtcatcactcgtgcggcacaggtggaagtag

SEQ ID NO: 109784 - DNA, 1407 bp, Artificial Sequence
  Description of Artificial Sequence: Synthetic coding sequence
atgggcgcacttgctagagctctgctgttacctctcctggctcagtggttgcttcgagccgcccctgagctcgcaccagctccgtttacccttcccctaagggtggctgcggcgaccaatcgggtagtcgcacctacgccaggacctggtacgcccgctgaaaggcacgcagatggtctcgccctcgccttagaaccagctctggcttcccccgcgggagccgccaatttcctggcaatggtggacaatcttcagggggattcggggagaggatattatttggaaatgctgatcggaacccctccccagaagttgcaaattcttgtcgatacaggatcaagcaacttcgcagtggctggaacaccccattcctatatagatacgtactttgacactgagcggtcctctacctaccggagtaagggctttgatgttactgtcaagtacacccaggggtcctggaccggcttcgttggggaagacttggtgaccatacctaaggggttcaatacgtctttcctggtaaatatcgcaaccatttttgagtctgaaaacttttttctccccgggataaagtggaacggtattctaggtctagcatacgctacgttagccaaaccttcctcttctctagagaccttcttcgacagcttggtgacacaggctaatatccccaatgtcttttccatgcagatgtgcggagcgggtctgcctgttgcaggcagcgggacaaacgggggctccctagtcttaggaggtatagagcccagtctgtacaaaggcgacatctggtacaccccgatcaaggaagagtggtattaccagatcgaaattctgaaactcgaaattgggggacagtctttgaacctggattgcagggagtataatgcggacaaagctattgtcgattccggtactactttgcttcgattgccacagaaagttttcgatgccgtggtagaggctgtggctagagccagcctcctatatatccagccaatgatgggagcagggctcaattacgaatgttaccgctttgggatctctccctcaacaaatgccctggtcatcggcgcaacagtgatggagggattttacgtcatctttgatagagcccagaaaagagtgggtttcgctgcaagcccatgcgctgaaatcgccggagccgctgtgtcagaaatcagcggcccattttctacagaagacgtggcttctaactgcgtacctgcccagagcctcagcgaacccattctgtggatcgtgagctatgccttgatgtccgtctgtggggctatcctcctggtcttgatcgttctgttgcttctcccattccgctgtcagcgacgccctcgagatcccgaagtagtcaacgatgagtcatcactggttagacaccgctggaagtag

SEQ ID NO: 109785 - DNA, 1272 bp, Artificial Sequence
  Description of Artificial Sequence: Synthetic coding sequence
atgctgattggtaccccaccacagaagctgcagatcttggtagacaccggatcatcaaattttgcagtggccggaacaccacatagctacatcgatacatactttgacaccgaaaggtcaagtacttaccggagcaaaggcttcgatgtgaccgttaagtacacacaggggagctggaccggttttgtcggcgaagatttggtgacaatcccaaaaggttttaacactagctttctcgtgaatattgccactatttttgaatcggagaatttcttcctgccaggcatcaaatggaatggaatattaggcctggcctacgctactctcgcgaagccctcctcaagcctcgagacattctttgatagtctcgtgacccaggcaaatatacccaacgtcttcagcatgcaaatgtgcggagccgggttgcctgtggccggctctggtactaacggaggaagtctcgtgctggggggtatcgaaccctctctgtataaaggcgatatttggtacacccctatcaaagaggagtggtattaccaaatagaaatactcaagctcgagataggcggccaaagcctgaacctggattgtcgtgagtacaatgcagacaaagctatcgtagattctggaactacccttctgagattgcctcagaaggtgtttgacgcagtggtagaagccgtcgcgcgggcttctctgattccagaattcagtgatgggttttggaccggttcgcaattggcctgctggacaaattccgagacaccgtggagttacttcccgaaaattagcatatacctgcgcgacgaaaatagctctagaagtttccgtatcaccattctgccacagctatatatccaacccatgatgggggcaggtttaaactatgaatgctaccgttttggcatctcccctagtactaacgctttggtcataggcgccacagttatggaagggttctacgttattttcgatcgggcacaaaagcgagtgggcttcgctgccagtccctgcgcggagatagctggagccgccgtcagtgaaatcagcggcccgttcagtaccgaggacgtggcatcaaactgtgtacctgcgcagtcgttgagcgaacccatattatggatcgttagttacgccctgatgagcgtgtgtggcgcgattctgttggtgctgatcgtccttctcctactcccgttccgatgccagcgacgccctagagatcccgaggtagtgaacgacgaatcaagcctggtccggcatcggtggaagtag

SEQ ID NO: 109786 - DNA, 576 bp, Artificial Sequence
  Description of Artificial Sequence: Synthetic coding sequence
atgccgcgttcactgtggctgggctgcagttccctcgccgacagtatgccgtccttacgctgcctttacaaccccggcactggcgctctgaccgctttccagaattcctccgagagggaggattgcaataatggggaaccaccaagaaagattatacccgaaaaaaattcactcagacagacctataacagttgtgcacggttgtgcttgaaccaggaaactgtttgcctggcgtccacggccatgaaaacagagaattgcgtcgccaaaaccaagctggctaacggcacatctagtatgatcgtaccaaaacaaaggaagctgtcagcctcctacgagaaggagaaagagctgtgcgttaaatattttgagcagtggtcagaatccgaccaggttgaatttgtggagcatctgatctcacaaatgtgccattaccagcatgggcatattaactcatatctgaaaccgatgctgcagagagacttcattacagcactccctgcccgtggactagatcatattgcagagaatatcctctcctatctggatgcaaaatcgctctgcgcagcggagtag

SEQ ID NO: 109787 - DNA, 1818 bp, Artificial Sequence
  Description of Artificial Sequence: Synthetic coding sequence
atggaccctgccgaagccgtcctgcaggagaaggcccttaagtttatgtgctccatgcctcgctccctgtggctggggtgcagctccttggcagatagtatgccatcactacgctgtctctacaacccgggaactggcgccctcactgcatttcaaaacagctcagagagagaagattgtaacaacggcgaaccccccaggaagattatcccagagaagaactccctgcgacaaacttataactcctgtgcccgactatgtttgaaccaggagacagtgtgtctggcaagcacagccatgaaaacggagaactgtgttgccaagaccaaactggctaacggcacctcaagcatgatcgtgcccaagcaacgcaaactgagcgcgtcctatgagaaggaaaaggaactgtgcgtaaagtacttcgaacaatggtccgagtccgaccaggtggagtttgttgagcacctgatcagccagatgtgtcattaccagcatggacatattaatagttatctcaaacctatgctccagcgcgattttatcactgcgctgccagccaggggcctggaccacattgccgagaatatcctgtcttatctggacgccaaatcactgtgtgctgccgaacttgtgtgcaaagagtggtaccgagttacttccgacggcatgttgtggaaaaagttgattgagaggatggtacggaccgactcattgtggcggggactggcagaaagaagagggtggggacagtatctgtttaagaataagcctccagacggcaatgccccacctaactccttctatagagccttataccctaagattattcaggacatagaaactatcgagtcgaactggcgatgtggccgccattcactgcaacgaatacattgtcggtccgaaacatctaagggtgtgtattgtttgcaatacgatgatcagaagattgtatctgggctgcgcgataatacaatcaagatctgggataaaaacactctggaatgtaaaaggattctgactgggcatactggcagcgttctgtgtttacagtacgatgagcgtgtgatcattacgggctccagtgactctacggtgagggtgtgggatgttaatacgggagagatgctcaacactctgatccaccattgcgaggcggtcttgcatctgagatttaacaatggtatgatggtgacatgtagtaaggaccggtccatcgcagtgtgggatatggcatcccctactgacataaccctccgtagagtgctcgtaggtcaccgcgctgctgtgaatgtcgtagacttcgatgataagtacattgtttccgcaagcggagatagaaccattaaggtgtggaacacttctacctgcgaattcgtcagaactctcaacggccacaaacgggggatcgcttgcctccagtatagggatcgtctcgtcgtgtcggggtcctccgataacactataaggctctgggacattgagtgcggtgcgtgcctacgtgtgctcgaaggtcatgaggagctggtgcgatgcatccgtttcgacaacaagaggattgtcagcggggcctacgatggcaaaataaaagtgtgggatctagtggcagcactggaccctagggccccagccggcacactctgccttagaacccttgtggaacattctggacgcgtgtttcggctgcagtttgacgagttccagattgtgtcctcatcacatgatgacacgattctgatctgggactttttaaatgaccccgcagcacaggccgagccgccaaggtcaccaagcaggacttacacatacatcagtcggtag

SEQ ID NO: 109788 - DNA, 1695 bp, Artificial Sequence
  Description of Artificial Sequence: Synthetic coding sequence
atgtgctccatgccgcgtagtctttggctgggatgctcctcactggccgacagtatgccgtctctgaggtgtctttataacccaggcactggcgccctaaccgcattccagacctacaatagctgtgcaaggctgtgtctgaatcaggagaccgtttgccttgccagcactgccatgaagactgagaactgcgtggcgaagacaaagctagccaacggtacctccagcatgatcgttccaaagcagaggaagctgagcgctagctatgagaaagaaaaggagctatgtgtcaagtatttcgaacagtggagcgagagcgaccaggtggaatttgttgaacacctgatctctcagatgtgccactaccaacacggacacattaattcgtacctgaagcccatgttacagcgagactttatcacggcgcttcctgctagaggacttgatcatatagctgagaacatcctgtcatatttggacgcaaaatccctctgtgccgcagagctagtatgtaaggaatggtatcgagtaaccagcgatgggatgttatggaagaaactgattgaacgaatggtgcggaccgactcactatggaggggactggccgaacgtagaggctggggtcagtatctgtttaaaaacaagccacccgatgggaatgctccccccaattcgttctatcgcgccctgtatcctaaaattatccaggatatagaaaccatcgagtccaactggaggtgtggtcggcattccctgcagcgtatacattgcaggtccgagacgtcgaaaggggtctactgtctgcagtacgacgatcaaaaaattgtgtcaggcctgcgggataacacgatcaaaatctgggacaagaacacactggagtgcaaacgtatactcacgggacacactgggtccgtattgtgtctccagtatgacgagcgtgtcataatcaccggaagcagtgactctactgtgcgggtgtgggatgtcaacacaggagaaatgctaaatactctcattcaccactgtgaagccgtgctgcatctgcgattcaataatggcatgatggtcacctgctctaaggacagaagcatcgccgtgtgggatatggcttccccaaccgacattaccttacggcgcgtattggtcggtcaccgcgctgcggttaatgtagtcgatttcgatgataagtacatagtgagtgctagcggagataggactatcaaagtctggaacacttctacatgcgagttcgtcaggacgctcaacggacacaaaaggggcattgcatgcttgcagtaccgggacaggttagtggtctccgggtcttcagacaacacgatcaggttgtgggacatcgaatgcggcgcatgcctccgggtcttagaaggacacgaggaacttgtccggtgcattagattcgacaataaaagaatcgtctccggagcttacgacggaaagattaaggtgtgggatctggtggccgcccttgatcctcgcgccccagccggcacgctgtgcctgcggactttggtcgaacactccggacgcgttttccgattgcagtttgacgaattccaaatcgtatcctccagccatgacgacactattctcatttgggactttctgaatgatccggctgcccaggccgagcctcctagaagcccctctcggacatacacctatattagtagatag

SEQ ID NO: 109789 - DNA, 1710 bp, Artificial Sequence
  Description of Artificial Sequence: Synthetic coding sequence
atggacccagcggaggccgtgctgcaggaaaaggcccttaagttcatgaattcttcggaacgcgaggactgcaacaatggcgaacctccacgaaagattatcccagagaagaattcattaaggcagacttataacagttgcgctaggctttgtctgaatcaggagacagtctgtttggctagcaccgcaatgaaaaccgaaaactgtgttgccaagactaagctagcaaatggaaccagctcgatgattgttcctaagcagaggaagctgagtgccagctatgagaaggagaaggaattatgtgtgaagtactttgagcagtggtcggagagcgaccaggtcgaatttgtcgaacatctgatctctcagatgtgtcactatcagcatggtcacattaatagctatctgaaacctatgctgcagagagatttcattacagcgctaccggctagggggctcgatcacatcgccgaaaacatcctgagttatctggacgccaaatctttgtgtgcagccgagctggtttgtaaggagtggtatagagtcacgagcgacggaatgctgtggaaaaaacttatcgagcgcatggtgcgaactgacagcctgtggagggggttggcagagagacgcggatgggggcagtatttgttcaaaaacaagcctcctgacggcaatgccccccccaatagcttctaccgcgcactatatcctaaaattatccaggacatcgaaacaattgagtcgaactggcgttgcggcagacattccctccagagaatacattgcagatcggagacatctaaaggggtgtactgtctccagtacgacgatcagaagatcgtgtctggcctgagggacaataccataaagatctgggacaagaatacacttgagtgcaagcgcattctgacaggccataccggctccgtgctatgcctccagtatgacgagcgtgtgattatcactggctctagtgatagcacagtgagagtatgggacgtgaatactggtgagatgctgaatacgttgatccaccactgcgaggccgtcctgcacctgcgtttcaataacggaatgatggtgacctgctccaaggaccgaagtatcgcggtgtgggacatggcgtcgcctaccgatattaccttacgacgagtcctcgttggccacagggccgccgtaaatgtggtcgactttgacgataaatacatcgtcagcgcatccggagacaggactataaaggtgtggaacacctccacatgcgagtttgtccgcacactgaatggccacaagagggggattgcctgcctgcagtaccgcgaccgccttgtggtctccggaagctctgataatacaattcgcttgtgggacatcgaatgtggggcatgtctcagagtgctagaggggcacgaggagttggtgcgctgcatccgctttgataacaagcgaattgtctccggagcctacgacggaaaaattaaggtgtgggacctcgttgcagccctggaccccagagcccctgcaggaacgctttgtttgcgaactctggtggaacactcagggcgcgtctttcgcctccagtttgacgagtttcagatagtcagctccagtcacgatgacaccatcctcatatgggattttctgaacgatccggctgctcaagctgagccaccaaggtcaccctctcgaacttacacatatatctctagatag

SEQ ID NO: 109790 - DNA, 126 bp, Artificial Sequence
  Description of Artificial Sequence: Synthetic coding sequence
atggatccagccgaggccgtgttgcaagaaaaagccctcaaattcatgacgtacaatagctgcgctcgtctgtgtctgaaccaggagactgtgtgcttagccagcacagcaatgaaaacggagtag

SEQ ID NO: 109791 - DNA, 327 bp, Artificial Sequence
  Description of Artificial Sequence: Synthetic coding sequence
atggttaccttgctgccaatcgaaggccaagagattcactttttcgagatcttagaatcggaatgtgtgctgtatacaggatggattgagcgcgcaagcggctcctccatctatccggaagcaaaggcccgccttccgctcgaagctctccttggctcaaataaagaacccatgttacccaaagaaaccgtgctgagcctgaagagatataacctcggatctagtgctatgaaacgaaatgtccccggtcacgtgctgcagcgccccagctacctgacgcgcattcaggtgaccctgctttgtaacagttccgctgaagccctatag

SEQ ID NO: 109792 - DNA, 1521 bp, Artificial Sequence
  Description of Artificial Sequence: Synthetic coding sequence
atggaacagctcgatgtcttcattagcataaaacctaaacctaagcagccatccaagtcagtgatcgtcaaaagcgttgagcgcaacgccctcaatatgtacgaagcacgaaaatgcctcctggggctggagtcttcaggggttactattgcgactagccccagcccagcttcatgcccagcaggactggcttgtccctctttggacatactggccagtgcaggactgggactgaccgggcttgggcttctgggtccgactactctctctctgaataccagcactacgccaaacagcctgctgaacgccttaaacagcagcgtttcaccactgcaatccccctcttctgggacaccatctcccactctctgggcgcccccattggctaacacttcttccgctactggcttcagtgcaattccacatcttatgatccccagcactgctcaggccactctgactaacatcctccttagcggagttcccacctatggccacacggccccatctccccctcccgggctcactccggtagacgtgcacattaattctatgcagactgagggcaaaaagatctcagctgccctgaatgggcacgctcagtcacctgacataaagtatggcgccatttccacctccagccttggggaaaaagtcctttctgccaaccatggtgacccgtccatccaaaccagcggatctgagcagacgtcacctaagtctagtccgaccgaaggatgcaacgatgctttcgtcgaagttggcatgccccgcagcccctcacactcaggtaacgcgggagatctgaagcaaatgatgtgcccatccaaggtgagctgtgccaagaggcagaccgttgagctgttacaaggcactaagaactcccacctgcactctacagacaggctcctaagtgatccggagttgtccgcgaccgagtcgccattagcggataagaaagctcccggatcagaacgagccgctgagcgtgccgctgctgcacagcagaacagcgagagagcacatctggcacccagaagctcttatgtcaacatgcaagcattcgattacgagcaaaaaaagctgctagccacaaaggccatgctcaaaaagccggtcgtcaccgaggtgagaactcctaccaatacatggtccggactgggattttctaaatctatgcccgctgaaactataaaggagttgcggcgtgcaaaccacgtgtcttacaaaccaaccatgactactacatatgagggaagtagcatgagcctgagtaggtctaacagccgagagcatttagggggggggtctgaatcggataattggcgggacaggaacggcataggccctgggtctcatagcgaatttgcagcaagtatcggttcaccaaaaagaaagcaaaacaaatcttcagagagatgtgtgctgtgtactcttctcgggattccaaggctggagtgtgtgtatcttggctggagcattacggactgtgggctatctgatttcaagtgccttgtgtag

SEQ ID NO: 109793 - DNA, 2925 bp, Artificial Sequence
  Description of Artificial Sequence: Synthetic coding sequence
atggccgcacagggggaacctggttatctggccgcccagtccgatcccggttctaatagtgaacggtctaccgattctcccgttccaggctctgaagatgatctggtcgcaggcgctactcttcattcccctgagtggagtgaagaacgattccgggtggacaggaaaaagctggaggctatgctgcaggctgctgccgagggcaaaggtcgctccggcgaggacttcttccaaaaaatcatggaggagaccaacacgcagatcgcatggccgtcgaagctgaaaattggagcgaaatctaaaaaagatccccatatcaaggttagcggaaagaaagaggacgtcaaggaagccaaagagatgataatgtctgtccttgacacaaagagcaaccgggttaccctaaaaatggacgtgagccatacggaacactcccatgtgattggcaaaggcggaaacaacattaaaaaagtgatggaagagactgggtgccacatccatttcccggattctaacaggaataaccaagccgaaaaatcaaaccaggtctccattgcagggcaacctgcgggcgtggagtcagctagggtcagaatcagagagctgttacccctggttttgatgtttgagcttcctattgctggcatactgcagccagtccctgatcctaacagcccatcaatccagcatatttcacagacttataacatcagcgtttcctttaagcagcgctcccggatgtatggagctacagtgattgtgaggggcagccagaataacacgtctgcagtgaaggagggcactgcgatgctgcttgagcatctcgctggctctttggctagcgctatacctgttagcacgcagctagatattgccgctcagcaccacttgttcatgatgggaaggaatggatcaaatataaagcacatcatgcaacggactggcgcccagattcacttcccagatccatcaaaccctcagaaaaaaagtaccgtataccttcagggcacgattgaatccgtatgcttggcacggcaatatctcatgggatgcttgcccctcgttcttatgttcgatatgaaggaagagatagaagtcgacccacaattcattgcacagttaatggagcagttggatgtcttcattagcatcaagccaaaacctaagcagccaagtaagagcgtcatcgttaagtctgtagaacgaaatgcattgaatatgtatgaggctagaaaatgcctgttgggtctcgaaagctcaggagtcacaatcgccacgtcacccagccctgccagttgtccagcagggttggcatgccccagcctggacattctagcatctgccggccttggcctcacaggtttgggtctcttaggcccaactacgctcagcctaaatactagcaccactcccaacagcctgttgaatgcgctaaacagtagcgtctcgcctttgcagtctccctcctcaggcacccccagccccaccctgtgggctcccccattagccaataccagtagcgcaacaggcttcagcgccattccccatctgatgattccgagcacggcgcaggctacattaactaacattctgctcagcggcgtccctacctatggtcacaccgcacccagtccaccacccgggctgactcctgtcgacgtgcatatcaattctatgcaaacagagggaaaaaagatctcagctgcccttaatggtcatgcccagagccccgacattaagtacggcgcaatctccaccagctcactcggggaaaaagtgctctcggcgaaccacggagatccgagtattcagacaagtggtagtgaacagacttcacccaaatcttctcctacagaggggtgtaacgacgcatttgtcgaagtaggcatgcctagaagtccttcgcattccgggaatgctggagacttgaagcaaatgatgtgtcctagtaaggtgagttgtgctaagcgacagacagtggagctgcttcagggaactaagaattcgcaccttcatagcacagacaggctgctaagcgaccccgagctgtcagctactgaaagtccccttgccgacaaaaaagcacccggaagcgagcgagccgcggaaagggctgctgccgcacaacagaattcagaaagggctcacctggccccccgatcatcttatgtgaacatgcaagcgttcgattatgaacagaagaagttacttgctacaaaagccatgctgaaaaagcctgtcgtgacagaagtgagaacccccacaaacacctggtcagggctaggattctccaaatccatgcccgccgaaaccatcaaggaactcagacgcgcaaaccatgttagttataagcctacaatgaccaccacatacgaggggtcctctatgtcacttagtcgttcgaactctagggagcatctcgggggagggtccgagtccgacaactggcgggatcgcaatggaatcggcccaggctctcacagcgagtttgccgcctctatcgggtccccaaagaggaagcagaataaaagtactgagcattacctgtcttcatccaactacatggactgcatatctagccttacgggaagcaacggttgtaacctcaattccagtttcaaagggtctgatctgcccgagctgttctccaaactaggactagggaagtatacagacgtgtttcagcagcaggagatcgatctgcagaccttcctgacccttactgaccaggatctgaaggagctggggattaccacattcggggctagaaggaaaatgttgttggcgatcagcgagctgaacaagaataggagaaaactgtttgaaagtcccaacgcccggacttccttcctggagggcggagcttcaggtaggctgccaaggcagtaccactccgacatcgcttctgtgtcgggaaggtggtag

SEQ ID NO: 109794 - DNA, 2928 bp, Artificial Sequence
  Description of Artificial Sequence: Synthetic coding sequence
atggcggccgaggaggtgttgcaaacggtcgaccactacaagacagagatcgaaagactcacaaaagagctgaccgagactacccacgaaaagatccaagcagcagaatacggactcgtggtgttagaagagaaactgaccctaaagcaacaatatgacgaattggaagccgagtacgacagtctgaaacaggagctggagcaactcaaggaggcctttgggcaatcttttagcattcaccgcaaggtcgctgaggacggcgaaacaagggaagaaaccctgctacaagagtcagccagcaaggaagcttactacctcggaaaaattcttgagatgcagaacgaactgaaacagtcacgagccgttgtaaccaatgtccaggccgaaaacgagaggctgaccgctgtggttcaggatcttaaagagaacaatgaaatggtcgagctacagcgaatccgtatgaaggacgagatccgcgaatataagtttagggaggcacgtctgctgcaggactatacagaattagaggaagaaaacattaccctgcagaaactggtgtctacgcttaagcagaatcaggtggagtacgagggtctaaaacacgaaatcaaacgcttcgaagaggagaccgtgctgttaaattcacaactcgaggacgccattcggctgaaagaaattgcagagcatcagttggaggaagcgctcgaaactttgaaaaacgaacgcgagcaaaaaaataacttgaggaaggagctatcacagtatatctccctcaacgacaaccacatctcaatctcggttgatgggctgaagtttgctgaagacggttcagagccaaacaatgatgataagatgaacgggcatatccatgggccactagtgaaactcaacggggactatcgtacacccacgttgcgaaagggcgagagcctaaaccccgtatctgaccttttctccgaactcaacatctccgaaattcaaaaattaaagcagcagctgatgcaggttgagagggaaaaggccattctcctggccaatctgcaggagagtcaaacacaactggaacacacgaagggcgctctgactgagcagcacgagcgagttcaccggttgactgaacatgttaatgctatgcgtggcttgcagtcctctaaggagctgaaagcagagctggacggcgagaaaggacgcgacagtggcgaagaggcccacgactatgaagtcgacatcaacggcctggagatccttgaatgcaaatacagggtcgctgtgacagaggttatcgaccttaaagctgagatcaaagctcttaaggaaaagtataacaagtcggttgaaaattataccgacgagaaagcgaagtacgaatccaagattcagatgtacgatgaacaggttacatccctggagaagaccactaaggaaagcggggagaagatggcccacatggagaaagagcttcagaagatgacatctatagcaaatgagaaccatagcaccctaaataccgcgcaggatgaattggttacgttttctgaagagctcgcccagctctaccatcatgtctgtctgtgtaataacgagacacctaaccgcgtgatgctggattactataggcagagtagagtgactaggagcgggagcttgaaaggacctgacgatcctagggggcttctgagcccccggctagcaagaagaggcgtctcatcgcccgtcgagacacgcacatcctctgaacccgtcgcaaaggagagtaccgaagcctctaaggagccctcgcctacaaaaactcctactatctccccagtgatcaccgccccgccttcttctcctgttctggatacctcagacattaggaaggagccgatgaatatttacaacctgaacgcaattattagagaccaaataaagcatctccaaaaggcggtcgatagatctctgcaactctctagacagcgcgcagccgcccgagaactagctcccatgatcgacaaggacaaggaggcacttatggaggagattctgaaactcaaaagcctgttatccacaaaacgagagcagatcgccaccctccgtgcggtgttaaaagccaataaacagacagccgaagtggcactggcaaacctgaagaataaatatgagaatgaaaaggccatggtgactgaaaccatgacaaagcttagaaatgagttgaaggcccttaaagaggacgctgcgacattcagcagtctccgggccatgttcgccacccgctgtgatgagtacgtcacccagctcgatgagatgcagcgccagctcgcagcggccgaggacgagaaaaaaacactcaacaccctcctgcgaatggctattcaacagaaactggctttgacccaacgtctcgaggacctggaatttgaccacgaacagtccagacgatccaagggtaaactaggaaagagtaagatcggatctcctaaggtgtcgggggaggcctccgtaacagtccccactatagatacatatctgctccatagccagggtccgcagaccccgaatatccgtgtcagctccggcacccaaagaaaacgccagttctctccatccctctgtgatcagagcaggcccaggacaagcggagcttcctaccttcagaacctgctgcgcgtccctcctgacccaactagtaccgaatcgtttctgctgaaaggacctccctcgatgtcagagttcatccagggccatcggttatccaaggagaagaggcttaccgtggccccacccgattgccaacagcctgctgctagtgtgccaccccagtgtagccaattggctggccgccaggactgtccaaccgtgagtccagatacagcactgcccgaagagcagccgcactcttcatcgcagtgcgcacctttgcactgcctttccaaacctccacatccatag

SEQ ID NO: 109795 - DNA, 2484 bp, Artificial Sequence
  Description of Artificial Sequence: Synthetic coding sequence
atggcagccgaggaagtgctccagacagtggatcactataagacagagatcgagcgcctcactaaggagctcacagaaaccacgcacgagaaaatacaggccgccgaatatggcctggtcgttctcgaagagaaactgaccctcaagcaacaatacgacgaacttgaagccgaatacgacagcctgaaacaagaactcgagcagttaaaggaagcctttggccaaagcttttccattcatcggaaggtggccgaagacggggagactcgcgaggaaaccctcctgcaggaaagtgccagcaaagaagcctactacctgggtaaaattttggagatgcaaaatgaacttaaacagagtcgcgctgtggtcaccaacgtgcaggctgagaatgagcgcctaacggccgtggtgcaggatctaaaggagaataatgaaatggtggagttacaaaggattcgcatgaaggacgaaatccgagaatacaaattcagggaagcccgtttactacaggactatacggaactcgaagaggaaaatattacactccagaagctggtgagcacactaaaacagaatcaggtggagtatgaggggctaaagcacgaaattaagcggtttgaggaagagacagtcctcttaaacagccaactggaagatgccatccgtctgaaggaaatcgcagagcatcagctggaggaggccctggaaactttaaagaatgaaagagaacagaagaacaatctccgaaaggagctgtcacagtatattagcctcaacgataatcacatatccatctctgtagacggcctcaagtttgcagaggatggatcagagccgaacaacgatgacaagatgaacggacatatacacggtccactcgtgaaactaaatggcgactatcgtacacctactctgaggaaaggtgaaagcttgaacccagtgagtgatctattttcagagctcaatatcagcgaaatacaaaagctgaagcagcagctcatgcaggtcgaacgggaaaaagcgattttactggcaaacttgcaagaaagccagacacagctggagcatactaagggcgcattgacagaacaacatgaaagggtgcacagactgacagaacatgtgaacgctatgcggggattacaatcttccaaggagctgaaggctgaactggacggggagaagggcagggactccggggaagaggcgcatgactacgaggtggatatcaacggcttggagattttagagtgcaagtacagagttgctgttaccgaagttatcgatctcaaggctgaaattaaagcactcaaggagaagtataataagtccgttgagaattacacagacgagaaggccaagtacgaatccaaaattcaaatgtacgacgagcaggttacctctctcgaaaagacgactaaggagtccggagaaaaaatggctcatatggaaaaagagctgcagaaaatgacctctattgccaatgaaaaccatagcacactgaacacagcacaggacgagttagtaacgttcagcgaagagctcgcacagctgtaccatcacgtatgtctgtgcaacaacgagacaccaaatcgtgtaatgctggactactacaggcagagccgagttacccgatcgggaagtctgaaaggcccggatgaccccaggggattgttgtcacctagactggctcgacggggggtatcgtctccagtggaaaccaggacatcttccgagcccgtagctaaagagtccaccgaggcctcaaaggaaccatctcccacgaaaaccccaaccatcagcccagtgatcaccgccccaccttcgtcacccgttctggatacctccgacattcgaaaggaacctatgaacatctataacctcaacgccataatcagggatcaaatcaaacacctgcagaaggcagtggacagaagcttgcaactgtcgcggcagcgagcggcggcgcgcgaactagccccaatgatcgacaaagacaaagaagccctaatggaggagatccttaagctcaaatcccttcttagtactaagcgggaacagatcgccactctccgcgccgtgcttaaagccaacaaacaaaccgctgaggtggctttagccaacctcaaaaacaagtacgagaacgagaaggcaatggttactgagacaatgacaaaattgaggaacgagttgaaggccttgaaagaggacgcggccaccttttctagtcttcgcgccatgttcgcaaccaggtgcgatgagtatgtcacccaattagacgaaatgcagcgacagctggccgctgccgaggatgaaaaaaaaaccttgaacacgctgctgcggatggcgatccaacagaagctagccctcacccaaagactggaggacctggagtttgatcacgagcagtctcggcgcagtaagggcaagcttggaaagtcaaagatcggatcaccaaagaccatttttacttttcctctctag

SEQ ID NO: 109796 - DNA, 2508 bp, Artificial Sequence
  Description of Artificial Sequence: Synthetic coding sequence
atggctgccgaggaggtgctgcaaactgtcgaccactacaaaacggagattgagagattgactaaagagctcacagagacaacccacgagaagatccaagcagctgaatacggtctcgtggtgctcgaggaaaagcttacactgaagcaacagtacgatgagctcgaagcagagtatgattcactgaagcaggagctcgaacagctcaaggaggcttttggacaatcctttagtatccacagaaaagttgccgaagacggcgagaccagagaggaaaccctcctgcaggaatctgcgagcaaagaagcatactatctgggcaagatcttggagatgcagaatgaactcaaacaatcccgagccgtcgtgacaaacgttcaggccgagaatgagaggctgaccgcagtggtgcaggatctgaaggagaacaatgagatggtggagctgcaacgtatcagaatgaaagacgagatccgcgagtataaattcagggaagctcgcctgcttcaagactatacagagctagaagaagaaaatatcaccttgcagaagctggtatccaccttgaaacaaaatcaggtagaatacgaaggactgaagcatgagataaagcgcttcgaggaggagacagtgcttctcaactcacagttggaagacgccatacgactgaaggagatagcagagcaccagctcgaagaggcgctagaaaccctgaaaaatgaacgtgaacagaaaaacaatcttaggaaggagctgagccagtatatcagcctgaacgataatcatatcagtatctcggtagatggacttaaatttgccgaggatggttccgagccgaacaacgatgataaaatgaacggccacattcacggaccgcttgtcaaactgaatggggattatcgaactcccacactgagaaagggtgaatcactcaaccccgtaagcgacctgttttccgaattgaacatatcggagatacagaaactgaagcagcagcttatgcaggttgagcgagagaaggcgattcttctggccaaccttcaggagagccagacacagcttgagcatacaaagggcgcacttacagagcagcatgaaagggtgcatcggctgacagagcacgttaacgcaatgcggggtctgcagtcctccaaggaactcaaggccgaacttgatggcgagaaggggagagattcaggggaagaagcacatgattacgaggtggatattaatggactggagatccttgagtgtaaataccgcgtggccgtgactgaggtaattgacctgaaggcggagatcaaagcactcaaagaaaagtacaataaatccgtggaaaattataccgatgagaaggcgaaatacgaaagtaagatccaaatgtatgacgaacaggtgacctctctggagaaaaccacaaaggagtcaggagagaaaatggcacacatggagaaagagctacagaagatgaccagcatcgcaaatgagaaccatagcaccctgaacacagcccaggatgaactggtgacattctcggaggaactcgcccaactatatcaccacgtctgcctgtgtaacaatgagaccccaaatagggttatgctggattactatagacaaagtagagtgactcggagcgggtccctcaaaggccccgatgatccaaggggcctgctgtcaccaaggctggcccgccggggcgtgtcttccccagtcgaaactagaacatcatcagaaccagtggctaaagagtctactgaagcttcaaaggagcctagccccacaaaaacaccaactatctcgcctgtgatcactgccccaccgtcctcaccagtactcgacacaagtgacatccgcaaagaaccaatgaacatctataacctcaatgctatcattcgcgaccagatcaagcatctgcagaaagcagttgatcgatccctgcagttgagccgtcagcgagccgcggcgagagagctggctccaatgatcgataaggacaaagaagccctgatggaggaaatcctcaaactgaagagcttattgtcaaccaaaagggaacagatcgctacccttagggccgtgttgaaggccaacaagcagacagcagaagtggccctggccaatttgaagaacaagtatgagaacgagaaagcaatggtgacagagacaatgactaagctgaggaacgagcttaaggctctcaaggaagacgcagcaactttttcctccctgagggccatgtttgcaacacgatgcgacgagtatgtgacgcaactagacgagatgcagagacagcttgccgccgcagaggatgagaagaaaactttaaataccttgctgcggatggcaatccaacagaaactggccttaacacagcgcctggaggatctagaattcgatcatgagcagagtcgccggtcaaaagggaagctgggcaaatctaaaatcggctcacctaaaattgtatcttcgctgctgcctccatacaggcatagtgcccacaattag

SEQ ID NO: 109797 - DNA, 2568 bp, Artificial Sequence
  Description of Artificial Sequence: Synthetic coding sequence
atgtcagctcctagcgaggaagaggaatatgctaggctcgtgatggaagctcagccagaatggctgagagctgaagtgaaaaggctctcgcacgagttggccgagactactagagagaagatccaggccgccgagtacggactcgccgtgttggaagaaaagcatcaactgaagttacagtttgaggagctcgaggtggattacgaagccatcagaagtgaaatggaacaattgaaagaagctttcggtcaggcgcacacgaaccataaaaaagtagcagccgatggggaatctagagaagagtctctgattcaggagagtgcttctaaagaacaatattacgtgaggaaggttttagaactccagaccgaactcaaacagctaagaaacgtattaacaaatactcagagcgaaaatgagcggctcgcatctgtggcacaggagctgaaagaaatcaatcagaacgtggaaattcagagaggacggctgcgtgacgacatcaaagagtacaaattcagagaagctcggttactgcaggattacagcgagctggaagaagagaatatctcacttcagaagcaagtcagcgtgttgaggcagaaccaagtggagtttgaggggctaaaacacgagattaagcggctggaagaggagaccgagtacttgaactcacaactggaagacgctatccgcttaaaggaaatctccgagcggcagcttgaggaagctctggagaccctgaagaccgagcgggagcaaaagaatagcctccggaaggaactcagccactacatgtccatcaacgactctttctacactagccatctccatgtgtcactcgacggactgaagttctccgacgatgccgctgaaccgaacaacgacgctgaggccttggtaaatggatttgagcacggtgggcttgctaagcttcctctggataacaagacgtccacacctaagaaggaaggactggcacctccgtccccatcactggtctctgaccttctttccgagctgaacatcagcgaaatacaaaagttgaagcagcaactgatgcagatggaacgagaaaaggccgggctgttggctacgctgcaggacacccaaaagcaacttgagcatactagaggatcccttagtgagcagcaagagaaggtgacgcggctgacggagaatctgagtgccctgcggagattgcaggcatccaaggagaggcagaccgccttagacaatgagaaagatcgcgactcacatgaggatggcgactattacgaagtggacatcaacggacctgaaatcctcgcatgcaagtaccacgttgcagttgccgaggcaggagaacttagagaacaactaaaggccctaagatctacacacgaggcgagggaagctcagcacgctgaggagaaagggcgatacgaagccgagggacaggctctgaccgaaaaggtctccttactcgagaaggcgtcgagacaggatcgcgagctcctcgccagacttgagaaagagctgaaaaaggtctctgatgtagctggcgagacccagggatccctgtccgttgctcaggacgagctggtgaccttctctgaggaattagctaatctgtaccaccatgtgtgcatgtgcaataatgagactcctaacagagtcatgctagactattatcgagaagggcagggcggcgccggccggacctcccccggtggccggacatcgcctgaggctagagggcgtagaagccctattctgctccctaagggcctgctagcgccggaggctggccgtgcagacggagggaccggagattcctctccttctccgggatcgtctttgcccagtccgctgagcgatcccagacgggagccaatgaatatctataatttgatcgcaatcatccgagatcagatcaaacacctgcaggccgccgtcgacagaaccactgaactgagccgacagcggatcgcctcccaggagctgggacccgctgtcgacaaagacaaggaggccctgatggaggaaatcttgaaactcaaaagtctcctttcaacaaagagggaacagattacaacactgcgtaccgttctgaaggcaaacaaacagacagcagaggtggcccttgccaatctgaagtccaaatatgagaatgagaaagcaatggtgactgaaactatgatgaagcttaggaatgaactgaaggcgctcaaggaggacgcagcaaccttttccagcctgcgcgccatgtttgcaaccaggtgtgacgaatatattacgcagttagacgagatgcaaaggcaactagccgccgcggaggacgagaagaaaaccctaaacagcctcctccggatggccattcagcaaaaactcgccctcacgcagcggcttgaactgctggagctcgatcatgagcagacgagaagggggagggcaaaggccgcccctaagactaaacctgcgactccctccgtgagtcatacttgtgcttgcgctagcgaccgtgcagagggcactggtctcgctaatcaggtattctgtagcgagaaacattctatttactgcgactag

SEQ ID NO: 109798 - DNA, 2475 bp, Artificial Sequence
  Description of Artificial Sequence: Synthetic coding sequence
atgagtgctcccagtgaagaggaggaatatgcgcgcttagtgatggaagctcaacctgagtggcttagggcggaggttaagcgtctttctcatgagctggccgagacgactcgggagaagattcaagccgccgaatatgggcttgcagtgcttgaagagaagcaccagctgaagctacagtttgaggagttagaagtggactatgaggctatcagatctgagatggaacagcttaaagaggcctttgggcaggctcacactaaccacaagaaggtggcagcggatggcgaatccagggaggagtcgctgatccaggaaagtgcctcaaaagagcagtactacgtgagaaaagtcctagagttgcaaaccgagttgaagcagctgcgtaacgtactgactaacacccagtccgagaacgagcgactagcgtccgtggcacaggaattgaaagaaataaaccaaaacgtcgagatacagcgtggcaggctccgggatgacataaaggagtataagtttcgcgaagcgcggctcttgcaggactactctgagctagaggaggagaatatcagccttcagaaacaggtgagcgtcctgaggcaaaaccaagtcgaattcgagggtttgaaacatgaaatcaagcgactggaagaggaaacagagtacttaaattcacagctcgaagacgctatcagactcaaagagatctccgagcgtcagcttgaagaggctctggaaacactaaagaccgagcgggagcagaagaactcactgcggaaagagctgtcacattacatgtcaatcaatgattcgttctacacttcgcacctccatgtctcattggacggactaaagttcagcgatgacgccgcagagcctaacaatgacgccgaagctctggttaacgggtttgagcatggaggactcgcgaagctgcctctggataataaaactagcactcccaaaaaggagggtctcgcgcccccctctccttctttagtaagcgatctgctgagcgagctgaacatctccgaaatccagaaattgaagcagcagctcatgcagatggaaagagagaaggctggcctgttggctaccttgcaagatacccagaagcagctcgagcatacaagaggatctctttctgagcagcaggaaaaggttacaagactgacagagaacctcagtgctctcagaaggctccaggcttccaaagaaaggcagacagctctggataatgagaaggatcgcgattctcatgaagatggcgactactatgaggtggacattaacgggccggagattctcgcctgtaagtatcacgtggctgtggcggaagcgggcgaactgagggagcagctaaaagctctgcgctctacacatgaagccagggaagctcagcatgccgaggagaagggaaggtacgaggctgaggggcaagcgctgacggagaaagtcagcttgttggaaaaggcgtcccgtcaagatagagagttgctcgcacgacttgaaaaggagctgaagaaagtcagcgacgtggcgggagagacccagggcagcctttccgtcgcccaggatgagctggtcactttttccgaggagctggcgaatttgtaccatcacgtgtgcatgtgtaacaacgaaacccctaatcgggtcatgctcgattattatcgagagggccagggtggggccggacggacgagtcccggcggtagaacaagccccgaggcccgcgggcgtaggagtcccatcttactgcccaaggggctcttggccccggaggcaggcagagcagatgggggtaccggcgattcatctccgtccccaggctccagcctgccttctcccttgagcgaccctcggagagagccaatgaacatttataacctcatcgccataatcagggatcagatcaagcacctgcaagcggcagtagatcgtaccactgagctgagtcgccaaagaatagccagccaggaattggggccagcagttgataaggacaaggaggctttgatggaagaaattctgaaactgaagtcgcttctctctaccaagagagaacaaatcacaacattacgaactgtgctgaaagcaaacaaacagactgcggaggtggccttggcaaatttaaagagcaagtacgagaatgaaaaggctatggtgacagaaacaatgatgaagttgagaaacgaactgaaggccttgaaagaagacgcagctaccttctccagcctgcgagcaatgttcgcaacaaggtgtgacgagtatatcacgcagcttgacgagatgcaacgccaactcgccgctgccgaggacgagaaaaagaccctcaattcgctcctgaggatggctattcagcagaagcttgcactcactcagcgactggagctcctggagcttgaccatgaacagaccagacgcggtcgcgcaaaagcagcacccaagacaaagcctgcaacccctagcctgtag

SEQ ID NO: 109799 - DNA, 1107 bp, Artificial Sequence
  Description of Artificial Sequence: Synthetic coding sequence
atgtggcctctctggcgtctggttagtttgcttgccctgtcccaggcgctgccatttgaacaaagaggattctgggatttcacgctggatgatggcccctttatgatgaacgatgaggaagctagtggagctgataccagcggggtgctggatccagatagtgttacgcccacatacagcgctatgtgcccatttggatgccactgccatctgagggtggtgcagtgctctgatctgggtctgaagtctgtcccaaaggaaatttccccagacaccaccctgctcgatctgcaaaataatgacattagcgaactcagaaaggatgattttaaaggcctccagcacctgtacgctctggttctagtgaacaacaaaatatctaagatccacgaaaaggccttttcacccctccgcaagttgcagaagttgtacattagtaagaaccatttagttgagataccgcctaatctcccatcctctctggtggagctgaggatccatgataacaggattcgcaaggtcccaaagggagtcttttccggactgcggaatatgaattgcatcgagatgggagggaatcccctcgagaattcaggctttgaaccaggcgctttcgacggactcaaacttaactacctgaggatttcagaggccaaactcactggaatcccaaaggacctgccagagactctgaacgagctgcacctggatcacaataaaatccaggctatcgagctggaggatctcttgcggtattccaagctgtacagactgggcttggggcacaatcagatacgcatgatcgagaacggctcgctgagcttcctcccaaccctgcgcgagctgcaccttgataacaacaaacttgcaagagtgcccagtggccttcctgatttgaaactactccaggtagtatacctacactctaacaatatcaccaaggttggagtgaacgacttctgtcctatgggttttggggtcaaacgcgcttattacaatggcatatcgctgtttaataaccctgtgccatattgggaggtgcaacccgcaactttccgctgcgtgacggaccgcttggccatccagtttggaaactataagaaatag

SEQ ID NO: 109800 - DNA, 924 bp, Artificial Sequence
  Description of Artificial Sequence: Synthetic coding sequence
atgtgtccctttggatgccattgccatctacgggtggtccagtgtagcgatctcggattgaagtctgttccgaaggagatctcaccagatacaacactgttggacctgcagaacaacgatattagtgaactgcgaaaggatgactttaagggtcttcagcatctgtacgcccttgttctggtaaataataaaattagcaagatacacgaaaaagcattctccccactccgcaaactccagaagttatacatcagcaaaaaccatctcgtggagattcctccaaatcttcctagctccctggtggaattaaggatccatgacaacaggattcggaaagtgcccaagggggtattttccgggctgagaaacatgaattgcattgaaatgggcggaaatccactggaaaatagcggctttgagccgggggctttcgatggcctgaaactcaactacctgcggataagtgaggcaaagttaacagggattcctaaggatctccccgaaaccctcaatgagctccatctggatcataataaaatccaggccatagagctagaagacttgctgagatactcaaagctttaccggctgggactgggccataaccaaatccgaatgatagagaatgggagccttagcttcctccctacattacgagagctccacctagacaataacaaattggctagggtacctagtgggcttcccgatttgaagcttctccaggttgtctatctgcacagcaataatatcaccaaagtcggcgtgaacgacttttgtcccatggggtttggtgtcaaaagggcctattacaacgggatttcgctgtttaataatccagttccatattgggaggttcagcccgcaaccttcagatgcgtgaccgatcggctggcaatccaatttggtaattacaaaaagtag

SEQ ID NO: 109801 - DNA, 924 bp, Artificial Sequence
  Description of Artificial Sequence: Synthetic coding sequence
atgtgtccctttggctgccactgccacctacgagttgtgcagtgttccgacctgggactgaaatcagtgccaaaggagataagtcctgacacaaccctgctcgatctccagaacaacgatatctcagaactgagaaaggatgactttaaaggcctccagcatctctacgcactagttctggtgaataacaaaatcagtaagattcatgaaaaggctttttcgccattaagaaaactgcagaaactctacatttctaaaaaccacctcgtggagatccccccaaacctgcccagtagcctggttgagctgagaatacatgacaatcgcattaggaaagttcccaaaggcgtgttttctggactaaggaatatgaattgcatagaaatgggagggaacccgctcgagaactctggcttcgagccaggagccttcgatggactaaagctgaattacctgaggatcagcgaggctaagctcaccggcattcccaaggacctcccagaaacactaaacgagctccaccttgaccacaacaagatccaggctatcgaattggaagaccttctgagatattccaagctctacaggctaggactcgggcacaatcagatccggatgattgagaacgggtcactgtcgttcttgccgacactaagagaattgcacctggacaacaacaagctggcccgtgtgccaagtggtctcccggatctcaaactgctgcaggtcgtctatctgcacagcaacaacatcactaaggtcggtgtgaacgacttctgtccaatggggtttggagtgaagcgggcttactataatggcatcagcctgtttaacaatccagtgccatattgggaggtccaacccgccacattcaggtgcgtcaccgaccgtcttgcaatccagttcggcaactataagaagtag

SEQ ID NO: 109802 - DNA, 717 bp, Artificial Sequence
  Description of Artificial Sequence: Synthetic coding sequence
atgtggccgctgtggagactggtgtctctgctcgcactgtcccaggctctgccctttgagcagaggggattctgggattttactttggacgacggcccctttatgatgaacgacgaagaggcctccggagccgacacctctggggtcttggatccggacagtgtgaccccaacttacagcgccatgtgcccctttggctgtcattgccacctaagagtcgttcagtgcagtgatctcggtctcaagtccgtaccgaaggaaatcagtcccgacactaccttgttggatctgcaaaacaacgacattagcgagctgcgcaaagatgattttaagggacttcagcatctgtacgtgaggagctgggaagagcctgcagggctgcagcagagggctggggttcgggctctcgtactggtgaataacaagattagtaagatccatgagaaggcctttagccccctgcggaagctgcagaaactttacatatccaagaaccacctcgtcgaaatccctccaaatctcccctccagtcttgtggagctgcgcattcatgacaacaggattcgcaaggtgcctaagggggtattttctggcctgaggaatatgaattgcatcgagatgggtggcaaccccctggaaaattcgggatttgaacccggcgcgtttgacgggttgaaactcaactaccttagaatatcagaagctaagctgacctag

SEQ ID NO: 109803 - DNA, 1257 bp, Artificial Sequence
  Description of Artificial Sequence: Synthetic coding sequence
atgatccagctgactgctactcctgtgtcagccctggtggatgagccagtgcacattagagcaaccgggcttataccttttcagatggtctcattccaggctagtctggaggatgagaacggagacatgttctatagccaagctcactaccgcgcgaatgaatttggcgaggtcgatctgaatcatgcatcctcactggggggggactatatgggagtgcaccctatgggcctgttctggagcctgaagcctgagaaattgctgactcgtctgctgaagagggacgtgatgaaccgccctttccaggtgcaagtgaagctttatgatctggaattgatcgtgaataataaagtggccagtgccccaaaagccagcctcacgcttgagcgttggtacgttgcccctggagtcacacgaatcaaggtacgagagggcaggctccgcggagcacttttcctgccacctggcgagggacttttccctggagtaatcgacctttttggggggttggggggccttttagagtttcgggcctccctgctggccagccgagggtttgccagcctagctctcgcctaccacaactatgaggatctgccacggaagcccgaggtgactgacctcgagtattttgaggaggcagccaattttcttctgcggcacccaaaagttttcggatccggcgtcggtgtagtcagcgtgtgtcagggggtgcagattgggctgtctatggctatctaccttaaacaggtgactgctaccgtgctcatcaacggcacaaacttccccttcggcatcccgcaggtgtaccacggacagatccatcagcctctgccccatagcgcacaactgatcagcactaatgcccttgggctattggaactgtacagaacctttgagacaacccaagtgggtgccagccagtaccttttcccgatcgaggaggcacagggtcaattcctgttcatcgttggggaaggagataaaacaatcaacagtaaggcacatgctgagcaggccatcggccagctgaagcggcatggaaaaaacaactggaccctgctctcctatcccggggccggtcacctgattgagcctccctactctcctttgtgctgcgcctctacaacgcatgatctgcggctacattggggaggcgaggtgatcccccatgccgcggcccaggaacatgcgtggaaggaaatccagcgctttcttcgcaagcacctgattcctgatgtaacctcgcaactttag

SEQ ID NO: 109804 - DNA, 1257 bp, Artificial Sequence
  Description of Artificial Sequence: Synthetic coding sequence
atgattcagctgactgctactcccgtctccgcactcgtagatgaaccagtgcatattagagcaacaggccttatccccttccagatggtgtcctttcaggcaagcctggaggatgagaacggagacatgttctacagccaagcccactatagggctaatgagttcggggaggtggatctgaaccacgcatcaagcctgggtggagattatatgggagtgcaccctatgggtctgttttggtcccttaaacctgaaaagctactgacgcgcctgctgaagagagacgtgatgaacagaccctttcaagtccaggtgaagctctacgatttggagcttattgttaataacaaggtggcttccgcacctaaagcatcattaactctcgagcggtggtacgtagccccaggggtgacaaggattaaggtccgagagggacgactgcgcggggctctttttctgccccctggagagggacttttccccggagttattgatctgtttggagggctggggggcctgctcgaatttagggccagtctgttagcctcacgtggcttcgccagcctggcactggcttatcacaactatgaggatttacctagaaagcctgaggttactgacctcgaatactttgaggaagccgccaacttcttacttagacaccctaaggtgttcggcagcggggtgggggtcgtgtccgtttgtcagggcgtccaaataggtttgagtatggccatctatttgaagcaggtgacagcaactgtgcttatcaatggtacaaattttcctttcgggatcccccaggtgtaccatggacagattcatcaacctctgccacactcagcacagttgattagcaccaacgctctggggctgctggagctttaccgcacctttgagaccacacaggttggcgcatcccagtacctcttccccatagaggaagctcaaggacagtttctgtttatcgtgggcgagggagataagactattaacagcaaggctcacgcagagcaagccatcgggcagctcaaaaggcacggcaagaacaattggacgctgctctcctatccaggtgctggacacttaattgaaccaccatactccccactttgttgtgcctcgaccacacacgatcttcgcttgcattggggcggtgaagttattccccatgctgctgcccaggagcatgcttggaaagagatccaaaggtttcttaggaaacacctaatccctgacgtgacttcacaactctag

SEQ ID NO: 109805 - DNA, 891 bp, Artificial Sequence
  Description of Artificial Sequence: Synthetic coding sequence
atgaacgccgagcccgaacggaagtttggggtcgttgtggtgggcgttggcagggccggcagcgttcggatgagggacctgcgcaacccccacccaagcagtgcttttcttaaccttatcggctttgtgtcaaggcgagaacttggatctatcgatggggtccaacagatctccttggaagacgctttgtcctcacaggaagtggaggtcgcatacatatgttcggagagcagttcccacgaggactatattcgtcagttcctgaacgctggaaagcacgtgttggtagaatacccaatgaccctctccctcgccgctgcacaagaactctgggaactggcggagcaaaagggtaaggtgttacacgaggagcatgttgaactgttaatggaggaatttgccttcctgaaaaaggaagtagtaggcaaagatctcctcaagggctctttactgtttacagccggacccttggaggaagaacgattcggcttccctgccttttccggaatctcaaggctgacctggctggtgtccctctttggagaattgagcctcgtctctgcaactctagaggaacggaaagaagaccagtatatgaagatgactgtgtgcttggagacggaaaagaaaagccctctcagttggatcgaggaaaagggccctggcttaaagcgcaacaggtacctaagcttccactttaaatcgggtagcttagaaaatgtcccaaatgttggagtgaacaagaatatcttcctgaaggaccagaatatctttgtgcaaaagcttctgggacagttctctgagaaggagcttgccgctgagaaaaaacgcattcttcactgcctgggattggccgaagaaatccagaaatattgctgcagccgtaagtag

SEQ ID NO: 109806 - DNA, 891 bp, Artificial Sequence
  Description of Artificial Sequence: Synthetic coding sequence
atgaatgccgagcctgagcggaaattcggggtcgtggtggtgggtgtggggcgtgccggttctgtccggatgagggatctccggaatccccatcccagctctgcctttctgaatctgattggatttgtcagccgccgagagttgggatccatcgacggggttcagcaaatcagtctggaggacgctctgagctctcaagaagtggaagtcgcttatatttgctcagagtcgtcgagccacgaagactacataaggcagttcctgaatgccgggaagcatgtgctggttgaataccctatgacactgagcttagccgccgcccaggagttgtgggagttggccgagcagaaggggaaggtgctgcacgaggagcacgtggagctgcttatggaggaattcgctttccttaaaaaggaagtggtgggcaaggatttgctcaagggatcacttttatttactgccggaccgctggaagaagagcgatttggttttcccgccttctctggtattagtcgactcacatggttagtgtcgctcttcggcgagctctcactggtctctgctacattggaagagaggaaggaggatcaatacatgaagatgaccgtgtgtctggaaacagagaagaaatctccactgagctggatcgaggagaaagggcctggtctgaagcgtaaccgttacctgagcttccactttaagtcgggttcactagagaatgttccgaacgtcggcgttaataagaatatcttcctgaaggaccaaaacatcttcgtgcagaagctcctcggccagttctccgagaaagaactcgccgcagagaagaagaggattttgcactgcctagggttagctgaagagatccagaaatactgctgctctagaaaatag

SEQ ID NO: 109807 - DNA, 309 bp, Artificial Sequence
  Description of Artificial Sequence: Synthetic coding sequence
atgaacgccgagcctgagaggaaattcggcgtggtagtagtgggtgtgggcagggctggctctgtccgtatgcgggacttacgaaatccccacccctccagtgccttcttaaacctgatcggatttgtctccaggcgggaactgggctccattgatggggtgcagcaaattagtttggaagatgcattgtcttcccaggaagtcgaggtagcgtatatctgtagtgagtcctcttctcacgaggactatatcaggcagttcctcaacgcagggaaacatgttttagttgaatatcccatgaccttatag

SEQ ID NO: 109808 - DNA, 621 bp, Artificial Sequence
  Description of Artificial Sequence: Synthetic coding sequence
atggcagtgaaaaagattgcaatctttggggccacggggcagaccggcctgactactcttgctcaagccgtgcaggcagggtacgaggttaccgtgctggttcgggactcaagcagactcccctctgaaggaccacggccagcccatgtggtcgtgggggacgttctgcaggccgcagacgtggacaagactgtagctggacaagatgcagtgatcgttctcctagggacacggaacgaccttagccccaccacagtgatgtccgagggcgctagaaatatcgtggccgcaatgaaggcacacggcgtggacaaggttgtcgcatgcacctctgcgtttctgctgtgggatcccaccaaagttccgcctcggctgcaggcagtgactgacgatcacatacgcatgcacaaggtgctgcgagaatctgggctgaagtacgtggccgtgatgccgccccacataggtgatcagcctttaacaggtgcctacacagttaccctcgatggtaggggacccagcagagttatcagcaaacacgacctgggccactttatgttgcgttgcttgactaccgacgagtacgacggacattctacatatccttcccatcaataccagtag

SEQ ID NO: 109809 - DNA, 399 bp, Artificial Sequence
  Description of Artificial Sequence: Synthetic coding sequence
atggggtccttgatgttgctctttgtggaaaccacccgaaacagcagcgcatgtatatttccggtgatccttaacgaactgagcagcactgtggagaccatcacccacttccccgaggtgactgacggcgagtgcgtcttcccatttcactataaaaacgggacttattatgactgcattaaatctaaggcacggcataaatggtgctccctgaacaaaacttatgaaggatactggaaattctgttcagctgaggatttcgccaattgcgtgtttccgttttggtataggaggctgatatactgggaatgtacagatgacggcgaagcttttggaaagaaatggtgcagcctcaccaagaactttaacaaggaccgcatttggaagtactgcgaatag

SEQ ID NO: 109810 - DNA, 429 bp, Artificial Sequence
  Description of Artificial Sequence: Synthetic coding sequence
atggccgcagccgccgagggcgtcctggctactcgctccgacgagcctgcgagggacgacgcagccgtcgagaccgccgaggaagccaaggagcctgccgaggcagatatcaccgaactgtgtcgcgatatgttctcaaagatggctacatatctgacaggcgagctcacagccacctccgaagactacaagttactcgagaatatgaacaagctgacctctcttaagtacctcgaaatgaaggatatcgcgatcaacatctcgcgaaacttgaaggacctgaaccaaaaatatgcaggtctgcagccctatctggatcaaatcaacgttatagaagaacaagtagccgcattggaacaggctgcttacaagcttgacgcttattctaagaaactcgaagccaagtacaaaaaactggaaaaacgctag

SEQ ID NO: 109811 - DNA, 225 bp, Artificial Sequence
  Description of Artificial Sequence: Synthetic coding sequence
atgaataagctcacctctctgaaatatctcgaaatgaaagatattgccattaatatttcccggaatctcaaggatttaaaccaaaagtatgctggtctacagccctacttggaccaaataaacgtcatagaagagcaggtggccgcgttggaacaggccgcatataagttggacgcatactcgaagaaattagaggcgaagtacaagaagctggaaaagcgatag

SEQ ID NO: 109812 - DNA, 225 bp, Artificial Sequence
  Description of Artificial Sequence: Synthetic coding sequence
atgaacaagcttacttcactcaaatatttggagatgaaagatatcgccataaatatctcgagaaatcttaaggatctgaatcagaaatacgccggactccaaccttatcttgaccaaattaatgttattgaggaacaagtggccgccctcgaacaggccgcctataagttggatgcttactctaagaaacttgaagccaagtacaaaaagttggagaagagatag

SEQ ID NO: 109813 - DNA, 300 bp, Artificial Sequence
  Description of Artificial Sequence: Synthetic coding sequence
atgttcagtaagatggccacctatctaacaggggagcttacggcaacttcggaagattataagttgctcgaaaatatgaataagctgacatccctgaaatatctagagatgaaagacatcgctattaatataagcagaaacctgaaagatttaaaccaaaagtatgcaggactgcagccctacctggatcaaataaacgtgattgaggagcaggtggcagccttggagcaggctgcttacaaactggacgcctactctaaaaagctggaagcgaagtacaaaaagctcgaaaagaggtag

SEQ ID NO: 109814 - DNA, 609 bp, Artificial Sequence
  Description of Artificial Sequence: Synthetic coding sequence
atggcttctcaaggtcgccgacgtcggcctcttaggcgtcctgaaacggtcgtgcccggtgaagcaaccgaaacagatagtgagcggtctgcaagtagctctgaggaagaagaactgtacctgggaccttctggtcctacaaggggacgaccgactgggctgcgagtggctggagaggccgcagaaactgattccgaaccagaacccgagcccgagccgaccgcggcaccgcgcgaccttcctcctcttgtagtgcagagagagtccgctgaggaggcctggggaacagaggaggcccccgctcccgcccccgcccgaagcctgttacagctgagactggcagagagtcaggctaggttagaccatgacgtggctgctgcagtgagcggggtatatagacgcgccggaagagacgtcgccgccctggcgtcccgcctcgctgctgcccaagccgcgggtctcgctgccgctcactcggtgcgcctggcccgcggcgatctgtgtgcactggctgaacgcctagacatagtagccggctgcaggttgctcccagatattcggggagttccgggcacagagccagaaaaagacccagggccaagggcctag

SEQ ID NO: 109815 - DNA, 1632 bp, Artificial Sequence
  Description of Artificial Sequence: Synthetic coding sequence
atggcccatgcccacatacagggcggccggagggcaaaaagtcgatttgttgtgtgtatcatgtccggcgctcggagcaagttggcactgttcttatgcggctgttatgttgttgcgctgggcgctcataccggagaggagagcgtagccgatcatcacgaagccgagtactacgtggctgctgtgtatgagcacccttcaatcctttccctgaatcccctggccttgatatcgaggcaggaagctctggagcttatgaaccagaatctagatatatatgagcaacaggttatgacagccgcacagaaggacgtgcagatcatcgtatttcctgaagatggcatccatggctttaactttacaaggacatccatatacccctttctggatttcatgccatcacctcaggtggttagatggaatccttgccttgaacctcaccgtttcaacgacaccgaggtcttgcaacgactaagctgcatggccattagaggggatatgtttctggtggccaacttaggtactaaagagccttgtcacagctcagaccctcggtgtcccaaagatggtcggtatcagttcaacaccaacgtagtcttctcaaataatggtactctggtggaccgctacagaaagcacaacctctattttgaggcagcgtttgatgttccacttaaagtcgacttaattacatttgacaccccctttgccggccgatttggtattttcacctgtttcgacatcctatttttcgatcccgctatacgggtgctgcgtgactataaggttaagcacgtcgtgtatccgaccgcttggatgaaccagcttccattgcttgccgccatagaaatccagaaggcctttgcagtggcattcggcattaacgtcctcgctgcaaacgtgcatcatcccgtgctgggcatgaccggttcagggattcacacacctttggagagcttctggtatcatgacatggagaaccccaaatctcaccttattatcgcacaagtggcgaaaaatcctgtaggactcatcggcgccgagaatgccacaggagaaactgaccccagtcacagcaaatttttgaagattttgtcgggagacccatactgtgaaaaggatgcccaggaagtccactgtgatgaggcaactaagtggaatgttaacgcccctccaactttccacagtgaaatgatgtacgataatttcacactcgtcccggtctgggggaaggagggatacctccatgtgtgtagtaacgggctctgttgctacctcctgtacgaacgaccaactctttctaaagagctctacgccctcggtgtgtttgatggtttacacacagtccacgggacctactatatacaggtgtgcgcattagtgagatgcggcggcctggggttcgacacttgtggacaagaaatcacggaagccaccgggatcttcgagttccacctctggggtaacttttccacgtcttatatcttccctctcttcctgacctcggggatgaccctggaggtcccagatcagctcggatgggagaatgaccactacttcctgagaaaatctcgcctgtcatccggccttgttacggcggccctgtatggcagactttacgagcgtgattag

SEQ ID NO: 109816 - DNA, 1572 bp, Artificial Sequence
  Description of Artificial Sequence: Synthetic coding sequence
atgtctggcgctcggtctaagcttgccctgttcctgtgtggatgctacgtcgtggcacttggagcacacaccggcgaggaatctgtggcggaccaccatgaagccgagtactacgtcgccgctgtgtacgagcaccctagcatcctgtccttgaaccctttggctcttatcagcaggcaagaggcactcgaactgatgaaccaaaatctggacatctatgagcagcaggtgatgactgcagcacagaaggatgtgcaaatcattgtgttccccgaggacggaatccatggattcaacttcactcggacatcaatctatccctttctggacttcatgccctcgcctcaagtggtcagatggaatccatgtctcgagcctcacagattcaacgacacagaagtgctacagaggctgagctgcatggccattaggggcgacatgtttctcgtagcgaatttaggcaccaaagagccttgtcactcgtcagatccaaggtgcccaaaagatggcagatatcaatttaatactaatgttgttttctcaaataatgggaccttagtcgatagataccggaaacataatctctactttgaggctgcctttgacgtgcccctcaaggtggacttgattaccttcgacactcctttcgctggccgattcggaatctttacctgcttcgacatattgtttttcgatccagctattagagtcctgcgcgactacaaagtaaagcatgttgtctatccgacagcttggatgaaccagctccccctgctggccgcgattgagatccagaaggccttcgccgtagccttcggcatcaacgttttagcggccaatgtgcatcatccagtgctcggaatgactgggagtggaatccacactcctctggaatcattctggtatcacgatatggaaaatcccaagagccacctaataatcgcacaggtcgccaagaacccagtagggctgatcggcgctgaaaatgccacgggagagacagacccttcccatagcaagttcctgaagatcttatctggcgacccttattgcgaaaaagacgctcaggaggtgcactgcgacgaggcaactaagtggaacgttaatgctccccctacttttcactccgaaatgatgtatgataatttcactctggtgccagtgtggggcaaggaggggtatctgcacgtctgtagtaatggcctctgctgttatcttctctacgaacggcctaccctcagcaaggagctctacgcattgggtgtgttcgacggtctacacactgtccatgggacctactatattcaggtatgtgcactggttcgatgtggcggcctggggtttgacacctgcggccaggagatcacagaggccaccgggatcttcgagttccacttgtggggcaacttcagcacctcttatattttcccgctctttttgacatccgggatgaccctggaggtgcctgatcagctcgggtgggagaatgatcactacttcctgcggaagagcaggctgtcctccggactggtcacagctgccctttacgggcggctctatgaacgcgattag

SEQ ID NO: 109817 - DNA, 1638 bp, Artificial Sequence
  Description of Artificial Sequence: Synthetic coding sequence
atggcaagaaaggaaactcagttgattatcaagatgaatcatctggcccggtttgtggtctgcatcatgtcaggtgcacgtagcaaactagcccttttcttgtgtggctgttatgtggtggcactaggagcgcacactggggaggagtcagttgcagaccaccatgaggcggagtactacgtagccgccgtgtacgaacatccgtccattctctcactaaatcctttggccctgatctccagacaggaagcgctggagctgatgaatcagaacctcgatatttacgagcagcaggtaatgactgcagctcagaaggacgtgcaaattatcgtgttccccgaagatggaatccacggatttaattttacaagaaccagcatctatccctttcttgattttatgccctctcctcaggtcgtaagatggaacccatgccttgagccccacagatttaacgacactgaggtgttgcagaggctgtcttgtatggccattcgcggggatatgttcctggttgcaaacctgggcaccaaagagccttgccactctagcgatccccgttgtccgaaagacggccgttatcagtttaatactaacgtggtctttagcaataacgggacgcttgttgaccgatacagaaagcacaatctgtacttcgaagcagcctttgatgtgccactgaaagtggatctgatcacttttgataccccgttcgccggacgatttggaatcttcacctgcttcgatatcttgttttttgacccagcgattcgtgtgttacgggattataaagtgaaacacgtggtttaccccacagcttggatgaaccaactgcccctgttggctgccatcgagattcagaaagctttcgccgttgctttcgggatcaacgttctcgcagccaacgttcaccaccccgtgttgggcatgaccggtagtggaattcacactcctttagagagcttctggtaccacgatatggagaaccctaaatcacacctgattatcgcacaggttgccaaaaatcccgtgggactcatcggagccgaaaacgccacaggcgaaactgatcccagtcacagcaaattcttgaagatcttgtccggtgatccatactgtgaaaaagatgcccaggaggtgcattgcgacgaagccaccaagtggaacgtaaatgcaccaccaactttccactctgaaatgatgtacgataacttcaccctcgtaccagtctggggtaaggaaggttacttgcacgtgtgctccaatggcttgtgctgttacctgctgtatgaacggccaacgctttcaaaagagttatacgctctaggcgtgttcgacggcctgcacacagtgcacggcacctactacatacaagtctgtgccctggtacggtgcggggggctgggctttgatacgtgtggccaggaaatcaccgaagccacgggcattttcgaattccacctttggggtaatttctcaacttcctatatttttcctctatttctgacgagcggcatgacattggaggttcctgaccagttggggtgggagaatgaccattatttcctgaggaaatcccgactcagcagtgggctggttacagctgccctttacggtaggctgtacgaaagagactag

SEQ ID NO: 109818 - DNA, 1638 bp, Artificial Sequence
  Description of Artificial Sequence: Synthetic coding sequence
atgcccgagggcggcggaacttcccgcaggttgctgcctatgcagtctcgattcgtcgtgtgcatcatgtcaggggcaaggtctaaattagccctttttttgtgcggctgttacgttgtagcactcggcgcccacactggcgaggaatccgtggccgaccaccatgaagcggagtattatgtggccgcggtgtatgagcaccctagtatactgtctctgaaccccctggccctgattagccgtcaagaagccctcgagctgatgaatcagaatctggatatctacgagcaacaggtgatgactgctgcccaaaaagatgttcagataattgtgtttcccgaagacgggatacacggatttaatttcacaaggacctctatctaccccttcttggactttatgccctctcctcaagtcgtgcgatggaacccgtgcctggaaccccatcgctttaacgacacagaggtactccagcggctgagctgcatggccattcgtggtgatatgttcctcgttgccaacctcggaactaaggagccttgccactcatctgatccacgctgcccaaaggacggcagatatcagttcaacacaaacgtggtttttagcaataacgggaccctagttgaccgatataggaaacataacctgtactttgaggccgctttcgatgtaccactgaaggtggatctcattactttcgataccccttttgccggccgattcggcattttcacctgtttcgacattcttttttttgaccccgcaattagggtgctccgcgattacaaggtcaagcatgtggtctatccgaccgcatggatgaatcaattacccctactcgccgctatcgaaattcagaaagcctttgccgtcgccttcgggattaacgtgctggctgcaaatgtgcaccaccccgtgctggggatgaccggatcaggcatccacactcccctagagtccttttggtatcatgatatggagaaccccaagagccacctcataatcgcccaggtcgccaaaaatccagtggggctgatcggcgctgagaatgccaccggcgagactgacccttcccatagtaagttcctgaagattctcagcggcgacccatattgtgagaaagatgcccaggaggtgcattgtgatgaggctacaaagtggaacgtaaacgctccacccacgttccacagtgagatgatgtatgataatttcacgctggtcccagtatggggaaaagaaggctacctccatgtctgctccaacgggctgtgttgctacctgttatacgagagacccacactgtccaaggagttgtacgctctgggtgtcttcgatgggctgcataccgtacatggaacatattatatacaagtgtgcgcccttgttaggtgtgggggcctgggcttcgacacctgcgggcaggaaattactgaggccacaggcatctttgagtttcatttgtggggaaacttttcgacctcttacattttccctctcttcctgaccagcggcatgaccctggaggtgcccgaccaacttggctgggaaaacgatcactatttcctgcgcaagtcacggctttcctcaggcctcgtgactgctgccttgtatggtcgcctgtacgaaagagactag

SEQ ID NO: 109819 - DNA, 585 bp, Artificial Sequence
  Description of Artificial Sequence: Synthetic coding sequence
atgcccaggaatctcctttactcattgctgtccagccatctgtcccctcatttctctacttctgtgaccagcgcaaaggtagctgttaacggtgtgcagctccactatcagcagactggcgagggtgatcacgcagtactcctattgccaggaatgctgggctctggcgagactgacttcggcccccagctgaagaatcttaacaaaaaactcttcaccgtggtcgcttgggatcccaggggatacggccacagccgtcccccggacagggatttccctgcggattttttcgagcgagatgctaaagacgccgtggatctgatgaaggcactgaagtttaaaaaagtctccctgctcggctggagcgacggcggtatcacagctctcatcgccgcagccaaatatccttcctatattcataagatggttatctggggcgcaaacgcttacgttaccgatgaggactccatgatttatgaggggatcagagatgttagcaaatggtcggaaagaacccgaaagccgctcgaggcattatatggttggtccctaaccctgtcgcctggttggaatgctatggcctag

SEQ ID NO: 109820 - DNA, 825 bp, Artificial Sequence
  Description of Artificial Sequence: Synthetic coding sequence
atgccccgcaatctactgtatagtctgttaagcagtcaccttagcccacatttttcaacgagcgttaccagcgctaaggtggccgtcaatggagtgcagctgcactaccagcagactggcgagggagaccacgctgtgctacttttgcctggaatgctcggatcaggcgaaacagattttgggccccagcttaaaaatttgaataagaaactgttcacagtagtggcctgggatccacgaggatacggtcacagccggccccctgatagggactttcccgctgatttctttgagagagatgcgaaggacgccgtggacctcatgaaagccctgaagttcaagaaagtaagccttctgggctggtctgacgggggaattactgctctcatagcagcggctaagtaccccagttatatccataagatggtgatttggggagcaaatgcttacgtaaccgacgaggatagtatgatctatgaggggattcgagacgtttctaagtggagcgaacgcacccgcaaacctctagaagcattgtacggctacgactattttgcaaggacatgcgagaagtgggttgacggcatccgacagttcaagcacctccccgatggaaatatctgtaggcatttgctgcctcgggtacagtgtcccgccttgatcgtgcatggagagaaggacccattagtgcccaggttccacgccgatttcatccacaagcatgtcaaagggagtcgacttcatcttatgcccgaaggaaagcataatctccacctgaggtttgccgatgaatttaataaattagctgaggacttcctgcaatag

SEQ ID NO: 109821 - DNA, 876 bp, Artificial Sequence
  Description of Artificial Sequence: Synthetic coding sequence
atggtcgccgtgctggggggcaggggtgttctgcggttgcgccttttactgtccgcccttaaaccaggaatccacgtgcctcgagccggccccgcagcagctttcggaacctcagtaacttctgccaaagtggccgttaatggagtgcaactccattatcaacagacaggtgagggggaccatgccgtgctgctactacctggtatgctcggatccggagagacggacttcggcccacagttaaagaatttgaacaaaaaattgttcaccgtagtggcttgggacccccgcggttatggtcacagccgaccaccagatagagacttccccgccgattttttcgaacgcgacgccaaagacgcggtggacttgatgaaggcactgaagttcaaaaaagtcagcctcctgggttggtcagacggcggcatcacggccctgattgccgctgctaagtatcctagttatatccataagatggtgatttggggggctaatgcatatgttacagatgaagactcaatgatctacgagggaatccgcgatgtctcaaaatggtctgagagaacaagaaaaccattggaagccctgtatgggtatgactacttcgcacgcacatgtgaaaagtgggtcgacggaattcgacagtttaagcatttacctgatggcaatatctgccggcacctgctccctcgagttcaatgcccagctctgatcgtgcacggcgagaaagatccactggtgccaagattccacgccgacttcatacacaaacatgtgaaggggtcgagattacacctgatgccagaggggaaacacaatctgcacctgaggtttgccgacgagttcaataaactggccgaagactttctccagtag

SEQ ID NO: 109822 - DNA, 264 bp, Artificial Sequence
  Description of Artificial Sequence: Synthetic coding sequence
atgtattgcctccagtggctgttaccagttctcctaatcccaaaaccacttaatccagctctgtggttctctcattcgatgttcatgggcttttacctgctctccttcttactcgaacgaaaaccgtgtactatttgcgcgcttgtatttctggcggccctatttctgatttgctactcttgttgggggaactgctttctttaccattgctccgactcgcccctgccagagtcagcacatgaccccggagtggttgggacatag

SEQ ID NO: 109823 - DNA, 264 bp, Artificial Sequence
  Description of Artificial Sequence: Synthetic coding sequence
atgtactgcctgcaatggttgttgccagtgctgctgatccccaagcccctgaaccccgccttgtggttcagccattcgatgtttatggggttttacctcctcagcttcttgttagaaaggaagccctgtaccatttgcgcattagtatttcttgctgccctgttccttatctgttacagctgttgggggaactgcttcctataccattgcagcgactcaccgctcccagaatccgcccacgaccctggggtggtcggaacgtag

SEQ ID NO: 109824 - DNA, 264 bp, Artificial Sequence
  Description of Artificial Sequence: Synthetic coding sequence
atgtattgcctgcaatggctgctgccggtgctcctcattcctaagcccttaaaccctgcattgtggttttcacactctatgtttatggggttttatctgctcagctttctgctggaacgcaaaccctgcaccatttgcgcactagtgttcttagcggcgctcttcctaatctgttattcctgttgggggaattgctttctttaccactgctcggattctcccttgcctgaatcagctcatgatcccggcgtcgtcggcacatag

SEQ ID NO: 109825 - DNA, 264 bp, Artificial Sequence
  Description of Artificial Sequence: Synthetic coding sequence
atgtattgccttcagtggttgttgccggtactccttataccaaagccccttaaccccgccttgtggttcagccactcaatgtttatggggttctacctgctcagcttcctgctggaaaggaaaccttgcaccatttgcgctcttgtgtttttggctgccctgttcctgatatgctattcctgctggggcaattgttttctgtaccattgctccgattcccccctgcctgagagcgcccacgacccgggtgtcgtgggcacatag

SEQ ID NO: 109826 - DNA, 264 bp, Artificial Sequence
  Description of Artificial Sequence: Synthetic coding sequence
atgtactgcctacagtggctgttaccggtgttactgatcccaaagccactcaatcccgccctgtggttttcccacagtatgttcatgggattctatctcctgtcatttttactggaacgcaagccatgtactatttgcgcacttgtgttcctggccgcactgttcctaatctgttacagctgctggggcaattgcttcctgtatcattgttctgactcacccttgcccgagtcagctcatgaccctggagtggtggggacatag

SEQ ID NO: 109827 - DNA, 189 bp, Artificial Sequence
  Description of Artificial Sequence: Synthetic coding sequence
atgtattgcctacagtggctgctgcccgtgcttctcatccctaaaccactgaaccctgccttgtggtttagtcactcaatgtttatgggcttctatcttttgagctttctccttgagcgaaaaccgtgcactatctgtgccctcgttttccttgcagcattgtttctaatctgttactcttgttggtag

SEQ ID NO: 109828 - DNA, 264 bp, Artificial Sequence
  Description of Artificial Sequence: Synthetic coding sequence
atgtactgcctgcagtggctgttaccagtcctgctcattccgaaacccctgaaccccgctctatggttttcccattccatgtttatgggtttctacctgctgagcttcctgttggaaagaaaaccatgtactatctgcgccctcgtctttctggccgccctcttccttatctgttacagctgctggggtaactgctttctctatcactgttctgactctccactgccagagagtgcccacgacccgggggtggtcggaacctag

SEQ ID NO: 109829 - DNA, 264 bp, Artificial Sequence
  Description of Artificial Sequence: Synthetic coding sequence
atgtactgcttgcagtggctactccctgtcctgctgattcccaagcccctcaatccagcgctgtggttctctcattccatgttcatggggttctaccttctctcgtttctacttgagcgaaaaccatgcacaatttgcgcattggtcttcctagcagctttgttcctgatctgttatagttgctggggaaattgcttcttgtatcactgttccgattctccgctgccagagagtgcacatgaccccggcgtggtcggtacatag

SEQ ID NO: 109830 - DNA, 237 bp, Artificial Sequence
  Description of Artificial Sequence: Synthetic coding sequence
atgtactgtcttcaatggctcctgcccgtgttgttaattcctaaacccctgaacccggccctgtggttctcacactccatgttcatgggtttttatttgctgtctttccttctggagcgaaagccatgtactatttgcgccctggtgttcctcgctgctctgttcttgatctgctattcctgttggggaaactgttttttataccattgtagcgattcaccactcccagagagctag

SEQ ID NO: 109831 - DNA, 24 bp, Artificial Sequence
  Description of Artificial Sequence: Synthetic coding sequence
atgtactgcttgcagtggctgtag

SEQ ID NO: 109832 - DNA, 1368 bp, Artificial Sequence
  Description of Artificial Sequence: Synthetic coding sequence
atgtcaagctccggcttaaacagcgaaaaggtggccgcacttatacagaagctgaacagcgaccctcagttcgttttagcccagaatgttgggacgacccatgacttgcttgacatttgtttgaagagggctaccgtgcagcgtgcacaacacgtgtttcagcacgcggtccctcaagaggggaaacctatcaccaatcagaagtcatctgggcggtgctggattttcagttgtctgaatgtcatgcggctcccatttatgaaaaagttaaatattgaggagtttgagttttctcagagctacttgttcttctgggataaggtcgaacgctgctatttcttcctaagtgctttcgtggatactgcacagcgcaaggaacccgaggacggaagacttgttcagttcttactcatgaatcctgctaacgacggtggtcagtgggatatgctggttaatattgtggaaaagtacggggttatccctaagaagtgtttccccgaatcctataccactgaggctacgaggcggatgaacgatattttaaatcataagatgcgggaattctgcatccggcttaggaacctcgttcactctggcgcaaccaagggcgagattagtgccacccaagatgtgatgatggaggaaattttccgcgtggtttgcatatgcctgggcaaccccccagagacttttacgtgggaatacagagataaagacaaaaactaccaaaagatcgggccgataactcctttagaattctaccgcgaacacgtgaagccacttttcaatatggaggacaagatttgcctagtgaacgatcctcgtccccagcataagtacaataagctctatacagtcgagtatctgagtaacatggtcggaggaagaaaaacactctacaacaaccagccaatcgattttctcaagaagatggtggccgcctctatcaaggacggcgaggcagtatggtttggatgtgatgttggaaagcacttcaacagtaaactcggtctttccgacatgaatctctacgaccacgagttggtcttcggagtgtcactgaaaaacatgaataaagctgagcggctcactttcggggagagccttatgactcacgcgatgaccttcacggctgtttctgaaaaggatgatcaggacggagccttcaccaagtggagagtcgaaaattcctggggtgaagaccacggccataaagggtacctctgtatgaccgatgagtggtttagcgaatacgtgtacgaggtggtagttgacaggaagcacgtgccagaagaggtgttagccgtgttggagcaggaacccataatattacctgcttgggatcctatgggtgccctggctgaatag

SEQ ID NO: 109833 - DNA, 1107 bp, Artificial Sequence
  Description of Artificial Sequence: Synthetic coding sequence
atgtgcagctctacaccatgccctagacgggcttcccagagccccacccgacgtgcacaagtcgaacggtgttatttttttctctcagcctttgtagacactgcccagcgaaaggagcctgaggacgggaggctggtgcagttcctattaatgaatcccgcaaatgacggcggccagtgggatatgttggtgaatatcgtcgaaaaatatggcgtaatcccaaaaaaatgcttccctgagagttacacaacggaggccacacgccggatgaacgatattctcaaccacaagatgcgggaattttgcattcggctcagaaacctcgtccactccggggccaccaagggagagataagcgcaactcaagatgttatgatggaagaaattttccgggtcgtctgtatttgcctcggaaaccctcctgaaaccttcacttgggaatatagggacaaggacaagaactaccaaaaaatcggacctatcacccccctggaattctatcgcgagcacgtgaaacctttgttcaacatggaagataagatttgtttagtgaacgaccccagaccccaacacaaatataataagctgtacaccgtggagtacctctctaatatggtaggtggtcggaaaaccctttataacaatcaacccattgactttctgaaaaaaatggtcgcagcgagcatcaaagacggggaagcagtctggttcggttgcgatgtgggcaaacacttcaattctaagctcggcctctccgatatgaatctctatgaccacgagctagtttttggcgtgtccctgaaaaatatgaacaaggccgaacggcttacattcggtgagagcctaatgacgcacgccatgacatttaccgccgttagcgagaaagatgatcaagatggagccttcaccaagtggagggtggaaaacagttggggagaggatcacggccacaagggttacttgtgtatgaccgacgagtggttttccgagtacgtgtacgaagtggtcgtagaccggaagcacgttccggaggaagtacttgcagtcttagagcaagagccaattattttgccagcatgggacccgatgggtgctctcgccgagtag

SEQ ID NO: 109834 - DNA, 2241 bp, Artificial Sequence
  Description of Artificial Sequence: Synthetic coding sequence
atggcaggatcaagaggtgctggtagaactgctgcccccagtgttagaccagagaagagaaggtcagaaccagaactggaaccggagccagaaccagagccccctctcctctgtacttctcctctgtcacactccaccggctccgactctggggtctcagactctgaagagagcgtgttttctggattggaagactccggttccgacagcagtgaggacgacgatgagggcgacgaagagggggaagacggcgcgctggacgatgagggccactctggtatcaagaagacgactgaagaacaggtacaagccagcactccatgtcccagaacagagatggcgtccgcccgcatcggagatgaatatgcggaggatagctctgatgaagaagacatcagaaacactgtaggaaacgtcccccttgagtggtatgacgattttccacatgtcggctacgatttagatgggcggcggatctacaaacccctccgcacgagagatgaattggaccaattcctcgataagatggacgatcctgattactggaggactgttcaggaccctatgaccggccgggatctgcgcctcaccgatgaacaagtggccctggtgagaaggctgcaaagcggccaattcggtgacgttggtttcaacccctatgaacccgccgtagattttttttccggagatgtaatgatacacccagtgacaaataggcctgcagataagcgcagtttcatcccaagtctggtcgagaaagagaaggtcagtcggatggtccatgctatcaagatggggtggatacagccaaggcgcccccgggaccccacgcccagtttttatgatctgtgggcacaggaagacccaaacgctgttcttggcagacacaagatgcacgtgcccgcaccaaaacttgcactgcccgggcatgcggagagttataacccccctcccgagtatctgctttctgaagaagaaagactggcctgggagcagcaagagcctggagaaagaaagctgagctttctccccagaaaatttcctagcctccgcgcagtgccagcgtacggcagattcattcaggagcggtttgaacgctgcttggatctgtacttatgcccccggcaaaggaagatgagggtcaatgtcgaccctgaggatctgatcccaaagttgcctaggccaagggacctgcagcccttcccaacgtgtcaggctttggtttaccgcggacatagtgacttggtccgctgcttgagtgtctcacctggcggacaatggttggtctctgggagcgatgacggctcccttcggctttgggaggtcgcgacagcccgttgcgttaggacagtccccgtcggcggtgtcgtgaagtctgtcgcttggaacccctcccccgccgtttgtctcgtcgcggctgctgtggaggatagcgtcctgctccttaatccggcactgggcgatcgcctcgtcgctgggtccaccgatcagttactgagcgccttcgtgccacccgaagaaccgccactgcagccggccaggtggctcgaagcttctgaggaggaacgacaggtaggtctgcgcttgaggatctgtcacggcaagcccgtgacccaggtgacctggcacggacgcggggattatttggccgtggtgttggcgacccagggtcatactcaggtacttatccaccagctgtctcgccggagaagccaatcacctttcaggagaagtcatggacaggtacagagggtggcttttcatcctgcacgacctttcttactcgtcgcaagccaacgctcagttcggttgtaccacttgttacgccaggaactgactaagaagctgatgccaaattgcaagtgggtgagcagcttagctgtgcacccggccggcgacaatgtgatctgtggttcatacgactcgaagctcgtgtggttcgacctggatctctctaccaagccgtatcgcatgctgcggcaccataagaaagctctgagagcagtagcttttcatcccaggtatcccctgttcgctagcggttccgacgacggctctgtgatagtgtgtcacggtatggtctacaacgatctcttacagaatcccctgcttgtgccggtgaaagtgctgaaagggcacgttttgaccagagatctgggggtcttggatgtgatcttccatcctactcagccctgggtctttagcagcggtgccgatggaaccgtccggctgtttacatag

SEQ ID NO: 109835 - DNA, 1083 bp, Artificial Sequence
  Description of Artificial Sequence: Synthetic coding sequence
atgaattacactgagtcaagccccctaagagagtcgacagccattggtttcacaccggagctcgagtcgattattcccgtgccctctaataagaccacatgcgagaattggcgggaaatccaccacttggtttttcatgtagcaaatatctgcttcgcagttggcttagtgattcctaccaccctgcacctgcatatgatttttctcagagggatgctgaccctggggtgtaccctctacatcgtctgggctacattgtaccgttgcgcactcgatattatgatctggaacagtgtgtttctcggagtcaatatcttacacctgtcctatctgctgtacaaaaaacggcctgtgaaaatagaaaaagaactgtccggaatgtatcgtcgactgttcgagcctttgagagtccctcctgatttgtttcgcaggcttactggccagttctgcatgatccagaccttaaaaaagggccagacttacgctgcggaggataaaaccagcgtcgacgaccggttgtcgattcttttaaaagggaagatgaaggtgagttatcgcggccacttcctccataacatttatccctgtgcattcattgacagtcccgagttccgatccacgcagatgcataaaggggagaaatttcaagtcactataatcgctgacgacaattgtaggtttctatgttggtccagagaacgtctcacttattttctcgaatcagaaccattcctgtatgagatctttagatacctcataggaaaggatatcacaaataaattatattctcttaacgatccaacactcaatgacaagaaggcgaagaaactcgaacatcagcttagtctgtgcacccagatctccatgcttgaaatgagaaactcaatcgcttcctcttccgatagtgacgacggcttgcatcagttcctaagaggcacctcaagtatgtcatcccttcacgtgagttccccccaccagcgagctagcgccaagatgaaacccattgaggagggggccgaggatgatgacgacgtcttcgagccagcctctccaaataccctcaaagtacatcagctgccgtag

SEQ ID NO: 109836 - DNA, 1083 bp, Artificial Sequence
  Description of Artificial Sequence: Synthetic coding sequence
atgaactacaccgagtcctctccacttcgggaaagcactgctattggctttaccccggagcttgagtccatcattcccgtgcctagtaacaaaactacttgcgagaactggcgggaaattcaccatcttgtgttccacgtggccaatatttgcttcgcagtaggactggtcatccctacaacccttcatctgcacatgatcttcctgcgcgggatgctgaccttgggctgtaccctatacatcgtgtgggccacgttgtaccggtgcgctttggatattatgatctggaactcggtgtttctgggagtcaacatccttcacctttcctacctgctctataaaaaaaggccggtcaagatcgaaaaggagctgtccgggatgtacaggagactttttgaacctctgagggtccccccagacttatttagacgtcttaccgggcagttctgcatgattcagacactgaagaaaggtcagacctatgcggcagaggacaagacttccgtggatgacaggctgagtatcctgctgaagggcaaaatgaaggtctcttacagaggtcacttccttcacaatatctacccttgcgcattcatcgattcccctgagtttagatctacccagatgcacaagggcgagaaattccaggttactattatagctgacgataactgcaggttcctctgctggtctagagagcggcttacgtatttcctcgagtcagagccatttttgtacgagatttttaggtacttgattggcaaggacattacaaataaactctattccctgaacgatccgacgctgaacgacaagaaagcgaaaaagctggagcaccagctgtctctgtgcacgcaaatctcaatgttggagatgcgaaattccatagctagttcctcagactccgatgacggcttgcatcaatttctcaggggaaccagcagtatgagctccttgcacgtctcctctccccatcagcgagcctccgcaaagatgaaacccatcgaagagggggccgaggatgatgacgatgtcttcgagcccgctagccccaacacactgaaggtgcaccagctcccttag

SEQ ID NO: 109837 - DNA, 1083 bp, Artificial Sequence
  Description of Artificial Sequence: Synthetic coding sequence
atgaattacaccgagtcatcccccctacgggagtctactgccattggctttacccctgagttggagtcgatcatccccgtaccttccaacaagactacttgtgagaactggagggagatccaccacctcgttttccacgtggctaatatctgctttgccgtcggtctagtaatcccgaccacgctacacctacatatgatattcctgcgaggcatgcttacacttggatgtacgctgtatattgtgtgggctactctgtataggtgcgcattagacatcatgatttggaatagcgtattcctgggagtgaacattctgcacctgagctatctcttatataagaaaaggcctgttaaaatcgagaaggagttgtctgggatgtaccggcgcctatttgaacccctgcgcgtgccccctgacctgttcagaaggctaacaggacagttttgtatgattcagactttaaagaaaggacagacctatgccgctgaagacaaaacctccgtggacgatcgactctccatcctgctcaaagggaagatgaaggtctcctatcgagggcacttcttacataacatctatccatgtgcattcattgatagcccggagtttagatcaacccagatgcacaagggcgagaaatttcaggtgaccataattgcagacgataattgtaggttcctgtgttggtcacgagagaggctgacgtacttcctggagagcgagccctttttgtacgaaattttccgatatttgatcgggaaagacatcaccaataaactgtattctctgaatgatccaacgctaaatgacaaaaaggccaagaaactggagcaccagctgtcactgtgcacccagatctcaatgctggagatgaggaactcaattgcaagctctagcgattcagacgacggcctgcaccagtttcttcggggcacctctagcatgtcttctcttcacgtgtcttcaccccaccaaagagcgtctgcaaaaatgaagccaatcgaggaaggggcagaggatgacgatgacgtgtttgaaccagcctcccccaatacactcaaagttcaccaactgccatag

SEQ ID NO: 109838 - DNA, 783 bp, Artificial Sequence
  Description of Artificial Sequence: Synthetic coding sequence
atggaccgtcactcgtcgtacattttcatttggttacagttagaactctgcgctatggccgtactcctaacaaaaggagaaatccgctgctactgcgatgccgcacactgcgtcgcgaccggttatatgtgcaagtcagagttgagcgcatgcttttcaaggctcctcgatcctcagaattcgaattcacctctgacccatgggtgcctggacagcctggccagtacgacagacatctgtcaggctaagcaggcaaggaaccacagtggcacaacgattccaacccttgaatgttgtcacgaagatatgtgcaactacaggggtctacatgacgtgctttcccctccgagaggtgaagcttccggacagggaaatcgctaccagcatgatgggtctaggaatctgataactaaggtgcaagagttaacatcctctaaggaactgtggtttcgcgctgccgtgattgccgttcccatagctggagggttaatcctggtgttactgattatgcttgctcttcgcatgctcagatctgagaacaaacgcctgcaagatcagcggcagcaaatgctctctcggctccattactcctttcacgggcaccactctaagaaggggcaggtggctaagctcgatctggagtgcatggttccagtgtctggccatgaaaactgctgccttacttgtgacaagatgaggcaggcagacctgtccaacgataagattctgagcttggtgcactggggaatgtattctggccacgggaagttggaatttgtgtag

SEQ ID NO: 109839 - DNA, 744 bp, Artificial Sequence
  Description of Artificial Sequence: Synthetic coding sequence
atggatcgacatagctcctacatctttatttggctccaacttgaactgtgcgccatggccgtcctccttaccaagggggagatcaggtgttattgcgacgctgcgcactgcgttgcgactggctacatgtgcaaaagtgagctgtcagcatgcttcagccgcctgcttgatccacagaactctaattcacctcatatatgtcaagcaaaacaggcccgtaaccactctggaacaacaattccaaccctggaatgctgtcacgaagacatgtgcaattatagaggactgcatgacgtgttgtcgcctccaaggggcgaggcttctggccaggggaaccgctaccagcacgacggcagcaggaacctgatcaccaaagtgcaggagttaacctcaagcaaggagctgtggttccgagcagccgtgattgccgtgcctatcgcaggcgggctgatactggtgctcctcatcatgcttgccctccgtatgctgcggtctgagaacaagcgcctacaggaccaacggcagcagatgctttccaggttgcactacagctttcacggacaccatagtaagaaaggccaggtggctaaattagatttggaatgtatggtgcctgtttctgggcacgaaaattgctgcctcacttgtgacaagatgcgtcaagccgacctatctaatgataaaatcctgagccttgtgcattggggcatgtattccggccatgggaaactagagtttgtgtag

SEQ ID NO: 109840 - DNA, 2058 bp, Artificial Sequence
  Description of Artificial Sequence: Synthetic coding sequence
atgctgtggttctctggagtcggcgctctggccgaaaggtactgccgtagatcccctggtattacctgctgcgttctgctactgctcaattgcagcggcgtccctatgagcctggcctcttcttttctgaccggctcggtggctaaatgtgagaacgagggcgaagtcctgcagatccctttcattacagacaacccttgcatcatgtgcgtgtgcctcaataaggaggttacatgcaaaagggaaaaatgtcctgtgctgtccagagattgcgctctcgcgatcaagcagaggggggcctgctgcgagcagtgcaagggttgtacttatgaggggaatacctataattctagctttaagtggcagtctcctgcggaaccctgcgtattgcggcagtgccaggaaggcgtggtgaccgaaagcggcgttcgctgcgtcgtgcactgcaaaaacccattagagcacctggggatgtgctgcccaacatgccccggatgtgtctttgagggggtgcagtaccaggaaggcgaggaattccagcctgagggctccaagtgcacaaagtgttcttgtacgggaggtaggacccagtgcgtacgcgaggtctgtcccatcctgtcatgcccccagcacctctcacatattcctcccggccagtgctgtcctaagtgcctgggccagagaaaggtgttcgatctgccatttggttcttgtctattccgcagtgacgtgtacgacaatggaagctcgttcttgtacgacaattgcactgcctgcacttgccgtgactctaccgtggtttgtaagcgcaaatgctctcatcccggggggtgcgatcaaggacaggaggggtgttgcgaggaatgcttgctacgagtgccccctgaagacatcaaggtgtgcaagttcggaaataaaatatttcaggacggcgaaatgtggagtagcatcaattgcacaatttgtgcctgcgtaaaggggcgtacagaatgtcgaaataagcaatgtattcccatcagcagctgcccacaaggaaaaattctaaatagaaaaggctgctgtcctatctgcacggagaaaccgggcgtttgcactgtgtttggagacccacactataacactttcgacgggcggacatttaattttcaggggacctgccagtatgttctcaccaaggattgctcatcgcctgcgtccccttttcaggttctggtgaaaaacgatgcaagaaggactcgatctttttcttggactaaatctgtggagctggtgcttggtgaatctcgagtctcgttgcagcagcacttgacagtgcgctggaatggcagccggattgccttaccatgccgggcccctcatttccatatagatctcgacgggtatctgcttaaggtcaccaccaaggccggcctggagatatcttgggatggtgatagctttgtggaagttatggcagcgccacacctcaagggaaagttgtgcggtctctgcgggaactacaacggccacaaaagagacgacttgattggcggagacggaaattttaaattcgacgtagatgattttgccgaatcctggagagttgaaagcaacgagttctgtaaccggccacagcgaaagccagtacctgagttatgccagggaactgttaaagttaagctcagggcccatcgcgagtgccagaagcttaagtcctgggaattccaaacgtgtcattcaaccgttgattacgccaccttctacagatcttgtgtaacagacatgtgcgaatgtccggtccacaagaattgttactgcgaatccttcctagcctatacccgcgcgtgccaacgggagggcatcaaggtccactgggagcctcagcagaactgcgccgctacgcagtgtaagcacggggccgtgtacgatacctgcggaccaggctgtatcaaaacctgtgataattggaacgagataggtccctgtaataagccgtgcgtagccggctgccactgtccagcaaatttggtcttgcacaaggggagatgcattaagcctgtgctctgtccacagaggtag

SEQ ID NO: 109841 - DNA, 2058 bp, Artificial Sequence
  Description of Artificial Sequence: Synthetic coding sequence
atgctctggttctcaggcgtcggggccctggcggaacgttactgtcggagatcccccggcatcacctgttgcgtccttctgctgttaaattgcagtggcgtgcctatgtccctagcttcctcctttcttacaggcagcgttgctaagtgcgaaaatgagggggaggtgctgcaaatacccttcatcacagacaacccgtgtatcatgtgcgtctgcctaaacaaagaagtgacatgtaagcgggagaagtgtccggttctcagtcgggactgtgccttagcaataaaacagcggggagcttgctgtgagcagtgcaagggatgcacctatgagggaaacacttacaacagctcttttaaatggcagagccccgcggagccatgcgtgctgaggcagtgtcaggaaggagtagtaacagagtctggcgtgcgctgcgtggtgcactgtaagaatcctctggagcacctggggatgtgttgtcctacatgccctgggtgcgtattcgagggggtacagtaccaggagggggaagaattccagcccgagggcagcaaatgtactaagtgttcctgcacaggcggaagaacacagtgcgtccgggaggtgtgcccgattctgagctgcccccagcatttgtcacatatcccccctggccaatgttgcccaaaatgcctggggcagcgcaaagtgttcgaccttcctttcgggtcatgccttttcagatcagatgtatacgacaatggttcctcgtttctctacgacaattgtacagcctgtacatgtcgcgactccacagtcgtgtgtaaacgtaagtgctcccacccagggggctgtgaccaaggtcaggaagggtgttgtgaagagtgtttgctgcgagtcccgcctgaagacattaaagtgtgtaagtttggcaataaaatattccaggacggtgaaatgtggtccagcattaactgcacaatttgcgcatgcgttaaaggcaggacagaatgtcgtaataagcagtgcataccaatcagctcctgtcctcagggcaaaattcttaaccgaaaggggtgttgcccaatttgtaccgagaaacctggcgtgtgtaccgtgtttggcgatccccattacaatacttttgacgggcgcaccttcaactttcagggcacctgtcaatacgtgctgacaaaggactgttcctctcctgctagtcctttccaggtgctggtcaagaacgatgcgagacgtacccgaagctttagctggaccaaaagcgtcgagctggtgctcggcgaatctagggtgtccttgcagcagcatttaaccgtgaggtggaacggatctcgcattgctctgccctgtagagctccgcatttccacatcgatctcgatggctatttgttaaaggtgacaacgaaagccggtctggagatttcttgggacggagattcttttgtagaggttatggcagctccccacctcaaagggaaattgtgcggactgtgtggtaactataacgggcacaaacgagacgacctaatcggcggcgatggcaatttcaaatttgatgtcgacgacttcgctgaatcctggcgcgttgagtctaatgagttctgtaatagaccgcagcgaaagcctgttcctgagctctgtcagggaacagtgaaagtcaaattgagagcgcatcgggagtgccaaaagctgaaatcctgggagttccagacctgtcacagcaccgtagactacgccacgttctacagaagctgtgtgaccgatatgtgcgaatgtcctgttcataagaattgctattgtgaatcgttcctcgcatacactagagcctgtcagagggaaggcatcaaggttcactgggagcctcaacagaattgcgcagctactcagtgtaagcatggtgcggtctacgacacatgcggaccgggctgcatcaagacctgtgataattggaacgagatcggtccttgcaataagccctgtgttgccggttgccactgtccagcgaatcttgtcctacataaagggagatgcataaaaccagtactgtgcccacagcgctag

SEQ ID NO: 109842 - DNA, 2028 bp, Artificial Sequence
  Description of Artificial Sequence: Synthetic coding sequence
atggatactaaaagtattttggaagagctgctcctaaaacgttcccagcaaaagaagaagatgagtccaaataattacaaagaacggttatttgtgttgaccaagaccaacctgtcttactacgagtatgacaaaatgaagcgcgggtctcgaaaaggcagcatcgagatcaaaaagattcgctgcgtagagaaagtgaacttggaggagcagacacctgtcgagcggcagtaccccttccaaatcgtatacaaggacggccttttgtacgtatacgctagcaacgaggagagcaggagtcagtggctgaaggccttgcagaaagagatccgcggtaatccacatctcctggtgaaatatcattccggcttttttgtagacgggaaattcttgtgttgccagcagtcatgcaaagccgctcctgggtgtactttgtgggaggcttatgcaaacctccatacagcagtcaatgaagagaagcatagggtccctacctttcccgatagagttttgaaaattcctagggccgtccccgtgcttaagatggacgctccttcatcatccacaactctggcacagtacgacaatgagtcaaaaaaaaattacggaagtcagcctccttccagctccacatccttggcccagtatgattccaactccaagaaaatctatggctcccagcctaatttcaatatgcagtacatccccagagaagatttccctgactggtggcaagtccgcaaactgaagtcatcaagttcctccgaagatgtggcttcatcaaaccagaaggagagaaatgtcaatcataccactagtaaaatttcatgggaattccccgaatcatcttcctcggaggaagaggagaatttggatgactacgattggtttgcaggtaacatctcgagaagccagagcgagcaactgctccggcagaaaggtaaggaaggggccttcatggtgaggaatagttctcaggttggaatgtatactgtgagcttgttctccaaagcggtgaacgataagaaaggcacagtgaagcattaccacgtgcacaccaacgctgaaaacaagctatatctggcagagaattattgctttgactcaatccccaagctgatccactaccatcagcacaatagcgcggggatgatcactcgtctgcgtcaccctgtgagcacaaaggccaacaaggtgccggactctgtcagcctgggaaatggaatctgggaattgaaacgtgaagagatcaccctgttaaaagagttagggagtggccagttcggagtggtgcagctcggtaagtggaaaggccaatatgacgtggcggtgaagatgatcaaagagggctctatgtctgaagacgagttcttccaggaagctcaaaccatgatgaagctgagtcaccccaagctggtgaaattttatggggtgtgttccaaagagtatcctatctatatcgtgacagaatacataagtaacgggtgtttgctgaattacttacgcagtcatgggaaaggtctagagccatcacagctactcgaaatgtgttacgatgtgtgtgagggaatggcatttctggagagccaccagtttatccaccgggacctagccgcccgcaactgccttgtagatcgagacctctgcgttaaagtgtcagacttcgggatgacgcgatatgtcctggacgatcaatatgtgtcatcagtgggaaccaaattccccgtgaaatggtctgctcccgaggtattccattattttaaatactcttccaagtcagacgtttgggcatttgggatactgatgtgggaggtgttttctcttggcaaacagccctacgatctgtacgataattctcaagtggtactgaaggtgtctcaggggcaccgcctgtacaggccacatctcgcctccgataccatctaccagatcatgtactcatgttggcatgaactacccgaaaaacgaccaacatttcaacagttactgagttcgatagagcctctgcgtgaaaaagacaaacactag

SEQ ID NO: 109843 - DNA, 2028 bp, Artificial Sequence
  Description of Artificial Sequence: Synthetic coding sequence
atggatactaagtctattttggaggagctgctattaaaacggagccagcaaaagaagaagatgtctcccaataattataaagaaagactcttcgtcttgacaaagaccaacttgtcttattacgagtatgacaagatgaaaaggggtagtagaaaaggctccatcgagatcaagaagataagatgcgttgagaaagtgaacttagaggagcaaacccccgtcgaacgacagtacccctttcagattgtgtacaaggacggacttctttacgtatacgcgagtaatgaggagtcacgttcccagtggcttaaagcattgcagaaagaaatccgcgggaatcctcatttgttagtaaagtaccacagtggtttttttgtggacggcaagttcctgtgctgtcaacaatcctgtaaggccgccccaggatgtaccctctgggaggcctatgccaacctgcataccgcagtgaacgaggaaaagcatagggtgccgactttccccgatagggtcctaaaaattccgcgcgccgtgccagttctgaaaatggatgcacctagctcatcaacaactcttgcccagtacgacaacgaatcaaaaaaaaactatggaagccagcctccatctagctcaacttccctggcacagtatgactccaactcgaagaagatttatggttcacagcccaactttaatatgcaatatattccgcgagaagacttccctgattggtggcaggtgcgcaagctgaagtcctcaagtagttccgaagacgtggcttcctcgaatcagaaagagcggaacgttaatcacaccacatctaagatttcctgggagtttcctgagtcctcttcatcagaggaagaagaaaaccttgatgactatgattggttcgccggtaatatttctaggtcacagtcagaacagctgctccgacagaagggcaaggagggcgcgttcatggtaagaaacagttcccaagtgggaatgtatacggtgtctctattctcaaaggctgttaacgacaagaaagggactgtgaagcactatcacgtgcacaccaacgccgagaacaagctttacctggcagagaattattgttttgattccattcccaaactcatccactatcaccaacataactctgccgggatgatcaccagactccgccaccccgtgtccacaaaagccaacaaggtcccagattccgtatcactgggcaacggcatatgggaactcaagagagaagaaattaccttgcttaaggaactgggctcagggcaattcggcgtcgtccagctgggaaaatggaaggggcagtacgacgtggccgtgaaaatgataaaggaagggtctatgtcagaggatgaattttttcaggaagcccagacaatgatgaaattaagccaccctaagctcgtaaagttttatggggtgtgttcaaaggaatacccaatctacattgtgaccgaatatatttccaatggttgcctgctgaattatctgaggagccacggtaagggcctggagccatcccagcttctagaaatgtgctatgacgtgtgtgagggcatggccttcctcgaatcccaccagttcattcaccgggacctggccgctagaaattgtctggtcgaccgcgatctctgtgttaaagtgagtgatttcgggatgactcgctatgtgttggatgaccagtacgtttcatctgtggggaccaagtttccagtgaaatggagcgcgcctgaggtgttccattatttcaagtactcgtccaaatccgatgtctgggcattcggtattctgatgtgggaggtgttctcattgggcaaacagccctacgatctgtatgataacagccaggtggtcctcaaggtctctcagggacacagactgtaccgacctcatctcgctagtgatactatatatcagattatgtactcctgctggcacgaactccctgaaaagaggcccactttccagcagcttctttcctcaatcgagccactgagggagaaggacaaacactag

SEQ ID NO: 109844 - DNA, 2028 bp, Artificial Sequence
  Description of Artificial Sequence: Synthetic coding sequence
atggatactaagtccatcttggaagagttactgcttaaaaggagtcagcagaagaagaaaatgagccccaataattacaaggaacgcctgttcgtgctgaccaagaccaacttaagctattatgaatatgacaaaatgaaacggggtagcaggaagggcagtattgaaattaaaaagatccgttgcgtcgaaaaggtgaacctcgaagagcaaacccccgttgagcgccagtatcctttccagatagtgtacaaagacgggctcctctatgtttacgctagtaatgaggagagtcggtcccagtggctaaaggctttacagaaagagatcagagggaacccccatttgctggtcaagtaccattcggggttcttcgtagacgggaaatttctctgctgccagcaatcctgtaaagctgcccctggatgtactttatgggaggcatacgcaaaccttcataccgcagtgaacgaggaaaaacatcgcgtcccaacatttcctgatcgagtgctgaaaatacccagagctgtgcctgtccttaaaatggatgcaccttcttcatccactaccctggcccaatacgacaatgaaagtaagaagaactacggatctcagccacccagtagctcaacgagccttgcgcaatacgacagcaattctaaaaaaatctacggttcccagcccaattttaatatgcagtacattcccagggaggattttccggattggtggcaggtgcggaaactcaagtcctcttcaagctcagaagacgttgcatcaagtaaccaaaaggaaaggaatgtgaatcacacaacaagtaaaatttcttgggagttcccggagtctagttcttctgaggaagaggagaatctcgatgattatgactggtttgctgggaacatttctcggtctcaaagcgagcaattgctccgacaaaagggaaaagagggcgctttcatggtccggaacagcagtcaggtgggaatgtatacagtgtccctcttttctaaagccgttaacgacaagaagggaactgtgaaacactatcacgtccacacaaacgctgaaaacaaattgtatttggcagaaaattactgtttcgactcgatccctaaactgatacattaccatcagcacaatagcgccggcatgattactagattgagacaccccgtcagcacaaaagcaaacaaggtgcccgacagcgtgtcactcggaaacggcatttgggagctgaaaagggaggagatcacactgctgaaagagctgggaagtggacagtttggcgtggtccagctggggaaatggaagggacagtacgatgtggccgtcaagatgatcaaagaaggatccatgagcgaggatgaatttttccaggaggcacagactatgatgaagctgtcacatccgaagctggtcaagttctatggggtttgctccaaggaataccctatctacatagtgacagaatatatttctaatggatgcctcctaaactatctacgatcccacggcaagggacttgagccatcacagcttctggagatgtgctatgatgtatgtgagggaatggcatttctcgagagtcatcagtttattcatagagacctggcagctagaaattgccttgtggatagagacctctgcgtgaaagtgtcagactttgggatgacacgttatgtgctggatgaccagtacgtaagctcagttggtaccaagtttcccgtgaaatggtctgcgcctgaagttttccattacttcaaatatagctctaagagcgacgtgtgggctttcggaattttaatgtgggaggtgttctctcttggtaagcagccctatgacctatatgataatagccaggtagttctcaaagtctcacaggggcacagactttatcgcccccacctggccagcgatacaatctaccagattatgtacagctgttggcacgaactcccagagaagcggcccactttccaacagctgctctcttcgatcgaacccctgcgggagaaggacaaacactag

SEQ ID NO: 109845 - DNA, 525 bp, Artificial Sequence
  Description of Artificial Sequence: Synthetic coding sequence
atgacggaacttgaataccccaagggcagtagcatcatgcccgcagccggcacgatgtacctcactacttccacagggtacccttatacctatcataacggagtggcctatttccatacccctgaggttaccagtgtgccgccaccctggcccagtcgtagtgtttgctccagccctgtgatggttgctcagcccatttaccaacagcccgcttaccactaccaagccaccactcaatacctgcccgggcagtggcaatggtccgtgcctcagcccagtgccagcagcgccccttttttatatctccagcccagcgaagtgatatatcaacccgtcgaaatagctcaggacggtggctgcgtcccacctccgctttctctgatggagacatcagttcccgagccctattccgaccatggagttcaggctacttatcaccaggtgtatgccccaagtgcaatcactatgccggcccccgtgatgcagccagaacccattaagactgtctggtctattcattactag

SEQ ID NO: 109846 - DNA, 888 bp, Artificial Sequence
  Description of Artificial Sequence: Synthetic coding sequence
atggagaccgaatctggaccacagacgtcaaaccagatgcagacagactcgctaagcccctcgccaaatccagtctcacccgttccgctgaacaacccaacaagtgcgcccagatatgggaccgtgatcccaaatcgcatcttcgtgggcggcatcgactttaagaccaatgaaagtgatctgcgcaaatttttcagccagtatggtagtgtgaaagaggtcaagattgttaacgacagagccggagtaagcaaaggctatggcttcgtaactttcgaaacacaagaggacgcacagaagattctgcaagaggcagaaaagctaaactacaaggataaaaagctcaatattggcccagctatcagaaaacaacaggttggcatccctcgatctagcatcatgcctgcagccgggacaatgtacctcaccacatctacaggatacccatacacttatcacaatggggtggcctacttccacacacctgaggtgacatccgttccacccccctggcccagccggagcgtgtgttcatctcctgttatggtggctcagcccatttaccaacagccagcgtatcattaccaagctacaacacagtacctgcccggacagtggcaatggagtgtgcctcaaccatcggcaagttctgccccgttcctctatctgcaaccaagtgaggtaatctatcagcccgtagagattgcccaagatggcgggtgcgtacccccacctctgtccttgatggaaacaagcgtgccagagccatactcagatcacggcgtccaggctacataccatcaagtgtacgcccccagcgccatcaccatgcctgcaccagtgatgcagcccgagcccatcaagaccgtatggtctatccactattag

SEQ ID NO: 109847 - DNA, 852 bp, Artificial Sequence
  Description of Artificial Sequence: Synthetic coding sequence
atgcagactgatagtttgtcaccctcccctaatcctgtcagccccgtccccctgaataatcccactagcgctccgcgatatgggactgttattccaaacaggatcttcgttggcgggatcgatttcaagaccaatgaaagcgacctgaggaagttctttagccaatacggatcagtcaaggaggtgaaaattgtcaatgacagggctggtgtttctaaaggttatggcttcgttaccttcgaaacacaagaggacgcacagaagatactccaggaggctgaaaagctgaactataaagataaaaagctgaacatcgggcctgccattcgaaaacagcaggtcggcattccgcggagcagcattatgcccgctgccggcactatgtatctgaccacctccacaggatatccctacacctaccataacggtgtcgcctactttcacactccggaggtcacaagcgtcccccctccatggccaagccgtagtgtctgctcttctccagtgatggtcgctcagcccatttaccagcagcccgcctaccattatcaggccactacgcagtatctccctggccagtggcagtggtcagttcctcaaccctctgctagtagcgcccccttcctgtatttgcagccttctgaggtaatttaccagcctgtggaaattgcgcaggatggtggatgtgtgccacctcccctgtcactgatggagacgagcgtgcctgaaccatattctgatcatggagtccaggctacctaccaccaagtctacgcgcctagcgccatcaccatgccagcaccagtgatgcaaccagaacctataaagactgtttggtcaatacattattag

SEQ ID NO: 109848 - DNA, 852 bp, Artificial Sequence
  Description of Artificial Sequence: Synthetic coding sequence
atgcagaccgactctctgtccccttcccccaatcccgtttcaccagtgccccttaacaaccccacctcagcaccaagatacggcaccgtgatccctaaccgaattttcgtgggcggtatagactttaaaaccaacgagagtgacctgcgaaagtttttttctcagtacggttctgtgaaggaagttaaaatcgttaacgatcgggctggcgtcagcaaagggtatgggtttgtgaccttcgagacacaagaggatgcccagaagatactgcaagaggccgagaagcttaattacaaggataaaaagctgaacataggccccgcaatcagaaagcaacaagtgggtatccctagatcatccataatgcctgcagcaggaactatgtacctcacaacctctacgggttacccatacacctatcacaatggcgtcgcctattttcacacaccagaagtgactagtgtccctccgccctggccatcacggagtgtgtgcagcagtcctgtaatggtcgctcaacctatctatcagcaacccgcgtatcactatcaggctactacacaatacctgcccggccagtggcagtggagcgtgccgcagccctcggcgtcgtcagctcctttcctgtacctgcagccctctgaagtcatttaccagcctgtggagattgcccaagacggcgggtgcgtgccaccaccattgtccctgatggaaacaagcgtgcctgagccgtacagcgatcacggagtgcaggctacttatcatcaagtctatgctccatctgcaattacaatgccagcccctgtgatgcagccagaaccaataaaaacagtttggtcgattcactactag

SEQ ID NO: 109849 - DNA, 414 bp, Artificial Sequence
  Description of Artificial Sequence: Synthetic coding sequence
atgctatctggccggcttgtgctcggcctggtgagcatggcaggccgcgtgtgcttgtgccagggctctgcgggttctggggcaatcggcccagtggaggctgcgataaggactaaacttgaagaagcattatcccctgaggttcttgaactgcgcaatgaaagcggcggacatgccgtgcctcctggaagtgagacacactttcgtgtggcggtggtgtcctcccgtttcgaggggctgtccccactccagcgccacagattagtgcacgcggcactagccgaagaactgggcggcccagtacacgcccttgccatccaggcccggactcctgcgcagtggcgtgagaattcccagttagacaccagccccccctgccttgggggcaataaaaaaactctgggtactccatag

SEQ ID NO: 109850 - DNA, 414 bp, Artificial Sequence
  Description of Artificial Sequence: Synthetic coding sequence
atgctgtcaggacgcctggtcctgggcctggtatccatggccggtagagtctgtttgtgtcaagggtctgcaggttccggcgccataggcccagtcgaggcagcaattagaacgaaacttgaggaggctctaagtcctgaggtgcttgagcttcgcaatgaatctggcggacatgcagtgcctcccgggtccgaaacacattttagagttgccgtagtgtcctcccggttcgagggtctgagtccactgcagaggcatcgccttgtgcacgccgccttggcagaggaactgggagggccggttcacgcactggcaattcaagctagaactcctgcccagtggcgggaaaattcccaacttgatacatcacctccctgcctgggaggaaataaaaagaccctcggaactccttag

SEQ ID NO: 109851 - DNA, 414 bp, Artificial Sequence
  Description of Artificial Sequence: Synthetic coding sequence
atgctgtcaggccggttggttctgggtctggttagtatggcagggcgtgtgtgcctgtgtcagggaagcgccgggtctggggcaatcggacctgtagaagcggcaatcaggactaaactcgaagaagctctgagccccgaggtcctggaactgagaaatgaatcaggtggccacgcagtgccaccagggtctgaaacacacttcagggttgctgtcgtgtccagcagattcgagggcctgtcaccgctgcagagacaccgcctcgtgcacgccgctctcgccgaagaacttggcggtccagttcacgccttggctatccaggccagaactccggcgcaatggcgcgagaatagtcagctcgacaccagcccaccatgcctggggggcaataaaaagacccttggcacaccctag

SEQ ID NO: 109852 - DNA, 459 bp, Artificial Sequence
  Description of Artificial Sequence: Synthetic coding sequence
atggcgtcggctaaaagcctggacagatggaaagcacgcttacttgagggcggttctaccgcactgacctacgcgcttgtgagggctgaggtcagcttcccagcagaggtggcacctgtgcgacagcaggggtctgtggccggcgctcgcgccggcgtagtttctctgttgggctgcagatcatcgtggaccgcagccatggagctgtcagcagagtacttgagagagaaactgcagagggatctagaagccgagcacgtcgaagtggaagataccactctgaacagatgtagctgttcttttcgtgttctagttgtgtcagcaaaattcgaagggaaaccactgttgcaacgccatcggttggtaaacgcttgcctggcggaagaattgccacacatccacgcatttgagcagaagacattgacccctgatcagtgggcaagagagcggcaaaagtag

SEQ ID NO: 109853 - DNA, 306 bp, Artificial Sequence
  Description of Artificial Sequence: Synthetic coding sequence
atggccgcatggtcaccagcagccgctgcaccattgctcaggggaatccggggattgcccctgcatcaccggatgtttgcaacccaaacagagggagagctcagagtcacgcaaatcctcaaagaaaagttcccaagggcgactgctattaaagtgaccgacatctctggtaccaagcgccgcaatcaaagagacgcgtggatcgccgacatctacctctgcccacagaccctcactaccccctggctacacagatgctgctgtttgcgaccctggatgaatttcactgacataatcctaccttag

SEQ ID NO: 109854 - DNA, 324 bp, Artificial Sequence
  Description of Artificial Sequence: Synthetic coding sequence
atggccgcctggagtcctgctgccgcggcccctctgctccgcggcattaggggccttccgcttcaccaccgaatgtttgccacccagactgaaggggaacttagggttactcagattctgaaagagaagtttccgcgtgcaaccgccattaaggtcacagacatctccggcggatgtggggcgatgtacgaaattaagattgagtctgaagagtttaaagagaagcgcactgttcaacaacaccagatggttaatcaggccctgaaggaggaaattaaggaaatgcatgggttgagaatctttacgtcagtgcctaagcggtag

SEQ ID NO: 109855 - DNA, 1200 bp, Artificial Sequence
  Description of Artificial Sequence: Synthetic coding sequence
atggcccaaagacagcctcactccccaaaccagacgctgatctctatcactaacgacacggaatcgtcatcctctgtggtgagtaacgataataccaataagggctggagtggggacaactcacctgggatcgaagcgttgtgcgcaatttacattacgtatgccgtgatcatatctgttggtatccttggaaatgccatcctgatcaaggtgttttttaaaacaaagtccatgcagaccgtcccaaatatcttcatcacgtctctggcattcggggatctcctattattacttacttgtgtcccagtggatgccacgcactacctcgccgaggggtggctgtttggcaggattggctgtaaggttctgtccttcataagattgacatctgttggcgttagcgttttcactctgaccattctctctgccgataggtacaaagctgtggtgaagcctctggaaaggcaaccctcaaatgccattctcaaaacctgcgtcaaagcagggtgtgtgtggatagtgtccatgatcttcgcattgccagaagccattttctcaaacgtttatactttccgggatccaaataaaaatatgacatttgaatcctgcacgtcctaccccgtgtctaagaagctgctccaggaaatacactctctgctgtgctttcttgtattttatataattcccttgtccattatctcagtctattactcactgatcgctcggactctgtataaatcaacactgaacatccctaccgaggagcagagtcacgcacgaaagcagatcgagtctcggaaacgcattgcccgcacagttcttgttctcgtggcactatttgcactctgctggctgcccaaccaccttttatatctctatcatagtttcacctcacagacatacgtggatccgtcagccatgcatttcatttttacaatcttcagccgcgtcctagcgttcagtaattcttgcgttaatccttttgctctctactggctatctaagtcttttcagaaacactttaaggcacagctattctgttgtaaggctgagagaccagaaccacccgtggctgatacaagcctaactactctggcggttatgggcaccgtgccaggaactggttcaattcagatgtctgaaatttccgttacgtccttcaccggttgtagtgttaaacaggctgaagatcgcttttag

SEQ ID NO: 109856 - DNA, 303 bp, Artificial Sequence
  Description of Artificial Sequence: Synthetic coding sequence
atgcgcgctctgaccctgctggcattgctggcattggctgcactgtgcattgctggacaggccggagccaagccttccggcgccgagagctcaaaaggcgccgcgtttgtgagtaagcaggaaggatccgaggtagtcaagcgccctaggaggtacctgtaccagtggctcggcgcccccgttccttacccagaccccctcgagccgagaagggaagtgtgtgagctgaacccagactgcgatgaacttgccgaccacattggtttccaagaggcatataggaggttctatgggccagtgtag

SEQ ID NO: 109857 - DNA, 957 bp, Artificial Sequence
  Description of Artificial Sequence: Synthetic coding sequence
atggccgctcaaggctgcgccgcttcccgactgttgcagctgctgttacaattgctcctactgttgttgctgctagcagctggcggtgcgcgcgcacgttggaggggggaaggcacctccgctcatttgcgggatattttcttgggtagatgcgccgaatatcgggcgttgctgtcaccggaacagagaaacaaaaactgcacagcgatctgggaagccttcaaagtcgccctggacaaagatccctgttccgtcctgccctccgactacgacctgttcattaacctcagcaggcactcgattccaagagacaagtctctgttttgggagaattctcacctgctggtaaattcctttgccgataataccagaagatttatgcccctgagcgacgtactgtatggccgtgtcgctgactttttgtcttggtgcagacagaaaaacgactctgggctcgactatcagagctgcccgacatctgaggattgtgaaaataatccagtggacagcttttggaagcgggcttcaatccaatacagtaaggacagcagcggggttatacatgttatgctcaatgggagtgaacctaccggcgcctaccctatcaagggtttttttgccgactatgaaatccctaacctccagaaagagaagatcaccaggatcgaaatatgggtgatgcacgaaatcggcgggcctaacgtcgaatcttgtggcgaaggctctatgaaggtactagaaaagcggctgaaagacatgggcttccagtatagttgcattaatgattaccgtcctgtcaagttgctgcaatgtgtagaccactccacccaccctgactgtgccctgaagagcgctgccgccgccacacagaggaaggcgcctagtttgtacaccgagcagcgtgctggcttaattatccctctgtttcttgtgctggcaagtagaacccaactctag

SEQ ID NO: 109858 - DNA, 543 bp, Artificial Sequence
  Description of Artificial Sequence: Synthetic coding sequence
atggcttccacttcttacgattactgcagggtgcccatggaggatggggacaaacgttgtaaattactgctggggatcggcatcctagtgctgctaatcatagtgatcctcggtgtgcctctgatcattttcacaattaaagccaactctgaagcatgtagagacggcctcagagcggtgatggaatgtaggaatgtaacccatctgctgcagcaggaactgaccgaggcgcaaaaaggattccaggatgtggaagcccaggcagccacatgcaaccacactgtgatggccctgatggctagcctggacgctgaaaaagcgcagggccagaagaaagttgaagagttggaaggtgagattacaacactaaatcataagctccaggacgcaagtgcagaggttgagcgactcagacgggagaaccaagtgctttctgtgcggatcgcggataagaaatattatccaagcagtcaggactctagtagcgctgccgccccccaactgctgatcgtgctcctgggcctgagtgctctcctccaatag

SEQ ID NO: 109859 - DNA, 651 bp, Artificial Sequence
  Description of Artificial Sequence: Synthetic coding sequence
atggcaagcacatcgtacgattattgtagggtccccatggaagatggagacaagagatgcaaattgcttttggggattggaattctcgtgctcctgatcattgtgatccttggagtgccacttattattttcacgataaaggcgaattccgaagcctgtcgggatgggcttagggctgtgatggaatgcaggaacgtgacgcacttgctgcagcaggagcttacagaggcccagaaggggtttcaggatgttgaagcccaggccgccacttgcaaccacaccgtcatggcactgatggcgtcgctggacgccgagaaggcacaaggacagaagaaggtggaggagttggaaggtgaaatcacaactcttaaccacaagcttcaggacgcctcagcggaggttgagcgactacgccgagaaaatcaggtcctttccgtgcgtatcgctgataagaagtattacccctcctcacacttcccaagcactccccagtcccggctgcaaactcagttgaccaccctgaaaattgaaatggacgaggcaaaggcgcaggggacacagatgggagccgagaatggcgctctgaccggggctttaggctgcaagggtgttggacgagacagaagtggccgcagcctgggcgagtcatag

SEQ ID NO: 109860 - DNA, 1179 bp, Artificial Sequence
  Description of Artificial Sequence: Synthetic coding sequence
atggtgctgctttcgattctcagaatcctgttcctttgtgagctggtccttttcatggaacatcgcgcccagatggctgaaggtggtcaaagttctatcgccttactagcagaggcaccaaccctccccctaatcgaagagctcttggaggaatcacctggggagcagccgagaaagcctcgcctgttgggccacagcctgcggtacatgcttgaattgtacagacggtctgccgacagccacggccatcctcgggaaaataggacaatcggagcgactatggtccgcctggtgaagccgttgaccaacgtcgctaggccccaccgtggcacatggcatatccaaattttgggttttccactgcggcccaatagaggcctataccaattggtgcgggccactgttgtgtacagacatcatctgcaattaactaggtttaatttaagctgccatgtagagccatgggtgcagaaaaacccaaccaatcactttccaagttccgaaggtgacagtagcaagccgagtctgatgtccaacgcctggaaggagatggatattactcagctggtgcaacaacgcttctggaataataaagggcaccggatcctaagactgaggttcatgtgccagcaacagaaggattccggtgggcttgagctctggcacggtacaagttctctggatattgctttcctcctcctctacttcaatgatacccataaatcaattcgcaaagctaaatttttgcccagagggatggaggaattcatggaacgagaaagcctactccgtaggacccgccaggccgacgggatatccgcagaggtgaccgctagcagtagcaaacattcagggccagagaacaatcagtgctccctgcatccatttcagatctccttccgtcagctgggatgggaccactggatcatcgcacctcctttctacacccccaactactgtaaagggacttgcctgcgcgtgctacgggacggcctcaattctcctaatcacgctattatccaaaatttaataaatcagctggtggaccaatctgtccctagacctagttgcgttccatacaagtacgttcctatcagtgtactgatgatcgaagctaacggaagtattctgtataaagagtatgaaggaatgatagccgaatcttgtacttgccgctag

SEQ ID NO: 109861 - DNA, 1419 bp, Artificial Sequence
  Description of Artificial Sequence: Synthetic coding sequence
atggctggggctagccgactgctgttcctgtggctgggctgtttttgcgtgagcctggcgcagggcgagcggcccaagcctccttttccagaactgaggaaagccgtgccgggggatcgtaccgccggtggcggccctgatagcgagctacagcctcaggataaggtgagtgagcatatgctccgcctttacgacagatactctacagtgcaggctgccagaacgcctggatcactagagggcggttcccagccatggagacccaggttgcttagggaagggaatacggtacgcagttttagagccgcagctgccgaaactcttgagagaaagggactttacatttttaacttaacatccctgacaaagtccgagaatatactgagcgcaaccctctatttctgcataggagaacttggaaatattagcctctcctgccccgtgtccggcggctgcagtcaccatgcccagaggaagcatatacagatagacctctcagcctggacgctcaaattttctagaaatcagtcccagttactgggacaccttagcgtagacatggccaagagccatagagatatcatgtcgtggctcagtaaggacatcacacagctcctccggaaggcaaaagaaaatgaggagttcctgatcggttttaacatcacaagtaagggtcggcagctgcctaaacggagactgccttttcccgagccttacattctggtttatgctaatgacgctgccattagtgagcctgaatcagtcgtgtcgagtctccagggccaccgcaattttccaaccggcaccgttccaaaatgggactctcacatccgggccgctctatcaattgagcgcagaaagaaacgctctaccggcgtgctccttcccctgcagaataatgagttgcctggcgccgaatatcagtacaaaaaggacgaagtctgggaggagcgcaaaccgtacaagaccctccaggcgcaggcccccgaaaaatctaagaacaaaaaaaagcagagaaagggcccacacaggaaaagccagactctacagtttgatgaacagacattaaagaaagcccgtagaaagcagtggatcgaacctcggaattgtgctaggcgctatcttaaagtggattttgccgacataggatggtcagagtggattatttcgcctaaatcctttgacgcatattattgttccggcgcttgtcagttcccaatgccaaagagtctgaagccgtcaaatcacgcgacgatccagtccatcgtccgggccgtaggggttgtcccgggcattcccgagccctgctgcgtgcccgagaagatgagcagcttgtcgatactgttttttgatgagaacaaaaacgtagtgctcaaggtctatcccaatatgacggttgaaagttgtgcctgtaggtag

SEQ ID NO: 109862 - DNA, 213 bp, Artificial Sequence
  Description of Artificial Sequence: Synthetic coding sequence
tgcttcttttactatctgaaaagcctaaagccatcgaatcatgccaccattcagtctatagtccgagcggtcggggtggtcccaggcataccagaaccttgttgtgtcccagagaaaatgagctccctgagcatactattctttgatgagaataagaacgtggttctgaaagtctaccctaatatgacagtggagtcttgcgcttgtcggtag

SEQ ID NO: 109863 - DNA, 1227 bp, Artificial Sequence
  Description of Artificial Sequence: Synthetic coding sequence
atgattcccggtaaccggatgctgatggtggtgctgctgtgtcaggtcctccttggaggggcatctcacgcgtcccttattccagagaccgggaaaaagaaggtggccgagatccaggggcatgcagggggccggaggtccggacagtctcatgagctgctaagggactttgaggcgaccctgctccaaatgtttggcttgcgacggcgcccccagccctccaagagcgctgtaatacccgactatatgcgggacctctaccggttgcaatccggtgaggaagaggaagagcagatacatagcacaggactggaataccccgaacgacccgctagtcgcgcaaatacagttaggagcttccatcatgaggagcacctggagaacatccctggtacaagtgagaattcagcctttcggttcctattcaatttgtccagtattcctgaaaacgaagtcatttcgtccgccgaattaaggctgttcagagagcaagtggatcagggacctgactgggagcggggcttccatagaataaatatctatgaggttatgaagcccccagctgaggtcgtgccagggcacctcataacacgcctcttggacacccggttggtgcatcacaatgtgacccgctgggaaacttttgatgtgtcccccgccgtgcttcgatggacacgggagaaacaacctaactacggcctggcaatagaggtgacacacctgcaccaaacgagaacgcaccagggccagcacgtgaggatatctcggtcccttccacagggctcaggaaactgggcccagcttcgccccctattggtgacattcggtcatgacggccgcggccatgcattgaccaggcgtcgcagggctaagagatcgcctaagcatcactcacagcgcgcacgtaagaagaacaaaaactgtcgcaggcactccctctatgtggatttcagcgatgtaggttggaacgactggatcgtggccccgcccggataccaggctttctactgccacggagattgcccattcccactagctgatcaccttaatagcaccaaccatgcaatagtgcagactctggtgaattctgtgaactcttccatcccaaaagcttgctgtgtgccgaccgagctctcagccatttccatgctatatctggatgagtatgacaaggttgtgttgaagaattaccaggaaatggtggtggaaggctgtgggtgtaggtag

SEQ ID NO: 109864 - DNA, 1227 bp, Artificial Sequence
  Description of Artificial Sequence: Synthetic coding sequence
atgatccccggtaaccgtatgttgatggtggtattgctgtgccaagtcctcctgggcggcgcaagtcatgcctctctgatcccagagacaggcaagaagaaggtcgcggagattcagggtcatgctggggggagacggtctggccaatcacatgaactcctgagggacttcgaggcaactttactgcagatgttcgggctgcggcgccgtcctcagcccagcaagagtgcagtcattcccgactacatgagggacctttacagactgcaaagcggtgaggaggaagaagaacaaatccactctaccggtctcgagtatcccgagaggccagcttctagggcaaataccgtgcgttcgttccaccacgaggaacacttagaaaacattcctgggaccagcgaaaattctgcatttcggttcctgttcaatctctctagcatacctgagaacgaagtcatctcaagcgccgagcttaggctgtttagggaacaggtcgatcagggtcccgattgggagcggggatttcacaggattaatatctatgaggtaatgaaacccccagccgaggtagtccctggccacctgattacgcggctgctggacacccgattggtccaccacaacgtgacacgatgggaaacttttgacgtctcgcctgccgtgttacgctggacgcgagaaaaacagccgaactatgggttggccatagaagttacgcatcttcaccagacacgaacacaccagggtcaacatgtccgaattagtcggagtctgccgcaaggctctggcaattgggcccagttgaggcctttacttgtgacttttggacatgacgggaggggacatgcgttgaccaggaggcggcgcgcaaaacggagccccaaacatcactcccagcgggcacggaaaaagaacaaaaactgccggaggcatagtttgtatgtcgacttttcagacgtggggtggaatgactggatcgtggcaccccccggctatcaggcattctattgtcatggtgactgccctttccccttagccgatcatctgaactccactaatcacgcgatcgttcagactttggtgaattcagtcaattcttccatcccgaaagcctgttgcgtccccactgaactgtctgccataagcatgttgtacctggatgagtatgataaagtcgtcctcaagaactaccaggagatggtggtcgagggatgcgggtgcagatag

SEQ ID NO: 109865 - DNA, 1227 bp, Artificial Sequence
  Description of Artificial Sequence: Synthetic coding sequence
atgatcccagggaaccgtatgctgatggtggtcctcctgtgccaggtcctcctgggaggcgcctctcatgccagccttatccctgagacgggaaaaaagaaggttgcggagatacaaggacatgccggtggcagaaggagcgggcagagccacgagttgctgcgcgacttcgaagctacccttctgcaaatgtttggactgaggcggagacctcagccaagcaagtccgctgttatccctgactatatgagagacttgtaccgcctgcagtcgggagaggaggaagaggaacaaattcactcaacagggctagagtatcctgagcggcccgcatcgagagcgaacacagttcgaagtttccaccacgaagagcatctcgagaacattcctggcactagtgagaacagcgcatttcgcttcctctttaatttatcttccatcccggagaacgaagtcatcagctctgctgagctgaggctcttccgggaacaggtagatcaggggcctgactgggagaggggttttcataggataaatatttacgaagttatgaaaccacccgcggaagtcgtgccaggacatctgatcacaagactgcttgacacaagactggtgcatcacaacgttaccagatgggaaaccttcgatgtatcaccggctgttctcagatggacccgcgaaaaacagcctaattacggcttagctattgaggtgacacacttacatcagacccggacccatcagggccagcatgtacgcatttctcgcagcctcccccaggggagcgggaactgggcgcagctgcgcccgctgcttgtgacatttggtcatgatggccgaggacacgcccttactcgaaggaggagagctaaacggtctccgaagcaccacagccaacgtgctagaaagaagaataagaattgcaggcgccattctctgtacgtggacttttctgatgtggggtggaacgattggattgtagccccacctggataccaagccttctactgccacggagattgccccttccctcttgctgatcacttgaactctactaaccacgctatcgtgcagactttggtcaatagcgttaattcttcgatcccaaaagcgtgttgcgtcccgactgagctgtctgcaataagtatgctgtaccttgacgaatacgataaggtcgtgttgaagaattatcaggagatggtcgtggaaggatgcgggtgccgttag

SEQ ID NO: 109866 - DNA, 1227 bp, Artificial Sequence
  Description of Artificial Sequence: Synthetic coding sequence
atgatccctgggaaccggatgctcatggtggtgctgctctgccaggtcctcctgggcggcgcctctcatgcatctctgatccccgaaaccggaaaaaaaaaggtcgccgaaatccaaggacatgccggcggccgccggagcgggcaaagtcatgaactgttacgggattttgaggctacactgctgcagatgtttgggctcagaaggagaccacagccatctaagtcagccgtgattcccgactacatgagagacctgtaccgattgcagagcggagaagaggaagaggagcagatccattctaccggcttggaatacccggaaaggcccgcgagcagggccaatacagtgaggtctttccatcacgaggaacacctcgagaatatcccagggacgtcggagaacagcgcttttcgttttctgttcaacctctccagcatacccgagaacgaggtgatcagctcagccgagctacggctgtttcgagagcaagtggaccagggacctgactgggaaagagggtttcaccgcattaatatctatgaggtgatgaaacctcccgctgaggtggtgcctggccacctgattacccggcttttggatacgcgcctggtccaccacaatgtcactcggtgggaaacctttgacgtttctccagctgtcttaagatggacacgggaaaaacagcccaattatggtctggccatagaggtcactcatcttcaccaaactcggacacaccagggccaacatgttcgcatctcgcggtctttgcctcaaggcagcggtaattgggcccagctccgtccactgctggtcacatttggacacgacggaaggggccatgccttgacccggaggaggcgcgccaagcgtagccccaaacaccatagtcaaagagccagaaagaagaataagaactgccgccgacatagcctctacgtcgacttctcagacgtcggctggaatgattggatagtcgccccgccagggtatcaagccttctactgccatggcgactgcccctttcctttggccgaccacctgaacagtacaaatcacgccattgttcagacattggtgaacagcgttaactccagcattccaaaggcctgttgcgtgcctacagagctgtcggccatttccatgctgtacctggatgagtacgacaaagtcgtcctgaaaaactaccaggagatggtggtggaaggatgtggctgtagatag

SEQ ID NO: 109867 - DNA, 333 bp, Artificial Sequence
  Description of Artificial Sequence: Synthetic coding sequence
atgattccaggtaatcgaatgctgatggtggtgctgctgtgccaggtcttactgggaggagccagccacgcctctctgattccagagacggggaagaaaaaagtagctgagatacagggacatgctggggggaggcgtagcggacagagtcacgagctgctccgggactttgaagccacactgttacagatgtttggattacggcgcaggccgcagccatctaaaagtgccgtaatcccagactatatgagggatctgtataggttgcagagtggcgaggaggaggaagaacaaatccattcgacaggtctcgagtatcccgagaggccctag

SEQ ID NO: 109868 - DNA, 1365 bp, Artificial Sequence
  Description of Artificial Sequence: Synthetic coding sequence
atgcacctgaccgtatttctgctcaaaggaattgtaggattcttatggagctgctgggtcctcgtcggctacgccaagggggggctgggcgataatcacgtgcattcttcatttatctaccggagactccgcaaccatgagcggcgcgagatccagcgtgaaatcctgagcatcctaggcttaccacatcggccccggcccttctctccgggaaaacaggcctcatccgcgcctctgtttatgttggatctatataatgccatgacaaatgaagaaaaccccgaggaaagcgagtatagcgtaagagctagtcttgccgaggaaacaagaggcgcccgcaaaggctacccagcatctcctaacggctacccgcgaagaattcaattatcccggacaactcccctgacgacacagagtccccccctggccagtctgcatgataccaactttctcaacgacgcagatatggttatgagttttgttaatctcgtggagcgtgataaagacttctcccatcaacggcgacactacaaggagttccgcttcgatctgacgcagattccgcacggcgaggccgtgacggcagctgagttccgtatctataaagaccgatccaataaccgatttgagaacgagactataaagattagtatttatcagataatcaaggaatacacgaatcgcgacgctgatcttttcttgttggacacacgcaaggcccaggccctggatgttggttggctggttttcgacatcaccgttacgtccaaccattgggtgattaacccacagaacaacctgggccttcagctatgcgccgagaccggcgacgggcgcagcataaacgtcaagagtgccggcctggtcggacgacaggggccccagagcaagcagcctttcatggtcgcctttttcaaagctagtgaggtccttttacgttcagttcgagctgctaataaaaggaagaatcagaaccgcaacaagagctcttcccaccaggacagcagcagaatgtcctctgtcggcgactacaacacatctgagcagaagcaggcatgcaaaaagcatgaactttacgtctccttccgcgacctggggtggcaggattggataatcgcccccgaaggatatgcagctttttactgcgacggtgaatgctcattccccctgaacgctcacatgaatgccaccaatcacgccatcgtgcagactctggttcatctgatgttccccgatcacgtcccaaagccctgttgcgctccaacaaagttgaacgctatcagtgtattgtacttcgacgactcttcaaatgtgattctgaagaaatacagaaatatggtagttaggtcctgtggctgccattag

SEQ ID NO: 109869 - DNA, 1254 bp, Artificial Sequence
  Description of Artificial Sequence: Synthetic coding sequence
atgcacctgacggtgtttctccttaagggtattgtgggcttcctctggtcctgctgggtccttgtcggctacgccaaaggcggcctgggagacaaccacgtgcatagttcctttatttaccgacgattgcggaaccacgagcggcgagagatccagcgagaaatcttgtctatcctgggattgccacatcgcccaaggcccttctctcctggtaaacaggcgtcaagcgccccactgttcatgctggacctatataacgccatgacaaacgaagaaaacccggaggagtcagagtactctgtgcgcgccagcttagccgaagaaactcgcggagcgaggaaaggatacccagcatccccaaatggctacccaaggcgaattcagttgtcccggacaacgccacttactacccagtcccccccattggctagcttgcatgacaccaacttcctcaacgatgccgatatggtgatgtccttcgtcaacctggtcgaacgggacaaagacttttcccatcagagacggcattacaaggagttcaggtttgatctgactcagattccacacggggaagcagtgacagccgctgaattcagaatctacaaagacaggtccaacaacagatttgaaaatgaaaccataaagatttccatataccagatcatcaaggagtacactaatagggatgccgatctgtttctgctagacaccagaaaagcgcaagcccttgatgtggggtggctggtttttgatattactgtcacctctaaccactgggtaatcaacccccagaacaacctggggctgcagttgtgcgcagaaactggagatggccggtccattaatgttaagtcagctggactggttggacggcagggacctcaatcaaaacagccattcatggtcgcattctttaaagcttccgaggtactcctaaggagcgtgagagccgctaacaagcgcaaaaaccagaataggaacaagtcctcctcccaccaggactcctctcgtatgagttcagtgggcgactacaacacgtctgagcaaaagcaagcatgcaaaaaacacgagttatatgtcagttttcgtgacctgggctggcaggtgcacctgatgtttccagaccacgtacctaaaccctgttgcgctccaaccaagttgaatgccatcagcgttctctattttgatgactcatctaatgttatattgaaaaagtatcgtaatatggtcgttagatcctgtggttgccactag

SEQ ID NO: 109870 - DNA, 1542 bp, Artificial Sequence
  Description of Artificial Sequence: Synthetic coding sequence
atgccagggctgggacggcgcgcccagtggctgtgctggtggtgggggctcctctgctcctgctgcggaccacccccccttcgtccacctttacctgccgccgccgccgccgccgctggagggcagttacttggtgacggcggcagccccggcaggaccgagcagccccccccatctccacagtcttctagcggtttcctctatcgccgactgaaaacccaggagaagcgcgaaatgcagaaagaaatcctctccgtgcttgggttgccccaccgaccacgccccctccacgggctgcagcaaccccagcctccagcactccggcagcaagaggagcagcaacagcagcagcagctgccgaggggcgagcccccaccagggaggctgaagagtgcaccactgttcatgctggatctatacaatgctctgagcgctgataacgacgaggacggggcctcagagggggagcgccagcagagctggccacatgaagctgcctctagctcgcagcgtaggcagccccctcctggcgccgcccatcccctcaacagaaagtccttgctcgctccaggatcaggttccggcggagcttctccactgacaagcgcccaggattccgccttcctgaacgacgcagacatggtgatgtcatttgtgaatttggtggaatatgacaaggaattcagtccgcggcagaggcatcataaggagtttaaattcaaccttagccagatcccagagggtgaggtggttactgctgcggagtttagaatttacaaggattgcgtgatgggttccttcaaaaaccagactttcttaatctctatctatcaagtcctgcaggagcatcaacatagagactcggatctattcttgcttgacaccagggttgtctgggccagcgaagaaggatggctggagttcgacatcaccgctacctctaacctgtgggtggtcactccccagcataacatgggcttgcagctgtctgtagtcactagagacggggtccacgttcacccaagagcagccggccttgtgggccgagatgggccgtacgataaacagcccttcatggtggccttcttcaaggtctcagaggtgcacgtcaggactacaagatcggcatcatctcggaggcgccaacagagtcggaatcgtagcacccagtcacaggatgttgcaagggtgagtagtgcaagcgactacaacagctccgaactcaaaacagcatgcaggaaacacgagttatatgttagttttcaggacctaggctggcaggattggatcattgcccccaagggttatgccgcaaactactgtgatggggaatgttccttccctctgaatgctcacatgaatgctacaaatcatgccatagtgcagacattggtccacctcatgaatccagagtacgttccaaaaccctgctgcgcacccacaaagttaaacgccatctcagtgctctactttgacgacaattcaaacgtgattctcaagaagtacaggaatatggtggtgcgtgcttgcgggtgccactag

SEQ ID NO: 109871 - DNA, 1308 bp, Artificial Sequence
  Description of Artificial Sequence: Synthetic coding sequence
atgcaaaaagagatcctcagcgtgttaggcctcccgcataggccacgaccgctgcatggtctgcagcaaccacagcccccggccctacgccagcaggaggagcagcagcagcagcagcaactcccgagaggcgaaccccccccaggcaggctcaagtccgctccactcttcatgttggatctgtacaatgccctatctgctgacaatgacgaggatggcgccagcgagggcgagaggcagcaatcgtggccccacgaggctgcctcatcttcccagcgaaggcagcccccacccggagccgctcaccctctgaacaggaaatctttgctggcgcccgggtctggatctgggggggcctccccattaaccagcgcgcaggacagcgcgttcttgaatgacgctgatatggtcatgagtttcgtcaacctagtggagtacgacaaagagttttctcctaggcagcgccaccacaaagagttcaaatttaatctctctcagatcccagaaggggaagtggtgaccgcagctgagtttcggatctataaagattgtgtcatgggctccttcaaaaatcaaacgttcttgataagcatctatcaagtcctgcaagagcatcagcatcgtgattctgatctctttctgttagacacccgggtcgtctgggcctcagaggagggctggttggaattcgacatcacagcgacatccaacctctgggtggtcaccccccagcacaatatgggacttcagctttctgtggttacaagagatggggtgcatgtccacccacgggctgccggcctggtaggtagggacggcccctacgataaacaaccctttatggttgctttcttcaaggtatctgaggtacatgtgcgaacgacgcgttctgcttccagcagacgaagacagcagagcagaaatcgaagtactcagtcacaagacgtagcacgggtgagctcggcctcggattataacagttcagagctgaaaaccgcctgtcggaagcacgagctttacgtttcattccaggatctgggctggcaggactggatcattgctccgaaggggtatgctgccaactattgcgatggagagtgttcatttccactcaatgcacacatgaacgcaaccaaccacgccatcgtacagaccctcgttcacctgatgaatccagaatacgtgcccaaaccatgttgcgcccccaccaaactgaacgccattagtgtcctgtatttcgacgataacagtaacgtgattctgaagaagtaccggaatatggtggttagagcctgtggttgccactag

SEQ ID NO: 109872 - DNA, 1431 bp, Artificial Sequence
  Description of Artificial Sequence: Synthetic coding sequence
gccgccgggggccagctgctgggtgatggtgggtctcccggaaggacagagcagcctcccccgtccccccagtcaagtagtggttttctgtatagacggcttaaaacacaagagaagagagagatgcagaaagaaattttgtcagtgctgggattgccacaccgcccacgccccctccacggattgcagcagccccagccaccggcactgcgccagcaagaagagcaacagcaacagcagcagctcccacgaggcgagccaccccctgggagactgaagtccgccccgctattcatgctcgacctgtacaatgcactgtctgccgataacgacgaagatggtgcctcagagggggagagacaacagtcgtggccccatgaagctgccagctcaagccagcgccggcaacctcctccaggcgcagctcatcccctgaatcgcaagtctctgctggcaccagggtccgggtcgggcggggctagcccgctgacttccgcccaagacagcgccttccttaatgatgccgacatggtcatgtcattcgtgaacctggtcgaatatgacaaggaattcagtcctaggcagaggcaccacaaagagttcaaatttaatctatcacaaatccctgaaggggaggtggtgacagccgccgagttccgtatttataaggattgcgtgatgggtagcttcaagaaccagacatttttgattagtatataccaggtcctgcaagagcatcagcatagggactccgacctctttcttctcgataccagggtggtgtgggcctcagaggaaggatggctagagttcgacataaccgccacaagtaatttgtgggtcgtcacaccacagcataacatgggccttcaactgtctgtagttactcgagacggcgtgcatgtccatccccgtgccgctggtctcgtgggccgcgacggcccttatgataagcagcccttcatggttgctttttttaaggtctcagaggtgcacgtccggactactcgctctgcttccagtcggcgcaggcaacaatctaggaatcgctctacacagtcgcaggacgtggcacgagttagctctgcctccgactataatagttcagagctcaaaacagcatgcagaaagcacgagctgtatgtgagtttccaggacttgggatggcaggactggatcattgcccccaagggctatgccgccaattattgtgatggcgaatgttcctttccgttaaatgctcacatgaatgcaacaaaccacgcgatcgttcagaccctggtacatcttatgaaccccgagtacgtgcctaagccatgctgcgcacctacaaaactgaatgcgatttcagtactttatttcgatgataattctaatgtgatattgaagaagtaccggaacatggttgttagggcttgtgggtgtcattag

SEQ ID NO: 109873 - DNA, 2505 bp, Artificial Sequence
  Description of Artificial Sequence: Synthetic coding sequence
atggaggagaaaacccaaatcaagacgtttctgggctccaaactgcccaagtacggcacaaagtcagttcgctccactttgcagccgatgccaaatggtacgccggtgaatctactcggtacctctaagaatagcaatgtgaagagctacatcaagaacaacggctctgattgtccaagcagccactccttcaactggcgtaaagctaacaagtaccaactgtgtgctcagggtgtggaggagccaaataatactcagaatagccacgataaaataatcgatcctgaaaagcgggtacccacccagggaatgttcgacaaaaacgggattaaggggggccttaagtccgtgtctttatttacttccaagctcgcgaaaccatcaacaatgttcgtatcgtcgaccgaagagcttaaccagaagtctttttcaggcccaagcaacctgggcaagttcacgaagggtactctgctgggtcgtacatcttactcctcaatcaacacacctaagagccagctgaatggcttttacggcaatagatcggccgggtcaatgcaaagacctcgggccaatagctgcgctacacgcagctccagtggagagagccttgcccaaagtccggactcctctaagtctatcaattgtgaaaaaatggtccggagccaaagtttttctcattccattcagaattcattcctccctcctagtagcatcactagatcacacagctttaacagggccgtcgatctaactaagccttatcagaaccagcagctgagcatccgggtgcctttacgcagctctatgcttactcgaaatagccggcaacctgaggtgctaaatggcaatgaacaccttggttatggcttcaataggccatacgcggcagggggcaagaaacttgcacttcctaatgggcccggggtaacaagtactctcggttaccggatggtccacccctccctgctgaaatctagcagatcccccttctccggaacaatgacagtggatggcaataagaacagccctgctgacacttgcgtggaggaggacgctactgtgttggcaaaggaccgcgctgccaacaaggaccaggaacttatcgaaaatgagtcctaccggacgaaaaacaaccaaactatgaagcatgacgcgaagatgcgttacctttccgacgatgtggatgatatttctttatcatcattgagctcatcagacaagaatgacttatcagaggatttctcagatgactttatcgatatcgaggattcgaataggacacggatcacacctgaagaaatgagcctcaaggaagagaagcacgaaaacgggcccccccaggatatgtttgattcaccaaaagagaatgagaaggccttctcaaaaaccgatgaatggattgacatcagcgtttcggacagaagcgagtgcactaagcatacctctggaaacaatcttgtttcccctgacaccgattaccgtgctggttcttccttcgaattgagcccttcagattcttcagatgggacatacatgtgggatgaggaaggcctggagcctatcgggaatgttcacccagtgggcagttacgaatccagtgagatgaattccatagacatactaaataatctcgaaagttgtgacctcgaagatgatgacctcatgctagacgtggacctgccggaggatgcaccattagagaatgtggagtgtgataacatgaaccgatttgaccgcccggacaggaacgttcgccagccccaagagggcttttggaagaggccacctcaacggtggtcgggtcaggagcactaccacctgtctcatcctgatcactatcaccaccatggcaagtcagacctctcccgcggaagtccttatcgagaatcacccctcggtcactttgagagctatggcggaatgccattctttcaggctcagaagatgttcgtcgatgtgcccgagaatactgtcattctggacgagatgactttgcgacacatggtgcaggactgtaccgccgtcaagacccagctgctgaaactgaagagactgctccaccagcatgacggctccggctccctgcacgatattcagcttagcctgccgagctcccccgagcccgaagatggcgataaagtctataagaatgaggacctgctgaacgagattaagcagctgaaggacgagatcaaaaagaaggatgaaaaaattcagctcctagaactccaactggccacacagcacatctgtcaccagaaatgtaaagaggaaaagtgtacatatgccgacaaatatacacagacaccctggcgcagaatccctggcgggtactctgcccccagcttctctccctggcaaggtagttttcaggggatcccccgcaccgtgccgccccatcgaaggcagacttcctctacaaccgcatttcagcagccttcccagacacaccgctcacacccaggaaaaacaaataaagcaacgacgtatcggggtcctcaatag

SEQ ID NO: 109874 - DNA, 1599 bp, Artificial Sequence
  Description of Artificial Sequence: Synthetic coding sequence
atgcctcagctgtatatttacatccgcctactgggtgcataccttttcatcatttcaagggtgcagggtcagaatctggatagtatgcttcacggtacagggatgaagagcgattccgaccagaagaagtccgagaatggcgtgaccctcgccccggaagataccttgccatttctaaagtgctattgttctggccattgcccggatgacgccatcaataacacatgcattaccaacggccactgcttcgccattattgaggaggatgaccagggtgagaccaccctggcatcggggtgtatgaaatatgaaggaagtgattttcaatgcaaagactcccccaaagcccagctgcgtcggacgattgagtgctgcagaacaaacctctgtaaccaatatctgcaaccaactctgccccctgtggtaatcggccccttcttcgatggttctataagatggttagttttgctcatttccatggcagtgtgtattatagctatgattatttttagttcctgcttctgctacaagcactattgtaagtctatctcttcgcgacgacggtacaatagagatctggagcaggatgaagcgtttatcccggtgggagaatctctgaaggatcttatcgaccagagtcagagcagtgggagcggttccggcctgcccctgctggtgcagcggactattgcaaaacaaattcagatggtaagacaagtgggcaaaggccgctatggggaagtgtggatgggcaagtggaggggggagaaggttgccgtgaaagttttttttacaactgaggaagcctcctggtttagggagactgagatctaccagaccgtgctgatgcgtcacgaaaacattttagggttcattgctgccgatatcaaaggaaccggaagttggacccagctgtacctcatcacagactaccatgagaatggatcactgtatgacttcttgaagtgcgccaccctcgacactagagccttattgaaactggcgtacagcgctgcctgcggattgtgccacctgcatactgaaatatatggcacacagggaaaacctgcgattgcccatcgcgacctgaagtccaaaaatattctgattaaaaaaaacggcagctgctgtattgctgatctagggctagccgtcaaattcaattctgataccaatgaggttgacgtgcctctgaacacaagagttgggaccaagcggtatatggccccagaagtcttggacgagagtctgaacaagaaccattttcagccgtacattatggctgatatttactccttcggactgattatttgggagatggctcgacggtgtattactgggggcatcgtcgaagagtaccagctcccctactacaacatggttccatcggacccctcttacgaggatatgcgcgaggtggtgtgcgtcaagaggctgagacccatcgtgtcgaatcggtggaactccgatgaatgcctccgcgctgttctgaagcttatgagtgagtgctgggcacacaatccagcatcacggctgactgccctgcggattaagaagaccctcgccaaaatggttgagagccaggacgtgaagatctag

SEQ ID NO: 109875 - DNA, 3117 bp, Artificial Sequence
  Description of Artificial Sequence: Synthetic coding sequence
atgaccagtagcttgcagcgaccctggagagtcccctggctgccatggacgattcttctcgtcagtacagccgctgcctcccagaatcaagaaagactgtgcgcattcaaggacccgtaccagcaagatcttgggataggggagtcaagaatcagccacgagaatggaactattctctgttcaaaaggttccacctgttatggtttgtgggaaaaaagcaaaggcgatattaatttggtgaagcaaggatgctggtcccacatcggagatccacaggaatgccactacgaagagtgtgtggtgaccacaacaccgccctcaattcagaatgggacttacagattctgttgctgttccaccgatttgtgtaacgtaaatttcaccgagaacttcccccccccagatacgacacccttgagccctcctcacagtttcaacagagatgagactatcatcattgctctggcttcagtcagtgtccttgcagtgttaattgtcgcactgtgcttcgggtataggatgctgactggggaccggaaacaggggttacattccatgaatatgatggaagcagcggccagcgaaccttctctcgacctcgacaatttaaagcttcttgagcttattggccgcggtaggtacggagccgtctacaagggctccctcgacgagaggcctgtcgccgtcaaagtgttcagtttcgcaaacaggcagaacttcatcaatgagaagaacatatatcgagtgcctctaatggagcatgataatattgcacggttcatcgtgggtgatgaacgggtcaccgcagacggcagaatggaatatctcctggtcatggagtactatccgaacggatccctgtgtaaatacctgtctctacacacatccgactgggtaagtagttgtcgcctggctcactctgtgactcgaggcctggcctacttgcatacggagctccctcggggcgaccattacaagcctgctatttcacacagagacctgaactcccgcaacgtcctggtgaaaaatgatggcacttgcgtcatatcggacttcggattgagcatgcgcctaaccgggaaccgtctggtgcgcccgggagaagaggacaatgcagcgatctcagaggttggaactatacggtatatggccccagaagtgctcgagggagctgtcaacctgcgcgattgcgaatccgccctgaagcaggtggacatgtacgccctgggtcttatctactgggaaattttcatgaggtgcacagacctcttccccggggagtccgtgcccgagtatcaaatggcttttcaaacagaggtcgggaaccaccctacatttgaggacatgcaggttctagtctcccgagagaagcagagacccaaatttcccgaggcatggaaggagaacagcctcgcagtcaggtctcttaaagaaaccatcgaggactgctgggatcaagatgctgaagcccgcctgacagcccagtgtgccgaggagcggatggccgagctaatgatgatatgggagcggaacaagtcagtttctccgaccgttaaccctatgagcacggctatgcagaacgagcggaacctgagccacaatagaagggtgccaaaaatcggaccgtatcctgattactcctccagctcatacatcgaagacagtattcaccacactgactccattgtgaagaatatcagcagtgaacactccatgtcatctacccctttgaccataggcgaaaagaaccggaactctatcaactacgagcgccagcaggcacaggcccgcattccatcccccgagacatccgtgacgagcttgagtacaaatacgacaacaactaacacaactggcctgactcccagcacaggaatgacaactatctcagagatgccctaccccgacgagaccaacctgcatactacaaacgtcgctcagagcattgggcccactcctgtgtgtctccaactgaccgaagaggatctggagaccaataaactggacccaaaggaggtggataagaatctgaaggagtcctccgacgaaaacctgatggagcattcactcaaacagttttctggccccgaccccctgtctagtacctcctctagcctgttataccccctgatcaagttagctgtggaagcaacagggcagcaggacttcactcagacggctaatggccaggcttgtctgatccctgatgtgcttcccacccagatttatcctcttccaaagcagcagaacctacccaaacgcccaacctcattgccgctcaatacaaagaacagcacgaaggagccgagacttaaatttggatccaaacataagagtaacctaaagcaggtggagacaggagtggccaagatgaacaccataaatgcagcagagccccacgtcgtcacagtgaccatgaatggggtggccggcaggaaccacagcgttaactcacacgcggccacgacccaatacgctaacggcacagtcctgtctggacagaccactaatatagtgacacatagggcccaagaaatgctccagaatcagttcatcggagaagacacacgcctaaacattaacagctcgcctgacgagcacgagccccttctccgtagggaacaacaagcaggccacgacgaaggggtgctggaccgcttggtggatcggagagaacgtccactggaaggagggcggactaattcaaataataataactccaatccatgcagcgagcaggatgtactcgcccagggagtgccatccaccgctgctgacccaggcccatcgaaacctcgaagggctcagagacctaattcgcttgatctgtccgccaccaacgtcttggatggttcaagcattcaaattggcgaatctacgcaagacggaaaaagcggaagtggtgagaagattaagaagcgagttaagactccatactcccttaaacgatggcgacccagtacctgggtgatctccactgagtctttagactgtgaggtgaataacaacggctctaatagagctgttcatagtaaatctagtactgcggtctacctcgctgaaggcgggacagcgaccactatggtttctaaagatattgggatgaactgcctgtag

SEQ ID NO: 109876 - DNA, 2337 bp, Artificial Sequence
  Description of Artificial Sequence: Synthetic coding sequence
atgtcctccggagcaaaagagggaggaggaggctcaccagcgtatcatctgccccacccccacccacatcctccacagcatgcccagtatgtgggcccatatcgcctggagaaaactctcggaaaaggccagactgggctcgtaaagctcggcgtacactgcattactggccagaaggtcgcaatcaaaattgtaaatcgagagaagctttctgagtctgtgttgatgaaggtcgagagagagatagcaatcttaaagctgatcgaacacccacacgttttaaaactccatgacgtgtatgagaacaagaagtatctctaccttgtgctagagcatgtatcaggaggtgagttatttgattacctggtgaagaaagggagactgacaccgaaggaggccaggaaatttttccggcagattgtgtccgcactcgatttctgccactcatatagcatctgccaccgcgacctgaagcctgagaacctgctgctagacgagaaaaacaatatcagaatcgctgatttcggaatggcctcactgcaggtgggcgacagcctcttggagactagctgtggatctcctcactatgcctgtcccgaagtcattaagggcgaaaaatacgatggtaggagagcagacatgtggtcctgtggcgtgatcctcttcgcactgctggtgggggcattacctttcgacgacgacaatttacgccagctgcttgagaaagtgaagagaggagtgtttcacatgccacatttcatcccgcccgactgccagagcctgttacgcggaatgattgaggtggaaccagagaagcggctgtctcttgaacagattcagaaacatccctggtacctagggggaaagcatgagcctgatccctgtctcgagccagcccctggacggagagtggcgatgcgttcgttaccatccaacggtgagctcgaccccgacgtgctagagtctatggctagtctcggatgcttccgagacagggagaggctccaccgtgaattgcgctctgaagaagagaaccaggaaaaaatgatatattatctgctgttagataggaaagagagatatccatcatgtgaagaccaggatctgccccccagaaacgatgtcgacccgccgaggaaacgggttgacagccccatgctaagcaggcacggcaaaagacgtcccgagcggaagtccatggaggtcctatcaataactgacgccggcgggggagggagccccgtccccactcggcgtgccttggagatggcccagcactcgcagcggagcaggagcgttagtggcgcgtcaaccgggctctcctcaagccccctttccagtcctcgctcacctgtcttctctttcagccccgaaccaggtgctggcgatgaagcaaggggcgggggctctccgactagcaagactcagaccttgccttccagagggccaagaggcggaggtgctggagagcagcctcctcctccttctgcccggagcacccccctgccaggacccccaggaagcccacggtcatctggtggaaccccccttcatagtccgcttcacaccccccgtgcgtctcccacgggcacgcctggaacaacacctcctccctcaccggggggaggggtggggggggccgcttggaggagtcggctcaactctatacgaaattcttttctagggagccctcggtttcatcgtcggaagatgcaggtccccacagcggaagagatgagtagtctgacgcccgagtccagcccagaactcgcaaagaggagctggttcggtaattttatatcgctggataaagaagagcagatcttcctcgtattaaaggataagccactttcctccatcaaggccgacatcgtgcatgcatttttgtccatcccctcactgagccactcagtcctgagtcagacatcgtttagagcggaatacaaggcctccggtggccccagcgtgtttcagaaacctgttagattccaggtagacatatcatcttctgaaggtcctgagccgtcaccccggagagacggctccggtggtggggggatttacagtgttacattcactttgatatctggcccaagccggcggttcaaacgggtcgttgagaccatccaggcacagttactgtctacgcacgatcagccctccgtccaggccctggctgatgaaaagaacggagctcagactaggcccgccggggcaccccccagatcgctgcaaccaccgcccggtaggccagatccagaactctcctcctcgcctcgccgcggtcctcctaaggataaaaaactgctcgcaacaaacggcacccccctcccctag

SEQ ID NO: 109877 - DNA, 1422 bp, Artificial Sequence
  Description of Artificial Sequence: Synthetic coding sequence
atgcgctccctgccctcaaatggtgaactggatcccgatgtgctagagagcatggcttcccttgggtgttttagggacagagagagactgcaccgcgaattacggtcggaggaagaaaatcaagagaagatgatctactaccttttgctcgatcgcaaggagaggtacccatcttgcgaagaccaagacctccccccaagaaatgacgttgaccctcctagaaagagggtagattcgcccatgctcagtaggcacggaaagcgacgccctgagaggaaaagtatggaagtactgtcaatcaccgatgccggcgggggcggcagtcccgtgcctacgaggagagcactggagatggcacaacactcacagagatcgcgcagtgtcagtggcgcctccacagggctaagctcctctcctttgtcttcccccaggtcccctgttttctcattcagcccagagcctggtgctggggatgaggcgcgcggtggtgggtctcccacatcgaaaacacagaccctgcctagtcggggaccgagggggggaggggccggtgagcagccgcctcctccttcagcgcggagcactcccttacccggacctccagggagccctagaagcagcggtggaacccccctgcactcgccgctgcacactccacgtgcctcccctacagggactccaggaacaaccccacccccgagccccggggggggggtcggcggcgctgcatggcgaagccggctgaactcgatcagaaattcgttcctcgggtcccccaggttccacagacgaaaaatgcaggtaccgacagcagaagagatgagctctttgacccctgaaagcagcccagaactggccaagcgaagttggttcgggaacttcatatctctggataaagaagagcagatctttctggtgctgaaggataagcccctgtcttctattaaagccgacattgtccacgccttcttgtccatcccgtctctgtcgcacagtgtgctctctcaaacgtcttttagggctgagtataaagccagcgggggccccagcgtttttcaaaaacccgtgcgattccaagtagatattagcagctccgaagggcccgagccgtcgccaaggcgggatggaagcgggggcggcggcatctactctgtgacctttactctgatatccggcccctcaagacggttcaagcgagttgtggagaccatccaggctcaactcctcagtacccacgatcaaccttccgtgcaggcgctcgctgacgagaagaacggcgcccagacccgcccagcaggggctccccccagatctcttcaacctcctcccggaagacccgatcccgaactcagcagcagccctcgcagagggccccccaaagataagaaactgttggccaccaatggaaccccccttccttag

SEQ ID NO: 109878 - DNA, 1422 bp, Artificial Sequence
  Description of Artificial Sequence: Synthetic coding sequence
atgaggtcattaccaagtaacggcgagctggatcccgacgttctggagagcatggcctcactggggtgcttcagagacagagagcggttacaccgggagttgcgtagcgaagaggaaaatcaggaaaaaatgatttattacctcctactggacagaaaggagcgctacccttcgtgtgaggatcaggatcttcctccccgtaatgacgtggacccccccaggaaacgcgtggactctccgatgttgagtaggcacggaaagagacgtcctgaacgaaaatccatggaggtcctgagtatcacagatgccgggggcgggggttcaccagtgccaacaagacgcgccttggaaatggcacagcactctcagcgctccaggtctgtatccggagcttcaaccggcttatctagctccccgctgtcgtccccaagaagtcccgtgtttagtttttcaccggaacccggggccggcgacgaagccaggggcggcgggagtcccacttccaagacgcagactcttccaagccgcggccccaggggtgggggagcaggggagcagccacctccgcctagtgccaggagcacgcctctacccgggccgccagggagtccacggtctagcggagggaccccactgcacagtccattgcatactcctagagcctctcccactggtactccagggactacaccccctccctcacccggaggcggagttggaggcgcagcttggcgttcccgcttgaacagtattaggaatagcttccttgggtcccctcgctttcacagacgaaagatgcaggtgccaacggctgaagaaatgtcgtcccttaccccagaaagttctcctgagttggcaaagaggtcctggttcgggaactttatcagccttgataaggaggaacagatattcctcgtcctgaaggataagccgttatcctccatcaaagccgacatcgttcatgcctttctgtctatcccttctctttcgcactccgtgctgagccagactagctttagagcagagtacaaagcctctggaggaccatcagtatttcaaaaaccagttcgtttccaggttgatatcagtagctctgaagggcccgagccttcaccacggagagacggctctgggggcggaggaatctactccgttacgttcactctgattagcggaccttcgcggcggttcaaaagggttgtcgagaccattcaagcacagctgttgtcaacgcacgaccagccttcagtgcaggctcttgctgacgaaaaaaatggggcacaaactagacccgcaggtgccccaccgcgaagcttgcaacctccccccggaagaccagatccagagctgagctcttcccctcgtcgagggccccctaaggacaagaaactgctggccaccaacggcactccccttccctag

SEQ ID NO: 109879 - DNA, 2976 bp, Artificial Sequence
  Description of Artificial Sequence: Synthetic coding sequence
atgcgtcatagagtgtgcagaggtcggtccggtcaaggacggaggagaagctccgtgattccatggcccgtgcctaagcacgtggggtgggtcgtactcctcggctgtggagggagcggtacttccatactggtggtttcaattgttggctctggactgatcaaagctatggctcccgccgagatcctgaatggtaaggaaatctcagctcagatcagagcccggctgaaaaaccaagtgacccaactgaaggagcaggttcccgggtttacgccccgactcgcaatcttgcaggtcggaaatagggacgattccaatctctacatcaatgtgaaactgaaagcggcggaggagataggcatcaaggctactcacattaaacttccacgaacaacaactgagagtgaggtcatgaagtatatcaccagtctcaatgaagactccaccgtgcatggcttcctggttcagctacccctggactcagagaactcaattaatacagaagaggtgatcaatgctatcgccccggaaaaggacgttgacggattgaccagcatcaatgctggcaaattagctcgcggagaccttaacgactgctttatcccctgtacaccaaaaggctgtttggagttgatcaaggaaacaggcgtgcctatcgctgggagacatgctgtagtggtgggtagatccaaaattgtcggggcaccaatgcatgacctgttactgtggaacaatgcaacagtcactacctgccatagcaaaacagcacatctcgacgaggaagtaaataaaggagacattctcgttgtggcgactggacagcctgaaatggtcaaaggagagtggataaaacctggggccatcgttatcgattgtgggatcaactatgtgcctgacgataaaaaacccaatggccggaaggtcgtcggagacgtagcctatgatgaagccaaggaaagggcgtcttttattacccctgttcccggaggcgtgggacctatgactgtggccatgctgatgcagtccacagtggaaagtgcaaaacgctttctggaaaagtttaagcccggcaagtggatgatacagtacaataacctcaacctgaaaacccctgttccgtccgacatcgacatatccaggagctgcaaacccaagcccatcggcaagctggccagggagattggcctgttaagcgaggaagtcgagctgtacggcgagacaaaagcgaaagtgctcctgtccgcccttgagcgcttgaaacatagacctgacggcaaatacgtcgtcgtgacgggaataacccccactccattaggagaggggaagagcacaaccacaatcggcctagtacaagcacttggcgcgcacctatatcagaacgtgtttgcctgcgtgagacagccttctcaaggacccacctttggaatcaaggggggcgccgccggcggaggatatagccaggtgattccaatggaggagttcaatctccatctcacaggtgacatccacgcaataaccgcggccaataacctggttgccgccgccatcgacgccaggatattccacgagctcacccagaccgacaaggcactattcaacagactggtcccaagcgtgaatggggttaggaggttctcagacatccagatcagacggctgaagaggttgggcatcgaaaagacagatcccaccacccttaccgatgaagagatcaatcggttcgcaagactggacatcgatcctgagactattacctggcaaagggtccttgacacaaatgataggtttctgcgtaagattactattggccaagcaccaaccgagaagggccacactagaacagctcaatttgatatcagtgttgccagcgaaatcatggcagtcttagcattgaccacatcacttgaggacatgcgggagaggctgggtaagatggttgtggccagctccaaaaagggggagcctgtgagtgcagaggacttaggcgtctccggcgccctgacagtgctcatgaaggatgcaatcaagccgaacctgatgcagactctggaggggacgcctgtgtttgtgcatgccggaccatttgccaatatagcacacggaaattcctctataatcgccgacaggattgctctgaaactcgtgggaccggagggctttgtagtgactgaggctggttttggagcggacatcggcatggaaaaattttttaacattaagtgccgatattccggcctttgtccccacgttgttgtgctggttgctaccgtcagggccttgaagatgcacggtggcggaccaacagtgactgcgggattgccgctcccaaaggcctacattcaggagaacctggagttagtagagaaaggtttctctaatctgaaaaagcaaatcgagaacgctagaatgttcgggattccggtcgtcgttgcagttaacgccttcaaaactgacaccgaatcggaactggatcttatctcccgactaagtcgggaacatggcgctttcgacgccgtgaagtgcacacattgggctgaaggcgggaaaggtgccctcgcattggcccaggccgtccagagggctgctcaggctccttctagtttccagctgctgtacgatttgaaattaccagtggaggataagatcagaatcattgcccaaaagatttacggcgctgacgatatagagcttctgccagaggctcagcacaaggccgaagtatatacgaagcaaggttttggaaacctgcctatctgcatggccaagacgcacctcagtttatcgcacaatcccgagcagaaaggggtgcccactggcttcatactccccattagagacataagggcctcggttggcgctggttttctgtatcccctcgtcgggacaatgagcacaatgccaggactacccactcgaccttgcttctatgacatcgatctggaccccgagactgaacaagtgaacgggttgttctag

SEQ ID NO: 109880 - DNA, 1176 bp, Artificial Sequence
  Description of Artificial Sequence: Synthetic coding sequence
atgttttcaccctggaagatttccatgtttctgtctgttcgggaagactccgtcccaacaaccgcctcgttttccgcggacatgttgaacgtcactttgcaggggccaacacttaatgggacgtttgcccagagcaagtgccctcaggtggagtggctgggctggttaaacaccatacagccaccctttctgtgggtgttatttgtcctcgctaccctggagaacatcttcgtcctctctgtgttctgtcttcataagagcagttgcactgtagccgagatttatcttggtaatctggcggccgccgacttgatcctggcgtgcggtcttcctttttgggccattaccatcagtaacaatttcgattggctgttcggagagaccctgtgtagagtcgtcaatgccattatctcaatgaacttgtactcaagtatctgttttctgatgctggtaagcatcgacaggtatctggccctggtaaaaactatgtccatgggtcggatgcggggggtccgatgggctaagctgtactcactggtgatttgggggtgtaccctcctgctgtcttccccgatgttagtcttccggaccatgaaggagtacagcgacgagggccataatgtgacggcttgcgtgatttcctaccctagtctaatctgggaggtctttacaaacatgcttctgaatgttgtcggcttcctgttaccgctgtctgtcatcactttttgtaccatgcagattatgcaggtgctccgtaataacgagatgcaaaagtttaaggaaatccaaaccgagcggcgggccacagttctggtgctggtcgttttactgctctttataatatgctggctcccatttcaaatttcaactttcctggatactctccaccggctgggcatactgtcatcttgtcaggatgagagaattattgacgtgattacacagattgcaagcttcatggcctactcgaattcatgcttgaaccctcttgtctatgtgatcgtgggaaagcgatttagaaaaaaatcctgggaagtgtaccaaggcgtatgtcagaaaggaggatgccggtccgaaccgatccagatggaaaacagcatgggcaccctgcgaacaagcatctctgtggagcggcagatacacaagctgcaagactgggcaggaagtcggcaatag

SEQ ID NO: 109881 - DNA, 1095 bp, Artificial Sequence
  Description of Artificial Sequence: Synthetic coding sequence
atgctcaacgtcacactgcaggggccaacgttgaatggaactttcgcccagagcaaatgccctcaagtggaatggctgggctggcttaacacaatccagccaccctttctttgggttctgttcgtgctggctaccttggagaacatctttgtgctcagcgtgttttgtctccacaaaagctcttgcacagtggctgaaatctacctgggcaatctggcagctgccgatctcatcctcgcttgtgggctgcccttttgggccattactatctcaaataattttgattggctgtttggcgagaccctttgccgtgtggtcaatgctattatctcgatgaacctttattccagcatatgctttttaatgttagtatccatcgatcgctatctagccctcgtaaaaaccatgagtatggggcggatgcgaggagttcggtgggcaaagttatattctttagtgatttggggctgcactctcctgctgagctcgcctatgctggtctttaggacaatgaaggagtactctgatgagggccataatgtgaccgcttgtgtgatcagctacccgagcctgatctgggaagtgtttacaaacatgcttcttaatgtcgttggttttttgctgccattgtctgttatcaccttctgcaccatgcagatcatgcaggtgctgaggaacaatgaaatgcagaaatttaaggaaatccaaacagagcgacgcgcaacagtgcttgtgttagtggttcttctccttttcattatttgttggctgcccttccagatttcgacctttctggatactctgcatagactcggcatcctctcctcttgccaggacgaacgaatcattgacgtcatcacacagatcgccagtttcatggcctattctaacagctgtctgaatcccttggtgtatgttattgtgggcaaaagattcaggaaaaaaagttgggaggtgtatcagggcgtctgtcaaaaaggtggctgcaggtccgagccaattcaaatggagaactcaatgggcaccctgaggacctccattagtgtcgaacgccagatccacaaactgcaggactgggctggttcgcgtcaatag

SEQ ID NO: 109882 - DNA, 1095 bp, Artificial Sequence
  Description of Artificial Sequence: Synthetic coding sequence
atgttgaatgttactctccagggcccaaccctgaatggcacgttcgcccagtccaagtgtcctcaagtggaatggctcggatggttaaatactatccagcctccgttcttgtgggttctattcgtgctcgctactttagagaatattttcgtactatccgtattttgccttcacaagagttcctgtaccgtcgcagaaatttatctagggaatctggccgccgctgacctcatcctggcttgcgggctacctttctgggctatcactatctcaaataattttgactggctgttcggcgagaccctgtgtagagtggtcaatgccataatctctatgaatctttattctagcatctgcttcttaatgctggtgtctattgacaggtatctggcactggtgaaaacaatgtccatggggcgaatgcggggagttagatgggccaaactgtattctcttgtaatttggggctgtacactgttgttgagcagccccatgctagtctttcgtactatgaaggaatactccgacgagggtcataacgtgactgcctgcgtgatctcatatccttccctgatatgggaggtgttcacaaacatgctgctcaacgtcgtgggtttccttttaccactgtccgtcatcactttttgcacaatgcagattatgcaggttcttcgcaataatgagatgcagaagtttaaggagatccaaacagagcggagagcaacggtgctggtgctggtggttttgctcctttttatcatttgttggctgccctttcagataagtaccttcctggacaccctccaccggctcggcatcctgtcaagttgtcaggacgagcgcattatagatgtgataacacagattgcatcattcatggcctactctaatagttgcctgaaccctctggtgtacgtgatagtcggtaagcgatttaggaagaaaagctgggaggtgtaccagggggtttgccagaaaggcggttgtaggtctgaacccattcagatggaaaactccatgggaacacttcgcacaagtattagcgtggagagacagatccataagcttcaggactgggccgggtctaggcagtag

SEQ ID NO: 109883 - DNA, 1176 bp, Artificial Sequence
  Description of Artificial Sequence: Synthetic coding sequence
atgttctccccatggaaaatctctatgttcctgtccgtcagggaggacagcgtgcccacaactgcaagtttcagcgctgacatgctgaacgtcaccctgcagggcccaacactcaatggcacttttgctcagtctaaatgtccccaggtggaatggttgggctggctgaacacgatccagcctcccttcttgtgggtgctgttcgtcctggctactctggagaacattttcgtcttgtcagtattctgtcttcacaagtcatcttgtaccgtggcagagatatacctcggtaacctagccgcagctgatttgatcctcgcttgtggcctaccattctgggccataacaatcagcaataattttgattggctgttcggcgagacactgtgccgcgtcgttaacgcgattatttccatgaatctgtatagcagcatctgtttcctgatgttagtgtcaatagatagatacttggcactggtcaagaccatgtccatgggacgcatgcggggggtgcgctgggcgaaactgtactctctagtaatctgggggtgcacactcttactgtcaagtcctatgttggttttccgcacaatgaaagaatatagtgacgaaggccacaatgtcaccgcttgtgttataagttacccgtccttaatttgggaagtgttcacgaatatgctgcttaatgtcgtagggtttctgcttccactgagtgtcatcacattctgcacaatgcagattatgcaggttctacggaacaacgagatgcagaaattcaaagaaatccagaccgagcgccgcgccaccgtcctcgtcctcgtcgttctattgctgttcatcatatgttggctgccatttcagatctctacattccttgataccctccatcgccttgggatactgtcttcatgtcaagacgaacgcattatcgacgtcatcactcaaatcgcaagttttatggcttactccaacagttgtctgaatcccctagtttatgtgattgtggggaagcgctttcgaaagaagagctgggaagtctaccagggcgtatgccagaagggaggatgtcggtccgagccaatccagatggaaaattcgatgggcactctgagaactagtatctcggtggaacggcaaatacacaagctccaagactgggccgggtcgcgtcagtag

SEQ ID NO: 109884 - DNA, 684 bp, Artificial Sequence
  Description of Artificial Sequence: Synthetic coding sequence
atgggaggaaagctttctaaaaagaagaagggatacaacgtgaatgacgagaaagccaaagaaaaggacaagaaggcagaaggtgcagccacagaagaagagggcactccaaaggagagcgagccccaagcggctgctgagccggcggaagcaaaggaagggaaagaaaagcctgaccaggacgcagagggcaaagcagaggaaaaagaaggggagaaagacgctgctgccgctaaagaggaagctccgaaagcagaaccagaaaaaactgagggagccgcagaggccaaggctgagcctccaaaagccccagagcaggagcaagctgctcctggccccgcagctgggggagaagcccccaaggcagcggaagctgccgcagcgcctgcggaatccgccgctccggcagctggtgaagagccctctaaggaagaaggcgagccaaaaaaaacagaggcccccgctgcacctgcggcgcaggagacaaaaagcgacggagcccctgcgtcagatagtaaaccagggagctcggaagccgctccaagtagtaaggaaactccagctgccactgaagcacccagttctacgcccaaggctcagggccctgcagcctccgcagaagaacccaaaccagtggaagcacccgcagccaactcggaccagacagtgaccgtgaaggaatag

SEQ ID NO: 109885 - DNA, 522 bp, Artificial Sequence
  Description of Artificial Sequence: Synthetic coding sequence
atggggggaaagctttccaagaaaaagaaagggtataacgtgaacgatgaaaaggctaaggaaaaagacaaaaaagcagagggggccgccacagaagaagaaggaacccccaaagagagcgagcctcaggccgccgcagagccagcagaagccaaggaaggcaaagaaaaacccgaccaagacgctgaaggcaaggccgaggaaaaagaaggagaaaaagacgccgctgccgcgaaggaggaagctcctaaggccgaacccgacaaggaggagggggaacccaaaaagacagaagcccccgcagcgcctgccgcacaggagaccaaatctgatggggcaccggcatccgacagcaaacccggaagctcagaagccgccccttcgtcgaaagagactccggctgccacagaagcccccagctcaacccccaaggcgcaaggcccagctgcatccgctgaggagccaaagccggtcgaggctccggcagctaattcggaccagacagtgacagtgaaagaatag

SEQ ID NO: 109886 - DNA, 543 bp, Artificial Sequence
  Description of Artificial Sequence: Synthetic coding sequence
atgggctgtggcggatcccgggccgatgccatcgagcccaggtactacgaatcttggactcgggaaaccgaaagcacctggctgacctatactgacagtgatgcacctccttcggccgccgcgcctgattctggcccagaggcaggcggcctccactccgtacttgaggcagagaaatccaaaatcaaagcgcctacagacagcgttagtgatgaggggctgtttagtgcatccaagatggctcccctggccgttttctcgcacggtatgttggaggacggcctgcccagcaatggcgtaccaaggagtaccgcaccaggaggaatacctaatcccgagaagaaaaccaattgtgagacccagtgccctaacccccagagcctgtcatctggcccactaacgcagaagcaaaacggtctgcagaccacagaagctaagagagatgccaagagaatgccagctaaagaggtcaccattaatgtgacagactccatccagcaaatggatcgttcccgaaggattacaaaaaattgcgtcaattag

SEQ ID NO: 109887 - DNA, 438 bp, Artificial Sequence
  Description of Artificial Sequence: Synthetic coding sequence
atgggctgtggcggctctagagcagacgctattgaacctagatattatgaatcttggaccagagagacagagtctacctggttgacttatacagacagcgacgcccccccttccgccgctgcaccggacagcggccccgaggctggaggccttcacagtggaatgcttgaggatggactcccctctaacggcgtcccccgatcaaccgccccaggaggcattccaaaccccgaaaaaaagaccaactgtgagacgcagtgtccaaacccacagagcctatcgagcggcccactgactcagaaacagaacggacttcagacaacagaggccaaacgggacgcaaaacgcatgcctgccaaagaggtgaccattaacgtgaccgacagcatccagcagatggatagatcccggaggatcactaagaactgcgtgaactag

SEQ ID NO: 109888 - DNA, 165 bp, Artificial Sequence
  Description of Artificial Sequence: Synthetic coding sequence
atgggctgtgggggctcccgagcggacgctatcgagcctagatattacgagtcatggacccgcgagaccgaatcaacctggctcacttacaccgattcagatgctcccccttcagctgctgcccctgatagtggtcccgaggccggggggttgcactccggatag

SEQ ID NO: 109889 - DNA, 387 bp, Artificial Sequence
  Description of Artificial Sequence: Synthetic coding sequence
atggaatctaaggaggagagggccctcaacaacctaatcgtggagaatgtgaaccaggagaatgacgagaaagacgaaaaggagcaggtcgccaataagggagagcctctggccctgccactcaacgtgagcgagtattgtgtcccccgagggaaccgaaggcgctttagggtgcgacagccgatcctccagtataggtgggacattatgcataggcttggagaaccccaggcacgtatgcgagaagaaaacatggagagaattggcgaggaggtgcggcagcttatggaaaagttacgggagaagcagttgtctcatagcctccgcgcggtctcgacggacccaccacaccatgatcaccacgacgagttctgtctgatgccctag

SEQ ID NO: 109890 - DNA, 387 bp, Artificial Sequence
  Description of Artificial Sequence: Synthetic coding sequence
atggaatcaaaggaggagagagctctgaacaatctgattgttgaaaacgtcaatcaggaaaatgatgaaaaagacgagaaagagcaagtcgctaacaaaggcgagccgctagctttgcccctgaatgtgtcagagtactgcgtcccccgcggaaaccgacgacgctttcgggtgagacagcctattttgcagtaccgctgggatattatgcataggctaggagaaccgcaggctcgcatgcgtgaggaaaacatggagcgcataggagaggaggtccgccagcttatggaaaagctccgtgaaaaacagctgtcacattctctgagagccgtgtcaactgacccaccacaccacgaccaccacgatgagttctgtctaatgccttag

SEQ ID NO: 109891 - DNA, 306 bp, Artificial Sequence
  Description of Artificial Sequence: Synthetic coding sequence
atggagtccaaggaggaaagagctctgaacaacctgattgttgagaacgtgaatcaagaaaatgatgaaaaggacgaaaaggagcaggtagccaacaaaggggagcctcttgctctgcctctgaatgtcagcgaatattgcgtaccacggggcaaccggcgcaggttccgggttaggcagccgattctacaatacagatgggacattatgcaccgcctcggagagccccaggctcggatgcgggaggagaacatggagaggatcggggaggaggtgcgccaattaatggaaaaattaagagagtag

SEQ ID NO: 109892 - DNA, 483 bp, Artificial Sequence
  Description of Artificial Sequence: Synthetic coding sequence
atgcagaagatggtcgtctgtggggctaagtgctgtggcgatgctccccacgtggaaaatagggaggaggagaccgctaggatagggccaggagtaatggagagtaaggaggaaagagccttaaacaacctgatagttgagaatgtgaatcaggaaaacgatgagaaagatgaaaaagaacaggtggcaaacaaaggggaaccccttgctctgcctctgaatgtgagtgaatattgcgtaccccggggcaacaggaggcgctttagagtcaggcagccgatcctacagtataggtgggacattatgcaccgccttggtgagccacaggccagaatgcgagaagagaatatggaacggatcggggaagaagtgagacagcttatggaaaaattacgcgagaagcagctatctcacagcctgcgggcagtcagtaccgaccctcctcaccatgaccaccacgatgagttctgcttaatgccctag

SEQ ID NO: 109893 - DNA, 378 bp, Artificial Sequence
  Description of Artificial Sequence: Synthetic coding sequence
atggagtctaaagagaaacgcgcagttaattccttgtcaatggagaatgcaaatcaggaaaatgaggaaaaggaacaggtagctaataagggggaacctctcgccctgcctctcgatgcgggcgagtactgtgtgcctcggggtaacaggaggcgttttagggtcagacagccgatccttcagtatagatgggatatgatgcataggctgggggaaccccaggccaggatgcgagaggagaatatggagcgaattggcgaggaggtaaggcagctcatggagaagctgagagagaagcagctgtcgcacagtctacgggctgtatccacagatcctcctcatcacgatcatcacgatgaattttgcctgatgccttag

SEQ ID NO: 109894 - DNA, 363 bp, Artificial Sequence
  Description of Artificial Sequence: Synthetic coding sequence
atggagagcaaggaggagctagccgcaaacaacctgaacggggaaaatgcccagcaggaaaacgaggggggagaacaagcacctactcagaacgaggaagagtctcggcatctgggggggggggaaggtcagaagccgggcgggaacatcaggagggggcgggtccgcagattagtccctaactttaggtgggcaatcccgaatcgccacatcgaacataatgaagccagagacgacgtcgaacgattcgttggacagatgatggagatcaagcgtaagaccagggaacaacagatgaggcactatatgaggttccagacgccagagccagacaatcactacgacttctgcctcatcccatag

SEQ ID NO: 109895 - DNA, 363 bp, Artificial Sequence
  Description of Artificial Sequence: Synthetic coding sequence
atggagagtaaggaagagctagcagctaacaatcttaacggcgagaatgcacagcaggagaacgaaggaggagaacaggcacctacacagaacgaggaggagtctaggcacttaggcggcggcgaaggccagaaacccggaggaaatatcagaagggggcgagtcagaagactcgtgcctaactttcgctgggctattcccaaccgccacatcgagcataacgaggcacgggacgatgttgagagatttgtagggcaaatgatggagattaagcgcaagactagggaacagcagatgcgtcactatatgcgcttccagacaccagaacccgacaatcattatgatttctgcctcataccgtag

SEQ ID NO: 109896 - DNA, 336 bp, Artificial Sequence
  Description of Artificial Sequence: Synthetic coding sequence
atggaaaacgtgccaaaggagaataaagtcgtcgagaaagcgcctgtgcagaacgaagcacctgcccttgggggtggggagtatcaggaaccagggggcaacgtgaaaggcgtgtgggcccccccagcccccggattcggagaggatgttcctaaccgacttgtggacaatatcgatatgattgatggtgatggtgacgacatggagaggttcatggaagaaatgagggagctgcggagaaagatcagagaactgcagctgcgctatagcctgcgcatacttatcggcgaccctcctcaccacgaccaccacgacgaattttgtcttatgccatag

SEQ ID NO: 109897 - DNA, 336 bp, Artificial Sequence
  Description of Artificial Sequence: Synthetic coding sequence
atggaaaacgttcccaaagagaacaaggtggtggagaaggctcccgttcaaaatgaggctccagcactcgggggaggtgagtaccaggaaccaggaggcaacgtgaaaggagtgtgggcgccacccgctccaggcttcggagaggatgtgcccaaccggctggtcgataacatcgatatgatcgacggggatggggatgatatggagcggttcatggaggagatgagagaactgagaaggaaaatccgggagctgcagctgcggtactcccttagaatcctgattggggatcctccacaccacgatcaccacgacgagttttgcctgatgccctag

SEQ ID NO: 109898 - DNA, 378 bp, Artificial Sequence
  Description of Artificial Sequence: Synthetic coding sequence
atggatcacaaacccctcctgcaggagagacctcccgcctacaacctcgaagcaggacagggggactatgcatgcggaccccacggctatggagcaatccccgccgctcctcctccacccccctacccatacctggtgactggcatacccactcaccacccacgcgtatataacattcacagcaggactgtgactagatatcccgcaaacagcatagtcgtggttggaggctgtcccgtttgcagagtgggcgtcttggaggattgctttacctttctgggcatttttcttgccattatcctcttcccctttggttttatctgctgtttcgcgctacgcaagcgcaggtgtcctaattgtggagccactttcgcgtag

SEQ ID NO: 109899 - DNA, 297 bp, Artificial Sequence
  Description of Artificial Sequence: Synthetic coding sequence
atggatcataaacccctcttacaggagcgacctccagcatataatcttgaggctggccagggtgactacgcttgtggtccccatggatacggtgcgatacctgccgcaccacctcccccaccgtacccctacttagtcaccggtattcccactcaccaccctagggtgtacaatattcacagcagaacggtgacccggtatcccgcaaattccatcgtggtggttggaggctgtcctgtgtgccgccaccagagaagcagttggctatacacatacccactgagagtctgtacctag

SEQ ID NO: 109900 - DNA, 1536 bp, Artificial Sequence
  Description of Artificial Sequence: Synthetic coding sequence
atgagccgtgggccagaggaggtcaacaggcttacagaaagcacatacagaaacgtcatggagcaattcaaccctggattacgcaacctgattaatctgggcaagaattatgaaaaggccgtcaacgccatgatcttagccggcaaagcctactacgacggagtggccaaaataggtgagatagctacaggctcgccagtctccaccgagctggggcatgtccttattgaaatcagcagtactcacaaaaagctgaacgagtccctggatgaaaatttcaagaagtttcataaggaaatcatccacgaactcgaaaaaaaaatcgaactggacgttaagtatatgaacgccacacttaaacgctatcagacggagcataagaacaagctggaatcccttgaaaagagtcaggccgaacttaaaaagatccgacgtaagtctcaaggtagccgaaacgctctaaaatacgaacacaaagagatcgaatacgttgagacagtgacatcacgccagtctgagatccagaaatttatagccgacgggtgcaaggaagcgcttctggaagaaaaacggcggttctgttttttagttgacaagcactgcggctttgctaaccacatccactattatcacctgcaaagcgcagaactgctgaactctaagctaccgcgctggcaggaaacctgtgttgatgcaattaaagttccggaaaaaattatgaatatgattgaggagattaagactcccgcctcaacccccgtcagtgggacaccgcaagccagccctatgattgagcggagtaacgtggttcggaaggactacgacaccctctctaaatgcagtcctaagatgcctcccgccccctctggccgggcttacacctcccccctgatcgatatgttcaacaaccccgccaccgcggcccctaattctcaacgcgtcaacaactccactggaacgtcagaggacccctctttgcagcggtcagtaagtgtcgctacagggctcaatatgatgaagaagcagaaagtgaagacaattttcccccacactgcaggtagcaataaaactctcctatccttcgcccagggtgacgtgatcactttgctgatcccagaagaaaaggacggctggctctatggtgaacacgatgtgtctaaggcccgggggtggttcccttccagttacaccaaactgcttgaggaaaacgagactgaagccgttaccgtgcccacaccatcccccactccagtcaggagcatttccacagtaaacctttcagaaaactcaagcgttgtaatccccccacccgactacctggagtgcctgtccatgggagcagccgctgacagacgcgccgactccgcaagaaccacatctacttttaaggcaccagcgagcaaacctgagactgcagccccaaacgacgcgaacggaacagccaaaccgcctttcttaagtggtgagaacccattcgcaactgtgaaactccggccgactgtgacaaatgatcgctcagcccctataatccggtag

SEQ ID NO: 109901 - DNA, 4656 bp, Artificial Sequence
  Description of Artificial Sequence: Synthetic coding sequence
atggagaatactggttggatgggcaagggccatagaatgaccccagcgtgccctctgctcctcagtgtgatcctgtccctgcggctggcaactgcattcgatccagctccatcagcatgctccgctctggctagtggagttctgtacggagcatttagcttgcaagatctgttcccgactatcgcaagcggctgttcctggactttggagaaccctgatccaacaaagtactccctctatttgcggttcaatagacaggaacaagtttgtgcccactttgccccccgactccttcctctggatcactacctggtgaacttcacatgcttgagaccttcccccgaggaagccgtggcacaggctgagagtgaggtgggccggccggaggaagaggaagccgaggccgcagccggattggagctgtgtagtgggagcggacctttcacctttctgcatttcgataagaacttcgttcagctgtgtctgtccgcagagcccagtgaagcccctagactcctcgcgcccgcagccctggcgttcaggttcgttgaggttctgctgataaataacaacaattctagccaatttacctgcggcgtcctctgccgatggtcggaagaatgcggtcgcgctgctggccgagcatgtggctttgctcagccaggatgttcttgccccggggaggctggtgctggatcaacaaccaccactagtccagggcctcccgcagcccataccctcagtaacgcgctggtgcccggcggccctgcaccaccagccgaagctgaccttcattctggaagttcaaatgatctgttcacaactgagatgcgctatggcgaggaacccgaggaggaacccaaggtcaagactcaatggcccagatcagccgatgagcccgggttgtacatggcccagactggtgatccagcggcagaggagtggtcaccctggtcagtgtgcagtctgacttgtggacaaggcctccaggttagaacacgaagttgtgtgtcttctccgtatgggacactctgctctggtcctctgcgggagacgcggccatgcaataacagtgcaacgtgtcccgtacacggggtttgggaagagtggggctcttggtccctgtgctccaggagctgcggccggggatcacggagtcggatgcgcacatgtgtacccccccagcatggaggcaaagcttgtgaaggcccggagctccagactaaactgtgctccatggccgcttgtcccgttgagggacaatggctcgaatggggaccatggggaccctgcagtaccagctgcgccaacgggacgcagcagagatcacgaaagtgtagcgtggccggcccagcatgggcgacttgcactggagctctgacagatactcgggaatgtagtaatctggagtgtccagccacagactccaagtggggcccctggaacgcctggtcattatgtagcaagacctgcgatacaggctggcagaggcgctttcgaatgtgtcaagctacagggacccagggttatccttgtgaagggaccggggaggaagtgaagccgtgcagtgagaagaggtgccctgcattccatgagatgtgccgagatgaatacgtaatgctaatgacctggaagaaagctgcggcaggcgagatcatctacaacaagtgtcctcccaatgctagtgggtcagcctctaggcggtgtctgctaagtgcccagggtgtcgcctattggggcctaccatcgttcgcccgctgcatttctcatgagtatagatacctctatctgtcactgcgggaacatcttgcaaaaggtcagcgcatgctggctggagagggtatgtcacaggtggtgcgctccctacaagagctcctggctagacggacatactacagtggcgatctactgttctccgtggacatcctcagaaacgtgaccgataccttcaagcgcgctacctacgtccccagtgccgatgacgttcagaggttcttccaagtggtgtcattcatggtggatgccgaaaacaaggaaaagtgggacgacgcccagcaagtaagcccaggaagcgtccatctgcttagggtggtggaggattttatccatctggtgggggatgctctcaaggcctttcagtcaagcctcatagtgactgataatttagtgattagtatccagagggagccagtctctgcggtttcatccgacatcacattccctatgaggggaaggcgcggaatgaaggactgggtccgtcattctgaggaccgcctgttcttgcctaaggaagtgcttagcctttcctcccctggtaagccggctacttctggggccgccggctcacctggaaggggaagaggccccggtacagtgcctcctggaccaggtcactcacatcagaggctcctgcccgccgatccagacgaatccagctacttcgtcatcggcgccgttctgtaccggactctagggttgattctgccccctccgcggccccctctggctgttacctcacgcgtaatgaccgttaccgttaggccacccacacagccgccagccgagcctctgatcacagttgagctgagctacatcatcaatggtactacagatccacattgtgcttcatgggattactccagagccgacgcgagttctggtgattgggacaccgaaaattgtcagaccctagaaacacaagctgctcacactcgctgccagtgccagcatcttagtacatttgccgtgctggctcagcccccaaaggatttgactctcgaattagccggctctcccagtgtaccacttgtgataggatgtgcagtgtcctgtatggctctcctcactctgcttgccatctacgccgctttctggcgattcatcaagagcgagcgctccattatcttgttgaacttttgcttatcaatcctggcttctaatatcttgatcctggtgggtcagtctcgtgtcctcagcaaaggcgtttgtacaatgacggccgcctttctgcactttttctttttgagctctttctgttgggtgctcaccgaggcttggcagtcttatctggccgtgattgggaggatgcgtacccgtctcgttagaaagcgcttcctatgtttgggctggggtctcccggctctggtggtagcagtgagcgtcgggtttacacgcaccaaagggtacggcacctccagttattgttggttatctctcgaaggcggattgctctacgcatttgtgggtcctgccgctgtgatcgttctcgtcaacatgcttattggcatcatcgtgttcaataaactcatggctcgggatggaatatcggacaagagcaagaagcagcgtgcaggcgccagcctttggtcgtcctgcgttgtcctcccattactcgccctgacctggatgagcgcagtcctggccatgaccgaccgtcgatctgtactctttcaggctctctttgcagtctttaactctgcccaaggctttgtgattaccgcagttcactgctttctccgcagagaggtacaggatgtagtaaaatgccagatgggtgtttgtcgggccgacgagtctgaggacagccccgactcatgtaagaacggtcagctacaaatcctctcagattttgaaaaggatgtcgatctggcctgtcagaccgtgctctttaaggaagtgaacacgtgtaacccgtctaccatcacaggaactctatcacgattaagcctggacgaggacgaggagcccaaatcatgcctggtggggcccgagggctcactgagtttctcgccactgcctggaaacatactggttcctatggccgccagtcccgggctgggggagcccccacctccccaggaggcaaatcctgtgtacatgtgtggagagggcggactgcgccagctggatttgacatggctccggcccactgagcctggcagcgagggagattacatggtcctgccacgccgaaccctgtctcttcagccgggtgggggcggcggtgggggcgaggacgcacctcgggccaggcccgagggcaccccaagacgtgctgccaagaccgtggcgcatactgaaggataccccagttttctgagcgtggatcatagcggccttggactcgggcccgcctacggttctttacagaacccttatgggatgacctttcaaccgccgcctccgacccccagcgcgcgtcaggttcccgagcccggcgaaagatcccgtaccatgccccggaccgtccccggaagcactatgaaaatgggaagtctggaaaggaagaaactcaggtatagcgaccttgatttcgaggttatgcatacaagaaaacgacacagcgaactgtatcatgagttgaatcagaagtttcacacctttgaccgataccgctcacaaagtacagccaagagggaaaagaggtggtctgtgagttcaggcggggcggccgagcgctcggtatgcaccgataagccttccccaggagaaaggcctagcttgtcccagcaccgccgacatcagtcctggagcactttcaagagcatgaccttaggctcattgcctcccaagcccagggaaagacttaccttgcaccgggccgccgcatgggagccgactgagccaccggatggggactttcagacagaggtatag

SEQ ID NO: 109902 - DNA, 4755 bp, Artificial Sequence
  Description of Artificial Sequence: Synthetic coding sequence
atggaaaacacaggttggatgggaaagggacatcgaatgactccagcctgccctctgctactgtctgtgatcctaagcctgcgattggctaccgcattcgacccagccccaagcgcctgctctgctctggcctcaggagtcctgtacggcgctttttccctacaggaccttttcccaaccattgcgtctggatgtagttggactcttgagaatcccgaccctactaaatactccctgtacctccgtttcaaccgtcaggagcaggtgtgtgctcactttgctcctcgactgctgccacttgaccactacttagtaaattttacttgcctgagaccctcaccagaagaggccgtcgctcaagctgaatcggaggtaggccgcccagaggaggaggaagccgaagctgccgcgggtctggagttgtgcagcggcagcgggccgtttaccttcttgcattttgataaaaatttcgttcaactgtgtctgagcgccgaaccatctgaggctccccgtttgttggcccccgccgccctggctttccgatttgtggaagtgctgctcattaataataataactcaagccagtttacctgtggagtcctttgccggtggtcggaggagtgcggaagagctgccggacgagcatgtgggtttgctcagccagggtgtagttgcccaggggaggctggggcaggtagcacaaccactacgagcccaggtcctccagccgcacataccctgtcaaacgctcttgtgccaggaggcccagcgcccccagctgaagccgacttgcacagcggaagctccaatgatctgttcacgactgaaatgcggtacggtgaagaaccagaggaggaaccaaaggtcaaaacccaatggccacgcagcgccgatgagcccggcctgtacatggcccagacgggggacccagcagcagaggagtggtccccttggtccgtgtgttcactgacctgtggtcagggcctgcaagtgcggacccggtcatgcgtcagttctccatacggtaccttgtgttccggacctctgagagagacacggccctgtaataacagcgccacatgtcccgtgcatggggtctgggaagagtggggctcatggtcactgtgtagccgctcatgtggacgaggcagtcggtcccggatgcgaacctgcgtcccaccccagcacgggggaaaggcatgtgagggacccgagttacagaccaagctgtgtagtatggcagcttgccccgtggagggtcagtggttggaatgggggccctggggaccttgctcaacatcatgtgcgaatggaactcagcaacggagcaggaagtgctccgtggccgggccagcatgggctacttgtaccggcgcccttactgacacccgcgaatgctctaatcttgaatgcccagctacagatagcaaatgggggccctggaacgcctggagtctttgctcgaagacttgcgataccgggtggcagaggcgatttcggatgtgccaggctactgggacacagggctacccttgcgagggcacgggcgaagaggtgaagccttgtagcgagaagagatgcccagcttttcacgagatgtgtagggacgaatacgtgatgctcatgacgtggaagaaagcagccgctggggagatcatttataacaagtgtcctcccaatgcaagcgggagcgcatcccggaggtgcctcctgagcgcacaaggcgttgcctattggggactaccaagcttcgcaaggtgcattagtcacgagtatcgatatctgtacttgagtctccgagagcatctggcaaagggccagcgtatgctcgcaggggagggtatgtcccaggtggtaagaagcctgcaggagctgctcgcccgtcgaacttactattccggagatctcctgtttagcgtcgatatcctgcgcaacgtcacagacacattcaagagagccacctacgtgccaagtgcagatgacgtgcagaggttttttcaggtggttagcttcatggtagacgccgaaaataaggagaagtgggacgacgcccagcaggtgagtcctggcagtgtgcaccttttgcgcgtagtggaggacttcatccacctggttggagatgccctgaaagccttccagagctctcttatagtcaccgataacctggtaatctccatacagcgcgaaccagtgagtgcagttagcagcgacatcacatttcctatgcgcggtaggagagggatgaaggactgggtcaggcattccgaggaccgactcttcctgccaaaagaagttctcagcttgagcagccctggaaaacctgcaacttctggggcagcgggatcacccggacgaggtcgcggcccagggacggtccctcccgggcccggccatagccaccaaagactgttgcctgccgacccagatgaatcttcctatttcgtgattggggccgtcctctaccggaccctgggtcttattctccccccccctcgtccaccccttgctgttacgagcagagtgatgaccgtaactgtccgcccccctacacagcccccagcagagccactcattaccgtggaactatcgtacatcataaatggtacaaccgacccccactgtgcctcatgggactatagcagagcagatgctagcagtggagattgggacaccgagaactgtcagacactggaaactcaggcagctcacacccgctgtcagtgtcagcacctgtctacctttgctgtgttggcacagccacccaaagacttaacactcgaacttgcgggctcaccatctgtccctctggtgataggctgcgctgtgtcctgcatggccctcttgactctgctggccatttatgctgccttttggcgctttattaaaagtgagcggtctataatcctgctgaacttctgcctgtccattttagcgtcaaatattcttattctcgtgggccaatctagggtcctgtctaaaggcgtctgcactatgaccgctgcctttctgcacttcttctttcttagttccttttgttgggtcctgacagaagcctggcagagctacctggccgtaatcggccgtatgagaacgaggctggtgcgtaaacggtttttgtgtctgggctggggcttgcctgcactggtagttgccgtgtctgtcggatttactcgtactaagggatacgggactagctcatactgttggctcagtctcgagggcggactcttgtacgcattcgttgggccggctgctgtgattgttctggtgaatatgttgattggtatcattgtatttaacaagcttatggccagggatgggatctctgataaatcgaaaaagcagagagcaggctccgagcggtgtccttgggcaagtctcctccttccttgcagtgcgtgtggtgctgttccatcccccctgctttccagcgcctcagctaggaatgcaatggcgagcctctggtcgtcgtgtgtagtcctgccactgctggccctaacctggatgagcgctgtcctggccatgaccgaccggcgttcggtgctgttccaggcactcttcgctgtgtttaattccgcccagggattcgtgattaccgccgtccactgtttcctacgtcgggaagtgcaggatgtagtcaaatgtcagatgggtgtctgtcgcgccgacgagtcagaagattcaccagactcctgtaagaatggacagttgcagatattgtcagattttgagaaggatgtggacctcgcatgccagactgtgctctttaaagaagtcaacacttgcaacccgtctaccattaccggaaccctctcacggctgtccctcgacgaggatgaggagcccaagagctgtctcgtgggcccggaaggatcactgtcatttagtccattgcctggcaatatcctagtgcctatggctgcctctccggggctgggcgagccccctcctccccaagaggctaatcctgtctatatgtgtggtgaagggggactgcgccaactagacctgacctggctgcggcccactgagcccgggtccgagggggactacatggtactgccaaggagaactttatccctgcaacctgggggaggaggcggaggaggagaagacgctccgagagctcggccggaaggaacccctcgaagggccgccaaaacagttgcgcataccgagggctacccctcattcctgagtgtagatcattctggactggggctcggaccggcctacggttcattgcaaaacccatacgggatgacttttcaaccgcccccccccacaccatcggcccgacaggtgcctgaacccggtgagcggtccaggaccatgccccgtactgttcccgggtccaccatgaagatgggttctctggagaggaagaaactcaggtactccgatctggactttgaggtcatgcatacacgtaagcgacattctgagctgtatcacgagctcaatcagaaattccatacatttgacagatataggagccagagcacggctaaacgggagaaaagatggagtgtgtcctctggaggtgcggctgagaggtcggtgtgcactgacaagccctcaccaggagagcggccctccctctcccagcatcgacggcaccagtcttggtcgaccttcaaatccatgacacttggcagcctcccaccgaaacctcgcgagagactgactctgcaccgtgcagctgcttgggagccgactgaaccccccgacggcgattttcaaacagaagtgtag

SEQ ID NO: 109903 - DNA, 4758 bp, Artificial Sequence
  Description of Artificial Sequence: Synthetic coding sequence
atggagaacaccgggtggatgggcaaagggcaccggatgacaccagcatgtcctctgttgctctctgtgattctgagtctgcggctggctaccgccttcgatccagctccatccgcttgtagcgcactggcttctggtgtactgtacggcgctttctcgcttcaggatctctttcctactattgcctcaggctgcagttggaccctggaaaatcccgaccccactaagtattcgctctaccttcgatttaacaggcaggagcaggtctgtgcccactttgcaccgcggctgctgcccctggaccattaccttgtaaacttcacttgtttgcggcccagtccggaagaagcagtcgcacaagcggaatcagaagtaggaaggccagaggaagaagaggcggaagcggcggcgggtctggagctctgctcaggttccggacctttcacatttcttcatttcgataaaaatttcgtccaattgtgcctaagcgcagaaccatctgaagcacctaggctgttagcccccgctgctctggcatttagattcgtggaggtcctcctgatcaacaacaacaactccagccaattcacctgtggtgtcctgtgtcggtggtccgaggagtgcggccgggccgccgggcgggcctgtggcttcgctcagccagggtgttcatgtcccggcgaggcaggtgccggttccactacaactacaagccccggccctcctgccgcacataccctgagcaacgccctggtgcccggcggtcccgcacctcccgctgaggccgatctgcactcggggagctccaatgacttgttcacaactgaaatgagatatggtgaagagcccgaggaggagcccaaagtaaaaactcagtggcctaggagcgccgatgagccaggcctgtacatggctcaaacaggagatccagctgccgaagagtggtcaccttggtcggtctgttccctgacatgcggacaaggcctgcaggtacggacaagatcctgtgtgtcatcaccgtatggaacgctgtgttctggtcccctgcgggagacacgaccctgcaacaacagcgccacctgtcctgttcacggagtgtgggaggaatggggcagctggtccctgtgctcccgctcatgtggtcggggcagtagatccagaatgagaacttgtgtgccaccccagcatggcgggaaagcctgtgaaggaccggagttgcagaccaagctatgctctatggccgcctgccccgtggagggtcagtggctcgaatggggcccttgggggccctgtagcacctcctgcgccaacggcacacagcagaggagtagaaaatgcagcgtggcgggtccggcctgggcaacttgcaccggagctcttacggacacacgcgaatgtagtaatctcgagtgtcctgcaactgactccaagtgggggccatggaatgcttggtccctgtgcagcaagacgtgtgataccggatggcaaaggcgcttccggatgtgccaggccaccggaacacagggatacccatgtgaggggaccggagaagaagtaaagccttgctctgaaaagcgctgtcccgcctttcatgaaatgtgtagggatgaatacgtcatgctgatgacctggaaaaaagcggccgccggcgagataatttataataagtgtccccctaacgcatcgggctctgcaagtaggcggtgcctcctaagcgctcagggcgtcgcctactgggggctgcccagctttgcaaggtgtatatctcacgaataccgctatctctatctttccctgcgcgagcacttggcgaaaggacagcgcatgcttgccggggagggtatgagccaggtggtccgctccctgcaggaactgctcgcccggagaacttactattctggcgatctgctctttagcgttgatattctgcgcaacgtgaccgacaccttcaagagggccacgtacgttccctccgccgacgatgtacagcgtttttttcaagtggtcagttttatggtcgatgccgaaaataaagaaaagtgggatgatgcccagcaggtatctccgggatctgttcatctcctgcgcgtagtggaagattttatccatctcgttggtgacgcgctgaaggctttccaatcctctctgattgtgactgacaacctcgttatatccatccagagagagcctgttagcgccgtctcttccgacataactttccccatgcgcgggagacggggtatgaaagattgggtgagacacagcgaagaccgattgtttttgccaaaggaggtgctttccctgtcctcacctggcaagcccgcgacatctggtgccgccggttcacccggacggggccggggcccggggacagtgccacctggacctggccactctcaccagcgcctgctcccagctgaccccgacgaatcatcatatttcgtgataggagctgtgctatacaggaccctgggacttatactcccaccccctagaccccctttggcggtcacctcccgggtgatgactgtgaccgtgaggccgcctactcagccgccagctgagcccctgattactgtagagctttcctacatcattaatggtaccacggaccctcactgcgcatcttgggactactcccgggctgacgctagtagcggggattgggacacagagaactgtcaaaccctggagacacaggccgcgcacacccgatgtcagtgtcagcatttgtcaaccttcgctgtgctggcccagccccccaaagatttgacactcgagttagctggatccccttcagtgcctctggttatcggctgtgctgttagttgcatggcattgctgactctgctggccatctacgctgccttctggagatttatcaagtctgaaagatccattatcctactgaacttttgtttgtcgattctggccagtaacatcttaatactggtcggtcaatccagggtcctgtccaagggcgtgtgcacaatgactgctgccttcctgcacttttttttcctctcaagtttctgttgggtgctcaccgaagcctggcagtcctacttggccgtaattggaagaatgcgcacgaggctcgtacggaagcggttcctgtgtcttgggtgggggttgcccgccctggtggtcgcagtgagtgtcgggtttacccggactaaagggtacgggaccagctcttactgttggctgagcctggaagggggcctgctgtacgcctttgtaggtcccgccgccgtgattgtgctggtgaatatgctaatcggaataatagtattcaacaaattaatggctcgtgacggaatctctgacaagtcgaagaaacaacgtgcagggtctgaacgttgcccctgggcatctctccttctgccctgctccgcctgcggcgcggtgccaagccccctgctttcatccgcgtccgcaagaaatgccatggccagtctgtggagtagttgcgtagtcttaccgcttttagcccttacatggatgtccgccgtgctggcaatgacagaccggcggtctgtcctatttcaggcgctcttcgccgtgtttaactctgcccaggggtttgtgatcaccgctgtccattgttttctgaggcgcgaagttcaagatgtcgtgaaatgtcagatgggggtttgtcgggcagacgagagcgaggacagccctgacagctgcaagaatggccagcttcagattctcagcgacttcgagaaggatgtagacctggcctgtcaaaccgtgttattcaaggaggtgaatacatgtaatccttcaactattacaggaacgttgtcccggctatccttggacgaagacgaggagcccaaatcttgtctggtgggcccagaaggctctctgagtttttcaccactgccaggcaacatactcgtgcctatggccgcctccccagggctgggagaacccccgccaccccaagaagccaatcctgtctacatgtgcggggagggcggtctgaggcaactggatctgacgtggcttcgacctaccgaacccgggagtgagggcgattacatggttctgcctcggcgaacactgtctcttcaaccagggggcgggggcggaggaggagaagacgctccccgcgctaggcccgaaggcactccccgccgcgcagctaagacagttgcccatactgaaggctacccgtcttttttgtccgttgatcatagcggcctcgggctgggacctgcttacgggtctctacagaacccctacgggatgacatttcagcctccgcctcccaccccaagcgcaaggcaggtcccagaacccggggagagatcccggaccatgcccaggacagtcccgggctcaactatgaaaatggggtccctggaaaggaagaaactaagatactccgacttggatttcgagaaagtgatgcacactcgaaagaggcatagcgaactttatcatgaactgaaccagaagtttcacacctttgatcggtacagaagccagtccacagctaagcgtgagaaaaggtggagtgtaagctcgggcggggcagctgagcgcagcgtgtgtaccgacaagccgtcacccggcgaaagaccttcactgagccagcacagaagacaccagtcatggtctacatttaaaagcatgactctggggtcactgccacctaaacctagggagagactgactctgcatcgcgccgcggcttgggaacccaccgaacccccagacggggattttcagactgaagtatag

SEQ ID NO: 109904 - DNA, 4665 bp, Artificial Sequence
  Description of Artificial Sequence: Synthetic coding sequence
atgacgccagcatgtccactgcttctgagcgttatcttgagcctacgtcttgctactgctttcgatccagccccaagtgcctgttccgctctggcgagcggcgtgctttacggtgccttcagcctgcaggacctgtttccaaccatcgccagtggatgtagctggactctggaaaatcctgatccgacaaagtacagtctatatctccgctttaacagacaggaacaggtgtgcgcccacttcgcccccagactgcttcccctcgaccactacctggtgaactttacttgccttagaccgagtcccgaggaggccgtggctcaggctgaaagtgaggtgggaagaccagaggaggaggaggcagaggcggcggcagggctcgagctgtgcagcgggtcaggcccttttacattcctgcactttgacaagaatttcgtgcagttatgcctgagcgccgaaccttctgaagctccccgcctcctcgcaccggccgccctggcttttcgatttgttgaagtgttgctgattaataataacaatagctctcagttcacatgtggcgtgctctgtcggtggagtgaagagtgcgggcgcgccgccggccgtgcttgtggctttgcacagccaggctgctcctgtcctggcgaggccggtgccggttccacaacgactacatctccaggcccccccgctgcccacacactctccaatgctcttgttccaggcggacctgcccctcccgccgaggcagatctccatagcggaagttcaaacgacctctttactaccgaaatgcggtacggtgaggagccagaggaagaaccaaaggttaagactcaatggccccgtagcgcagatgaacctgggctgtacatggcacagactggggatcccgctgccgaagaatggagcccctggagcgtgtgctcactcacctgtggccagggcctccaagttaggactcgtagctgcgtaagctccccttacggcacactgtgcagcggtccactgcgcgaaacaaggccgtgcaacaactcagctacctgccccgttcatggggtgtgggaagagtgggggtcatggagtctgtgttctcggagctgtggaaggggttcccgctcacgaatgcgcacctgcgtgccacctcaacatggcggcaaggcttgtgagggtccagagcttcagacaaagctttgttccatggccgcctgccctgtagaggggcagtggctggagtggggcccatggggcccttgcagtaccagttgcgcgaatggaactcagcagcgctcacgtaagtgctccgtggccggacctgcgtgggcaacctgtacaggagccctgaccgacacccgggagtgctccaacctcgaatgcccagctactgattccaaatgggggccctggaatgcgtggtcgctctgcagcaagacctgcgacacaggctggcagaggcgctttcggatgtgccaggccaccggcacccagggctatccctgcgaaggaactggtgaggaagtgaaaccatgctcagagaaaaggtgcccagcctttcacgagatgtgtagagacgagtatgtgatgctaatgacctggaagaaggcggcagccggcgagattatctacaacaaatgtccaccgaatgcttcaggctccgcatcgcgcaggtgtctgctgtccgcccagggcgtcgcctactggggattgccatccttcgcccgttgcattagtcatgaatacagatatttgtatctcagtctaagagaacacttggcaaagggtcagcgcatgcttgctggggagggtatgagtcaggtcgtgagatccctgcaagagctgctcgcacgtcgcacctactacagtggtgatctcctattcagtgtagatatattgagaaatgtcactgacactttcaaaagagcaacttacgtgccttccgccgatgacgttcagcggttctttcaggtcgtcagctttatggtcgacgccgagaacaaagagaagtgggatgatgctcagcaggtgagccctggaagcgtgcacttgctgcgggttgtggaagacttcattcatctggtcggcgatgcactcaaggcctttcagtcttccctgatcgtcaccgataaccttgtgatcagcatccagcgcgagcctgtgtccgctgtgtcatctgacatcacatttcccatgcggggcagacgtgggatgaaagactgggtaagacactctgaagatcgtctcttcctgcctaaagaggtgctcagcttgagctcacccggaaagcctgctacttccggggccgcgggctcccccgggcgcgggcggggacccggcacagtaccaccaggtccgggtcatagccaccaaagactgcttccagctgaccctgacgaaagtagttacttcgtaattggcgcagtcctgtatcggactctcgggcttattctccctcctcctcgtccacccttggccgtcacttccagggtcatgaccgtgacggtgagacccccaacccagccaccagctgagccacttatcaccgtggagttgtcttatattataaatggaacaaccgatccgcattgcgcctcatgggattactccagagctgatgctagttcgggtgattgggacaccgaaaactgtcagacacttgagactcaggctgcacacacaagatgtcaatgccagcatttaagcactttcgccgtgcttgctcagcctcccaaggacctgactttagagctggcagggtcccccagtgtccctctagtgatcggatgcgcagtgagttgtatggctctgttgaccctgttagctatctacgccgccttctggcggttcatcaaatccgaacgcagcattatcttgctgaacttctgcctctcaattctggccagcaacattctgatcctggtgggacagagtagggtactctcaaaaggcgtgtgcacaatgactgccgcgttcctgcattttttctttctttcctccttctgttgggtgctgaccgaggcctggcagagttatttggcagtcatcggccgtatgcgtaccaggcttgtccggaagcggttcctatgcctcggctggggccttcccgctcttgtggtagccgtgtctgtaggttttaccaggacaaaaggctatggaacctcttcctactgctggctgagcttagaagggggattactctatgcgttcgtgggccccgctgccgtcatagtgctggttaatatgctgatcggcataatagtctttaacaaactcatggcgagagatggcatctctgataagtccaaaaaacaaagagctggaagcgaacgctgtccctgggcaagcttgcttctgccttgcagtgcttgtggggcagtgcctagcccccttttatccagcgcatcagctaggaacgccatggccagcttatggagttcctgcgttgtcctgccacttttggccctgacgtggatgtcagccgtgttagccatgacagatcgacgcagcgtcctgttccaggcactgttcgcagtgtttaactccgctcagggctttgtgatcaccgctgtgcattgcttcctgcggcgcgaggtgcaagatgtggtgaaatgccagatgggcgtttgtagagcagatgagtctgaggatagtccagacagttgtaagaatggtcaattgcagatcctgtccgactttgagaaggatgttgatttggcgtgtcaaactgtgctctttaaggaagtgaatacctgcaacccaagcactatcacaggaaccctgtctcgactgagtctcgacgaggacgaggagcctaagagctgtcttgtaggaccagaaggttcactttctttttctccactgccgggtaacatcctggtccccatggccgccagccccgggcttggtgagcccccaccgccgcaagaggccaatccggtatatatgtgcggcgaaggtgggcttcgccagctggacttgacatggctcagaccaacggagcccggctcggaaggggattatatggtgttacctagacggacactgtccctgcagcccggcggaggcggcgggggcggggaggacgcccctcgggcacgaccggagggtaccccccgtagggcagcgaaaaccgtagctcacacggagggctaccccagttttttaagcgtagatcactcagggcttgggctgggtcctgcttacggctccctccagaatccatatgggatgacttttcagcctccccctccgacaccatctgcacggcaagtccccgaaccaggtgagagaagcaggactatgccccgtacagttccagggagcactatgaagatgggaagcctcgaaagaaaaaagttgaggtattctgatctcgatttcgaaaaagtcatgcatactcgcaaacggcactctgaactgtaccacgagcttaaccagaagttccatacatttgacaggtaccgctcgcagtctaccgctaaggacaagccctctccgggcgaacgcccaagcctcagtcagcataggcgccaccagagttggagcacctttaaaagcatgacactgggctcgctgccaccaaaaccacgggagcggctgactctccacagggcggcagcctgggagccgactgaaccaccagacggcgacttccagaccgaggtgtag

SEQ ID NO: 109905 - DNA, 4401 bp, Artificial Sequence
  Description of Artificial Sequence: Synthetic coding sequence
atgacgcccgcctgccctcttttgctatctgttatcctctctctcaggttggcgacagccttcgaccccgcacccagcgcttgctccgcactcgcctcaggggtgctttatggagccttctccctccaagacctgtttccgacaatagcctccggttgcagctggaccctggagaatcctgacccgactaagtacagtttgtacctgaggttcaatagacaggagcaggtgtgcgcacacttcgccccccggttattgccacttgaccactatcttgtgaacttcacttgtttgagaccttctcccgaagaggctgtggcacaggctgagtccgaggttggcagaccagaggaagaagaagccgaggcagccgccggcctcgagctctgttctgggagtggaccttttaccttcctgcactttgacaagaacttcgtgcagctgtgtctgagcgctgagccatccgaggcgcctcggctgctagcacctgctgccctggcattccgctttgtggaggtcttactcattaacaataacaacagttctcagtttacatgcggcgtgctttgccggtggagcgaagaatgcgggagagctgcaggcagagcatgtggctttgcccaaccaggatgttcttgccccggggaggcaggagccggctcgacgactactacaagtcctggcccccctgccgcccatacgctgtcaaatgccctggtgccgggcggccccgcccctccggctgaagctgacctgcactccgggagctcgaacgatctgttcactactgagatgaggtacggcgaagagcccgaggaggagccaaaggttaagactcaatggcctaggtctgcagatgagccagggctgtacatggcccaaacgggggacccagccgcggaggaatggagtccttggtcggtctgctccttgacatgcggccagggtctgcaggtgcggacacgcagctgcgtatctagtccttacggaaccctgtgctccgggcccctgagggaaacccgaccctgtaataactccgccacctgtccagtggaggggcagtggctggaatggggcccatgggggccatgcagcacttcttgtgctaatggcacacagcagagatccagaaaatgcagcgtggccggacctgcctgggcaacatgcacaggcgccctaaccgacactcgagaatgcagtaacctcgagtgccctgccacagacagcaaatggggcccttggaacgcatggagtctatgttcaaaaacttgtgacacaggatggcaaaggcggttccgtatgtgccaggccaccggaacccaggggtacccatgcgaaggtaccggggaggaagtgaagccatgcagcgaaaagaggtgccccgcttttcatgagatgtgtagggacgagtacgttatgctgatgacatggaagaaggccgccgctggggaaataatctataataagtgccctccgaatgcctcaggcagtgcaagcagacgatgtttgcttagtgcccagggcgtcgcttattgggggcttcctagtttcgcgagatgcatatcccatgagtacagatacctctatctgtctctgagggagcacttggctaaaggacaaaggatgctcgccggggagggtatgtcacaggtagttcgctcactacaggagttgttggcgcgcaggacgtactattcaggggatctcttgttctccgttgacatccttcggaacgtgaccgacacctttaagcgagccacatacgttccctccgcagacgatgtacagcgctttttccaggttgtaagttttatggttgacgcggaaaacaaagagaagtgggatgatgcgcagcaggtgagtccaggctcagtccatcttctgagggtcgtcgaggacttcatccacctcgtgggggacgccctgaaagctttccagtcaagtttgatcgtgacagacaacctggtgatttcaattcaacgggagcccgtgagcgccgtgtcctcagatatcacatttcctatgcgaggcaggcgtggcatgaaggactgggtccgccacagcgaggacaggctgttccttcctaaggaagtgctgtccctcagcagtccaggaaaaccagcaacatccggggctgccggaagtccgggccgaggtcgaggcccaggcacagtgcccccaggccccggccatagccaccagaggctgctccccgcagacccagacgagtcttcatacttcgtgatcggggcagtgctgtaccgcacgctcgggcttatcctcccgcctccccggccacccctagccgttacctctagggttatgacagttactgtgcgcccccccactcaacctcctgcagagccccttattaccgtggaactgagctacatcataaatgggacgacggacccccactgtgcttcgtgggattactctcgcgcagatgcttccagtggtgactgggacactgagaactgtcagacactggagacacaggcagcacacacaaggtgtcaatgccagcacctgagcactttcgccgtgctggctcagccacctaaagatctcactctggagcttgctggaagcccttctgttcccttagtgatcggttgtgccgtgagttgtatggcgctcctgactctgctcgccatttacgcagcattttggcggttcataaaatccgagcgcagtattattctactgaacttctgtttgtcgattctggcttcgaatattttgatactggtggggcagtcaagagttctctcaaaaggagtgtgcaccatgaccgctgcattcctgcatttcttctttctgtctagtttctgttgggttttgacagaggcttggcagagctacctggcagtgattgggagaatgcgcacacgcctggtccggaaaagatttttgtgcttgggctggggcctgccagctctagtggttgcagtctctgtgggattcaccagaactaaagggtatggcactagctcctattgctggctctccctcgaaggcggactgttatacgcctttgtgggacccgccgctgtcatcgtgctggtgaatatgctcatcggaattattgtgtttaacaagctaatggcccgggacggcatctcagacaagtctaagaaacagcgtgcaggcgcctcactgtggtcaagctgcgtggttctgcccctcttggccctgacctggatgtcagcagtactcgcgatgaccgacaggcggtcggtgctctttcaggccttgttcgccgtgtttaactcagcgcaggggtttgtgatcaccgccgtgcactgctttttacgcagggaggtgcaggatgtcgtcaagtgtcagatgggggtctgcagggctgatgagagtgaggactcccctgattcctgcaaaaatggacagctgcagatcctgtccgatttcgagaaggacgttgatttagcctgtcaaacagtgctgttcaaggaagtgaatacctgtaacccatctaccattactggcacactgagccgtttaagcctggacgaagatgaggaacctaaaagttgtttagtgggacccgagggaagcctatcgttctccccccttcctggaaacatcctggtcccaatggccgcctctcctggcttgggcgaaccacctccaccccaggaggcaaaccctgtctatatgtgtggagagggaggattgaggcagctggaccttacctggcttcgtcctacggagcctggctctgagggggactatatggtactgccacgccggaccctctccttgcagcccggtggcgggggtggcggaggtgaggatgccccacgcgctagacccgaagggacaccccgcagggcagcaaagacagtcgcccacacagaagggtaccccagcttcctgtccgtcgatcactctggcttggggctgggacccgcctacgggtccctgcagaatccatatggaatgactttccaaccaccgccacctacgccctctgccaggcaagttcccgaacctggtgaaaggagccgtactatgcctcgaacagttccagggtctacaatgaagatgggatctttggaaagaaaaaaactgagatacagcgaccttgactttgagaaggtgatgcacacccgcaaaagacatagcgaactgtatcacgaattgaaccagaagttccacactttcgacagatatcggagtcagagcaccgccaaggataaaccatccccgggtgagaggccgtcactgagtcagcataggcgtcaccagagctggtcaacctttaaaagtatgactttgggatctcttccaccaaagccacgagagcgtctaacccttcatagggctgctgcctgggagcccacggagcccccagacggggacttccagacagaagtctag

SEQ ID NO: 109906 - DNA, 4500 bp, Artificial Sequence
  Description of Artificial Sequence: Synthetic coding sequence
atgacgcccgcctgccctctactgcttagtgttatactttcgctgcgcctggcaacagcattcgacccagccccttcagcctgtagtgccttggccagcggtgtcctgtatggcgccttctctctgcaagacttgtttcctaccattgcctccggctgcagttggacattggagaaccccgaccccaccaaatactctctgtatttgcgatttaaccgacaggagcaagtgtgcgcgcacttcgcaccccgactcctgcccctcgatcactaccttgtgaatttcacatgcctgaggccctcaccagaggaggccgtggcacaagccgagagtgaagttgggcgccctgaagaggaagaggccgaggcagcagccggtctggaactgtgctccggttccggcccattcaccttcctgcacttcgacaagaactttgtgcaactctgcctctctgcagagccctctgaggcacccagactcttggccccagccgcactcgcgttccggtttgtggaagtgctcttaataaataacaacaatagcagccagttcacctgtggagtgctgtgcaggtggtctgaagaatgtgggcgagctgcggggagggcctgtggtttcgcccagccaggatgctcttgtcccggtgaggccggcgctgggtcaactacgacgaccagtcccggcccacctgccgcccatactctctcaaacgctcttgtaccaggcggccccgcacctcctgccgaagcagaccttcattccggaagtagtaatgatttgtttactacagaaatgaggtacggagaggagcccgaagaggaacccaaggtgaagacacagtggccaagatctgccgacgaaccgggattgtatatggcacaaacagtgcatggcgtctgggaggaatggggcagctggtccttgtgcagccgatcctgcggtagagggtcaaggagcagaatgcgaacctgcgtcccaccacaacacggcgggaaggcgtgcgaagggcctgagctgcagaccaaactatgcagtatggccgcatgcccagtggagggacaatggctcgagtggggaccctgggggccttgctctacttcttgtgctaatggtactcagcagcggtccaggaagtgctcagttgcaggcccagcttgggcaacgtgcaccggggcgctgactgataccagggagtgtagtaacttagagtgccccgcaacagacagcaaatggggaccttggaatgcctggagtttatgctccaaaacttgtgacactggatggcaaaggagatttcgaatgtgccaggcaacgggcacccagggatatccttgcgaagggactggggaagaggttaaaccttgtagcgaaaagcgatgtcctgctttccacgagatgtgcagggacgagtatgttatgctgatgacctggaagaaagcggctgcaggggaaattatttacaataaatgtccccctaacgccagcgggtcggcctctcggaggtgcctgctcagcgcccaaggggtggcctattggggcctgccatcctttgcgcggtgtatttcccacgaatacaggtacctgtacctctctcttcgggagcaccttgccaaaggtcagcggatgttggccggagaggggatgtcacaggtggtgaggtccctgcaggagctcttggctcgccggacatactatagtggagatttgttattttccgtggatatccttcgaaacgtcactgatacgttcaaaagggcaacctacgtgccaagcgccgatgacgtacagagattcttccaggttgtgagcttcatggtggacgcagagaataaagagaagtgggacgatgcccagcaggttagcccgggctccgtgcacctgttacgggtggtggaagattttatccacttggtgggagacgcactcaaggcattccagtcgagtctgattgtaacagacaacctcgttatttctatacaaagggaacccgtgtccgccgtttcaagcgacataactttcccaatgcgtgggaggagagggatgaaagactgggttagacattccgaagatcgactgtttctccccaaggaggtgctgtcgttgagcagccctggcaaaccggccacctcgggtgccgcagggtctccgggacgcgggcgcgggccaggcaccgtgccacccggcccggggcactcccatcagaggcttctcccggccgatcctgacgaaagttcctatttcgtgataggggctgttctatatcgcacacttgggcttattctccctcctccccgaccaccactggcagtgacttcgcgggtgatgactgtgaccgtgcgcccacctacccagccacctgccgaacctttgatcacagtggaattatcctatatcatcaatggaactactgacccgcactgtgcatcttgggactacagcagagctgacgcaagttcaggcgactgggacaccgagaattgccagaccttggagacccaggcagcgcacacacgctgtcagtgccaacacctcagtacctttgcagttctcgctcaaccaccaaaagatttaaccttagagctggccggatctccgtcagtcccattggtgatcgggtgcgctgtgagctgcatggcccttcttaccctgttagcgatctacgccgccttttggcgtttcattaaaagcgaaaggagcatcattctcctgaacttctgtctgagtattcttgcatccaacatactgattctagtcggtcagagccgggtgctgtccaagggcgtgtgtacaatgacagcagcgtttctgcacttcttcttcctgagttccttttgttgggtgctgaccgaagcctggcagagctatttggccgtcatcgggagaatgcggacgagattagttcgcaagaggttcctgtgtctggggtggggactgcccgccttggtggtggccgtttcagtgggattcactcggaccaaaggttacggcacgagctcatactgctggctctcacttgaaggcggtttactgtatgcatttgtgggcccagctgctgtcattgtgctggtgaacatgttgatcgggataatcgtattcaataaactgatggctcgggatgggatatcagataagagtaagaaacagcgcgctgggagcgaaaggtgtccatgggcaagcttgctgctgccatgcagtgcttgtggagccgttccatcccccttgttgagctccgcctcagctcgcaatgccatggcttccctatggtctagttgtgtggtgctacctctgctggcactgacctggatgagcgccgtgctcgcaatgaccgatagacggtctgtcctcttccaagcacttttcgccgtgttcaactcagctcaggggtttgttatcaccgctgtacattgttttctgcgcagggaagtgcaggatgtggtcaaatgtcagatgggcgtgtgtagagccgatgaatctgaggattcgcctgattcgtgtaaaaacggccagctgcaaatcctgagtgactttgaaaaagatgtcgatttggcttgtcagactgtgctcttcaaggaggtcaacacatgcaacccctcgacaattaccggaactctgtcacgattgtcacttgacgaggacgaggaaccgaaatcttgcctggtcgggccagagggctccctgtcattctcacccttgcccggtaatatcttggtcccaatggcagcctcgcctggtctcggtgagcctccccctccacaggaagccaatcccgtctacatgtgcggagaagggggtcttaggcagttggatttaacatggttacgcccaacagagcccggttctgagggcgattatatggtgctgccgagaaggacactttcattgcagcctgggggcgggggcggcggcggggaagatgcacctagggcccgcccagaaggcaccccacggagagcagccaagaccgtcgctcacacagaagggtacccttcatttctgtccgtggatcacagcggattaggccttggccctgcttacgggtctctgcaaaacccttacgggatgaccttccagcctcccccacctacacccagcgcgagacaggtcccagaacctggagagcgctctcgcaccatgcctcgcacagtcccagggtcgaccatgaaaatggggagcctggaacgcaagaaattgcgatacagcgacttggattttgaaaaagttatgcacacccgcaagcggcacagtgagctttaccatgaactgaaccaaaagtttcacaccttcgacagatatagatcccagtccacagccaaggacaaacccagccctggagagcgcccaagtctcagccaacacaggcggcaccagtcttggtccacttttaagagtatgacccttggcagtctcccacctaagcccagggaacgcttgacacttcacagagcggcagcatgggaacctactgaaccgcccgatggcgacttccagaccgaagtctag

SEQ ID NO: 109907 - DNA, 4503 bp, Artificial Sequence
  Description of Artificial Sequence: Synthetic coding sequence
atgctgtcactgcgggggccggatactcatggaaagggtcaccgcatgactcctgcctgccctctgctgttgtccgtgatcctgagcctgcggctggcaactgcattcgacccagccccgagtgcctgttcggcgcttgcaagcggcgtgctttatggcgcctttagccttcaggatctcttccccacaatcgcatccgggtgctcctggaccctcgagaatccagatcccacaaaatactccctctatctgaggtttaatcgccaggaacaggtgtgcgcacactttgctcccagactgttgccgcttgatcattatctggttaattttacgtgtctaagaccatcccctgaagaagcggttgctcaagctgaatccgaggtcggccgtccagaagaggaggaagccgaggcagcggctgggctggagctgtgctctggttcaggaccttttactttcctgcacttcgataaaaactttgtacagctctgtttaagcgccgagcctagtgaggcgcctcgtctccttgcccccgctgccctcgcctttaggttcgtagaagtgctgctgatcaacaataataactcaagtcaatttacctgtggggtgctgtgtcgatggagtgaagagtgcggacgggccgcaggacgggcctgcgggtttgctcagccaggctgctcttgtcctggggaggctggggctggcagcactacaaccacctcaccaggccctcctgccgcacacacgttgagtaacgctctagttccaggcgggcccgctccccccgccgaagcagacctccacagtggcagtagcaatgacctgttcactactgaaatgcggtatggggaggagccagaggaagaaccaaaagtcaagacccagtggccacggagcgcagatgaaccgggcctgtacatggctcagacagttcatggtgtgtgggaagagtggggctcctggagcctgtgtagtaggtcatgtggcagaggatcacgctcacgaatgcggacatgtgtgcccccccagcatggcggaaaggcgtgcgaggggcccgaacttcagacaaaactctgctctatggcagcatgccctgtggagggtcagtggttggaatggggaccgtggggaccttgttctacctcttgcgcgaatggcacccagcagcgctcgagaaaatgttctgtcgctggcccagcttgggcaacctgtacgggtgccttaaccgacacaagggaatgtagcaatctggagtgtcctgccaccgattccaaatgggggccttggaacgcgtggtcactgtgtagtaaaacttgcgataccggttggcagagacggtttagaatgtgccaggcaactggcactcaaggatatccctgtgaaggtactggcgaagaggttaaaccctgtagcgaaaaacggtgccccgctttccatgagatgtgtagggacgaatacgttatgcttatgacttggaagaaggcagccgcaggagaaataatctacaataaatgcccaccaaatgctagtgggtcagcttcgcggaggtgtctcctgagtgctcagggggtagcttattggggcctaccaagctttgctagatgtatctcgcacgagtatcgttatctctatctatcactgagagagcatcttgcaaaaggacagcggatgctagctggcgaaggtatgtctcaggtcgttagatccttgcaggagttactggccaggaggacttattattcaggagacctgctgttttctgttgatattctaaggaacgtcacggatacattcaagcgcgctacctatgtcccgtcagctgatgatgtccagcgattttttcaagttgtgtccttcatggtagacgccgagaataaggagaaatgggatgacgcccaacaggtatcccccgggtctgtgcatttacttcgagtggtggaagacttcatccatctcgttggggatgcactgaaagctttccagagttccctgattgtcacagacaatctggtcatttccatccaacgcgagcctgtcagcgctgtttcttccgatattacgttcccaatgaggggacgaaggggaatgaaagactgggtgcggcatagcgaagatcggttgttcctgccaaaggaggttctcagtctgagctcccccggaaagcccgccacatcaggggctgcagggagcccagggcggggacgagggccgggcacggtgccaccagggcccggccactctcaccaacggctcctccccgcagatcccgatgagtcctcgtacttcgtgattggagcggtgctgtacagaactctgggtctgatcctccctcctccgcgtccccctcttgcagtgacctcgcgtgtgatgactgtcacagtgagacctcccacccagccccccgcagagccccttattacagtggagctgtcatatataattaatggcacgaccgatccacattgcgcttcctgggattatagcagagctgacgcctcgagcggggattgggatacagagaactgtcagacacttgaaacacaggccgctcacacaaggtgccagtgtcagcacttatctacatttgcagtgctagcccagcctcccaaggacctaacattagaactagccggctcgcctagtgttcctctggtgattggatgcgcagtgagctgcatggccctgctgacattgctggctatttatgcagccttctggcgcttcataaagtccgaaaggagcatcatcctcctcaacttttgtctaagcatcctggcatccaacattcttatcctggtggggcagtctagggtcctgagcaaaggagtgtgcacaatgacggcagccttcttacatttcttcttcctttcttcgttctgttgggtgctcaccgaggcgtggcagtcatacttggccgtcatcggtagaatgagaacaagactcgttagaaaaagattcctgtgcttaggatggggcctacccgctcttgtcgtggcggtaagtgtgggattcacaagaacaaaggggtacggcacctcttcatattgctggttgagccttgaaggcgggctgctctacgccttcgttggcccagcagctgtgatcgtgctggtgaatatgctgattggtataatcgtgttcaacaagctaatggctagggacggaattagcgataagagtaagaaacagagagcgggcgccagcctgtggtccagctgtgtagtgctgcctctactcgccctgacgtggatgagtgccgtcctggccatgaccgatcgtagatccgtgctgtttcaagcgctctttgctgtgttcaattccgcccagggtttcgtcattaccgcggtgcactgtttcctgcggagggaggttcaggatgtggtcaagtgccaaatgggcgtgtgcagggcggatgaaagcgaggattcccctgatagctgcaagaatggtcagctgcaaattctcagcgatttcgagaaggatgtagacttggcctgccagaccgttctatttaaggaagttaacacctgtaacccttctaccattactgggaccctgagccgcctcagcctcgatgaagacgaagagcctaagtcctgtctggtcggccctgagggatcactaagttttagccctcttccaggcaacatactggtgcctatggcagcatctcctgggcttggggaaccgccaccgccccaggaggcaaacccggtttacatgtgtggagaaggcggcttgcggcaactagatttgacatggcttcggccaaccgagcccggaagcgagggagattatatggtgttgccacgtaggactctctctttacaaccgggaggcgggggtgggggaggcgaggacgcccccagggcacgtcctgaagggacacctcgcagggccgccaaaaccgtagcccatactgaggggtacccatcttttctcagcgtggaccacagtggcctgggactggggcctgcttatggctccttgcagaatccttacggcatgacatttcaacccccgccaccaactcctagcgcacggcaggtccccgagcccggagagcgctcacgcaccatgccccggaccgtcccgggttcaacaatgaaaatgggctccctcgagagaaagaagctgcgctactccgatctcgatttcgaaaaggtgatgcacactcgcaagaggcattccgaattatatcatgagcttaaccagaaattccataccttcgaccggtatcgctctcaatcaacagctaaacgtgagaagagatggtccgtgtcaagtgggggagctgccgaacgatctgtgtgcacagacaagcccagccccggcgagagaccaagtctctctcaacatcggagacaccaatcctggagtacatttaagtcaatgaccctaggcagccttcccccgaagccgcgtgaaagactcaccctgcacagggcagctgcatgggaaccaactgagccaccagatggagactttcagaccgaggtgtag

SEQ ID NO: 109908 - DNA, 2544 bp, Artificial Sequence
  Description of Artificial Sequence: Synthetic coding sequence
gggaagggtcacaggatgacccctgcttgtccactgctcctttccgtgatcctttccctgagattggccactgcatttgacccagctccttcagcgtgcagtgccctggcatctggggtgttgtacggggcttttagcctgcaggatctcttcccaaccatagcttccgggtgttcttggacactggaaaatcctgacccaactaagtattcactttatctacgatttaaccgccaggagcaagtgtgcgcccatttcgccccgagactgttgccactggaccactaccttgtgaattttacatgtttgaggccttcaccagaggaagcggttgctcaggcagagtctgaggtgggccgaccagaggaagaggaggctgaagcagctgcgggactagaactttgctctgggagcgggccgttcacatttctgcattttgataagaactttgtgcaactgtgtctcagcgctgaaccctccgaagccccacgcctccttgcccccgctgcgctggcctttagattcgtggaggttctgttgattaataataataatagcagtcagttcacatgtggcgttctatgcaggtggtcagaggaatgcggacgggccgccgggcgagcatgtgggttcgctcaacccggatgctcttgtcccggagaggcgggagccggtagcaccacgactaccagtcctggaccacccgccgcgcacacccttagtaatgctttggtgcccgggggaccagcacctcccgccgaggcagatttacactccggtagcagtaacgatctatttaccaccgagatgcgctacggcgaagagccagaggaggagccaaaggttaagacccagtggcccagatcagcagacgagccaggcctttatatggcacagacgggggaccctgccgccgaggagtggtccccttggagcgtttgtagcctcacttgcggtcagggcctccaggtgagaacgagatcatgtgtcagctcaccatacggaaccctgtgctctgggccgctcagagagacacgaccatgtaataatagcgctacctgtcccgtggaaggtcagtggttggaatggggaccatgggggccgtgcagcacatcttgtgccaatggtacacagcagcgctcaaggaaatgttctgttgccggaccagcctgggcaacatgcactggggctctgactgatacacgggagtgcagcaatctagaatgtcctgctacagattctaagtgggggccatggaacgcctggtctttgtgctccaaaacctgtgacaccgggtggcagaggaggttccgcatgtgccaggcgaccggaacgcaaggctatccatgtgagggaacgggggaggaggtgaagccctgctcagagaaacgctgtccggccttccacgagatgtgcagagatgaatacgtgatgttaatgacctggaaaaaggcagctgccggggaaattatctataacaaatgtccgccaaatgcctcaggctctgcttcgaggcggtgtctcctgtccgcacagggagtggcctattgggggctgccctcatttgctagatgtatttcccacgaatataggtatctctacctgagtctccgtgagcacctagccaaaggccaacgtatgctcgcgggcgaaggtatgtcacaggttgtacgaagccttcaggagctgctggccagacgaacatactactcgggagatctcttgttttccgtcgatatactgcggaacgtgactgataccttcaaacgagccacatacgttccaagtgctgatgacgtacagcgattcttccaggtggtctcattcatggtggatgccgaaaacaaagagaaatgggacgacgcacaacaggtgagccctggctctgtgcacctgctgagggtggtagaagattttattcacctcgtaggggatgcgctcaaggccttccagtcctcactcatagtgaccgacaacctcgtgatctcaatccagcgggaaccggtgagcgcagtgtcctccgatatcacattcccaatgcgggggagaaggggaatgaaagactgggttagacacagtgaggatcgactcttccttccaaaggaagtcctgtctttgtcctcacccggtaagccagcaacctctggagctgcaggcagcccgggaagaggaaggggtcctgggacagtgccgcctggtcccggacacagtcatcagagactgctcccagccgatcctgacgagtcttcgtatttcgtcataggagctgtcctgtatagaacactagggcttatcttaccaccgcctagacctcccctcgcagtaacctcccgagtcatgacagtgacagtgaggccccccacccagccacccgcagagcccctgattacagttgaactgtcctacatcatcaacggaacaactgatcctcactgcgcttcatgggattattccagagccgatgcatcatccggggattgggatacagaaaactgtcagacactggagacccaggcggcgcacacacgctgtcagtgtcagtag

SEQ ID NO: 109909 - DNA, 6 bp, Artificial Sequence
  Description of Artificial Sequence: Synthetic coding sequence
atgtag

SEQ ID NO: 109910 - DNA, 3528 bp, Artificial Sequence
  Description of Artificial Sequence: Synthetic coding sequence
atggcccaaacggtgcacggggtctgggaagaatgggggtcttggagcctatgttctcgttcttgtggtcgcggttcgcgctcaaggatgaggacatgtgtcccaccgcaacacggcggtaaggcctgcgaggggcccgaacttcagacaaagttgtgtagtatggctgcctgcccagtcgagggacagtggcttgagtggggcccttggggtccctgcagtaccagctgcgctaacggcactcagcagcgctctaggaagtgtagtgttgcaggtcctgcatgggccacatgtaccggagccctcaccgatactagggagtgctccaatctagaatgtccagctacagacagtaagtgggggccatggaacgcgtggagcctttgtagcaagacctgcgataccggctggcagcgaaggtttcggatgtgccaagctacaggaactcagggctacccatgtgaggggaccggcgaggaggttaaaccgtgctcagaaaaacggtgcccagcctttcatgagatgtgtcgcgatgaatacgtcatgctgatgacttggaagaaggccgctgctggggagatcatttacaacaagtgcccacctaatgcaagcggaagcgcgtcccggcgctgtttgttgagcgctcagggcgtggcttactggggcctcccttctttcgcacggtgcatttctcatgagtaccggtatctgtatctctccctgagggagcacttagccaaaggacagcggatgctcgccggggagggaatgagccaagtggtgcgaagcttgcaggagttactagcaagacggacatactatagcggagacttgctgttcagcgtggatatacttagaaatgtgaccgacaccttcaagagggccacgtacgtcccttccgccgatgacgttcagcgtttttttcaggtggtgagcttcatggtggatgccgaaaacaaggagaagtgggacgatgctcaacaagtgtcacccggctcagtgcatctgctgagagtggtcgaagacttcattcacctagtaggtgatgcactcaaggccttccaaagttctcttatcgtcactgacaacttggtgatctccatccagcgcgagcccgtctctgctgtctcgtccgatattacctttcctatgcggggccggcgtggaatgaaggactgggttagacacagcgaggaccggctcttcctgcctaaagaggtcctgtctctgtctagtcccggaaaaccagccacgtctggcgcagcaggatcccccggacggggtcgtgggccaggaaccgtgccccctgggcccggacattctcaccaaagattgctgcctgccgaccccgacgagtcttcctacttcgtgatcggcgctgtgctttacaggacactgggcttgattctcccgcctccacgaccacccctcgctgtcacatccagagtgatgacagttacggttcgaccacctacccagccaccggctgagcccctcatcaccgtcgaactgtcctacattatcaatggcactacagaccctcactgcgcctcgtgggattattctagagcagatgcttcctcaggagactgggatacagagaattgccagaccctggaaactcaggccgctcatacccggtgtcaatgtcagcatttgagtacatttgcagtgctggcccagcctcctaaggacctgactctcgaattggctggtagtcccagcgtgcccctggtcatcggatgtgccgtgtcctgcatggcactgctgactctgttggccatctatgccgctttttggaggttcattaagagtgagagatcaataatcctacttaatttctgtctgagcattctggcctctaacatcttgatattggtcggtcaatctcgcgtgctgtccaagggggtgtgcacaatgacggccgccttcctccattttttcttcctgtcttccttctgctgggtactcactgaggcttggcaatcatatttagccgtgatcggtaggatgcgtacacgcctcgttagaaaacggtttttgtgcttgggttggggcttgccagcgcttgtggtagccgtttcagtgggcttcacccgcaccaaggggtacggaacatcatcgtactgctggctgtccttggagggcggccttctttacgccttcgttggccctgcagctgttattgttttggtcaatatgctgattgggataatcgtctttaacaaactgatggccagggacggaatttctgacaagtcaaagaagcagagagcaggggcatccctgtggtcaagttgcgtcgttctgccccttctcgctctgacttggatgagcgctgttctggcgatgacggatcgacggtcggtcctgtttcaagctttgtttgctgtgtttaactccgcccagggcttcgtaattaccgctgtgcactgctttctacgcagggaggtccaggatgtcgtcaaatgccagatgggcgtgtgtcgggcagatgaaagcgaagatagtcctgattcttgcaagaacggccagctccagatccttagcgattttgagaaggatgtcgaccttgcatgtcagactgtcctgtttaaagaagtcaacacttgcaacccttcaacgattaccggaacactaagtcgtctgagtttagatgaggacgaagaaccaaaatcctgcctggtcggacccgaaggctctctgagcttctctcctttgccaggcaatatactggtccctatggccgcatcacctggtctaggtgagccgcctccaccacaggaggctaacccggtctatatgtgtggggagggcgggttacgccaactcgacttgacctggcttcggccgaccgaacctggcagcgaaggcgattatatggtgctaccccgcagaactctcagcctccagcccggaggcgggggcgggggaggcgaggacgccccgcgcgcacggccagagggcactcccaggcgagccgccaaaaccgtggctcatacagaaggatatcctagtttcctgagtgttgaccatagcggcctgggccttggcccagcttacgggagtcttcagaatccatacggcatgacatttcagcccccacctcccaccccttctgccagacaggtacccgagcccggggagcggagtagaactatgccacggactgtccccggtagtacgatgaaaatgggttccctggagcggaaaaaacttcggtacagcgacctggattttgagaaagttatgcatactcgcaagaggcacagtgaattgtatcacgaacttaaccagaagtttcacaccttcgatcgctacaggtcccaatctactgctaaggataagccaagtcccggtgaaagacccagcctgagtcaacatcggaggcatcagtcttggtccacatttaagagcatgaccctgggatctctacccccgaaaccacgtgagcggctgaccctgcatcgggccgccgcgtgggagcctacagagccgccagatggtgattttcagaccgaggtgtag

SEQ ID NO: 109911 - DNA, 4656 bp, Artificial Sequence
  Description of Artificial Sequence: Synthetic coding sequence
atggagaacaccggatggatgggaaaaggccaccggatgactcccgcgtgccctttgctgttgtccgtcatcctatccctgcggcttgcaacagcgtttgaccctgcacccagtgcctgcagtgcccttgcctccggggtgttgtacggtgcgtttagtctccaggatttgtttccaacaatcgctagcggctgcagttggacgctagagaaccccgacccgaccaaatactccttatacctcaggtttaaccggcaagagcaggtctgtgcacacttcgcacctcgcctcctgcccttagaccactacctggtgaacttcacctgcctgaggccatcaccagaggaagccgttgcccaggcggagagcgaggtcggccgtcccgaggaagaggaggccgaggccgcggcgggtttggaattatgttccggtagcggccccttcacgtttctacattttgataagaactttgttcagctttgcctgtctgctgagccgtccgaagctccgcggttgcttgcccccgcagcactggctttcaggttcgtggaagtgttgctgatcaataacaacaatagctcacagtttacctgtggggtgctgtgcaggtggagtgaggagtgtgggcgcgccgccggcagggcttgcggctttgctcagcccggttgcagctgtccgggcgaagcgggcgcaggttctactactactacttcgccggggcctcctgccgcacacactctgtccaacgccctggtccccggcggcccggcacctcccgcggaggctgatctgcattctgggagttccaatgatctatttactaccgaaatgcgatatggtgaggaacctgaagaggaacctaaggtgaagactcagtggcccaggagcgctgacgagccagggctgtatatggcccagacaggggaccctgcagctgaagaatggagcccctggtctgtctgttcattgacttgcggccagggcctccaggtcaggaccaggtcatgtgtgagttctccctacggaactctgtgcagtggccctctgcgagaaacacgcccatgcaacaacagcgccacgtgtccagttcatggcgtgtgggaagaatggggctcgtggtcactgtgcagccgtagctgcggacgaggcagccggagcagaatgagaacttgcgtgcctcctcagcacgggggtaaagcctgcgagggacccgaactgcagaccaaactttgtagtatggccgcctgtccagttgagggacaatggctggaatggggcccttgggggccctgtagcacttcctgcgcgaatggcactcagcaaagatccagaaagtgctccgtagccggccctgcctgggccacgtgtaccggggccttaacggacactcgggagtgcagcaacctggagtgcccagcaaccgattccaagtggggcccctggaatgcttggagcctttgttcaaagacctgtgacaccggttggcagaggaggtttcggatgtgtcaggcaaccggaacccaggggtatccctgtgagggcaccggcgaagaggttaagccatgttccgagaaaaggtgtcctgcgtttcacgaaatgtgccgggatgagtacgtcatgcttatgacctggaagaaggctgctgctggggaaatcatctataacaagtgcccgcctaatgcaagcggcagcgcctcgcgccgctgcctgctgtcagcccaaggagtcgcatactggggcctaccctctttcgccaggtgcatctctcatgagtataggtatctctacctgagcctccgggaacacttggccaaaggtcagcgtatgctcgctggggaaggcatgtcgcaggttgttcggtcattacaggaactactggccagaaggacgtattatagtggcgaccttctttttagtgtggacattctgcggaatgttacagacactttcaagcgagcaacgtacgttccttcagcagacgacgttcagcggttctttcaagtcgtgagctttatggtggacgccgagaataaggagaaatgggacgatgcccagcaggtgtctcctggctccgtgcatctgctgagagtggtggaggattttatccacctagttggggatgcccttaaggcatttcagagttctctaatagtcactgataacctggtaattagcatccagagagagcctgttagcgccgtaagtagcgacatcacattcccaatgagaggtcgccgagggatgaaagattgggtacggcactctgaagataggttgttccttcccaaggaagtgctgagtctgtcgtcaccagggaaacccgcgacctcgggcgccgccgggagcccaggtagaggtcggggaccaggtactgttccacccggacccgggcacagccaccaaagactgttgccggccgaccctgatgagtcatcatattttgtgataggggcagtgctgtacaggacgctgggactgattttaccaccgcccagaccacctctagcagtgaccagccgggtcatgacagtaaccgtgcgtcccccaactcagccccctgccgagcctctcataactgtagagctatcctatataatcaacggcactacggatccacattgtgcctcatgggactattcccgggccgacgccagcagcggcgactgggatactgagaattgccagacgctagaaacccaggcagcccacacgagatgccaatgtcagcatctgtctacattcgcagtgctagctcagcccccaaaggacctgacactggagttggccggtagcccatcggtgcccctcgtgatagggtgtgcagtttcatgcatggccttgcttaccctactcgccatctacgctgccttctggcgattcatcaagagcgagcgaagcataatactcttaaacttctgcctgagtattttggcaagtaatattctgattctcgtagggcagtcacgtgtgctgagcaagggagtgtgcacgatgactgctgctttcctgcacttcttctttttaagcagtttttgctgggttttaaccgaggcatggcaaagttatctcgctgtaattggcaggatgcggaccagacttgtgagaaaacgatttctctgcttagggtggggcttacccgctttagtggttgccgtgtctgtgggcttcacaaggacaaagggctatggtacctcaagttactgctggctgtcccttgagggtggcttactatatgcgttcgttggccctgccgcagtgattgtccttgtgaatatgctgattggtatcatcgtgttcaataaacttatggccagagatggcatcagtgacaagtccaagaaacagcgtgcgggagcctcattatggtctagctgcgtagtgttgcctctcctcgccctcacatggatgtctgccgttctggctatgaccgacaggcgctccgttttgtttcaggccttgtttgccgtgttcaatagcgcacagggcttcgtcatcacagccgtccattgctttttgcgtcgcgaggtgcaagatgtggtgaaatgtcaaatgggtgtctgcagggcagatgagagcgaggattcccctgatagctgcaaaaatgggcaactccaaatcctgtccgacttcgagaaggacgtggatctggcttgtcagaccgtgctcttcaaagaagtgaacacatgcaacccaagcacaattacaggtaccctgtcaaggttgagccttgatgaggacgaagagcctaaaagctgtctcgtcggaccagagggcagcctctcatttagtccattgccaggaaacatcttagtgcccatggccgcatcccccgggttaggggaacctccaccaccacaggaagcgaatccagtgtacatgtgcggtgaagggggcctccgccagttggacctgacgtggttgcgacccaccgagcccggatcggagggtgactacatggtcctgccccgcaggactctctctttacagcccggaggcggtggcggcggtggggaggatgcaccccgggctcgacccgaagggacgcctagacgggccgcgaaaaccgtggcccacacagagggctacccgagcttcttgtccgttgatcatagcgggctgggccttggccccgcatacgggtctttgcagaacccttatgggatgactttccagcctcctccgcctactccaagcgccagacaggttcctgagcctggggagaggtctaggactatgcccagaaccgttccgggctccaccatgaaaatgggcagtctcgaacgcaaaaagcttagatacagcgatctggacttcgaagtcatgcatacaagaaaacggcattctgagctttaccacgaacttaatcagaagttccacactttcgaccggtaccgatcacagtctactgcaaagagagaaaagaggtggtccgtgagttcaggcggtgctgcggaacgatctgtgtgcactgacaaacctagccccggagagcgccccagcttatcccagcacaggaggcaccagtcctggtcgacttttaagtctatgaccttaggctcgctccctcctaagccacgagagcggctgaccctgcaccgtgccgctgcgtgggaacctacagaacctcctgatggtgactttcagaccgaagtttag

SEQ ID NO: 109912 - DNA, 2187 bp, Artificial Sequence
  Description of Artificial Sequence: Synthetic coding sequence
atgctattgccgcaaggtaaagaggccgtagaaggaaagaaatgccaggggaggcagagacgtgcaggcttatcagaggtctggtcgaggaagctcaggaacgagagcctgggtacctggtctacgcagggctgcaagaccgtgctaacagacgcgagtcatacaaagtgtttgtgtgaccgcttaagcacttttgccatattggcccagcagccaagagagataatcatggagagtagtggaaccccctctgtgactctcatcgtagggtctggtctgagctgcctggctctgattactctggcagtggtgtatgccgctctgtggcggtacattcgctccgagagaagcataattctgataaatttttgcctaagcattatttcgtccaatatcttaatcctggttggacaaacgcagacccataataagtcaatttgtacaacaacaaccgcgttcctgcacttttttttcctggcctctttctgctgggtcctgacagaggcctggcagtcttacatggccgtcacgggcaagatccgcactagactgatacgcaaacgtttcctctgcctcggctggggattaccagcactggtggtcgcgacgagtgttgggttcacccgcacaaaggggtatggtaccgaccattactgctggctgtccctggagggaggtttgctatatgctttcgtgggccctgcagcagccgtggtgttagttaacatggtcataggtattctagtgtttaacaagctggtgtccagggatggaatacttgacaaaaagttaaagcatagagccggtcagatgtccgagccacattccgggctgacgctgaaatgtgcgaaatgtggcgtggtgagtaccaccgccctttctgccacaaccgcctcaaatgccatggcaagtctctggtccagctgtgttgtgctcccactgttagccctaacgtggatgagcgcagtgttggcaatgactgacaagaggagtatcttattccagattttgttcgcagtctttgattctttacaggggtttgtcattgtgatggtccactgtattttacgacgtgaggtccaggatgctttccgctgtaggctgcggaattgccaggacccgattaatgccgactcatcaagctccttcccaaatggacatgcacaaatcatgacggatttcgagaaggacgtagacattgcctgccggtctgtattgcacaaagacataggcccgtgtagagctgcaacaataaccggcaccctctcgagaatttccttgaatgatgacgaggaggagaaagggactaaccctgagggcctttcctattcgacactgcccggcaacgtgatttctaaggtcattatccagcagccaacggggctgcacatgcccatgagcatgaatgagctctcaaacccatgcttgaagaaggaaaactcggagctgagacggaccgtgtacctgtgcacagatgataatctgcgcggggctgatatggatattgttcacccacaagagagaatgatggagagtgattatatcgttatgcccagatcatctgtgaataaccagccgagcatgaaggaggagagcaagatgaacatcggaatggagaccctgccacatgagcggctgctgcactataaggtgaaccctgagtttaacatgaacccccccgttatggaccagttcaacatgaacctcgaacagcatctggctccacaggaacacatgcaaaatttaccctttgagccacggacagctgtgaaaaatttcatggcctctgagcttgatgacaatgcagggctaagtcgtagcgaaaccggttcgaccatctccatgtcttctctagaacggagaaagtctagatatagtgatctcgattttgaaaaggtaatgcatacaaggaagcggcatatggaactgttccaggagcttaaccaaaagttccaaactctggatagatttcgggatatacctaacaccagcagcatggaaaatcccgcgcctaacaagaatccctgggatacttttaaaaacccgtcagagtacccacactatactaccatcaacgtactggataccgaagcaaaggatgcactggaacttcggcccgctgaatgggaaaagtgcttgaatttacccctggacgtccaggagggcgattttcaaactgaggtctag

SEQ ID NO: 109913 - DNA, 4569 bp, Artificial Sequence
  Description of Artificial Sequence: Synthetic coding sequence
atgaaagcagtgagaaacctgctgatctatatatttagcacatacttgcttgtcatgtttggatttaacgctgcacaggacttctggtgctccaccttggtcaagggtgtcatttacgggtcttattcagtaagcgagatgtttccaaagaactttactaactgtacctggaccctagaaaatcctgacccaaccaagtacagtatttatctcaagttctccaagaaagacctgagctgttccaatttttcccttctggcttaccagtttgatcacttttcccacgaaaagatcaaggaccttttgaggaaaaaccacagcattatgcagctgtgtaactcaaaaaatgccttcgtgtttcttcagtacgataaaaatttcatccagatcaggcgcgtgttccccaccaattttcctggccttcagaagaagggtgaggaagaccagaagtctttcttcgagttcttggtcctcaacaaggtttccccatctcagttcggttgtcatgtactgtgtacctggttggaaagctgtctgaaaagcgaaaatgggagaactgagtcatgtggaataatgtataccaaatgtacttgcccacagcacctgggtgaatggggtattgacgaccagtccttaattttgctgaacaacgtcgtgcttcctttgaacgagcagactgagggctgcctgactcaagaacttcagaccactcaagtttgtaatcttactagagaagccaaacgtccccccaaggaggaattcggaatgatgggcgatcatacgatcaaatctcagcgcccacgatctgtgcacgaaaaaagagttcctcaggagcaggccgacgccgccaaatttatggcacagacaggcgagagtggcgttgaggaatggagtcaatggagcacatgctctgtgacttgtggccagggctcgcaagtgcgtacacgtacttgtgtgagtccctatgggacccactgtagtggccctttgcgcgagagtagagtgtgtaacaacaccgccttatgtccagtgcacggcgtgtgggaggaatggagcccatggagcctctgcagcttcacatgcggccgtggacagcgcacccgtactcggagctgcacgccaccgcaatatggcggaagaccctgcgagggaccggaaacacaccacaaaccatgtaacatcgccttgtgccctgtcgacgggcaatggcaggagtggagcagctggagtcagtgtagcgtgacttgttctaatggaacccagcagcggagtagacagtgtaccgcggccgcacacggaggctcagagtgcagaggcccatgggctgaaagcagagaatgctacaatcctgaatgtaccgccaatggccagtggaatcagtggggacactggtccgggtgcagtaagtcatgcgacggggggtgggagcggcgcattagaacctgccagggcgctgtcatcaccggacaacagtgcgaagggacaggtgaggaagtgagaaggtgtaatgagcagagatgcccagccccttacgagatttgcccagaagattacttgatgagtatggtgtggaagcggacgcctgctggcgacctggcttttaatcagtgccccttgaatgctactggaacgacatcacggcggtgtagcctgtcgctgcacggcgtggctttttgggagcagccaagttttgcgaggtgtatcagcaacgagtaccggcaccttcagcacagcatcaaagaacaccttgcaaaaggtcaaagaatgttggctggggacgggatgtcacaggtaacaaaaacactcctggatctaacccagcggaagaatttttacgcgggagacttgcttatgtctgtggagatactcaggaatgtcacagataccttcaagcgagctagttatatccctgcctcagacggtgtccagaacttctttcagatcgtatccaaccttttagacgaagagaataaggaaaagtgggaagatgcacaacagatctatcctggctcgattgagctgatgcaggtgatcgaagatttcattcatatcgtcggcatgggcatgatggattttcaaaacagctacctgatgacgggaaatgtcgtggcctccatccagaagctgcctgccgccagcgtacttacggacatcaactttcccatgaaaggcaggaagggaatggttgactgggcccgcaactctgaggacagagtggtgatccccaagagcattttcactcccgtcagctctaaggagttggatgaatcttctgtgttcgtgcttggtgcagttctctataaaaacttggacctgatactgcctacgctgaggaattacacggtgattaactctaaaattatcgttgttactatccggcccgagcccaagaccaccgattccttcttggagatcgaactggcgcaccttgcaaatggcactttaaacccatattgtgtgttatgggatgattccaagacaaacgagtccctgggaacctggtctacacagggctgcaaaaccgtgctgacggatgccagtcataccaaatgcctatgtgacaggctctcaacttttgcaatcttggcccaacagccacgggagatcatcatggaatcctcaggtaccccgagcgttacgctcatagtgggatctgggttgagttgtctcgccctcatcacacttgctgtggtctacgccgctttgtggagatatatcaggtctgagcggtcaatcatactcatcaacttttgcctgagcataatatcttctaacattctcatcctagtcggacagactcagactcacaataagtccatctgcacaacaacaactgccttcttacattttttcttcctggcgtctttctgctgggtgttgacagaagcctggcagtcctacatggcagtaactggaaagatacgaacccgactcataagaaaacgcttcctttgtttgggctggggcctgcctgctctggtggtggctactagtgttgggttcaccagaacgaaagggtacggcaccgatcattattgctggctgagcctcgagggcggactcctctacgcttttgtgggtccggcggctgcagtggttctggtcaacatggtcattggaattctcgtgttcaataaactggtctccagagacggaattttagacaagaagttaaaacatcgagccggacaaatgtcggaaccacatagcggactgacactgaaatgtgcaaagtgcggggtcgtgtccactaccgcgctttctgccaccaccgccagtaacgccatggcctccctgtggtcctcatgtgtggtgcttccgctgctggcactcacttggatgtctgcagttctcgccatgactgataagcggtcaattttattccagatactatttgcagtgtttgattccttgcaggggttcgtgatcgtgatggtgcattgcattctgaggcgagaagtacaagacgcatttcgttgtcgactcaggaactgccaggatcccataaacgccgacagttccagcagctttccaaacgggcatgctcaaatcatgactgactttgaaaaagatgtggacattgcctgccggagtgtcctccacaaagatattggaccctgcagggcagccactattacgggcacattatcgcgaatttctttgaacgacgacgaagaagagaaagggacaaaccccgagggcttaagctacagtaccttgcctgggaacgtgatttcgaaggtgatcattcagcagcccaccggcctccacatgccgatgtcgatgaatgagctcagcaatccttgcctaaaaaaggagaactccgagctccggcgcacagtctatttgtgtaccgacgataacttaaggggggctgacatggatattgtgcatccacaggagaggatgatggagtcggactacattgttatgccccggtcctccgttaacaatcagccctccatgaaggaggagagcaaaatgaacatcggcatggaaacactaccccacgaacgcttattgcactataaggtaaatcctgagtttaatatgaaccccccagtgatggatcaattcaacatgaacctagagcagcacttggcccctcaagagcacatgcagaatcttcccttcgagccccgaacggccgtcaaaaacttcatggcctcggagctcgacgacaacgcggggttgagcagatctgagacaggcagtactatctccatgtcatcacttgaacgaagaaaatctcggtattccgacttggattttgagaaggtgatgcacactcgcaagaggcacatggagttgtttcaggagttgaaccagaagttccagacacttgaccgctttcgtgacattccaaacacctctagcatggaaaaccctgcccccaacaaaaacccatgggatacttttaagaatccatcagaatacccccactatacgactatcaatgtgctagataccgaggccaaggacgcgctcgagctcaggcctgcggaatgggaaaagtgccttaatttgccccttgatgtgcaggaaggtgatttccagactgaagtgtag

SEQ ID NO: 109914 - DNA, 1461 bp, Artificial Sequence
  Description of Artificial Sequence: Synthetic coding sequence
atggttatcggaattctggtctttaacaagcttgtgagtagagacggaattctggataagaagctgaaacaccgagccggtcagatgtctgagccacattccggcctgacactgaaatgcgctaaatgtggagtcgtaagcacaaccgccctgtccgcaactacggcctctaatgctatggcctccctctggagtagctgtgtggttcttcccctcctcgccctgacttggatgtctgctgttctcgccatgaccgataagagatccattctgtttcagatcctctttgccgtgttcgatagcctacagggcttcgtcatcgtgatggtgcattgtattctccggagggaggtgcaggatgcctttaggtgcaggctcaggaactgccaagatccgatcaacgctgatagttcatctagcttccccaatggacacgcccaaattatgacagacttcgagaaagacgtcgacattgcctgtaggtctgtgctccacaaagacattgggccatgcagggcagctacaataactggtaccctttcgcgaatttctctgaacgacgatgaggaagagaaaggtacaaaccccgagggactctcctactcaaccctgccggggaacgttatctccaaggtgatcatccaacagcctactgggctccacatgcccatgtccatgaatgagctctccaatccatgcctcaaaaaagaaaactccgaactccgccgcacagtctacttatgcacagatgataacctaaggggggcggacatggacatcgtgcacccccaggagcgtatgatggagagcgattacatcgtgatgccgcggagcagcgtgaacaatcagcccagcatgaaagaggagtctaaaatgaacattggaatggagacactgcctcacgagcggctacttcactacaaagtcaatcccgagtttaatatgaatccaccggtcatggaccagttcaacatgaatctggagcaacatttggccccccaagaacatatgcagaacctgccttttgaaccccgcacagctgtgaagaactttatggctagcgaacttgacgataacgccggcctctcccgcagtgaaaccggctccaccatcagtatgagctctttagagcgaagaaagagccggtacagcgacctggactttgagaaggtcatgcacacccggaagagacacatggaactgtttcaggaattgaatcagaaattccagactctggatcgattccgagacatccccaatacttcctccatggagaacccagctccaaacaaaaacccatgggacacattcaagaacccttccgaataccctcattacacgacaatcaacgtgttggataccgaggcaaaggacgccctggagctcagaccagccgagtgggaaaagtgccttaatctccccctggacgtacaagagggcgattttcagactgaggtctag

SEQ ID NO: 109915 - DNA, 978 bp, Artificial Sequence
  Description of Artificial Sequence: Synthetic coding sequence
atgaaggccaaagacttgatcgtgacccctgctaccattttaaaggagaagcctgaccctaacaacctggtgttcggcaccgtcttcaccgaccacatgcttacagtggagtggtctagcgaattcggctgggagaaacctcatattaaaccattgcagaatttgtcacttcatccagggtcctccgccctgcattatgcagtcgaggtgttcgacaaggaggagctgctcgaatgtattcaacaactagtgaagttagaccaagagtgggttccatattccactagcgcctccctgtatattcggccaacttttattgggacagaaccgtcattaggtgtcaaaaaacccacaaaagctcttctgtttgtgttactgtctccagtagggccgtatttttctagcggaacattcaacccagtcagcttatgggctaaccctaagtacgtgagagcttggaaggggggaaccggtgattgcaagatgggcggtaactacgggtctagcctcttcgcccaatgtgaagccgtcgacaacggttgccagcaagtgctctggctgtacggtgaggaccaccagataaccgaggtgggaacaatgaacctcttcttatactggatcaacgaggatggtgaagaggaacttgcgacacctccactggacgggattatccttccaggtgtgacacgcaggtgtattctggatctggctcaccagtggggggagtttaaagtttctgagcggtacctgaccatggacgacctcaccacagccctcgaggggaacagagtgcgcgagatgtttggctcaggcaccgcctgtgttgtttgtcccgtcagcgacatcttgtataagggggagaccatccatattccaaccatggaaaacgggccaaaactggcctcacgcatactgtcaaagctgacggacatacagtatggcagagaggagagcgattggacaattgtgctctcatag

SEQ ID NO: 109916 - DNA, 1158 bp, Artificial Sequence
  Description of Artificial Sequence: Synthetic coding sequence
atggactgctccaacggatgcagcgccgaatgcaccggcgaggggggaagtaaagaggttgtgggcaccttcaaggcgaaagatctcatagtgacccctgccactattctcaaagaaaagccagacccaaacaacttggtgttcggcaccgtgtttacagatcatatgctgaccgtggaatggtcctcagagtttgggtgggaaaagcctcacattaagcccttacagaatttatcgttgcaccccggctcttcagctctgcactacgccgtggagctgttcgagggccttaaggcattcagaggcgtcgacaacaagattcgactatttcagcctaatctcaacatggaccgaatgtataggagtgccgtcagagcaaccctccctgtatttgataaggaggaacttctcgagtgtatccagcagctcgtaaagctagaccaggagtgggtaccctatagcacctccgcttctctgtacattaggcctacatttatcggaaccgaaccaagccttggtgtcaagaaaccaactaaggcactgctgtttgtactgttgtcaccagttggcccctacttctcttccggtaccttcaaccctgtgagcctctgggcaaaccctaagtacgtacgcgcttggaaagggggcactggagattgcaaaatgggggggaactatggtagttcactctttgctcagtgcgaggccgtagataatggatgccaacaggtgttgtggctgtatggcgaagaccatcagatcactgaagtgggcaccatgaatctgttcctgtactggattaatgaagatggagaggaagagctggctaccccgcctctagatggcatcatactccctggcgtgacacggaggtgcatactggacctcgcacaccagtggggcgaatttaaagtgtccgagcggtacctgaccatggacgacctgacaacggcactggaaggaaatagggtgagagaaatgtttggcagcggtacggcctgcgttgtgtgtcccgttagcgacattctgtacaagggagagaccatacacattccgaccatggagaatggtcctaagttggcctcccggatcctatccaaactgactgacatacagtacggccgggaggaatcagattggaccatcgtgctgtcctag

SEQ ID NO: 109917 - DNA, 1197 bp, Artificial Sequence
  Description of Artificial Sequence: Synthetic coding sequence
atggccagccccctaagaagtgccgcagcacttgcgcgccaggactgtagtaatggctgcagcgctgaatgtacgggcgaagggggctcaaaggaagttgtcggcactttcaaagccaaggacctgattgttaccccagccactatcctgaaagaaaaacccgaccctaataatctcgttttcggtaccgtcttcacagaccatatgctgaccgttgagtggtcttccgagtttggatgggagaagcctcatatcaaacctcttcagaatctctctctgcacccgggaagcagcgccttgcactacgcggtggaactcttcgaggggctgaaagcattccggggggttgacaacaaaatacgcctgttccagccaaatttaaacatggaccggatgtatagatcagccgtgagagcgaccctccccgtgttcgataaggaggagctgctcgagtgtatccaacaactggtgaagcttgatcaagagtgggtgccttactccacatcagcatccttatatatcaggccaacttttatagggacagaaccttccctcggcgtcaagaagccgacaaaggccctgttatttgtgttgctgtcacccgtcggtccctacttttcgtctggaaccttcaatcccgtgtctctgtgggcgaatccgaaatacgtgcgggcgtggaagggcgggactggggattgcaaaatgggcggaaactacgggtctagcctgtttgctcagtgcgaagcggttgataacggctgccagcaggtcttgtggctatatggcgaagaccatcagatcacggaagtggggacgatgaatttatttttgtactggatcaatgaagatggcgaagaggagctagcaacaccccccctagatggaatcattctccccggagtcacaaggcggtgcattctcgatctggctcaccagtggggcgaattcaaggtcagtgagaggtatctgacaatggatgacctgacaacagcgctggaaggaaatcgggttcgggaaatgttcggcagtgggactgcctgcgtagtgtgtcctgtctcagatatcctgtacaaaggagagactatacatattccgacaatggagaacggtcctaagctggcaagtagaatcctatcaaaactgacagatatacagtatgggcgtgaggagagcgactggaccattgtcctctcttag

SEQ ID NO: 109918 - DNA, 1050 bp, Artificial Sequence
  Description of Artificial Sequence: Synthetic coding sequence
atgaaggattgctcaaacggctgctccgctgaatgcaccggagagggcggaagtaaggaagtggtaggcacttttaaggccaaggacctaatcgtgacccccgcgacgattctaaaagagaagcccgaccccaataatctggtgttcgggacagtgtttacagaccacatgctcaccgtggaatggtcttcagaatttggatgggagaaaccacatataaaacccctgcagaatctttctctgcatcccggcagtagtgccttacactatgccgtggaagtgtttgacaaagaggaactcctcgaatgtatccagcagctggtgaagctggaccaggagtgggtgccctattccacctccgctagcctgtacatccggcctaccttcattggcaccgaaccatctttaggcgtcaagaagcctacaaaggctctgctcttcgtattactcagtcccgtgggaccctacttctcctcaggcacctttaatcctgtcagtttatgggctaaccccaagtacgtgcgcgcttggaagggcgggacaggcgactgtaagatgggcggcaactacggcagcagtctttttgcccaatgtgaagctgtcgacaatggatgccagcaggtgctgtggctgtatggagaggaccatcaaattaccgaagtgggaaccatgaatctatttctctactggatcaatgaagatggcgaagaggagcttgcgacccctccattggacggtatcattttacctggcgttactagacgctgtatcttagacttggcccaccagtggggcgaatttaaagtcagcgaaaggtacttaacaatggacgatctgaccactgcactggagggcaaccgcgtgcgggagatgtttggatcgggcacagcctgtgtcgtgtgtccagtgtccgatatcctgtataaaggcgagaccattcacattccaacgatggaaaacggcccaaaactcgcttccagaatcttgtcaaagctgacggacatccagtatggaagagaggaatcagattggaccatcgtgctctcctag

SEQ ID NO: 109919 - DNA, 1161 bp, Artificial Sequence
  Description of Artificial Sequence: Synthetic coding sequence
atgaaagactgcagcaacgggtgttcagccgaatgtacgggcgaaggtggaagcaaggaagtcgtaggtactttcaaggcaaaggacctgatcgtgacccccgctaccatcttgaaagaaaaacccgacccaaacaacttagtgttcgggacggtcttcaccgaccacatgctgacggtggaatggtcctccgagttcggttgggagaagcctcatattaagccacttcagaacttgtctctacatccaggctcatcagccctgcattacgccgtcgagttgttcgagggcctcaaagcctttcggggtgtggataacaagatcaggcttttccagccaaatctgaatatggatagaatgtatcgttcagccgtcagagcaacgttaccggtgttcgataaggaagagctgctggagtgtattcagcagctcgtaaagctggaccaggagtgggtcccctactcaacgtccgctagcctgtatattaggcccacgtttataggcactgaaccctctctgggggttaagaaacctactaaggcactgttgttcgtgctgttgtctccagttggcccctatttttcttccggtacatttaatcctgtttcactgtgggcaaaccccaaatatgtgagggcttggaagggggggactggtgactgtaaaatgggtggcaattatggaagctctctctttgcacagtgtgaggctgtcgataatggatgccaacaagtcctttggctgtacggcgaggaccaccaaattaccgaggtcggcacaatgaatctgttcctgtactggatcaatgaagacggagaggaggaactggccactcccccccttgatgggattatattgcccggcgtgacccggcgttgcatcctggacctggcacaccagtggggggaatttaaggtttccgaacgctaccttaccatggacgacttaactactgcacttgagggtaatagggtgcgggaaatgtttgggtctggaaccgcctgtgtggtgtgcccagtgtccgatattctgtataagggggaaactatccatatccctactatggagaatgggcccaaactggctagcaggattctctccaaactcactgatatacaatacgggagggaggagagcgattggactattgtgctgagttag

SEQ ID NO: 109920 - DNA, 1179 bp, Artificial Sequence
  Description of Artificial Sequence: Synthetic coding sequence
atggccgctgcagcactgggccagatatgggcgagaaagttgctgagcgtgccatggctcctctgtgggcctaggaggtatgcgtcctcatcttttaaggccgcagatcttcaactcgagatgacccaaaaaccacacaaaaaacctggccctggcgaaccgcttgtgtttgggaaaactttcactgaccatatgctgatggtggagtggaatgacaagggctggggtcagcctcggatacagcctttccagaacctgacacttcatccagcatccagctccctccattatagtctgcagctgttcgaaggcatgaaggcctttaaaggcaaggaccagcaggtgcgcctttttcgcccttggctcaacatggacagaatgttgcggtccgcgatgcggttgtgtctgcctagtttcgacaagctggaattgctggagtgcattcggcgcctcatcgaggtcgataaagattgggtccccgatgctgctggtaccagcctgtacgtcaggcccgtgctgattgggaacgaaccatccctcggcgtgtcccagcctacgcgggccctgctctttgttattctctgcccggtgggagcctattttccgggcggtagcgtcacccccgtgagcctcctggctgatccagcctttatccgggcatgggtgggaggtgtcgggaactacaagctaggtggcaactacggacccaccgtgctggtccagcaggaggctctgaagcggggatgcgaacaggtgttgtggctctacggtccggatcatcagctgacagaggtgggaaccatgaatattttcgtttattggacacacgaggatggagtgctggagctcgtgacgccacctttgaatggggtgattctacccggcgtagtccgtcagagtttactggacatggcccagacatggggggagttcagagttgtggagaggacaatcacaatgaagcagctgttgcgggccctggaagaaggccgcgtcagggaggtgttcggaagtggtaccgcgtgtcaggtatgcccagtgcacagaatcttatataaggataggaacctccatatcccaacaatggaaaacggacctgagttgattctcagattccagaaggaacttaaggaaatccaatatggcatcagggcccatgagtggatgttccccgtctag

SEQ ID NO: 109921 - DNA, 1059 bp, Artificial Sequence
  Description of Artificial Sequence: Synthetic coding sequence
atgacccaaaagcctcacaagaagcccggccccggcgagccattagtgttcgggaaaacttttacggatcacatgttgatggtagaatggaacgacaagggctggggccagccccgtatacagccgtttcagaatttaacgctccaccccgccagctcaagcctccattacagcctgcagctctttgaaggcatgaaagcctttaagggcaaggaccagcaggtgcgtctgtttcggccttggctaaacatggaccgcatgctacgctcggcgatgcgtctctgtttgccctccttcgacaaactagaactgctcgaatgcattaggcgcctcattgaagtggataaagattgggtccccgacgccgcgggcacatcactctacgtgcggccagtccttatcggcaacgaaccctcgcttggcgtgtcccagcctacgcgggcccttctgttcgtaatattatgccccgtgggagcctatttccctgggggttctgtcacaccagtttcgcttctagccgacccagctttcattagagcctgggttggcggagtcgggaactacaagctgggaggcaactacggaccaacagtgctggttcaacaagaggccttaaaacgcggttgcgaacaggttctgtggctttatggtcctgatcaccagctgactgaggtgggcaccatgaacatattcgtatactggacacatgaagacggggtattggagctggtgactcccccgctgaatggcgtaattctccctggagttgtgcgacagtctctgctggatatggcccaaacttggggagagtttagagtagtggagcgtaccattaccatgaaacaactccttagagcactggaagaaggccgggtgagggaggtcttcggttcgggcaccgcttgtcaggtctgccccgttcacaggatcctctataaagacaggaacttgcatattcctacaatggagaatggccctgagctgatcctgagattccagaaggaacttaaggaaatccagtacggaatcagagcccacgaatggatgtttccagtgtag

SEQ ID NO: 109922 - DNA, 903 bp, Artificial Sequence
  Description of Artificial Sequence: Synthetic coding sequence
atggcagccgctgcactcggacagctattcgagggaatgaaggcttttaaaggcaaggatcagcaggtgaggctttttcgaccctggctaaatatggaccggatgctgagatctgccatgagactgtgtttaccatcttttgacaagctggagttattggagtgtatccgcagactcatcgaagtcgataaagactgggttccagacgccgccggcacatctttgtacgtgcgcccagtcttgatcggaaacgaaccctctctaggtgtatcacagcccacaagagcactcctcttcgtgatcctctgcccagtgggagcctatttcccagggggctccgtgacccccgtcagcctactagctgaccctgcttttattcgtgcgtgggtcgggggggtgggtaattataagctggggggaaactatggacctaccgtgctggtgcagcaagaggccttgaagcggggttgcgaacaggtactgtggctctacgggccagaccaccagctgaccgaagtgggaaccatgaacatctttgtgtactggacacatgaggatggcgtccttgagctggtcacccctcctttaaacggtgtgattctgccaggcgtggtacgccaatctctgctggacatggcacagacctggggtgagtttagagtcgtggagaggacaataacaatgaaacagctgctcagggcacttgaggagggtcgcgtgagggaggtttttggatcgggaaccgcgtgccaggtctgtcccgtgcaccgtattttgtacaaggaccggaatcttcacattcccacaatggagaacggacctgaactgattcttagatttcagaaggaacttaaggagatccagtacggcatccgagcacacgagtggatgttccctgtgtag

SEQ ID NO: 109923 - DNA, 1338 bp, Artificial Sequence
  Description of Artificial Sequence: Synthetic coding sequence
atggctgtagctattgccgcagccagagtgtggagactgaacaggggcctatcacaggctgctctcttgctcctccgacaacccggggcccgcgggctggcccgatcacatccacctcgacagcagcagcagttctcatctctcgatgacaaacctcagtttcctggggcaagtgctgaattcattgataagttggagtttatccagccaaatgtgattagcggcattcctatctatcgggtgatggatcggcaaggacagattattaaccccagtgaagacccgcatctccctaaggagaaagtcttgaagctctacaagagtatgacgctgctcaacacaatggaccggatactttatgagagccagagacaagggcggatcagtttctatatgactaattacggcgaagaaggcactcacgtgggatcagctgctgccctggataacacagatctggtcttcggacagtatcgagaggccggtgtactgatgtaccgcgattatccactggagctgtttatggctcagtgttacggtaatatctcagaccttggaaagggccgccagatgcctgtgcactatggatgcaaggagcgacacttcgtgacgataagctctccgctggcaacccagattccacaggccgtgggtgcagcctatgctgcaaagcgcgcgaatgctaatcgggtggtgatctgctattttggcgagggagctgcctctgagggggatgcccatgctgggtttaattttgcagccacccttgagtgtcccattatctttttttgtagaaataacggttatgcaataagtaccccgacctccgagcagtaccggggcgacggaatcgcagctcggggcccgggctacggcatcatgagtattcgagtcgacggtaacgacgtgttcgccgtctataacgccacaaaggaagctaggagaagggccgtggccgaaaatcagccatttctcatcgaagccatgacatacaggatcggacaccactcaacttccgacgacagcagcgcataccgtagcgtagatgaagttaattattgggacaagcaggaccatccaatcagcaggctgcgacactacctgctctctcagggatggtgggacgaggagcaggagaaagcttggcgcaagcagtctcgacggaaagtcatggaggcctttgaacaggcagaacggaaacccaaaccaaatcctaacttacttttctctgacgtgtaccaggagatgcccgcacaactgagaaagcagcaagaatctcttgctaggcatcttcagacttatggcgagcattacccactggaccactttgacaagtag

SEQ ID NO: 109924 - DNA, 1212 bp, Artificial Sequence
  Description of Artificial Sequence: Synthetic coding sequence
atggctgttgccattgccgcagcccgggtgtggaggctcaaccggggcctgtctcaagcggccctgctcctgttgaggcaacctggcgcccgaggtctcgcgaggtcccaccctccccgccagcaacagcagttttcaagcttggacgataaaccccagttccctggcgcctcggcagaattcattgataagctggaatttatacagcccaacgtaatctccggcattcctatttatagagtgatggatagacagggccagattatcaatccatccgaagatccccacctgcctaaagagaaagtgttaaagctttataaatccatgacactcctgaacaccatggatagaatcctgtacgaaagtcagcggcaggggcggatttctttttatatgactaactatggcgaagagggaacccacgtcggaagtgcggccgctctggataatacagacctcgtgtttgggcagtacagggaggccggagttctgatgtacagagactatcccttggagctgtttatggcccagtgctatggcaacatatcagacctaggcaagggacgccagatgcctgtgcactacggatgcaaagaaagacacttcgtgacaatttcctctccgctcgctacccagataccccaggctgttggcgcggcctatgcagcaaagcgggcaaatgccaatagagtggtcatttgctattttggggagggcgctgcatcggagggagatgcccatgctgggttcaatttcgctgccactctggaatgcccgataattttcttttgcaggaataatggatacgccatttctacccccacctccgaacagtataggggagacggcattgcagcccgtggccccgggtacggcattatgtctattcgggtggacgggaacgacgtgttcgcggtttacacagccaccggaggccccaaggccagggcctctgtcgggcctagcagtccaagcaccactggcacatgtggaatcatgatgcccttgcacgctatgggcctttggcacccagtaagtcatcagcaggagctgtccgcggcccctaagcctaagggaaccactaaacctatcctagaatcttatctcaagtctcacctgctaggacactcacgttaccagctgtatattcatcaggatgcagtgcgtagagaaaagcctcaatccaacctgaatcgcgagagccttatatag

SEQ ID NO: 109925 - DNA, 1179 bp, Artificial Sequence
  Description of Artificial Sequence: Synthetic coding sequence
atggctgtggttgctgccgccgctggatggcttctgaggctccgtgctgcaggagcggaaggccactggcgtagactacctggagcagggctggcgcgtggattcctacacccagctgccacggtcgaggatgccgctcagaggaggcaggtggcccactttactttccagccagaccctgaaccccgagagtacggccaaactcaaaagatgaacctgttccagagtgtgacctccgcccttgacaattcattggctaaggacccaactgcagttatcttcggcgaagatgtagctttcggcggggtgttcaggtgtacggtgggcttgcgtgacaaatacggcaaggatagggtctttaatacacccctgtgcgagcagggaatagtggggtttggcattgggattgcggtcactggtgctactgcgatcgcagaaatccagtttgcggactatatattccctgcgttcgaccagattgttaacgaagccgcgaaatatcgctatcgctccggcgatctatttaactgtgggagcctcactatccgttctccttgggggtgcgttgggcacggggcactataccactcccaaagccccgaagcgttttttgcacattgccccgggatcaaggtcgtcatcccaaggagcccattccaagcgaagggcttgctcctgtcttgtatcgaggacaaaaacccgtgcatcttcttcgaacctaagatcctctatcgtgctgccgcagaggaagtgcctattgagccctataatattcctctgtctcaggctgaagtgatccaagagggaagtgacgtcactctggttgcctggggcacgcaggtgcacgttataagagaagtggcctctatggcaaaggaaaagcttggagtgagttgcgaggtgatagatctccgcacgatcatcccctgggatgtagacactatctgcaagagcgtgatcaaaacgggtcgcctcctcattagtcacgaggcgcctctgacgggcgggttcgctagcgagattagctccaccgtccaggaagagtgctttctgaatttagaggccccgatatcaagggtatgtggctacgacactccattcccccatatatttgaacctttctacatccctgacaaatggaaatgttacgacgcactgagaaaaatgatcaattattag

SEQ ID NO: 109926 - DNA, 1179 bp, Artificial Sequence
  Description of Artificial Sequence: Synthetic coding sequence
atggcagtcgtggccgccgcagccggctggcttctgcggctgcgtgctgccggtgccgaaggccattggcggcgcctaccaggcgcgggcctcgcacgcggctttctgcatcccgctgctacagtcgaagatgcagcccagaggcgccaagtggctcacttcaccttccagcctgatccagaaccccgtgaatatggccagacccagaaaatgaacctgtttcagtccgtcacctctgccctcgacaattcgctggcaaaggatcctacagccgttatctttggggaagacgttgcttttggcggcgtgtttaggtgcacagtgggattaagagataagtatggcaaggatcgcgttttcaacactcccttgtgtgagcagggaatagtaggttttggaattgggattgcggttaccggggctacggccatagctgagatccagtttgccgactatatctttcccgccttcgatcagatcgtgaatgaagcggcaaagtaccgttacaggtccggcgatttattcaattgtggctctctgacaatcaggtctccctggggctgtgtgggccacggtgctctgtatcattcacagtccccagaggcattctttgcgcattgccccggtatcaaggtcgtgattccaagatctccctttcaggctaaaggcttgctcctgagttgtatcgaagacaagaatccctgtattttctttgaacccaagatactctatagggcagcagcagaagaggttccaatcgaaccctacaacattccactgagccaggccgaggttatccaggagggtagcgacgtcacattagtggcatggggcacacaagtacatgtgatcagagaggtcgcaagcatggcaaaagagaaattgggcgtgtcttgtgaagtcattgacctgaggacaataatcccctgggatgtggatacaatatgtaagagcgtaataaagactggtaggttgctaatctctcatgaggccccactgaccggagggtttgcctctgagatttcaagcacggtgcaggaggaatgcttcctgaatctcgaagctccaatcagccgggtgtgtggctatgatacgccattcccgcacattttcgagcccttctatatccctgacaagtggaagtgttatgacgcactccgcaaaatgattaattattag

SEQ ID NO: 109927 - DNA, 657 bp, Artificial Sequence
  Description of Artificial Sequence: Synthetic coding sequence
atggccgtggtggcggccgccgcaggttggttactgaggcttcgcgcagctggcgccgaggggcactggaggagattacccggggccggactggcccggggatttctacatccggctgccactgttgaagatgcagctcagaggagacaggtcgcccacttcacctttcagccggatcccgaacctcgcgaatacggacagactcaaaagatgaatttgtttcagtcggtaacttcagcactagataacagtctcgcaaaagaccccacagcagtaatctttggcgaggatgtcgcattcggaggcgtctttcgctgcactgtgggtctgagagacaaatatggcaaagaccgcgtctttaatactccgctctgcgagcaggggattgtgggctttgggatagggatagccgtgaccggggcaactgccatcgccgaaattcagttcgcagactatatcttcccagcctttgaccaaatcgtcaatgaggccgccaaatatcggtaccgcagtggagatctttttaactgcgggagtctgactatccgtagcccttggggctgtgtgggccatggcgccctgtatcattctcagtcaccagaggccttcttcgctcactgccctgggataaaaataaaagtgatttccctttcttag

SEQ ID NO: 109928 - DNA, 969 bp, Artificial Sequence
  Description of Artificial Sequence: Synthetic coding sequence
atgaatctgttccagtcagtaaccagcgcccttgataactccttggccaaggacccaaccgcagtgatttttggggaagatgttgctttcggtggagttttccgttgcaccgtgggcctgagagacaagtacggtaaggatcgcgtcttcaatactccactgtgcgaacagggtatagtaggatttggaatcggaattgctgtcacaggagcaacagccatagccgaaatccaattcgccgactacatcttccccgctttcgaccaaattgttaacgaggccgctaagtacagatatcggtccggcgacctttttaactgtggatccctgaccatccgatcgccctggggctgcgttggtcatggcgccctctaccattctcagtcaccagaagccttttttgcacattgccccggcattaaagtggtcattccgagaagtccttttcaggccaagggtttactgctgagctgcatagaagacaaaaatccctgtatctttttcgagcccaagatcctatatcgcgctgcagcagaagaggtcccaattgagccttataatatccctttaagccaagccgaggtgatccaggagggctcagacgtcaccttggtcgcatggggcactcaggttcatgtgatcagggaggttgcatcgatggccaaagaaaagttgggggtgtcatgcgaggttatcgacctgcgaactatcatcccttgggatgtagacaccatctgtaaaagcgtaattaagaccggacgtctcctcatcagtcacgaggcccccctgacggggggattcgcttctgaaatcagtagcactgtgcaagaggagtgttttctgaatctggaggcccccattagcagggtgtgtggatacgacaccccttttccgcatatcttcgaacctttctatattcccgataagtggaagtgctatgacgcactcaggaaaatgataaattactag

SEQ ID NO: 109929 - DNA, 657 bp, Artificial Sequence
  Description of Artificial Sequence: Synthetic coding sequence
atggccgtagtcgctgccgcagcaggctggttattgaggctacgtgccgccggggccgaagggcactggcgcagactcccgggagcaggccttgctcgagggtttctgcaccccgccgcaacagtggaggatgccgctcaacgtcggcaagtggcccatttcacctttcagcccgacccggagccgagagagtatgggcagactcagaaaatgaacttgttccaatccgtgaccagcgccctcgataattctttggcaaaagaccctacagcagtgatctttggagaggacgttgcttttggaggcgtgtttaggtgcacagtggggctgcgtgataagtacggaaaggaccgagtgtttaacacccctctgtgtgaacagggaattgttggattcggaatcggcattgcagtgacaggcgccaccgcgattgccgagattcagtttgctgactatattttccccgcctttgaccagatcgtgaacgaggccgccaagtatcgctatcggtctggcgacctctttaattgcgggtccctgaccataaggagcccttggggttgtgtcgggcacggagctctctatcattcacaaagtcccgaagcttttttcgcccactgtccgggcatcaagatcaaggtcatctctttgtcctag

SEQ ID NO: 109930 - DNA, 1779 bp, Artificial Sequence
  Description of Artificial Sequence: Synthetic coding sequence
atgagcgtgtccctagttgtgatacgactggagctggcagagcatagcccggtcccagccggcttcggcttttctgcagcggccggagaaatgtccgatgaggagattaagaagacaactctggctagtgccgtggcttgtctggagggcaagagccctggggagaaggtggccataatccaccagcacttgggccggcgagagatgacagacgttatcattgagactatgaagagcaatccagatgaactcaagacgacagtagaagagcgcaaatcttcagaggcaagcccaactgcccagaggtccaaggatcacagcaaggaatgcatcaatgctgcaccagactctccatcaaagcagctcccagatcagatcagcttcttcagcggaaatccaagtgtggagatcgtgcatggtatcatgcacctgtacaagactaataaaatgacttcactgaaggaggatgttcgccggtctgcaatgttgtgtatcttaaccgttcctgccgccatgacatcacacgatctcatgaagttcgtggcaccctttaacgaggtgatcgagcaaatgaagatcatcagggacagcactccaaatcaatacatggtgttgattaagttccgcgcccaggccgatgccgatagcttctatatgacttgcaatggtaggcaattcaatagtattgaggatgacgtttgtcagttggtgtacgttgagcgcgccgaggtcttgaagtcagaggacggggccagcttacctgttatggatttaaccgagctacccaaatgtacagtgtgcctggagcgcatggatgaatccgtaaacggcatactgaccactctatgtaatcacagcttccactcccagtgtctgcagcgctgggacgatacaacgtgcccggtgtgtcggtattgccagacccccgagcccgttgaggaaaacaaatgttttgaatgcggggtgcaggaaaatctgtggatatgtctgatatgcggccacataggctgcggccgctacgtgagccgccatgcctacaagcatttcgaagagactcagcatacatatgcaatgcagcttacaaatcatagggtgtgggattatgccggagacaactacgtgcacagactggtggcttcaaaaactgatggtaaaatcgtccaatatgagtgcgaaggagacacatgccaggaggaaaaaattgatgctcttcagctggaatattcttatctgctgacctctcaactagagtcacaacggatatactgggagaataaaattgtgcggattgagaaagacaccgctgaagaaatcaacaacatgaagaccaagtttaaggaaaccatcgaaaaatgcgataacttggagcataagctcaatgacctgctcaaggagaagcagtctgtggaacgtaaatgtactcagcttaatactaaggtcgccaagctcacgaacgagctaaaagaagagcaggagatgaataaatgtctgagggccaatcaggtgttgctgcaaaacaagctgaaagaggaggagcgggtgttgaaggaaacttgcgatcagaaagacctacagataaccgaaattcaggaacagctacgggacgtcatgttctatctcgaaactcagcagaaaatcaaccatttgcccgccgaaacaagacaagaaattcaagagggacagatcaacatagctatggctagcgcctcatcacctgcctcttccggaggctccgggaaactgccatcccgcaagggtcgaagcaagcgcggcaagtag

SEQ ID NO: 109931 - DNA, 1242 bp, Artificial Sequence
  Description of Artificial Sequence: Synthetic coding sequence
atgcacctgtataagaccaataagatgacttccctaaaggaggatgtacgccgatccgccatgctgtgcatcttgactgtccccgcggcgatgacctctcatgatctgatgaaattcgtggccccctttaacgaggttattgagcagatgaaaataatcagagattctactccaaatcaatatatggtactaataaagttccgggctcagggtgcgagcctccccgtcatggacctcactgagctcccgaaatgcacagtgtgtctggaacggatggacgagtccgtgaatggtatccttaccacactctgtaatcatagcttccactcacagtgcctacagagatgggacgacaccacgtgtccggtgtgccgctattgccaaacacccgagcctgtggaggagaacaagtgcttcgagtgcggggtgcaggaaaatctctggatttgtcttatctgcgggcacattggctgcgggcgttatgtttcaaggcacgcttataaacatttcgaggaaacacagcatacttacgccatgcagctaaccaaccatagggtatgggactacgctggagacaattatgtacaccgtctggtggcaagtaagacagacgggaagatagtccagtacgagtgtgagggtgatacctgccaggaagagaagatagatgccctacagcttgagtactcttatctcctgacatctcagctggagtcccagagaatttattgggaaaacaagatcgtgcgcatcgaaaaggacacagcggaggagattaataacatgaaaactaagttcaaggaaaccatcgaaaagtgtgataatttagaacacaaactgaacgacctactcaaagagaaacaatcagttgagcgtaagtgtacccagctcaacacaaaagtggcaaagctgaccaatgagttaaaggaagagcaggagatgaacaaatgcttacgcgcaaaccaggtgcttctccagaataaactgaaggaagaagagagagtcttgaaggagacctgtgatcaaaaggacctgcaaatcacagagattcaggagcaactcagagacgtgatgttctatttagaaacacagcagaagataaatcacttgcccgctgagaccaggcaggaaattcaagaaggccagatcaacattgcaatggctagcgcctcctctccagccagtagcggagggtccggcaagctgccttcccggaaagggagatccaagcgcggcaaatag

SEQ ID NO: 109932 - DNA, 2136 bp, Artificial Sequence
  Description of Artificial Sequence: Synthetic coding sequence
atgaataagggttggcttgaactggaatcggatccaggcttattcactctcctggtggaagactttggagttaagggcgtgcaggttgaagagatctacgatttacagtctaagtgtcagggacctgtgtacggctttatctttctcttcaagtggatagaggaaagacgtagtcggcgtaaggtgtctacactagtggatgacactagtgtgatcgacgacgacatagtgaataacatgttcttcgcacaccagctgatcccgaattcctgcgcaactcacgcgctactctctgtgctattaaattgcagttcagtggacctcgggcccacattgagccgaatgaaagatttcaccaagggattttcacccgaatctaaaggctatgccatcggcaatgcacctgaattagccaaggcgcacaattctcatgcacgtcccgaaccccgccacctgcctgagaagcagaatggtctatctgctgtccgcacaatggaggctttccatttcgtttcctacgtgcccattacagggcggttattcgagctggacgggctgaaagtctatcctatcgaccacggcccttggggcgaagacgaggaatggacggacaaggcccgtcgagtgattatggagaggatcgggctggcaaccgccggcatcaaatacgaggcaaggcttcacgtcttaaaagtgaaccggcagaccgtgctggaagccctgcaacagctaatccgggtcacgcaacccgaattaatccagacccataaatctcaagagtcccagcttccagaggagtccaagtcagcttctaacaagtcacccttggttttagaggccaatagggctcctgcagccagcgaggggaaccacacggatggggccgaggaagctgccggctcatgtgcacaggcacctagccactcacctcctaacaaacctaagctcgttgttaagcctcctggttcatcactaaacggggttcatcccaatccaactccgattgtccaacgcctccctgcctttcttgacaatcataactacgctaaaagcccgatgcaggaggaggaagacttggctgcaggcgtaggacggtcaagagttcctgtgcggcccccacagcaatatagtgacgacgaggacgactatgaagatgatgaagaggacgacgtgcagaataccaactctgcattgcgatataaagggaaaggcaccggtaaaccaggagctttatcgggatctgcagacggccagctcagtgtgctgcagccgaatactataaacgttctcgccgagaagctgaaagagtcccaaaaggatttgagtatcccattgagcattaaaacaagttctggtgctggttcacccgcagttgccgtgcccacccactctcagccttctccaactccctctaatgaatccactgacacggcttcagagattggctcagcttttaactctcccctccggagccctatccgaagtgccaatccgactcgaccctcaagtccagttacgagtcacatttccaaggtgctgtttggtgaggatgactctctgctgagggtcgactgcattagatacaacagggctgtgcgcgacctgggccctgtcatctcaaccggcctgctgcacctcgcagaggatggagtgctgtctccccttgcacttaccgaaggaggaaaaggatcaagcccatcgatccgcccaatccaagggtctcaaggctcgtccagtcctgtcgagaaagaggtggtcgaagcgactgattcacgcgagaagacaggaatggtgcgccccggggaaccgctctcaggcgagaagtacagccctaaggaacttttagcgcttttaaagtgcgtggaggccgagatcgccaattatgaagcctgccttaaggaggaggtcgagaagcggaagaaattcaaaatcgatgatcagaggagaacacataattatgacgaatttatctgcacatttatctccatgctagcgcaggagggaatgctcgctaatctggtggagcagaatatttcggtgagaagacgccagggggtctccatcggacgtctccacaaacagagaaaaccggataggcgtaagcgctcgcgtccttacaaggccaagagacagtag

SEQ ID NO: 109933 - DNA, 2190 bp, Artificial Sequence
  Description of Artificial Sequence: Synthetic coding sequence
atgaataagggctggttggagcttgaatcagaccctggactgttcactctgctggtggaagacttcggggtaaagggcgtccaggtcgaggagatatatgacctgcaatctaagtgtcagggtccagtatacgggtttatttttctgttcaaatggattgaggaacgaaggtcacggaggaaagtctctacgctcgtggatgacactagtgtcatagatgacgatattgtgaacaatatgtttttcgcgcaccagctcatccctaactcttgtgccacacatgcactactttctgtgttactgaactgttctagcgttgatctgggcccaaccctgagccgaatgaaggatttcacaaagggctttagtccggagtctaagggctacgcaataggtaatgctcctgagttggccaaagctcataattcccacgcccggcccgagcctcggcatctgcctgagaagcagaacggcctgtctgcagtaagaacaatggaggcttttcacttcgtcagctacgttccgattacaggtagactgtttgagctcgatggtctgaaagtgtaccctatcgatcatggcccgtggggagaggacgaggaatggaccgataaagccagacgcgtgattatggagcgaatcggtctggccacagcgggcgagccgtatcacgatattcgatttaacctgatggcagtagtgcctgacaggcggattaaatacgaggctagactgcacgtgctgaaagtaaaccggcaaactgtgttagaggcccttcagcaactgattagagtgacacaacctgaactcatccagacgcacaagagccaggagagccagttgccagaggaatctaagagcgccagcaataagtctcctctagtcctggaggctaacagggcaccagctgctagtgaaggaaatcacacagacggcgcagaggaagccgcaggctcctgtgcacaggcaccttctcactctccacctaacaagccaaagctggtggtcaaaccacctgggtcatccctgaacggcgtgcatcccaaccctacccctatcgtgcagcggctgcccgcctttctggataatcacaattatgctaagtcacctatgcaggaggaggaggatctagcggccggcgtaggacgaagtagggtgccagtgcgcccccctcagcaatactccgacgatgaggacgactatgaagacgacgaagaggatgacgtgcagaacaccaacagcgccctccgctataaagggaagggtacagggaagcccggggcgttgtcaggctctgccgacgggcagctgtctgtcctgcagcctaataccattaatgttcttgcggagaagctcaaggaatcccaaaaggaccttagcatcccccttagtattaagacatcctcaggggcaggcagcccggcggtggctgtcccgactcattcacagccctctcccacaccatctaacgaatctaccgacaccgcctccgagattggttccgccttcaacagccccttgagaagccccataagaagcgcaaaccctaccagaccaagttcacctgtgacatcacatattagtaaggttcttttcggggaggatgactctctgctacgcgtggattgcatacgttataatcgggccgtgagggatctggggccagtcattagcacagggttgctgcatctagctgaagatggcgtgctgagcccccttgccctgacggaaggtggtaaaggttcttccccgtccattaggccaattcagggctcccagggatctagtagtccagtcgaaaaggaagtggtggaggcaacggactctcgagaaaagaccggaatggtccgccccggagaacctctctcgggggaaaagtattcacccaaagagctccttgccctcctaaaatgcgtagaggccgagattgcgaattacgaagcatgtctgaaagaggaggtggagaaacggaaaaaatttaagatcgacgaccagagaaggactcataactacgatgagtttatttgcactttcatctccatgctcgcccaggagggcatgctcgctaatctggtcgaacagaacatcagcgtgagaagaaggcagggcgtcagtatcggccgcttgcataagcagcgtaaacctgacaggaggaagcgctcccggccctacaaggctaagcgccagtag

SEQ ID NO: 109934 - DNA, 879 bp, Artificial Sequence
  Description of Artificial Sequence: Synthetic coding sequence
atggctgtacaggtggtgcaagcagtgcaggcagtccatttggagagtgatgccttcctggtgtgtttaaaccacgcattgagcacagagaaggaagaggtgatgggattgtgcattggcgagctcaatgacgacacctccaggagtgattctaagttcgcgtacaccggcacagagatgcgaacagtggcggagaaggtcgacgcagttagaattgtacatattcactccgtgattatccttcgcagatcagataagaggaaagatcgcgtggagataagccccgaacaactgtctgcagcttctactgaggctgagcggctcgcagagctaaccggcagaccgatgagggttgtgggttggtaccactcccatcctcacattaccgtatggcccagccatgtcgacgtgagaacacaggctatgtaccagatgatggaccaggggtttgtcgggctaatattcagctgctttatcgaggataaaaataccaaaaccggacgggtactgtacacctgttttcagtcaattcaggcccaaaaatcgagcgagtatgaacgtatcgagatccctattcatatcgtgccacacgtgacaattggaaaggtttgcctcgagtcagctgtcgagcttccaaagatcctctgccaggaggagcaggatgcctaccgccgaatccattccctaactcatctcgattcggtaacaaaaatccataatggctccgtgttcactaaaaatttgtgtagccagatgagcgcagtgtctggccctttactgcaatggctcgaggatcgactggagcaaaaccagcagcacctgcaggagctgcagcaggaaaaagaagaattgatgcaggagctgtcctcattggagtag

SEQ ID NO: 109935 - DNA, 876 bp, Artificial Sequence
  Description of Artificial Sequence: Synthetic coding sequence
atggcggtgcaggtcgtgcaggccgtgcaagcagtccatctcgagtcagacgctttcctggtgtgcctgaatcacgcattaagtaccgaaaaggaagaggtcatggggctctgtatcggcgagctaaatgacgatacgcggtctgacagcaagtttgcatacacagggaccgaaatgcggacagtcgcagaaaaggtcgacgcagtcagaatagtccatatccactccgtaatcattctgcgtcggagcgacaaaaggaaggacagagtggaaatcagccccgaacaactgtcagctgcctcaacggaggcggagagactcgcagaactcactgggagaccaatgcgtgtggtggggtggtatcacagccacccccacataacagtatggcccagccacgttgatgtgagaacccaggccatgtaccagatgatggatcaaggattcgtagggctgatcttttcctgctttattgaagacaagaacaccaagacaggccgcgtgctgtatacctgtttccagtctatacaggcccaaaaatcgtccgaatatgagaggatcgaaataccgatccacatagtcccccacgtcacaattggcaaagtgtgcctggaatctgcggtcgagttacccaagatactctgtcaggaagaacaagacgcttacaggaggatccatagcctcactcatctcgattcggtcaccaagattcacaacggtagcgtgtttaccaagaatttgtgctcgcagatgtcagccgtgagcggacctctacttcagtggcttgaggaccgtctcgagcagaaccagcagcatttgcaggagctgcaacaggaaaaggaggagctcatgcaggaactcagctctcttgaatag

SEQ ID NO: 109936 - DNA, 951 bp, Artificial Sequence
  Description of Artificial Sequence: Synthetic coding sequence
atggcagtacaggtggtccaggccgtgcaggctgtccacctggaaagcgatgccttcctggtgtgcctcaatcacgcgctcagtacggaaaaggaagaggtcatgggcttatgtattggtgagcttaacgatgatacacgtagcgactcgaaatttgcatatacgggaaccgaaatgcgaactgttgccgagaaggtcgacgcagttcggattgtccatatacactcagtgattattctgcgcagaagtgacaagagaaaggaccgggtggaaattagcccagagcagctgtcagccgcatccaccgaagcggagcgcctagcggaactgaccggtcgaccgatgcgcgttgttgggtggtaccatagtcacccacacatcaccgtgtggccaagccatgtggatgttcggacacaggcgatgtatcagatgatggatcagggatttgtaggactgatttttagctgttttatcgaagacaagaacacaaagaccggccgcgtgctttatacctgtttccagtctattcaggctcagaagtccagcgaaagccttcatggccccagagacttttggagcagtagtcaacacatctccatcgaagggcaaaaggaagaggaacgatatgaaagaatcgagatcccgatccacatcgttcctcacgtcactattggcaaggtatgtctcgagagcgccgtcgagctcccaaagattctctgtcaggaggagcaggacgcctaccgcaggatccacagcctgacccatctggattcagtaacaaagatccacaacggctctgtgtttacaaagaatttgtgtagccagatgagtgccgttagtggccccttgctacagtggctagaagaccgcctcgaacagaaccagcagcacctgcaagagctccaacaagaaaaggaagagctcatgcaggagttaagctctctggaatag

SEQ ID NO: 109937 - DNA, 954 bp, Artificial Sequence
  Description of Artificial Sequence: Synthetic coding sequence
atggcagtgcaggtggtacaggccgtacaggccgtccatttggagtccgatgccttccttgtgtgtttgaatcatgccctgagtaccgaaaaggaagaagtgatgggcctgtgcattggggaggtgtcgtctccttctaggtccgactccaagtttgcgtacaccggaaccgagatgcgcactgtggctgaaaaggtggacgctgtgagaatagtgcacatccactccgtcatcatcttgaggcgcagcgacaaacgtaaggatcgggtggaaatttcccccgagcagctcagcgctgcgtcaacggagacccatagactggcggagctgacaggccgaccaatgagggttgtcggatggtatcactcccacccacacataacagtgtggccctctcacgtggacgtacggacccaggcaatgtaccagatgatggaccagggatttgtggggctcattttttcttgcttcatcgaagataagaatactaagactggcagggtcctgtacacttgcttccagtcaattcaggcgcagaaaagttctgaatccctgcacggcccaagggatttctggagcagctcccagcatatctccatagaaggtcaaaaggaggaagagaggtatgagaggatagaaataccaatacatattgtgccccatgtgactattggaaaggtgtgtctggagtccgccgtggaattgccgaaaatcctgtgccaggaagagcaggacgcctataggcggatccactctctgacccacctcgactccgtaaccaagatccacaatggtagcgaggtgttcaccaagaatttgtgcagccagatgtccgccgtttcgggaccccttctgcagtggttggaagacaggctcgaacagaatcagcaacacctgcaggaactgcagcaggaaaaagaggagctcatgcaggagctcagcagccttgagtag

SEQ ID NO: 109938 - DNA, 747 bp, Artificial Sequence
  Description of Artificial Sequence: Synthetic coding sequence
atggctgtccaagtcgtgcaggcagtgcaagctgtgcatctagagtctgatgccttccttgtgtgccttaatcatgctttaagcactgagaaggaggaggtcatggggctttgtatcggcgaggtgagctccccatctagatccgattctaagttcgcttacaccggaactgagatgcgaactgtagccgagaaggtcgatgctgtgcggatcgtccacatccatagtgtgatcatcttacgtcgaagcgataagaggaaggacagagttgagattagtccagagcaactctctgccgccagtacagagacacacaggttggccgagctcacgggtcgacctatgagggtggttggctggtaccatagccaccctcacatcacggtctggccctcacatgtggatgtaagaacgcaggccatgtaccaaatgatggatcagggcttcgtaggcctcatatttagctgttttatcgaagacaagaacaccaagactggacgggtattgtacacctgtttccaatcgattcaagcccagaagagctctgacctgacacatctagactcagtgaccaagatccacaacgggtccgaagtgttcacaaagaacctgtgctcccagatgagcgctgtgtctggcccactgcttcagtggctggaggatcggttggagcagaaccagcaacatttgcaagagctgcagcaggaaaaagaggagctgatgcaggagctcagttccctagagtag

SEQ ID NO: 109939 - DNA, 1845 bp, Artificial Sequence
  Description of Artificial Sequence: Synthetic coding sequence
atgggcaaccagatgtcagttccgcagcgtgttgaggatcaagagaacgaaccagaggctgagacataccaagataacgctagcgctctcaacggtgtgccagtcgtggtctccacccatacggtgcagcacttagaagaagtggatcttgggatctctgtgaagacagacaacgtcgccacctcctctccagaaaccacagagataagcgccgtggcagatgccaacggcaagaatcttggaaaggaggccaaacccgaggcccccgctgccaagtcccgctttttcctgatgctgtcccgccctgtgccgggaagaacaggagaccaagccgcggattccagccttggcagcgtgaagttggatgtcagtagcaacaaagcccctgccaacaaagaccccagcgaatcttggactttgcctgtggcagcgggtccaggacaggacacagacaaaactcctggacacgcccccgcccaggacaaagtcctgtctgccgcccgggatccgaccctcctcccaccagagactggaggcgcaggcggcgaagccccaagcaaacccaaggatagctccttctttgacaagttttttaagttggacaagggtcaggaaaaagtccccggagacagtcaacaagaggcaaaacgggccgagcaccaggacaaagtggacgaggtgccagggttgagcggccagtccgatgacgtaccagccggtaaggatatagttgatggcaaagaaaaagaggggcaggaactgggtaccgcagactgttcagtaccgggagaccccgagggattggagactgctaaggacgattcccaggctgcagccatcgccgagaataataactcgataatgagttttttcaagacattggtcagccctaacaaagctgagacgaaaaaggatcctgaggacacggcatccaaggccgaaagtgtttgtgatggccaggccgggcaaaaaacatcagaaattcaagcaaggggcactaaaaaaaagcatcttgattcaccaagactggggctagctttccgcaaattttttagacataaaggcgccgagaagtcaccaacaaccagcgcggacttgaagtccgacaaggctaatttcaccagccaggagacccagggagctggtaagaactccaagggctgcaatccttccgggcatacgcaaagcgtcacgacacctgagccagctaaagagggcaccaaagagaaaagcggtcctacaagcctgcctctcggcaaactattttggaaaaaagtggtttgcgagagtcctgtggaaattattaaatctaaggaggttgaatcagccctccagacagtggatctcaacgagggtgatgcggccccggagcccaccgaagccaaactgaagcgtgaggagagcaagcccagaacctctcttatggcctttctcaggcaaatgactagcgattccactgagaagacgattacaccccccgagccagagcccactggggcgccacagaaaggtaaggaggggagctcgaaagataagaaaagcgccgcagagatgaacaagcaaaaaagtaataaacaggaagctaaggagccagctcagtgcaccgaacaggcaactgtggatactaactcactccagaacggagacaagctccagaaaaggccggaaaagcgtcagcagagtcttggtgggttctttaagggacttggccctaagcggatgctggacgctcaagtacaaaccgatcctgtatccatcgggcctgtaggaaaaagcaaatacaccggaaagtgcgtgttttctcatgtcaaaaagaaatggcctttccaagaatggtcctactag

SEQ ID NO: 109940 - DNA, 1755 bp, Artificial Sequence
  Description of Artificial Sequence: Synthetic coding sequence
atgggtaatcagatgtcggttccacaacgggtggaagaccaggagaacgagcccgaagccgagacctaccaggacaacgcatctgccttgaacggtgttccagtggttgtgtctacgcacacggtccagcacctggaggaagttgatcttggaatctcagttaaaactgataatgtggccacgtcctcgcctgaaaccacggagatctcagcagttgcggacgccaacggcaaaaatttgggaaaggaagccaagccagaagctcccgccgcaaagtcacgattttttcttatgctgagccgtcccgttcccggtcggacgggtgatcaggcggctgatagctcgttaggaagcgttaagctggatgtatcatcgaacaaagccccagccaataaagatcccagtgagtcttggaccttaccagtagcggcaggaccgggccaggatactgacaagacaccaggccacgctcccgcccaagacaaagtgctctctgcagcgcgtgaccccacactgttgcctccagaaactggcggagccgggggggaagctccttccaaacccaaagacagttctttctttgataaattcttcaagcttgataagggccaagagaaggttccaggagactcgcagcaggaggccaagagagccgaacatcaggataaggtggatgaagtgcctgggctaagtggtcagagcgatgacgtgcccgctggaaaagatattgtggatggcaaggagaaggaaggccaagaactgggaacggcagactgctcagttccaggcgaccctgagggcctggagactgctaaagacgacagtcaggcggcggctattgccgagaataataactctattatgtctttctttaaaactctcgtgagccctaataaggctgaaacaaagaaggatccggaggacaccggagccgaaaagtcaccaaccacttcagccgatctgaagtctgacaaagctaatttcacatctcaggagacacagggggctggaaagaatagcaagggatgcaaccccagcggccacacccaaagtgtaaccacacccgagcccgcaaaagaaggcactaaggagaaatcagggccaacttcactcccactcggcaagctgttttggaaaaaatcggtcaaagaagacagtgtgcctacgggcgctgaggaaaatgtcgtgtgtgagtcacctgtagagatcattaaatcaaaagaggtagaatcagccctgcagaccgtagatctgaacgagggcgatgccgctccggaacccacagaagccaaacttaaacgggaggagtccaagccaaggaccagtcttatggctttcctgcgtcaaatgagcgttaagggcgatgggggtatcactcactcagaggagattaatggcaaggactcaagttgtcagacgtctgacagcaccgagaaaaccatcaccccaccagagccggaaccaactggggcaccacagaagggcaaagagggatcctcaaaggataaaaagagcgcagccgaaatgaataagcagaagtctaataagcaagaagccaaagagccggctcagtgtaccgaacaggcaacggtggacaccaactcccttcaaaacggtgacaagctgcagaagagacccgagaagcgccagcagagcttggggggatttttcaagggactgggccctaaacgcatgttggatgcgcaggtgcagacagaccccgtcagtatcggacctgtgggaaagagcaagtag

SEQ ID NO: 109941 - DNA, 495 bp, Artificial Sequence
  Description of Artificial Sequence: Synthetic coding sequence
atgctgtcccgccctgtgcctggtcgaactggcgatcaggcggctgattcctctcttggctccgttaagctggacgtgtcatccaacaaggcgcccgccaacaaggacccatcagagtcctggactctgcctgtggctgccgggcccggacaagataccgataaaactcctggtcatgctccagctcaggacaaggtcctgtcagccgcaagggacccaactctgctcccccccgagactgggggagccggtggggaagccccctctaaacccaaagattcatctttctttgataagttttttaagctagacaaagggcaggagaaggtgccgggagactcccagcaggaggccaagagggcagagcaccaggacaaggtggatgaggtcccggggctgtctggacagtcagacgacgtgccggccggcaaggttagcgtgcctcgatgcattcatctggtgctcaatgcctgttcaggcgcattaatgggctag

SEQ ID NO: 109942 - DNA, 753 bp, Artificial Sequence
  Description of Artificial Sequence: Synthetic coding sequence
atgtcatttttcaagactctggtcagtcctaataaggcggagaccaagaaggacccagaagatactgcctcaaaagccgagagtgtatgcgacggccaggccggacagaagaccagtgagattcaggcacggggaacaaaaaagaaacaccttgattccccgcggctgggattggcctttagaaagttttttcgccacaagggagccgagaagagtcccaccacttcagccgatctcaaaagtgataaagccaacttcacatcccaggagactcagggggccggcaagaatagcaaaggctgtaatccaagcggacacactcaatctgtgaccacgcctgagcccgcaaaagagggtactaaagaaaaatcaggtcctacatcattaccacttggtaagctgttttggaaaaaaacctctgatagcacagaaaaaaccatcaccccccccgagcctgaaccgaccggcgccccgcaaaaagggaaagagggtagttccaaagacaaaaagagcgccgcagaaatgaataaacagaagtctaacaagcaggaggccaaggaacccgcacagtgtacggagcaagctacagtcgatactaattccctgcagaacggcgataaattgcagaagcgcccagagaaacggcagcagtccttgggcgggtttttcaaaggcttaggtcccaaacggatgcttgacgcacaagtgcagactgacccagtgagtatcggcccggtgggcaagtcgaagtag

SEQ ID NO: 109943 - DNA, 1155 bp, Artificial Sequence
  Description of Artificial Sequence: Synthetic coding sequence
atgtctgctcctattaaacttcagcggaccaagacccaggtacgggccgggcatttcaggtggcagttggaccgcggtcgcacccagataaagccacagggtaccccaagacccaagacaagaagctccctcccgcccggaatacccaggttttcccacttacgccagggggaacaagaagagaagctgccaccctcaccacgaacacccttcttcgacaaattttttaagcttgacaagggccaggagaaggtccctggagacagccagcaggaagcgaagcgcgctgaacaccaagataaagtggatgaggtacctggcttgtccgggcagagtgacgacgttcccgcggggaaggatattgtagatggcaaggaaaaggagggccaagaacttggcacagcggattgtagtgtgcctggcgacccagagggtttggaaacagctaaggacgactcccaggcagcagcaattgctgagaacaataacagtatcatgtctttcttcaagacactggtgtctcccaataaggccgagaccaaaaaggatcccgaggacacaggtgcagagaagtcccccactacttcagccgacctcaaaagtgacaaggctaactttactagccaggagacccagggcgcggggaaaaattccaagggatgcaatcctagtgggcatactcaatctgtgacaactcctgagcctgctaaggaggggaccaaggagaaatcagggccgacctcactccccctgggcaaactgttttggaagaagagtgtgaaagaagactctgttcccactggcgctgaggagaatacctcagacagtactgagaaaaccattacaccacccgagcccgaaccaacgggcgctcctcaaaagggcaaggagggatcttccaaagataaaaagagcgcagccgaaatgaataagcagaagagcaataaacaagaggcaaaggagccagctcagtgtacagagcaggccacggtggataccaacagcctgcagaatggtgacaagctccaaaagcgacctgaaaagcgccaacagtcactaggaggcttttttaaggggttaggcccaaaacgtatgctggacgctcaggtgcagactgaccccgtatccatcggaccggttggcaaaagcaaatag

SEQ ID NO: 109944 - DNA, 678 bp, Artificial Sequence
  Description of Artificial Sequence: Synthetic coding sequence
atggccgggactgggctggtggccggagaggtcgtggttgacgctctaccttacttcgatcagggctacgaagccccgggcgttcgagaggcggctgcagccttggttgaagaagaaaccagacggtaccgtccgaccaagaactacctttcctacctaacagctccggattacagcgcttttgaaaccgacatcatgcgcaatgagttcgagcggctggccgcccgacagcctatcgagcttctgtcaatgaagcggtacgaactgcctgcgccctctagcgggcagaaaaacgatatcactgcctggcaagaatgcgtcaataattccatggctcagctcgagcatcaagctgtccggattgaaaatttagagctgatgagccagcatgggtgcaacgcctggaaggtttataatgagaacttggtccacatgattgagcacgcccaaaaagagctgcagaagctacgtaaacatatccaagacctaaactggcagagaaagaatatgcaactgacggctggaagtaaattaagggaaatggaaagcaactgggtctccctcgtgtccaagaactacgagatagaaaggactattgtgcagttggaaaacgaaatctatcagataaaacagcagcacggcgaggccaacaaagagaatattcggcaggacttctag

SEQ ID NO: 109945 - DNA, 477 bp, Artificial Sequence
  Description of Artificial Sequence: Synthetic coding sequence
atgcaaaggacaggcggtggagctccgcgacccggccggaaccatggacttcctggaagcttaagacagcccgaccctgtcgccctcctgatgctgctggtggacgccgaccaacctgaacccatgcgcagtggggccagagagttggctctgttcctcacccctgaaccgggcgcagaggctaaagaagttgaggagacgatcgagggcatgctccttagattagaggaattctgttccctggccgatctgattaggagtgatacatcacagatcctggaagagaacatcccggtgctcaaggccaaactgaccgagatgagagggatttatgccaaggtggatagacttgaaaaaagtcccgccccagttccggtgacctacgagctaccaacactgtaccggactgaagattacttccctgttgacgcgggcgaggcccagcatcacccccgcacctgccctcgcccgctatag

SEQ ID NO: 109946 - DNA, 570 bp, Artificial Sequence
  Description of Artificial Sequence: Synthetic coding sequence
atgcagcgtactggaggaggagcgccgaggcctggacggaatcatggcttaccagggtcattacgtcagcccgatcccgttgcgctactcatgctgctggtcgatgccgaccagcccgagccaatgcggagtggtgcccgggaactcgccctgtttcttacccctgagccaggtgcagaagcgaaggaggtcgaagagacgatcgagggtatgctcctccgcttggaagaattctgttctctagcagatcttatcagatccgacacctcccaaatactggaggagaatataccagtgcttaaagctaaactcaccgaaatgaggggaatttatgccaaggttgaccgactggaggccttcgtcaaaatggttggccaccacgtggctttcttggaagcagacgtgctacaagccgaacgggatcatggggctttcccacaggctctgagaagatggctgggatccgctggcttaccctcgttccgcaatttggagtgctctggagccatacttgcccactgcaaccttagattgtccggctcctcagatagccccgcaagcgcctcttag

SEQ ID NO: 109947 - DNA, 636 bp, Artificial Sequence
  Description of Artificial Sequence: Synthetic coding sequence
atgcaaaggacaggcgggggagctcccagacccgggagaaatcacgggctgcccggatccttaaggcagccagatccagtggccttactcatgcttctggtggatgccgaccaacccgagccgatgcgcagcggagccagagagttagctctgttcttgacccctgagccaggcgcagaagctaaggaagttgaagagacaatcgaaggcatgctgctgaggttagaagagttctgtagccttgccgacctcattcggtctgatactagtcagattttagaagagaacatccccgtccttaaggcgaaactaacggagatgcgagggatctacgccaaagtggataggcttgaggcttttgtaaagatggtggggcaccacgtggcattcctggaggccgatgttcttcaggcagaacgagaccacggagccttcccccaagcgctccgaagatggctcggctctgcaggcttgccgtcctttcgaaacgtcgagtgctcaggcacgatacccgctcggtgcaacctgagacttcctggcagctcagactcacccgcaagcgctagccaggtcgccggcattaccgaggtcacatgtaccggagctagagacgttagggcggcccacactgtctag

SEQ ID NO: 109948 - DNA, 612 bp, Artificial Sequence
  Description of Artificial Sequence: Synthetic coding sequence
atgcagaggacaggcggaggtgcccctcgacccggcagaaatcatgggctgcccggatccctcagacagccggatcccgtggccctgctaatgctgcttgtggacgccgaccagcctgagcccatgcgcagtggggctagagagctcgccctgttcctgacccctgagcccggggctgaagctaaagaagtggaggagactatcgagggcatgcttttacggcttgaagagttctgcagtctggctgatctgatcagaagcgatacctcacaaatcttggaggaaaatatccctgttctcaaagcaaaactgaccgagatgaggggaatatatgcgaaagtggacagactcgaggcttttgtgaaaatggttggacatcatgtggcctttctagaagctgacgtcctgcaggccgagagagatcacggcgccttcccacaggcattgcgacggtggctcggctctgctggtctgcctagttttcgtaataagtcccctgcccctgtgcctgtgacctatgaattgccaactctataccggacagaggattatttccctgtcgatgccggcgaggcccaacaccacccgcgaacctgccctagacctctctag

SEQ ID NO: 109949 - DNA, 627 bp, Artificial Sequence
  Description of Artificial Sequence: Synthetic coding sequence
atgacaggccgagtatgtcgcgggtgcggtggtacagacatagaactggatgccgccagaggtgatgctgtttgcacagcatgcggcagtgtcttggaggataacataatcgtcagtgaagttcagtttgtcgagtcctcgggaggtggatcaagcgccgtggggcagttcgtgtctctggacggggctggcaaaacgcctacattgggaggggggtttcatgtgaaccttggtaaggagagccgagctcaaactctccagaatggccgacggcacattcatcacctgggaaatcagctccagctgaaccaacactgcctggacacggcgtttaacttcttcaagatggccgtttcccggcacctaactcgaggtaggaagatggctcatgtgattgccgcatgtctgtatctagtgtgcaggaccgaaggaacacctcacatgttgctggatctctcagatttgctgcaggtcgactccctgagacctgcgtcattccccacatggggctgtgacttgggcgttgtaacccgcgttgtgactggggtatacccccgctgcttgcacgcatctcagtggccagtctgtgcagcgtgtcccgtaagaaagttctggagcgttggttag

SEQ ID NO: 109950 - DNA, 1689 bp, Artificial Sequence
  Description of Artificial Sequence: Synthetic coding sequence
atggcagtaagccggcatcttacaaggggccgcaagatggctcacgttatcgctgcctgtctatacttggtgtgtagaaccgaggggactccacacatgctgctagacctttctgacctgcttcaggtgaatgtctacgtcctcggcaagaccttcctgcttctcgcaagggagttgtgcattaacgcccctgccatagatccctgcctgtatatccctcgcttcgcccacttgttagagttcggggagaagaatcacgaagtgagcatgaccgccctgagactgctgcagcggatgaagcgagattggatgcacaccggacgaagaccttcaggcctgtgcggcgccgcactcctggtggcagcccgcatgcatgactttagaaggaccgtgaaagaggtcatctctgtggtcaaggtgtgtgaatcaacactgagaaagagactgaccgagttcgaggatacacccactagtcagctgacgatcgacgagtttatgaaaattgacctggaggaagaatgtgaccccccatcctacactgcgggtcagcgcaagttacgaatgaagcaattggaacaagtgctctcaaaaaagttggaagaagttgagggcgagatctcttcatatcaagatgcaatcgagattgaattggaaaattcgcggccaaaggccaaaggcgggctggcatctctagctaaggacggctcaactgaggatactgcatcttctctttgcggagaagaggatacagaggatgaggaactcgaggccgcagcttcacacctgaacaaggacctgtacagagagctgttagggggcgccccgggaagcagcgaggccgcgggctcaccggagtggggaggtcgtccccctgccctcggctctctgctggacccactgcccaccgctgcatccctggggatctctgactcaattcgtgagtgtatctcatcccagagctcagaccctaaagatgctagtggcgacggtgaactggatctgagtggcattgatgatctggagatagaccgatacattctgaacgaaagcgaagcccgcgtcaaggccgagctttggatgcgagaaaacgccgaatatttgcgggaacagagggagaaagaggccaggatagcaaaagagaaggagttgggaatctacaaagaacacaaacccaagaagtcctgcaaacgccgcgagccaatacaggcaagcacagccagggaggcaattgaaaagatgctggagcagaaaaaaatttctagcaaaattaactattctgtgctgcgggggctgtcctctgcaggcggcggatccccacaccgggaagatgctcagcctgagcattccgcaagtgccaggaaactctcccggagaaggacacccgcatctcggtccggagccgatccagttaccagtgtggggaagcgcctcaggccattagtttccacacagcctgccaagaaggtcgctactggggaggccctgctgccatcatctcccacacttggcgccgaacccgcacgccctcaggccgtcctggtagaaagtgggcctgtctcttatcatgctgacgaagaggccgatgaagaggaaccagatgaggaagacggagagccctgcgtctctgccctacagatgatgggctccaatgattacgggtgtgatggagacgaggacgacggctactag

SEQ ID NO: 109951 - DNA, 408 bp, Artificial Sequence
  Description of Artificial Sequence: Synthetic coding sequence
atgacagctctgcgcctgttacagaggatgaaacgagactggatgcatactggacgacgaccatctggcctctgtggagctgcactactcgtggctgcccgcatgcacgacttcaggagaaccgttaaggaggttatctctgtggtaaaagtatgtgagagcaccctgaggaaacggttgactgagttcgaagataccccgacgagccagttgacaattgatgagtttatgaaaattgacctcgaagaggaatgtgacccaccacccatcgaggagggggggcagacggaagctagggaacccccccaagccagctcctgggaaggcccatctactactcgacggagatctcagctctggcatggatgtcctgggtgcggccgcggagggtttacattatgcccatag

SEQ ID NO: 109952 - DNA, 723 bp, Artificial Sequence
  Description of Artificial Sequence: Synthetic coding sequence
atgacagggcgtgtgtgtcgcgggtgcggcgggacagacatcgagctggatgcagctcggggtgacgctgtttgtactgcctgcggctccgtcctggaggataacatcattgtctccgaagtccagttcgtagagtcgagcggcgggggttcatcagcagtcgggcagtttgtcagcttggacggcgcaggtaagactcccaccttggggggaggcttccatgtgaacctgggaaaagaaagccgtgctcaaaccctgcagaatggacgtaggcacatccaccacttgggaaaccagctccagctaaatcagcattgtctcgacactgctttcaacttttttaagatggcagtgagccggcacttgacaaggggtcgcaaaatggcccatgtcatcgccgcatgcctttatttagtatgcagaacagagggcacgccacatatgctgctggatctttccgacctcctgcaggtggactccctgcggcccgcttctttccccacatggggctgcgatttgggcgtcgtgaccagagtggtcaccggcgtgtatcctagatgccctagaatcagtgttgcaggcctgtgttgtctcccttcacaggaggtcctggtgtgtagaatgcgaggactgcatgacatgggcgtgaccgtgagagatttatgggagtgcggaagcccatggcaggaacatctgccaatgttaggcacagtcggatgctag

SEQ ID NO: 109953 - DNA, 555 bp, Artificial Sequence
  Description of Artificial Sequence: Synthetic coding sequence
atgactgccctgaggttgcttcagcggatgaaacgcgattggatgcacaccggcagacggccttccgggctgtgcggtgccgccctactggttgccgcaagaatgcacgacttccgaaggacagttaaagaagtcatctcagtagtcaaagtctgtgagtccacattgcggaagcggcttactgagtttgaagacactccgaccagccaacttaccattgacgaatttatgaagatcgatctcgaagaggagtgtgaccctcctagctacacagccggtcaacggaagctccggatgaaacaattggaacaggttctctcgaaaaagctggaggaggtggagggagagatcagctcatatcaggatgccatcgaaattgagctggaaaacagtccacccagtcgacgggagggaaggagacgcccagagtcactgccaaggccactgcgcggtaaggcaccggtgccactggtcggaggactgtcctctggtatggccgccccggatgtcgctgagggcgcctccccttgcgtgctcagaagagggtggccctag

SEQ ID NO: 109954 - DNA, 1953 bp, Artificial Sequence
  Description of Artificial Sequence: Synthetic coding sequence
atgaccggacgtgtgtgtaggggctgcggggggaccgacatcgagctggatgcagctcgcggtgatgcggtgtgcactgcctgcggatccgtgttggaagataacatcatcgtatccgaggtccagttcgtggaaagcagcggtggcggtagttctgccgtcggacaatttgttagcttggatggcaggaggcacatccaccatcttggaaatcaactgcagttgaaccagcactgcctcgacactgctttcaatttcttcaagatggccgttagtcggcacctgaccagaggacggaagatggctcacgtgatagccgcttgtctctacctcgtttgtagaacagagggcacacctcatatgctcctggatctgtctgacctcctgcaggtgaatgtgtatgtgttagggaaaactttccttttactcgctagagaactgtgcataaacgcacctgcaatcgacccctgcctctacattcctcgttttgctcacctgctcgaatttggcgaaaaaaaccatgaggtcagtatgactgctttgcgcctgttgcaaagaatgaagcgggattggatgcacaccggtcgcaggccttccgggctttgtggggcagccttgcttgtcgccgcacgcatgcacgacttccggcggaccgttaaagaagtcatcagtgtagtgaaggtgtgcgagtctactctgagaaagcggttaactgaattcgaggacacgccaacttcccagctcaccatcgatgaattcatgaagatcgatctggaagaagagtgcgaccctccttcctacacagctggccagaggaaactgcggatgaagcagctggaacaggtcttgagtaagaaacttgaagaagtggaaggagagattagtagctatcaagacgccatcgagatcgagctggagaactccagacccaaggccaaggggggcctcgcctcactcgcaaaggatggctccaccgaggataccgccagttctctttgcggagaggaggacacagaggacgaggaacttgaagcagcagcgtctcatctcaacaaggatctgtatcgcgaattactgggcggagccccaggatcatccgaagcggccggctcccctgagtggggcggacgcccacccgcacttggatctctgctggaccctctgcctacagccgcaagtctggggatctctgactcgattagagagtgtatctcctcacagtccagtgatcctaaagatgcatccggcgatggagagctcgaccttagcggcattgacgatctagaaatagatcgctatatccttaacgaatcggaggctcgcgtcaaggcggaactgtggatgcgcgaaaacgcagagtatctgagggagcagagggaaaaggaagctagaatcgctaaggaaaaggagcttggaatctacaaggagcataagcccaagaaaagctgtaaacggcgtgaaccgatccaagccagcactgcacgggaagcaattgaaaagatgctcgagcagaagaagatttcttccaagattaattattctgtgctgcgtggattgagttccgctggaggaggctccccacaccgagaagatgcgcagccagaacactctgctagcgctcggaagctttccagaagacgcaccccggcatcccggagcggcgcagacccggtgacatctgtgggcaaacgtctaagaccactcgtgagtacccagccggcgaaaaaggtggctacaggagaagctctattgccatcaagcccaaccctgggggcggagccggcgcgtccccaagccgtgttggtggaatccggccctgtgtcttatcacgcagacgaggaggccgacgaagaggaacctgacgaggaagacggagagccctgcgtgagcgcgctgcagatgatgggttctaatgactatggttgcgatggagatgaagacgacgggtattag

SEQ ID NO: 109955 - DNA, 1422 bp, Artificial Sequence
  Description of Artificial Sequence: Synthetic coding sequence
atgacagccctgcggctcttacagcgcatgaagcgggattggatgcacacagggagacggcccagtggcctgtgcggcgccgcattgcttgtggctgcccgaatgcatgattttagacgcaccgttaaagaggttatctcagtcgttaaggtgtgcgagagtaccctgagaaaaagactcacagaattcgaggacacacctacctcccagttaacaatagacgagttcatgaaaattgacctggaagaggagtgcgacccccccagttacaccgcgggccaacgaaagctgcggatgaagcagctggagcaggtgttatcaaagaaattggaagaggttgaaggagagatcagcagctatcaggacgcaatcgaaattgaattagagaactctcggccaaaagccaagggcgggttggcatctctagctaaggatgggagtaccgaggacaccgctagttctctgtgcggcgaggaggacaccgaggatgaggagctggaagcagctgcctctcacttgaacaaggacctgtaccgagagctcctgggcggcgcacccggttcttctgaggctgccggcagccccgaatggggtggtaggccgcctgccctcgggtctttactggaccccctccccactgcagcgtctctagggatatctgattcaatcagagagtgtatctcctcacagagctccgacccaaaggacgcatctggcgacggtgaactggacctgtctgggatagatgacctggaaattgatagatatatcctcaacgagagcgaggcccgcgtgaaggctgagctttggatgcgagagaatgccgagtatcttagagagcagcgagaaaaagaggcccgaattgccaaggagaaggagctaggaatctacaaggagcacaagcccaaaaagagctgcaaaaggcgagagcccattcaggcaagcaccgccagagaggcaattgagaaaatgcttgaacagaagaagatctcatcaaagattaactactctgtgctccgcggactgtcaagtgctggaggcggaagcccacaccgagaggacgcccagccagagcactccgcaagcgcgcgcaagctgtcacggagacggacccccgcttcgcgttcaggtgcagacccggtgacttcagtgggaaagcgcctcaggcccctggtgtctacccagcctgcgaagaaagttgccacaggcgaagcccttttgcccagcagcccgacactgggagctgaacccgctaggccacaggccgtgcttgttgagagtggccccgtgagttaccacgctgacgaagaagccgatgaggaggaaccagacgaagaagatggcgaaccatgcgtgtcggcattacagatgatgggtagcaatgattatgggtgcgacggcgatgaggatgacggatactag

SEQ ID NO: 109956 - DNA, 1755 bp, Artificial Sequence
  Description of Artificial Sequence: Synthetic coding sequence
atggccgtcagccgccacttgacccgagggcgtaaaatggcccacgtgatcgctgcatgcttatacctggtgtgtcggaccgaggggaccccccacatgcttctagacctctctgaccttttgcaggtcaacgtctacgtgcttggcaaaacatttctgcttcttgcgagggagctgtgcataaacgctccggccatcgacccctgtctttacatcccccggtttgcacacctactcgagttcggagagaagaaccatgaagttagtatgacagctctgcgcctcctgcaaagaatgaagcgcgactggatgcatacgggacgaaggccgtccggactgtgtggcgctgctctcttggtagcggccaggatgcacgacttcaggaggactgtgaaagaagtgatctccgtggtgaaagtgtgcgagagcacactgcgcaaacgattgaccgaatttgaggatactccaactagtcagctgaccatcgacgaatttatgaaaatcgatctggaggaagaatgcgaccccccttcttacactgctggtcagaggaagctacggatgaagcagttagagcaggtcttatccaagaaactggaggaagttgaaggcgagatctcctcttaccaggacgcaattgaaattgaactcgaaaactcgcggcccaaggctaaagggggcttagcaagccttgccaaagacggtagcacggaggacacagctagctcactctgcggcgaggaggacacagaggatgaggaactcgaggctgccgcgagtcatttaaacaaagatctctaccgagagctgctgggcggggcacctggcagcagcgaggctgctggaagccctgagtggggcgggagaccacctgccttaggatcgctacttgaccccctaccgacagccgcctccctcgggatctcagacagcatccgagagtgtatttccagccaaagttcagatcccaaggatgcgtcaggggatggagagctcgatctctctggcattgatgacctggaaattgaccgcagagacctgtctatgccgcgttgcgcaaaagcaaaaagtcaaccacacttccctgttttggcccagtatattctgaacgagagtgaggcgagagtgaaggccgagctgtggatgagagaaaacgcagaataccttcgggagcagagagagaaagaggcaaggatcgctaaagagaaggagctgggaatctataaggaacacaaacctaagaaatcatgtaagagaagggagcctattcaggcctccacagcgcgagaagcgatagaaaaaatgctcgagcagaagaaaatcagcagtaagattaattactcagtgctgcgtgggctgagttcggctggggggggctcccctcatcgcgaggatgcccaacccgaacactcagccagtgctcgaaaactctcaagaaggcggacgcccgcttcacgtagtggggcagatcctgtcacatcagtcggcaagcgactgaggcccctggtgtccactcagcccgccaaaaaggtcgccactggtgaggcgctcttgccgtccagcccaacacttggcgccgagccagcccgtccccaggcagttcttgtcgagtccggccccgtatcatatcatgcggatgaggaggctgacgaggaggagcctgatgaagaggatggggaaccctgtgtgagcgccctgcagatgatggggagcaatgattacggatgtgacggcgacgaagacgacgggtattag

SEQ ID NO: 109957 - DNA, 1320 bp, Artificial Sequence
  Description of Artificial Sequence: Synthetic coding sequence
atgcacgattttagaaggaccgtgaaggaggtgatctccgtggtaaaagtttgcgaatcgacactccgcaagagactgacggaatttgaagatactccgacaagtcaactgacaatcgacgagtttatgaagattgatctggaggaggagtgtgatccacccagctatacagcaggacagagaaagttgcgcatgaaacagcttgaacaagtgctgagtaagaagctcgaggaggttgagggagaaatatcttcctaccaagatgccatcgagatcgaactcgagaattctagacccaaagccaagggcgggctggctagcctggccaaggacggttctacggaagacactgcgagttctctgtgcggggaagaggacactgaggatgaagaattggaagctgcagcctctcacttaaacaaagatctgtacagagagttactgggcggggctccaggatctagtgaagcggcagggagccccgagtgggggggacgccccccagctctgggctccttgttggaccctctacccacggcagctagccttgggattagtgactccatcagagaatgtatatcgtcccaaagctcagaccccaaagacgcatccggggatggagaactcgacttatcaggcattgacgacctcgaaatcgacaggtacatacttaacgagagcgaagcgcgagtaaaagcagaattgtggatgcgcgaaaacgccgaatacctgcgggagcagcgggagaaggaagcccgcatcgcaaaagagaaagagctgggcatctacaaagaacataaacctaagaagagctgcaaacggagagaacctatccaagcctccacggcccgcgaagcaattgaaaagatgctggaacagaagaagatcagcagcaaaatcaattacagtgtgctgagggggctgtcctccgctggcggggggagcccccaccgcgaggatgctcagcccgagcactccgcaagcgcaagaaagctctctagacggcgaaccccagcgtcccggtccggcgctgatccagtcacgagcgttgggaagagacttcgtcctctggtaagcacacagcccgccaagaaagttgccacaggggaagctctgctgccttcatctcccaccttaggggccgaacccgctagacctcaggcggtgctggtggaatctggacctgtgtcatatcacgcagatgaagaagcagatgaggaggagcctgacgaagaagacggggagccttgtgtgagcgctctgcagatgatgggctctaatgattacggatgtgatggtgatgaagacgacgggtattag

SEQ ID NO: 109958 - DNA, 2034 bp, Artificial Sequence
  Description of Artificial Sequence: Synthetic coding sequence
atgaccggacgggtctgccgaggctgcggaggcacagatatagaactggatgctgcacggggtgatgctgtgtgcaccgcttgcgggtctgtgcttgaggacaacatcattgttagcgaagtccagtttgtggaatcttcggggggtggatcgtctgccgtagggcagttcgttagcctcgacggcgcggggaaaacccctaccttagggggcgggtttcatgtgaacctggggaaagagagtcgcgctcaaacactccagaacggccgcagacacatccaccatctggggaaccagctgcagttgaaccagcactgcctggacacggcattcaattttttcaaaatggctgtgagtcggcacctgacccgcgggaggaagatggcccacgtgattgctgcatgtctgtatctcgtgtgcaggaccgagggcaccccccatatgctgctcgacttatcagacctgcttcaagtcaatgtgtatgttctgggcaaaacgttcctcctccttgcccgcgagctgtgtatcaacgcccccgcgatcgatccctgcctgtacattccccggttcgcacacctactggagttcggcgaaaagaaccatgaagtttctatgaccgccctgagactgctgcaacggatgaagagggattggatgcatacagggcgccggccgtccggactgtgtggcgccgcccttctggtggcagctcgtatgcacgactttagacgcaccgttaaagaggtcatcagtgtggtgaaggtgtgcgaatctaccctccgcaagcgtctgactgaattcgaagacactccaaccagtcagctaaccatcgacgagtttatgaagatcgacctggaggaagagtgcgatcccccgagttatacggccggacagcgcaagctgaggatgaagcagcttgagcaggttctgagtaagaagctggaggaagtggagggggagatttcatcctatcaggatgcaattgaaattgagcttgagaatagcagacccaaagctaagggtggactggcaagccttgcaaaggatgggtcaactgaggataccgccagcagcctgtgcggagaagaggataccgaggacgaggaactggaagcagctgcatcccacctgaacaaggatttgtaccgggagttattgggaggcgcccccggtagttcagaggccgctggctcccccgagtggggcgggcggccacccgccctgggctccctgctggacccattgcccacagcagcctccctcggtatctcagacagcatccgggagtgtatatcctcgcagagctcagatcccaaagacgcctcaggggacggagaactggacctgtcaggcattgacgacctggagatcgatcggtatatcttgaacgaatccgaagcgcgagtgaaagcagagctgtggatgcgagagaacgccgagtatcttcgagaacagagggagaaggaagcacggatagctaaagagaaagaactgggaatatataaggagcataaacctaagaaatcctgcaaaagaagagagccgattcaagctagcaccgctcgggaagcaatagagaagatgctggaacagaagaagattagcagtaagataaattattcagtgctcagaggactttccagcgcaggagggggctctccccaccgtgaggatgctcagccagaacatagtgctagtgcacggaagctcagtagaagacgaacccccgccagcaggtctggtgctgatcctgtgactagcgtggggaagagacttcgcccactggtgtctacacaacctgccaaaaaggtggctactggcgaagcgctgctgcccagcagtcctacattgggagccgagccagctcgcccccaggctgtactcgtagaatccggaccagtgagctatcatgctgatgaggaagccgatgaggaagagcccgatgaggaagatggcgagccctgtgtgtccgcccttcaaatgatggggtctaacgactatgggtgcgacggtgacgaagatgacggttactag

SEQ ID NO: 109959 - DNA, 612 bp, Artificial Sequence
  Description of Artificial Sequence: Synthetic coding sequence
atgagggaaaatgccgaatacctccgagaacagcgcgagaaggaggctcgcatcgctaaggagaaagagctgggaatttataaggaacacaaaccaaagaagagctgcaagcggcgcgagcccatccaagccagcacagcacgggaggccatcgaaaagatgctggaacaaaagaagatctcgtccaagatcaactactctgtcctgcgcggtctctcctccgccggtggggggagtccccatcgggaggatgcgcagccagaacattccgccagcgcgcgcaagctgtcacggcgacgcaccccagcgtccaggagcggtgccgatcccgtgacttcagtgggaaagcgattgcggcctctcgtctcaacacaacctgctaagaaggtagccacaggggaggcactgctcccaagcagccctacgttgggcgccgaacccgccaggccacaggctgtgcttgtggaatccggaccagtgagttatcacgctgatgaagaagcggacgaggaagagcccgacgaggaggacggcgaaccatgcgtgagcgccctccagatgatgggcagcaacgactacgggtgtgatggggacgaagacgatggatactag

SEQ ID NO: 109960 - DNA, 714 bp, Artificial Sequence
  Description of Artificial Sequence: Synthetic coding sequence
atgacggccctgcgtcttctccagagaatgaaacgggattggatgcacaccggtagacgcccctccggactctgcggagctgccttgttagtggccgcaaggatgcacgacttccggaggacagtaaaagaagtcatctccgtcgttaaggtgtgcgagtctactcttagaaagcggctgaccgaattcgaagatactccaacctcgcagctcactatcgacgagtttatgaagatagacttggaggaggagtgcgaccctccctcttacacggctggacaacgcaagttgcgcatgaagcagctggaacaggtgctgtccaagaagcttgaagaggtggaaggagagatctcgagctaccaggatgccatcgagatcgagttggagaatagccggccgaaagccaaggggggcctggcctctctggctaaggacgggtcaaccgaggataccgccagctcgctctgcggggaggaagacacagaagacgaggaacttgaggctgcagcgagccacctaaataaggatctgtacagggagttgctgggcggagcaccggggagtagcgaagcggccgggtctcccgagtggggtggcaggcctccggcactgggctctctgttggatcccctcccaacggccgcctcgctgggaatttccgactcaatccgagaatgtatctcatcccagtccagtgacccaagcgagttctag

SEQ ID NO: 109961 - DNA, 138 bp, Artificial Sequence
  Description of Artificial Sequence: Synthetic coding sequence
atgacggcgctgagacttctgcagagaatgaagagggactggatgcatacgggacgcaggccgtctggactatgcggggcagccctgttagttgctgcaaggatgcacgactttcgccggactgtcaaggaagtgtag

SEQ ID NO: 109962 - DNA, 45 bp, Artificial Sequence
  Description of Artificial Sequence: Synthetic coding sequence
atgaccgccctgaggctgctgcagcgcatgaagagggattggtag

SEQ ID NO: 109963 - DNA, 468 bp, Artificial Sequence
  Description of Artificial Sequence: Synthetic coding sequence
atgactgccctgcgcttgcttcagcggatgaagcgggattggatgcatacaggaaggcggccgtcaggcctgtgcggagccgccctcctcgtggcagcccggatgcatgacttcagacggaccgtcaaagaagtgatttctgtcgtgaaagtgtgtgagtccaccctgagaaagcgcctgacagaatttgaagacacccctactagtcagttgacaattgatgagttcatgaagatcgacctcgaagaagagtgcgatccaccttcttacacagctgggcagagaaaactccggatgaagcagctggagcaagtgttgtccaagaaacttgaagaggtggagggcgagatcagcagctaccaagatgctattgagatagagctcgaaaactccagaccgaaagccaagggcggtctggccagcctggcaaaggatggctctacagaagatacagcatctagtctatag

SEQ ID NO: 109964 - DNA, 8307 bp, Artificial Sequence
  Description of Artificial Sequence: Synthetic coding sequence
atggcactggttcttgaaatttttacacttctggccagcatttgctgggtatctgcgaacatttttgaataccaggtagatgcccaacctctgcgaccctgcgagttacagagggagaccgcattcttgaaacaagctgactatgtccctcagtgtgcagaggacggaagtttccagactgtgcagtgccaaaatgacggtcggtcttgctggtgtgtaggcgccaatggttccgaggtgctggggtcacgtcagcctggccggcctgtggcctgtctttccttttgccagctacagaaacagcagattctgctgagtggctatatcaactccaccgacacatcctacctgccgcaatgccaggactctggagattacgccccagtgcagtgcgatgtccaacaggttcagtgctggtgcgtcgacgctgaagggatggaggtctatgggacacggcagttagggagacctaaacggtgccccaggtcgtgtgagattcgcaaccgccggcttctacatggagtcggagacaagagtcctccccagtgctcggccgagggggaattcatgcctgtccagtgtaagtttgttaacactacagatatgatgatattcgatctggtgcactcctacaatagattcccagatgcttttgttaccttttccagttttcaacgccggttccctgaagtcagcgggtactgccattgcgctgattcacagggaagggagcttgcagagactggcttagagcttttactggacgaaatttatgacacaatctttgcgggactggatttgccgagcacgtttactgagacaactttatatcgtattcttcaaagaaggtttttggccgtccagagcgttatctccggaaggttccgatgccccaccaaatgtgaagtggaaagatttacagctacctcatttggtcatccttatgttccatcgtgcaggagaaacggggactatcaggccgtgcaatgccaaacagagggcccttgctggtgcgtggacgcccagggtaaggagatgcatggaacccgacagcagggggaacctcctagctgcgctgagggccagtcgtgtgcctcggaacgtcaacaggctctctctcgtctgtatttcggtacttcaggatacttttcacagcatgatctgttctcatcacccgagaagagatgggcgtcaccccgtgtcgcacggttcgcgacttcatgtccccctaccataaaagagctattcgtagactccggactgttgcgtcctatggttgaagggcagagccaacagtttagcgtctctgagaatttactgaaagaggccatccgggcgatctttccctcgcggggcctcgcacggctggcattgcagttcaccaccaatcctaaacgattgcaacagaacctgtttggagggaaatttcttgtgaatgtgggccagtttaacctgtctggggcactgggaacccgtgggacattcaactttagtcagttttttcagcagctgggactggctagcttcctgaatggcgggcggcaggaggacctggcgaagcccctatccgtagggctcgatagtaattcaagcacagggacacctgaggccgcgaagaaggacggcacaatgaataagcctacagtgggctcttttggcttcgaaattaacttacaggaaaatcagaatgcactcaagttcttggcctcactgttggaattacccgagttcttgttgtttcttcagcatgccatttccgtaccggaggacgtggctcgtgaccttggagatgtcatggaaaccgtgttgtcaagccagacatgcgagcaaaccccggagcgactgttcgtcccttcatgcaccaccgagggatcatatgaagacgtgcaatgcttcagtggtgaatgctggtgtgtgaactcttggggaaaggagctgcccggaagtcgagtccggggaggacaaccaaggtgcccaacagattgtgaaaaacagcgcgccaggatgcagagtcttatgggatcgcaaccagcaggcagtaccttattcgtccctgcttgtacaagcgagggccactttctgccagtacagtgttttaacagcgagtgctactgtgtggatgcagagggacaggctattcctggaactaggagtgccataggcaagcctaagaagtgcccaaccccatgccaactgcaatctgagcaggcttttctgcggaccgtccaggccctgctgtctaactcctccatgctccccaccctctcagatacgtacattccacagtgtagtaccgacggccagtggcgtcaggtgcagtgtaatggccctcctgagcaggtattcgagctttatcaacggtgggaagcgcagaacaaggggcaggacctgacccctgccaagctactggtaaagatcatgagttatagagaggcggcttcaggaaatttcagcctgtttatccagtctctgtacgaagctgggcagcaggacgtgttcccagttcttagccaatatccttcccttcaagatgtgccactggcagctctcgaaggcaagagacctcagccccgcgaaaatatcctcctagaaccctatctcttttggcagattctgaacggtcaactgtctcagtatcccgggtcttacagcgatttttccacaccactcgctcacttcgacctaaggaactgctggtgcgtcgacgaagcgggtcaggagctggagggaatgcgcagcgagccgagcaaactgccaacttgccccggttcatgtgaagaagctaaactcagagtgctccaattcatcagggagacggaggaaattgtatcggctagtaattcttccaggtttcctcttggcgaatcattcctagttgctaaagggatacgccttcggaacgaagatctcggtctgcctcccctctttccaccacgcgaagctttcgctgagcagttccttagaggatcggattacgctatccggctggccgcgcagtccacgctgagtttttaccagcgcagacgtttcagtccagacgatagtgctggtgcaagcgcactgctaaggagcggcccttacatgccgcagtgtgacgcttttgggagctgggagccggttcagtgccatgctggcacgggccattgttggtgtgtggacgagaagggcggtttcatacctggaagtctaacggctcgatcgcttcagatccctcagtgccctacaacctgtgaaaaatcaagaaccagcggcctccttagctcttggaaacaggcacggtctcaagaaaacccatcccctaaggacctgtttgtccctgcatgcctggagaccggcgaatacgcgagactccaagcatcaggcgctgggacgtggtgcgtagatcccgcgtctggggaagagctccgacctggaagttcttcaagcgctcaatgcccctccctgtgcaacgttctcaaaagcggagtgctttctagacgcgttagtcctgggtacgtgcctgcttgccgtgcagaagacggcggctttagcccggttcagtgtgatcaggcccagggaagctgctggtgcgtcatggattctggtgaagaggtgcctggaacccgcgtgacgggcgggcagcccgcctgcgaatcgccaaggtgtcctttgcccttcaacgccagcgaagttgtcggggggacaattctctgcgagacaatctcagggcctaccggtagcgcgatgcagcagtgccagcttctctgcaggcagggttcttggagcgtattccctcccggccccctgatctgcagtttggagtctggccgttgggagtcccaactgcctcagccccgagcatgtcaacgtccccagttgtggcaaactatccaaactcaaggccacttccagctacaactgcccccaggaaagatgtgttcagccgactatgccgacctccttcagacgttccaggtattcattctggatgagctgaccgctaggggtttttgccagatccaagtgaaaacctttggcaccctggtttctatcccggtctgcaataacagtagtgtgcaagtcggttgcctgacccgtgaacggctgggcgtgaacgtgacatggaaaagtagactggaagatatcccagtggcgagtcttcccgatttgcacgacatagagcgggcattggtggggaaagatttgctaggtcgatttactgatttaatacaatccggcagcttccagctgcacctggactccaaaacctttccagccgaaaccatcaggtttctgcaaggcgatcatttcgggacaagccctagaacgtggttcggttgcagcgaggggttctaccaggtgctgacaagcgaagctagccaggatggattgggctgtgtcaaatgtcccgaggggtcctattcacaggatgaagaatgtataccatgtcctgtaggattctatcaggaacaggctggaagtctggcctgcgtgccctgtcctgtaggcagaacaaccatttctgcaggagcctttagtcagacacactgtgtgaccgattgccagcgcaatgaggccgggctacagtgtgatcagaacggacaatatcgagctagccaaaaagaccgcggtagcggtaaagccttctgtgttgacggcgaaggacggagattgccttggtgggagacagaagcgcccctggaggacagccagtgcctgatgatgcagaagtttgaaaaagttcccgaatctaaagtgatctttgacgccaatgcccccgtggcagttcgctcaaaggtacctgatagcgagttcccagttatgcagtgcctcactgattgcacggaggacgaggcatgttcctttttcaccgtgtctaccaccgagcctgagattagctgcgatttctacgcctggacttccgacaatgtggcatgcatgacttcggatcagaaaagagatgctctcgggaattccaaagctacttcgtttggctctctgcggtgccaagttaaggtccgaagccacgggcaggacagtcctgcagtctacctgaaaaaggggcagggttccacaaccacacttcagaagagattcgagcctaccggcttccagaatatgctctcagggctctataaccccatcgtgttcagcgcatccggcgctaacctaacagacgctcacctcttttgcttgctggcgtgcgatcgggacctgtgctgtgatgggtttgtgttaactcaggtgcagggaggggcgatcatctgtggcctcctcagctcaccttctgtgctcctgtgcaacgtcaaggactggatggatccatctgaagcctgggcgaatgcaacctgcccgggtgtaacttacgaccaggagtcgcaccaggtgattcttcgcctaggcgaccaggagttcatcaaaagcctgactccattggaaggcacccaggacacatttacaaacttccaacaggtctatctatggaaggacagcgacatgggctcccggcccgaatcaatggggtgcagaaaggatactgtgccaaggcccgcaagtccaacagaggcaggactcacgacggaactgtttagtcccgtggacctgaaccaggtgattgtgaatgggaatcaaagcctgtctagtcagaagcactggctgttcaaacacctcttttcagctcaacaggctaacttatggtgcctgagtcgctgtgtccaggaacactctttctgccagttggcagagatcactgagtcagccagcttatacttcacttgcacactgtatcctgaagctcaggtgtgtgacgatattatggagtccaacgcccagggttgccgacttatcttgccacagatgccaaaggccctgttcaggaaaaaagtgattttagaagacaaagttaaaaatttctacacgagattgcccttccagaagctaatgggtatcagcattcgaaataaggtaccaatgagcgaaaaatccatttcaaatggcttttttgaatgcgaaagacgatgtgatgcagacccctgttgtaccggattcggcttcttaaacgtgtctcagctgaaggggggggaggtaacgtgtttgaccttgaactctcttggcattcagatgtgcagcgaagaaaacggcggagcatggcggattttggattgtgggtccccagacattgaggttcacacataccctttcggctggtatcaaaaaccgatcgctcagaacaacgcgccaagtttctgtccgctcgtggtgctgccctctctgaccgagaaagtgtctctcgattcatggcagtctcttgcactcagcagtgtcgtcgtggacccatcgatcaggcatttcgatgtcgcacacgtgagcacggcagctacaagcaatttctccgcggttagagatctctgcttgtccgagtgtagccagcacgaagcatgcctcatcacgaccttgcaaactcagcccggtgcagtgcggtgtatgttctatgcagacacccagtcctgtacccactctctgcagggccagaactgtcgcctgctcctgagggaagaggccactcacatctatcgaaagccagggatttcactccttagttacgaggcttcagtcccgtctgttcccatctcaactcatggacgcctgctggggcgtagccaagccatccaggttggcacctcatggaaacaggtggatcagtttttgggcgtgccatatgcagctccacccctcgcagagcggagatttcaggcacccgaacccttaaattggaccgggagttgggatgccagcaaaccaagagcatcatgttggcaacccggcactcggacctctacctctcccggggtttcagaagattgcctgtatctcaacgtgtttatccctcagaatgttgcccctaatgcttcagtacttgtgttttttcataatacaatggatcgcgaagaatcagaaggctggcccgcaatcgacggtagctttttagctgcagtgggaaaccttatcgtagttaccgcaagctaccgcgttggtgtctttggtttcctatccagcggctcgggcgaggtcagcggcaattggggcctgttagaccaggtggccgcactcacctgggtacagacccacatcagagggtttgggggagacccaaggcgcgtgagtcttgcagcagatcgtggcggagcagatgtagcttctatacatctactgactgcgcgagcgactaactcgcagctgtttaggcgcgctgttcttatgggcggctcagccctgagcccagcggctgtaatcagtcatgaacgggcccagcagcaggcgatagcccttgccaaagaggtttcatgcccgatgagctcaagccaggaggtggtctcctgcttgagacagaaacccgcaaacgtcctgaacgacgcgcagactaagctgctggcggtgtccggcccattccattattggggcccagtgatagatgggcacttcttacgggaaccccccgctcgagccctaaagcggtccttgtgggtggaagtggatttgctcataggcagctcccaggacgacgggctgatcaaccgcgctaaggctgtgaaacaatttgaggagtcgagggggaggacctcttcgaagacagcgttttatcaggctctacaaaatagtcttgggggcgaagactccgacgcccgcgtggaggccgccgccacctggtactactctctagagcatagcaccgatgattatgcttcttttagccgagccctagagaatgcaactcgcgattacttcatcatttgccccatcatagatatggcatccgcatgggcgaagagagccagaggaaatgtcttcatgtatcatgctccagaaaactacggccatggctcacttgaactgttggcagacgtgcaattcgcactgggactgcctttctatccggcatacgagggacaatttagtctggaggagaagagcctgtcccttaaaattatgcagtatttctctcacttcattcgcagcggcaaccccaattacccgtacgagttcagtcggaaggtcccgacgtttgctactccttggcccgacttcgtgcctcgcgccggcggcgagaattataaagaatttagtgagttgttaccaaatcgacaaggcctcaagaaggccgattgctcattctggagtaagtatatttcgagtctcaagacatcagctgacggggccaaaggcggacagtctgccgagagcgaggaagaagagcttaccgccgggtccgggctgcgagaggacctgctgtctttacaggagccaggcagcaaaacgtattccaaatag

SEQ ID NO: 109965 - DNA, 1191 bp, Artificial Sequence
  Description of Artificial Sequence: Synthetic coding sequence
atgccgggtcggggacgctgtcccgactgcgtcgtgacagagggtgtcttaacaacaacctttagtgatgagggaaatctgagagaagtcacctactcgaggagcaccggcgagaatgagcaggtgtctcgatcccagcagcgaggcctgcgcagggtgagagatctgtgccgcgtgctgcagctgcctcctaccttcgaggacaccgccgtggcgtattatcagcaagcctatagacactctggaatccgggcagcgagactccagaagaaggaggtgttagtgggatgttgtgtcttgattacctgtagacaacacaattggcccctgacaatgggagccatctgcacattgttgtatgccgacctggatgtgttcagcagcacatacatgcagatcgtaaaactgctggggctggacgtaccgtccctttgcttggccgagctggtcaaaacatattgcagtagtttcaagctgttccaggccagcccaagtgttcctgcaaaatatgtggaggacaaggagaagatgctatcgcgcaccatgcagctggtggagctcgccaacgagacctggctcgtcacaggacgccatccactgcccgtgatcaccgctgccacgtttcttgcttggcagtcgctgcagcctgcggatcggctgtcctgtagtctcgctaggttttgtaaattggcaaatgttgatctcccctaccccgctagcagcagactgcaggagctcctcgccgtgctcctccgaatggcggagcaattagcttggctccgggtgctgaggctggacaaacgctctgtggtgaagcatataggagatttgcttcagcatcgtcagtctctcgtcaggtccgcctttcgggatgggaccgcagaagtggagacgagggagaaggaaccccccggctggggacagggccagggcgaaggggaggtggggaataactcccttggactgcctcaaggtaaacgccccgctagtcctgccttgcttcttccaccctgcatgctgaaatcacccaaaaggatctgtccagtgccacccgtctccactgtgacaggcgacgaaaacatctcagattccgagattgagcagtacctgcgcacgcctcaggaggtgagagatttccagcgcgcacaagccgcaaggcaggcagcgacgagcgtgcctaaccccccttag

SEQ ID NO: 109966 - DNA, 1698 bp, Artificial Sequence
  Description of Artificial Sequence: Synthetic coding sequence
atggctgaaggcaaggctggcggagccgctggtctgtttgctaagcaggtgcagaagaaattcagccgcgctcaggaaaaagtcctacagaagcttggcaaagccgttgagacgaaagatgaaagattcgaacagagcgccagcaacttctatcagcagcaagcagagggccataagctgtataaagatctgaaaaacttcctgtctgccgtcaaggttatgcatgaatcttctaaaagggtttccgagacactccaggagatctactcgagcgaatgggatgggcacgaggagctgaaagctatagtgtggaataatgatcttttgtgggaggactacgaagaaaagctggccgaccaggccgtccgcacgatggaaatctacgttgctcagttctctgagatcaaagagcggatcgcgaagcggggtcgcaaactggtggattacgattccgcccggcaccatctcgaagctgtgcagaacgctaagaaaaaagatgaggcaaaaaccgcaaaggcagaggaagagttcaataaggcccagactgtgttcgaggacctgaaccaagagttgctggaggaattgccgatcctgtacaacagtcgcataggctgttatgtcaccatctttcagaacattagcaacttacgcgatgtgttctatagggaaatgtctaagctgaaccacaatctttatgaagttatgagcaaactagagaaacagcacagtaacaaggtgtttgtcgtaaaggggctgtcctcttcttcccgtagatctctggtaatctcccccccagtgaggacagccactgtttcaagtcccctaaccagcccgacttcccccagtaccctgtcactaaagtcagaatctgagtctgtgagtgccacagaggacctcgcacctgacgccgcacagggcgaggataacagcgagattaaggaactgctggaagaggaggaaattgagaaggagggctcagaagccagttcaagtgaagaggatgaaccactccccgcctgtaacgggccagcccaggctcagccttcacctacgacagagagagcaaagagtcaagaagaggtcttgccatctagtactacaccttcccctggaggagcactgagcccctctgggcagccctcgtccagtgcaactgaagtggtgctccggacccggacagcgtctgaaggaagtgaacagccaaaaaaaagagcaagtatccagaggacttcagcaccccctagccgtccacccccaccacgggcaaccgcatcaccccggccatcctccggaaatatccccagcagccctactgcaagcggaggggggagccctaccagtccccgcgcgagcctgggcacagggaccgcgtccccgcggacctcgctggaggtttcaccaaatccagagccccctgagaaacccgtgcgcacccctgaggccaaggaaaatgagaacatccacaatcagaaccccgaggaactgtgtaccagcccaaccctcatgacctcccaggtggcaagtgaacctggggaggctaaaaagatggaagacaaagaaaaggacaacaaactgatctccgccaatagcagtgaggggcaggaccagctgcaggtgtccatggtgcccgaaaataacaatctgactgcgccagagcctcaggaggaggtgtcaaccagtgagaatcctcaattgtag

SEQ ID NO: 109967 - DNA, 1602 bp, Artificial Sequence
  Description of Artificial Sequence: Synthetic coding sequence
atggccgagggtaaagcaggcggagccgcgggtctgttcgctaagcaagtccagaagaagttttcgagagcccaggaaaaggtgcttcagaaactcggaaaagccgtggaaacaaaagacgagagattcgagcaatccgcaagcaacttctaccaacagcaagcagaggggcataagctatacaaggacttaaagaatttcctttcggccgtgaaggtaatgcacgagtcctccaaacgcgtgagcgaaacactacaggaaatatacagttccgagtgggatggtcacgaagaactgaaggcaatcgtgtgggaacgtatcgccaaaagggggaggaaacttgttgattatgactcagcccggcatcatctcgaggctgtgcagaacgccaagaaaaaggatgaggccaaaactgcaaaggcagaagaagagtttaacaaggctcagaccgtcttcgaggaccttaatcaggagttgctggaggaactgcctatactctacaactcccggatcgggtgttacgttactatctttcagaacatttctaacctgcgggacgtgttttatcgagagatgagcaagctcaatcacaatctttacgaggtgatgtccaagctggaaaaacagcattcaaacaaagtgtttgttgttaaggggctgagtagtagcagccgccgaagcctcgtgatcagccctcccgtgagaaccgccaccgtctcttcccccttgaccagcccaacaagtccatcaacactctctctgaaatccgagagcgagtccgtgtcagctacggaggatcttgccccagatgctgcacaaggcgaggataacagtgagattaaggaactccttgaggaggaagagatcgaaaaggagggctctgaggcctcatcctcagaagaggacgagcctttgcccgcctgtaatggcccagcacaggcacaaccaagtcccacgactgagcgggctaaaagccaagaagaggtgctgcccagcagcactactccatctccaggcggcgccctgagtccaagcgggcaaccttcgtcttctgccacagaggtggttctgaggactcgcacagcttcggagggcagcgaacagcccaaaaaacgggctagcattcaacgcacctccgctcccccctcacgaccgcctcctcccagagctaccgctagccctagaccttctagtgggaacataccatcttcccctaccgcttccggaggcggctcaccaacctctccacgcgcatcactggggaccggaaccgcgagcccacggactagcctggaagtgagtcctaatccagagccaccggaaaagccagtacgtaccccagaagctaaggagaatgaaaacatccacaaccaaaatcccgaggagttgtgtacgtcgcctacactcatgaccagccaagtggcatcagaaccaggcgaagccaagaagatggaagataaggagaaggataacaagctgatatccgcaaattccagcgaggggcaggaccaactgcaagtgagcatggtccctgaaaacaataacctcacagctcctgaaccacaagaggaagttagcaccagcgagaaccctcaactttag

SEQ ID NO: 109968 - DNA, 1620 bp, Artificial Sequence
  Description of Artificial Sequence: Synthetic coding sequence
atggtgctgcagaagctgggcaaagccgtggagacgaaagacgaaaggtttgagcagtccgcatcgaacttttaccagcaacaggcagagggccacaaactttacaaggaccttaaaaatttcctgagcgctgtcaaagtgatgcacgagagctcgaaacgggtgtctgagactttgcaggagatttactcgtctgaatgggatgggcatgaggaacttaaggctatcgtatggaacaatgaccttctctgggaagattacgaggagaaactcgccgaccaggcggtgagaactatggaaatttatgtagcccaattctccgaaatcaaagagaggatcgctaaaagaggacgcaagctggttgattacgactctgcccgccaccacctcgaagccgtgcaaaacgcaaagaaaaaagacgaagcaaaaactgctaaagcagaagaggaatttaataaggcccagacagtgttcgaagacctgaatcaggaacttctggaggaattgccgattctctacaacagccggatcggctgctatgtgaccatctttcagaacataagcaacctcagagacgtattttaccgggagatgagcaagctcaaccacaacctgtacgaggtaatgagcaagctggaaaaacagcatagtaataaagtgttcgtcgtgaagggcctgagttcaagctctagaagatccctggtgatttcacctccagtgcgcactgctaccgtgagcagccccttaacttccccaacctccccttccacactatctcttaaaagtgagagtgaatcggtatcagcaacagaggatttggcccctgatgcagcccagggcgaggacaactcagagataaaggaactcctggaggaagaggagatcgagaaggaaggttctgaggcatctagttctgaagaggatgagccacttccggcctgcaatggacctgcccaagcccagccctctcccaccactgagagggccaagtcccaagaagaggttctcccgagttcgaccacgccttctcctggcggcgccctatcacctagtggtcagccatcctcttctgctactgaggtggtgttgaggacccggaccgcctccgaaggtagtgaacagccgaagaagcgtgcatctatccagaggacatctgcacctccttctcgtcctcctcccccacgcgccacggcctcacctcggccctcctccggaaatattccatctagcccaacagcctcgggtggaggctcgccaactagcccccgggctagtctgggcacagggactgcatcccctcggacttccctagaagtcagtcccaacccggagcctcccgagaaaccggtgcgcacccctgaggccaaagaaaatgaaaatattcacaaccaaaatccggaagagctgtgtaccagtccaaccctcatgaccagccaggtggcatctgagcctggcgaagcaaaaaagatggaagataaggagaaagataataaactcattagtgctaattcaagcgagggacaggaccagctgcaggtttccatggtccctgaaaataacaatctgaccgcccccgaaccccaggaggaagttagtactagcgaaaatcctcagctgtag

SEQ ID NO: 109969 - DNA, 762 bp, Artificial Sequence
  Description of Artificial Sequence: Synthetic coding sequence
atgtcatggattcctttcaagatcgggcagccaaaaaagcagatcgtgcctaagacagtggagagggatttcgagcgggaatacggcaaattgcagcagttggaagaacagactcgacgactgcagaaagatatgaagaagagtaccgatgccgacttggccatgtctaagtccgccgtgaagattagtcttgacctcctctcaaacccactctgtgagcaagatcaagacctactgaatatggtcactgccctcgacacggcaatgaagcgaatggatgcattcaaccaggaaaaggtcaaccaaatccaaaagacagtgattgagccactcaagaagttcgggtcagtgttcccatccttgaatatggccgtgaaacggagagagcaggcactccaagactacagaagacttcaggcaaaggtcgagaagtacgaggaaaaagaaaaaaccggccctgtgctggcaaagctgcaccaagcaagagaggaactgaggccggtcagggaggacttcgaagctaagaaccgacaactactggaagagatgcctcggttttatggaagcaggctcgattacttccaaccttcatttgagtcactgatccgcgcccaggtcgtatactattcagaaatgcacaagatattcggggacttgtcacaccagctggaccagccaggacattcagacgagcagcgagagcgtgagaatgaagccaaactctcagagctgcgggccctatctattgtagctgatgactag

SEQ ID NO: 109970 - DNA, 600 bp, Artificial Sequence
  Description of Artificial Sequence: Synthetic coding sequence
atgagcaagagcgcggtgaagatttcactggatctgctgagtaatccactgtgtgagcaggaccaagacctgcttaacatggttactgcactagacaccgcgatgaaaaggatggatgcttttaaccaggaaaaagtgaatcaaattcagaaaacagttatcgagcccttgaaaaagttcgggtcggtctttccctccttaaacatggccgtcaagagacgagaacaagcattacaagactaccggcgcctccaggccaaggttgagaaatacgaggagaaggagaagaccgggcctgttctggccaagctccatcaggccagggaggagctcaggcccgtcagagaagacttcgaggctaagaacagacagcttctcgaagagatgcctcgcttttacgggtcaagactggactactttcagccatctttcgagtcccttatacgagcccaagtggtgtactatagcgaaatgcataaaatcttcggcgatctgagccaccagctggatcagcctgggcattcagatgagcagagagagcgggagaatgaagccaaattgtccgagttgagggctctgagcatcgtcgcggacgactag

SEQ ID NO: 109971 - DNA, 2343 bp, Artificial Sequence
  Description of Artificial Sequence: Synthetic coding sequence
atgacccacacaagacgtaaatcgctccccatgctttcaagcggacttacggggaggcgagaacctctacaaatggaggacagcaacatggagcagggggtggagggggtagaacctggcatgcccgagagcccaggccaccttactgggcgaagaaaaaactatcccctcagaaagagacctttggtgcccgagaagcccaaggcatgcaaggtgcttctgacgcgactagagaacgttgcaggtcccaggagcgcagacgaggctgacgaactcccccccgatctgccaaaacctccttctcctgcccctagctctgaggaccctgggctggcacagccacgcaagagacggttagcaagcctgaatgcggaggctctgaataacctccttcttgaaagggaggacacctccagtcttgcaggtactagacgaagccgggctggtgacccgcatcggagtcgggatagggatagagcaaccggcggatggtcttcaagcaagaagcggccgcggctgggagacctcggaggaggttccagggatttgtcccccgaaccagcgcccgacgaagggcctcgcagagacggcgatcccgcaccaaaacgattggcttcactaaacgctgcagcattcctgaagctctcacaggagcgtgagttgccattgaggctccctagggcccatgccgaagtagacggccggtccactgaacctccagctcccaaagctcctaggcccaaatggcctaaggtaaatggaaagaactaccctaaagcctggcagggcgcgagcagcggcgaagccgccgggccgcctggatggcaggggtgtcccgacgaaccctggccttccgccactccatgtgggccgtccgtgcagccgtcccatcagccgctttcaaaagcgctcgagagccctctcggccttcggcctcatttgccactgctcatgggtgggcaggccgctctaaagcctgaacctggtcgacccggggaagagtcccctgcgcctaagcaagagttgcaccagccaagcttccctaccccccagctgagcccattaccgatgcccggtaatccagctgactacaatgggctgtgtgtgggacccgagctcaccgctctaggctcattttacctgtactgcggccaggaggggctgcagtgtggggggtacagcccatgccctatgctgccagaaggtaaactgagcccagttgctgcacctcatgaggagggactgttactggcacccagctctgtgcctagcgggacgccctttcagcatcctccttggggctctagccgttactgctcaagcgaagatactggcgtgaacggttacagcatctgcggcgttctgccgctgtctgttacgcacgccggcacgacatgcggcggctgcccctacaaaatgccgtttgcagccgagggctgcagaagtctgggacaactcgaattccctctccctgaagcagggcatccagcctctcctgctcacccactccttggatgcccagtgcctagtgtgccacccgcagcagaacctgttccgcacctccagacgcccacatctgaaccacagacagtggcccgggcatgtcctcaatcagcaaagcctccaagcggaagtaagagcgggttgcgcacaggctccagctgtagacatactgccagatctaaggcagccagaaggccatcacacccaaagcagcccagggtccagcgcccgaggcccaggcgtagaagacggcgacgaacaaatggctgggtgccggtgggggccgcttgcgaaaaggccgtgtatgtgttggatgagccagagcccgccatcagaaagagttaccaggcagtagagagacatggggagacaatcagagtaagagatacagtactcctcaaatccggcccccggaagacctctaccccttacgtggcgaaaatctctgctctgtgggagaatcccgaatctggtgagctcatgatgagccttctgtggtactaccgtcccgagcatcttcagggaggacgttcgcccagcatgcacgagcccctgcagaacgaagttttcgccagtcgacatcaggaccagaatagtgtcgcgtgtattgaggaaaagtgctacgtgctgacttttgccgagtactgtcggttttgtgctatggcaaaaagaagaggggaagggttacccagtagaaagacagctctcgtccccccctccgcagattattccaccccccctcacaggactgtcccagaggataccgatcctgagcttgtcttcttgtgtagacacgtgtatgactttaggcatggcagaatcctgaagaacccgcagtag

SEQ ID NO: 109972 - DNA, 2340 bp, Artificial Sequence
  Description of Artificial Sequence: Synthetic coding sequence
atgacccacactagaagaaaatctttgccaatgctgagctccggactcacgggccgaagagagcctctgcaaatggaggactccaacatggaacagggtgtggaaggtgtagagccaggtatgcccgagtcccccgggcatctgactggccgcagaaaaaattatcccctacgtaagcggcccctggtcccagagaagccaaaagcgtgtaaagtactgctgacaaggcttgagaatgtcgccgggcctcgcagtgccgatgaggctgacgagttgcctcccgatcttcccaaaccaccctcccctgccccctcttccgaggatcctggcttggcccagccccgcaagaggcgcttggccagtttgaacgcagaggcgctgaacaacctgctactggagagggaagacactagttctttggctggcacacgccgaagtcgagccggggacccacatagaagcagggaccgggatcgcgctacaggcgggtggagctcgtccaaaaagcgtcctcgcctgggcgacttagggggaggtagccgggatctgtccccagagccagcccctgacgaggggcctagacgcgacggcgacccagcaccgaaacgactggcctcgctcaacgccgctgcctttctgaagctgtcacaggaacgtgaactcccactgcggctgccacgggctcacgcagaagtggatgggcgcagcaccgagccacctgccccgaaggctccccgtcccaagtggcccaaggtgaacggtaagaactaccccaaggcctggcagggcgcctcttctggagaggccgcaggccctcccggttggcagggttgccccgatgaaccctggccctcagccacgccttgcggcccatctgtacagccttcccatcaaccgctatccaaagccctcgagtcccctctgggactccgaccgcaccttccattgttaatgggagggcaggcagcactcaagcctgagcctgggcgaccaggagaggagagtccagcccccaaacaagaacttcaccagcctagctttccaaccccacagctttccccactgccaatgcctgggaatcccgcggactataacggactttgtgtaggacctgagctgaccgctctggggagtttctatctctactgcggtcaagagggcctgcaatgtggcggttactctccttgtcccatgttaccagaaggcaaactgtcccctgtcgccgcgccacacgaggagggcctgctgcttgctccaagttccgtgccctccgggactccattccaacacccgccgtggggctcctccagatattgttccagtgaagacactggcgtaaatggttatagcatctgtggcgtcttgccactctctgtgacacatgcgggcacaacttgtggtggatgcccatacaagatgcccttcgcagccggttgcagaagccttggacagcttgagtttccactgcccgaagccggtcacccggctagccctgcgcatccattattgggttgccctgttccaagcgtgcctccagcagcagagcccgtcccccatttgcagacgccaacctctgaaccgcagactgtggctcgagcctgtccccagtccgccaaacctccatcaggtagcaagagcggattgaggacgggatcttcttgtcgccataccgcacggagtaaggctgcccggaggcctagtcacccaaaacaaccccgagtccagagaccccgccctcgccgcagaagaaggaggcgcacaaacggctgggtgccagtcggagccgcttgcgagaaagctgtgtacgtcctggatgagcccgaacctgctattcgcaaaagttaccaggcggtggaaaggcatggagagaccattagggtgagggataccgttctgttaaagtccggtccaaggaagacctcaaccccctacgtagctaaaatcagtgccctgtgggagaatcccgaatctggcgaactgatgatgagcctgctgtggtactaccggccagagcatttgcaggggggacgatctccatccatgcacgagcctttacagaacgaagtgtttgcgagccgccaccaggaccagaactctgtggcttgtattgaagagaaatgctacgtgctgacctttgcggagtattgtagattttgcgccatggccaaacggcggggggaggggctgcctagccgaaagacggcgctggtacccccctccgcggactacagcactccaccacaccggactgtgcccgaagatacagatccggaacttgtgtttctgtgcagacatgtttatgatttccgccacggaaggatcctaaagaaccctcagtag

SEQ ID NO: 109973 - DNA, 4575 bp, Artificial Sequence
  Description of Artificial Sequence: Synthetic coding sequence
atgccactccttcacagaaaaccttttgtgcgtcagaaaccacccgctgacttgcggcctgacgaggaggtgttctattgtaaggtgactaatgaaatctttcgccactacgatgacttctttgagcgcacaattctatgcaattcgctggtttggtcatgcgctgtgacaggcagacccggacttacataccaggaggccctggaaagtgagaagaaagcgcggcagaatcttcagtcgttcccagagcctctaattatccccgttttgtatttgaccagcctcacgcaccgctcaagactacatgagatttgcgatgatatttttgcatacgtgaaggatagatactttgtggaagagaccgttgaggtcatccgtaacaatggtgctcgcctccagtgccgtatcctggaggtgctgcccccttcacaccagaacggttttgccaacggtcacgtaaactccgtagacggagagaccattatcatcagcgacagcgacgacagcgaaacacagtcctgcagcttccagaacggcaagaagaaggacgccattgaccctcttttatttaaatacaaggtccaaccaacaaagaaagaactgcacgaatctgctatcgtgaaggctacccagatcagtaggcgcaaacacctgttcagtcgcgataaactcaaactgtttctgaaacagcattgtgaaccacaggacggtgtgataaagattaaagcaagcagcctgagtacctataaaatagctgagcaggattttagctactttttccctgatgatcccccgacattcattttctcccccgcaaacaggcggagggggagaccccctaagaggattcatatcagccaggaggacaatgtcgcaaacaagcagacattggcaagttatcggtctaaggctaccaaagagcgagacaagctgttgaagcaggaggaaatgaagagtttggcttttgagaaggcgaagctgaagcgcgagaaagccgatgccttggaagccaagaagaaagagaaagaagacaaggaaaagaagagggaagagctcaagaaaattgtagaggaagaaagactgaagaaaaaggaggagaaggagcggttaaaagtggagcgggaaaaagaaagggagaagctgcgtgaggagaaaaggaaatacgttgaatatcttaaacaatggtccaagcctcgggaggatatggagtgcgacgacctaaaagagctgcctgaaccaaccccagttaaaacccgccttccaccagagatctttggcgatgccctgatggtcctcgaattcctgaatgcttttggggagttgttcgaccttcaagatgagttcccagacggcgtgaccctggaggtcttggaggaggcactggttggtaatgatagtgagggacccttatgcgagctcttgttcttctttctgacagcaatatttcaggctatagcagaggaagaagaggaagtcgcaaaggaacagctgacggacgcagacacaaagggctgttctctcaaaagcctggatctcgactcatgtacgttgagtgagatcctgaggctgcatatccttgcatcgggggcagatgtgacaagcgccaatgcgaaatatcgctaccaaaagcggggtggatttgatgcaaccgatgacgcctgtatggagcttcgcttgtctaacccgtctttggtgaaaaagttgagctctactagcgtctacgacctgaccccaggagagaagatgaaaatcctccacgcactctgtgggaagcttctgactctcgtctcaacacgtgactttattgaagactatgttgatattctgcggcaggccaagcaagaatttagagagcttaaggcagaacagcataggaaggaaagagaggaggcagctgctcgcatcaggaagcgaaaagaggaaaagctgaaggaacaagaacagaagatgaaagagaaacaagagaagctaaaagaagatgagcagcgaaacagtactgccgacattagcattggggaggaggagcgggaggatttcgacaccagcatagaatcaaaagatactgagcagaaagagcttgatcaagacatggtcactgaggatgaagatgatccaggtagtcacaagcggggtcggaggggcaagcgaggtcagaacggctttaaggagttcactcggcaggagcagatcaattgcgttacaagagagcccctgaccgcagatgaagaagaggccctaaagcaggagcatcaacgaaaggagaaagagctgttagaaaaaatccagagtgctatagcttgtaccaacatctttcctctgggacgcgatcggatgtacaggagatattggatatttccctcgatcccaggcctgtttattgaggaggactatagcgggctgaccgaagacatgctgttaccgcggccttccagcttccagaacaacgtgcagtcgcaggatccccaagtgtcaacaaaaaccggcgagccattgatgtccgaatcgacatccaatatcgatcaggggccgcgggatcacagcgtccagttgccgaaacccgttcacaaaccgaaccgatggtgcttctacagctcctgcgagcagctcgatcagctgattgaggcgttaaacagtcggggccatcgtgagagtgcactcaaggaaacgttgctgcaagaaaaatcgcggatctgcgcccagctggccaggtttagtgaggagaaattccacttctccgacaagcctcaacctgattccaagcctacctattcccgaggcagatctagtaacgcctacgatccatcacagatgtgcgccgagaaacaacttgagttacggctcagagacttcctgctagacatcgaggaccgcatttaccagggaacgttaggcgccataaaagtgactgatcggcatatttggcggtcagccttggagtcaggccgttacgagttacttagtgaagaaaataaggagaacgggattatcaaaaccgtgaatgaggatgtggaggagatggagatcgatgaacagaccaaagttattgttaaagatcgactgttggggataaagactgaaacacctagcacagtatctactaatgcatccacccctcagagcgtgtcttccgttgttcattacctggccatggccctgttccagatcgagcagggcatcgagcgtagatttctcaaggccccactcgacgccagcgacagcggacgctcttacaaaacggttctcgaccgttggagggagtctctgctgagcagtgccagtctctcccaggtgtttctgcacctatctaccttagacaggtctgtcatttggagcaagagcatcttaaatgcgagatgtaaaatttgtcgcaaaaaaggggacgcagaaaacatggtgctttgcgatggatgcgatcggggacatcatacctattgtgtccgccctaaactgaaaacagtgccagagggggattggttttgtccagaatgtcgtcccaaacagcgaagtcgtagactctcctctcgccagcgcccatctctcgaatccgacgaggatgtggaggattcgatgggtggggaggatgacgaggtggatggggatgaagaagagggccaaagcgaagaggaagaatatgaagtggagcaggacgaggacgattctcaagaagaggaggaggtgtccctgcccaaaaggggacgaccccaggtgcgacttcctgtgaaaacccgagggaagttatccagctccttcagttcacgaggacagcagcaggaacctggccgttacccaagtagaagccagcaatctactccaaagaccactgtcagtagcaaaacaggccgtagtctgaggaaaataaactctgccccaccaacagagaccaagagccttcgcatcgcctcccgatccacaagacacagccacggtccactgcaggctgacgtctttgtagagttgttgtcaccacgaagaaagcggcgcggaagaaagagcgcaaacaatactcccgagaactcaccaaatttccccaacttccgcgtgatcgctaccaagagtagtgaacaatccagatctgttaacatcgcgtccaaactgtctctccaggaaagcgagagtaaaagaaggtgtcgaaaaagacagtcccctgagccctctcctgtgacccttggtcgtcgcagttcaggacgccaggggggggtgcacgagctgtcagctttcgagcagctggtagtcgaattagtaaggcatgatgacagttggcctttcctgaagcttgtgagcaagatccaggtacctgactattatgatatcatcaaaaaacccatagccttaaacattatccgagaaaaggttaataagtgtgagtacaaactcgcctctgagtttatagacgacatagagctgatgtttagcaactgctttgaatacaatccgagaaatacaagcgaggcgaaggctggaacccggttgcaggcattttttcacattcaagctcagaaattggggttgcacgtcactccatctaatgtcgaccaagtttcaacgccccccgcagccaaaaagagccgcatttag

SEQ ID NO: 109974 - DNA, 4671 bp, Artificial Sequence
  Description of Artificial Sequence: Synthetic coding sequence
atgccactgttgcaccgaaagccatttgtccggcagaaaccccccgcagatctgcgacccgatgaagaagttttttattgcaaggtcacaaacgagatattcaggcactatgacgactttttcgagcggactatcctgtgtaactcactagtctggtcctgcgcagtcacaggccgacccgggctgacttaccaagaggcactagagagcgagaaaaaagcccgccagaacctgcagtcattccccgaacccttgattatccccgtcctatacctgacttcgcttacacaccggtcccggctccatgagatttgtgacgatatttttgcatatgtgaaggatagatacttcgtcgaagagaccgtggaagtcatccgaaacaacggagcccgcctccagtgtcgcatcctggaagtcctgccaccctcacaccaaaatggcttcgccaacggacacgtgaatagcgtcgatggagagactatcatcatttcagattccgacgactccgaaactcagtcttgtagttttcagaacggcaaaaagaaagatgccattgatcctctgctttttaagtataaggtacagccgaccaagaaggagctccacgagtctgccatcgtgaaggcaacccagattagcagaaggaagcacctgttctcccgggataagctgaaactgtttctgaagcagcattgtgagcctcaggacggcgtaatcaagataaaagcgagctcattgagcacctacaaaattgccgagcaagatttctcgtatttttttcccgacgatccccccacattcattttttccccggcgaatcgcaggcgcggcagaccacctaaacgaatacacatttcacaggaagacaacgttgctaacaagcagaccctcgcttcttacagatcaaaggcaaccaaggagagggataaactcctcaaacaagaggagatgaaatccctggcattcgagaaggcaaagctgaaacgcgagaaggcagatgccttagaggcaaaaaagaaagagaaggaagataaagagaaaaaacgtgaggaattaaagaagatcgtcgaagaggaaagactgaaaaagaaggaggaaaaggaacgactaaaggtggaaagagagaaagaacgcgaaaaactgagagaggagaagaggaagtatgtggaatacctcaagcagtggagtaaaccacgagaggatatggagtgtgacgatttaaaagagttgcccgaacccaccccggtgaagacgaggcttcccccggagatctttggcgacgccctcatggtgctggaatttctgaatgccttcggagagctgttcgatctgcaggacgagttccctgatggggtgacccttgaagtgctcgaagaggcccttgtgggcaatgacagcgagggacctttgtgtgagctcctgttcttctttctgactgccatttttcaggcaatcgctgaggaggaggaagaagttgcaaaagagcagctgacagatgccgacacgaaagacttgactgaagctctggacgaggatgccgacccaacgaagtccgctctcagtgcggtagcatcactggccgctgcatggccccaactccatcaaggatgctctttgaagtcactcgacctggactcatgcaccctcagcgagatactgcggctgcatatccttgcctctggtgcggacgtgacctcggcaaatgcaaagtatagatatcaaaaaagaggggggtttgacgccacagacgatgcttgtatggagctgcggctgtcgaacccatccctcgtgaaaaagttgtccagtacctcggtttatgacttgacaccaggcgaaaagatgaagatcttgcacgcactgtgtggaaagttgctcaccctggtgagtacacgcgattttattgaggactacgtagatatcctgcgacaggccaaacaggaatttcgggagctgaaagcggaacaacacaggaaggaaagggaagaggccgcagctaggatcaggaaacgcaaggaggagaagctgaaagagcaagagcagaagatgaaggagaagcaggaaaagctgaaagaagatgaacagaggaactctactgccgatattagcatcggcgaggaggagagagaggatttcgataccagcatagagtctaaggacactgagcagaaagaattggatcaagacatggtgaccgaggacgaggacgatccgggatcccacaaaagggggcggaggggcaagcggggccagaacggttttaaggaattcactaggcaggagcagatcaactgcgtcactagagagccacttaccgctgacgaagaagaagcactcaagcaagaacaccagaggaaagagaaagagctcttagaaaaaatccagagcgccatcgcttgcacaaacatttttcctttgggtagggatagaatgtatagacgttactggatctttccttccatccctggcctgtttatcgaagaagactattccggcttgaccgaagatatgttgctgccacgcccaagcagttttcagaacaatgtgcaatctcaggatccacaggtttcaacaaaaactggtgaaccacttatgtcggaaagcaccagtaatatagatcaggggccaagggatcatagcgtgcagctgccgaagccagtgcacaagcccaatagatggtgcttttatagcagctgtgaacagcttgaccaactcatcgaggctttgaattcccgaggccaccgagaatctgcgttgaaagaaaccctcctccaggaaaaaagccggatctgcgcacagctcgctcgattttcagaggaaaagtttcatttttcagataaaccacagcctgatagcaagccaacctactcacgcgggcggtcgagcaatgcttacgatcccagtcagatgtgtgccgaaaagcagctcgagttgcggctccgtgatttcctgctggacatcgaggacaggatctaccaaggcacccttggtgccatcaaagtgaccgatcggcacatatggcgcagtgctttagaatcaggtaggtacgagctactgagcgaggagaacaaggaaaacgggatcatcaagaccgtgaacgaagacgtggaagagatggaaatagacgaacagaccaaggtcattgtgaaagatcggctgctgggaatcaaaacggagactccaagcacagtgagcaccaacgcctcaacccctcaatccgtgagctcagtggtgcattatctggccatggccctcttccaaattgagcaggggatagaacgcagatttctgaaagcacccttggatgcttctgatagcggacggtcctacaagacagtcttggaccggtggcgagagtcactgttgtcatcagccagcctcagccaagtgttcctgcacctttccaccctggatcggagcgttatctggtctaagagcatcctgaacgcccgttgcaagatttgccgcaaaaagggcgatgcggagaacatggtgttatgcgatggctgtgacaggggccaccacacatactgcgtgcgaccaaagctgaagaccgttccagaaggggactggttttgtcctgagtgtcgacccaagcagaggagccgcagactcagctccagacagaggccttctctggagagcgatgaagatgttgaagattctatgggcggagaggatgacgaagttgacggcgatgaggaggagggacaaagcgaagaagaagagtacgaggtagagcaggatgaagatgattctcaggaggaggaggaggtttcactgccaaagcgggggcgacctcaagtgaggcttcctgtgaagacccggggaaagctttcttccagcttcagtagcaggggacagcagcaggaaccaggacgttatccatctcgcagtcagcaaagtaccccaaaaaccaccgtgtccagcaaaacaggtagatctctgcgcaaaatcaacagtgccccgccaacggaaactaagagcctgcggatagcatctaggagcacacgccactcacacggccctttgcaggcagatgtgtttgttgaactgctctctccgaggcgcaagcgccgcggaaggaaaagtgcaaataatacccccgagaatagccctaacttccccaatttcagagtcatagcgaccaaatcatctgagcaatccagaagtgtgaacatcgcctccaagctgagtctgcaggagagcgaaagcaagagacgttgtcgcaagcgacagagcccagagccctctcccgtgacactgggacgacgcagttctggccgtcagggcggcgttcacgagttgtcagcattcgagcaactggttgtggagctggtgagacatgacgactcttggccatttctcaaactcgtgtcgaagattcaggtgcccgactactatgatattatcaagaaaccgatagcattgaatatcattcgggagaaggtgaacaaatgcgaatacaaattggcgtccgaatttatcgatgatattgagctgatgttttccaattgcttcgagtacaatccaaggaacacttccgaagcgaaggccggaactaggcttcaagccttcttccacattcaggcccagaagctaggcctgcatgtcactccatccaatgtggaccaagtgagcacaccccccgccgccaagaaaagtagaatatag

SEQ ID NO: 109975 - DNA, 4671 bp, Artificial Sequence
  Description of Artificial Sequence: Synthetic coding sequence
atgcctctattgcataggaaaccctttgtgcggcagaaaccccctgcagatttgcgtcctgacgaggaggtattctactgtaaagtgacaaacgagattttccgtcattacgatgattttttcgagaggaccatcctgtgcaatagcctcgtctggtcctgcgccgtgaccggtaggccaggcctcacgtaccaggaggcattggagagcgagaaaaaggcaagacagaacttgcagtctttccctgaacccctcatcatccccgtgctatatctgacgtctctgacccatcgctcgcgcctccacgagatctgcgacgatatcttcgcctacgtgaaagaccggtatttcgtggaggagacagttgaggtcattcggaataacggcgctcgcctccagtgcaggatcctcgaagtgctgccaccctctcaccagaatggcttcgcgaacggtcacgttaactctgtcgacggggaaactattatcatctcagacagcgacgatagtgagacccaaagctgctccttccagaatgggaagaaaaaggacgccattgaccctcttctcttcaaatacaaggtgcagccaacaaaaaaagagctgcacgaatccgcgatcgtcaaagccacccaaatcagtagaagaaagcacctgttctcccgggataaattgaaactgttcctcaagcagcattgcgagcctcaggatggagtaataaagattaaggcatcgtcactctctacctacaaaattgccgaacaggacttcagttactttttccccgacgacccaccaacttttatcttttccccagcgaacagacgtcggggcagaccccccaaacgcattcatattagtcaggaggacaatgtggccaataagcaaaccctagcgtcctataggagtaaggccacaaaggaaagagacaagcttcttaaacaagaagagatgaagtccctagcttttgagaaggcaaagctgaagagagagaaagccgatgcattggaggctaagaagaaagagaaagaggacaaagagaagaagagggaagagctaaaaaagattgtagaggaagaaagactgaaaaaaaaagaggaaaaggagcgcctcaaggtggaacgagaaaaagagcgtgagaagcttagggaggagaagaggaaatacgtggaatatctaaagcagtggagcaagccacgtgaggacatggaatgcgatgatcttaaggagttgcctgagcccaccccggttaagaccaggttgcccccggagatttttggtgacgcgcttatggtccttgaattcttgaatgcctttggcgagctgtttgatctgcaggacgaatttcctgatggggtgacactcgaggtccttgaggaagccctagtggggaacgactctgaaggccccttgtgtgagctcctgttcttcttcctgactgccatcttccaggctatcgccgaggaggaggaggaagtggctaaagagcagctgaccgatgcggataccaaggacttaacggaggctctggacgaggacgcagaccctaccaagtcggccctgtctgcagtggctagcctagccgccgcttggcctcaactgcatcagggatgttcacttaagagtctggacctcgatagctgcacactgtctgagattctccggctgcatatcctcgcatcaggcgccgacgtgacaagtgccaacgcaaaatacaggtaccaaaaaagaggagggttcgacgcaaccgacgatgcttgtatggaactccgcctttctaacccctcactggtgaaaaaactttcctcaaccagcgtttatgatttgaccccgggcgaaaagatgaaaatcctgcatgccctttgcggcaagcttcttacactcgttagcacaagggactttatcgaagattatgtagacattctgcgccaagcgaagcaggagtttcgcgagctgaaggccgagcaacaccgcaaagaaagggaggaggctgctgctcgcattcggaagcggaaggaagaaaaactgaaagagcaggagcaaaaaatgaaggagaagcaggagaaactgaaagaagacgagcagaggaacagcactgctgacatctctataggagaggaagagagggaggatttcgacacttccatcgagagtaaggatactgaacagaaggagctggaccaggatatggtaaccgaggatgaagatgatcctggatcccacaaaaggggcaggaggggaaagagggggcaaaatgggttcaaagagttcacccggcaggaacagatcaactgtgtcaccagggagcctctgaccgccgatgaagaagaggcactaaaacaggagcaccaacgcaaagaaaaggagttactggaaaagatccagagtgccatcgcttgcaccaatatttttcctttaggccgagacaggatgtatcgacgttattggatattccctagcatccccgggctttttattgaagaggactattcaggtctcactgaagacatgctgcttccccggccatcttcgtttcagaataacgtgcaaagccaggacccccaggtgtcaaccaaaactggagaaccgctgatgagcgaaagtacttccaatatcgaccaaggccctcgcgaccactcagtgcagcttccaaagcccgtccacaagcccaaccgttggtgcttctacagcagttgcgagcagttagatcagttgatcgaggccctgaattcccgtggacaccgggagtctgccctcaaagagacattgctgcaggagaaatcgaggatttgtgcccagctggctagatttagcgaggagaagttccactttagtgacaaacctcaaccggattccaagcctacctacagcagaggcaggtcaagcaacgcatatgatccaagccagatgtgtgctgaaaagcagttggagctgcggttgcgggatttcctgctcgacattgaagatagaatttaccagggaacacttggagctatcaaagtcactgatcgccacatctggcgttcagctctagagagcgggagatacgagttgcttagcgaggagaataaagaaaatggcatcataaagactgttaacgaggacgtggaggaaatggaaatagacgaacagactaaagtcatcgtgaaggatcgcctgctgggtataaagaccgagacaccctcaacagtgagcaccaacgccagcactcctcagtcggtctcctcagtcgtgcattatctggctatggccctatttcaaatcgagcagggcatcgagagacggttcttaaaagcacccctagatgcttccgactcggggcgatcctacaagaccgtgctggatcggtggcgagaatcactgctgtccagtgccagtctgtcacaggtattcctgcacctgagtactctcgaccggtctgtaatttggagcaaaagcattctcaatgccagatgtaagatctgtagaaagaagggtgacgctgaaaacatggtcctctgtgacggttgtgatcgggggcatcatacttattgcgtgcgtcccaagctcaagacagttcccgagggcgactggttctgccccgaatgcagaccaaaacagaggagccgcagactgagctctcgacaaaggccgtccctggagagtgacgaggatgtcgaggattctatgggaggcgaggacgatgaagtggatggggatgaagaggagggccaatccgaggaggaggagtacgaagtggagcaggacgaagacgacagccaggaagaggaggaagtctctcttcctaaaagaggaaggcctcaagtccgactgccggttaaaacccggggcaaactgtctagctccttttcctcaaggggccagcaacaagagccaggccgatatcctagcagatcccagcagtcgacccccaaaaccacagtcagctctaaaactggtcgcagcctgcgcaaaatcaacagcgcacctccaaccgaaaccaagtcactgcgaatcgctagtcgaagtacccgccatagtcacggtccgctgcaggcggatgtgttcgtagagctgctgagcccaagacggaagcgcagggggagaaaatccgccaataatacccccgaaaattctcccaatttccccaacttcagggttattgccacgaaatcttccgaacagtcccggtcggttaacatcgcctcaaagctttcccttcaggagagcgagagcaagcggcggtgtcggaagcgccagagccccgagccttcacccgttacattgggtcgccgttcctctggaagacaaggaggcgtgcatgaactctccgcttttgagcaactcgtggtggagctggtccgtcacgacgactcatggcctttcctgaagctggtgtccaagatccaggtgcccgattattatgatattattaagaaaccaatagccctgaacatcattagggagaaagtgaataaatgtgagtacaaactggctagtgagtttattgatgacatcgagctcatgttctctaactgtttcgaatataacccccgaaacacaagcgaagccaaagctggtacacggcttcaggccttttttcatatacaagcccagaagctcggccttcacgtaacccctagtaacgttgatcaggtttcaacgccccccgctgcaaaaaagtccagaatctag

SEQ ID NO: 109976 - DNA, 3702 bp, Artificial Sequence
  Description of Artificial Sequence: Synthetic coding sequence
atgaaaagcttggcatttgaaaaagcaaagcttaagcgcgagaaagctgacgctctcgaggcaaaaaagaaagagaaagaggacaaagaaaagaaaagagaagagctgaagaagatagttgaagaagaaagactcaaaaagaaagaagagaaagaaaggcttaaggttgagagggaaaaagaacgtgagaagctgcgagaagagaaacgtaagtacgttgagtacctcaaacagtggagcaagcccagagaggatatggaatgtgacgatctaaaggagctgcccgaacccacaccagtgaagaccaggctgccacctgagattttcggcgatgctctaatggtgctggaatttctgaacgcctttggtgagctctttgatctgcaggacgagtttcctgatggagtgacccttgaggttctggaggaggccctggtgggcaacgattctgaaggccccctgtgcgagctcctgtttttctttctgaccgcgatattccaagccatagcagaagaggaagaggaggtggctaaggagcaactcactgatgcagataccaaaggatgttccctgaagagcctggatctcgattcgtgtacgttatcagagatacttagactccacatcctggcgtccggtgctgatgtcacgagtgctaacgctaaatatagataccagaaacgcggcggcttcgacgcaaccgatgacgcctgtatggagctaaggctgagtaacccaagtttggtgaaaaagctgagttctacatctgtttacgacctgacccccggagaaaaaatgaagattctccacgctctatgtgggaaactgctcaccctggtgtcaactcgtgactttatcgaagattacgtcgacattcttaggcaggcgaaacaggagttcagggagctgaaagcggagcagcatcgtaaggaacgggaggaggccgccgccaggatccggaaacgcaaggaggaaaagctgaaggagcaagaacaaaagatgaaagagaagcaggagaaattgaaggaggacgagcagaggaatagtaccgctgatatcagtatcggtgaggaagaacgtgaagatttcgacaccagtattgagtccaaggacactgaacaaaaagagcttgaccaggatatggtaaccgaagatgaagacgatcccggtagccataaacgcggccgtagaggcaaacgcggtcaaaatgggtttaaagagttcaccagacaagaacaaataaattgtgttacaagagagccacttaccgctgacgaggaggaggccctgaagcaggaacaccagagaaaggaaaaggagcttctagagaagattcagtctgctatcgcctgtacgaatatatttcccctcggtagggacaggatgtaccgacgttactggatcttcccttcaatcccggggctgttcatcgaagaggattactcaggactgaccgaggatatgcttctaccgcgccccagcagctttcagaataacgttcaatcccaggatcctcaggtgagcacaaagaccggggagcctctgatgtctgaatccaccagcaacattgatcagggcccgagagaccacagtgtccagctgccaaagcctgttcacaagccaaatcggtggtgcttttatagctcctgcgagcagctggaccagctgattgaggctcttaactccaggggccaccgggagtcagccctaaaagagactctgctccaggagaaatctcgcatttgcgctcaactagctaggttctcagaggaaaagttccacttctccgataagcctcagcctgatagtaaacctacctatagccgaggaaggtcgagtaacgcctacgatccttctcagatgtgcgctgagaagcaactcgaactgcggctgagggacttcctgctcgacattgaagataggatctaccagggcacactgggcgccatcaaagttaccgacaggcatatctggcggagcgccctcgaatccggcaggtacgaactactaagtgaagaaaacaaggaaaatggtatcatcaagacagtgaacgaagatgtcgaggaaatggaaatagacgaacaaacaaaggtgatcgtcaaagacaggttgctgggcattaagactgaaacaccatccacagttagcaccaatgcctccaccccccagtcagtgagctcagtcgttcattatcttgctatggccttgtttcagattgagcagggaatagagaggagattcctcaaagcccccctagacgccagtgatagcgggagaagctataagaccgtgttggataggtggcgtgaaagccttttaagctctgctagcttgagccaggtttttctacacctgtccacactcgaccgttcagttatatggagtaagtcaattcttaacgctcgctgtaaaatctgcaggaagaagggagatgctgaaaacatggtcctgtgcgacgggtgtgacagaggccatcatacttactgcgtgaggcctaaattgaagacagtgcctgaaggtgattggttttgcccggagtgccgtcctaaacagcggagccggcggctgagttcccgacagaggccttctcttgagtccgacgaggatgtggaggattctatggggggtgaagacgacgaagtagacggcgacgaggaagagggtcaatcagaggaggaggagtatgaggtggagcaggacgaagatgactcccaggaggaagaagaagtgagcctgcctaaacgcggccgtccacaggtgaggttgcctgtgaagaccagaggcaagttaagttcctccttttcatccagaggccagcagcaggagcccggccgctatccttcccgctctcagcagtctactccaaagacaacagtatcttcgaaaacaggacgctcactgcgtaagatcaatagcgctcctccaactgagaccaagtcgttgagaatcgcgagccgaagcacacgccattcccacggacccttgcaggctgatgttttcgtggaactgctgagccctcggcgtaaaaggcggggccgcaagagcgcgaataacacaccagaaaacagcccaaacttcccaaactttcgggttatcgccactaaatcttcagagcaaagtaggtctgtgaatatcgcttcaaagctcagcctccaggaatccgagagcaagcggcggtgcagaaagcgacagagccctgaaccgtcacccgtcacgttgggaaggaggtcctctggcaggcaagggggtgtccatgaactctccgcgtttgagcagctcgtcgtggaactagttaggcacgacgatagctggcctttcctgaagctggtcagcaagattcaagttcccgattactatgatatcataaagaaaccaatcgctcttaacatcatccgggagaaggttaataagtgcgaatataaacttgcgtcagagttcatagatgacatcgagctcatgttctccaactgcttcgagtataacccgcgaaacacgtcagaggctaaggccggcacccggctgcaggccttttttattttccggttaaagtctctggactccacatcacaccctgttatgtggactaaattagctcatcatagattgcgcaaatcgcacgaatccgattttgtgctgttgaaggacatctttgaggagaagcagatcgtccacgagaatgggacgttgaaccacgctgtctag

SEQ ID NO: 109977 - DNA, 4452 bp, Artificial Sequence
  Description of Artificial Sequence: Synthetic coding sequence
atggctccactgcttgggagaaaaccgttcccccttgtgaaacccctcccaggcgaggaaccactctttaccatccctcacacccaggaagcatttagaaccagagaggaatacgaagcacggctcgaacgttacagtgagagaatctggacctgtaaatcaaccgggtcatcccagcttacgcataaagaagcatgggaggaagaacaggaggtggctgagctcctgaaggaggaatttccagcttggtatgagaagctcgttctcgagatggtgcatcataacacagctagccttgagaaacttgtggataccgcgtggctggaaatcatgacgaagtatgctgtgggagaggaatgcgactttgaagtgggcaaagaaaaaatgttgaaggtaaagattgtgaagatccatcccctggagaaggtggatgaagaggccaccgaaaaaaaatccgatggggcttgtgattccccaagcagtgacaaggagaattcatctcagatagctcaggaccaccaaaagaaagaaaccgtcgttaaggaggacgagggacggcgtgaaagtatcaacgatcgggctaggaggagcccacgaaagctgccgacctccctgaagaagggtgagcgcaagtgggctcctccaaaatttctccctcataagtacgacgtgaaactgcagaatgaggataaaattatttctaatgtgcccgccgattctcttattcggaccgagcgcccccctaacaaagagatcgtacggtattttataagacacaacgccctcagggcaggcactggcgaaaacgccccttgggtggtcgaagacgagctagtaaagaaatattccctgccttccaaattttccgatttcctcctcgatccttataaatatatgaccctgaatccctccactaagagaaaaaatactggttccccggatagaaaaccatccaagaagagtaagacagataattcttccctttcatctcccctgaatcccaaactgtggtgccacgtccacctaaagaagtccctctctggctcgccacttaaggtgaagaactcaaaaaactccaagagtccagaggagcacctagaggaaatgatgaaaatgatgtcgcctaataaactgcacacgaacttccatatccctaagaagggacctccagcgaaaaagccaggtaaacactcagacaagcctttaaaagccaaagggaggtccaagggaatcctcaacgggcagaaatccaccggaaactccaagagtcctaaaaaaggcctaaagacacctaaaaccaagatgaaacaaatgacactgttagatatggcgaaggggacacagaagatgaccagagctcctaggaactcaggcggaacccctaggactagcagcaagccccataaacacctgcctccagcagccctccatctgatcgcgtattataaggagaacaaagaccgcgaagacaaacgttctgctttgtcttgcgtgatcagcaagaccgcgagactcctgtcaagtgaggatagggctcgattgcctgaagaactcaggtcccttgtgcaaaaacgctatgaactgctcgaacataagaagcggtgggccagcatgtccgaggaacagagaaaagagtacctgaagaagaaacgcgaggagctcaagaagaaattaaaagagaaagcaaaagaacggcgtgaaaaagagatgctagaacgactcgaaaagcagaaaaggtacgaggaccaagagctgacgggcaagaatctgcctgcattcagactcgttgatacccctgagggccttccaaacaccctgtttggggatgtggctatggtggtggagttcttgagttgctactctgggctactgctaccagatgcccaatacccaatcaccgctgtgagtctgatggaggccctgtcggccgacaagggagggttcctgtacctgaacagagtactcgttatcctactccagaccctactgcaagacgagatcgccgaggattatggcgaattaggaatgaagctcagcgaaatccccttgacgttgcactccgtgtctgaattggtaagactctgcctccgccgtagcgatgtccaggaggagtcagagggaagtgacacagatgacaacaaggatagtgcggccttcgaggataatgaggttcaggatgaatttcttgagaaactggaaacttcggaattcttcgaactaacctctgaggaaaaactccagatcctcaccgccttgtgtcacagaattctcatgacttattctgttcaggatcatatggaaaccaggcagcaaatgtctgccgagttatggaaagaacgcttggcagtattgaaagaagaaaatgacaagaaaagggctgagaaacagaagagaaaggaaatggaagcaaaaaataaggaaaacggtaaggtagagaatggcctcggcaaaacagatcgcaaaaaagaaatagttaagttcgaacctcaggtggatactgaggccgaagacatgatcagcgcagtgaaatctcgtaggctgcttgctattcaggctaaaaaagagcgggaaatccaggagcgagagatgaaagtaaaactagaacgccaggccgaggaagaacggatcagaaaacacaaagccgcagccgagaaagcatttcaggagggaatcgccaaagcaaaactcgtcatgcgaaggacacccattggtacagaccggaaccacaaccgttactggctgttcagtgatgaagtgcctggacttttcattgaaaagggttgggtccacgatagtatcgactacagattcaaccaccattgtaaggatcatacagttagcggcgatgaagactactgtccacggtccaaaaaagccaacctgggcaagaacgcttcaatgaatacacagcacggaaccgctacagaggtcgctgtggagaccaccacccccaaacagggacagaacctgtggtttctctgcgactctcagaaggagttagacgagctccttaactgtttgcatccacagggaatcagggaatcccagcttaaggagagactggagaaacggtaccaggacatcatccactccattcatctggcccgcaaacctaacctcggtttgaaatcatgcgacggcaaccaggagctcctgaatttcctgcgcagtgatctgatcgaagtcgctacacgcctgcagaaagggggtctcggttacgtggaagagacaagcgaattcgaggctagagtgatttcccttgagaaattgaaggacttcggagagtgcgtcattgctctgcaggcctctgtgattaagaaattcctgcagggatttatggcgcctaagcaaaaacgaagaaagctccaaagtgaggattccgccaaaactgaggaggtggacgaagagaagaaaatggtcgaggaggccaaggtcgcctctgcccttgagaaatggaaaactgcgatcagagaggcacagacatttagccgcatgcatgtcttattgggaatgctggatgcttgcatcaaatgggatatgtctgctgagaacgccagatgtaaggtatgtcgtaaaaaaggtgaagacgacaagctaattttatgtgatgagtgcaacaaggccttccacctgttctgtcttcgccctgccttatatgaagtgcctgacggcgaatggcagtgccctgcatgccagccagctaccgcccggcgcaattcccgcgggcgaaattacaccgaggaaagcgcatccgaagatagtgaggatgacgaaagcgacgaagaggaagaggaagaggaggaggaagaggaggaagaggactatgaggtggcaggcttgcgtcttcgacctcggaaaaccattcgggggaaacacagcgtgattccgccagcggcccgctctgggcgccggcccggaaaaaagcctcactcgacccgcagatcgcaacctaaggccccccccgtggatgacgccgaggtggatgaactggtgttacaaactaaacgctcgtcccggcgacagtcgttggaacttcagaaatgtgaggaaatcctacataagatcgtgaaatatagatttagctggccattcagagagccagtgacacgggacgaggctgaagactactatgacgttatcacacacccaatggacttccagacagtccagaacaaatgtagttgcggtagttaccgcagtgtccaagaattcctcacagacatgaagcaggttttcacgaatgcggaggtctacaactgccgaggttcccacgttcttagttgtatggtgaagacagaacaatgcctcgttgccttgctgcacaagcatcttccaggccatccctacgtacgccgcaagcgaaaaaaatttccagaccggctggcagaggatgaaggcgactcagagccagaggccgtcggacagagccgcggccgcagacagaagaagtag

SEQ ID NO: 109978 - DNA, 4452 bp, Artificial Sequence
  Description of Artificial Sequence: Synthetic coding sequence
atggccccgctcttaggtcgcaagcccttccctttggtgaagcccctcccgggtgaagagccactcttcaccatcccgcacacacaggaagctttcaggaccagggaggagtacgaagctcggctggagcgttattcagagcgcatttggacctgcaaatcaactggtagctcacagctgacccacaaggaggcctgggaagaagagcaggaagtggccgagctgctcaaagaggaatttcccgcctggtacgaaaagctcgttctggagatggtgcaccacaataccgcctctctcgaaaaactggtcgacactgcttggctggagataatgaccaagtacgcagtgggggaggaatgcgacttcgaggtgggcaaggaaaagatgctcaaggtgaagattgtgaagatccacccactggagaaggtggatgaagaggctaccgaaaagaaaagtgacggggcctgcgactcaccgtcttctgacaaggaaaattcctctcaaatcgcccaggatcaccaaaagaaagagacagtggttaaggaagacgaaggtcggcgagaaagcatcaacgatagggctaggcgcagccctcggaagcttccaacatcactgaaaaagggcgaaagaaaatgggccccccctaaatttctgcctcacaaatatgacgttaaactgcaaaatgaagacaaaatcatcagtaacgtgccggctgattccttgatacgcacggagcgaccgccgaataaggagatcgtgcggtactttatacgccacaacgccctgagggcaggcactggagagaacgcaccgtgggttgtggaggatgaactggtcaagaaatactctttgcccagcaagtttagtgatttcttgctggatccttacaagtatatgacattgaacccctcgactaagaggaagaatacaggcagccccgatcgaaaacctagcaagaagtctaagaccgataattcctccctttcttctcccttgaaccccaagttgtggtgtcatgtgcacctcaagaaatctctatccgggagccctttgaaagtgaaaaatagcaagaatagcaagtcaccagaagagcacctggaggagatgatgaagatgatgtccccaaacaaactgcacacaaactttcacatccctaaaaaagggccgcccgctaaaaagccagggaaacattctgacaaaccgttaaaagccaaaggacgcagcaagggcatccttaacggacaaaagtctaccggcaactctaaaagtcctaaaaaagggttgaaaacccctaagaccaagatgaaacagatgaccctgctggacatggcgaaaggcacacagaagatgactagagcccctagaaattctggagggacccctcgcacttcatcaaagccgcacaagcacttacctcccgcagctcttcacttgatcgcctactacaaagagaacaaggatagggaagacaaacggtccgccctatcttgcgtgatcagcaagacagcaagactcctttcttccgaggatcgggcccggctacccgaagaactgcgcagtctggtgcagaaacgctatgaactgctagagcacaaaaagcggtgggctagtatgtcagaggaacagagaaaggagtatcttaagaaaaaacgggaagagcttaagaaaaagctaaaggagaaagccaaggaacgaagagaaaaagaaatgctggaaagacttgaaaagcagaagagatatgaagatcaagagctcaccggcaagaatctgcccgctttcagactagtggacacccctgagggactccccaataccctcttcggcgacgtcgctatggtcgttgagttcttgtcatgttattctggcctgctcctgccggacgcccagtacccgataacagctgtgtccctgatggaggccttatcagccgataagggaggttttttgtatctgaacagggtgctagttatactgcttcagaccctgctgcaagatgaaattgcagaagattacggggaacttggcatgaaattgtcggaaatccctctgactctgcattctgtttctgaactggtgcgattgtgcctgcgcagaagtgatgtacaagaagaatccgagggaagcgacaccgatgacaacaaggacagcgccgcgtttgaggacaatgaggtacaagatgagtttttagagaagctggaaacttctgagttctttgagttaacgtcagaagagaaactacagattctgaccgcgctttgccatcgaatcctgatgacctactcagttcaagaccatatggagacaaggcaacagatgtctgctgagctgtggaaggaacggctggccgtcctgaaggaggaaaatgacaaaaagagggccgagaagcagaagcggaaggagatggaagctaagaataaagagaacggtaaggtggagaacgggttggggaagacagatcggaaaaaggagatcgtgaagtttgaaccacaggtggacactgaagccgaagacatgatcagcgccgtgaaatccaggcgcctgctcgcgattcaggccaagaaggagcgggaaatccaagaacgggaaatgaaagtaaagttggaacgtcaagccgaagaggagcggatccgcaagcataaggccgccgccgagaaagccttccaggaaggtattgccaaggctaagctcgttatgcgtaggacccccatcggcacagaccgtaaccacaaccgatattggctcttttcagacgaagtaccaggtctgtttatcgagaagggctgggtccatgacagcatcgactatcgcttcaaccaccattgtaaggatcacacagtttctggcgacgaagactattgcccgcgttcaaagaaagccaacctcgggaagaacgccagtatgaatacacagcatggaaccgccaccgaagtcgctgtggagactacaacccccaaacagggccaaaacctctggttcctgtgtgatagtcaaaaggagttagatgagctcctgaactgccttcaccctcaggggatccgtgagagccagcttaaggagcggcttgagaagcgttaccaagatatcattcactccatacatctggcgagaaagcccaacctcggcctaaagtcatgcgacggaaatcaggagctcttaaactttctcaggtcagacttaatcgaggtggcgaccaggctgcagaaaggcgggcttggatatgtagaggagacgagcgagtttgaagcgcgggttatttcgttagagaagctcaaagacttcggagagtgtgtgatcgctctccaggcctcagtaataaagaagttcttgcaggggtttatggcccctaaacagaaacgcaggaagctacaaagcgaggatagcgcaaagacggaagaagtcgacgaggaaaagaagatggtggaggaagccaaggtcgcgtctgccctggagaagtggaagaccgcaattcgggaggcacagaccttttcccgaatgcacgtactgctgggaatgctcgacgcgtgcatcaagtgggacatgtccgctgagaatgcaagatgtaaagtatgtagaaaaaagggagaagacgacaaacttatcctgtgtgatgagtgtaataaggcgtttcatctcttctgcctgcgccccgcgctatatgaggtgccagatggagaatggcaatgccccgcgtgccagccagccaccgccaggcgcaattctcgcggccgcaactatacagaagagtctgccagcgaagacagtgaggacgacgagtccgatgaagaggaggaggaagaggaggaagaagaggaggaggaagattatgaggttgcggggctgaggctgaggcccaggaagacaattcgcggtaaacactccgtgattcctcccgctgcccggagcggcagaaggccagggaaaaagcctcattcaaccaggcgatcccagccaaaggccccccccgtggatgacgccgaagtggatgagcttgtgcttcagaccaaaaggagctctcgccggcagagtttggagctccagaagtgcgaggaaatcttgcacaaaatcgtgaaatataggttttcttggccttttagggaaccagtcacgagggacgaggctgaagattactacgacgtcataacgcaccccatggattttcaaactgtgcaaaataagtgttcttgcggaagttacaggtcagtccaggagtttcttactgacatgaagcaggtttttaccaatgctgaggtgtacaactgcagggggagtcacgtcctctcttgcatggttaaaaccgagcagtgcctcgttgctctcctccacaaacaccttccaggtcacccatacgtgagaaggaagaggaagaagtttccagatagactggccgaggacgaaggggactccgagcctgaggctgtggggcagtccagggggaggagacaaaagaagtag

SEQ ID NO: 109979 - DNA, 5622 bp, Artificial Sequence
  Description of Artificial Sequence: Synthetic coding sequence
atggaagccaatgaccactttaactttacgggactgcctcccgctcccgcagcctctggtctcaaaccatcgccttccagtggtgagggcttgtacacaaacggcagccctatgaactttccccagcagggaaagagtctgaacggtgacgtcaacgtaaacgggctgagcacagtgtcgcatacaactacttccggcattctgaacagtgcccctcattcctcctctaccagtcacttacatcatccctccgttgcctacgactgtctctggaactactctcagtatcccagcgcaaatcccgggagcaatctcaaagaccctcccctgctgtctcaattttccggcgggcagtatcccctcaacggaatccttggaggtagccgccagccatcatcaccctctcacaacacgaatttgagagcaggaagccaggagttttgggcaaacggcacccagagtcctatgggcttaaacttcgattcacaggaactatacgattctttcccagaccaaaactttgaggaggtcggctctggtattcaccctgatgaagccgcggaaaaggagatgacatctgtcgtggccgagaatggcaccggtctcgttggatccctggaactggaggaagagcagcctgagctgaagatgtgcggctataacgggtctgtacctagcgtggagtcacttcaccaagaagtgagcgttctcgtgccagatcctactgtgtcctgcctggatgatccctctcacctgccagaccagcttgaagacaccccaatcttgagtgaagattctctcgagccttttaattcactcgcacctgaacctgttagcggcggactctacgggattgatgatacagagcttatgggcgctgaggacaagctgcccttggaagatagccctgtgatcagtgccttagactgccccagcctgaacaacgctactgccttcagccttcttgccgatgactctcagacgtccacctcaatctttgcctcccctacgagtccaccggtgctgggagaatctgtactccaggataacagcttcgacctcaataacgggagcgacgctgaacaggaagagatggagactcaatccagtgattttccaccttcgctgacacagcccgcccctgatcagtccagtacaattcaactgcatcccgccacctctcccgcagtcagccccactacttcgccagccgtatcgctggtggtaagccctgctgccagccccgaaatcagtccagaagtttgtcctgctgcctctaccgttgtatctcctgctgtattttccgtagtgagccccgcatcgtccgctgtgctgcccgccgtgagtctagaggtcccccttacggcaagcgtcaccagcccgaaggcctcaccagtgacatccccagcagccgcattccctaccgcgtcccccgcgaataaggacgtgagctctttcctggaaactaccgccgatgtagaggagataacaggggaaggcctgactgcttctggctcgggagatgtgatgaggagacggatagctacccccgaggaggtcaggctcccactgcagcacggatggagaagagaggtgcgaatcaaaaaggggtctcaccgctggcagggagagacctggtactatggaccatgcggcaagaggatgaagcaattcccggaagttataaaatacctgtctcgcaatgtcgtgcacagtgtgcgccgcgagcattttagcttcagccctcggatgcctgtcggagatttctttgaggagcgcgacacgccagagggtttacagtgggtacagctgagtgctgaagagatcccctcccggatccaggccataaccggcaaaaggggcagacctcgaaacacagagaaagctaagacaaaggaagtccctaaggttaaacgagggaggggtagaccgccaaaggtcaagatcaccgaactgctaaataaaaccgataacaggccactcaagaaactggaagcgcaggagactctgaatgaagaggacaaagccaaaatcgcaaagtctaaaaaaaaaatgaggcaaaaagtccagagaggagaatgccagaccactattcagggacaggcccgcaacaagagaaagcaggaaacaaagtctttgaagcaaaaagaggccaaaaagaagtcaaaggcagaaaaggagaaaggaaaaacaaaacaagagaagctgaaagagaaggtgaaacgtgagaagaaggaaaaggttaagatgaaggagaaggaggaggtgaccaaggcaaagcccgcttgtaaggcagataagacccttgcaacccagcgccggctggaagagcgccagagacagcagatgattctcgaagagatgaaaaagcccacagaggacatgtgcctcaccgaccaccagcctttaccggatttctccagggttcccggtctgacattgccatccggggcctttagtgactgtctgaccattgtcgagtttctgcacagctttggaaaagttctcgggtttgacccagccaaggatgtgcctagcttaggcgtgctgcaggaagggctactttgtcagggggatagtctgggcgaagtacaagaccttcttgtgcgcttgctgaaggccgcacttcacgaccctggattccccagttactgtcagtcccttaaaatcttgggagagaaggtgtccgagatccctctgacacgggataacgtgagtgagatactccgttgtttcctaatggcttatggagtcgaaccagctctgtgcgaccggttgcgcactcagccttttcaggcccaaccacctcagcagaaagccgctgtgctggcgtttctcgttcatgagttgaacggttcaaccctgatcatcaacgagattgacaagaccctcgaaagtatgagcagttaccggaaaaacaagtggatcgtggagggccgactcagacggctgaagacagtcttggccaaacgaactgggaggagcgaagtcgagatggaagggcctgaagaatgcctggggcggcgcaggtcttctcgaatcatggaggaaaccagcggcatggaagaagaggaggaggaggaatccatcgcagctgttcccggaagaaggggacgacgtgacggagaagtggatgctaccgcatcaagcatccctgaacttgaacgtcagatagagaagctgagtaaaaggcagctcttttttcgaaaaaaactgctgcacagctctcaaatgttacgggccgtttcactgggacaggaccgttatagaagacgctattgggtgcttccttatctggcaggaatatttgtagaaggaacagaaggcaacttagtcccagaagaggtgatcaaaaaggaaacagacagtctgaaagtggccgcccacgcttccttaaaccccgccctctttagcatgaagatggaactggccggctctaataccaccgcctcatctcccgcccgtgcaagaggcaggcctcgaaagacgaaaccaggctccatgcagccccgtcacttaaaatctccagtgcggggccaggacagtgagcagcctcaggctcaactacaaccagaagctcagttgcacgctccggcgcagcctcagccccaacttcagctccagttacagagtcacaagggcttcctggagcaagagggaagcccgctaagtctgggacagtctcaacacgacctgtcacaaagcgcctttttgtcatggctgtcgcagacacaatcccattcctccctcctctcctcaagtgttctgactcccgatagctcgccaggaaagctggatccagctccctctcaaccccccgaggaacccgaacccgacgaggctgagtcatccccagacccacaagccctgtggtttaatatctctgctcaaatgccctgtaacgcggcgcccacccctcctcccgcagtctccgaagaccagcccaccccatcgccccaacaactggcttcttctaagccaatgaaccgaccaagtgcagccaacccctgctccccagtgcagtttagctctacgccgttagccgggctcgcgccgaaacgaagagccggagacccaggtgagatgccacagagcccgacaggtctaggacaaccaaagcgtcggggtaggccaccaagtaagtttttcaaacagatggaacagagatacctgactcagcttacggcccagccagttcctcccgaaatgtgttcaggatggtggtggatcagagaccccgaaatgctcgacgcaatgctgaaggctctccaccctcgaggcatccgagaaaaagccctccacaagcatctgaataagcaccgagacttccttcaggaggtttgtctgcgccccagcgcagacccaatcttcgaacctagacaattgcctgccttccaggaggggatcatgagctggtcccccaaggagaagacctacgaaacagatctggcagtgctgcaatgggtggaagaactggaacagagagtgataatgtctgatttacagattcgggggtggacttgtcccagtcccgattcgacaagagaggaccttgcatattgtgaacacctatctgatagtcaggaggacattacgtggcgaggtcggggcagggaaggactcgcgccacagagaaagacgaccaaccctcttgacctcgccgttatgagacttgctgcactggaacaaaatgttgagaggcgatacctgcgggagcccttgtggcccacgcacgaagtcgtgctcgagaaagcgctgttgagcacccctaatggagcccccgaaggcaccactaccgaaattagttatgagatcaccccacgtatccgcgtttggcgacaaactttggaaagatgtaggtcggcagcccaggtatgcttatgtctggggcagctggagcgatccattgcgtgggagaagagcgtgaataaagttacctgccttgtgtgcagaaaaggggataatgacgagttcctgcttttgtgtgatggctgtgatcgcgggtgtcacatttactgccaccgcccaaaaatggaagctgttcccgagggggactggttctgtacagtgtgcttggcccagcaagttgagggtgaattcacccagaaacccgggtttcctaagagagggcaaaaaaggaaatctggctactcattgaactttagcgagggcgacgggagacggaggcgtgtgttattgaggggccgtgaaagccccgcagccggtcccaggtattcagaggaaggactgtccccgagcaagagacggcgcttgtcaatgaggaaccatcatagcgacttgaccttttgtgaaatcatactcatggagatggagtcccacgacgctgcatggcccttcctagagcccgtgaaccctaggctggtgtcgggctatcgcagaattataaagaatcccatggatttctcaacgatgagagagcgacttctaaggggcggctacacatcatccgaagaattcgcagctgatgcactgctcgtcttcgacaactgtcaaacattcaacgaagacgactctgaggtggggaaagccgggcatattatgcggagattctttgagtctcgatgggaggaattctatcagggaaagcaggccaacttatag

SEQ ID NO: 109980 - DNA, 2514 bp, Artificial Sequence
  Description of Artificial Sequence: Synthetic coding sequence
gtgcctggtagacggggcagacgagacggcgaagtggacgccacggcatctagtatccccgagctggagcgacagattgagaaattgagcaagagacagctgttcttcaggaaaaagcttttgcatagtagccaaatgctgcgtgccgtgtcgttggggcaggacaggtatcggcggaggtattgggtactgccttacttagccggtattttcgtcgaaggaactgagggtaacctggtgcccgaagaagtgattaaaaaggaaacggatagccttaaggtggccgcacacgcttcgctgaatccagcgctgtttagtatgaaaatggagctggcaggttctaacaccaccgcaagcagccccgctagggctaggggccgtccacgaaagactaaacccggcagcatgcagccaagacatttaaaatcgcctgtgagggggcaggacagcgagcagccccaagcacagctgcagcctgaagcacagctccatgcacctgcgcagcctcagccgcaactgcagctgcagctgcagtcccacaaaggcttcctggagcaagaggggtccccacttagcctgggtcagtcacagcacgatctgtcacaaagcgccttccttagttggctgagccaaacacagagccactcgtccttactgagtagctctgtgttgactcctgattcctcccccggcaaactggaccccgcgccaagtcagcctccggaggaaccagaacctgatgaagcagagtcctctcccgaccctcaagccctgtggttcaacatttctgcccagatgccttgcaatgcagcccccacccctcccccggctgtgtccgaagatcagcccaccccatcccctcagcagctcgcatctagtaaacctatgaatcggccttctgcagctaacccatgctcccccgttcagttcagctcgaccccccttgcgggactcgcacctaaaaggagagcaggagacccaggtgaaatgcctcagagtcccacaggactgggccagcccaagagaagaggcaggccaccatccaagttttttaagcagatggagcaaagatacttaactcagctaacagcccagcccgtcccccctggctggtggtggatccgcgatccggaaatgctcgacgccatgctgaaggcactacacccaagggggattcgtgagaaggcactgcacaaacacctcaataagcatcgagactttctacaggaggtctgtctgcggcctagcgccgatcctattttcgagcctcgacagcttcctgccttccaggaaggaattatgagttggagccccaaagagaagacctatgaaactgacctggcagtgttacagtgggtggaggagctggagcagagagttatcatgtccgacctgcagattagagggtggacctgcccaagcccggactcgacgcgggaggatctcgcctattgtgagcatctgtctgactcccaagaagacattacttggcgggggcggggacgcgaggggctcgcacctcagcggaaaactaccaacccactggatcttgccgtgatgcggcttgcagccttggaacaaaatgtcgagaggcgatatttgcgggaaccgctctggccaacccacgaggtggtcctggagaaggccctgctctccacaccgaacggtgcacctgaaggaaccactacagagatctcttatgagattaccccgaggattcgagtgtggcggcagacgctggaacgctgtcgctctgccgcacaggtgtgtctgtgcctggggcagctggagcggtctatagcgtgggagaagtccgtgaataaagtcacttgtctggtttgtagaaagggggataacgatgaattcctccttctgtgcgacggatgcgaccggggctgtcacatctattgccacaggcctaagatggaagccgtgcccgagggagactggttttgtaccgtttgtctagcacagcaggtcgaaggcgagtttacacagaagccaggattcccgaagcgcggacagaaaagaaagagcgggtattctctgaatttttccgagggggatggtaggaggcgccgcgtactactgcgcggccgagagtcccccgcagccgggccccgctacagcgaggagggcctgtcaccgagtaaacgtagacgactttcaatgcgcaaccatcattccgacctaacattctgtgagataattctgatggagatggagtcccacgacgccgcctggccgttccttgagccagtgaaccccaggttggtatccggatacaggcggattataaagaacccaatggatttttctacaatgcgcgagcggctgctgcgcggtggatacaccagctctgaggagttcgctgccgacgcattgctggtgtttgataactgccaaacgtttaatgaagatgattctgaggtgggtaaggctggtcacattatgagaaggttctttgagagtcggtgggaggagttttatcagggaaaacaggccaatctgtag

SEQ ID NO: 109981 - DNA, 5718 bp, Artificial Sequence
  Description of Artificial Sequence: Synthetic coding sequence
atggagatggaggctaacgatcactttaattttactggactcccgccagctccagccgcgagtggcctgaaaccttctcccagcagtggagaaggactgtacacaaacggatcaccgatgaattttccacagcagggaaaaagcctaaatggggatgtgaacgtgaacggcttatctactgtaagccatacgacaacctctggaatcctcaatagtgcaccacactcctccagcacaagccacctccatcacccctctgtagcctatgactgcctttggaactacagccagtacccttctgctaatcctggttctaatctgaaagaccctccattactgagtcagtttagtgggggacagtaccctctgaacggcattctcgggggaagtcggcagccctccagtccctcccacaataccaacttgcgagccggctctcaggagttctgggcaaacggcacacagtctcccatgggcttaaacttcgactctcaagagctatatgactctttcccagatcagaatttcgaggtcatgcctaatggaccccccagcttttttacaagtccacagacatccccgatgctgggttcttccatccaaacatttgcaccctctcaagaggtcgggtccggtatccatccagacgaggctgctgagaaggaaatgacaagcgtcgtggccgagaacgggactggcctcgtagggagcctcgaactggaggaggagcagcccgagctcaagatgtgcggatataacggttctgtgcccagcgtggagagcctgcatcaggaggtcagcgtgctggtgcctgacccgactgtgagttgtctggatgacccgtcccacctgcccgatcaactcgaggacactccaatcctctccgaggacagcctggagccatttaattctctcgctccagagccagtgtccggaggtttatatggtattgatgatacagagcttatgggtgccgaagataagcttccactggaggacagccctgtgatctccgcactggattgtccgtccctgaataacgccaccgcttttagtctgcttgccgacgactctcagacctctacttcaatttttgcctcccccacttctccccccgtactaggtgaaagcgtgctgcaagataactcattcgatctcaacaatggctccgacgcggaacaagaagagatggaaactcagagttcagactttcccccatctctgacacaaccagcacccgaccagagctccacaatccagttgcatcccgccacaagtccagccgtatctccaaccacctcgcccgccgtgtcattggtcgtaagtccagcagcctctccagaaatctctccagaagtgtgcccagctgcctcaacagtggtctcaccagcagtctttagtgtggtgagcccagcttcttccgccgtcctgccagctgtgtctctggaggttcccctgacagcttccgtcaccagccccaaagcctctcctgttactagccccgcagccgcattccctactgctagtccagcaaacaaagacgtcagctctttcctcgaaactaccgccgatgtagaagaaatcacaggtgaggggttgactgccagcggaagtggcgacgtcatgagacggagaatcgccacacccgaagaggtgcgactcccccttcagcatgggtggcgccgtgaagtccgcatcaagaaaggaagccaccgctggcagggagaaacatggtattacggaccctgtgggaaaagaatgaagcagttccccgaggttatcaaatacctcagccggaacgtggtccactccgtcaggcgtgagcatttctctttcagccctcggatgccagtcggggacttttttgaagagagggatacaccggaggggctccagtgggtgcaactgagcgccgaagaaatcccatccagaattcaagccattaccggcaagagaggccggcccagaaacacggagaaagcaaagaccaaggaggtgcccaaggtcaaaagaggccgggggcggcctccgaaggttaagatcacggagctcctaaacaagacggataatcgccctctgaagaaattggaggcgcaggaaacattaaatgaagaggacaaggccaaaatcgcaaagagtaaaaagaagatgcggcaaaaagttcagcgaggagagtgccaaacgacaattcagggtcaggctcgaaataagcggaaacaggagaccaagtccctgaagcagaaagaagcaaaaaagaaatcaaaggccgaaaaagaaaagggtaagaccaaacaggagaaactcaaggagaaagttaagagagagaagaaggagaaggtaaaaatgaaggagaaagaagaggtcaccaaagccaagccagcctgtaaggccgacaagacactagcaactcagcgaagactcgaggagaggcagcgtcaacagatgatcctcgaggagatgaaaaagcctaccgaagatatgtgccttacagaccatcagccactgccggacttcagtcgggtgcccgggctcacccttcccagcggagcattcagcgattgtctgaccattgtggagtttctacactcctttggcaaggtgctgggcttcgaccctgcgaaagacgtcccgtctctcggcgtgttgcaggaaggcctgctctgccaaggcgattcgctgggggaagttcaggacttactggtccgtctgctgaaagccgctcttcatgatcccggcttcccaagctattgccaatcattaaaaatccttggagaaaaggtttcggagatacctctgacacgcgataacgtgagcgagatcctgcggtgtttcctaatggcctatggcgtcgaacccgccctgtgcgacagattgcgtacccaaccctttcaagcccagccacctcaacaaaaagctgctgtgcttgcattcttagtacacgagctgaacggaagcacactcatcatcaatgagattgacaagacgctggaaagcatgagctcctaccgcaaaaataaatggatcgtggaagggcggttgcggcggctcaaaaccgtgcttgctaaacgaaccggacggagcgaagtggagatggagggacccgaggagtgcctgggtagaaggcgcagttcgaggatcatggaggagacctctgggatggaggaagaggaagaggaggagagtattgccgcggttccagggcgaagaggccgaagggatggagaagttgacgctacagcttcctcaattcctgaactagaacggcagatcgaaaagctgtcaaagcgtcaactcttttttaggaagaagcttttgcactcatcccagatgctaagagccgtttcactcggtcaggatcggtacagacgccggtactgggtgttaccatatctcgcgggtattttcgtcgaaggcacagaggggaatctcgtgcctgaagaggttataaaaaaagaaactgatagtctgaaggtggccgcacatgcatcactaaacccagccctgttttcaatgaagatggagttagctggtagcaatactacagccagctccccagctcgggctcgcggcagaccgcggaagaccaagcctggttctatgcaacccagacacctcaaaagcccagtgcgggggcaagatagtgaacagcctcaggctcagctgcagccggaagcccagttacatgcccctgcccagccacagccacaactgcagctccagttgcagtcacacaaaggatttctggagcaagagggctctccactgtctctgggacagtcccagcatgacctgagtcagtctgctttcctgagctggctgagtcagactcagtctcattcgtcactcctctcatcaagcgttctcacacccgatagtagtcccggcaaactcgatccggcccccagccaacccccagaagagcccgagcccgatgaggctgagtcctctccagatccgcaggctctttggttcaatatcagcgctcagatgccatgcaacgctgccccaactcctccacctgccgtcagcgaggaccagccgacgcccagcccacagcagcttgcttcctccaagccaatgaacaggcctagtgccgctaacccatgctctccagtacagttttcatccacacctttggccgggctcgctcctaagaggagagctggcgacccgggagagatgccccaatctcctacgggattgggccagccaaaacgcaggggacggcccccttctaagtttttcaaacagatggagcagcgatacctcacacagctcacggcgcagcctgttccaccggaaatgtgtagtggctggtggtggatacgagatcctgagatgttggacgccatgctgaaagcccttcacccacggggaatacgagaaaaggccctgcataagcatctcaacaagcatcgagacttcttacaggaggtgtgtctacgtccctctgcggatcccatttttgagccaagacagctccccgcatttcaagagggtattatgagttggtcacccaaggaaaagacttatgagacagacttagctgttctgcagtgggtagaagaactggaacagcgcgttattatgagcgatctacagatacgcggttggacatgcccatcccccgacagcacaagggaggacctcgcatactgcgaacatctttcggactcacaggaggatattacgtggagggggcggggacgcgagggccttgctccgcagaggaaaaccacaaaccccctggatctcgccgtgatgcggctcgctgcattagaacagaacgtggaaaggcggtatttaagggaaccattgtggccgacccacgaagtagtgctagaaaaggcactgctgtcgactccaaatggggctcccgaaggaacgaccaccgaaatcagctacgaaattacaccccggataagagtttggcgccagaccctggagcggtgtcgatctgcggcccaggtatgcctctgtctgggacaactggagcgcagcattgcctgggagaaatcagttaataaagtcacttgcctcgtctgcaggaagggagataatgacgaattcctcctgctgtgcgatggctgtgataggggttgccatatctactgccatcgccctaaaatggaagccgttcctgagggtgattggttctgcacagtgtgcctggcacaacaggtcgaaggtgagttcacccagaaaccagggtttccaaagcgcggccagaagcgcaaatccggctacagtttgaattttagcgaaggcgacggaagacgtaggcgcgttcttctgcgcggcagggaaagtcccgctgccggtcctcggtactcagaggaaggactctcacccagtaaaaggagacgcttaagcatgcgcaatcaccatagcgatctaaccttctgcgagatcatcctgatggaaatggagtcacacgatgcagcctggcccttcctggagcccgtaaatcctcggttggttagcggatatcgtagaattatcaaaaacccaatggactttagcacaatgcgggagcggctcctgcgtggaggctatacgtctagcgaagaatttgccgctgacgcacttctggtttttgacaactgccagaccttcaatgaagacgatagcgaagtaggaaaagcggggcacattatgcgccgctttttcgaaagtcgctgggaggaattttaccagggtaagcaagccaacctttag

SEQ ID NO: 109982 - DNA, 6207 bp, Artificial Sequence
  Description of Artificial Sequence: Synthetic coding sequence
atggagtctggagagcggctgccttcttcagcagcttctagtaccacgcctactagcagctctactccctccgttgcatctgtagtgtcaaaggggggactgagcactggagtagcttccctgtcttccacgattaatccatgcgggcacctcttcagaactgccggcgaccagccattcaatttgtccacggttagcagcgcattccctatggtgtcccatcctgtgtttggactgcatagcgctagcagcggccactcagagtttggtggtttgggcacactgggtacacccaccgctttggcagctcatcctcaattggcctcatttccggagtggtggcggacgacggatgctcatacccgcacaggtgcaacattctttcccccactcttggggatcccacccctcttcgcgccccccgcccagaatcacgattccagctcttttcactcaaggaccagcgggaaatcaaaccgaaacggacccgagaaaggcgtgaatgggtctatcaatgggtccaacacttcaagcgtcattggcattaatacctccgtgctgagcacaacagcatcaagctctatgggccaaacaaagtccactagctcaggtggcgggaatagaaagtgtaatcaggaacagagtaaaaatcaacctctggacgctcgggttgataaaattaaggacaaaaagccccggaagaaagctatggaatcgagctctaatagcgatagtgacagcgggactagcagcgatacctcctccgagggaattagctcaagtgattccgacgacctggaggaggatgaagaggaagaggatcagagtatagaggagtccgaagatgatgactcagactcagaaagtgaggcccagcacaaaagcaacaatcaggtgctgctgcacggtatcagcgaccccaaagccgacggtcagaaagcgacagagaaagctcaggagaagagaattcatcagcctctgcctttggcctcagaaagccaaactcacagctttcagtcccagcagaaacaaccacaagtccttagtcagcagcttcccttcatattccagtcttctcaagcaaaagaggagtccgtaaataaacacacttctgttatacagtcaacaggtctggtctctaatgtcaaacccctgtccctcgtgaaccaggctaagaaggagacttacatgaagttaattgtccccagcccagacgttctgaaagccgggaataagaatacctccgaagagagttctttactcacgtcagagttaagatccaagcgcgaacagtacaagcaagcctttcctagtcaactgaaaaaacaggagtcatcaaaatccctcaagaaagtcatcgcagctctaagcaaccccaaagcaacaagctcctctcccgctcaccccaagcagaccttggaaaataatcacccaaacccattcctgacaaatgctctgctcggcaaccaccagcccaatggagttatccagtcagtgatccaggaggcacctctcgcgctaacaacaaaaaccaagatgcagtcaaagataaacgagaacatagccgcagcctctagcacacctttttccagtccagtaaatctgtccacctctggacgacggacacccggtaatcagacaccggtgatgccctcggcgtctcccatcctgcactcccaaggaaaagagaaggcagtctctaacaacgtgaaccctgtaaaaacccaacatcacagccacccggcaaagtctctggtcgagcagtttagaggcaccgactccgacatcccaagcagcaaagactccgaagattccaatgaggatgaggaagaagatgatgaggaggaggacgaggaggacgacgaagacgatgaaagcgacgatagccaatcaggaactagcaagagacgccgggtgacggacgagcgcgaactgcgtataccactggagtacgggtggcagcgggaaacacgaattcggaacttcggcggcaggctccagggagaagtagcgtactacgctccgtgcggcaaaaagttaagacagtaccccgaggtcatcaagtacctgtcccggaatggcattatggacatcagcagggacaacttctctttctccgccaaaatacgggtgggggatttctacgaagcgagagacgggccgcaaggcatgcagtggtgtcttctgaaagaggaggacgtgatccctcgcatcagggctatggaaggaagaaggggaagaccccccaaccccgatcgacagcgcgcacgggaagaatctagaatgagacgtaggaaaggacggcctcctaacgtcggaaatgccgaattccttgataatgcggatgctaagctcctgcgtaaattgcaggcacaggagatcgctagacaggcggctcagataaagctcttaagaaaactgcagaagcaggagcaagcacgcgtcgcaaaagaggcgaagaagcagcaggctatcatggctgctgaagagaagagaaaacagaaggagcagattaagattatgaaacagcaggagaagattaagcgcatccagcagatcaggatggagaaagagctccgggcccagcaaatactcgaagcaaagaagaaaaagaaggaggaggctgcaaatgccaaactcttggaggctgaaaaacggattaaggagaaagagatgcgtaggcagcaggctgtgttactcaagcatcaggaaagagaacgtcggcggcagcacatgatgctgatgaaggctatggaggctcggaaaaaggcggaagagaaagagaggctcaaacaggagaagagggatgagaaacggctgaataaagagcgcaaactggaacagcgtcggttggaactggagatggcaaaggaactgaagaagcccaatgaggatatgtgcctggccgatcagaagccactgccggagcttcctagaatccccggacttgtcctgagcggttccaccttcagcgattgtctcatggttgtgcaatttctcaggaattttgggaaagtgctggggtttgacgtaaatatcgacgtgcccaatctgtccgtgctgcaagaaggactgctgaacatcggcgattcaatgggcgaggtgcaggatctcttagtgaggctactcagtgccgccgtgtgcgaccccggcctgattactgggtacaaggctaaaacagcactcggcgagcatttgctgaacgtgggcgttaaccgggacaatgtgagcgagatcttgcagatttttatggaagcccattgtgggcagacagaacttaccgaaagccttaaaacaaaagccttccaggctcatacccctgctcagaaagcctctgtcctggcctttctaatcaacgaacttgcttgcagcaaatccgtcgtgagcgagatagacaaaaacattgattatatgtccaatttgaggagggataaatgggttgtcgaaggaaagctccgcaagctccgaatcattcatgcgaaaaaaaccggcaaacgcgacacctccgggggcatagatctgggcgaagagcagcatccgctggggacgccaacgccaggccgaaagcggcgaagaaaagggggggacagcgactacgatgatgatgatgacgatgattccgacgatcagggtgacgaagacgatgaagacgaggaagataaggaagataagaaagggaagaagacagatatctgtgaagacgaggatgaaggggatcaggctgcatcggtcgaggaacttgagaagcagattgagaagctatcaaagcagcaatctcaatacaggaggaagctgtttgacgcaagccatagccttaggtcagtgatgttcgggcaggaccgatacaggcgtagatactggattcttcctcagtgcggtggcatttttgtggaagggatggagagtggagagggtttggaagaaatagccaaggaacgcgagaaattgaagaaggctgagtccgttcagataaaggaagagatgtttgagacttcgggggactctctgaattgtagcaacacagaccattgtgagcaaaaggaggatctcaaagagaaggacaacaccaacctgtttctccagaagcctgggtcatttagcaaattatccaaactgctagaagtggccaagatgccacccgagtcagaggttatgactcccaagcctaatgccggtgctaatggctgcaccctttcctaccagaattccggaaagcacagcctgggatcagtccagtctacggccactcagagcaacgtcgagaaggccgactctaataatctattcaacacaggaagctccggtcctgggaaattctacagtccactgcctaatgaccagttgctgaagactctgactgagaagaacagacaatggttctccttacttccacgtaccccatgtgatgacacctccttgacccacgctgatatgtcaacagctagtcttgtgaccccccaatcgcagcctccctctaagtcaccatctcctactccggcccctcttgggagcagtgcccagaatccggtgggcctgaatccttttgccctctctcccctgcaggtgaagggtggagtttccatgatgggcctccagttctgcggttggccaacaggcgtggtgacctctaatatccctttcacatcgtctgtgccttcactgggttcgggcctgggcctgagcgaggggaacgggaattcgttcctcacatctaacgttgcaagctcaaagagtgaatctccagtgccccagaatgaaaaagccacctccgcacagcccgcagcagtagaagtggccaagcccgttgattttccttcgcccaaacctatccctgaagagatgcagtttggctggtggcgcatcatcgatcctgaggacctgaaagccctattgaaagttctgcatctgagagggatcagggagaaggcactgcagaaacagatccagaagcatctcgactatatcacccaggcctgcctgaaaaacaaggacgtcgctattatcgagctgaacgagaacgaagaaaaccaagtcactcgtgatattgtggagaattggtccgtggaggagcaagccatggaaatggacttatccgtccttcaacaagtagaggatcttgaaaggagggtggcttccgcctccttacaagtcaaaggatggatgtgccccgagccagcctcggaaagggaagacctggtttactttgagcacaagagtttcaccaaactttgtaaggaacacgacggagaatttacaggtgaagatgaatcctccgctcatgctctggagcgtaagagtgacaatccattagacattgcggtgacgagattagcagatctggagcggaacattgagcggcgcatcgaggaggatatcgccccgggtcttcgggtttggagaagagcactgtccgaagcgagatccgccgcgcaggtggcactttgcatccagcagctgcagaaatcaattgcttgggagaagagtataatgaaggtgtattgtcagatctgccggaagggggacaacgaggagctgctgttgctgtgcgatgggtgcgacaaaggatgtcacacatactgccatcggcccaagatcacaacgattccagatggggactggttttgccccgcctgcattgccaaagcttccgggcagactctgaaaattaagaagctgcacgttaagggtaagaagactaacgaatcaaagaaaggtaaaaaggtaacactgaccggagataccgaagacgaagattcagcgagcacatcgagcagtctcaagcgtggcaataaggatcttaaaaagagaaaaatggaggagaatacttcaatcaatttatccaaacaggagtcattcacctctgttaagaagcccaagagagatgactctaaagatttggctttatgcagtatgatactcacagagatggaaacccatgaagacgcgtggccttttctgttgccagttaaccttaagctggttcccggttacaagaaagtcatcaaaaagcccatggatttctcaactatacgtgagaagctcagtagtggacaataccccaacctggagacattcgccctggatgttagactcgtgttcgataattgtgaaacatttaatgaggatgacagcgacattggcagagccggacataatatgagaaagtattttgaaaagaaatggacagatacatttaaggtctcttag

SEQ ID NO: 109983 - DNA, 6405 bp, Artificial Sequence
  Description of Artificial Sequence: Synthetic coding sequence
atggagtctggtgagcggctgccgtcctctgctgcaagttcaacaactccaacgtcttcaagcaccccttccgtcgcttctgtggttagcaaaggagggctgagtacaggggtggctagcttgagctctacaatcaatccttgtggccacctgtttagaaccgccggcgatcagccttttaatctgagcaccgtgtctagcgctttcccaatggtgagccaccccgtgtttggtctgcattcagcaagctccgggcactccgagttcggcgggttagggaccctcggtactcctactgcccttgccgcacatcctcaactggcctcatttcctggcgccgaatggtggcggactactgatgcacatactcgcacaggggcgacatttttcccccctctgctggggatccccccgctgtttgccccacctgcgcaaaatcatgatagttcaagctttcactctaggacatctggcaagtccaacaggaatgggcctgaaaagggcgtgaacggaagcataaacggttctaatactagtagtgtcattggaattaatactagcgtgctgagtaccacagccagcagcagtatgggacagactaagagcacaagttccggaggagggaacagaaagtgtaaccaggagcagagcaagaaccaacccttggacgcaagagttgataaaataaaagataaaaagccacgtaagaaggctatggaatcaagttccaatagcgactctgatagcggaacctcttcggacacatccagtgaagggatctctagtagtgatagcgacgatttggaggaggacgaagaggaggaagatcagtctatcgaggagagcgaggatgacgacagtgacagtgagtctgaagcacagcataagagtaataatcaggtgctgctacatggaattagcgatcccaaggccgacggacagaaggccacagagaaggcgcaggagaaacgaattcatcagcccctacctttggcaagcgagtcccagacccatagcttccagagtcaacagaaacagccccaagtcctgagccagcagttgccgttcatattccagtcaagtcaagcaaaagaggaatccgttaacaagcacacttcagtaattcagtctacaggtttagtgagtaatgttaaacccctgagcctggtgaatcaggcaaaaaaagagacctatatgaagctaatcgtacccagccccgacgtgctgaaggccggaaacaaaaacacctctgaagagtcatccctgcttacaagcgagctgaggagtaaacgggagcagtacaagcaggcctttcccagccaactgaagaaacaggagagttccaagtccctgaagaaggtcatagccgcactgtccaatcccaaagccacatcatctagtccggcccaccctaagcagaccttagagaacaatcaccctaaccctttccttacaaatgcactgctgggaaatcatcagcccaacggcgtcatccagtctgtgattcaggaagctcccctggcgctaaccactaaaacaaagatgcagagcaagataaacgagaatattgccgctgctagcagcacacccttttctagtcccgtgaatctgagcacgagcgggagaagaacaccgggaaatcaaacaccagtgatgcctagcgcgtctcccatcctgcactcccaaggaaaagagaaggccgtttccaacaacgtcaatcccgtgaaaacccagcatcatagtcatcccgcaaagtccctggttgagcagtttaggggaacagactctgacattccttcttccaaggacagtgaagacagcaacgaggacgaggaggaggacgacgaggaagaagatgaggaggacgacgaagacgacgaaagtgacgactcccagtccgagtctgattccaatagcgagtccgacaccgaggggagtgaagaagaagacgacgacgataaggaccaggacgaatctgactccgacaccgagggtgaaaagacgtcaatgaagctcaacaagaccaccagttctgtcaaatcgccttccatgagtctcactgggcattctacaccaaggaatttgcacatcgccaaggcacccggctccgcccccgccgccctctgttccgagagccagtcccctgcttttctgggcacaagttcaagtacccttacctcaagcccccactctggcacttccaaacgccgtagggtgaccgatgaaagggaactacgcataccacttgagtacggatggcagagggaaactaggatccgaaatttcggcgggaggctgcagggcgaagttgcctattacgccccctgcggcaagaaacttcgccaatatccagaggtgattaaaggaatgcaatggtgcttactgaaagaagaggatgtcatcccccgcataagggctatggagggccgaagggggaggccacctaaccctgaccggcagcgcgcacgcgaggagagcaggatgaggcgacgcaaaggcagaccccctaacgtggggaatgcagagttcctggataatgcggatgcaaagctgttaagaaagctgcaggcacaggagattgccaggcaggctgctcaaataaagctactgcggaagctgcagaaacaggaacaggcccgagtcgcaaaagaagcgaaaaaacagcaagctataatggctgcggaagagaagcgaaagcagaaggaacaaatcaagattatgaagcagcaggagaagatcaaacggattcaacagatcagaatggaaaaggagttgcgcgctcagcaaatcctggaggcaaagaagaagaaaaaagaggaggccgctaatgccaagcttctcgaggccgagaagcgtataaaggaaaaggagatgaggagacagcaggcagtcctgctcaaacaccaggagcgggaacgtaggaggcagcacatgatgttgatgaaggccatggaggccagaaagaaagccgaggagaaggagaggctcaagcaggagaagagagacgagaaacgcctaaacaaggagcggaagctcgaacaaaggcggcttgagctcgagatggctaaggagctgaagaaaccaaacgaggatatgtgcctggccgaccaaaagcccctccccgaacttccaaggatcccggggcttgttttgtctgggagcacattcagtgattgtctcatggttgtacaatttttgcgcaactttggcaaggtacttggcttcgatgtcaatattgacgtgcccaacctgagcgtcctacaggagggactactgaacatcggcgattccatgggtgaggtccaggacctcctggttagactgttaagcgcagccgtgtgcgatccaggcctgattacaggctataaagctaaaactgcactcggagagcacctgctgaacgttggagttaatcgtgataacgtgagcgaaattttgcaaatcttcatggaggcacactgcgggcagactgagctaaccgaaagtctgaagacaaaagcttttcaggcccatacccctgcccagaaggctagcgtgcttgcttttttaatcaatgagttagcctgtagtaaatccgtggtgagcgaaatagacaaaaacattgattatatgtctaatttgcgacgggacaagtgggtcgtcgaaggaaaattacggaaactgcgaataatacatgctaagaaaaccgggaaaagagacaccagcggtggaattgatctgggagaggagcagcaccccctgggcactccgactccaggacggaagagacgacggaaaggtggtgacagtgattacgacgatgacgatgacgatgactcagatgaccaaggagacgaagatgacgaggacgaggaagataaggaggacaagaagggcaagaagaccgatatttgcgaagatgaggatgaaggcgatcaagctgcatccgtagaggaactagaaaaacagatcgagaaactgtccaagcaacaaagtcaatacaggcggaaactgttcgacgcctctcacagcttgaggtcggtgatgttcggccaagatcgctaccgccgtaggtattggatcctaccccagtgtggaggcatcttcgtagagggcatggaatccggcgaaggactcgaggaaattgccaaggaaagagagaagctgaaaaaagctgagtccgtccaaatcaaggaggaaatgtttgaaacatccggagattctctgaactgctctaatactgaccactgcgagcaaaaagaggatcttaaagagaaagataacactaacctgtttcttcagaaacccggcagcttcagtaagttgtctaagctcttagaggtggccaaaatgccacctgagagtgaagtgatgactcccaagcctaatgctggagccaacggttgcaccctctcgtatcagaacagcggcaagcattcattggggagcgtacaaagcacggccacccaatccaacgtggaaaaggctgacagcaacaacttgttcaataccggatcaagcggcccaggaaagttttacagcccgctgcctaatgatcagctcttaaaaactttgactgaaaaaaaccgccagtggttctctctgctgccgcggaccccgtgcgatgatacaagcttaacacatgccgacatgagcactgcttccctggtgactccacagagccaaccaccatccaaatcccctagtcccacgcccgccccgctcggatcttccgcccagaacccagtcggcctgaacccgttcgctctgtcacccctgcaagtcaaggggggagtgtcgatgatgggcttacagttctgtggctggcccacaggagtcgtgaccagcaacatcccttttaccagtagtgtacctagtctgggatccgggctggggctcagcgagggcaacggcaactccttcctgacctcaaatgtcgccagtagcaaatctgaatcaccggtgcctcagaacgaaaaggctacatccgcgcagcctgccgcggttgaagtggccaagcctgtcgatttcccttcaccaaagcccatccccgaagagatgcagttcggatggtggcggattatcgatccggaagacctcaaggcattgttgaaagttcttcacctgcgagggatcagagagaaagccctgcaaaaacaaattcagaagcatctcgactacatcacccaagcctgcctgaaaaacaaagatgtcgccataatcgagctcaatgagaatgaggagaaccaggtcactagagatattgtggaaaactggtccgtcgaggagcaggcaatggaaatggatctaagcgtgctccagcaggtggaggatcttgaaagacgggtggcctctgcatctctgcaggtgaaaggatggatgtgccctgagccagcgtccgagcgcgaagacctagtttacttcgaacacaaatccttcaccaagttatgcaaggagcatgacggcgaattcaccggcgaggatgagagctcagctcacgcactggaacggaagagcgacaatccactcgacatcgccgtgacaagactggccgatctcgaaaggaatatagaacgtcggatcgaggaggacatcgcccctggtctgcgtgtttggaggagggccctgagcgaggcccggtctgccgctcaggtcgctctgtgtattcagcagctgcaaaaatccattgcatgggaaaaaagtataatgaaagtgtattgccagatttgtagaaagggtgataatgaagaactgctccttctgtgtgacgggtgcgataaaggctgccatacctactgtcatagaccaaaaattacgacgataccggacggagattggttctgccctgcttgtatagccaaagcctccggacaaacattgaagatcaagaagttgcacgtgaaaggtaagaagacaaacgaaagtaaaaagggaaaaaaagtcactctaactggagacacagaagacgaggattcagcgtccacttcctcctccctcaaacgcggcaataaggatttaaaaaagcgaaagatggaagagaatacctcaattaacctttcaaagcaagagtcatttacttctgttaagaagcctaagagagatgacagcaaagatttggcgctttgttcgatgattcttacagaaatggagacccacgaagatgcttggccctttctgttgccagttaatctgaaactcgtcccaggatataagaaagttatcaaaaagcccatggactttagcaccattagagaaaagctgtcaagcgggcagtacccaaacctggaaactttcgcgctcgacgttagattggtgttcgacaactgtgaaacttttaacgaggatgatagcgacataggccgggccggccacaatatgaggaaatatttcgagaagaagtggaccgatacatttaaggtctcgtag

SEQ ID NO: 109984 - DNA, 6399 bp, Artificial Sequence
  Description of Artificial Sequence: Synthetic coding sequence
atggaatcaggcgaacgtttgccttcctccgccgcgtccagtaccactcccactagcagttctactccatctgtcgctagcgtggtttcgaagggtggtctctccacaggggtggcgagtctgtctagcaccatcaacccatgcggtcatctttttcgaacagcgggggaccagccgttcaatcttagcacagtcagtagtgcatttcccatggtgtctcacccagtgttcgggctgcacagcgcctcctcaggtcactctgaattcggcggcttgggcacactcggaacccccacagccctagccgctcatcctcagttggctagctttccagaatggtggcggacgacggacgctcatacgcgcactggagctacgtttttcccacctctactcggcatcccccccctttttgccccacccgcacagaaccatgactcctcttccttccacagccgcacaagcggtaagagtaaccgcaacggtcccgagaaaggtgtgaacggctccatcaacggctccaacacctcctcagtcatcggcatcaacacctccgtgctctcaaccactgcaagtagtagtatgggtcagacaaagtctacctcttctggcggaggcaaccgtaagtgtaatcaggaacagagtaaaaaccaaccactggacgcacgggtcgacaagattaaagacaagaaacccagaaagaaagctatggagtcaagttccaacagtgattcagactcaggcacctctagcgatactagtagcgaggggatcagctcctctgattcggatgatcttgaagaggatgaggaggaggaggaccaaagtattgaagagtctgaggacgacgacagtgactctgaaagtgaagcacaacataaatctaacaaccaggtgctgctgcatggtataagtgatccaaaggccgacggacaaaaggcgacagaaaaggcccaagaaaagagaatccaccagccattacccctcgctagcgagagccaaacacatagtttccagagccagcaaaaacagccgcaggtgctcagccagcaattgccatttattttccagtcttcccaggctaaggaggagtccgtcaacaagcacaccagcgtgatccagtctacagggctggtgagcaacgtaaaacccctttccttggtaaaccaggctaagaaagagacatatatgaagctgatcgtcccctcaccagacgtcttaaaggctgggaacaagaacactagcgaggagtcgtcacttttgacctctgagctcaggagtaaaagagagcagtacaagcaggcgtttccatctcagctaaagaagcaggagagctcaaagtccctgaaaaaggtgattgcagcccttagcaatcccaaagctaccagcagctcgcccgcacatccaaagcagaccctagagaacaaccatccaaacccttttctcactaatgcccttttaggcaaccaccagcctaatggcgtgattcagtccgtaatccaggaggcacctctggcccttacaaccaaaaccaaaatgcagtccaagatcaacgagaatatcgccgctgcctcgtctacgcccttcagctcaccagtaaatttgagcacctcaggacgccgaacccccggcaatcagacacccgttatgccttctgcaagtccgatcctgcacagccaaggcaaggagaaggccgtgtccaataacgtcaatcccgtaaagacccagcatcacagtcatccagctaagagtcttgtggaacagttccgaggcaccgacagcgacatcccatcaagtaaggactccgaggacagtaacgaagacgaggaagaggacgatgaggaggaggatgaagaggatgacgaggatgacgagagcgatgatagtcagagcgaatccgactctaattccgagagcgacactgaggggtccgaagaagaggatgacgatgacaaggatcaggatgagagtgattccgacactgagggagagaagacaagcatgaaactgaataagaccacatccagtgttaagtccccgtcaatgtcgttaactggccattctacccccaggaacctgcatattgcaaaagcccccggcagtgcccccgccgccttatgcagcgagagccagtctcctgccttccttggcacctccagttctacactgacctcgtcgccccactcagggactagcaaacgacggagagtcactgatgagagggagttgagaatacctctcgagtatggttggcagcgtgagacccgcatacgaaactttggtggccgcttgcagggggaggtagcctattacgcaccttgcggcaagaagctgcgccagtatcccgaagtcatcaagggaatgcagtggtgcctgttaaaagaggaagatgtcataccaaggattcgggccatggagggacgccgcgggcgcccacccaatccggatcgccaaagggcacgtgaagagtcccgcatgaggcgtcggaaggggcgtccaccaaatgtgggaaatgcagagtttctcgacaatgccgatgctaaactgctgcggaagctccaagcccaggagattgccaggcaggccgcgcaaatcaagctgctccgcaaactacaaaaacaggaacaggcacgcgttgcaaaagaggcgaaaaagcaacaagccataatggcagccgaggagaagcggaagcagaaagaacagattaaaatcatgaagcaacaagagaaaattaaacgtatacagcagatcagaatggaaaaggagctaagagcccagcaaattctagaagccaagaaaaaaaaaaaggaggaggccgctaacgccaagctgcttgaagctgaaaaaagaattaaagaaaaggagatgcgaagacagcaggccgtgttgcttaaacatcaggagcgtgagcggcgtcgccagcacatgatgctgatgaaggcaatggaggcgaggaagaaggcagaagaaaaagagcgactgaagcaggaaaaaagagacgagaagagactgaacaaggagcggaaattagagcagaggcgtctggaactggaaatggcaaaggagctgaagaagcctaacgaggacatgtgtctcgcggatcaaaaacctctccctgaattgcctagaatccctggcctcgtcttgagtgggtcaacattttccgactgtcttatggtggtacaattcctgcgtaatttcgggaaagtacttggcttcgacgtgaacattgacgttccaaacctttcagtcttacaggagggcttgttgaacatcggggatagtatgggagaggttcaggacctgctggtgcggttgctgagcgctgctgtatgtgatccaggactaattacaggctataaagccaagacagccctgggcgagcaccttcttaatgtgggggtgaatcgggacaatgtgagcgaaatcctgcagatatttatggaagcccattgcgggcaaactgaactgactgagtctcttaagaccaaggcgttccaggcccacacaccggcccaaaaggcatccgttctggctttcctgatcaacgaactggcttgttccaaatcggtggtgtcagagatcgacaagaacatcgattacatgtcaaatctgcgaagggataaatgggtggtggagggcaagctcaggaaactgcggattattcacgcaaagaaaaccgggaagagagacacatcgggcggcatcgacctgggcgaagagcagcacccactgggcacgccgactcctggccggaaaaggagaaggaagggtggtgattccgattatgatgacgatgatgacgatgattccgatgatcagggtgatgaagatgatgaagacgaggaggacaaggaggacaaaaaaggaaagaaaaccgatatctgtgaggacgaggatgagggcgaccaggcggctagcgtagaggaactggagaaacaaatcgagaagctgagcaagcagcagtcccagtaccgcagaaagctattcgatgctagccacagtctgcggtctgtgatgttcggacaggaccgctatcgtcgtcggtactggatcttgccgcaatgtggagggatcttcgtagaaggcatggagagcggggagggcttggaggagatcgctaaagagagggagaaattaaaaaaggccgagagcgtgcaaataaaggaagaaatgttcgagactagcggcgattcactcaattgtagcaataccgatcactgcgagcagaaagaagacttgaaagagaaggacaatactaacctctttcttcagaagcctggcagttttagcaaactgtcaaagcttctcgaggtggcaaagatgccacccgagagtgaggtcatgacccctaaaccgaacgctggcgccaacggatgtacactatcttaccagaacagcggcaaacattccctggggtcggtccagagcacagccacacaatctaatgtggaaaaagctgactctaataatctgttcaacaccggcagctccggccccggcaagttttactctcctctgcccaatgaccagctgcttaagacattgaccgagaagaaccgacagtggttctccctgttgccaagaaccccatgcgatgatacgtcactcacgcatgccgatatgtctaccgcgagtctagttaccccccagtcacagcccccatccaagagcccttcacctacaccggctcccctgggatcatctgctcagaacccagtcgggctgaatccgttcgccctgtctcccctccaggtgaagggcggcgttagcatgatggggctacagttctgcggctggcctacgggtgtggttacatcaaacatacctttcaccagctctgtgccatcactgggctctggactgggactgagcgaaggaaacggcaacagctttctgacttcaaatgtggcctcttcaaagtcggaatctcccgtgccacaaaatgagaaggccacttccgcacagccagctgcagtcgaggttgctaaacctgtcgactttccctctcctaagcccattccagaagagatgcagttcgggtggtggaggattattgatcctgaagatctgaaggcgctcctgaaagttttacacctgaggggcattcgagagaaagcgctgcagaagcaaattcagaagcacctggactacattactcaggcatgcctgaagaataaagacgtcgcgatcatagagcttaatgaaaacgaggaaaatcaggtgacccgcgacatcgtcgagaactggagtgtggaggagcaggccatggagatggatctgtctgtcctccagcaagtggaggacctggagaggcgcgttgcctctgccagtcttcaggttaaaggttggatgtgccctgagccagctagtgagcgtgaagacctagtgtatttcgagcataaatccttcaccaaattgtgcaaagagcatgatggcgagttcacgggagaggatgagtcctcagctcacgctctggagcgcaagagcgacaaccccttggacatcgccgtaacccgcctggcggatctagaacggaatatcgagagaaggattgaggaagatatcgctcccggcttgagggtttggcgaagggccctgtctgaggcaagatccgccgcccaagtggccctgtgcatacagcagctccaaaagagtatcgcatgggagaagtccatcatgaaggtgtactgtcagatctgccgaaaaggggataatgaggagctccttctgttgtgcgacgggtgcgacaagggttgccacacttactgtcatagacctaaaatcaccaccatcccagatggggattggttctgtcccgcttgcatcgccaaggctagtggccagaccttgaaaatcaaaaaactgcacgttaagggtaagaaaaccaacgagtcaaagaagggcaagaaggtgacgctgaccggagataccgaagatgaggattctgcttcaacctcatcctcactgaaacgggggaacaaggatctgaaaaagaggaagatggaagagaatactagtatcaatctctccaagcaggagtcctttacgagtgtgaagaaacccaagcgagacgactcaaaagatctggccctctgcagcatgattcttacagagatggagacccatgaggatgcctggcctttcctcctgccagtgaacctgaagctcgtgcccggttacaaaaaggtcatcaagaagccaatggacttctctaccatcagggagaaactgtcttccggacaataccctaatcttgagacattcgcgttggatgttaggctggtctttgacaattgcgagacctttaacgaagatgacagcgacatcggccgggcgggacataacatgagaaaatactttgagaaaaaatggaccgacacttttaaggtcagttag

SEQ ID NO: 109985 - DNA, 6507 bp, Artificial Sequence
  Description of Artificial Sequence: Synthetic coding sequence
atggagagtggtgagagactgccatcttccgcggcaagctcgactactccaacgtccagcagcaccccatccgtcgctagcgtcgttagcaaggggggcctgtctactggggtagcctctttatcgtcaacaattaacccctgcggccatctcttcaggacagctggagaccagccctttaatctgagcaccgtgagctccgccttccccatggtaagccacccagtctttggcttacatagcgccagttcaggacattctgaattcggtggattgggcactttaggaacgccgaccgcactggctgcacacccccagctagcttcctttcctggggccgagtggtggcggactaccgacgcgcatacaaggacaggagctacatttttcccgcccttactaggtataccgcccctttttgcaccaccagcccagaaccacgattcatcctcctttcactcacggacaagcggaaaaagtaatagaaacggccctgagaagggtgttaatggatccatcaatggcagcaacacgagttcagtgatcggaataaatacatccgtgctttcgactacggcctcttcaagtatgggacagacgaagtctacctctagcggcggtgggaatcgaaagtgtaatcaggagcagtccaagaaccagcccctggatgcccgagtagataagatcaaggacaagaagcccaggaagaaagcaatggaatcctcatctaactccgactccgattcaggaacttcttcagacaccagtagcgaaggtatttcatcttcagactcggatgacctcgaagaggacgaagaggaggaggatcagtccattgaagagagcgaggacgacgacagcgatagcgaatcggaagctcagcataagtccaataatcaggttctgctccacgggatcagcgatcctaaagcagatgggcagaaggctacagagaaggcgcaagaaaagcggatccaccagccgttgccattggcttcagagtcacaaacccacagctttcagtcccagcagaagcagccccaagtgctgtcgcagcaactgcctttcatcttccaaagctcgcaggcaaaagaagaatctgtgaacaagcacacgagcgtaattcagtcgaccggacttgtgtcaaacgttaagccattaagcctggtgaaccaggctaaaaaggaaacatacatgaaactgatcgtgccttccccggatgtgcttaaagcagggaataaaaacacgtctgaggagtcctccctcctgaccagcgagctccgatccaagagagagcagtacaaacaggcctttccatcacagctgaagaagcaggagtcttccaagtctcttaagaaggttatagccgcgctctctaacccaaaagccactagcagctcacctgcccatcccaagcagaccctagaaaacaatcatccaaacccatttctgactaatgcattactgggcaaccaccagcccaatggcgtgatccagtctgtgatccaagaggccccattggccctaacgacaaaaaccaagatgcagtcaaagatcaatgagaatattgctgctgcctctagcactcccttctccagtccggtgaatctgtcaacgtccgggagacgcacacccggcaaccaaacccccgttatgccatccgcaagccccatcctgcatagccagggcaaagagaaagccgttagcaataacgttaatccagtcaaaacacagcaccactcccatcctgccaagtcactggtggaacagtttagggggactgattcagatatcccctccagcaaggactccgaggattccaatgaggacgaagaggaagacgacgaagaggaggacgaagaggacgacgaggacgacgaatctgacgactcccaatctgaatcagattccaatagcgaaagcgacacagaggggagcgaggaagaggacgatgatgacaaagaccaggacgagagtgacagtgatactgaaggagagaagacatcaatgaagctgaacaagacaaccagctcagttaagtcaccctctatgagcttgaccgggcattccacgccaaggaacctccacattgcaaaggcaccaggatcggctcctgccgcgttgtgctccgagagccaatcaccggcttttctcggcacctccagttccacgctgacctcatctccgcacagtggtacatcgaaaagaaggagagtgactgacgagagggagttgcggatacccctggagtatggatggcagagagaaacgcgtattagaaacttcggcggtcgattgcaaggggaagtggcctactacgcaccctgcggcaagaaacttaggcagtacccggaagtaatcaagtatctgtcccggaatggcatcatggatattagccgggataattttagtttttccgcaaagatccgagtcggcgacttttacgaggcacgggatggcccacagggcatgcaatggtgcctgctgaaggaagaggatgttatcccgagaatcagggcgatggaggggcgtcgtggtaggccacccaatcccgatcgccagcgggctagggaagaatcaaggatgagaaggcgaaaggggagaccacctaatgtgggaaacgccgagtttttggacaatgccgacgcgaagctgctacgcaaattgcaggcccaagaaatcgccagacaggcggcgcaaatcaagttactgaggaaacttcaaaaacaagaacaggccagggtggctaaagaggccaaaaagcagcaggcaatcatggccgcagaggaaaaacgtaaacagaaagagcagatcaaaattatgaagcagcaggagaagattaaacggatccagcagattcggatggagaaggagctccgcgctcagcaaatcctggaagcaaagaaaaaaaaaaaagaagaagcagcaaacgccaaactgctggaagccgaaaaacggattaaggaaaaagaaatgagaagacagcaggcagtcctccttaagcatcaagagagggaacggaggcggcagcatatgatgcttatgaaggccatggaagctcgcaaaaaagctgaggagaaagaacggcttaagcaagagaaaagggacgaaaagaggctgaataaggaaagaaagctggaacaaaggagactggagctagaaatggcaaaagagctcaagaaacccaacgaagatatgtgtctggctgatcagaagcccctccccgagttaccccgaatacctggccttgtcttgtctggcagtacgttcagcgactgtctgatggtcgtgcaattcctgcgcaatttcggaaaagtcctggggttcgacgtgaacatcgatgtccccaatctgagcgtgctgcaggagggtcttctcaacatcggggacagtatgggcgaagtccaggatctgctcgttcgcctgctctctgcagccgtgtgtgatcccgggctgatcactggatacaaggccaagaccgctctcggcgagcatctcctgaatgtcggagtcaatcgtgacaacgttagcgaaatcttacagatcttcatggaagcccattgtgggcagaccgaattgaccgagtctctgaaaacaaaagcattccaagcccataccccggcgcagaaggcaagtgtgcttgctttccttatcaatgagctcgcatgttctaagagtgtggttagtgaaattgacaagaacattgactacatgtctaatctgagaagagataagtgggtagtggaaggaaaattacgcaagctcaggataattcatgcaaaaaaaacaggcaagcgcgacacgagcgggggaatcgacctgggcgaggaacaacaccctctgggcacaccaactccaggcagaaagaggagacggaaaggtggtgactccgactatgatgacgacgatgacgacgacagcgacgatcagggagacgaagatgatgaagatgaagaagataaagaggacaagaagggcaaaaaaacagatatctgtgaggacgaggacgagggagatcaggccgcttctgtcgaggaacttgagaaacagatcgagaagcttagtaaacagcagtcgcagtatcggcggaaattgttcgatgcatcacacagtcttaggtcagtgatgtttgggcaggaccgctatcgtcgccgatactggattctgccacagtgtggggggattttcgtggaggggatggagtctggcgagggtctcgaagagatcgccaaagagcgagagaagctcaagaaggccgagtctgtgcagatcaaggaagaaatgtttgagaccagcggagattctcttaactgttccaacactgatcactgcgaacaaaaggaggatctgaaggaaaaggataatactaacttgttcctgcagaagccaggatccttttccaagctttccaagctcctggaggtggccaagatgcccccagagtcagaggtgatgacaccgaaaccgaacgctggagccaacggatgcacactctcttatcagaacagtggcaagcacagtctgggatcagtgcagtccaccgccacacagagtaacgttgaaaaggcagattctaacaacctgttcaatacagggtcaagcggacccggcaaattttatagccccctgcccaatgaccagctgctgaagacattaacagaaaagaatcgacagtggttttccctgttacctcggacaccttgcgacgacaccagcctaacccatgctgatatgtcaacagcttcgcttgtaacaccccagagtcagcctcccagtaagagtcctagcccaaccccagctcctctcgggtcttctgcgcagaatccagtcgggctcaacccatttgccctgtcaccactgcaggtcaaagggggcgtctcaatgatgggtttacagttctgcgggtggccaactggggtggtgaccagcaacataccatttacttcctctgtcccttcactcgggtcaggcctcgggctgagtgagggcaatggcaatagtttcctaacaagcaatgttgcctcttccaagagcgagtctcccgttcctcagaacgaaaaggctacttcggcccagccggcagccgtggaggtggctaagcctgtagattttcccagtcctaaaccaattccagaagagatgcagtttgggtggtggcggatcatcgaccccgaagaccttaaggccttgttaaaagtgctgcacttacgcggcattagagaaaaggctctgcagaaacagattcagaagcatctggattacattacccaggcttgtttgaaaaacaaggacgtggccattattgagttgaatgaaaatgaagaaaaccaggtcactagggatattgtggaaaattggagtgttgaagagcaagctatggaaatggacctctccgtcctgcagcaggtggaagacctggagagaagggttgctagcgctagcctgcaagtgaagggatggatgtgccccgagcccgcctctgagagggaggacctggtgtattttgagcataagtccttcaccaaactgtgcaaggagcatgatggagagttcaccggagaagatgaaagcagtgctcacgccctcgaacgcaaaagcgacaaccccttagatatcgcagtaactcggttagcagacctggagagaaatatagaaagacgcattgaggaagatattgcccccggcctccgggtgtggcggcgtgccctgagcgaagcccgctctgcagcccaagtcgcgctgtgtatacaacagctgcagaaatctatcgcatgggaaaagtcgattatgaaggtgtactgtcagatctgcaggaagggcgataatgaagaactgttactcctctgtgacggatgtgataaagggtgtcacacatattgccatcggccaaagatcacaaccattcctgacggagattggttctgccccgcttgcattgctaaagcttcgggccagacgctgaagatcaagaagctccacgtaaaaggcaagaaaaccaacgaaagtaaaaaagggaaaaaggtaacgctgactggcgataccgaagacgaggattccgccagcacatcttcatcgttgaaaaggggaaacaaagaccttaagaaaaggaagatggaagaaaatactagcattaatctttctaagcaggagtcctttacctcggttaagaagccgaaacgcgacgatagcaaagaccttgcactctgctcaatgatcctgacagagatggagacgcacgaagacgcctggcccttcctcctccctgtgaacctgaagctggtgccaggctacaagaaagttatcaagaaaccaatggatttctctactatcagggagaagctgtcaagcgggcagtatcctaacttggaaacattcgcccttgacgtccgcctggtttttgacaactgcgagactttcaatgaagacgattcagacatcggcagagcaggccacaacatgcgcaaatactttgagaaaaagtggaccgacacatttaaagtgagctag

SEQ ID NO: 109986 - DNA, 432 bp, Artificial Sequence
  Description of Artificial Sequence: Synthetic coding sequence
atggagtccggggagagacttccttcctccgcagccagctccaccacccccacaagctcctcgactccctccgttgcaagtgtggtttctaaaggtggactatccactggggtcgctagcctgtcttcaacaatcaacccgtgcggacacctctttcgcactgctggcgatcagccatttaatctgagcactgtgtccagcgccttcccaatggtttctcacccggtgttcggattgcactccgcttctagcggccatagtgaatttggcggtctgggaacactcggcaccccaacagcactggcagctcaccctcagctggccagctttcctggagctgagtggtggagaacaaccgatgcacacacccggacaggtgctacatttttcccaccactcctgggaatacctccactgtttgccccaccatag

SEQ ID NO: 109987 - DNA, 1563 bp, Artificial Sequence
  Description of Artificial Sequence: Synthetic coding sequence
atggaatctggagaacgcctgccatctagcgccgctagctccacaactccaaccagttctagtaccccttcggtcgcttctgttgtcagcaagggcggcctcagcactggggtggcaagcctttcatctacaatcaatccctgcggggcagagtggtggaggacgactgacgcgcacacacggacaggcgccactttttttcccccattgctgggtatcccacctctgtttgccccaccagcacaaaaccacgactcaagctctttccacagccgaacctcagggaagtcaaaccgaaatgggcctgaaaaaggggttaatgggtctattaatgggtctaatacttcttcagtgatcggaatcaacacttccgttctgtccacaactgcgtcgagtagcatggggcaaaccaaatccacaagctccggcgggggaaaccgcaaatgtaaccaggaacaaagtaaaaatcagccattggacgctcgagtagataagattaaggacaaaaaaccacgaaaaaaggccatggaatcatcatccaattccgatagcgacagcggtacgtcttctgatacttctagcgaaggaattagctctagtgatagcgacgacttagaagaggacgaggaggaggaggaccagtcgatagaagaatcggaagatgacgactcagacagcgaaagcgaagcacagcacaaatctaacaatcaagtgctgctgcatggaatcagcgaccccaaggcagatggtcaaaaggctaccgagaaggcgcaggagaaaagaattcatcagccacttcctttggcatctgagtctcagacccattcctttcaatctcaacagaagcagccccaggtgttgagccaacagctgccattcattttccagtccagccaggccaaagaggagtcagtgaataagcacacctccgttatccagtccactggattggtatcaaacgtgaaacctctaagcctcgtgaatcaggctaaaaaggaaacctatatgaagttaatagtgccctcacccgatgttctcaaagcaggtaataaaaataccagtgaagaaagcagcctcctgacctcagagctgcggtcaaaaagagagcagtataaacaagcgtttccatcacagctaaagaagcaagagtcatccaaaagcttgaagaaggtgatagctgccctttccaacccaaaagctacttcctccagcccagcacacccaaaacaaaccctggagaacaaccatcccaaccccttcttgacaaatgcactgctgggtaatcaccagccaaacggtgtcatccagagtgtgattcaggaggcacctctagcgttgactactaaaacaaaaatgcaatcaaagatcaatgaaaatatagcagcggccagtagcaccccattttcctctccagtgaatctgagtaccagcggcaggcgcacccctgggaatcagaccccagtgatgccatcagcgtcaccaattctgcatagccaggggaaggaaaaggctgtatctaacaacgtaaacccccgtaaaatgatgaagaagaaaatgcggtag

SEQ ID NO: 109988 - DNA, 3645 bp, Artificial Sequence
  Description of Artificial Sequence: Synthetic coding sequence
atgggggtggattttgatgtgaagacattctgtcacaacctccgggcgacaaagccaccatatgaatgcccagtggagacatgtaggaaggtctataaaagctacagtgggatcgagtatcacctgtaccactacgatcacgataatcccccgccccctcagcagacccccctgcgaaaacacaaaaagaaaggacgacagagtcgacctgcaaacaagcagagtccatcaccttctgaagtgtcccaaagtcccggacgtgaagtgatgtcctacgctcaggcacagcgcatggtcgaggtggatctccatggacgcgtacatagaatctccatcttcgataacttggacgtagtcagcgaagacgaagaggcccctgaggaggcacctgaaaacggctccaataaagaaaataccgagactcccgccgctacacccaaatctggtaagcacaagaataaagaaaaaagaaaggactctaaccatcatcatcaccataacgtctccgcgagcacaacacctaagcttcccgaagtggtgtatcgggagttagaacaggacacgcctgatgctccccctaggccaactagttattatagatatattgagaaatcagccgaagaactggacgaagaagtggaatatgatatggacgaagaagattatatctggcttgacatcatgaacgaacggaggaagacagaaggtgtgtcaccaattcctcaagagatctttgagtatctcatggatagattagagaaggagagctactttgaatcccacaataagggcgatccaaatgctctggtggatgaggacgcagtgtgctgtatttgtaatgatggagagtgccagaactccaacgttatcctgttctgtgatatgtgtaatctcgctgttcatcaggaatgctacggggtgccatacattcccgagggccaatggctttgcaggaggtgcctccaatccccatctcgcgccgtcgactgtgccctttgtcctaacaaaggcggggccttcaaacagacagatgacggtcgctgggctcacgtggtgtgcgctctgtggattcccgaagtttgctttgctaatacagtattcctggagcccatagactctatagagcatattcctcctgcgcggtggaagctgacctgctatatttgtaaacagcggggcagcggagcttgcatccagtgtcataaagctaactgctatacagcttttcacgtgacatgcgctcaacaggcagggctatacatgaagatggaacccgtgcgtgaaaccggagcgaacggtacctcgttttccgtgcggaaaactgcatattgcgatattcacacacctcctggaagtgctcgaagattaccagccctgtcccattccgagggtgaagaagacgaggacgaggaagaagacgagggcaaaggatggtcaagtgaaaaagttaagaaggccaaagcaaaatcacgtataaagatgaagaaggcacgtaagatcctggccgagaaaagggccgcagcaccggtggtctccgtgccttgcattcctccccatagattgagcaagatcacaaacaggctgacaatacagcgtaaatcacagttcatgcagaggctccacagctactggacactcaagcgacagtcaaggaacggggtccctctgttaagacggttgcagactcatctgcaatcgcagagaaactgtgatcaggttggccgagacagcgaagataaaaattgggccctgaaggagcagctgaaatcttggcaaagactgagacacgatctggagagagccaggttgcttgtagaactgatacggaagcgtgagaaactcaagcgtgagaccatcaaagtgcagcagatcgccatggaaatgcagctgacaccgtttctgattttacttcgcaaaacactcgagcaactgcaggagaaggacacaggcaacatcttttcagagccagtaccactgagcgaggtacccgattacctcgatcacattaagaaacctatggattttttcactatgaagcagaacttggaggcttatagatatttgaactttgatgactttgaggaggactttaacctgattgtgtctaactgcctgaagtacaacgcgaaagacactatcttctacagggctgcagtgagacttagagagcaaggcggtgctgttctgcgccaggcacgccgtcaggccgagaaaatgggaattgactttgaaacgggaatgcacataccgcattcgctcgcaggcgatgaggcaacccatcacacagaagatgcagccgaagaggagagactggtgttactcgagaatcagaaacatctcccagtggaagagcagctcaaactccttctggagagattggacgaggtcaacgctagcaaacagagcgtgggccggagccgcagggcaaagatgattaaaaaggaaatgaccgccctgagaaggaagctggctcatcagcgggaaaccggtcgcgacggcccagagcgtcacggcccctccagtagaggttctctaaccccccaccctgcggcctgcgacaaagacgggcaaactgacagcgctgctgaagagagttcctctcaagaaacatccaaggggctaggcccgaatatgtctagcaccccagctcacgaggtcgggcggaggactagtgtcctgtttagtaaaaaaaaccctaagaccgctgggccacccaagcggccgggtcgcccaccaaagaaccgcgaaagccaaatgacaccatctcatgggggatcccccgtgggaccaccccaactgccgatcatgtcgtctttgagacagcggaaaagaggacgcagtcccaggccctcctctagctctgactccgacagcgataaaagcacagaggacccgcccatggacttacctgccaacggattctcgggaggcaaccagcctgtgaagaaatccttcctcgtgtatcgcaacgactgcagtctcccccggtcgagcagcgacagtgaatcctcttctagcagctctagctcagctgcttcggaccgcaccagtacaaccccgtctaaacagggccggggcaagcctagcttttcacgcgggacctttccagaggatagctccgaagatacctcaggcaccgaaaatgaggcttactccgtagggaccggacgcggggtagggcactcaatggtgcggaagtctctcggcagaggcgccggttggctctctgaggacgaggacagtcccctcgatgcactcgacctagtttgggcaaaatgcagaggatacccttcctacccggctcttatcatcgatccgaagatgccccgggagggaatgtttcaccacggggtcccaatccctgtgccacccctagaggtcctcaagctcggcgagcagatgacacaggaagcgcgagaacacttgtacctggtgctgttcttcgacaataaacggacatggcagtggctcccccggacgaagttagtgccactgggtgtgaaccaagatctggataaggagaaaatgttagagggtcgcaagtcgaacatccgcaaaagtgtgcagattgcctaccaccgggcgcttcagcacaggtctaaagtgcagggcgaacaatcgtcagaaacctcggacagcgactag

SEQ ID NO: 109989 - DNA, 3663 bp, Artificial Sequence
  Description of Artificial Sequence: Synthetic coding sequence
atgggcgttgacttcgatgtgaaaactttttgccataacctgagggctaccaaacccccctacgagtgtcctgtggaaacatgtcgaaaggtgtataaaagctatagcggcattgagtatcacctgtatcactatgatcatgataatccgccgcccccacaacaaacccctctgagaaaacacaaaaaaaagggtcgtcaaagtaggccagcaaacaagcaatctccaagcccgagcgaagtaagccaaagccccgggagagaggtgatgagctatgcccaggctcagcggatggtggaggtggacctgcacggtagggtgcatcggatctctatttttgacaacttggacgttgtttctgaagacgaggaagctcccgaggaggcccccgaaaacggttccaacaaagagaataccgaaactcccgcagcaacccccaagtccggtaaacacaaaaataaggagaagagaaaggactctaatcaccatcaccatcacaacgttagtgcttccactacacccaagctgcctgaggtggtatacagagagctagaacaggacacccctgacgctcccccccgccctacttcatattataggtacatagagaagtcggccgaagagctagatgaggaagttgagtacgacatggatgaagaagattatatttggctggatatcatgaatgagcgccgaaaaactgagggggtttcacctatccctcaggaaatcttcgagtacctgatggaccgactggagaaagaaagttacttcgagtcacacaataagggtgaccccaatgcattggtcgacgaagatgccgtatgctgcatctgcaatgacggcgagtgccaaaatagtaacgtgatactgttttgtgacatgtgtaacctggcagttcaccaagaatgttacggagttccgtacataccggaaggccagtggctgtgtagacgctgtctgcaaagtccctccagggccgtggactgcgccctgtgtcctaacaagggcggagcattcaaacagacagatgacggccgctgggctcatgtggtgtgcgccctctggataccggaagtctgctttgcgaacaccgtctttctggagcctatcgatagcatcgaacacataccacccgccagatggaagctgacatgctacatctgcaagcagcggggctccggggcctgcattcagtgccataaagctaactgctacaccgctttccatgtgacttgtgcacaacaagccgggctgtatatgaaaatggaaccggtgcgggagaccggcgccaatgggacaagtttttccgtgagaaagactgcctactgcgatattcataccccaccaggaagtgctagacgcctacccgcactgtcccactctgaaggcgaggaggacgaagacgaagaggaggacgaggggaaagggtggtcctccgaaaaggtcaagaaagctaaagcaaaatcaaggattaaaatgaaaaaggctagaaaaattctggccgagaagagggccgcggctccagtggtctcggttccttgcattccaccccaccgcctgagtaagatcacaaatcgcttaacaatacagagaaaaagccaattcatgcagagactccacagttactggacgctgaagcgtcaatccagaaacggcgtgcctctgcttcggagactccagacgcatctgcaaagccagcgtaattgcgaccaggtaggacgcgacagcgaggacaaaaattgggcgctaaaggagcagctcaaaagttggcaaaggcttagacacgacctggaaagagctcggctgctagtggaattaattagaaagcgcgagaaacttaaacgagagaccattaaggtgcagcagatcgcgatggagatgcagttgacaccctttctgattctcctgagaaaaaccctcgagcagctgcaagagaaagacaccgggaacattttttccgaacccgttccactgtccgaggttacagaactggacgaggtgcctgattacttggaccatattaagaaacccatggatttcttcacaatgaaacagaacctcgaggcctaccgatacttgaattttgatgattttgaagaagatttcaacctcattgtgtcaaactgtctgaagtataatgccaaggatacaattttctatcgcgccgcggtccgcttacgtgagcaggggggtgcggtgttgcgccaagcacgaagacaggcagaaaaaatgggaatcgacttcgagaccggcatgcacataccacacagtctcgccggtgatgaggcgacacaccatacagaagacgcggcggaagaggagaggctggtgctgctggagaatcagaaacatctgccggtagaggaacagctcaaactgttactcgagcgacttgacgaggttaatgcctcgaaacagagtgtcggacggtccagaagagcaaaaatgatcaaaaaagagatgacagccttacgtcggaaactggcgcaccagcgggagaccgggcgcgatggaccagagagacatggaccgtcaagtaggggctcccttacaccccacccagcggcttgcgataaagatgggcaaaccgactcagccgcagaggagagttcttcccaggagaccagcaaaggattgggcccaaacatgagctccactccggcgcacgaagtcggtcgccgcaccagcgtgttgttctccaaaaagaaccccaagacggcagggccgcccaaacgccctggccggccgccaaagaatcgcgaatcacagatgacgcccagccacggaggcagtcctgtgggtcccccccagctgccaataatgagctcactgcgtcagcgcaaacgcgggaggagtccacgaccttcatcatcctcggacagcgattctgataagtctacagaggaccctcctatggatctgcccgccaatggcttttcaggaggaaatcagcctgttaaaaagagcttcctggtgtatagaaatgattgctcacttccacggtcctcctcagactccgaatcatccagctcctcttccagcagtgcagccagcgaccgcactagcactaccccaagcaagcagggtagaggcaaaccctctttcagcagggggaccttccccgaagactctagtgaagatacatccgggacagaaaatgaagcttactccgtggggaccggacgaggcgtgggtcatagcatggtgagaaaatctcttgggaggggagccgggtggttaagcgaagacgaagactctcctctggacgcacttgatctggtgtgggccaaatgccgtggatatccatcttaccctgccttgataattgatccaaagatgccacgagaaggcatgttccatcacggagtgcccattccggtgccacccctggaggttctgaagctcggagagcagatgacccaagaggccagggagcatctgtatctggtgctgttttttgataacaaaagaacctggcagtggttacctaggaccaaactagtgcctctaggggtcaatcaggatctggacaaagagaagatgctggaaggacggaagagcaatatcaggaaatctgtgcagatagcataccacagagccctacagcacaggagcaaggtgcaaggggaacagtcctctgagactagtgatagtgactag

SEQ ID NO: 109990 - DNA, 303 bp, Artificial Sequence
  Description of Artificial Sequence: Synthetic coding sequence
atgggcgtcgactttgatgtcaagaccttctgccataacctacgtgcaacgaaacccccgtatgaatgcccagtggaaacctgccgaaaagtctataagagctactccggcatagagtaccacctgtatcactacgatcatgataatccgccaccccctcaacagacccctttgagaaagcataagaaaaaaggcaggcagtcccgccccgccaacaaacagtcaccgtccccttccgaggtgtcgcagtctcccggcagggaggtcatgagctatgcccaggcacagcgaatggttgaatag

SEQ ID NO: 109991 - DNA, 318 bp, Artificial Sequence
  Description of Artificial Sequence: Synthetic coding sequence
atgggcgtggatttcgatgtgaaaacattttgccacaatctgcgggctactaaacccccttatgaatgtcccgtggagacttgccgaaaggtgtataaaagttacagcggcatcgaatatcatctataccactatgaccacgacaaccctcccccaccccaacagacacctctaagaaagcataagaaaaaaggcagacagtcccgccccgcgaacaaacagagccccagccccagtgaagtatcccaaagtcctggcagagaggtcatgtcctatgcacaagctcagagaatggttgaggtggacctgcatggttag

SEQ ID NO: 109992 - DNA, 3645 bp, Artificial Sequence
  Description of Artificial Sequence: Synthetic coding sequence
atgggcgtggactttgatgttaagacgttttgtcacaatctccgcgctaccaagcctccttacgaatgtccagttgagacctgtcggaaagtttacaaatcatattctgggatcgaataccacctctatcattacgatcacgataaccctccacccccacagcaaacgccgttgcgcaaacataagaagaaaggccgacaatctagacccgccaataagcagtcaccttctccaagcgaagtctcccaatcgccgggccgggaagtaatgagttatgcacaggcccagagaatggtagaggtcgatctccacgggcgtgtgcaccgcataagtatttttgacaacctggatgtggtcagcgaggacgaggaggctcccgaggaggcacctgagaacgggtctaacaaagagaacacagagaccccagcagcaacaccaaaaagcgggaagcataaaaataaggaaaaacgcaaagattcaaaccatcaccatcaccacaacgtctctgctagtactacacccaagttaccggaggtcgtataccgcgagctggaacaggatacacccgatgcacccccaaggcctacctcctactatagatatatcgaaaaatccgcagaggagctcgacgaagaggtggagtacgacatggatgaagaagactacatctggttggacattatgaacgagagaagaaaaacggaaggggtgagcccgatcccccaggaaatcttcgaatacttaatggacagactagaaaaagaatcctacttcgagagccataataaaggtgaccctaacgcactggtagacgaagacgccgtgtgttgtatctgtaatgacggcgagtgtcaaaacagtaatgtgatcctgttctgtgacatgtgcaaccttgcagtccatcaggaatgttacggggttccttacatccccgaaggtcaatggctttgccgaagatgcctgcagtctccttccagagcagtggactgtgccctgtgccccaataaaggcggggcttttaaacagaccgatgatggccggtgggctcatgtcgtgtgcgcactgtggattcccgaggtctgcttcgccaacaccgtcttcctagagcccatcgattcaatcgagcatattccccccgcaaggtggaagttgacctgttacatctgcaagcagcgcggtagcggcgcatgtattcagtgccacaaggcaaattgctacacagccttccacgtaacatgcgctcagcaagctggcctgtacatgaagatggagcccgttcgggagactggagctaacggcacctctttctccgtaagaaagacggcttactgtgacatacatactcctccagggagcgcaaggcggctccccgctctgtcacacagcgagggtgaggaggatgaggatgaggaggaggatgagggcaagggctggagttcagaaaaggtgaaaaaagccaaggctaagagcagaataaagatgaagaaggcccgcaagatcctggctgaaaaaagagccgccgcccccgtggtgtcggtgccctgcatacctccgcacagactgtcgaaaatcactaatcgcctgactattcagcgcaagagtcagttcatgcaacgtcttcactcctattggactttgaaacggcaaagtaggaacggggtgcccctactgcgtcgcctgcagactcatctacagagtcagaggaattgcgatcaggttggccgggatagtgaggataagaattgggccctaaaggaacagctgaagagctggcaacgactcagacatgacttggaaagagcaaggctgctcgtggagttgattcgcaaaagagaaaaattaaagcgggagacaataaaagttcagcaaattgctatggaaatgcagctgacaccatttttgattctcctcagaaagacgctagaacagctacaggaaaaggacacgggaaatattttctccgaacctgtccctttgtctgaagtcccagactacctggatcatattaaaaaaccaatggatttctttacaatgaaacagaaccttgaggcctataggtacttgaactttgatgacttcgaggaggacttcaacttaatagtgagcaactgtttgaaatacaacgctaaggataccatattttatagggcggcagtgaggctgcgcgagcagggcggggctgtcctgcggcaggctcgccggcaggccgagaaaatgggcatcgacttcgagactggtatgcatattccacactctttagctggcgacgaagcaactcatcatacagaggacgctgcagaggaagagagactggttctcctggagaatcaaaaacatctgcccgtcgaagaacagctgaagctgctccttgagcgactggacgaggtgaatgcatcaaagcaatctgtgggcagaagtaggcgggccaaaatgatcaagaaagagatgactgccctgcggaggaagttggcacaccagcgggagacgggacgagatggacccgaacggcatggaccctcttcccggggatctctcacacctcacccggccgcatgtgacaaggatggtcagaccgactccgcagccgaagagtccagtagtcaggaaaccagcaaggggttgggtccgaacatgtcttcaaccccagcccacgaggtgggtcggcggacatcagtgcttttttctaaaaaaaaccccaaaactgcaggaccacctaaaaggcctggtaggccacccaaaaaccgcgaatcacaaatgaccccgagccacggaggttcgccggtggggccaccacaactaccgattatgagttctctgagacagcgcaaaagggggcggtctccacgcccctcctccagttcagatagtgacagcgataaaagtaccgaggatccaccaatggatttgccggctaatggcttcagcggggggaaccagcccgtgaagaagtctttcttggtgtataggaatgattgttccttgcctcgttcttcctctgatagcgaatctagctcaagctcgagcagtagcgctgctagcgataggactagcacaacgccgtccaagcaggggagaggaaaaccgagctttagcagaggcacatttccagaggatagctccgaggacacttcaggaaccgagaatgaggcctattccgttggcacgggtagaggcgtgggccactctatggtgcgcaagtccttagggaggggcgccgggtggctgtccgaggacgaagactcacctttggacgccctggatctagtgtgggccaaatgtagaggttatccttcctatcccgcactgatcattgatccaaagatgcctcgggagggcatgttccatcacggggtccccatccccgttcctcccctcgaggttctgaaactgggtgagcaaatgacccaagaagcccgggagcacttatacttggtcctctttttcgacaataaaagaacgtggcaatggttgccccgtaccaagttagtacccctcggcgtcaaccaggatctcgacaaggagaagatgctggagggtcggaaaagcaacatccgaaaatccgtccagattgcataccacagagcgctccagcatcggagcaaggtacagggagagcaatcaagcgagaccagcgatagcgattag

SEQ ID NO: 109993 - DNA, 5409 bp, Artificial Sequence
  Description of Artificial Sequence: Synthetic coding sequence
atggccgccgctccaacacagatcgaggcagagttatattacctgattgctcgatttctccagtccggaccctgtaacaagtccgcccaagtccttgtccaggagctggaggagcaccagctcattccacgccgcctcgactgggaaggaaaggagcatcgtagaagtttcgaggatctggtcgccgccaacgcgcacatcccaccagattatctgctgaaaatttgtgagcgcatcggaccgctgctggataaggagatcccgcagagtgtgccaggtgtgcaaaccctcctgggggtagggcgtcagtcccttctgagagatgccaaggactgcaaatccaccctgtggaatggtagtgcatttgcagcgctgcatcgaggccggccacccgaactcccagtaaactatgtcaaaccgcctaacgttgtgaatatcacctcagctcgacaactcacgggatgttcacgttttgggcatatcttcccaagcagtgcctaccagcacattaaaatgcacaagaggatcctgggtcatctgagctccgtttattgcgtggcttttgatcgtagtggccggcgcatatttacaggcagcgacgactgtctggttaagatctgggctactgacgatgggaggcttctcgctacgttgcggggtcattccgctgagatctccgatatggcagtcaactacgaaaatactttgatcgccgctgggtcttgtgacaaggtggtccgagtatggtgcctgaggacctgcgcccctgttgctgttctccaggggcacagtgcttccattacaagtatacagttttgtcctagtaccaaaggaacaaacaggtacctgacatccactggggctgacggcacaatttgcttctggcagtggcacgttaaaactatgaaattccgcgaccgtcccgtgaaattcacagaacgctcccgacctggcgtgcagatcagttgcagttctttctccagcggtggtatgtttatcaccactggcagcactgatcacgtgatcaggatttactatctgggaagtgaggtccctgaaaaaatcgcagagctcgaaagccatactgataaagtagttgccgtccagttctgcaataatggtgactcccttcgcttcgtaagcgggtcccgggacgggaccgcgcgaatatggcagtatcaacaacaggagtggaaaagtatagtcctggacatggccaccaaaatgactgggaataacctgccctctggcgaagataaaataaccaagctgaaagttacgatggtggcatgggataggtatgacactaccgtcatcacagctgtgaataatttcctgttaaaagtatggaattctatcactgggcagctcctccatactctatccggccatgacgacgaagttttcgtgctcgaggcgcatccatttgaccagaggatcatcctgtcagcaggccacgacggtaacatttttatttgggatcttgaccggggcactaaaattaggaactacttcaatatgatcgagggccagggccacggcgcagtgtttgactgcaagtttagtccagacgggaatcacttcgcttgcaccgacagccacggccacttgctgctcttcggcttcggctgtagcaaatactatgaaaaaatcccagaccagatgttcttccatactgattatagacctctaatcagagacgcaaataactacgtgctggacgagcagactcagcaagccccccatttgatgccacctccatttctcgtagacgtggatggaaacccccatcctactaagtttcaacgtctggttcccggacgcgagaattgcaaagatgagcagctgattcctcagcttgggtacgtggcaaatggtgacggagaagtggtagaacaggtgatcggacagcagacaaacgatcaggatgagtctatcctcgacgggataatccgcgagctgcagagggaacaagacctgcgtttgataaacgagggagacgtgccccatctgccagtaaatagggcgtactctgtgaatggcgcgctgaggtcccctaatatggacatcagcagcagtcccaatataagactacgcaggcatagtagccaaatagagggggttaggcaaatgcacaacaacgctccacggagccagatggctactgagcgcgatctcatggcatggagccgtcgggtggtagtcaatgagcttaacaacggagtatcacgcgttcaggaggagtgtcgaacggcaaagggggacatagagattagtctgtacaccgtagagaagaagaaaaagccctcatacactacccagcgcaacgactacgagcccagttgtggccggtccctcaggagaacgcagcggaagcgacagcatacataccagaccaggtccaatatcgagcataactcacaagccagttgccagaattcaggtgtccaagaggatagtgattcttccagcgaggaagatgagacagtgggtacaagtgatgcatcagtggaagatcccgtcgttgagtggcagagtgagagctcttcaagcgattcatcatctgagtattccgactggactgccgacgcgggcattaatctgcagcccccgaaacggcagacacggcagacaacgcgcaagatttgctcttcctctgatgaggagaatcttaaaagcctcgaggagaggcagaagaaaccaaagcagaccagaaagaagaaaggtggcttagtgagcatagctggcgaacccaatgaagagtggttcgcgccccagtggatcttagacaccattcctcgcagaagcccctttgttcctcaaatgggggatgagctgatctatttcaggcaaggacacgaagcttatgtccgtgccgtgcgcaagtctaaaatctattccgtcaacctccagaagcagccctggaacaagatggacctgagggaacaagagttcgtgaagatagtgggtattaaatacgaagtcggaccacccaccctgtgttgtctcaagctcgcttttctcgatccaatctccgggaaaatgaccggagaatctttcagcattaaatatcatgatatgccagacgtgattgacttcttagttcttcaccaattctataatgaggcaaaggagagaaattggcagatcggtgaccggttcaggagcatcattgatgatgcgtggtggttcggcacagtggagagtcaacagccttttcagccagagtatcccgactctagcttccaatgttactctgtccattgggacaataacgagcgtgagaagatgtcaccttgggacatggaaccgatcccagagggtactgccttccccgacgaggttggcgcgggggtccctgtctcccaggaggaacttaccgcgcttctgtacaaaccccaggaaggtgagtggggtgcacattcacgagacgaagagtgtgagcgagtgatacagggcattaaccacttgctcagccttgacttcgctagtccctttgcagtgcctgtggatctgagcgcttatcccttgtactgcaccgtcgtggcataccctactgacctcaacaccatcaggcggaggctggaaaatcgcttttacagaaggatctctgcgttgatgtgggaagtgcggtatatcgagcacaatgcaaggaccttcaacgaacccgatagtcccatcgtaaaggccgccaaaatcgtgaccgacgttctgctgagatttatcggggaccaatcttgtacagacatactcgatacctacaacaagattaaggccgaagaacggaatagcactgatgctgaggaggacaccgagatcgtcgacctggacagtgacgggccaggcaccagtagcgggaggaaagtgaaatgtcgcggccgacgtcagagtctgaagtgcaatcccgatgcctggaagaagcagtgcaaagaactgctgagtctgatttacgaacgagaggatagtgagccctttcgacagcctgccgacctgctgagctacccggggcaccaagagcaggaaggcgagtcttcagagagcgttgtcccagagcggcagcaggatagcagcctctctgaggactaccaggacgtgattgacacccccgtcgatttctccacggtgaaagagaccctagaagccggcaattacgggtcaccgttggagttttataaggacgtacgccagatcttcaataattctaaggcttatacttcaaacaagaagagtcgtatctattctatgatgctcagattgtccgccctgtttgagtcccacattaagaatatcataagcgaatataagtccgctattcagtcacagaagaggcgacgcccgcgttaccgaaagcggctacgaagtagttcctcctctctttcctcatctggagccccgagccccaaaggtaaacagaaacaaatgaaactccaaccaaagaacgatcagaatacctcagtttcacacgcacgtacaagttcccccttcagctctcccgtatccgacgccgccgaaggtctgtcgctttacctcctcgatgacgagcccgacggtccgttttctagctccagctttggtggctacagccgaagtggaaactcacacgaccccggcaaagctaagagctttcgaaacagggtgcttcccgtgaaacaggaccattccctggatggccctctcactaatggcgatggcagggaacctaggacgggcatcaaacgcaagcttctgagcgcctccgaggaggacgaaaatatgggcggagaggataaggagaagaaagaaaccaaagagaagtcacatttgagcaccagtgagtctggggaactgggatcttctctaagcagcgagagcacctgtggttctgattccgacagcgaaagtacgtcacgtaccgatcaagattacgtggatggggaccatgattacagcaagtttatccagaccagaccgaagagaaagctgcggaagcagcacggcaacggcaaaaggaactggaagacacgaggaactggcgggaggggtaggtggggccggtggggaagatggagtcgcggcggccggggtcggggcggcagggggagaggttcccgtgggcgcggcgggggtggaaccagaggtcggggcaggggccggggtggacggggggcatcgagaggcgctacacgtgccaagagggctcgcatcgccgacgacgagttcgacacaatgttttcaggaagattctcacgccttccgcgtattaaaacgcgcaatcaaggccgccgcacagtcctgtacaatgatgatagcgacaacgacaacttcgtgagcacagaggatccgttaaatctgggcacaagtaggtccggaagagtgaggaaaatgaccgagaaagcccgcgtgagccacctgatgggctggaattactag

SEQ ID NO: 109994 - DNA, 2406 bp, Artificial Sequence
  Description of Artificial Sequence: Synthetic coding sequence
atgctacagaacgtgacccctcacaataaattgcccggcgaaggaaatgccgggctgcttggcctcggtccggaggctgccgcaccagggaaacgaatacgcaagccgtctctgttgtacgaggggttcgagagtccgaccatggcaagtgtgcctgccctgcagctgacacccgcgaacccgccgccgcctgaggtctcgaatccaaagaaacccgggagagttacgaatcagctgcagtatctccacaaggtcgttatgaaggccctgtggaagcaccagttcgcatggcctttcaggcaaccagttgacgcagtgaagttaggtctgcccgattaccacaagatcattaaacagcctatggacatggggaccatcaagcgcagactggagaacaattactactgggcggcctcagaatgcatgcaggattttaacacgatgttcactaactgctacatctacaataagcccaccgatgacatagtgctcatggcacagaccctcgagaaaattttcttgcagaaggtcgcttcaatgccccaggaggagcaggaactcgtagtgacaatcccaaaaaatagccacaagaagggagcgaagctggcagcactgcagggatctgtgacatcggcacatcaggtgcctgcagtgtcaagtgtcagtcacaccgcactgtatacccccccaccagaaatccctacaactgtgttgaacatcccccaccccagcgtcattagcagcccactgcttaagagtttgcatagcgcaggaccccctcttctcgccgtgactgccgctcctccagctcagcctctcgcgaaaaagaagggtgtgaagcggaaggcagacactacaacaccaactccgactgccatcctcgctccagggtctcctgcttcgccccctggaagcctggaacccaaagccgcccgcctgcctccaatgcgccgggaaagtggaagaccgatcaagcctccccgtaaggatctgcccgactcccagcaacaacaccagagctcaaagaagggcaagctaagtgaacagctcaagcactgtaacggtatcctgaaagagttgctgagcaagaagcacgccgcctacgcctggcccttttacaaacctgttgacgcctcagccctcggcctgcacgactatcatgacataatcaaacatcccatggatttatctaccgtaaaacgtaagatggaaaacagagattatcgcgatgctcaggaatttgctgccgacgttaggcttatgttcagcaactgctataagtacaaccctccagaccatgacgtagttgctatggctagaaagctccaggacgtgtttgagttcaggtacgcgaaaatgccggacgagccccttgagcctggacccctgcccgttagcacggcaatgccaccaggcctggctaagagctcttcggagtctagcagtgaggagtcaagctcagagtcatcaagcgaggaggaagaggaagaggatgaggaggatgaggaggaagaagagagcgagtcgagcgattctgaggaggaacgtgcccaccgattagctgaactgcaggagcagcttagggccgtacacgagcagctggccgccttatcccaagggcccatttccaagcccaagcgtaagcgagagaaaaaggagaaaaagaagaaacgtaaggctgagaagcacaggggcagagccggggctgacgaggatgacaaaggcccacgagcacccagaccaccccagccgaagaagtctaaaaaggctagtggtagcgggggggggtccgctgcattgggaccttctggctttgggccatctggaggctctggaaccaagctccctaagaaggccacaaagacggccccacccgccttgcctaccggctacgattccgaggaggaagaggagagcagacccatgtcttatgatgagaagagacaacttagcttagacatcaacaagctgcccggagagaaactcggccgcgtcgtgcacatcatccaggcacgggagccaagtctccgcgattccaatccggaggagatcgagattgattttgaaaccctgaaacccagcactctgcgcgagctcgagcggtacgtgctgtcttgcttaaggaagaaacccagaaaaccatatactatcaaaaagcctgttggcaagacaaaggaagagctagcgttagaaaagaaaagagagttagaaaaaagactgcaagatgttagcggtcagttgaatagtaccaagaagcctccgaaaaaggccaacgaaaagacagagtcctcctccgcacagcaggtcgctgtgtcaagattaagcgcttcctcgtcaagttcagacagcagctcatcatcaagttcaagttctagttctgacacctcagatagcgactcaggatag

SEQ ID NO: 109995 - DNA, 2406 bp, Artificial Sequence
  Description of Artificial Sequence: Synthetic coding sequence
atgctgcagaatgtgacgccccacaataaattacccggggaagggaatgctggactgctaggattgggccctgaggcggccgctcctggcaagcggattcgaaagccttctcttttgtacgagggctttgagtcccctactatggcctctgtccccgcgctgcaactgaccccagccaatcctccccctccagaagtgtcaaatccaaagaaacctggtcgggttacgaaccaacttcagtatctgcacaaggtggttatgaaagccttgtggaaacaccagttcgcctggccatttcggcagccagtcgatgcagtgaaactggggcttcccgattaccacaaaattatcaagcagcccatggacatggggacaattaaaaggcgacttgaaaataattactactgggctgcttcggagtgtatgcaggacttcaataccatgttcactaattgctacatttacaataagccaacagacgacatcgttctgatggcccaaaccctggagaagatattccttcaaaaggtggctagtatgcctcaggaggaacaagagctggtagtaaccatccctaagaactcccacaaaaagggggctaaactggccgctctccagggctcagtgaccagcgcccaccaagtgcctgccgtcagctctgtcagccataccgcgctgtataccccaccgcctgagattccgacgactgttttgaacatcccacatccatccgtcatttcaagcccactcctaaaatccctgcactccgccggacccccactgcttgccgtgactgctgccccaccagctcagccattagctaagaaaaagggcgtgaaacgcaaagctgacaccaccacacctacaccaacagcaatcctggcacccggatcccccgccagtcccccggggtctctcgagccgaaagccgcccgactcccacctatgaggagagagtcaggtcggcccataaaaccccctcgtaaggacctaccggactcacagcaacagcatcagtcaagtaagaaggggaagctctctgagcaattaaagcactgcaacgggatattaaaggaattattatccaaaaagcatgccgcatatgcatggcctttctataagcccgtggatgcctccgccctcggattacatgactaccatgacatcataaagcatcccatggatctgtctaccgtcaaaaggaaaatggagaatcgggactatcgagacgctcaggagttcgccgccgatgtacgtctgatgtttagcaactgctacaaatataatccccctgaccatgacgtcgtggccatggctaggaagctgcaggatgtgtttgagttcaggtacgccaaaatgcctgacgagcctctcgagcccggtcccttacctgtctcaacggccatgcctcccggtctggccaagagctcttcggagtctagtagcgaggaatcctctagcgaatcttcctctgaggaagaggaggaagaggacgaagaagatgaggaggaagaggaatcggaaagctctgatagtgaagaggaacgagctcatcgattggcagagctgcaggaacagttaagggctgtgcacgaacaattggctgccctttcacagggccctattagcaaacctaaaagaaagagagaaaagaaggagaaaaagaagaagagaaaggcagaaaagcacagggggcgcgccggcgctgacgaagatgataagggtccaagggctccccgacccccccagcctaagaagtcaaagaaagcctctggttccggcggcggatcagcagctctggggccttcgggcttcggcccttccggcgggtccggaaccaaactgccgaagaaggctacaaaaacagctccgcccgctctgccaacgggatatgacagcgaggaagaggaggaatctcgcccgatgagttatgacgagaagaggcaactgtcgctggatataaacaagctcccaggcgaaaagcttgggcgggtcgtgcacatcatccaggcacgcgagcccagccttagagacagcaatcctgaggagatagaaattgatttcgagactcttaagccatccacactgcgggagctcgagcggtacgtgctatcatgtctcagaaagaaacccaggaagccctacactataaagaagccagtgggcaaaactaaggaggaattggcactggagaagaaacgcgaactggagaagcgtctgcaggacgtaagcggtcagctgaattctaccaaaaagcccccgaaaaaggcaaatgaaaagactgaaagttcatcggcgcagcaagtcgcagtgagccgcttgtcagcgtcatccagttcctcagattcaagcagcagcagctcctccagtagcagcagcgatacatcagacagtgattctggctag

SEQ ID NO: 109996 - DNA, 2406 bp, Artificial Sequence
  Description of Artificial Sequence: Synthetic coding sequence
atgctgcagaacgtcacccctcacaacaagcttcccggcgaaggcaacgcagggcttctgggcctgggaccagaggccgctgcacccggcaagcgtattcgcaaaccctctctcctatacgagggcttcgaaagccctaccatggccagtgtgcccgcacttcagctgacgcctgccaacccaccacctccagaggtgagtaaccccaagaaaccagggagggttacaaatcagctccagtaccttcacaaagtcgtcatgaaggcgttgtggaagcaccaattcgcttggccattccgacaacctgttgacgcggtgaagttaggcctgccagactatcacaaaatcatcaaacagccaatggacatggggaccataaagcgacgcctggagaacaattattactgggctgcctcagagtgtatgcaggacttcaatacgatgttcaccaactgctatatatacaacaaaccaactgatgacattgtgctgatggcgcaaaccctggaaaaaatattcctacaaaaagtggcctcgatgcctcaggaggaacaggagctggtggtgactatccccaaaaactcccacaagaaaggcgccaagctggccgcgctgcagggctcagtcactagcgcacaccaagtgcccgccgtttcctccgtgtcccacactgcgctgtacactccacctccagagattccaactactgtacttaacatcccgcatccctccgtcattagctcaccactgctcaagtctctgcactccgcggggcctcccctcctagctgtcaccgcagcacctccggcccagcctctcgccaagaagaagggggttaaaaggaaagctgatacaactactcctacccccaccgccatcctcgcgcctggaagtcccgcaagccctcccggctcgctcgaacctaaagcagcaagactgcccccgatgagacgggaaagcgggcgacccatcaagcccccacggaaggaccttcctgattcccagcagcaacaccagagcagcaaaaagggcaagctcagtgaacagctgaagcattgtaacggaatcctcaaagagctattaagtaagaaacacgctgcctatgcctggccattctataaaccagtcgatgcatctgcattgggcctgcacgattatcacgatatcattaagcaccccatggacctctcaaccgtgaagagaaaaatggagaacagagactaccgggacgcacaagagttcgctgctgatgttcgactgatgttttccaattgctataaatataacccccctgaccatgacgttgtggcaatggccaggaagctgcaggatgtttttgaattccggtatgctaaaatgcctgatgagccacttgagcctggacctctgcctgtgagcacagctatgccaccaggactcgcgaagagctctagcgagagtagcagcgaagagagtagctcagagtccagctccgaggaggaagaggaggaagacgaagaggatgaggaagaggaggagtcagaaagctccgattccgaggaggagcgcgcgcaccgtctcgctgagctccaggagcaactccgcgccgtgcacgagcagttggccgccctctcccaaggcccaatctctaaacctaagcggaaacgcgagaagaaggagaaaaagaagaagcgtaaggccgagaaacaccgtggcagggccggcgccgacgaagatgataaagggcctagggcaccccggcctccgcagcccaagaaatcgaaaaaggcctccggatccggcggaggatccgcggctctaggaccctccggattcgggccaagtggaggctctggaacaaagttgccaaaaaaagccactaaaactgctccgcctgccctccccaccggctacgacagtgaggaggaggaggagtctagaccaatgagctatgatgagaaacgccagctttctctggacattaataagctgccgggtgagaagcttggacgggtcgtgcacatcatacaggctcgtgagcccagtttgcgggattccaatccggaggagattgaaattgatttcgaaacgctcaagccgtccacgcttagggaactggaaagatatgtgctctcttgcctacgaaaaaagcccaggaagccttatacaatcaagaaaccagtgggaaaaacaaaggaggaattggcgctggaaaagaaacgtgaactcgagaagcgcttacaggatgtgtcggggcagcttaactctacaaaaaagccacctaaaaaggcgaatgaaaagaccgagtctagtagcgcccagcaagtcgcagtcagcagactctctgcgtcttcctcgagcagcgatagcagctcatcctcgtcctcatccagcagctcagatacatccgattctgacagtgggtag

SEQ ID NO: 109997 - DNA, 2511 bp, Artificial Sequence
  Description of Artificial Sequence: Synthetic coding sequence
atgctgcagaacgtgacacctcacaataagttacccggggaaggcaacgcaggtctgctgggactgggccccgaggcagcagcccctggcaaacgcatccgcaaacctagcctcctctatgaaggcttcgaatcgccaaccatggccagtgtgcctgctctccagcttacaccggccaacccaccacctcctgaagtgagtaacccgaaaaagcctggacgcgtcacaaatcaattacaatatttgcacaaggtcgtcatgaaagccttgtggaagcatcagttcgcttggcccttccggcagccggtggacgccgtaaagctcggattaccggattatcacaaaatcattaagcagcctatggacatgggaacaatcaagagacgcttggagaataactattactgggccgccagcgagtgcatgcaggacttcaataccatgttcaccaactgctatatctataacaaacccactgatgacattgtgctgatggcccagacactcgagaagattttcctgcaaaaggtcgcttccatgcctcaggaagagcaggagctcgttgtcacaatcccgaagaactcccacaagaagggagccaagctcgctgcactgcaaggaagcgtgacctcggcacaccaggttcctgccgtgtcttctgtgagtcatacagccctgtataccccaccacctgagatacctaccactgtactcaatatccctcaccccagcgtgatttcatcccccctcctaaaatcactgcactctgccggccccccactcctggccgtcaccgccgccccacccgctcagcctctggctaagaagaagggagttaaacggaaggccgatacgaccacaccaactcccaccgcgatcctggcccccggatcaccagccagtccccccggaagcctcgagcccaaggcggcgcggctgccacccatgagacgtgaatccggacggcctataaagccgcccaggaaagacctgccagattcacagcagcagcaccagtcctcgaaaaagggaaaactcagcgaacagttaaaacattgcaatggcattctgaaagaactcctctctaagaagcatgccgcttacgcctggcctttctataaacctgtggacgccagtgctctgggtttgcacgattatcatgacattatcaagcatcccatggatctttcaaccgtgaaacggaagatggaaaaccgggactaccgggatgcccaggaatttgccgcagacgtcaggttaatgttttcaaactgctataaatacaacccacccgatcacgatgttgttgctatggcgcgcaagttacaggatgttttcgagtttagatacgctaaaatgcctgatgagcccctcgagcctggtcctctgcccgtgtctaccgccatgccccccggcttggccaagagctccagtgagtcttccagcgaagagtcatcctccgagtcatcttcggaggaggaggaggaggaggacgaagaagatgaagaagaagaggaatccgagagctccgactcggaggaggagagggcgcatcgcctcgccgagctacaggaacagctgagggccgtacacgagcagcttgcagctctgtcccagggcccaatctcgaagccaaaacggaaaagagagaagaaggagaagaagaaaaagcgaaaagcagagaaacatagggggcgcgcaggtgccgatgaagacgacaaaggtcctcgggccccgcggccaccacagcccaaaaagagcaaaaaagcttccgggtctggggggggatctgcagcactgggaccttctggttttggcccatccggaggctcgggtacaaagcttcaggccggggtgcagtggagagacctcggtctcctgcagccgcctctgctgggattcaaacgatttagctgtctctcccttccctcctctcaagattaccggcttcctaagaaggcaaccaagactgcacccccagccctccccacaggctacgactcggaagaagaagaggagagcaggcccatgagctacgacgaaaagcgccagctgagcctggatatcaataagctaccaggagagaaactgggtcgggtagttcacataatccaggctcgcgagccatctctgagagactcaaaccctgaggaaatcgagatcgatttcgaaaccttaaagccctcaacactgcgagaattggaacgatatgttctgtcttgcttgcgcaagaaacctagaaaaccctatacaatcaaaaaaccagtgggcaagaccaaggaagagcttgccctggaaaagaaaagggagctggagaagcgtctgcaagacgtatccggacagctgaactccaccaaaaaacctcctaaaaaggcaaatgagaagaccgaatcaagcagcgcccagcaagtggctgttagccgcttgtctgctagcagctctagctctgattccagcagttctagtagcagttcttcatcatccgacacatcggacagcgattcaggatag

SEQ ID NO: 109998 - DNA, 2511 bp, Artificial Sequence
  Description of Artificial Sequence: Synthetic coding sequence
atgctgcaaaatgtaacgccacataataagttgccaggtgaaggcaatgcaggactcctgggacttggcccagaggccgccgccccaggcaagcgaattagaaagccatcattactttacgaagggttcgagagcccgaccatggctagtgtgcccgcacttcagctgacccctgccaaccctcctcctcccgaagtgagcaaccctaaaaagcccggccgagtgacaaaccagttgcaatatttgcacaaggtcgtgatgaaagcattgtggaaacaccaatttgcatggccattcagacagccggtcgacgccgttaagctggggctccctgattatcataaaataataaagcagcccatggacatgggaacgatcaaaaggaggctcgaaaacaattattactgggcagccagtgagtgtatgcaggattttaatacaatgtttaccaactgctatatttataacaagcctacagatgacatcgtgctcatggcacaaactctcgagaaaatattcttgcagaaagtcgctagtatgcctcaggaggagcaagaattggttgtcacgatcccaaaaaattcacataagaagggagcaaagttggcagctttgcaagggtccgtgaccagtgctcatcaggtgcccgccgtgtcttccgtgtctcacacagcgctgtataccccgcctcctgagatcccaaccactgtactcaacatccctcacccatcggtcattagtagccctctcctgaagtcactccattccgccggccctcctttgctcgctgtgacagccgcaccacctgctcaacctttggctaaaaaaaagggggtaaagagaaaggcggatacaacaacgccgacgccgacagcaatccttgcgcccgggtctcctgccagtccgccaggttccctggagcctaaagcagctagactcccacctatgcgacgcgagtcaggccgcccaatcaagcctccacgcaaggatttacctgattcgcagcagcagcaccagtctagcaagaagggaaagcttagcgagcagctgaaacattgcaatggcatcctcaaggaactcctgtccaaaaaacacgctgcttatgcatggcctttctacaagcctgtcgacgcctccgctcttgggttacatgactaccacgacatcattaagcatccaatggacctgtctactgtgaaacgaaagatggagaatcgggactaccgtgacgcccaggagttcgctgccgacgtgagactgatgttttctaactgttacaagtacaatccacccgatcacgatgttgtggcaatggcccgcaagctgcaagatgtcttcgaatttaggtatgctaagatgccggacgagcctctcgagcccggacctttgcccgtgtctacagcaatgccacccggcctggccaagtcttccagcgagagttcctccgaggagagttcaagcgaaagtagtagcgaggaggaggaggaggaggacgaagaggacgaggaggaggaggagagcgagtcgtctgacagtgaagaagagagagctcaccgtttggccgaacttcaagaacagttacgcgccgttcacgagcaattagccgctctctcacagggcccaattagcaaaccaaagcggaagcgagagaaaaaggagaaaaaaaagaaaaggaaggcggaaaaacaccgggggcgggcgggcgctgacgaagatgacaagggtccccgtgccccaaggcccccccagccaaaaaagtctaaaaaagcgtccgggtccgggggggggtctgccgcccttggcccatccggctttggcccgagcggagggtccggaacaaagctccaggcaggcgtgcagtggcgggatctcggcctgctccagccaccactgttaggcttcaagaggttttcttgccttagtctgccgagtagccaagactaccgcctccccaagaaggcaactaaaacggctcctccggcgcttccaaccggatacgattcagaagaggaggaggaaagtcgccccatgtcctatgatgaaaaacgccagctctctctcgatattaataagctgcccggagaaaagctgggcagggtggttcatatcattcaggcccgtgaacccagcctccgggatagtaaccctgaggagattgagatcgatttcgagaccctgaaaccatctaccttgcgcgagctcgagagatatgtcctgtcttgtctgaggaagaaaccccggaaaccctatacaatcaagaagcccgttggtaaaactaaggaggagctagctttggagaagaaaagggaattggagaaaaggttacaggacgtgtctggccagctgaactctaccaagaagcctcctaagaaggccaatgagaaaacagagtcatcgtcagctcaacaggttgctgtatctcgcctgtctgccagctcaagttcatcggactctagttccagcagctcttcctcttcctcgagcgatacatccgactctgatagcggctag

SEQ ID NO: 109999 - DNA, 2511 bp, Artificial Sequence
  Description of Artificial Sequence: Synthetic coding sequence
atgcttcagaatgtaaccccgcataacaaactacctggtgaaggcaatgcgggccttttgggattgggacctgaggcagccgctccggggaaaaggatccgcaagccgtctctgttatatgagggtttcgaatccccaacaatggcaagcgtgccagccttgcagttaactcctgctaatccaccgcctcccgaagtgagcaatccaaagaaacctggcagagttactaatcagctgcagtacctccacaaggtagtcatgaaggcgctttggaagcaccagtttgcttggcctttccggcagccagtcgacgctgtcaaattggggttgcccgactaccacaagattatcaaacagccaatggatatggggactattaaacgaaggctggagaacaattattattgggcagccagcgaatgcatgcaggactttaatactatgtttactaactgctacatatataacaaacccacagatgatatcgtccttatggcacagaccctggaaaagatatttctgcagaaggtcgcctccatgccacaggaggaacaggaattggtggtaacaattcctaagaactctcataagaagggcgcgaagctcgcagctcttcaaggcagtgtgacatctgcacaccaggtgcctgcagtgagcagtgtgtctcacacagcactttacacacccccccctgagatcccgacaacagtgctcaatatcccacatcctagcgtgataagcagccccctgctcaagtcactgcattccgcagggcctccactcctggctgttactgcagcacctccagcccagcctcttgctaaaaaaaaaggtgtcaaaaggaaggccgacaccacaacgcccactcctaccgccatcttagcaccagggtcacctgcatcgcctccggggtcactggagcctaaggcagcgcgcctccccccgatgaggagagagagtgggcgccctatcaaacccccacggaaagatctgccagattcacaacagcaacaccagtcctccaaaaagggaaagttgtccgagcagttaaaacactgtaacggcatcttaaaagaattactgtctaaaaagcatgccgcttacgcctggcctttttacaaaccagtggatgcgtccgccttggggcttcacgattatcacgacatcattaaacatcccatggatttatctacggtgaaacgaaagatggaaaaccgcgactatcgggacgcccaggagtttgccgcagacgtgcgcctaatgttctctaactgctacaagtacaaccctccggatcacgatgtggttgcgatggcacgcaagctgcaggatgtttttgagttcagatacgctaagatgcccgacgaaccactcgaacctgggccccttccggtgagcactgctatgccgcctggcctggcgaaaagctccagtgaatcctccagcgaagagtcgtcctctgagagcagcagtgaggaggaggaggaggaggacgaggaggatgaggaggaagaggagtctgaatcatccgattcagaggaagagcgagcacatcggctggcagaactgcaggaacagctcagagctgtgcacgaacagctcgctgctttgtcccagggacccataagcaaacctaaaaggaagcgggagaagaaggaaaaaaaaaaaaagcggaaagccgagaagcatcgcggcagggccggcgctgacgaagacgacaagggtccgcgcgcgcccaggccaccccagcccaagaagtctaaaaaggcctcgggttccgggggcggatccgcagccctcggccctagcgggtttggcccaagcggggggtctggtaccaagctgcaggccggggtacaatggagagatctcggcctgctgcagccccctctcctggggtttaaaagattctcctgcctgtctcttccatcctcccaggactacagactgccaaagaaggccaccaagacggctcctcctgctcttccaaccggatatgacagcgaagaagaagaggagagtcggccaatgtcctacgatgaaaagcgccagctgtctctggacatcaacaaacttcccggggaaaaactcggacgcgtggtccacattatccaggcgagagaaccgagtctgcgcgattccaatccagaggaaattgagatcgatttcgagaccctcaagccttccacattgagagagctcgaacgctacgtcttgagctgtctacgcaagaagcccagaaaaccctacaccataaagaaaccggtcgggaagacgaaagaggaactggcactcgagaagaaacgtgagctggaaaagcgcctacaggatgtctctgggcagctcaatagtactaagaaacctccgaagaaagctaatgagaagaccgagtcctccagcgcgcagcaagttgccgtctccaggctctccgcttcctcaagctcatccgatagctccagttcaagttcgtcttcatcatcctccgacacgtctgatagtgactctggttag

SEQ ID NO: 110000 - DNA, 2406 bp, Artificial Sequence
  Description of Artificial Sequence: Synthetic coding sequence
atgctgcagaacgtcactccgcataataaactccccggggagggaaacgctggtctgttggggctgggtccagaggcagctgcacccggaaagcgcataagaaagcccagcctgctgtacgagggcttcgaatcgccaaccatggcttccgtgcccgccctccagcttactccggctaaccctcctcctcctgaggtgtctaacccgaaaaagcccggtagggtaactaatcaacttcagtaccttcataaagtcgtgatgaaagccctatggaaacaccaatttgcttggccattcagacagcctgtggatgctgtgaagcttggcctacccgattaccataagattattaaacaacccatggatatgggaacaattaagaggcggttggagaacaattactactgggccgcgagcgagtgtatgcaggacttcaacactatgtttacgaactgctacatttacaacaaacccacagatgacatcgtgctgatggcacaaacgctggagaagattttcctccagaaggtcgcgagcatgccacaggaggaacaagagctcgtcgtaaccattccaaagaatagtcataagaaaggggcaaagctcgcagcccttcaaggtagtgtgacctccgctcaccaagtgcctgctgtgtcttcggtgagccacacggccctttatactccacctcccgagattcctaccactgtgctcaacattccccacccttccgttattagttcaccacttctgaaaagtttgcattcagcagggccccccctgcttgcagtaacagccgctccccctgctcagccactcgcaaagaaaaagggcgtaaagcgtaaagcagatactacaaccccgaccccgaccgccatcctggcacccggaagcccagcctcaccacctggaagcttggagcctaaggctgctaggctaccgccaatgcgaagggagagcggtcgccctattaagcctcctagaaaagacctgccagactctcagcagcagcaccagagtagcaaaaaagggaagctctccgaacaactgaaacactgtaacggaatcctaaaagaactcctgtccaaaaagcatgcagcctacgcctggccattttacaagcccgtggacgcttctgccctgggcctgcatgactatcacgacattataaagcaccctatggacctttctaccgtgaagaggaaaatggagaatagggactatagggacgcacaggagttcgccgcagatgtgaggttgatgttttctaattgttacaagtataaccctcccgaccatgatgttgtcgcaatggcaaggaagctgcaggatgtttttgaattccgatatgccaagatgcctgatgaacccctcgaaccaggtccactaccagtatcaacagcaatgccgccagggctagccaaatctagcagtgagagttccagtgaagagagttcttcagaatccagttccgaagaagaagaagaggaagacgaggaggatgaggaggaggaggagagcgaatcatcggattccgaggaagagagggcccacaggctggcagagctccaggaacagctgagggcagtccacgagcaactagctgccctgagccagggcccaatctctaagccgaaacggaagcgggagaagaaggaaaagaagaagaagcgtaaagccgaaaaacaccgcggaagggccggagctgatgaagacgacaagggcccacgggcaccgagacctccacagccgaagaaaagcaagaaggcttctggctctggcgggggcagcgccgccctgggcccttcgggatttggtccttccggagggagcggaacaaaactgcccaagaaggcgaccaagaccgccccccccgccctaccaaccggttacgatagcgaagaggaggaggaatcccgtcccatgagttatgacgaaaagcgccagctgtccttggatatcaataagttgccaggcgaaaagttgggacgggtcgtccacattatccaggcaagggagccatcactgcgcgacagcaatcctgaagagattgagattgacttcgaaacccttaagcccagcacactgcgggagctggagagatacgtattatcttgcctacgcaagaaacctaggaagccttataccatcaaaaaacccgttggtaagacaaaggaagagctcgcactagaaaagaagcgggaactcgagaagcgcctccaggacgtgtcaggtcagctgaacagcactaaaaagccaccaaagaaagccaatgagaaaacggagtcctcgtccgctcagcaagttgccgtgagccggctgagcgctagcagctcaagcagcgacagttcctctagttcttcttctagctccagcagtgatacttcggatagcgactctggttag

SEQ ID NO: 110001 - DNA, 2406 bp, Artificial Sequence
  Description of Artificial Sequence: Synthetic coding sequence
atgcttcagaacgtgacccctcacaacaagctccctggagaagggaacgcaggactgctgggattgggacctgaggcagctgctcctgggaagcgaatcagaaaaccaagcctcctgtacgagggttttgaatctcctacaatggccagtgtaccagccctccaactgacaccggccaacccacctccgcccgaagtctccaatcccaaaaaaccggggagggtgacgaatcagttgcagtacctgcataaggtggtaatgaaggccctgtggaaacatcagttcgcatggcctttcagacagccagttgacgccgtgaagttaggcctcccagactaccacaagatcattaagcagcctatggacatgggcaccatcaaaaggagactcgaaaacaattattattgggcagcctcagaatgcatgcaggattttaacaccatgttcacaaactgctatatctacaacaaaccaacagacgacattgtcctgatggcccagactcttgaaaagatctttctgcagaaagtggctagcatgccacaggaggagcaagagctcgttgtgactattccgaagaactctcacaaaaaaggggcgaagctcgccgctttacaggggagcgtcacctctgctcaccaggtgcctgccgttagttcagtgtcgcataccgctttatatactcccccccctgagatccctacgaccgtcctgaacatcccccaccccagcgtgatctcgagccccctgctcaagtctctacatagtgccgggccacctctgctcgccgtgacagccgcacctccggctcagcccctggcaaagaagaagggggtgaaaaggaaggcagataccacaacaccgacgccaaccgcaatacttgccccgggatctccggctagtcccccgggcagtctggagccaaaggctgctcggctgcctccgatgcgacgcgagtctggacggcctataaagccacctcggaaagacttgcctgatagccagcaacagcaccagagctctaagaaaggcaaattgtctgagcagctcaagcattgtaatgggatcttaaaggagctgctgagtaaaaaacacgccgcctatgcatggcccttctataagccagttgacgctagcgccttaggattacacgattaccatgatattatcaagcaccctatggacctcagtacagtcaagcggaagatggagaacagagattaccgggacgctcaagagttcgccgcagacgttaggttgatgttttctaactgttataagtacaatccgccagaccacgacgtggtggcaatggcacgaaagctccaggacgtgtttgagttccggtatgcgaagatgccggatgaacccctcgagcccgggcctttgccagtctctacagctatgcccccgggactggctaagagttcaagtgagtcgtcttctgaagaatcttctagcgagagcagcagcgaagaggaagaggaggaggacgaggaagatgaggaggaggaagagtccgaatcctctgatagtgaagaagaaagggctcacaggttggccgagcttcaggaacaacttagggctgtacatgagcagctggctgccctgtcccaaggccccatttcaaaacccaagaggaagagagagaagaaagagaaaaagaaaaaaagaaaggctgagaagcatcgtgggagagccggcgccgacgaagacgacaaggggccacgcgctcctcgaccgccacagcccaaaaagtcaaaaaaggcctccggtagtggaggaggcagtgcggccctcggcccttccggcttcggaccatcaggtggaagcgggactaagcttccaaaaaaggctaccaagactgcaccaccagctctaccaacaggctatgactcggaggaggaggaggaaagtcgaccaatgtcttacgacgaaaagagacagctttccctggacatcaacaaactccccggcgagaaactgggccgggtggtccatatcattcaggctcgggaacccagtctccgggactctaacccagaggaaatcgagatcgattttgagaccttaaaaccctccacacttcgggagctggagcgctatgtgttgtcctgtcttcggaagaagcctaggaagccctatacaattaagaagcctgtgggtaagacaaaggaagaattggcgctcgagaagaaacgcgaactggaaaagagacttcaagatgtttcaggccagcttaacagcactaagaagccacctaaaaaagccaacgaaaagactgagtcttcgagcgcgcagcaggtcgccgtttcccggctgtccgcctctagttcaagttctgacagctccagttcttctagcagttctagttctagcgacacctccgacagtgattcaggatag

SEQ ID NO: 110002 - DNA, 891 bp, Artificial Sequence
  Description of Artificial Sequence: Synthetic coding sequence
taacgaccccttggagttcagcaacctggcgctcgcctccccggcgagggcaacgccggccttttgggcctaggtcccgaagctgcggcaccgggcaagcgaatccgtaaaccttctttgctgtatgagggctttgaatcacccacaatggcctcagtcccagctttgcagctcactccagcaaatcccccaccacctgaagtctctaaccctaagaaaccaggtcgagtcaccaaccagcttcagtacctgcacaaggtggtcatgaaagccctttggaagcatcaatttgcctggccctttagacagcccgtggacgcagttaagctcggtttgcctgactatcacaagatcatcaagcagcctatggacatggggacaattaaaagaagactggaaaacaactattactgggccgccagcgagtgcatgcaagacttcaacaccatgtttacaaattgctatatttacaacaaaccaaccgatgatatcgtgctaatggcacagaccctggaaaagatttttcttcaaaaggtggcatctatgcctcaggaagagcaggaactcgtcgtgacaatcccgaagaattcccacaagaaaggcgctaagctggcagcacttcagggttcagtgacatcagcgcatcaggtgccggccgtgagttctgttagccacactgctctgtatacacctccaccagagatcccaaccacagtcctgaatatcccacatccttccgtgattagcagtcccctgctcaaaagcctgcatagcgctggaccacccctattggccgtaaccgccgcccctcccgctcagccactggcgaagaaaaaaggcgtgaaacgcaaggcggacaccactaccccaacacctaccgccatcctttag

SEQ ID NO: 110003 - DNA, 2406 bp, Artificial Sequence
  Description of Artificial Sequence: Synthetic coding sequence
atgttgcaaaacgtgacgcctcacaacaagctgcctggcgaaggaaatgccggcctgcttggattaggcccggaggccgctgctcctgggaaaagaatccgcaagccaagtctgttatatgaggggtttgaatctcccacgatggcctccgtgccggcgctgcaattgactcctgccaatcccccaccacctgaggttagcaaccctaaaaagcctggacgcgtgactaaccagctgcagtacctccataaggtcgttatgaaggcactgtggaagcatcagtttgcttggcccttccggcagccggtcgatgccgtcaagcttggcctcccggactatcataagattattaaacaaccaatggacatgggaactattaaaaggcgacttgaaaacaactattactgggccgcaagtgagtgcatgcaggactttaacacaatgtttacaaactgttacatatataataaaccaacagatgacatagttcttatggctcagacattggaaaaaatatttcttcaaaaggtcgcctctatgccccaggaagagcaagaactcgtcgtcactatccccaaaaacagccacaaaaaaggggccaaactggctgcattgcaggggtccgtgacgagcgcccatcaggtccccgccgtgtcaagtgtgtcacatacagcactgtacactccacctcctgaaatccctacaacagttttcaacattcctcatccaagtgttatctcgtcgcccttactgaaaagtttgcatagcgccggaccacctctgcttgcagtgacagcggccccccctgcacagccgttagcaaaaaaaaagggcgttaagcgcaaagctgacacaaccaccccaaccccaactgctatccttgccccgggaagccccgccagtccacccggttctctcgagcccaaagccgcccggcttcccccaatgagaagagagagtggtaggcctattaagccacctaggaaagacctccctgactctcaacagcagcatcagtcttctaagaaggggaaactctctgagcaactcaaacactgtaatgggatcttgaaggaactactcagcaagaaacacgcagcctatgcatggccattttacaaacctgtcgacgccagtgccctcgggcttcatgattaccacgacattattaaacatcctatggatctctcgaccgtgaaaaggaaaatggaaaacagagattatagagacgcgcaagagttcgcagccgacgtgcgccttatgttctccaattgttacaagtataatccacccgaccacgacgtggtggcaatggcccgcaaactgcaggacgtgttcgagtttagatacgctaagatgcccgacgaaccgcttgagccaggccccctccccgtgtccacagccatgccccccggcttggcaaagtctagttctgagagcagcagcgaggagagcagctcggaatcaagcagtgaagaggaggaggaagaggacgaggaggacgaagaggaggaagaatcagagtcctctgattctgaagaagagcgagcccaccgattggctgagctgcaggaacaactacgcgccgttcacgaacagctagcagcgctgagtcaggggccgatatccaagcccaagagaaaaagagaaaagaaggaaaaaaagaagaagcgaaaggctgagaaacaccgcggccgggccggcgctgatgaagacgataaggggccccgtgccccccgaccaccacagcccaagaagtccaagaaggcttctggatccgggggaggaagcgctgctctcggcccgtccggattcggaccttctggtggcagcggaacaaagttacctaagaaagcaacaaaaaccgcgcccccagccctaccaacaggctacgactccgaggaagaggaagagagtcggcccatgtcttacgatgaaaagcgccagctcagtttggatatcaacaagctgcccggggagaaactggggcgagtggtgcatatcatacaagccagggagccatcactgagggactcaaaccctgaggaaattgaaatcgattttgaaacattaaagccatcaaccctgcgagagctcgaaaggtatgtgctctcttgtctgcgaaaaaaaccccgcaagccgtatactatcaagaagcctgttggcaaaacaaaggaggagctcgctctggagaagaaacgcgaactggagaagcgtctccaggatgtgtctggccaactcaactctacaaagaagcctcctaagaaagctaacgagaagaccgagagctctagcgcccaacaggttgcagtctctcggctgtctgcatctagcagttcgtccgacagcagtagttcatcctcgagcagtagtagtagcgacacgagcgactcagatagcgggtag

SEQ ID NO: 110004 - DNA, 1842 bp, Artificial Sequence
  Description of Artificial Sequence: Synthetic coding sequence
atgctccaaaatgtgactccccataataaactccccggagagggcaacgccgggctgctgggattgggcccggaagccgctgcacccggcaaacgaattcgaaagccctccctactttatgagggtttcgagagtcctactatggccagcgtccctgctctgcagctcacaccggcaaatccgccccccccggaagtgagcaaccccaagaagcctggaagagttaccaaccaactgcagtacctgcacaaggtggtgatgaaggcgttgtggaagcaccagttcgcgtggccatttaggcagcctgtcgatgctgtgaaattgggtctccctgactatcacaaaatcattaagcagccgatggatatgggaaccatcaaacgccggctggagaataattactattgggccgcatccgagtgtatgcaggatttcaacacaatgttcacgaattgctatatctataataagcctacagatgatattgtgttgatggcccagactctcgagaagatcttcttacaaaaagtggcctccatgcctcaggaggaacaagagctcgttgtgaccatccccaaaaacagccataagaagggcgctaagttggctgctctgcagggcagtgtcacgtccgcacaccaggtcccggcagtgagttcagtgtctcacaccgcgttgtatacaccgcctcccgaaattccaacaacagtcctcaatattccacatccctccgtcattagctcaccactgctaaagtcactgcattctgccggccctcccctgctagcagtgacagccgcaccccccgcccagcccctcgccaaaaaaaagggcgtcaaacgcaaggcagacactacgacacctacacctaccgcaattttggctccggggagtcctgcatcccccccagggtccctcgagcccaaagccgccagactgccaccaatgaggagagagagcggaaggccaatcaaaccccccaggaaagatctgcccgatagtcagcagcagcaccagtcaagcaaaaaaggcaaattgagcgagcaactgaaacactgcaacggtatccttaaggagctcctttctaaaaagcacgccgcttacgcctggcccttctacaagcccgtggatgcctccgcacttggtctgcacgattatcacgacattatcaagcatccaatggacctctccaccgtgaagaggaaaatggagaatagggattatagagacgcccaggaatttgcagctgatgtgaggctgatgttctcaaactgttacaaatataaccccccagatcacgatgtggtggctatggcaaggaagcttcaggatgtcttcgaatttaggtacgccaagatgcccgatgagcctctggagcccggacctcttcccgttagtaccgcgatgcctcccgggctggctaagagttccagcgagtctagttccgaagaatcttcttcagaaagctcctccgaggaggaggaggaggaggacgaggaggatgaagaggaggaggaaagcgagtcaagtgacagcgaggaggagcgcgcccatcggctcgctgagttacaggagcaattacgcgcagtacacgaacaactagcggccctcagccaagggcccataagcaaaccgaagaggaaaagagaaaagaaggagaagaagaagaagagaaaagcagaaaaacaccgtgggcgcgccggagccgacgaggacgacaagggtccccgagcgcccagacccccccaacctaaaaaatctaagaaggctagcgggtcagggggtggctctgccgcacttggcccctcaggtttcggtcccagcggtggcagtgggacctag

SEQ ID NO: 110005 - DNA, 1842 bp, Artificial Sequence
  Description of Artificial Sequence: Synthetic coding sequence
atgctccagaatgtgactccccataataaactgccaggcgaaggcaacgcgggcctgcttggtcttgggccagaagccgccgctcccggaaaaaggatccgcaagccgtctctcctgtatgagggcttcgaatctcccacaatggctagcgtgcccgctttgcagctgacccctgcaaatccacctccaccagaggtgagcaaccctaaaaaaccgggaagagttaccaatcagctgcagtatctccacaaagtggtgatgaaggcactctggaagcaccagtttgcctggccctttagacagcctgtggatgctgtaaagttggggcttcccgactaccacaagattatcaagcaacctatggacatgggcacaatcaaaaggcgactggaaaataattactactgggcagcctctgaatgcatgcaagactttaataccatgtttaccaactgttatatttataacaagcctactgacgacattgtgctgatggctcaaaccctcgagaaaatttttcttcaaaaagtggcatctatgccgcaggaagagcaggaattggtggtgacaatcccaaagaactcgcataagaagggcgcgaagttggctgcactgcagggatcagtgacatctgcgcaccaggtgcccgctgtgtcatctgtgagccatactgcactgtacacaccacccccagagataccaaccacagtgctgaacattcctcacccatccgtgatttccagtccccttctcaagtctctccattcagcaggacccccgctgcttgcggtaacagcagccccccccgcccagcccctcgcgaaaaagaagggggtgaaacgcaaagccgacacgactactcctactccaaccgctatcttggcccctgggagccctgcctctcctccaggaagtctcgaaccaaaagcagcacggctgcctcctatgaggcgcgagtctggaaggcccattaaacctccgcgcaaagacctgccggactcccagcaacagcatcagtcttctaagaaaggaaagctcagcgagcagctgaagcactgtaatggaatcttgaaagaacttctaagtaagaaacatgctgcgtacgcttggccattctacaagcctgtggatgcgtcagcactcggactccacgactaccatgacataattaaacaccctatggacctgagcaccgtgaaaagaaaaatggagaatcgggattatcgcgacgctcaagaatttgctgccgatgtccgcctgatgttctccaattgctataagtacaatcctccggaccatgatgttgtggcaatggcccggaagctgcaagacgtgttcgagttccgctatgcaaaaatgcctgacgaacccctcgaacctgggccacttcctgtatccactgccatgccacccggcctggctaagagttcgagcgagtccagcagtgaggagtctagtagtgaatcttcatcagaggaagaagaagaggaggatgaagaggacgaagaggaggaggagtcagagtcgtcagactcagaagaagagcgagcacaccgactcgcggagctgcaagaacagctgcgggcagtacacgaacagctggctgctctctcccagggcccaattagcaagcccaaaagaaagagggaaaaaaaggagaagaaaaagaagcggaaggccgagaagcatcgcggacgggccggtgccgatgaagatgacaaggggccccgcgcccctaggcctccacagccaaaaaaaagcaaaaaggccagcgggtcaggcggaggctccgcagcactggggccctctgggttcggaccttccggaggatctggtacttag

SEQ ID NO: 110006 - DNA, 987 bp, Artificial Sequence
  Description of Artificial Sequence: Synthetic coding sequence
taagctaaaagctcttcagaatcatcaagcgaggagtccagtagtgagtcatcctctgaggaggaagaggaagaggatgaagatgaagaggaggaagaatctgagtcatcagactctgaagaagaaagagctcacagactggccgagctacaggagcagcttcgagctgttcacgagcagttggctgcactcagccaaggccccatctctaagcccaagagaaagcgcgagaagaaggaaaaaaaaaagaaacgcaaagcagagaaacatcgagggcgagccggggctgatgaagacgataagggaccaagagcccctcggccgccccagcccaaaaagagcaagaaggcctccggctccggcggcggctccgccgcgcttggaccctccggcttcgggcccagcggaggatctggcacaaagctgcccaaaaaagcaacaaagactgcacccccggctctgcctacgggctacgactcggaagaagaagaagagtccaggcccatgagctatgatgagaaacggcagctgtctttggatattaataagttgcccggcgagaaactagggcgcgttgttcatatcatacaggcaagggagcctagcttgagggatagcaatccagaggagattgagatcgatttcgagactctgaaaccatcgaccttgagagagctggagaggtacgtcttgtcctgcctacggaagaaaccgaggaagccatatactatcaagaagcccgtcggcaaaacaaaagaagagctggcactagagaaaaaacgagaacttgagaagagattgcaagatgtcagtggacaactgaactcgaccaaaaagccccccaagaaagctaatgaaaaaacagagagctcatcagcacagcaggtcgcagtgtcaagattaagcgcgagcagctcttccagcgactcttctagtagcagcagctcttccagttcatctgatacctcagattccgactctggatag

SEQ ID NO: 110007 - DNA, 1947 bp, Artificial Sequence
  Description of Artificial Sequence: Synthetic coding sequence
atgttgcagaatgtgactccgcacaacaaactgccaggtgaggggaacgctggcctgctggggcttggcccagaggcagcagcgcctgggaaaagaattcgaaagccgtcattgctgtatgaggggttcgagagccccacgatggcctcagttccagcactgcagctgacacccgcaaatccccctccacctgaagtatccaaccccaaaaaacctggacgcgtgaccaaccaactccagtacctgcataaggtagtgatgaaggctctctggaaacaccagttcgcatggccctttaggcagccagtggacgcagtcaagcttggcctccctgattaccacaaaatcatcaaacagcctatggatatggggacaatcaaacgccgcctcgagaacaactactactgggccgcctccgaatgcatgcaggatttcaacaccatgttcactaactgttatatctacaacaagcctaccgacgatatagtattaatggcccagactctcgagaagatctttttacagaaagtagcctctatgccacaagaagaacaggagcttgtggttaccatcccaaaaaacagtcacaaaaagggggcgaagctcgctgcacttcagggatctgttactagtgcccatcaggtgccggctgtgtcaagcgtatctcacactgcgctttacactccccctcccgaaatcccaacgactgtactgaatattccgcatcccagcgtgatctcgtcaccgctcctgaagagtcttcacagcgccggacccccattactcgcagtgacagcagccccccctgcccaacctctcgccaaaaagaagggagtaaaacggaaagccgacaccactactcccactccaacagccatcctcgcccctgggtccccagccagtccacctggttctctcgagccaaaagcggcgagactgccccccatgagacgtgaatctggccgcccaattaaacctccacgaaaggacctgcctgattcacagcagcagcatcaatctagcaagaagggaaagctgtcagagcagcttaagcactgtaacggaatcctaaaggagttattgagcaagaaacacgcggcatatgcctggcccttctataagcccgtagatgcaagtgcactcgggctccacgactaccacgacattatcaagcatcccatggacctgagcaccgtgaagaggaagatggaaaaccgggactatcgggacgctcaggagttcgccgcggatgtgcggctgatgttttcaaattgctacaagtacaatcctcccgatcacgacgtagtcgcaatggcacgcaaacttcaagacgtcttcgagttccgatatgcgaagatgcctgatgaacccctggagcccggcccattgcccgtgtccaccgcgatgccgcccggtttggcaaagtcatcgtctgaatcctcaagcgaggagtcatccagtgaatcatcctcggaggaggaggaagaggaggatgaggaggatgaggaagaagaggaaagcgaatcaagcgacagcgaggaggaacgggcccacaggcttgctgagcttcaggagcagttaagagccgttcatgagcagctggcggctctgtcgcaggggcctattagtaagccaaaacggaaacgcgagaaaaaggaaaaaaagaaaaagagaaaagcagaaaaacacaggggccgtgccggagcggatgaggatgataagggtcctagggcacctaggccaccccagccaaaaaagtccaagaaagctagcggtagtggaggcggatcagcagctctcggaccaagtggcttcgggccatccggagggtctggtaccaaactccaggcgggagtgcagtggagagacctaggtctcttgcagcctcccctgctggggttcaagcggttctcctgcctgagccttccaagttcccaggactactag

SEQ ID NO: 110008 - DNA, 2424 bp, Artificial Sequence
  Description of Artificial Sequence: Synthetic coding sequence
taaaacggcggcggtggctccgccacagcccgcggtggagagtatcgtctccctggagaaggcaatgcagggcttctggggttaggaccggaggccgccgccccaggcaagcgaatccgcaagccatccctgctgtacgaaggcttcgagtcccctaccatggcatctgtgccggctctccaactcaccccggcaaacccccctcctccagaggtcagtaacccaaaaaagccgggtcgtgtaaccaaccaactccaatacttacataaggttgtcatgaaagctctctggaagcatcaatttgcctggccatttcggcagcccgtggacgccgtaaagctgggcttacccgattatcacaagatcatcaagcagccaatggacatggggacaattaagcgcaggctcgagaataattattactgggcagcgtccgagtgtatgcaggactttaacacaatgttcacaaactgctatatctacaacaagcccaccgacgatattgtcctgatggctcagactctggaaaagatttttctgcagaaggttgccagcatgccccaggaagaacaggaattggttgtgacgattccaaaaaactcccacaaaaagggcgccaaattggctgcactacagggaagcgtgacctccgcccaccaggtgcccgcagttagcagcgtatcacatactgccctgtatactccgcctccggaaattcctactaccgtatttaacatccctcacccttctgtgatttcttcccccctcttgaagtctttgcactctgctggcccccctctactggccgtaactgcagccccgccggctcaaccgttggctaaaaaaaaaggtgtgaaacgcaaagcagatacaaccaccccaacccccacggccatcctggctcccgggtcccctgcatcccctcccggttcactagagccaaaagctgcacgtctcccccccatgcgccgggagtctggtcgcccaatcaaacccccgaggaaagatctccccgattctcagcaacagcaccaatcctctaaaaaaggcaaactgagcgagcagttaaaacattgtaacgggatcttgaaggagttgttatctaagaagcacgccgcctatgcatggcctttctacaagcccgtggatgctagcgcactgggcctgcacgactaccacgacattatcaagcatccaatggacctctccacggttaagaggaaaatggaaaaccgtgattatcgcgacgcccaggagtttgccgctgatgtccgcctgatgttctctaattgttacaagtacaacccaccggatcacgacgtggttgccatggcccgtaagcttcaggacgtcttcgagtttcgctacgcaaagatgcctgacgagcccttggaacctggcccattgccagttagcactgcgatgcccccaggtcttgcgaagagctcatctgagtcctcctcagaggaatccagtagcgagagcagcagcgaggaggaagaagaagaggatgaggaggacgaggaagaagaagaaagcgaatcctcggattctgaggaagagcgggcccatcgtcttgccgagcttcaggagcagctgagggcagttcacgagcagcttgcagcactgtcacagggacccatctcgaaacctaagcgcaagcgagaaaagaaggagaagaaaaaaaaacgaaaagctgaaaagcatagaggacgcgccggcgccgacgaggacgacaaaggaccacgcgccccgagacccccccagccaaagaaatccaagaaagcctccgggagcgggggaggctcagctgcccttggtccatccggctttggaccatctggggggagtggaactaaattgccaaagaaagccaccaagactgcacctcccgcgctccctaccgggtatgatagtgaggaggaggaggagtcacgcccaatgagttacgacgagaagaggcagttgagtttggacatcaataagctccctggcgagaaactgggaagggtcgtgcatattattcaggccagagaaccttccctgcgcgattctaacccagaagagatagaaatcgatttcgaaacactcaaaccgagtaccctccgagagctcgaacggtatgttctctcctgcctgagaaaaaagcccaggaagccctataccatcaaaaagccggttgggaaaacaaaggaagaactggcactagagaaaaagcgggaactggaaaagagactgcaggatgtttctggacagctcaattcaacgaagaaaccaccgaagaaagctaatgaaaaaactgagtcctcatccgcgcagcaggtggctgtgtcccgcctgagcgcgtcttcatcaagctcggacagtagctctagcagcagctcatcatcttcatctgatacctcggatagtgattccggatag

SEQ ID NO: 110009 - DNA, 891 bp, Artificial Sequence
  Description of Artificial Sequence: Synthetic coding sequence
tgacggccccttggagtccagcagcctggcgcacgtttgccgggggaaggtaatgccggcctcctgggacttggtcccgaagcagccgcacctggaaagcgcattaggaagccttcactactgtacgaagggttcgagtccccaacaatggcctccgttccagcgctgcagctgacccccgctaaccccccacctccagaagtgtcaaacccaaagaaacccggtcgcgtaactaatcagctccaatatttgcacaaggtcgtcatgaaagccttgtggaagcaccagttcgcatggcccttccggcaacccgtggacgccgtgaagttgggcttgccggattatcacaaaattattaaacagccgatggacatggggactatcaagcgccgcctggaaaacaattattactgggcggcctccgaatgcatgcaggattttaataccatgttcaccaactgctacatctacaacaaaccgacagacgatatagttctcatggcacaaaccctggaaaagatcttccttcaaaaggttgcaagcatgccccaggaagaacaagaactggtggtgactatccccaagaatagccacaagaagggagcaaaattggccgctctgcagggatcggtgacttccgctcaccaagtacccgccgtctctagcgtctcgcataccgctttgtacaccccccctccagagataccaactactgttttcaatattccccatccgtcagtgatcagttccccactgctcaagtcattacacagcgccggaccacccctgctggcggttacagccgctccacctgctcagcccttagcgaagaaaaagggggtgaagcggaaagctgatactactacacccactcccactgctattttgtag

SEQ ID NO: 110010 - DNA, 2265 bp, Artificial Sequence
  Description of Artificial Sequence: Synthetic coding sequence
atggcgtctgtgcccgctctgcagctgacacccgccaatcctcctccacccgaagtgagcaatcccaagaaaccaggacgtgttaccaatcagctccaatatcttcacaaggtggtcatgaaagctctctggaaacatcagttcgcctggccattcaggcagccggttgatgccgttaagctggggcttcctgactaccataaaattatcaaacagcccatggacatggggactataaaaagacgtcttgaaaacaattactattgggcagcctccgagtgtatgcaggatttcaatactatgtttaccaattgctatatatataataagcccacagatgacattgtcctgatggctcagaccctggagaaaatatttttgcagaaggtcgcttccatgcctcaggaggagcaggaactggtggtgactattccaaaaaacagtcacaagaaaggtgcgaagctggcggcactgcaagggtccgtgaccagcgcacaccaggtccccgccgtcagctctgtatcccacacagccctgtataccccacctcccgaaatccctactaccgtcttgaatatcccccacccctctgttatctctagcccactgctaaagtccttgcactccgctggccctcctctgcttgccgttaccgccgctcccccagcccagcccctggcaaagaagaaaggagtgaagaggaaggccgatactaccaccccaacccctacggccattctggccccgggttctccagccagccccccaggttccctggaacctaaggccgcgcggcttccccccatgcgccgagagagcggacgcccaattaaacccccacgcaaagacctccccgactcccagcagcagcaccagtcaagtaagaaggggaagctgtctgagcagctcaaacattgcaatggcattctgaaagaactgctgtcaaagaaacacgccgcttacgcatggccattctacaaaccagtggacgcatctgccttaggactgcatgattaccacgacatcataaagcatcctatggacttgagtaccgtgaagcgtaagatggagaaccgagactaccgcgacgcacaggaattcgccgccgacgtcagactgatgttttcaaattgttacaaatataacccaccggatcatgatgtggtcgcaatggctcggaagctccaggatgtctttgaattccgatatgctaaaatgcccgatgagcccctggagcccgggcctctccctgtgtcaactgctatgcccccaggcctggctaaatcttcctccgaatcgtcatccgaagagtctagctccgagtcttcctcagaggaagaggaagaggaggatgaagaggacgaggaggaagaggagagcgaatcgtcggacagcgaagaagagcgtgcacatagattagcggagttgcaagaacagctgcgcgctgtgcacgagcaactggccgctctcagtcaggggcccatctcaaagccaaaaaggaaacgtgaaaagaaagaaaaaaaaaaaaagcgcaaagccgagaagcacagaggcagagccggtgctgacgaagacgacaaaggcccaagagcccctcgaccaccccagcccaagaagtctaagaaagcgtcaggctctggagggggaagtgctgccctgggaccatctggtttcggtccatcgggggggagcggcaccaagctgccaaagaaggcaacaaagaccgcacctcccgctcttcccactggctatgattccgaagaagaagaagagtctaggcccatgtcctacgacgaaaagaggcaactgagcctggacattaacaaacttcccggggagaaactaggaagggtggtgcatatcatccaagcacgcgaacccagcctgcgagacagcaacccagaagagatcgagatcgattttgaaactctgaaacccagcactttgagggaacttgaaagatacgttctcagctgcctgaggaagaaacccaggaaaccctacaccatcaagaagcctgtcggcaagaccaaagaggaattagcactggaaaaaaaaagggaacttgaaaagaggcttcaagacgtgagtggccagctgaactccacaaaaaaacctcctaaaaaagccaacgaaaaaactgagtcctcctccgctcaacaggtggctgtgagcaggctcagtgcatcctcctcatcctccgattcatcgagctcatcctcctcaagctctagtagcgatacgagcgactctgactctggatag

SEQ ID NO: 110011 - DNA, 2406 bp, Artificial Sequence
  Description of Artificial Sequence: Synthetic coding sequence
atgctgcaaaatgtcacacctcacaacaagctcccaggcgagggcaacgccgggctgctgggccttggtccagaagcggctgcacctggaaagcggatccgtaaaccctctctgctgtacgaaggctttgaatctccaacaatggcatcggtgcctgcactacagcttactcctgcaaacccccctcctcccgaggtctcgaatccaaagaagcccggccgcgtgaccaaccaactgcaatatctacacaaagttgttatgaaagctttatggaagcatcagtttgcgtggcctttccgccagccagtggatgcagtcaagctggggcttcctgactaccacaagatcatcaaacagcctatggatatgggaaccattaagcgacggctggaaaataactattattgggccgctagtgagtgcatgcaagactttaatactatgttcactaactgttacatttataacaagcccaccgatgatatagtgttgatggcccaaacgttagagaagatattcctccaaaaggttgctagtatgcctcaagaagaacaggagctggtagtcacaatcccaaagaactctcataagaaaggggccaaacttgcagccctgcagggatctgtgacgtccgcccaccaggttccggctgtgtcttccgtgagccatacagctctttataccccaccccccgagatccctaccaccgtactaaacattccccacccatccgtcattagctctcctctgctgaaaagccttcattctgccggtccccccctgctagccgtgactgcagcaccaccagctcagccattagccaaaaagaaaggggttaagaggaaggcagatactactacaccaactccaactgcgatcttggccccagggtcacctgcctccccaccaggttccctagaacccaaagccgcaagactgcctcccatgaggcgagaaagcgggaggcccatcaagccacccagaaaggatctgcctgacagtcagcagcagcatcagagctccaagaaaggcaaattgagtgagcagctcaagcactgtaatggtatcctcaaggagctgctatctaagaaacacgctgcgtacgcgtggcctttttataaaccagttgatgctagcgcgcttggacttcatgattaccatgacattataaagcaccctatggacctgtctacggtgaagcgcaagatggaaaatagggattaccgggacgctcaggagttcgccgcggatgtgcgcctgatgttctccaattgttataagtataacccgccagatcatgacgtggtggcgatggctagaaagcttcaagatgtgtttgaatttcggtacgccaagatgcccgatgaaccccttgaacccggaccactgccagtgtcaaccgcgatgcccccaggccttgcgaaatcaagcagcgagagcagtagcgaagaaagcagttcggaatcttcttcagaagaggaagaggaagaggacgaagaagacgaggaggaagaggagtctgagagttcggattccgaagaggaacgagcacaccgcctcgccgagcttcaggagcagttaagagctgtgcatgagcagctcgccgcgctttctcaaggacctattagcaagcccaaacgaaagcgggaaaaaaaggagaagaagaaaaaaaggaaggctgaaaagcatcgggggcgggcaggggcagacgaggacgacaagggtcctcgggctcctcggccgcctcagccaaaaaaatctaaaaaggcaagcggtagcggaggcggcagcgctgccctcggaccgtctgggtttggcccttccggtggcagcggcacaaaattaccaaagaaagctaccaagacagcgccacccgctttacccaccgggtatgactcagaggaggaggaagagagcaggcccatgtcctacgatgagaaaagacagctgagcctggacattaacaaattaccaggggagaagctagggcgggttgttcatataatccaggcacgtgaaccatctctgagagatagcaatcccgaggagatcgaaatcgactttgagaccctgaaaccaagtacactcagggaactggaacggtatgtgctctcatgtctgaggaagaagcccagaaagccttataccattaaaaaaccggtaggcaaaacaaaagaggaattagctctcgaaaagaagcgcgagctggagaagcgattgcaggatgtcagcggccaactgaactccactaaaaagcctcccaagaaggctaatgagaaaacagagagtagttccgcccagcaagtggccgtgtcacgattgtctgccagcagctctagctccgacagctccagctcatcaagctccagcagtagctcagacactagtgactctgactcgggctag

SEQ ID NO: 110012 - DNA, 2424 bp, Artificial Sequence
  Description of Artificial Sequence: Synthetic coding sequence
tgaaatggcgggggtggttcggctacagcgagaggcggagaatacaggctccccggagaaggaaacgccggcttacttggcctggggccggaagcggcggccccagggaagagaattcgaaaacccagcttgctctacgaaggctttgaatcaccaacgatggcctcggttcctgctctgcagcttaccccagcaaatcccccaccccccgaagtgtccaaccccaagaaacccggccgagttaccaaccagcttcaatatttacacaaggtggtgatgaaagcattatggaagcaccagttcgcatggccgttccgacaaccggtcgatgcagtgaagttggggttgcccgattaccacaagattatcaagcagcccatggatatggggaccattaagcggcggctcgagaataactattattgggctgcttctgaatgcatgcaagatttcaataccatgttcacaaactgctatatatataacaagcctaccgacgatattgtgcttatggcccagacactcgaaaaaatatttctgcagaaagtcgcgagcatgcctcaagaggaacaggaactggtggtgacgatccccaaaaatagtcacaagaaaggagccaaactggcagcacttcaggggtccgtgacgtctgctcatcaggtgcctgcggtctcctcagtgtctcacaccgccctctataccccgcctcccgagatccctacaacagtgcttaacattcctcatccaagtgtcatctcaagccctctgcttaaatctttgcattctgccggccctccactgctcgctgtgacggctgcccccccggcacagcctctggctaagaagaaaggcgttaagaggaaggccgataccacaacgccaactcccacagcaattctggcacctgggagtcccgctagcccgccagggtctttggagccgaaagcagcacgcctcccacccatgcgtcgggaatccggaagaccgataaagcctcccagaaaagaccttccagattcccagcagcaacatcaatcaagcaaaaagggcaaactgtctgagcagctgaaacactgcaacgggatcctgaaggagctgcttagtaaaaaacatgctgcttatgcgtggccgttctataagccagttgatgcatccgccttaggtttacatgactaccatgatattataaaacacccaatggacctgagcacagtaaagagaaagatggaaaatcgcgattatcgggatgctcaggagtttgccgcggacgtgaggctcatgttcagcaattgctacaagtataaccctcctgatcatgatgtagtcgccatggccagaaaactgcaggatgtgttcgagttccggtacgcgaagatgccggacgagcctctagaacctggacctttgccagtgtctacagcaatgccccccggcctggctaagtcttcatctgaatcatcaagtgaagagtctagctccgaatcgagcagtgaggaagaagaggaagaggacgaagaggacgaagaagaggaggaatccgaatcttcagattccgaagaggaaagggctcacagacttgccgaacttcaagagcaactaagggccgttcacgagcagctagcagccctgtctcagggacccattagtaaacccaagcgcaaacgggagaagaaggaaaagaaaaaaaagcggaaagccgagaagcacagggggagggccggagccgatgaggacgacaaagggcctcgcgcccctaggccacctcaaccgaagaagagcaaaaaggcctcaggttccggcggcggtagtgccgccttggggccctctggatttgggccatccgggggctctggaaccaaactccccaaaaaagctaccaaaactgctccacctgctctacctacgggttatgactccgaagaggaggaagagtcccgcccgatgagctatgatgagaagagacagctatctctcgatattaataaactccctggggagaagttaggccgcgtggtgcacattatccaggcaagggagcccagcttgcgcgattccaatcctgaggaaattgagatcgactttgaaacactaaaaccatcgacactcagggagctggagagatatgtcctgtcctgcctgcgtaagaagcctagaaagccctatactatcaaaaagccagttggaaagaccaaagaggagctggccctcgaaaagaaaagagaactcgagaaacgactgcaggatgtgtccggccaactcaacagcactaaaaagccgcctaagaaagccaacgagaaaactgagagcagttccgcccagcaggttgctgtgtccagactgtctgcttcctcctcgtcatccgattccagctcatcttcaagttcctctagctcctctgatacaagcgatagcgattccggctag

SEQ ID NO: 110013 - DNA, 1092 bp, Artificial Sequence
  Description of Artificial Sequence: Synthetic coding sequence
tgagcgaagagtagtagcgagtctagcagtgaggagtcttcctctgaaagcagtagtgaggaggaggaggaagaagacgaggacgaagaagaagaagaatccgagtcctccgatagtgaggaagagcgtgcacacaggctcgccgagcttcaagagcagttaagagcagtgcacgaacaacttgctgctctgtcccaggggcccatctccaagcccaaacgtaaacgagaaaaaaaagaaaagaaaaaaaaacggaaggctgaaaagcatagaggaagagccggggccgatgaagacgacaagggccctcgggccccccgtccccctcagccaaagaaatccaaaaaggcttcaggatccgggggaggtagcgcagcacttggtccatcggggttcggtccatccggaggatctgggaccaagttgcaggcgggcgtgcagtggagagacttaggcctgctccaaccaccactcttagggttcaagcggttttcgtgtctgtcgctgccctcctcgcaggactaccggttgccaaaaaaggccactaagacagctccccctgcacttcctaccggctacgactctgaggaggaagaggaatcaaggcccatgtcctatgatgagaaacgacagctgtccctcgacatcaataagctaccaggagagaaactcgggagggtggtgcatattatacaggcccgcgagccatccctgagggattccaaccctgaggagattgagattgacttcgagaccctgaaaccatccactctccgggagctcgagcgatacgttctcagctgcctaaggaagaagccgcgcaaaccatacacaataaagaagccagtaggcaaaaccaaagaagaactggcactggagaagaagcgtgagcttgaaaagcggttgcaggacgtatcgggtcaactgaatagtaccaagaagccgcccaagaaggccaatgaaaaaaccgaaagcagttctgctcagcaggtcgcagtcagtcgcctgtccgctagctccagctcatccgacagcagtagcagctcttcatcgtccagtagcagcgacacttctgactccgacagtggttag

SEQ ID NO: 110014 - DNA, 2511 bp, Artificial Sequence
  Description of Artificial Sequence: Synthetic coding sequence
atgctgcagaacgtgactcctcacaataaactgcccggtgaaggaaacgcaggcctgcttgggctaggacccgaggcagctgctccaggcaagcggatcagaaagccatcactgctgtacgagggcttcgaatccccaacgatggcatctgtgcctgctttacaactcacgcctgctaaccctccaccaccagaagtatccaatccaaaaaagcctggacgagttacaaatcagctacagtatcttcacaaggtagtgatgaaggctctgtggaagcaccagtttgcctggcctttcaggcaaccagttgatgcagttaagcttggactgcccgactaccacaagatcataaagcagcctatggatatggggaccattaaacgccgcctcgagaataactactactgggcagcctcggagtgtatgcaagactttaacacgatgtttaccaactgctacatttataacaaacccaccgatgacatagtgctaatggctcagaccctggaaaagatttttttgcaaaaggtcgccagtatgccacaggaggaacaggagcttgttgtaactattcccaaaaactcccacaagaagggagctaagctggcagcgttgcagggttctgtaacctcggctcaccaggtgccggcagttagcagtgtctcacatactgcactgtacacaccgccacctgaaataccgactacggtgctgaatatcccccacccctcagtgatcagcagcccacttttaaagagcctccactctgccggaccacctctgctggcggtcactgctgccccacccgcgcaacccctggctaagaagaaaggagtaaagagaaaggccgacaccaccaccccaacacctaccgcgattctggcacccgggagtcccgcttcccctccgggatccctcgagcccaaagccgctaggctaccgccaatgcggcgggaaagcggtcggccgatcaaacccccacgaaaggatttgcccgattcgcaacaacagcaccaaagttcgaaaaagggtaagctgtcagagcagctgaaacattgcaacggcattttgaaggaacttctgagtaagaagcatgcggcctacgcgtggcctttctacaagcccgtggacgctagtgccttagggctccacgattaccatgatattatcaaacacccgatggacttgagcaccgtaaagaggaagatggagaatagagattacagggacgctcaagaattcgcggcagatgtgaggctcatgtttagcaattgttataagtacaatccaccggatcatgatgttgtcgcaatggcaaggaagctgcaggatgtatttgagtttcgttacgccaaaatgcccgacgaaccactggagcccggtcctctgcccgtctctaccgcgatgccacctgggctggccaaaagctcgagcgagtcgtcttcggaggaatcttccagcgagagcagttcggaagaggaggaagaggaggatgaggaggatgaagaagaggaagagtccgagtctagcgattctgaggaggagcgggcgcatcgcctggccgagcttcaggagcaactgagagccgtgcacgagcagctggccgccctgtcacagggccccattagtaagcccaagcggaagcgagaaaaaaaagagaagaaaaagaaaaggaaggccgagaagcatcgtggtcgggccggggccgatgaagatgataagggcccacgtgctccaaggccgcctcagccgaagaagagtaaaaaagcatctgggtctggtgggggatcagcggcgttaggtccctccggcttcgggcccagtgggggaagcggtacgaaattgcaagcaggggtgcaatggcgggatctcggcttactgcagcccccactgctaggctttaaaaggttctcgtgtttatccctgccctcgtcccaagattatagactccctaaaaaggccacgaagaccgcccctccggctctgcctaccggatacgacagcgaggaagaggaagaatctagaccaatgtcatatgatgaaaagagacagctgtctctggacattaataagctgccaggggagaagctaggtagagtcgttcatatcattcaagctagagagcctagtctgagggacagcaacccagaggagattgaaatcgacttcgaaacgctcaaaccaagtacactgagagagctggaacggtacgttctgtcctgtcttcgaaaaaaacctcgaaagccttacaccatcaagaagccagtcggtaaaacgaaagaggagctggccctcgaaaaaaaacgggaactcgagaagagactgcaggatgtctctggtcagctgaacagcacaaaaaaaccacccaaaaaggccaacgaaaagaccgaatcttcatctgcccagcaggtagccgtttcgcgactgagcgcttcatcttcttctagtgattcaagttcttcctccagctcctcttcctcaagcgacaccagcgatagcgattctggttag

SEQ ID NO: 110015 - DNA, 2046 bp, Artificial Sequence
  Description of Artificial Sequence: Synthetic coding sequence
atggatatggggaccattaagcgccgtctggagaacaattattactgggctgcctcagaatgtatgcaagatttcaacactatgtttaccaactgctacatatacaacaagccgaccgacgatatcgtcctgatggcacagactttggagaagattttcttacagaaggtggcatctatgccccaggaagagcaagagctggtcgtcactatcccgaaaaactcgcataaaaagggggctaagctggctgccctccagggctctgtgacaagtgctcatcaggttcccgccgtcagctctgtaagtcataccgccctgtatacacctccacctgagatcccaaccaccgtgctgaacattccccatccaagcgtgatctcaagtcccctcttgaaaagcctccactctgccggtcccccactgttagccgtaacagctgctccacctgcgcaacctctggccaagaaaaaaggcgttaagagaaaggctgacaccaccacccccacacccactgccatactagcgccagggtcaccagcatcaccaccagggtccctggaacctaaggctgcacgcctgccacctatgcggcgagagtccgggcgcccaattaaacccccgagaaaggatttacctgactctcagcaacagcatcagtcatcaaaaaaagggaaattgtccgagcaactgaaacactgcaatggcatcctcaaggagctcctgtctaaaaagcacgcagcctatgcctggccattttacaaacctgttgacgcctccgctctcggtctgcatgattatcacgacataatcaaacatccaatggacctgagcactgtgaaaagaaagatggaaaacagagactaccgggatgcccaagagttcgcagcagatgttcgtctcatgttcagtaattgttacaagtacaacccacccgaccacgatgtcgtggcaatggctcgtaaactccaagatgtttttgagttccggtacgcgaagatgcccgacgaaccgctggagcctggccctttgcccgtgagcacagcgatgcctcccggactggccaaatcgtcatccgagagcagctccgaagagtcctccagcgagtctagctccgaggaggaggaggaagaggatgaggaggatgaagaggaggaagagtctgaaagttccgactcggaagaagagcgtgcacaccgactcgccgagctgcaggaacaactgcgagctgtgcatgaacagctagctgcgctatcccagggccccatttcgaaacctaagcgcaagcgtgagaaaaaagaaaagaaaaagaagcgcaaggctgaaaagcatagaggacgggccggggccgacgaggacgacaagggtccgcgagccccccgtccacctcagccgaaaaaatccaaaaaggcaagcggttcaggaggcggctcggcggcattgggcccctcaggctttggtcctagtggagggtccgggaccaagctaccaaaaaaggctactaagaccgcccctcccgcgctgcccaccggctatgattccgaggaggaggaagaaagcaggcctatgtcttacgatgaaaaacgccaactctcattggatatcaacaagctgcccggcgagaaacttggaagggtggtacatatcattcaggctagagagccctccttgcgggattctaatccagaggaaattgagatcgattttgaaacactcaagccaagtacacttagagagctggagaggtatgtgttaagctgcctgcggaagaaacccaggaagccctatacaatcaaaaagccggtgggaaagacaaaagaggaacttgccttggagaaaaagcgcgaacttgaaaagcggttacaggacgtgtctgggcagttgaacagcaccaaaaaacctcctaagaaggctaacgagaaaactgaatctagctctgcgcagcaggtagcagttagccggctcagcgcgagcagttcgtccagcgacagctcctcctcttcaagttcatcctcctcctccgatacttcagacagcgatagcggctag

SEQ ID NO: 110016 - DNA, 2424 bp, Artificial Sequence
  Description of Artificial Sequence: Synthetic coding sequence
taaaacggaggagggggcagtgcgaccgcacgaggcggagaatatcggttgcctggtgaagggaacgctgggctcctgggcttgggtcccgaggccgccgcccctggcaagaggatacggaagcctagcctgctgtatgaggggtttgaaagccccactatggctagcgtccccgccctgcagctaactcctgctaaccctccccctccggaagtgagtaacccaaagaagcctggtcgggtgacaaaccaattgcaatatttgcacaaggtcgttatgaaggccctgtggaagcatcagtttgcttggcccttccggcaacctgtagacgccgtcaaactggggttgcccgactatcataaaattattaagcagccaatggacatggggaccataaagcgacgactggagaacaactattactgggcggcttcagaatgcatgcaagatttcaacaccatgttcacgaattgttatatctacaataagccaaccgatgatatcgttttgatggcacaaactttggagaagatttttctacagaaagtagcatccatgccgcaggaagaacaggagctggtggtaacaatccctaaaaactcacacaagaaaggagccaaactcgcagccctgcaggggtcagtgactagcgcccaccaggtgcccgctgtttcctcagtgtctcataccgcattgtatacaccaccccccgagatcccaaccacagtgctcaatattcctcatccttctgtgatctcaagccctctcctgaagagcctacattccgcgggccccccccttttagcagtgaccgccgccccgccggcacagccactggccaagaagaaaggagtgaaacgcaaggctgataccaccacgccaacacctactgcaatcctcgcacctggtagtcccgcctcaccaccagggagtctggagccgaaagctgccagacttcccccgatgaggcgggagtccggacgcccaatcaagcccccaagaaaggacctccccgactcacagcagcagcaccagagcagtaagaaaggtaagctctccgagcaactgaagcactgcaacggtattctgaaggagctcctgagcaaaaagcatgcagcatatgcctggcctttttataagcccgtagacgcctccgccttgggactccatgattaccatgacattattaaacaccccatggatctgagtactgtgaagcgcaagatggaaaatagagactaccgggatgcgcaagagtttgccgctgacgttaggttgatgttcagcaattgttataaatacaacccaccagaccacgacgtggtcgccatggcccgaaaactgcaggatgtattcgagttccgctatgccaagatgccggacgaacctctggaacctggacctctgcccgtatccactgctatgccacccggcctcgcaaagagttcaagtgagtcttccagcgaggagagctcgtctgagtcaagcagtgaggaagaggaggaggaagatgaggaggacgaggaggaggaggagtcagagtccagcgacagcgaagaggagcgcgcacatcgtctcgccgaactgcaggagcagttgcgagctgttcacgagcagctggctgcactgtcacaggggccaatctcaaagccgaaacggaaacgtgaaaaaaaagaaaaaaagaagaagcgtaaggctgaaaaacatagagggcgcgccggcgctgacgaagacgataaaggtcctcgggccccccgcccgcctcagcccaagaagtccaagaaggcttctggtagcggcgggggatcagccgctctggggcctagcggattcggcccctccggtggctctggaactaagctgcctaagaaggccacgaaaaccgctccccccgccctgccaacgggctacgatagcgaagaggaggaggagagtcgacctatgagctatgacgagaagcgccagttgagcctggatatcaataagctgcctggggagaaacttggacgagtcgttcacattatccaggctcgtgagccaagcctcagagacagtaacccagaagagattgaaattgactttgagactctgaaaccgagtactctgcgtgagctggagcggtatgttctctcatgtctgcgaaaaaaaccacgaaagccgtacacgattaaaaagcccgtgggaaagactaaagaagagctcgcactggaaaagaagcgtgaactggagaaacgactacaggatgtcagcgggcaactgaacagcacaaaaaaaccacccaaaaaagccaatgagaaaaccgaaagcagttcagcacagcaggtggccgtgagccgtctttctgcgagcagctcgagttcagactcatcatcctcttcctcttcctcctcttctagtgatacatctgattccgattctggatag

SEQ ID NO: 110017 - DNA, 987 bp, Artificial Sequence
  Description of Artificial Sequence: Synthetic coding sequence
taggcgaagagttcctctgaatcttcatccgaggaaagtagtagcgaaagctctagtgaagaggaagaagaggaggatgaggatgaagaggaggaagagtctgaatcgagcgactcggaggaagagagggcccaccgcctcgcagagctgcaggaacaattaagggctgtccacgagcagctcgcagctctgagtcagggacctatctcgaaacccaagaggaagagggagaaaaaagagaaaaagaaaaaaagaaaggcagaaaagcaccgaggtcgggcgggtgcggatgaagatgacaagggacctcgagccccacggccgcctcagccgaagaagagtaagaaagcttcaggctctggcggcggcagcgccgccctcggcccctctggcttcgggccttcaggagggtccggcactaaattaccaaagaaggctactaaaacagcccctccagcgcttccgacagggtacgattccgaggaggaagaggagtccaggcctatgagctacgatgagaagcgacagctgtctctcgacattaacaagctgcctggtgaaaaattaggaagggtggtgcacattatccaggccagggagccctccttgcgcgattcgaacccagaggagatagaaattgattttgagacgcttaagccttcaacactaagagaactggagcgctacgtcctgtcatgcctccggaagaagcctaggaaaccctatacaataaaaaagccagttgggaagaccaaggaggaactggccctcgagaagaagcgtgagttggaaaagcgtctgcaggatgtgagcggccagttaaactctaccaagaagccacccaaaaaggcgaatgagaaaactgaatccagctctgctcaacaggtagcagttagtcgtctgagtgcttcctcttcttctagtgacagctccagcagctcgagttcttccagtagcagcgacacctctgattctgactctggctag

SEQ ID NO: 110018 - DNA, 2511 bp, Artificial Sequence
  Description of Artificial Sequence: Synthetic coding sequence
atgctccagaacgtgactcctcacaacaaattgcctggcgaggggaatgcaggactactgggtctaggacctgaggcggccgctcctggaaaaagaatcagaaagccttccttgctctatgagggcttcgagtcaccaaccatggctagcgtccctgctctccagttaactcctgctaacccaccaccacccgaggtctcgaaccccaagaaacctggccgcgtcacaaatcaattgcagtacttgcacaaggtggtcatgaaagctctctggaaacaccagtttgcttggccctttagacagccggtggatgctgtcaagctagggctgcctgactaccacaaaatcattaagcaacctatggatatgggcaccattaaacggcggctggagaacaattattattgggctgcttctgaatgcatgcaggacttcaacacgatgtttaccaactgttatatttataataaaccgacagatgatatcgtgctgatggctcaaacccttgaaaaaatattcctccagaaggtcgcctccatgccacaggaggagcaagagctagttgtaacaatcccaaagaattcacacaaaaagggggccaaactagctgccctgcaagggtccgtcacaagtgcccaccaggtgcctgcagtgtcctcagtttctcatactgctctgtatactccaccgcctgagatccctaccaccgtcctaaatattccccaccctagcgttatatcctctcctttgctgaaaagcctgcattcagcgggccctccactgctcgctgtgacggcagctccccccgcacagcccctggccaaaaagaagggtgtaaagcgcaaagccgacaccactactcccacacctaccgcaatcctggccccaggctcaccagcaagcccgcctgggtccctcgagcctaaagccgctcgacttcctccaatgcggcgcgaaagcggtcgtcccatcaagccccccagaaaagacctgcctgacagtcagcagcagcatcagtcttccaagaagggtaaactttctgagcagctgaaacattgcaacggtatccttaaagagctgcttagcaagaaacatgcagcctacgcctggcctttctacaaacccgtcgatgccagtgcactcggcctgcacgactaccatgatattattaagcacccaatggatcttagcacagtcaagcggaaaatggagaacagagattatcgggacgctcaggagtttgctgcagatgtgaggctcatgttttccaattgctacaagtataaccctcctgaccatgatgttgtggccatggcccgtaagcttcaagacgtgttcgagtttaggtacgctaagatgcctgacgagccattggagcctggaccgctacctgtttcgacagcaatgccgcccgggctggctaagtccagctccgaatcaagcagcgaagaaagctcaagcgaatctagtagtgaagaggaagaggaggaggatgaagaagacgaggaagaggaggaaagcgagagctccgattccgaagaggagcgggcccaccgtttggctgagctgcaggagcaactacgcgctgttcatgagcagctcgctgccctgtctcagggacctatctccaagcctaagcgcaagcgcgaaaagaaggaaaaaaagaagaaacgcaaggctgaaaagcacaggggccgggcaggagccgatgaagacgacaagggccccagagcccctcggccaccgcagcccaagaagagcaagaaagcttccggtagtggcggcggcagcgccgctctcggaccatctggctttgggccaagtggaggcagtgggactaagctgcaagccggagtgcagtggcgggatcttgggcttttgcagccaccactgcttggcttcaagcgattctcctgtctcagcctacctagcagccaggattacaggcttccaaagaaggctacaaagacggcacccccagcactgcctactggctatgattcagaagaggaggaggaaagccggcccatgtcctacgacgaaaaaaggcaactgtccctcgacatcaataagttaccgggagaaaagctgggacgagtggtccacatcattcaggcaagggagccatcgctccgcgactcaaatccggaggaaatcgagatcgattttgagaccctgaagccatctactctgcgcgaactggaacgctacgtgctaagttgcctgcgtaagaagccccggaagccatacactatcaagaagcccgtggggaagactaaagaggaacttgccctagagaaaaaacgcgagcttgaaaagcgactgcaagacgtgtctggccagctcaacagcaccaaaaaacccccaaagaaagcaaatgagaagaccgaatctagtagcgcccagcaagtagcagtgtcacggctgagcgcctcctcaagcagcagcgactcctcttcaagttcatcatctagctcctcctcagataccagcgactccgactctggatag

SEQ ID NO: 110019 - DNA, 2424 bp, Artificial Sequence
  Description of Artificial Sequence: Synthetic coding sequence
taaaacggagggggtggcagtgcgacggcccggggcggcgaatatcggctccccggcgaaggcaacgcaggtctgctcggtctcggaccagaggccgcagcaccaggaaaacggattaggaagccatcactgctctatgagggtttcgaaagcccaacgatggccagcgtccccgccctgcagctcactccggcgaacccacctcctcctgaagtatccaatcctaaaaaacctggaagggttaccaatcagttacagtatttgcacaaggtggtaatgaaagctctgtggaagcaccagtttgcctggcccttccggcagccagtggatgccgtgaaattgggacttcctgattatcacaaaattattaaacagcccatggacatggggaccattaaaaggcgactggaaaacaattattattgggcagctagcgagtgtatgcaagattttaacaccatgttcaccaactgctacatctacaacaaaccgacggacgacatagtgttgatggcacagactttggaaaagatttttttacagaaggtggcgtccatgccccaagaagaacaagagctggtggtgactatccctaagaattctcacaaaaagggagccaagttagccgccctgcaaggtagcgtaacgtccgcacaccaggtgcccgccgtgtcttccgtgagtcacaccgcgttgtacacaccaccaccagaaatccccactacggtcctgaatattccacatcccagcgtgatcagtagcccacttctgaaatctctgcacagcgctggcccccccctcttagcagtgactgctgcacctcctgcccaacctctagcgaagaaaaagggagtgaaacgtaaagccgataccaccacgccaactcccaccgccatcctggcccctggcagcccagctagccctcctgggagcctggagcctaaagctgctaggttaccacctatgaggcgtgagagcgggagacctatcaagcccccgcggaaggatcttcccgactcccagcaacagcatcagagtagcaaaaaaggtaaactgagtgaacagcttaagcactgcaacggcatcctgaaagaactgctgtctaagaagcatgccgcctacgcatggccattttataaaccagtcgacgccagtgcgctcggcctgcatgattatcatgatatcattaaacacccaatggacctgtcaactgtgaagaggaaaatggagaaccgcgattaccgcgacgcacaagaatttgccgcagacgtccgattgatgttctccaactgttataagtacaaccctcctgaccacgacgtggtcgctatggctcggaagctgcaggacgtgttcgaattccggtatgctaagatgcccgacgaaccactggaaccaggtccactacctgttagcacagcaatgccgcctgggctggccaagtcgtcttcggagagctcctcagaagagagtagctctgaatcatcatctgaggaggaggaagaagaggatgaggaagatgaggaagaggaggaaagcgagagctcggactctgaggaagaaagagctcatcgactcgcggagttgcaggaacagttacgtgctgtccatgaacaattggcagccctgagccaggggcccatttccaagcccaaacggaaaagggagaaaaaggagaagaaaaaaaagcggaaagcagagaagcaccgaggtcgcgccggagctgatgaggatgacaaggggccacgggcgcccagaccacctcagccaaaaaagagcaagaaggcctcaggcagcggtggtggttctgcggcactagggccaagcggatttggacctagcggcggtagcggcaccaaattgccaaaaaaggctaccaagactgctcccccagcgttacctacaggttatgactctgaggaggaagaagagtctaggcctatgagttatgacgagaaaagacagctgtccctggatatcaacaaacttcccggggaaaagctgggccgagtggttcatatcattcaagcacgggaaccaagtctgcgcgactccaaccccgaggagattgaaattgattttgagaccctgaaaccatctactctcagagaactcgaaaggtatgtgttaagctgtctccggaaaaaacctcggaagccttataccattaaaaagcctgtgggtaagactaaggaagagctggctctggagaaaaagcgcgaacttgagaaaaggctccaggacgtgagtggacaactcaactccacaaaaaagccacccaagaaggcaaacgagaaaacagaaagttccagtgcacaacaggtcgcagtgtcccgattaagtgcatccagtagttcctcagacagttcgagtagctccagctcttcttcatccagcgacacatctgactccgatagcgggtag

SEQ ID NO: 110020 - DNA, 2265 bp, Artificial Sequence
  Description of Artificial Sequence: Synthetic coding sequence
atggcaagcgtgcctgcgcttcaactcacccccgcaaacccacccccgcctgaggtgagcaatcccaagaagcctggccgggtaacaaatcaattgcagtacctgcacaaggttgtgatgaaggctctgtggaaacaccaatttgcgtggccattcaggcagcctgttgatgctgtgaaactgggccttcctgattatcataaaatcatcaaacaaccaatggatatgggcaccatcaaacgccgactggaaaacaattactactgggccgccagcgagtgcatgcaggactttaacactatgttcacaaactgttatatctataataagcccactgatgacatcgtgcttatggctcagaccctggagaagatttttctacagaaggtggcgagcatgccccaggaggagcaggaattagttgtaacaatccccaagaacagtcacaaaaaaggagctaagttggccgccctgcaggggagcgtgacctccgcacaccaggtgcccgctgtgtctagcgtcagccacactgcgctctatacaccccccccagagattccaactacagtacttaacattcctcacccctccgtgatctcatctcctcttctaaagtccttacatagcgctggccctcccctgctggcagtgaccgcagctccaccagcacagccactggcgaagaagaaaggcgtgaaaaggaaggctgacactacaacccccaccccgactgctatccttgccccgggctctcctgccagtcctcctggttctctggagcccaaggccgctcgccttccccccatgcggagagaatccgggcggcccattaagccacctcggaaggatctccctgactcccaacaacagcaccagagtagcaaaaaggggaagctatccgaacagttaaagcattgtaacgggattctgaaagagcttctgtctaaaaagcacgccgcatatgcctggcccttctataagccagtggatgcatccgcgctagggctgcatgactatcatgatatcataaagcacccaatggatcttagcacagtgaagcgaaaaatggaaaatagggattaccgcgacgcgcaggaattcgctgcagacgtgcgactgatgtttagtaattgctataaatataatcctccagaccacgatgtcgtagccatggcacgaaaactgcaggatgtgttcgaattcaggtacgcaaagatgcccgacgaacctctggagccaggtccgttgcccgtttctaccgcaatgccccccggtcttgcaaagagctctagcgagagtagcagtgaagaatcttcctcagagtcctctagtgaagaggaggaggaagaggatgaggaagacgaagaagaagaagagtctgagtccagcgattctgaagaagaaagagcacatcgcctcgccgaactacaagagcagcttcgcgccgtacacgagcagctagcggccctcagccagggtcccatctccaaacctaagcggaagcgcgaaaagaaagagaagaagaagaagcgtaaggctgaaaagcataggggccgagctggagccgacgaggatgacaaagggccccgtgcaccacgccctcctcagcccaagaaaagtaagaaggcctctggctccggcggcggttcggccgccctcggacctagcggctttggcccctccgggggctctggaacgaagttgccaaagaaggcaaccaaaacagcgcctcccgcacttccaaccggctatgatagcgaagaagaggaggagtcacggccaatgtcctatgatgaaaagaggcagctcagcctagacataaacaaactcccgggcgagaaactgggccgggttgtgcacataattcaggccagagaaccgtccctgcgtgatagtaaccccgaagaaattgagatcgacttcgagacattgaagccatccaccctgagggagctcgagaggtatgtcttgtcttgcctccgaaagaagcctaggaaaccgtacaccattaagaaacccgtggggaaaacgaaggaggagctggcgctggaaaagaagcgcgagctggaaaaaaggctgcaggacgtatccgggcagctgaacagtacaaagaagcctccaaaaaaagctaatgagaaaaccgaaagttcatcagcacagcaggtcgcggtaagccgcctgagtgcatcttccagcagctccgactcgagttctagttcctcatcaagctcctcgtctgatacctctgacagcgacagcggatag

SEQ ID NO: 110021 - DNA, 2406 bp, Artificial Sequence
  Description of Artificial Sequence: Synthetic coding sequence
atgcttcaaaatgttacaccacataataagttaccaggggaggggaacgccggcctgctaggactgggacccgaggctgcggccccaggaaagcgaatccgcaaacctagtctgctgtatgagggttttgaatctccaaccatggcaagtgtgccagcactacaactgacaccagccaacccaccacctcctgaagtgtccaatccaaagaagccaggtcgtgtgactaaccagctccagtacctccacaaagtggtgatgaaggcactgtggaaacatcagttcgcctggccatttcggcaacccgtggacgctgtaaagctgggactccccgattatcacaagattattaaacagccgatggatatgggaacaatcaagcgcaggctcgaaaataactactattgggcagccagcgaatgcatgcaggatttcaacaccatgtttacaaattgctatatatataacaagcccaccgatgatatagtcttgatggcgcagaccctcgagaaaatctttctgcagaaggttgcatctatgccccaggaggaacaagaattagtcgtgacaatcccgaaaaattcccataaaaagggcgccaaactggccgcactccaggggtccgtgacctccgcacatcaggtgcctgctgtatcatcagtatcacacactgctttatacaccccacctcctgagatccccacaacggtatttaatatcccccatccaagtgtgatttcctctccccttctgaaaagcttgcacagtgccgggccgcccttactcgcagtaactgctgcccccccggctcagccactggccaaaaagaagggggtgaagagaaaggccgacactacgaccccaacaccaacagccatattggcccctggtagccctgcttcccctcccgggtctcttgaaccaaaggcagcccggctgccccccatgagaagagaaagtggtcggcctatcaagcctcccaggaaagacctccccgatagccaacagcaacatcagtcttctaaaaagggaaagctcagcgagcagttaaagcattgcaacggaatactcaaagagctattaagtaagaaacacgccgcctatgcctggccgttctacaaaccggttgatgcatcagccctaggcctgcatgactaccatgatatcataaagcacccaatggacctgagcaccgtgaagaggaagatggaaaatagggattaccgggacgcccaggaattcgcagccgacgtccggcttatgtttagtaattgttataagtacaacccacctgatcacgacgtggtggctatggctagaaagctgcaggacgtgtttgaatttagatacgccaagatgccagacgaaccacttgaacccggcccattacccgtgagcacggcaatgccccctggcttggcaaagagttcttctgaaagctcctcagaagaatcatcttccgagagtagctcagaagaggaggaagaggaggacgaagaagacgaggaggaggaggaaagcgagagttctgactcggaagaggagagggcccaccggctcgccgaactgcaagagcagttgcgtgctgtccatgagcagctggccgcgctgagtcaagggcctatatcaaaacctaaacggaagagagagaaaaaggagaaaaagaaaaagagaaaggccgagaaacatcggggtcgcgcaggcgctgatgaggacgataagggcccccgcgcaccgaggcctccacagcccaagaagtcaaagaaggcctctgggtccggagggggctctgccgcactgggcccatctgggttcggtccttctggaggcagcgggaccaaattgccaaagaaggccacgaaaactgcgcccccggcactgcccacgggttacgacagcgaagaggaggaggagagtcggcctatgtcttacgacgagaaaagacagctgtccttggatattaacaagctgccgggcgaaaaacttggacgagtggtgcatatcattcaggcccgagaaccatctttacgcgattctaaccccgaagagatcgagattgacttcgaaacactgaagccatcaaccctcagagagctggagaggtatgtgctgtcatgccttcgcaaaaaacctcgcaagccttatactatcaagaaacccgtgggaaaaaccaaagaagaactggccctagagaagaaaagagagctggagaaaaggctgcaggacgtcagcggacagctgaacagtactaaaaaacctccgaagaaagccaatgagaaaacggagtcctcatccgcccagcaggtcgccgttagccggctttctgcttcttcatctagctccgactcaagtagcagtagctcaagttcatcctcatcagacacctctgattctgactccggttag

SEQ ID NO: 110022 - DNA, 891 bp, Artificial Sequence
  Description of Artificial Sequence: Synthetic coding sequence
taaagacctttgggagtgcagcagcccggggctagactgccaggcgagggaaacgcggggttgttaggactgggtccagaggcagctgcccccggcaagcgaattcggaaaccttcattgttgtatgaggggttcgaaagccctacgatggcctccgtcccggctcttcagctcacccccgcaaatcccccacccccagaggtgtcaaaccctaagaaacctggccgcgtcaccaaccagttgcagtacctccacaaagtggtcatgaaggcactgtggaagcatcagttcgcgtggccgtttagacagcccgtcgacgctgtgaaattaggtctccctgactatcacaagattataaagcaacccatggatatggggacaataaaaagaagactcgagaacaactattattgggcggcctctgaatgtatgcaagatttcaatactatgttcactaactgctacatatacaacaaacctaccgacgacatcgtgctgatggcacagactctggaaaaaatttttttacagaaggttgcctccatgccccaggaggagcaggaactagtggtcactatccccaagaattctcacaaaaaaggcgctaaactggccgctcttcaaggcagcgttaccagcgctcatcaggtccccgccgtgagttcagtttctcacactgccctgtatacccctcccccagagatcccgacaactgtgctcaacatcccacatccaagcgtcatttccagccccctgctcaagtctctgcacagcgccggaccaccccttttggccgtgacggccgctccaccagctcaaccactcgcaaaaaaaaaaggggttaagcggaaggctgacactactactccaacccctacagccatcctgtag

SEQ ID NO: 110023 - DNA, 2511 bp, Artificial Sequence
  Description of Artificial Sequence: Synthetic coding sequence
atgctccaaaatgtgacaccgcacaacaagctcccaggcgaaggcaatgctgggcttctgggtttgggacccgaggcagctgcacctggaaaaaggatccggaagccatcactcttgtatgaagggtttgagagtcctactatggcatctgtgcctgctctacagctgactcccgccaatcctccaccgcccgaagtctcaaacccaaagaaacctgggagggtaaccaatcagttgcagtatcttcacaaggtggttatgaaggctctctggaagcaccagttcgcatggccatttcgccagcctgtggatgccgtgaagctcgggctccccgactaccataagataatcaaacaaccgatggacatgggcacgatcaagcgacggctcgaaaacaactactattgggctgcttcagaatgtatgcaagacttcaatacaatgttcacaaattgttatatctacaataagcccaccgacgacatcgttctgatggctcagactctggaaaaaatctttctccagaaggtggcttcaatgcctcaagaggaacaagagctcgtggttacaatccctaagaattcccacaagaaaggggctaagttggccgctctgcagggaagcgtaacgtctgctcatcaggtccctgccgtttcaagcgtgagtcacactgccctctacaccccacccccagagattccaacaacagtctttaatataccccacccctcggtgatctcctcacctctcctcaagtcgctgcatagcgccgggccaccgctgttagccgtaaccgccgccccccccgcgcaaccccttgctaaaaagaaaggcgtcaagagaaaagccgacactacaacccctactcccacggccatacttgcccctggctcacctgcaagcccgccaggctcgctcgaacctaaagcagcccggttgccccctatgcgcagggaatccggtcggcccattaagccccctcggaaggatttacccgacagccagcagcagcatcagtcgtcaaagaaagggaagttgtcagagcaactgaaacattgcaacggaattctcaaggaactgctgagcaagaagcacgctgcgtacgcatggcctttctacaagccggtcgacgcgtctgcgctgggcctgcacgactatcacgatatcatcaaacatccaatggacctcagtactgtcaaaagaaaaatggagaaccgggattatcgggacgctcaggaatttgctgccgacgttagactgatgttctctaactgctataagtacaatccacctgaccatgacgtggttgctatggctaggaagctccaggatgtctttgagtttaggtatgcaaagatgcctgatgagcctcttgaaccaggccccctgccagttagcaccgccatgcctccaggccttgccaaaagttcttctgaaagtagttctgaggaaagctcatccgaatctagcagtgaagaggaggaagaagaggatgaggaggacgaggaggaagaagaatctgagagctccgattcggaggaggaacgcgcacacagactggccgagctccaggagcagctccgggcagtgcacgagcagctggctgctttgtcacagggccctatctcgaaacctaaaaggaagagggagaagaaagagaagaagaagaagcgtaaagccgagaagcataggggtcgagctggcgctgatgaagacgataaggggccacgcgcccctcgccccccgcagcccaagaagagcaaaaaggcttcgggcagcggtggggggagcgctgcactgggccctagcggcttcggaccctctggcggctccgggactaagctgcaagctggagtgcagtggcgggacctggggctgctgcagcctccactgctcggttttaagcgattctcatgcctgtcgctgccttcctctcaaaactataggctcccaaagaaagctaccaagaccgcacctccggccctgccaacaggctatgatagcgaggaggaggaggaatcgaggccaatgagttatgatgagaaacgtcagctgtccttggacatcaacaaacttccaggcgagaaacttggacgggtggtgcacattatccaggctagggaacccagcctgcgggattctaacccggaagagatcgagatcgacttcgagacactgaagcctagcacactgagagaattggaaaggtacgttctgtcttgcttacgcaaaaagcccagaaagccctacacaattaagaagcccgtcggcaaaacgaaagaggagctggccttggagaagaaacgggagttagagaaacgcctgcaggatgtctccggccaactgaacagcaccaagaagccccctaaaaaggccaatgaaaaaacagagagctcgtccgcccagcaagtcgccgtcagtcggttatccgcttcatcatccagcagtgatagctctagttcgtcctcctctagttcaagttctgacacaagtgactcagactcaggctag

SEQ ID NO: 110024 - DNA, 987 bp, Artificial Sequence
  Description of Artificial Sequence: Synthetic coding sequence
tgagcgaaatcgtcttcagagtcttctagcgaagaaagctcatcagaatcctcatctgaagaagaagaggaggaggacgaagacgaagaagaagaggagtccgaatcatcagacagtgaggaagagcgcgcacatcgcctagccgaactgcaggagcagctgagggcagtccatgagcaactggccgccctcagccaggggcccatctccaaacctaaacgcaagcgggaaaaaaaggaaaagaaaaagaagagaaaggctgagaagcaccgcgggcgggccggcgccgacgaggacgataaggggccacgggcccccagacctcctcaaccgaagaagtcaaaaaaagcctcaggttctggcggtggctctgccgccttgggacctagcggttttgggccctccggagggtctggaacgaagttacccaagaaggccacgaaaacagctcctcctgctcttcctacgggttatgactctgaggaggaggaggaatcacgtcccatgagctacgacgagaagaggcagttgtccctagacattaacaagctcccaggggaaaaactgggaagagtggtgcacatcatacaagctcgggagccatctctgagggatagtaaccctgaggagattgagatcgactttgagacactgaagccctcaacgctccgggaactcgaacggtacgtcctgtcctgtctcagaaaaaaaccccggaagccctacaccattaaaaaacccgtgggaaaaaccaaggaggaactggcgctggagaaaaaacgtgagctcgagaaaagactgcaagacgtgagcggacagctgaatagcaccaaaaagccaccaaagaaagcgaacgaaaaaactgagtccagctccgctcaacaagtggccgtttcccgcttatcggccagctcctcatcttctgacagtagttcctctagctcgagctcctcctcctctgacacctctgactctgacagcggctag

SEQ ID NO: 110025 - DNA, 891 bp, Artificial Sequence
  Description of Artificial Sequence: Synthetic coding sequence
tgaagaccgctgggtgttcagcagcctggggccagactgcctggtgaaggcaatgccggcttgctgggcctggggcccgaagccgcagcacccggcaagagaattaggaaacccagtctgttgtatgaagggttcgagagccccactatggcctccgttcctgccttgcagctgactcccgccaaccctcctccccctgaagtgtctaatcccaagaagcccggacgggtgacaaaccagctccagtatctgcacaaagtcgtgatgaaggccctgtggaagcaccagttcgcatggccatttcgacaaccagtcgatgcagtgaagctgggacttcctgactatcacaagatcattaagcaacccatggacatgggcactataaaacgaagactggaaaataattattactgggcagcctcagagtgcatgcaggacttcaacaccatgttcaccaactgttacatatataacaagcctactgatgacattgtgttaatggctcaaacattggagaaaattttccttcaaaaggtggcttccatgccgcaggaagaacaggaacttgttgtgaccatacccaaaaattcgcataagaaaggggccaaactggcagcactgcaaggatctgtaaccagcgcgcaccaggtgcccgcagtgagctccgtgtctcacaccgcattgtacacaccacctcctgagataccaaccactgtgctgaacatcccacatcctagcgtcattagtagtcccttgttgaaaagtttacattccgcgggcccaccattgctggcagtgactgcagcccccccggcacagccattagcaaaaaagaaaggtgtaaagagaaaggcagacaccacaaccccaacccccacagccattctctag

SEQ ID NO: 110026 - DNA, 891 bp, Artificial Sequence
  Description of Artificial Sequence: Synthetic coding sequence
tgacgccctttaggcgtccagcagccgggagctcgcttgccgggagagggtaacgccggcctcctcggcctaggccctgaggccgccgctccaggcaaaaggattcgcaagccaagcctcctttatgaggggttcgagagccccaccatggcaagtgtgccagcactgcagctgacacctgcgaatccacccccgccagaggtatcaaacccaaaaaaacccgggagggtcacgaaccagctccagtatcttcacaaggttgtgatgaaagctctgtggaaacaccagtttgcatggcccttccggcaaccggttgatgctgttaagcttggcctacccgattatcacaagatcatcaaacagcctatggatatgggaactattaaacggcgcctggagaacaattattattgggctgcaagcgagtgtatgcaggactttaacactatgttcacaaactgttacatttataataagcccactgatgatatcgtgctgatggcccagacactagaaaagatcttcctgcagaaggtggcatctatgccccaggaggaacaggagttagtggttacaataccaaaaaattcccacaagaagggcgccaagctggctgccctccagggatcagtcacaagcgcgcaccaagtccccgcagtcagctccgtgtcccacactgctctgtacaccccacctcccgagatccccaccactgtgctgaatatcccccacccatctgtgatcagttcacccctattaaagtctttgcactcggcaggcccgcctctgctggctgtaaccgccgcgccgccagcccagccactggctaagaaaaaaggggtgaagaggaaggccgataccacgacccctaccccaactgccatactatag

SEQ ID NO: 110027 - DNA, 1860 bp, Artificial Sequence
  Description of Artificial Sequence: Synthetic coding sequence
tgaaatgggggtggaggtagtgctaccgcccgcggaggggagtaccgcctgcccggcgaagggaatgctgggctgcttggtttgggccccgaggctgcagcacccggcaagcggatcaggaagccatccctcctgtacgaaggtttcgaaagtccaactatggcttccgtgccagcgctgcagctgacccccgcgaaccccccaccccccgaggttagcaaccccaagaagccgggtagagttaccaaccaactccagtacctccacaaggtagtcatgaaggctctatggaaacatcagttcgcatggccgttcaggcagcccgttgatgctgtgaagttgggtttaccagactaccacaagatcatcaaacaaccaatggatatgggtacaatcaaaaggagactcgagaacaactattattgggccgcgtcggagtgtatgcaggacttcaacactatgttcactaactgctacatctataacaagccaaccgatgacatcgtccttatggcccaaacgctggaaaagatcttcctgcagaaggttgcctcaatgcctcaggaggaacaggaactggtggtaaccatcccaaaaaactctcacaaaaagggggcaaaacttgctgcattgcaaggctctgtgacatcagcacaccaggtccctgccgtgtcctccgtctctcacaccgcgctgtatacacctcccccagaaatcccgaccaccgtcttaaatatccctcatccatccgtcatcagtagtccgctcctgaaatctctacatagcgccggcccacccttgctggctgtgaccgcggcaccgccagcccaaccactggccaagaaaaagggggtgaagagaaaggcggatactacaacccctacgcccaccgctatcctcgcgcccggctcccctgcgtcaccgcctggctctctggagccaaaggcggcacgactccccccaatgaggagggaatctgggagacccatcaagccaccccggaaagatctgcccgattcccagcagcagcaccagagttccaagaagggcaagttgtctgagcagttgaaacactgtaatggaatcctgaaagagctccttagcaaaaagcacgcggcctacgcttggccattctacaagccagtggacgcgagcgccctaggtcttcacgattatcatgacattattaaacatcccatggatctcagcaccgtcaaacggaaaatggagaacagggactatcgagacgcacaggaattcgctgctgatgtgaggctgatgttttccaactgctataaatacaacccccccgatcacgacgttgtcgcaatggctagaaagctgcaggatgtgttcgaatttcggtacgcgaaaatgcctgacgagccactcgaacccggacctcttcccgtatcaaccgccatgcctcccgggctggctaagtcatcatcagagagcagtagtgaggagagcagctcagagtcaagctctgaggaggaggaggaggaggatgaggaagatgaggaggaagaagagtctgagtcaagcgactctgaggaagagagggcacataggctcgccgagttacaggagcagctccgggcagtccatgaacagctcgctgcacttagccagggacctatcagcaaaccaaagagaaagcgggagaagaaagagaagaagaagaagcgtaaggcagaaaagcatagagggcgggctggcgcggatgaagatgacaaggggcctagagctccgagaccccctcagccgaaaaagagcaaaaaggcctccgggagcggcggaggatcggctgctctggggccctccggattcgggccaagcggcggaagcggcacctag

SEQ ID NO: 110028 - DNA, 987 bp, Artificial Sequence
  Description of Artificial Sequence: Synthetic coding sequence
tgagccaaatcttctagtgagagcagctctgaggagagctcttccgaatctagcagtgaagaagaagaggaagaagacgaggacgaagaggaagaagaaagtgaatcctccgactcggaagaggaaagggcacacaggctagctgaactccaggagcagttacgggctgtccacgagcagctggctgcattaagccaaggccccatctctaagcccaagagaaaaagggaaaaaaaggagaagaaaaaaaagcgtaaggcagagaagcatagaggtagggcgggtgcagatgaagacgataaaggtcctcgggccccccgcccgcctcagcccaaaaaatccaagaaggcatctgggtctggcggcgggtcagccgccttgggcccttctgggttcggaccatccggtggctctggaactaaactgccaaaaaaagctacaaaaaccgctcctccagccttgcccacaggttacgacagtgaggaagaggaggagtcacggccaatgtcctacgacgagaaaaggcagctctccctggacataaacaagctcccgggcgaaaagcttggccgcgttgtgcacataatccaagccagagaaccctcgctccgtgactctaaccctgaagagatagagatcgactttgagaccctgaaaccatctaccctgagggaattagaacgttatgtcctcagctgcctccggaagaaacccagaaaaccatacactattaaaaagcctgtcggaaaaaccaaggaggagctggcgctggagaagaagagagaactggaaaagcgtttgcaggacgtgtcaggacaactgaattcaacaaagaaaccccccaagaaggccaacgagaagaccgagagtagtagcgctcaacaggtggccgtttcaaggctttccgccagtagctcaagctctgactcttcttcaagcagcagcagcagcagttcctctgacacatcagattcagattcagggtag

SEQ ID NO: 110029 - DNA, 2046 bp, Artificial Sequence
  Description of Artificial Sequence: Synthetic coding sequence
atggatatggggactattaaacgcaggctagaaaataactactattgggcggcctccgaatgcatgcaggattttaataccatgtttacaaattgttatatttacaacaagcccacagacgacattgtgttaatggcacagaccttggagaagatcttcttgcagaaagtggcctctatgcctcaggaagagcaggagttagttgttacaatcccaaagaactcgcataagaaaggcgctaagctggctgcactacaggggagtgtaacgagcgcacatcaagtgcccgctgtgagttcagtcagccacactgctctgtatacaccgcctccagagattcctaccactgtgtttaacattccacaccctagtgtcatctcatcccccttgcttaagtctctccacagcgccggtccaccactattggctgtcaccgccgcaccccccgcacagcctctcgctaagaaaaagggagttaaacgcaaggctgacactacaacacccacaccaactgccatacttgcccccgggtcccctgccagtccccccggcagcctcgagcctaaggcagcaaggctccctccgatgcgccgcgagtcaggtaggccgataaaacccccgcggaaagatcttcccgacagtcagcaacaacaccaaagcagcaaaaaaggcaaactttccgaacaacttaaacactgtaatggcattctaaaagaactgctgagtaagaagcatgcagcttacgcatggcccttctataagcctgttgatgccagcgcactgggcctccacgattatcatgacatcatcaaacaccccatggatctttctactgtgaagcggaaaatggagaacagggactacagagacgcccaggagttcgcggccgatgtgcgtctgatgttcagcaattgttataaatataatcctcctgaccatgacgttgtggccatggcccgcaagcttcaggacgtcttcgaattcaggtatgcaaagatgccagatgaacccctggagcccgggccactgcctgtcagtacagctatgcctccaggcctggcaaaatctagttcggagagcagctcagaagagagctcaagtgagagctcaagcgaagaggaggaggaagaagatgaagaagatgaggaggaagaagagagcgagtccagcgacagcgaggaagagagggcccacagactcgccgaactgcaggagcagcttcgcgccgtgcacgaacagctggctgccctgtcccaggggcctatttctaaaccaaagagaaaaagggagaagaaagagaagaaaaagaaaaggaaagcagagaaacataggggccgggctggcgctgacgaagacgataaaggacccagagcacccagacctccccagcccaaaaaaagcaagaaagcctctggatcaggtggcggctcagccgctctggggccctcaggttttgggccaagcggcgggtcaggaacgaaacttccgaaaaaagctacaaaaaccgccccaccggcactaccaaccggatatgactctgaggaggaggaggaaagtcggccaatgagttatgacgagaagagacagctgtccctcgacatcaataaactgccaggcgagaagttgggacgcgtggtccatatcatccaggcccgggaaccaagcttacgggactccaaccccgaagaaatagagattgactttgagaccttgaagcctagtaccctcagggagcttgaaaggtatgtgctcagttgtcttagaaaaaagccccggaagccatatacaatcaagaagcccgttggtaaaacaaaggaagagcttgcgctcgaaaaaaagcgagagctggaaaaaagattgcaagatgtctcggggcagttgaatagcactaagaaacctccgaagaaggccaatgaaaaaactgagtcatcctctgcccagcaggtggcggtcagcaggctaagcgcctcttcatcctcctccgacagcagtagctcttccagttcctcttcctctagtgacaccagcgacagtgacagcggttag

SEQ ID NO: 110030 - DNA, 2265 bp, Artificial Sequence
  Description of Artificial Sequence: Synthetic coding sequence
atggcgagcgttcctgccttacaattgactccggccaacccccctcctcccgaggtgtctaaccctaaaaagcccggtagagtcactaaccagttgcagtatctgcataaagtggtcatgaaagcgctctggaaacaccagtttgcatggccatttagacagcccgtagacgccgtcaagctgggcctcccagattaccataagatcattaaacagcctatggacatggggaccattaaacgccggctggagaacaactactactgggccgcgagcgaatgcatgcaggacttcaacacaatgtttactaactgttacatttataacaagccaacagatgacattgtcctgatggctcaaactctggagaagatattcttgcagaaggtagcctccatgccacaggaagaacaggagctggttgtgaccatacccaagaactctcataagaagggcgcaaagctggctgctctgcagggatctgtgacttccgctcatcaggtgcctgccgtgtcttcagtgtcacataccgcactatacactccaccccccgaaatccccaccacagtatttaatatccctcacccgtccgtgattagcagtccgctgctgaaatctctgcacagcgccggtcctcccctgctggccgtgaccgcggccccgcccgcccagccgctggccaagaagaagggagttaagaggaaagctgacactactactccaactcctaccgcaattctcgctccaggctctcccgcatcacctccagggagcctcgaacccaaagccgcccgcctgccccccatgaggagagaatccggacggcccattaaaccacctaggaaagatttgcctgattcccagcagcaacaccagtctagcaaaaagggaaaactgagcgaacagttaaaacactgcaatggaatcctgaaggagttactgtcaaagaaacacgcagcatatgcgtggcccttctataaaccggtagacgcttcagcactcggcctgcatgattatcatgatataattaaacaccctatggatctgagcaccgtgaagcgcaagatggaaaaccgggactatcgtgatgcccaggagtttgctgccgacgtacggcttatgttcagtaactgttataaatacaacccaccagatcacgatgtagtggctatggcgcgaaaactgcaggacgtgtttgagttccggtatgccaaaatgcccgacgaaccgttagaacctggtcctttacctgtgagcactgctatgccgcccggcctggccaagagcagctccgagagtagttcagaagaaagttccagtgaatcctcctcagaggaggaagaagaggaggatgaggaagatgaggaggaagaggaatcagagagctcggactcagaggaagagagggcgcacaggctcgctgagctgcaggagcagctgcgcgcagtgcacgagcagctagccgccctgagtcagggcccgatctctaagcccaaacggaaacgagagaaaaaggaaaagaagaagaaaaggaaagctgaaaagcatagggggcgggcaggcgccgacgaggacgataaaggtccacgggctccccgtccacctcaaccgaaaaagagcaaaaaggcatctggctcaggaggcggttccgctgccctggggcccagtggattcgggccttcaggaggaagtggaaccaagctgcccaaaaaagccaccaaaacagcccctccagcgctgcccacgggatatgattctgaggaggaggaggagagtcgtccgatgtcatacgacgaaaaacgtcagttgtctttagacatcaataaactccctggcgagaagctgggcagggttgtgcatattattcaagccagagaaccatctctgagagacagcaatcctgaggaaatcgaaatcgacttcgaaacgctaaaaccttctacactgcgggaattggagcgctacgtcctgagctgcctgagaaagaagcctcgcaaaccatacacaattaaaaagccggtggggaagaccaaagaggagcttgccctcgaaaagaaaagagagctggagaagaggctgcaggacgtcagcggccagctcaattctactaagaaacctcccaagaaggccaatgagaaaacagaatcctcttctgcccagcaggtggccgtgtcccgtctgagcgccagcagtagttcctcagattcctcttcatcatcatcctccagttcctcgtccgatacatccgactctgactcagggtag

SEQ ID NO: 110031 - DNA, 2511 bp, Artificial Sequence
  Description of Artificial Sequence: Synthetic coding sequence
atgcttcagaacgtcacccctcataataagctgcctggcgagggaaacgcaggcctacttgggctgggcccagaagctgcagctcccggtaagcgcatcagaaagcccagcctgctctacgaaggtttcgagtccccaacaatggcgtccgtgcctgctttgcagctcacccctgccaacccaccccccccagaagtgagtaaccccaaaaaaccaggacgcgtgaccaaccagttacagtatctccacaaggtcgtcatgaaagccctgtggaagcatcaattcgcctggcccttccgccagccggtggacgccgtgaagttagggttacccgattatcacaaaataatcaaacaacccatggatatgggcaccattaaacggcgcttagaaaacaattattattgggcagcatctgagtgtatgcaggatttcaataccatgttcaccaactgttacatatataataagccaaccgacgacatcgtgcttatggcccagacactagagaagatcttcctgcagaaagtagctagcatgcctcaggaagagcaagagcttgttgtgacaattccgaagaacagccataagaaaggtgctaaactggcagccctccaaggctcagtgaccagcgctcaccaagtgccagcagtcagcagcgtttctcacacagcactctatacaccaccgcctgagatccctacaaccgtgcttaacattccccaccctagcgtgattagtagcccactgctgaaatctttgcacagcgccggtcctcccctcttggccgttaccgccgccccccctgcccagcctctcgccaaaaagaagggagtcaaacggaaagctgacactactacaccaactccaaccgccatccttgcacctggatcacccgcctctcctccagggtcactggagcccaaggctgccagactaccccccatgcggagagagtccggacgcccaatcaaaccccccagaaaagatcttcctgactcacagcagcaacaccagagctcaaagaagggaaagttgtcagagcagctgaaacactgcaatggcattctgaaggagttgctgagtaagaagcatgctgcatacgcctggccgttttataaaccggtcgacgcaagcgccttgggcctccacgactatcacgacattatcaaacatcctatggacctgtcaaccgtgaaaagaaagatggagaatcgggactatcgtgacgcccaggaatttgcagccgacgtgcgccttatgttctcgaactgttacaagtacaatcctcctgatcacgacgtggttgccatggctcggaaactgcaggacgtgtttgagtttaggtatgcaaagatgcctgatgagccgctggagcccgggccacttcctgtgagcaccgccatgcccccagggctggccaaatcctcaagtgagagctcctccgaagaaagtagcagtgaaagcagcagcgaagaggaggaggaagaggacgaagaagacgaggaggaagaggagtccgagtcttccgattcagaggaagagagagcccacaggctggcggagctccaggagcagctcagggcagtacacgagcagctggcagctctcagccaggggccaatttcaaagcctaagcgtaaaagggaaaagaaagaaaagaaaaaaaagagaaaggccgaaaaacacagagggagagccggagccgacgaagacgataaagggcctagggccccgcggcctccccagcccaagaagagtaagaaggcgagtggctcaggggggggctcagccgctttaggtcctagtggattcggacccagcggcgggtccggaaccaagttgcaggccggtgtgcagtggcgggatttgggcttactacaaccacccttattgggtttcaaacggttctcttgcctcagcctcccctctagccaagattacagattacccaagaaagcgacaaaaacagctcccccggccctccctactggctatgattctgaagaagaggaggaatctaggcctatgtcctacgatgagaaacgccagctgtcattggatattaacaaactgccgggagaaaagctgggacgcgttgtgcatatcatacaggcaagggaaccatcactcagggatagcaaccccgaggaaatcgagatcgacttcgaaaccctcaagccgagcaccctgcgagaactcgaacgatatgttctctcatgtctccgaaagaagcccaggaagccttacactatcaagaagccagttggcaaaaccaaggaagaactggcgctcgaaaagaagcgcgagctcgagaaaaggctccaggacgtgagtggccagttaaacagcaccaagaagcctccaaagaaagcgaacgagaaaacggaatcgtcctctgcacagcaggttgcagttagtcgactttcggcttcctcatctagttccgactcctccagctcctcaagtagtagcagttcctcagacacctctgactcggacagtgggtag

SEQ ID NO: 110032 - DNA, 2046 bp, Artificial Sequence
  Description of Artificial Sequence: Synthetic coding sequence
atggacatggggactatcaaacggcgcctcgagaataactactattgggctgcgagcgaatgcatgcaggattttaacacaatgtttactaactgttacatctacaacaaacctaccgacgatattgtgctcatggcccagaccctcgaaaaaatatttctacagaaagttgccagcatgcctcaagaagagcaggaattggtagttacaattcccaagaactcccataagaagggagctaagttagctgctctacaaggatccgtgaccagcgcccaccaagtaccggctgtctcgagcgtgtcccacaccgccctgtatactccacctccggagatccctactacagtgctgaatatccctcaccccagcgtcatctctagccctctgttaaaaagcctacattccgccgggcctcctctgttggccgtcacagcagccccaccggctcagcctttagctaagaagaaaggagtgaagcgcaaggcagataccacaacgcccaccccgaccgccatccttgctccaggcagtccagcctcacccccgggctcccttgagcctaaggcggcccgactgccacctatgcggagggaaagcggacgtcccatcaagcctccaaggaaagacctccccgactctcagcagcagcatcagtccagtaagaagggcaagttgagtgaacagctgaagcattgcaacggaatcctgaaggagctcctgtccaaaaagcacgcagcatacgcctggccgttctataagcctgtagatgcttcagctcttggactgcacgactaccacgacattatcaaacatccgatggatttaagtacagtgaagcggaagatggagaatagagattatcgtgatgcccaagagtttgccgcggatgtgcggttaatgttttccaattgttataaatataaccccccagaccatgacgtagtggccatggcacggaaattacaagatgtgtttgaatttagatacgccaagatgcctgacgaacctcttgagccaggtcccctccctgtctccaccgccatgccccctgggttagccaaaagcagcagcgagtcatcatcggaagagtccagttcagagtcctcaagcgaagaagaggaagaggaagacgaggaagatgaagaagaagaagagagtgagtcaagtgactcagaagaagagcgagcacacaggttggctgaactccaggaacagctccgtgctgttcacgagcagctggccgcactttcccagggtccaatctccaagcccaaaaggaaacgcgagaaaaaagaaaaaaaaaagaaaaggaaagcggagaagcaccgtggtagggctggggctgacgaagacgataaaggtccacgtgccccccggcctcctcaacccaaaaagtcaaaaaaggccagtggctccggtggcggttccgccgctctgggcccaagtgggtttggtccctcggggggctcagggaccaagctaccaaagaaggccacaaaaaccgcacctcccgcccttccaaccggctatgactccgaagaggaggaggaatcccgtcccatgtcatacgacgagaagcgccagttatccttggatatcaataaacttcccggcgagaagctcggaagggtggtacatatcatccaggcccgtgagccatcgctgagggattccaaccccgaggaaattgagatcgactttgaaactctgaaaccttcaaccctcagagagcttgaaagatacgtgctaagttgcttacgaaagaagccacggaaaccctacactattaagaagcctgttgggaagaccaaggaggaactggcccttgagaagaaaagggaacttgagaaacgcttgcaagacgtgagtggccagctcaactcgacaaagaaaccaccgaagaaagcaaacgaaaaaactgaatcatcatctgcccagcaggtagccgtgtcacggctgtcagcgagcagctcctcctcagactcctcgtccagctcatccagctccagttccagcgatacttccgatagcgactctggctag

SEQ ID NO: 110033 - DNA, 2511 bp, Artificial Sequence
  Description of Artificial Sequence: Synthetic coding sequence
atgctccagaatgtgacgccacataacaagcttcccggagaaggtaacgccgggttattggggctcggtcccgaagccgcggcacctgggaagaggatccggaaacccagcttgctttatgaagggtttgaaagtcccacgatggctagtgtgcccgcattgcaactaacgcctgctaaccctcctccgccagaggtttccaatcccaaaaaacctggcagggtgaccaatcaactgcagtatctccataaagttgtgatgaaggcactgtggaaacaccagttcgcctggccattcaggcaacccgtggacgccgtgaagttgggtctgcccgattaccacaagattattaaacagcctatggacatgggcacaatcaagaggcgcctagagaataattattactgggccgctagcgaatgcatgcaagatttcaacacaatgtttaccaactgctatatttataacaagccaaccgacgacatagtcctgatggcccagactttggaaaagatcttcctgcagaaagtcgcttcgatgccacaggaggagcaggagttggtggttaccattcccaaaaacagccataagaagggagccaaattggccgctttacagggatccgtaaccagcgcgcaccaggttcccgccgtgtcgagcgtctctcacaccgccctgtacacacccccacctgaaatccctacaaccgtgttgaacattcctcacccttcagtcataagctccccactgcttaagagtcttcattccgcgggaccccctttgctcgccgttaccgcggctcctcctgcccaacctctggctaaaaaaaaaggagtgaaacgtaaggctgataccaccacgccgacccccactgctattctggcacccggatcaccagcttcaccccctgggagcttggaacctaaagccgcccggctgccaccaatgagaagggagagcgggcgtcctattaaacctcctagaaaagaccttccagattcgcagcagcagcaccagagctccaagaagggtaaactgtctgaacagttgaaacactgtaacggaattctgaaagagctgctgtctaaaaagcacgccgcatacgcctggcctttctacaagcctgtggacgcttccgccctcggcctccacgactaccatgacattattaagcatcccatggatctgtccactgtcaagcggaaaatggagaaccgagactaccgggatgcacaggaatttgccgctgatgtacgacttatgttttcgaactgctacaagtataacccgccagaccatgacgtcgtcgcaatggcccggaaactgcaggacgtctttgagttcagatacgccaagatgccggacgaacctcttgaacccgggccactacctgtgagtacggccatgcccccagggctcgcaaagagcagcagtgaatctagttcagaggagagcagcagcgaaagctcttcggaggaggaggaagaagaagatgaagaggatgaagaagaagaagaaagcgagtcatccgacagcgaggaagagcgcgctcacagattagcagaactacaggaacaactcagggctgtgcacgagcagttagcagctctcagccaaggtcccatcagcaagcccaaacgaaaaagggaaaagaaggagaaaaaaaagaagagaaaggccgagaagcaccgtggaagagccggggcagatgaagacgacaagggtcctcgcgccccacgaccccctcaaccgaagaagagcaaaaaggccagtgggtcaggtggggggagcgccgccttggggccgagcggattcggaccaagcgggggctctggcacaaagttacaagctggcgtgcaatggcgggacttgggcctgttgcagcctcctctcttaggtttcaagaggttctcgtgcctgtccctgccttcatcccaggattatcgcctgcctaagaaggcgactaaaacagcccctccagccctacctaccggttacgattcggaggaggaggaggagtcccgcccgatgtcctacgacgagaaaagacaactgtcactggacataaacaaattaccgggagagaaactggggcgcgttgtacacattattcaagctcgggagccctcgcttcgggattccaaccctgaggagatcgaaatagacttcgagaccttaaaaccctcgacactccgggagctcgagaggtacgtcctgagttgtctgcggaaaaaaccgcgtaaaccatataccatcaaaaagccagttggtaagacaaaggaggaacttgccctggaaaaaaagcgggaacttgagaagcgcttgcaggatgtaagcgggcagctcaattcaaccaaaaagccccccaaaaaagccaacgagaagacagaatccagctctgcccagcaggtggccgttagtagactgagcgcctctagttcttctagtgactcctcttcttcttcttcatcatctagcagttccgacacgagcgatagcgactctgggtag

SEQ ID NO: 110034 - DNA, 2265 bp, Artificial Sequence
  Description of Artificial Sequence: Synthetic coding sequence
atggcctcagtgccagccctgcaattaaccccggcaaaccctcctcccccagaggtgagtaaccccaagaaaccgggccgagtaactaatcagctccagtatctgcacaaggttgtgatgaaagctctatggaagcaccagtttgcctggccattcaggcagccagtagatgcagttaaacttgggttgcctgattaccataagataatcaagcagcccatggacatgggcacaataaaaagaaggctcgagaataactactactgggctgcctctgaatgtatgcaagactttaacaccatgttcacgaactgttatatctataataaacccacggacgacatagttctcatggcacagacacttgaaaaaatcttcctccaaaaagttgcatcaatgcctcaagaggagcaggagctggtggtaacaatccccaaaaattcccataagaagggagctaaactagctgctctccagggatctgtcacatctgcccaccaggtccctgctgttagctcggtaagtcacactgccctgtacacccctccaccagagatcccaaccacggtgctgaatatcccccatcctagcgtaatctcttccccactcctcaaatcactccattctgccggcccccccctgctggccgtgacagctgctcctcccgcacagcccttggctaaaaagaaaggagtgaagcgcaaggcagataccactactccaaccccaactgccatactggcacccgggtcccctgcatcacccccggggtccctggaaccaaaagcagcacgactgcccccaatgcgcagagaatccggacgacctataaaacccccacgcaaagatttacccgactcccagcagcaacaccagagctccaaaaaaggcaaacttagcgagcagttgaaacactgcaacggtattctcaaggagctgttgtccaaaaagcatgctgcctatgcgtggccattctataagcccgtcgatgcaagcgccctcggcttacacgactaccacgacatcatcaagcaccctatggatctaagcaccgttaagcggaaaatggagaacagggactatcgtgatgcccaagaattcgccgcggacgtaagactgatgttctccaactgttataaatacaatccccctgatcatgatgtggtggccatggctcggaagctgcaggacgtgttcgaatttcggtacgccaaaatgcccgatgagcccctggagcctggcccgcttcccgtgagcactgctatgccacctggacttgcaaagtcctccagcgaaagcagttcggaggagagttcaagtgaaagcagttctgaagaggaagaggaggaggacgaagaagacgaggaggaagaagagtcagagagcagtgactcggaagaagagagggcccacagactggccgagctgcaagagcagctgcgagcggttcacgaacagctcgccgccctaagccagggacccatctccaaacctaaacggaaacgggaaaagaaggagaaaaagaagaagcgcaaagcagaaaagcacagagggcgcgccggtgccgacgaggacgacaagggtcccagggcacccagacctccacagcctaagaagtctaagaaagccagcggatctggcggcggatctgcggcactgggaccaagtggattcgggccttccgggggatccggcaccaagctacctaaaaaggcgaccaaaactgccccaccggcactgcctacaggctacgacagtgaggaggaagaggaatcacgcccaatgagctacgacgagaaaagacaactgagcctggacatcaacaaactgccaggggaaaagttgggacgggtcgtgcatattatccaggctagggaacccagtctccgcgacagtaaccccgaggaaatcgagatagattttgaaaccctaaaaccatcgaccttacgcgagttggagagatatgtattgtcgtgtctccgtaagaaaccacgaaagccatacacaattaaaaaacccgtgggaaagacaaaagaagagctggctctcgagaaaaagcgcgagcttgaaaagcgcctacaggacgtgagcggacagctgaattcaaccaagaagcctcctaagaaggccaatgaaaagaccgaatcgtccagtgcgcagcaggtagcggtgagtcgactttctgcaagcagttcctcaagcgactccagctcctccagtagctccagttcttcttcagacacaagcgactcggacagtggctag

SEQ ID NO: 110035 - DNA, 2046 bp, Artificial Sequence
  Description of Artificial Sequence: Synthetic coding sequence
atggacatggggaccatcaagaggcggctggagaacaattactactgggctgcttcagagtgcatgcaggacttcaataccatgtttactaattgttacatctacaacaagccaacagacgacattgtgctgatggctcagacacttgaaaaaattttcctgcaaaaggttgccagtatgccccaggaagagcaggagctggtggtgacgatccctaagaattctcataagaagggggccaaactcgccgccctgcagggaagcgttactagtgcccatcaggtgcccgctgtgtcatctgtgtctcataccgcgctctatacacctcctccggagattcccactacagtgctgaacatccctcatccttcagtaatctcttccccgctgcttaagtctctccatagtgccggcccacccctgctggccgtgacggctgccccgccggcgcagccactggctaagaaaaagggcgttaagaggaaagctgatacaactacccctactcccactgcaatattggcaccaggttcaccggctagcccacctgggtcactggaacctaaggcagcccgcttgccaccaatgagacgcgaatccggtaggccaattaaacctcccagaaaggacttgcctgactcacaacaacagcaccaatctagcaaaaaggggaagttgtccgagcagctaaaacactgcaacggaatcctcaaggagctgctgagtaaaaaacacgctgcatatgcttggcccttttataagcctgtggatgcatcggccctgggtctacacgactaccatgacattatcaagcatcccatggatctttcgactgtgaagaggaagatggagaacagggactatagggacgcgcaggaatttgctgcggacgtccggctgatgttctctaactgttacaaatataaccctcctgaccacgacgtcgttgcgatggcccgcaaattacaggacgtttttgagtttagatatgccaaaatgcccgacgagccgctcgagcctggccccctgccggtgtctacagccatgcccccaggactggccaaatcaagttcggaatcctcatcagaagagtcttcctccgaatcctcctcagaggaagaagaggaggaggatgaggaagatgaagaggaggaggaaagcgagagcagcgatagcgaggaggaacgggctcacaggctcgctgagctccaggagcagttaagagccgtgcatgagcagctggctgccctgtcccagggacccatttctaaaccaaaacgtaagagagaaaagaaagagaagaagaagaagaggaaagcggaaaagcacagggggagggccggggcagacgaggacgacaaaggtcccagggcccccagacccccccagccgaagaagtccaaaaaagctagcggaagcgggggcggtagtgccgctttgggtcctagtggttttgggccgtcgggagggtctggtaccaagctgcccaagaaagcgaccaaaacagccccacctgcattacctacaggatatgactccgaagaggaggaagagagcaggcctatgtcctatgatgaaaaacggcagctttcactggacataaataagctgccaggcgagaagctgggaagggtcgtgcacatcattcaggcccgcgagccctcgcttcgggatagcaatcccgaggagattgaaatcgactttgagactctgaagccatccacccttagggaactcgaaagatatgtactgtcatgccttcggaaaaagcctaggaaaccatataccataaaaaaaccagtagggaagaccaaggaggaactcgcccttgagaagaagcgggagctcgaaaaacgccttcaggacgtgtccggccagctgaatagcaccaagaaacccccaaaaaaggctaacgaaaaaaccgagtcttcgagcgcccagcaggtggccgtatctcgcttgtcggccagtagtagcagttccgacagctctagctcttcctctagttcctcctcatcagatacgagcgacagtgattcaggatag

SEQ ID NO: 110036 - DNA, 2511 bp, Artificial Sequence
  Description of Artificial Sequence: Synthetic coding sequence
atgctccaaaacgtaacgcctcacaacaagcttcctggagagggcaatgccggactgcttggtctgggacccgaggctgcggctccaggaaaaagaattcgcaaaccaagtctactgtatgaaggattcgagtctcctacaatggcctctgtgcccgctttgcaactgacgcccgccaaccctccacctccggaagtcagcaacccaaaaaaaccagggcgagtcacgaaccaactacaatatctccacaaggtggtgatgaaggcactatggaaacaccagttcgcctggcctttcaggcaacccgtagacgccgttaagctggggctccctgactaccacaaaataatcaaacaacccatggatatgggaactatcaagaggcggttggagaacaactattactgggccgcctctgagtgtatgcaggatttcaacactatgttcacaaactgctatatatataacaaacccacagacgacattgtcctgatggcacaaactctggaaaagatatttctccaaaaggttgcgtctatgcctcaggaggagcaggagctcgtggtcacaatcccgaaaaactcccacaaaaagggtgctaaattggcggctctacaggggtctgtgaccagcgcccaccaggtccccgcagtttcaagcgtttcacacaccgcactttatacaccacctccagagatccccacaacagtgctgaatatccctcaccccagcgttatcagctccccacttctgaaaagcctccatagtgcaggacctccactcctcgctgtaactgccgctccacctgcccagccactcgcaaagaaaaaaggcgtgaagcgcaaagccgacacaacgactccgacaccaactgccattcttgcacctggaagccctgcgtctccccctggctctctggagccaaaagcagccagactgcctccaatgagacgtgagagtgggaggcccatcaaacctccgcgtaaggacctgcccgatagtcagcagcagcaccagagcagcaaaaaaggaaagttgagtgaacagttgaagcactgtaacggaatcctcaaagaactgctgagcaaaaagcacgccgcgtacgcctggccattttacaagccagtcgacgcatcagcactgggtctccacgactatcatgacatcataaagcacccaatggatctctctacagtgaagcggaagatggaaaatcgcgattaccgcgacgctcaggagttcgccgctgatgtgcgcctgatgttttctaactgctataagtataacccccctgatcatgacgtggtagccatggcccgaaagctgcaagacgtttttgagtttcgttatgctaaaatgccagatgaacctcttgagccggggcctctgccagtttccaccgcaatgccgcctggactggccaaatcaagttccgagtcctcttctgaggagtcttcttccgagtcaagtagtgaagaggaggaggaagaggatgaagaggatgaggaagaggaggaatccgaaagctcggactctgaggaagagagagcccacaggctggcagagctccaggagcagttgcgggctgttcacgaacagttggccgctctctctcagggccccataagtaaaccgaagcggaagcgtgaaaagaaggaaaagaaaaagaagagaaaagcggagaagcatagaggccgggcaggtgcagacgaggatgacaagggacctcgggccccgcggccgccccagcccaagaaatccaagaaggccagcggcagcggaggtgggtctgcagctctaggcccatctggctttgggccatccggcggatccgggactaagttacaggctggtgtgcagtggagggacttgggactgctgcagcccccactgcttgggttcaagagattctcatgcctctctcttccttcaagccaggactaccgattacctaaaaaggctactaagacagcccccccagcactgcctaccggatatgactctgaggaggaagaagaaagtaggcctatgtcatacgatgagaagcgccagctcagcctggatattaacaaactgccaggagagaaactcggtagagtcgttcacataattcaggccagggaaccctccctgcgggattccaaccccgaagaaatcgagatagactttgagactttgaaaccttcaacgctgagagaattggagagatatgtactctcttgtctccgcaagaaacctagaaaaccatatacaataaaaaaaccagttggaaaaacaaaggaagaactggcactcgaaaaaaagcgcgagctggagaaaagacttcaagatgtgtcaggtcagcttaactcaactaagaaacctccaaagaaagctaacgagaagactgagtcctcgtccgctcaacaggtggccgtttcacgcctgtccgcgtcttccagttcttcggattccagttcttcttcctcctcttcttcgtcgagcgacacttcagactccgactccggttag

SEQ ID NO: 110037 - DNA, 2511 bp, Artificial Sequence
  Description of Artificial Sequence: Synthetic coding sequence
atgctgcaaaacgtgacacctcacaataaactgccaggagaggggaacgccggactgctcggactgggaccagaggctgcggcccctggcaaaagaatacgaaaaccttctctgctctacgaagggttcgaaagccccactatggcaagtgtgcctgccctccagctcactccagccaaccctccaccccctgaagtctccaatccaaagaagcctggccgcgtaaccaatcagctccaatacctccataaggtggtgatgaaggccctctggaagcaccagtttgcatggccctttcgccagcctgtcgacgccgtcaaattaggtttgccggattatcataaaatcatcaaacagccaatggacatgggaaccatcaagcgacggcttgagaacaattattactgggctgcttcagagtgtatgcaggacttcaatacaatgtttaccaactgctacatctacaacaaaccaaccgacgacatcgtgttaatggcccagacactcgagaagatcttcttgcagaaagtcgcctcgatgccccaggaggagcaggagctcgtggtaaccatccctaagaactcccataagaaaggggcaaaactcgctgccttgcagggctccgttacaagcgcccatcaagtcccagctgtttcttccgtgtctcatacagccttatacacaccaccgccagagatccccaccactgtgttcaatatcccgcacccaagcgtcatttccagcccgctgctcaagagtctgcacagtgccggcccaccactgcttgccgttacagctgcccctccggcacaaccactcgcgaagaaaaagggagtgaagcgcaaagccgatacgaccaccccaacgcccaccgcgattctcgcacctggctcccctgctagcccacccggctctctcgagccgaaagccgcccgattgccccctatgagacgtgaaagtggaaggccaatcaagccaccccgcaaggatctcccagatagccagcaacagcaccagtcaagcaagaagggcaaactctctgaacagttaaagcactgtaatggcattctaaaagagctgctgtctaagaagcacgctgcctacgcttggccattttacaaacccgtggacgcctcagctctgggcctccatgattaccacgacatcattaagcacccgatggacctgtcaaccgtgaaaagaaagatggagaacagagactacagggacgcccaggagttcgctgccgacgtcagactgatgttttccaactgttacaaatataaccctcccgaccacgacgtggtggcaatggcccgaaaactgcaagacgtgtttgagttccgatatgccaaaatgccggacgagcctctggaaccgggacctctaccagtctcaactgccatgccacccggcctggctaaatctagctctgaatcttcttctgaagagagctcatctgagtcatccagcgaagaggaggaggaggaagacgaggaagatgaagaggaggaggaaagtgaatccagcgattctgaagaagaaagagcgcaccgcctggcagaactccaagagcagttgcgcgctgtgcacgaacaactcgccgctctgagccagggaccaatcagtaagcccaagagaaagagggagaagaaggagaaaaagaagaagcggaaggcagaaaaacacagaggacgcgccggcgcagacgaagacgacaaagggcctcgggcccctagacctccccagcccaagaagagcaagaaagcatcaggctccggaggtggctctgcagcactcggaccgtccggcttcggaccttccgggggaagcggaactaaattgcaggccggtgttcagtggagggacctggggctgctgcagccacccctgctagggttcaaaaggttcagttgcctctccctcccctcctctcagaactaccggctcccaaagaaggcaacaaaaacagcgccccccgctctccctacgggctacgactctgaggaggaggaggaatccaggcccatgtcttatgacgagaaaaggcagctttccctggatatcaacaagctccccggggaaaaattggggcgggtcgtgcacataattcaggccagagaacccagcctgagggactccaatcctgaggaaattgagatcgactttgagactctgaaacccagtacgctgcgggaacttgaacggtacgttctgtcctgccttaggaagaagccgaggaaaccatacaccattaagaaaccggttggaaagactaaagaggaactggcccttgaaaagaagagagagctggagaagcgcctgcaagacgtgagcgggcagctcaactctaccaagaagccacccaaaaaagccaacgagaaaacggaaagcagttccgcacagcaggtggccgtgtccaggctcagcgccagttcatcctcttcggatagttctagcagctcctctagttcgtcaagcagtgacacatccgactccgacagtggatag

SEQ ID NO: 110038 - DNA, 2265 bp, Artificial Sequence
  Description of Artificial Sequence: Synthetic coding sequence
atggccagcgtgccagctctgcagttgacccctgcaaaccccccaccaccagaagtgagcaacccgaaaaagcctggacgcgtcacaaatcagcttcagtacctgcacaaggttgtcatgaaagccctgtggaaacaccagttcgcgtggccattccgacaacccgtggacgctgtgaaactaggtttgcccgattaccacaagatcattaaacaacccatggatatggggaccataaagcgcaggctggagaataactactactgggcagcatcagaatgtatgcaggacttcaacacaatgttcacaaattgttacatttataataagcctactgatgacatagtgctgatggcccagaccctggagaaaattttcctgcaaaaggtcgcttctatgccccaggaagaacaggagctggtcgtaactattcccaagaactctcacaagaagggcgcgaagctggctgctctgcaggggagtgtgactagcgcccatcaagtgccagccgtgtccagcgtttcccataccgccctttatacacctccccccgagataccaaccacggttctgaacatcccccacccttcagtcataagtagccctcttctgaaatctctgcatagtgctgggcctccattgctggctgtgacagccgcgcccccggctcagccactggctaaaaaaaagggcgtgaagcggaaggccgataccactacccccactcctaccgccatcctggccccaggctcacctgcctcgccacccgggagtttggagccaaaggcagctagactgccaccaatgcgccgagagtcaggcagacccatcaaaccacctcgcaaggatctccctgactcgcagcagcagcatcagtcatcaaaaaagggaaagctttctgagcaactgaaacattgcaacggcatcctaaaagagctccttagtaaaaaacacgccgcctacgcatggcctttctacaaacccgtcgacgcttctgccctcggactccatgactatcacgacatcattaaacatccaatggacctgagcacagtcaaacgcaaaatggagaatagggattaccgcgacgcccaggaatttgcagcagatgtccggttgatgttttcaaactgctacaagtacaaccctccagaccacgacgtggtcgcgatggcccggaagctccaggacgtatttgagtttcggtacgccaagatgcccgacgaaccactggagccaggccccctgcctgtctcaacggccatgcctccaggcctagccaaaagctctagcgagtcctcctcagaggagtcatcctcagagtcatcgtctgaggaagaagaggaggaagatgaggaggatgaggaagaagaggagtcagagagcagcgactccgaggaagagcgggcgcaccggttggccgagctgcaggagcaactgagggccgtccacgagcagctggccgctctgtcccagggaccaatttctaagcctaagaggaagagagagaagaaagaaaaaaagaagaaaaggaaggctgagaagcatcgtggaagagctggagctgacgaagatgataagggtccgcgagccccacgacccccccagccaaaaaagtccaaaaaggcgtcgggaagcggaggcgggtcagctgctctgggcccctccggttttggacctagtggcgggtcagggaccaaactgcctaagaaagctactaaaacagcacctcctgcactacctacgggttacgacagcgaagaggaggaagaaagtcgcccaatgtcttatgacgagaagcggcaactgtcacttgatattaacaaactccccggagaaaagctcggacgggtggtccacatcatccaggcacgcgaacccagcctaagggatagcaaccctgaggaaatcgagatcgatttcgaaacactgaaaccttcaacactccgggagctcgagagatacgtccttagctgcctgagaaaaaagccaagaaaaccctacaccatcaaaaaacccgtaggaaaaactaaagaggagctagccctggagaagaaaagagagctcgagaagcgtctacaggatgtgagcggtcagctcaacagtacaaaaaagcctcctaagaaggctaatgagaaaaccgaatcctcctccgcccagcaggtcgcggtgagccgcctcagtgcctccagcagttcctctgatagttcaagcagctcctcttccagcagctccagtgatacgtctgactccgacagcggctag

SEQ ID NO: 110039 - DNA, 2406 bp, Artificial Sequence
  Description of Artificial Sequence: Synthetic coding sequence
atgttacagaatgtgactccccataataaactaccgggtgagggtaacgccgggttgttgggactcggccccgaagccgccgctcccgggaaaagaatcaggaagccttctttactttacgaaggatttgaaagtccaacaatggcctccgttcccgccctccagctcacccccgcgaaccctcctccccctgaagttagcaatcccaagaaaccaggccgagtcaccaaccaactacagtatctgcataaagtggtaatgaaggcactgtggaagcaccaattcgcgtggccttttcgccaacccgttgatgcagtcaagctgggactgcccgattaccacaaaataattaaacagcccatggacatgggtacgatcaagcggcggctcgagaacaactactattgggccgcatcagagtgtatgcaagattttaacacaatgtttacaaattgctacatttacaacaagcctactgacgacatcgtgctcatggcccagacactcgagaaaattttcctgcaaaaagtggccagcatgccccaagaggagcaagagcttgtggtgacaatcccaaaaaatagccataagaagggcgcaaaactggctgcactgcaagggagtgtcacaagtgctcaccaggtacctgcagtgtcttcagtgagccataccgccctgtatactcccccacctgagattcccacaacagttctgaacattcctcatcccagcgtgatcagctcccccctcctgaagtctctgcactccgcaggcccgcccctgttggcagttacagctgcgccgcccgcccagcccctggccaagaagaaaggcgtgaagaggaaggccgacaccaccactcccacgcctacggccatattagctcctggctctccggcttccccccctggctcgctggagcctaaagccgctcggttgccaccaatgcgaagggagagtggacggccaattaagccgcccaggaaagaccttccagatagccaacagcagcaccagtccagtaagaagggtaaactgagcgaacaattaaaacactgcaatggtatcctcaaggagctactgtctaaaaagcacgccgcatacgcctggcctttctacaaacccgtcgatgcatctgctctaggtctgcatgactatcacgatattattaaacacccaatggacttgtccacagtcaagcggaaaatggagaatcgggactatcgagacgcacaggagttcgctgcagacgtgagactgatgttttcgaactgttataagtacaacccgccagatcatgatgtggtcgctatggcaaggaagttacaagacgtgttcgagttccgttacgccaagatgccggacgagcctctggaacccggccctctccctgtttctaccgctatgccacctggacttgcaaagagtagcagcgagtctagttcggaagaaagctcctccgagtcatctagtgaggaggaagaagaagaggatgaggaggacgaagaagaagaggagtctgagtctagcgactcagaggaggagcgggcgcaccgccttgccgaactacaagagcagctgagggcagtacacgaacagctcgctgccttgtcccaaggaccgatcagcaaacccaaaaggaaaagagaaaaaaaagaaaagaagaaaaagcgaaaggctgagaagcaccgaggaagagctggggccgacgaggatgataagggcccacgcgcccccagacccccccagcctaaaaagagcaaaaaggcctctggttcaggcggggggagcgccgcgctgggccctagcggcttcggtccatcagggggctcagggaccaagctccctaagaaggcaaccaagactgcccctcctgctctgcccacagggtacgactcagaagaggaagaagaatccaggcctatgtcttacgatgaaaaacggcaactctccctggacatcaacaaactcccaggggagaagctggggcgggtggtgcatattatccaggcacgagagccctcgctgagggactctaacccagaggagatcgaaatcgactttgaaacattgaagccttcgactttgcgggagctcgaacggtacgtgttaagttgtctcagaaagaagccaagaaagccatacactatcaagaagcccgtgggtaaaaccaaggaggagctggccttagagaagaagcgagagctcgaaaaacggctgcaggacgtgagcggccagctcaattctaccaaaaagcctcctaaaaaagccaatgaaaaaacagagtctagcagtgcccaacaggtggcagtgtctcgattatcggcctccagcagtagctcggattcatcatcgagctcatcctcttcgtcctcttctgacaccagcgattctgactctgggtag

SEQ ID NO: 110040 - DNA, 2046 bp, Artificial Sequence
  Description of Artificial Sequence: Synthetic coding sequence
atggacatgggcacaattaagcgacgactggaaaataattactattgggctgctagcgagtgcatgcaggatttcaacactatgtttactaattgctacatctacaacaagcccaccgacgatattgtgcttatggctcagacactcgaaaagatttttctgcaaaaggttgcgagcatgccacaggaggaacaggaactggtggttactatccctaaaaattctcataaaaagggagctaaattagcagccctgcagggcagtgtgacgtcagcccaccaggtaccagcagtatcctccgtgtcccacaccgcactttacacaccccctccggagattcctaccactgtcctgaatatcccacatccctccgttatttcgtcaccactacttaaatctctgcactccgcaggtcctcctttacttgccgtgacggcagcccccccagctcagccccttgcaaagaaaaaaggagtgaagagaaaggccgacactaccacgcccacacccaccgcaattctcgccccagggagcccagctagtcccccgggttccctggaaccgaaggccgccaggttaccgcccatgcgccgggaatcaggacggcccatcaagccaccaaggaaagatctgccggactcgcagcagcaacatcagtccagcaaaaaagggaagctgagtgagcagctgaagcactgcaatggcattttgaaggaactgctgtccaagaagcatgccgcctatgcatggccattttacaaacctgtcgatgcctcggccctgggactgcatgactaccatgatataatcaagcaccctatggacctttcgaccgtaaagcggaaaatggagaacagggattacagagatgcgcaggaattcgcggccgatgtacgattgatgttcagcaactgttacaagtataaccctcccgatcacgacgtggtggcaatggctagaaagttacaggatgttttcgaatttaggtatgccaagatgcctgacgagcctttggaacccggaccccttccagtgtccacagcaatgcctccaggtctagccaaatccagtagtgagagtagcagtgaggaaagcagctctgaatcttccagcgaggaggaggaggaggaggacgaagaggacgaggaagaagaggagtctgagtcaagcgactcggaagaggaacgcgcccaccgccttgctgagctgcaggagcaactgagggccgtccacgagcagctggctgctctgagccagggaccaatctccaagccgaagcgaaagcgggagaagaaggagaagaaaaagaagagaaaagctgaaaaacaccggggtcgggctggcgccgacgaagatgacaagggtcctcgcgctccaaggcccccacagcccaaaaagagcaagaaggccagtggcagcgggggcggatcagctgccctgggtccttccgggttcgggccctctggcggatccggcacaaaattgccgaagaaggcgacaaaaactgccccccccgccttacctacaggctacgactccgaagaggaagaagaatctaggcccatgtcttacgatgagaagcgacaactgtcgctggatataaataagctacctggggagaagctcggcagagtggtgcacatcattcaggccagggagccctccttgagagactcaaatcccgaagagattgaaatagattttgaaaccctcaaaccatcaacgttgcgtgagttggagaggtatgtgctgagttgcctccgcaagaaaccaagaaaaccctacactattaagaagcctgtgggaaaaacaaaggaggaattggccctggaaaagaagcgcgagctcgaaaagaggcttcaagacgtaagtggccagctaaattccacaaaaaaaccccctaaaaaagccaacgagaaaaccgagtctagcagtgcccaacaggtggctgtaagccggctgagcgcgagttctagctcgtccgatagttcctcgagttcatcctctagttcttcttcagatacttctgattcggattccggatag

SEQ ID NO: 110041 - DNA, 4089 bp, Artificial Sequence
  Description of Artificial Sequence: Synthetic coding sequence
atgtctgctgaaagcggacctgggaccagactacggaacctgcctgtgatgggggacggtcttgagacttcccaaatgagcaccacgcaggcgcaagcacagccacagcctgccaacgcagccagcaccaacccccctccgcccgaaacctctaacccaaataaacctaaaagacagacgaaccaactacaatacctccttcgtgttgtgctgaaaactctgtggaaacaccagttcgcctggccattccagcagcccgtggatgctgttaagctcaacctgcctgactactataagattatcaagaccccaatggacatggggaccatcaagaagaggctggagaataactactattggaatgcacaggagtgtatccaggatttcaatacgatgttcacgaattgctacatttataacaaacctggagatgatattgtactaatggccgaagccctagagaagttattcctccagaagatcaacgagctcccaaccgaggagaccgagattatgattgtacaggcaaagggacgaggaagaggcaggaaagagacaggtaccgcgaagcccggagtctcaacagtcccaaacacaacccaagcatcgacaccgcctcagacacaaactccccagcccaatcccccccccgtccaggctacaccacatccgtttcctgctgtgacacctgacctcattgtccagacccccgtcatgactgtcgtgccgccccaaccacttcagactccgcctcccgtacctccccagccccagcccccacccgctccggctcctcagccagttcaatcccatccccccattattgctgctacacctcagcctgttaaaaccaaaaaaggagtaaagcggaaagctgacaccaccacgccgaccacaatcgatcctatccatgagcctccttccttacctccagagcctaagaccaccaaacttgggcaacgtcgagaatcgtcccggcctgtcaagccgccgaagaaagacgtgcccgatagccagcagcatccggccccagaaaaatcttccaaggtgtccgagcagctgaagtgttgttcggggatcctgaaagaaatgttcgcaaaaaaacacgctgcctatgcatggcccttctacaagcctgttgatgttgaagctctgggcctgcatgactattgtgatatcatcaagcacccgatggatatgtctactattaagtcaaaactcgaagcgcgggagtatcgggacgcccaggagtttggggccgatgtgcgcttgatgttcagcaactgctacaaatacaacccccccgaccatgaagttgtggccatggcgaggaaactgcaagatgtgtttgagatgcgctttgccaagatgcccgacgaaccagaggagccagtagtcgcagttagctcacccgccgttccaccaccaaccaaggttgtggctcccccaagcagcagtgattcatcgtcagattccagttcggacagcgacagtagcactgacgactccgaggaggaaagagcacagaggctggcagagctccaggaacaacttaaggctgtccacgagcaattggccgctctgagccagccacaacagaacaagcctaagaagaaggaaaaggacaaaaaggagaaaaaaaaggagaagcataagagaaaggaagaagtggaggaaaacaagaagtcaaaagccaaggaaccgcctccaaagaagaccaagaaaaataattctagcaattcaaacgtgtcgaagaaggagccagcaccgatgaaaagcaaacctccacctacgtatgagagcgaagaagaggataaatgcaagcctatgtcctacgaagaaaagagacagctctcgctggatatcaataaactgccaggtgagaagcttggccgtgtggtgcacatcatccagagcagggaaccctccctgaaaaactccaaccctgacgagatcgaaatcgactttgaaactctgaagccctctactttgcgcgagctggaacgttatgtgaccagctgcctgagaaagaagagaaaacctcaggccgagaaggtggatgttattgctggaagctctaagatgaagggcttttcatccagtgagtctgagtcctccagcgaatcttccagctcggactcagaagacagcgagactgagatggcgcccaaatctaagaaaaagggacaccccggacgggagcaaaaaaaacaccaccaccaccaccatcagcaaatgcagcaggcccctgccccggttccacagcaacctccccctccaccacagcaacccccgcccccgccccctccacagcaacagcaacagcccccgcctccacctccgccaccttcaatgccacagcaggccgcccctgctatgaaatcctcccccccgcccttcattgccacgcaggtccctgtgttggagccccagctgcccgggtccgtgttcgatcccatcggccacttcacccagcccatactgcatctccctcaacccgaactccccccccatcttccccagccccccgagcacagcacccctccccacctgaatcagcacgcagtggtgtccccccctgcgctgcataatgcgctcccacaacagcccagccggcctagcaacagagctgcagctctccctcccaaacctgctcgtccccccgcagtgagcccagccctaacccaaacacctctgttaccccagcctcccatggcacagccgccacaagtactgctggaggacgaggagcctcccgcccctccgctcacatcgatgcagatgcagctgtacctacaacaactgcagaaggtgcaacccccaacgcccctcttgccttccgttaaggtgcagagtcaaccccctcctccacttccaccacccccacatcccagtgttcaacagcagctgcagcaacagccgcctccgcctccacctcctcagccacagccacccccccagcagcagcatcagccccctcctcgccctgtgcacctccaacctatgcagttttccacccatatccagcagccccctccaccccaaggtcagcaaccaccccacccgccacccggacagcagccaccccctccacaacccgcaaaaccccagcaggtcattcagcaccaccactcacctcgtcaccacaaaagcgacccttattccactggacacctcagagaagcacccagccccctgatgattcacagtccccagatgtctcaattccaaagtttaacccatcagtccccaccccagcagaatgtccagcccaaaaaacaggaacttcgcgccgctagtgttgtgcagccccagccgcttgtggtagtaaaggaagagaaaatccacagtcccatcattagaagcgagccattctccccctctctccgcccggaacctcctaagcaccctgaatcaatcaaggctcctgttcatctcccccagcggcctgaaatgaagccggtcgatgtggggcggccagtcattaggcctcctgagcaaaatgcgccacctcccggcgcgcctgataaggacaaacaaaaacaggagcccaagacacccgtcgctccgaagaaggatctcaagatcaagaatatgggctcgtgggcttctctggtgcagaagcaccctacaacaccctcgagcacagccaaaagcagttcggactcttttgagcagtttagaagagctgcccgcgagaaggaagagcgcgagaaggcgctgaaggcccaagctgagcacgccgagaaagagaaagagcgtctgagacaggagcgcatgagaagccgagaagatgaggacgccctggaacaggctagacgcgcacatgaggaggcaaggcggcggcaggaacagcaacagcaacaacgtcaggagcaacagcagcagcagcagcagcaggctgctgccgtcgcagctgccgcgacaccccaggcccagtcttcgcaaccacagagcatgctggatcagcaaagggaactcgctagaaaaagagagcaagagcgacgtagaagggaggccatggccgctaccatagacatgaatttccagagtgaccttctcagcattttcgaagaaaatctgttctag

SEQ ID NO: 110042 - DNA, 2385 bp, Artificial Sequence
  Description of Artificial Sequence: Synthetic coding sequence
atgtctgccgaatctgggcccggaacccgactcaggaacctccctgtaatgggtgacggcttggagacctctcaaatgtccacgactcaagctcaggctcagccccaaccagcgaatgcggcctctactaatccacccccccccgagactagcaatccaaataagcccaagcgtcagacaaaccagcttcagtacctcctaagagtggtgctgaaaaccttgtggaagcaccagttcgcttggcccttccagcaaccggtggacgcagtcaaacttaaccttcctgactactacaagatcatcaagacccccatggacatggggaccatcaagaaacgcctggagaacaattattactggaatgcccaggagtgtatccaggatttcaatactatgtttacgaattgctacatctataataagccgggagacgacatcgtcctgatggcagaggctctggagaagctgtttctgcagaaaataaatgagctcccaactgaagagaccgagataatgatcgtgcaggcaaaggggcgcggccgggggcggaaagaaactggcacagccaagcctggagtgtccaccgtccccaatactactcaggcctctacccctcctcagacccagacaccccagcctaatcctccacccgtgcaggccacaccccaccccttccccgcagtcacacccgacctgatagtccaaacaccagtgatgaccgttgtgccgcctcagcccttacaaacaccaccccctgtgcccccgcagccgcaaccaccaccggcccccgcgccccagcctgtacagagccatccccctataattgctgcaacgccccagccagtgaagaccaagaaaggagttaagcggaaggccgataccaccactccgaccacgatcgaccctattcatgagccaccgtctctccctcctgaaccaaaaactaccaaactgggccaacgacgggagtcctcacggcctgtgaaaccacctaaaaaggacgttcctgactctcagcagcatccagcacccgaaaagtcaagcaaggtgtccgaacagttgaagtgctgctcaggaattctgaaagaaatgttcgcaaaaaagcacgctgcctacgcttggcccttttacaaaccagtagatgtggaggccctcggtcttcacgattattgtgacatcatcaaacaccccatggatatgtctaccatcaagtctaagctggaggccagagaataccgtgacgctcaggagttcggcgccgatgtgcgactgatgttctcaaattgctacaaatataatccccctgaccatgaagtagtcgcaatggctcgcaaattgcaggatgtattcgaaatgcgattcgctaaaatgccggatgagcctgaggagccagtggttgcagtgtcatctcccgccgtgcctccacccaccaaggtggtggcccccccatcgagcagcgactcctcctctgactcaagtagcgatagtgattccagtaccgacgactccgaagaggaacgagctcagaggctggccgagcttcaggagcagctgaaagcagttcatgagcaactcgcagcccttagccagccccagcagaataagccaaaaaagaaggagaaggataagaaagaaaaaaaaaaggagaaacataagagaaaggaagaagtagaggaaaacaagaagagtaaagcaaaggagcccccgcccaagaagactaaaaagaataactcatcaaactccaacgtgagcaagaaggaacctgcacctatgaaaagtaaaccaccgcccacatacgagtctgaggaagaggacaagtgcaaacccatgtcttacgaggagaagagacagctgagtttggatatcaacaagctcccgggagagaaactaggccgagtggtgcatatcatccaaagcagagaaccatctctcaagaactctaatcccgatgaaatagaaatcgattttgaaacactcaagccaagcacccttcgggaactggagcggtatgtgactagttgccttagaaagaagcggaaaccgcaggcagagaaagtggacgtgatcgccggaagcagcaagatgaaagggttctcttcgagtgaatccgagtcgtcatcggaaagctcatcttctgacagcgaggatagtgagacggctttttgtacttctggcgattttgttagtcccggtccaagcccgtatcattctcatgtacaatgtggtcgcttcagggaaatgctgcgatggttcctcgtagacgtggagcaaacggccgcgggacagccccatcggcaatctgccgctggcccggccatcacttgggcccccgccatcgcctaccccagccctgaatgtgcaaggtgctgcgtgggatgttcctag

SEQ ID NO: 110043 - DNA, 2169 bp, Artificial Sequence
  Description of Artificial Sequence: Synthetic coding sequence
atgagcgccgaatcgggcccaggcacccggctgcggaatttacccgtcatgggcgacgggttagagacaagtcagatgtctacaactcaggcgcaggcccagcctcagcccgccaacgctgcatctacgaatccccctcctcctgagactagcaatcccaataagcccaaacgacagactaatcagctgcaatacctcctacgggtagtattgaaaaccctttggaaacaccagtttgcctggccctttcaacaaccagtagatgccgtgaaattgaacttgcccgactactataaaatcataaagactccaatggatatgggcactattaagaagagactcgagaataactactactggaatgcgcaagagtgcatccaagatttcaacacgatgttcaccaactgttatatctataataaacctggggatgatattgttctaatggctgaagcactggagaaactgtttctgcagaagatcaacgaactgcctactgaagaaactgagattatgatcgtgcaggctaagggtagaggccggggccggaaagaaaccggaaccgcaaagcccggcgtaagtaccgtcccaaacacaacacaggcgagcactccgccccaaacccaaactcctcagccaaatcccccaccagtgcaggccactcctcacccttttcccgctgttaccccagatctgatcgttcagacgcctgtaatgactgtcgtgccaccccagcctctgcagacacctccaccagttcccccccaaccccagcctccaccagctccggccccccagcctgtgcagtcacatccgccaataatcgcggcaacaccccagcctgtgaagactaagaaaggagtcaagcgcaaagctgataccacgaccccgaccaccattgacccaatacatgaaccgccgtcactgccccccgagcctaagactaccaagctcggacagaggagggagagctcaaggcctgtaaaaccaccaaagaaagatgtcccagattcccaacaacaccccgccccagagaagagctctaaagtgtccgagcagttgaaatgttgttccggcattctgaaggagatgtttgccaagaagcatgcagcctatgcttggcctttttacaagcctgttgacgtggaggccctcggactgcacgactattgcgacataatcaaacatccaatggacatgtccaccatcaaatccaaactggaggcccgagaatatagagatgcccaggaattcggggcagacgtcagattaatgtttagcaattgctacaaatacaacccgcctgaccacgaagtggtggcgatggcgcggaagctacaggatgtgtttgagatgaggttcgccaagatgcccgacgagcctgaggaacctgtcgtcgccgttagctcgcccgctgtgccaccacctactaaagtcgtggcccctccatcaagcagtgacagctcttcggactcgtcatcagactctgactcgagtaccgatgatagcgaagaggaacgtgcacaaagattggctgagcttcaggaacagttaaaggcggtgcatgaacagctcgcggcccttagccaacctcagcagaacaagccgaaaaagaaggagaaggacaagaaagaaaaaaagaaagaaaagcacaaacgaaaggaagaggtggaggaaaacaaaaagagcaaagcaaaggagcccccaccaaagaagaccaagaaaaataattcgtcaaactccaatgtgtccaagaaggagcccgcaccaatgaaatccaagcctcccccaacctacgaatcagaagaagaagacaaatgtaagccgatgagctacgaggagaaacggcaactgagcttagacattaacaagctgcccggcgaaaagctgggaagggtagtacatataattcagagccgggagcctagtttaaagaactccaacccagatgaaatagagattgacttcgagacactcaaacctagcactttaagggagctcgagcgttatgtgacgagttgcctgagaaagaagaggaagcctcaagccgagaaggtggatgtcatagccggcagctccaaaatgaagggcttttcctcaagtgaatccgaatcatcctccgagagcagctcctctgattccgaggatagtgagactggcccggcttag

SEQ ID NO: 110044 - DNA, 2625 bp, Artificial Sequence
  Description of Artificial Sequence: Synthetic coding sequence
atggacctgaatactataaaaaagcgcctggaaaacaaatattacgctaaagcttccgaatgcatcgaggattttaatactatgttcagcaattgctatctctataacaaacccggcgacgacatagtacttatggcgcaagccctagagaagctgtttatgcaaaaacttagccagatgccccaggaggaacaagtggtgggtgtgaaggaacgaattaagaaaggcacccagcagaacatcgctgtttcctcagctaaggagaagagtagcccaagcgccactgaaaaggtgtttaaacaacaggaaatcccgagcgttttccccaaaacctctatttcacccctgaacgtagtgcagggcgcctctgtcaacagtagttcgcagaccgctgcccaggtcacgaaaggcgtcaagcgcaaagccgacactactacccccgccacaagtgcagtgaaagcgtccagcgagttcagtccaacctttaccgaaaaaagtgttgctcttccgcctatcaaagagaatatgccaaaaaatgttctgcccgatagccaacagcagtacaacgttgtaaagacagttaaggtaacagagcagttgagacactgcagcgagatcctgaaagaaatgcttgcgaaaaagcactttagctacgcttggcctttttacaatcctgtcgacgtaaacgcactgggtctgcacaactactatgacgttgtcaagaacccaatggatctgggcactattaaggagaagatggataaccaagagtacaaagacgcctacaaattcgctgctgatgttcgtctcatgtttatgaattgctacaaatataatccccctgatcatgaggtagtgaccatggccaggatgctgcaagatgtattcgaaacccacttctcaaaaatacctattgagccagtcgaatctatgcctctgtgctacatcaagacggatatcacagaaacaacaggtagggaaaacacaaatgaggcctcttctgaggggaattctagtgatgatagcgaagacgagcgtgtaaagcgcttagcaaaattgcaggagcagttgaaggccgtacatcagcagctgcaggtactcagccaggttccctttcgcaagctgaacaaaaaaaaagaaaaatctaagaaggagaagaaaaaggagaaggttaataattccaacgaaaacccgagaaagatgtgcgagcagatgagactgaaggagaagtcaaagcggaaccagccaaagaaacgcaaacagcagtttataggcctgaaaagcgaggatgaagacaacgccaaaccgatgaattatgacgagaaaagacagctctccttaaacatcaacaaacttcctggtgacaagctcggcagagttgtgcacatcattcaatcccgagagccttcgctatctaactccaatcccgatgaaattgagatagattttgagaccctgaaggcaagcacccttcgagaactcgaaaaatatgtgtcggcgtgtttaagaaagagaccgttgaagcccccagccaagaaaatcatgatgagcaaagaggaactccattcgcagaagaagcaggagctggaaaaaagattgttggacgtgaacaatcaattaaattcgcggaagaggcagactaagagtgacaagacgcagccaagtaaggccgtcgagaatgtttccaggctgagtgaatcatcatcatctagcagcagtagttctgagtctgaatcctcctcatctgacctgagctccagtgatagtagtgattcagaaagtgagatgttccctaagttcaccgaggtaaagcccaacgattctccgtctaaggaaaacgtcaaaaaaatgaagaatgaatgtattcccccagaaggtcggacaggtgtgacacaaattggatattgtgtgcaggacactacttcagcaaatacgacacttgtacaccagacaacgccgagtcatgtgatgccccccaatcatcaccagctggcctttaattaccaagagctcgagcacctgcagaccgtgaaaaatatctcccctctgcagatcctcccaccttccggtgacagtgagcagctgagcaacggcatcactgtcatgcatcccagtggggacagtgacacgaccatgctggagtcagaatgccaggcccccgtgcagaaggatatcaagatcaagaatgcggatagctggaaaagcctgggaaagcccgtgaagcctagtggagtgatgaagtcatctgatgagttgtttaaccagttccgtaaggctgctatcgagaaggaggtgaaggcgagaacacaggagctcatacgcaaacatcttgaacagaacacaaaagagcttaaggcatcgcaggagaatcagcgagacctcggtaacggccttacggtcgagtccttcagtaataagatccaaaataaatgttcgggcgaggagcagaaggagcatcagcagtctagtgaggcacaagataagagcaagctgtggcttctcaaggaccgagatttggccaggcaaaaagaacaagagcgcagaagacgggaggccatggtgggcacaatcgacatgacgctgcagagtgatatcatgaccatgttcgaaaacaattttgattag

SEQ ID NO: 110045 - DNA, 45 bp, Artificial Sequence
  Description of Artificial Sequence: Synthetic coding sequence
atgagtctgccctcgcggcagactgccattattgttaatccatag

SEQ ID NO: 110046 - DNA, 2844 bp, Artificial Sequence
  Description of Artificial Sequence: Synthetic coding sequence
atgtcactcccctcccgccagaccgctataatagtaaatcctccccctccagagtacatcaatacaaaaaaaaatggccgcctcactaatcagctgcagtacctccagaaggtggtgcttaaggatctatggaaacactctttttcttggccatttcaaagaccagtcgatgctgttaaactgcagttgcccgactactatacaattattaagaaccccatggacctgaacactattaaaaaacggctggagaataaatactacgcaaaagcaagtgagtgcatagaggactttaacactatgttcagcaattgttatctttataataagccaggcgacgacattgtgctaatggcccaagccttggagaagctcttcatgcagaaactctcacagatgccacaggaggaacaggtcgttggagtgaaagaaaggatcaagaaagggacacagcagaacattgccgtttcctcagccaaagagaagagttccccttcagccacggaaaaggttttcaaacagcaagaaatcccctctgttttccccaagacttccattagccctctcaatgtcgttcaaggagcctcagtgaactccagttcccaaacagccgctcaggttaccaagggagtcaaacgcaaggctgacactaccacccctgctacctcagcagtcaaggcctccagcgagtttagtcccactttcacggagaagagtgtggcattaccacctatcaaagaaaacatgcctaagaatgtcctccccgactctcagcaacagtacaatgtcgtgaagaccgtgaaagtcacggagcagctgagacattgtagtgaaatcttgaaggagatgctggccaagaaacacttctcttacgcctggcccttttacaatcccgtggacgtcaacgccctaggtcttcacaactattacgacgtagtaaaaaacccgatggacctgggcactatcaaagaaaaaatggataaccaggagtacaaggatgcttataagttcgcagctgacgttagactgatgtttatgaattgttataagtacaatcccccggaccatgaggtggtgaccatggcacgcatgctgcaggatgtatttgaaacccacttcagcaagatacccattgaacctgtcgagtcaatgccactgtgctatatcaagactgacatcacggaaacaaccgggagggaaaacacaaacgaagcctcatccgaagggaattcatctgatgactccgaggacgagcgggtcaaacgattagctaagttacaggaacaactgaaagctgtacatcaacagctgcaggttctatcacaagttccctttcggaagttgaacaagaagaaggagaagagcaaaaaagagaagaaaaaagagaaggtcaacaattccaatgaaaaccctaggaagatgtgtgaacagatgcgtctaaaagaaaaatcaaagcgcaaccagccgaaaaaaagaaaacaacagtttatcggtctgaaatctgaagatgaagataatgccaagccaatgaattacgatgaaaaacggcagcttagtcttaatataaataaactgcccggagataaactggggagggtagtacacattattcaaagtcgtgagccatcactgtcgaacagtaaccccgacgaaatcgaaatagattttgagaccctgaaagcctcaactttgcgcgaactggagaagtacgttagtgcctgcctgagaaagcggccccttaaacctcccgccaagaagattatgatgagcaaggaagaactccactctcaaaaaaagcaagagctggagaaacgacttctggacgtgaacaatcaattgaactctcgcaaacgacagaccaagtcggacaaaacacaaccaagcaaggccgtggagaacgtctcccgcctgtccgaatcgagctcaagtagtagcagcagctctgagtcagaaagtagctcttctgacctcagtagtagcgattcttcagattccgagagcgagatgttcccaaaatttaccgaggtgaaaccaaacgactctccgtcaaaggagaatgtaaagaagatgaaaaatgagtgcatcccacccgagggaaggaccggcgttacgcagattggctattgtgtccaggacaccacgtccgctaatacaacgctcgtgcatcaaaccacgcctagccacgtaatgccgcccaatcatcatcagctcgcattcaactaccaggagctcgagcacctgcagactgttaaaaatataagtcctctgcagatactcccgccttcaggtgactccgagcagctgtcaaatggcatcactgtgatgcatccttctggagattctgataccacaatgctcgaaagcgagtgtcaggctccggtgcagaaggacatcaagatcaaaaacgctgattcttggaagagcctcggcaagcctgtgaaacctagcggcgtcatgaagtcctctgatgaactattcaatcagtttcgaaaggccgccattgagaaggaagtgaaagctcgcacccaggaacttataagaaagcacctggaacagaatacaaaggagttgaaggcgtcgcaagaaaaccagcgggatcttggaaatggcttgacggtcgagtcgtttagtaataagatccagaacaagtgcagcggggaagagcagaaggagcaccagcagagcagcgaggcacaggataagagcaagctttggctcctgaaggacagagacctagcacgccaaaaggagcaagaacggcgcagacgcgaggcgatggtcggcaccatcgacatgaccctccagagcgacatcatgactatgtttgagaataactttgattag

SEQ ID NO: 110047 - DNA, 2706 bp, Artificial Sequence
  Description of Artificial Sequence: Synthetic coding sequence
atgagcttgccgagtcgacagacggcaattatcgtcaatccacctccccccgagtacattaacacaaagaaaaacgggagactcaccaaccagttgcaatatctgcaaaaagttgttcttaaagacctatggaagcactccttctcctggccatttcagagaccagtggatgccgtcaaactccagcttccacctggcgatgatatagtgttaatggcgcaagccctcgagaagctcttcatgcagaagctgagccagatgccccaggaggaacaggtggtgggtgttaaagaaaggattaaaaaagggacacagcagaacattgccgtgtcctccgcgaaggagaaatcgtcaccttccgcaaccgagaaagtcttcaaacagcaggagatcccaagtgtctttccaaagacaagcatctcaccactaaatgttgttcagggtgcttcagtgaattcaagttcccagacagcggcgcaggtcaccaagggggtaaagcggaaggctgacactacgaccccggccacatccgccgtcaaagccagttctgaattctcgcccaccttcactgaaaaaagtgtggccttacctccaatcaaggaaaatatgcccaagaatgtgcttcctgacagccagcagcaatacaacgtggttaagactgtaaaagtcacagaacagctgcggcactgctccgagatcctgaaagagatgctagccaagaagcattttagctacgcatggccattctataatcctgtcgacgtgaatgctctgggacttcacaattattacgatgtagtcaagaatcccatggatctggggaccatcaaggaaaaaatggacaatcaggaatacaaggatgcttataaattcgctgcagacgttagactgatgtttatgaactgctataagtataaccctccggatcatgaggttgtgacaatggctcggatgcttcaggatgtctttgaaacccacttctctaaaattcctatagaaccagtggagtcaatgcccctctgctacattaaaacagacatcaccgagaccactggtagggagaatacaaacgaggctagctccgaaggcaatagcagtgacgattctgaggatgagagagtgaaacgcttggctaagctgcaggaacagctgaaggctgtccatcagcagttgcaggtcctgagccaggtccctttcagaaagctgaataaaaagaaagagaagagcaagaaagaaaagaaaaaggaaaaggtcaacaactcaaacgagaaccctcgaaaaatgtgtgagcagatgcgattgaaggaaaaatccaagaggaaccagccaaaaaaacgaaaacagcagttcatcggcttaaaatccgaagatgaagacaacgcaaaaccgatgaactacgatgagaaaaggcaacttagtcttaacataaataaactgcccggagataaactggggcgagtggtccatatcatccaatctcgggagccgtctttgagtaattctaacccggatgaaattgagattgactttgagactctgaaagcatctacactaagggagttggaaaagtacgttagcgcttgcctgcgcaagaggccattaaagccccctgctaagaagatcatgatgagcaaggaggaactgcatagccagaaaaagcaagagctggagaaaaggttgctggacgtgaataaccaattgaactcccgaaaacgtcagaccaaatcggataagacacagccttcaaaagcagtggaaaacgttagcagattatccgagagtagctcgtcctcctccagtagctcggagtccgaaagctcgtcatccgatttgagttcttccgacagcagtgattccgaatccgagatgttccccaagttcaccgaagtcaaacctaatgacagcccaagtaaggagaacgtcaaaaaaatgaaaaatgagtgcatcccacccgagggcaggaccggtgtcactcaaattggttattgcgtccaggatacaacttcagcaaacactacactggtccatcaaacaactccatcgcacgtgatgccaccaaaccaccatcagctagcgtttaattatcaggagctagagcatctgcagactgtgaagaatatcagccctctgcaaatcctccccccttctggagatagcgagcagcttagtaacggcatcaccgtcatgcatccttcaggtgattctgacacgaccatgctggaatccgagtgccaggctcctgttcagaaggatataaagatcaagaacgccgacagctggaaaagcctggggaaacctgtgaagccttcaggcgtgatgaagtcttccgatgaactttttaaccagtttcgtaaggcggccatcgagaaggaggtaaaggcgagaactcaggaactaattaggaagcatcttgaacagaataccaaggagctgaaagcttctcaggaaaaccagcgcgatctgggcaacggactgactgtcgagagttttagtaacaaaattcagaataaatgctccggcgaagagcagaaagagcaccaacagtcctcggaggctcaggacaagtccaaactctggctgctcaaggaccgagaccttgctagacagaaggagcaggaaaggaggaggcgcgaggccatggtgggaacgattgatatgacgctacagagcgatattatgaccatgttcgagaataattttgattag

SEQ ID NO: 110048 - DNA, 2844 bp, Artificial Sequence
  Description of Artificial Sequence: Synthetic coding sequence
atgagtctgccatctcgacagacagccatcatagtgaacccaccccctcccgagtacataaataccaagaaaaatgggcgactaacgaatcagctgcagtacttgcagaaagttgtattgaaggatctttggaagcactccttctcttggccattccagcggccagttgacgcagtgaaactccagctgcccgactattatacaatcattaaaaaccctatggacttaaacacaattaagaagagactggagaataagtattacgcaaaagcatcagagtgcatcgaggattttaacactatgttctcaaattgctacctgtacaacaaacctggagacgatatcgtgctgatggcccaggccctggagaagttgttcatgcagaaactgagtcagatgccgcaggaagagcaggtcgtgggagtgaaggagagaattaagaagggtactcaacagaacattgcggtcagctctgccaaagagaaatcatcaccctcggctacagaaaaagtgttcaaacagcaggagatcccgtctgtttttcccaagacttctatctcgcccttaaacgtggtgcagggagcatcagtcaattcaagctcacaaactgccgcccaggtgacgaagggcgtgaaaagaaaggccgatacgaccaccccggcaacttccgccgtaaaggcaagctctgagtttagtccaacctttacggaaaaaagcgtggcacttccacctattaaggagaacatgccaaaaaatgtcctcccggactcccagcagcagtacaacgtcgtgaaaaccgttaaagtgaccgaacaactcaggcattgttcagaaatcctaaaagagatgctggcgaagaagcatttctcttacgcttggcctttttataatccggtggatgttaacgccttgggcctgcacaattactatgacgtggtcaaaaacccaatggacctcgggactataaaggagaaaatggataatcaggagtacaaggacgcttataaatttgcagctgacgttaggttaatgttcatgaattgttacaagtataaccctcctgatcatgaggttgtgaccatggctcgcatgctgcaagatgtcttcgaaactcactttagcaaaatcccgattgagcctgtggagtcgatgcctctgtgctatattaagacagacatcacagagacaaccggccgtgaaaacactaatgaagcttcctcagaagggaacagcagcgacgactcggaagatgagcgcgttaaacgcctggctaagctgcaggaacagctgaaggccgtgcaccagcagttacaggtgctaagccaggtaccattccgaaagctcaataagaagaaggaaaagtccaaaaaagagaagaagaaggagaaagttaacaattctaatgagaaccctaggaagatgtgcgagcaaatgcgcctcaaagagaagtccaagaggaaccagcccaagaagagaaagcagcagtttattgggctcaaatctgaagacgaagacaatgcgaagcctatgaattatgacgaaaagcgtcagcttagcctcaacatcaacaaattgcctggagataaactgggccgcgttgtacatattatccagtctcgcgagccatctctgtctaattctaatccggacgagatcgagattgacttcgagacgctgaaggcttcgacccttcgagaactcgagaagtacgtgagcgcatgtcttaggaagaggcccttgaagccacccgccaaaaagattatgatgagcaaagaggagctgcattcgcaaaagaagcaggagctggagaaacggttactcgacgtgaacaatcagttgaatagcaggaagcgccagactaagtcagacaagacccagccctccaaggcggttgagaatgtgtccagattaagcgaaagcagttcgtcctctagttctagttctgaaagcgagtcatcatcttcagacctgtcttcgagcgactcctccgactccgaatcggagatgttcccgaagtttacagaagtcaaaccgaacgatagccccagtaaggagaacgtgaagaaaatgaagaatgagtgcattccccccgaagggaggacaggagtgacgcagattggatactgcgttcaggacaccactagtgccaacacgaccctcgtgcatcagacaactccaagccacgttatgccacctaaccaccatcagctggctttcaattaccaagagctggaacacctacagaccgtgaagaatatttcgcctctccaaattttgccaccatccggggattcagaacagcttagcaatgggattacagtcatgcacccttctggggactccgatactactatgctcgagtcagaatgccaggcccccgtccagaaggatatcaagattaaaaacgctgacagttggaaatctcttggcaaacctgtgaagccctccggtgtgatgaagtctagtgatgagttgtttaaccagttcagaaaagctgccattgaaaaggaagtgaaggctcggacacaggagttaatcaggaagcatctggagcagaatacgaaagaacttaaagctagtcaggagaaccaacgcgatctcggcaatggtctgactgtagagtctttcagcaacaaaatccagaacaagtgctcaggggaggagcagaaagaacaccaacagagctctgaagctcaggataagagtaagttatggctgttgaaggatcgggatctggcccggcagaaagagcaggagaggcggcgcagagaagcaatggtggggactatcgacatgactcttcaatcggatatcatgaccatgttcgaaaataattttgactag

SEQ ID NO: 110049 - DNA, 2844 bp, Artificial Sequence
  Description of Artificial Sequence: Synthetic coding sequence
atgtccctccccagtcgccagacagccattatcgttaacccaccccctccagagtatatcaacactaagaagaatgggagactcacgaaccaactacaatatctccagaaagtcgtcctgaaagacctttggaagcattccttcagctggccatttcagaggcccgtcgacgcggtcaaactgcaactgccagattattatacaattattaaaaatcccatggacttgaataccattaaaaaacgacttgagaataaatactacgcaaaggcttccgaatgcatcgaggacttcaacactatgttcagcaattgctacttatacaataagccaggggatgatatagtgcttatggctcaggctctagagaaactttttatgcaaaagttatctcagatgccccaggaagagcaagtggtgggcgtcaaagaacgcatcaaaaaggggacacagcagaatattgcagtgagcagtgctaaggagaagagcagtccgagcgcaaccgagaaagttttcaaacagcaggagattcccagcgtatttcccaaaacctccattagcccactgaatgtggtgcaaggggcatccgttaattcctcttcccagacagcagctcaggtgactaagggagtaaagcgcaaagcagacaccactacccccgccacctccgctgtgaaagcttcctctgaattttcccccacattcactgaaaaaagtgtggcactgcctcccatcaaggaaaatatgccaaagaatgttctcccagacagccagcaacagtataacgtggtgaagacagttaaagtcacagagcaactgaggcactgcagcgagatcctgaaagagatgcttgccaaaaagcacttcagctacgcctggccattttacaaccccgttgatgtgaacgctctcggacttcataactactatgatgtcgtcaagaatcctatggacctgggaacaattaaagagaagatggataatcaggagtacaaggacgcctacaagtttgccgccgatgttcgtctcatgttcatgaattgctataaatataacccgccagatcatgaggtggtgacgatggcccgcatgctgcaggatgtcttcgagacgcattttagcaaaatccccatagagcccgtcgaaagcatgcccctgtgttacattaagactgatatcactgaaacgacagggcgcgagaacacgaacgaggctagcagcgagggaaatagcagtgatgacagcgaggacgaaagagttaaacgcctggccaagttacaggaacagctgaaagctgtgcaccagcagctgcaggtattgagtcaagttccctttcgcaagttaaataaaaaaaaagagaagagcaagaaggagaagaagaaagagaaggttaacaacagcaacgaaaatccgcggaagatgtgcgagcagatgcgcttaaaggagaagagtaagcgtaatcaaccgaagaagaggaaacagcaatttattggcctgaaaagcgaagatgaagacaatgcaaagccaatgaattacgatgaaaaaagacagctgagcttgaatatcaacaaactaccaggcgataaactgggccgggttgtgcatatcatacagagccgcgagccgtcactctccaacagcaatccagacgaaattgagatcgatttcgaaacattaaaggctagtacactccgcgagttggagaaatacgtgtccgcatgtctgaggaaacgtccactcaaaccacctgccaagaaaattatgatgtcaaaagaagagctacatagtcagaagaagcaggagctagagaagcggctgctggacgttaataaccagctcaattccaggaaaaggcagactaagagcgacaagacacagcccagcaaagctgtcgagaacgtcagcagactgtctgaaagcagctccagctcctcttcctcatcagaatcggaaagttctagttcagatctgtctagtagcgattctagtgacagcgagtccgagatgtttccgaaattcaccgaggtgaagccaaatgattctcccagtaaggagaacgttaaaaaaatgaagaatgaatgtattccgcccgaaggacgcacgggcgttacgcagatcggttactgtgtacaggacacgacgtcggccaacaccactctcgttcatcagaccacacccagccacgttatgcctcctaatcaccatcagctggcattcaactatcaggaactggaacacctgcaaaccgtcaaaaacatcagccctctccagatcctgccaccatccggggactcggagcagctgagtaacgggattaccgtcatgcatccgagcggggattctgataccaccatgttggaatcagaatgccaggcaccagtccaaaaagacatcaagattaagaatgcggatagctggaagagtctggggaagccggtgaagccctctggggtgatgaaatcctctgatgagctattcaaccagtttaggaaggctgccattgagaaggaggtaaaggcaagaacccaggaactgatcagaaaacacctggaacagaacacaaaggaactgaaggctagtcaggagaatcagcgcgacctcggtaacgggcttaccgtcgagtcttttagcaataaaatccagaacaaatgctctggcgaggagcagaaggaacaccaacaaagctctgaggctcaggacaagtcaaaactatggcttctgaaggatagggacctcgcaaggcagaaagaacaggagaggcggagacgagaggccatggtaggaactattgatatgacattgcagagcgacatcatgacaatgtttgaaaacaacttcgactag

SEQ ID NO: 110050 - DNA, 531 bp, Artificial Sequence
  Description of Artificial Sequence: Synthetic coding sequence
atgagcctgccctcaaggcagacggctatcatcgtcaaccccccaccccccgaatatatcaacactaaaaagaatggaagactgacgaaccagctacaatatctgcagaaggttgtcctgaaggatctgtggaaacatagctttagctggccctttcagcgcccagtcgatgctgtgaaacttcagctgcccgattattatacaatcatcaagaaccccatggacctgaataccataaaaaagcgcctcgagaataagtactatgcaaaagcatctgaatgtattgaggacttcaatacaatgttttctaactgttatttatataataagcccggtgacgacattgtcctgatggcacaggcgttggaaaaactgtttatgcagaaactttcacagatgccacaggaagagcaggtggtgggcgtgaaggaaagaataaagaagggaacccagcagaacatcgccgtctctagtgctaaagaaaagagctctccctctgctacagaaaaggtctttaaacagcaggagtag

SEQ ID NO: 110051 - DNA, 1389 bp, Artificial Sequence
  Description of Artificial Sequence: Synthetic coding sequence
atgtctctccccagtcggcagacagctattatcgttaatccgccacctccagaatacatcaacacaaaaaagaacggcaggctgaccaaccaactgcagtacctgcagaaagtggtactgaaggatctttggaagcatagcttttcttggcccttccagcggcccgtggacgcagtgaaactacagcttccagactactacacaatcataaaaaacccaatggatctaaatacgatcaagaagagattggaaaataaatactatgccaaggcatcggagtgtattgaggattttaatactatgttcagcaactgctacctgtataataagcccggcgacgatattgtcctgatggcgcaagctttggagaagttgtttatgcaaaagctctcacagatgcctcaggaggagcaggtcgtcggagtgaaggaaagaattaaaaaggggacccagcaaaatatcgccgtgtcgagcgccaaagaaaaaagctcgccttccgccaccgaaaaagtgtttaagcagcaggagatcccctcggtatttcccaaaaccagtatcagtcccctaaacgtggtgcaaggagcctccgtgaattcttcttctcaaactgccgcacaagttacaaaaggcgtcaaacgaaaagccgatacgactacaccggcgacgtcagcagtcaaggcctccagtgagttctccccaacttttactgagaagtcagtcgctctgccccccatcaaagaaaatatgcccaaaaacgtattacccgactcccagcagcagtataatgtggtcaaaacagtgaaagtgactgagcagctccggcattgctctgaaatactgaaagagatgctggccaagaaacatttttcctatgcctggcccttctacaatcctgtggatgtaaatgcgctcggactccacaattactacgacgttgttaaaaaccctatggatctgggaaccatcaaagagaagatggacaaccaggagtacaaggatgcgtacaaatttgccgcagacgtccgcctgatgtttatgaactgctacaagtataatccccccgaccacgaagtggtgaccatggccagaatgttacaagacgtattcgaaacccacttctcaaagattccaatagaaccagttgaaagcatgccactgtgttatataaaaactgatataacagaaacaaccgggagagagaatactaacgaagcctcatcagagggaaactcttctgatgacagtgaagatgagcgtgttaagagactcgctaagttgcaagagcagttaaaagccgtgcaccagcagctgcaggtcttgtcccaggtgccattccgcaaactcaacaagaaaaaggagaagagtaaaaaagagaaaaaaaaggaatag

SEQ ID NO: 110052 - DNA, 468 bp, Artificial Sequence
  Description of Artificial Sequence: Synthetic coding sequence
atgtctttgccatcgcgccaaacagcaatcatcgtgaacccacctccgccagagtacatcaatactaagaagaacggccggctgacaaatcagcttcagtaccttcagaaagtggtcctcaaagacctgtggaaacactccttctcctggcccttccagcggccagtggatgccgtaaaactacagttaccggactactacacaatcattaaaaaccctatggatttgaataccatcaaaaaaagacttgagaataagtactacgctaaggcctctgagtgcatcgaagacttcaataccatgttcagtaattgctatctatacaacaaaccaggggatgacattgttttaatggctcaggccctggagaaactgtttatgcagaagttatctcagatgccgcaggaggaacaggttgttggagttaaggagagaatcaaaaagggtacacagcagaacatagcctag

SEQ ID NO: 110053 - DNA, 603 bp, Artificial Sequence
  Description of Artificial Sequence: Synthetic coding sequence
atgtctttgccttcgcggcagacggcaatcattgttaatccccccccccccgaatatatcaatactaaaaagaatgggagactgactaaccagttacagtacctacagaaagtggttctgaaagacctgtggaaacattccttttcttggccattccaaaggcctgtcgacgctgtgaagcttcagctacccgactattatacgattattaaaaaccccatggaccttaacactattaaaaagagattggaaaataagtactacgcgaaagcctccgaatgcatcgaggattttaacaccatgttttctaattgctacctttataacaagcccggtgacgacattgtgctgatggcacaggcactggagaaactgtttatgcagaagctttcccaaatgcctcaggaagagcaagtggtaggagtcaaggaaagaataaagaaaggaactcagcagaacatagccgtgtcctctgctaaggagaaatcctcccctagcgccaccgaaaaagtattcaagcagcaggaaatcccttcagtgttccccaagacctcaattagccccctcaatgtggtccagggagcatcagtaaacagcagttag

SEQ ID NO: 110054 - DNA, 468 bp, Artificial Sequence
  Description of Artificial Sequence: Synthetic coding sequence
atgagtctgccatcccgccagactgccatcattgtgaatcctccacccccagagtatatcaacaccaaaaagaacggccggctgacgaaccagttgcagtatcttcagaaggtcgtactgaaagacctgtggaaacacagcttcagttggcctttccagagacctgtcgacgccgtaaagctacaactaccagattactacaccattattaagaatcctatggacctgaacacaattaaaaaacgcctagaaaacaaatattatgctaaggccagcgagtgtatcgaagatttcaataccatgttttcgaactgctacctgtacaacaaaccgggggacgacattgtgctgatggcacaggcactggagaaactgttcatgcagaaactgagccagatgccacaggaagagcaggtggtgggcgtgaaggaacggattaaaaaagggactcagcagaatattgcgtag

SEQ ID NO: 110055 - DNA, 159 bp, Artificial Sequence
  Description of Artificial Sequence: Synthetic coding sequence
atgtccctcccttcccgacaaactgctatcatagtcaacccgccccctcccgagtacatcaataccaaaaagaatgggcgcctcactaaccagctgcagtatctccagaaagtcgtcttgaaggacctctggaaacacagcttcagttggccattttag

SEQ ID NO: 110056 - DNA, 291 bp, Artificial Sequence
  Description of Artificial Sequence: Synthetic coding sequence
atgagtttgccctcgaggcagactgccataattgtcaacccgcctcctccggagtacatcaatacaaagaaaaatggacgacttaccaaccaactgcagtacctccaaaaagtggtactgaaagatttgtggaagcattcttttagctggcccttccagaggcccgtggatgctgtgaagctccaactgcccgactattacacaatcatcaaaaatcctatggacctcaacacaatcaaaaaaagactggaaaataagtactatgccaaagcctccgaatgcatcgagtag

SEQ ID NO: 110057 - DNA, 99 bp, Artificial Sequence
  Description of Artificial Sequence: Synthetic coding sequence
atgtctttaccgtcacgccagacagctattattgtcaacccaccaccccctgaatacattaacaccaagaaaaatggacggctgaccaaccaactttag

SEQ ID NO: 110058 - DNA, 1398 bp, Artificial Sequence
  Description of Artificial Sequence: Synthetic coding sequence
atgtccctcccatcaaggcagactgccatcatcgtaaaccctcctcccccagaatatatcaacactaaaaagaacggaaggctgacaaaccagcttcaatacctgcagaaggttgtgctgaaggatttatggaaacactcttttagctggccctttcagaggccagtggatgctgtgaaactccagctcccggactattataccattattaaaaatcccatggatctcaacacaattaagaagcgtctggagaataagtactatgctaaagcctccgagtgcatcgaggacttcaacactatgttcagcaattgctatctatataataaacccggcgacgatattgtgctgatggctcaggccttggaaaaactgtttatgcagaaactcagtcagatgcctcaggaagaacaggttgtcggagtgaaagaacggataaagaaagggacacaacaaaatatcgctgtttcttctgccaaagagaaatcttcaccttctgccacggagaaagtattcaaacagcaggaaataccttccgtttttcccaagacttcaatatcaccccttaacgttgtgcaaggagctagtgtaaacagcagctcacagaccgcagcgcaggtaaccaaaggagtgaagagaaaagccgatacaactactcctgcaactagcgccgttaaagcgtcatctgaattcagtccgaccttcacagaaaagagcgtcgccctccctcctattaaagagaacatgcctaagaacgttttgccagattcccagcagcagtataacgttgttaaaactgtgaaggtgactgagcaactccgccattgctccgagattcttaaggaaatgttggccaagaaacacttcagttacgcttggccgttctacaatcctgtcgatgtcaacgctcttgggttgcataactactacgacgtggtgaaaaaccccatggatttgggaacgattaaagagaagatggacaaccaggaatacaaagacgcctacaaatttgctgctgacgtgagactcatgtttatgaactgctacaagtacaaccctcccgaccacgaagtggtgacaatggcgaggatgcttcaggacgttttcgagacacacttctccaagatccctattgagcctgtggaatccatgcctctgtgttatataaaaacagacatcaccgaaaccacgggccgggagaacaccaacgaggcctcgagtgaaggaaatagttcagacgacagtgaggacgagcgcgtcaagcggttagcgaaacttcaggaacaacttaaggccgtccaccagcagctgcaggtgttatcacaggttccattccgtaagctaaacaaaaaaaaggagaagtcaaaaaaagagaagaagaaagaaaagaaaaaatag

SEQ ID NO: 110059 - DNA, 303 bp, Artificial Sequence
  Description of Artificial Sequence: Synthetic coding sequence
atgtcactgcctagccgccaaactgcaataatcgttaacccccctccaccagagtacattaacacgaagaaaaacggccgacttacaaatcaacttcaatatctccagaaagtagtcctcaaggacctgtggaagcactccttctcatggccttttcagaggccagtagacgccgtcaagctgcaacttcctgattactacacaattattaaaaatccaatggatttgaacacaattaaaaagcggctagaaaacaaatactatgcaaaagcgtcagaatgcattgaagacttcaacacctag

SEQ ID NO: 110060 - DNA, 5550 bp, Artificial Sequence
  Description of Artificial Sequence: Synthetic coding sequence
atggcggtgtctcgactggatcgtctgttcatcttactcgacacaggcaccacgcctgttaccagaaaggcggccgctcagcagttgggcgaggtggttaaactccacccccacgaattaaacaatctgctcagtaaagttctcatatacctacggtcagcaaactgggatacaagaattgccgccggtcaggctgtggaggccatcgtaaaaaatgttccagaatggaaccccgtccccagaaccaggcaagaaccgacatccgaaagttcaatggaggacagccctaccacggaaagactaaacttcgaccgcttcgacatctgccggttgctgcagcacggagctagcctgctgggctcagcaggcgccgaatttgaggtccaggacgagaagtcaggagaggttgaccccaaggagcgaatcgcgaggcagagaaagctgctccagaagaagctgggtttaaacatgggagaagcgattgggatgagcaccgaggagctgtttaatgacgaagatttggattatacacccactagcgcaagctttgtgaataaacagccaactctccaagcagcagaattgatcgactctgaattcagagcaggaatgtcaaaccgccagaaaaataaagccaaacgcatggcaaagttatttgccaagcagcggtcgcgcgacgccgtggaaaccaacgagaaaagtaatgactccacagatggtgagccagaggagaaaaggcgaaagatcgctaacgtggttataaaccaatcagccaatgactccaaggtactgattgataatattcccgatagctcctcgcttattgaggaaacaaacgaatggccacttgagagcttttgcgaagagctttgtaatgacctctttaaccctagctgggaggtcagacacggtgccggcaccggcctgcgtgaaatcctaaaggctcacggaaaatccgggggtaaaatgggagattcaaccctcgaagaaatgatccaacagcatcaagaatggctcgaggacctcgtgatccgtctcctctgcgtgtttgcattagaccggtttggcgactttgtgagtgatgaagttgtggcccccgtgagagagacatgtgctcaaacccttggcgtagtgttgaaacacatgaacgaaacaggcgtgcacaagactgtagacgtgctcttaaaactccttactcaagaacaatgggaagtgagacacgggggactccttgggattaagtatgctcttgcggtccgtcaggatgtgattaacaccttgctgccgaaggtactgactagaattattgaaggactgcaggatctagatgacgatgtgcgggcagtggccgcagcctcacttgtgcccgtagtcgagtcacttgtatatctgcagacacagaaagttccattcattatcaacactctgtgggatgcgctgctagagttagatgatctgacagcgtcaacaaacagtatcatgacgctccttagctcattgctaacgtatccacaggtccagcagtgctccatccagcagagccttactgtgctcgtgccccgcgtatggcccttcctgcaccacacaatcagtagcgtgagaagggcagccttagagaccttgttcaccctgctgagcactcaggatcaaaacagttctagctggttgatccctatccttccagatatgctgaggcacattttccagttctgcgtactggagtcctcacaggaaatcctggacctcattcacaaggtttggatggagctccttagtaaagccagcgtccagtacgtcgtagccgctgcgtgtccttggatgggcgcctggttgtgcctgatgatgcagccttctcatctgccaattgatctaaatatgctgcttgaagtgaaggctcgggccaaggaaaagactggcgggaaagttagacagggccagtctcagaacaaagaagtcctgcaggaatatattgccggcgccgacacaattatggaagacccagccaccagggattttgtcgttatgcgggccaggatgatggcagccaaactgctgggagccctctgttgttgtatttgtgatccaggcgtaaacgtcgtgacccaggagattaaaccagctgagtcacttgggcagctacttctgtttcacctcaattccaagagcgctctacagaggatctctgtggctttggtcatttgtgagtgggctgctctgcagaaagagtgtaaagcagttacactggccgttcagccccgcctgctggacatcttatccgaacacttgtattatgatgaaatcgccgtgccattcacaaggatgcaaaacgagtgcaagcaactgattagctccctcgccgacgtccatattgaggtgggtaacagggtaaacaacaatgttctcacaattgaccaagcatccgacttggttactactgtgtttaacgaggctaccagcagctttgatcttaacccccaggtcctgcaacaactggactctaaacggcagcaggtgcagatgacagtgactgaaaccaaccaggagtggcaggtcctgcagctgcgggtacataccttcgcagcatgtgctgtggtctccctccagcagctgcctgagaagctgaaccccataatcaagcctctcatggagacgataaaaaaggaggaaaacactctggtacagaattacgctgctcagtgtatagctaagcttctgcagcagtgtactaccagaacgccgtgcccaaacagtaaaattatcaaaaacctgtgtagctccctgtgcgtggacccatatctcacaccctgcgtgacctgcccggtgccgactcagagcgggcaggagaatagcaaggggtctacatcggagaaggacggaatgcaccacaccgtcactaaacataggggtattatcaccctctacaggcaccaaaaagcagcattcgcaattacatccagacgcgggcccacacccaaagcagtgaaagcgcagatagccgacttgcctgcaggctcaagcggcaatatcctggtcgagcttgacgaggctcagaaaccctatctggtgcagcgccgcggcgctgagtttgctttgaccaccattgtgaagcacttcggcggggaaatggcggtgaaactccctcacctgtgggatgccatggtggggcctctgcgaaacacaatcgacatcaataattttgacggaaagtctctgctagacaagggcgatagtcccgcccaggaactcgttaacagcctgcaggtcttcgaaactgcagccgcctctatggatagtgagctgcacccacttctagtgcagcacctgccccacttgtacatgtgtctgcagtatccttccaccgcggtgagacacatggccgcacgttgtgtgggcgtcatgagcaaaatcgccacaatggaaactatgaacattttcttggagaaggtactaccatggctaggagccatcgatgactccgttaagcaggagggggccatcgaagcgctcgcctgcgtgatggagcaactggacgttggcatcgtgccttatatcgtgctgctagtggtaccggtgcttgggaggatgtccgaccagacagactctgtccgatttatggccacgcagtgcttcgcgactctgattcggctcatgcctttggaagcaggtattcctgaccctccaaacatgtccgctgagctcattcaactaaaagccaaagaacgacattttcttgagcagctgctggatggcaagaagttggagaattataagattccggtcccgatcaacgcggaactgcggaagtaccagcaggatggggtcaattggctggcatttttgaacaagtataaacttcacggcattctgtgtgatgacatgggcctcggaaaaactctgcagtcaatttgtattctggctggcgaccactgtcatcgtgcacaggaatatgcccgctcaaagctagccgagtgtatgcctctcccaagtctcgtggtgtgtccacctaccctgactggccattgggttgacgaagtgggcaagttctgcagtcgggagtacctgaatccattacactacactggtccgccaacagagcgaattcggctccagcatcaggtgaaaagacacaacctgatcgtcgcctcctatgacgtggtcaggaacgatattgattttttcagaaacataaagttcaattactgcatactcgacgagggccatgtcatcaagaacggcaagacgaaattgtccaaagctgtgaagcagctgacggctaattataggataatcttaagcggaactcccattcagaataacgtgctggagctctggtctctctttgatttccttatgccaggtttcctggggactgagagacagttcgccgcacggtacggtaagcccatactggcctcgagagatgctcggtcttcgagtcgagaacaagaggcgggagttttggcgatggatgcgttgcataggcaggtccttccttttttgctcaggcgaatgaaagaggacgtcttacaggatctaccccccaaaatcatccaagactactactgcaccctttcacctctgcaggtgcagctttacgaagacttcgccaagtcacgcgccaagtgtgacgtcgatgaaactgtctcttctgcaaccctctctgaggaaaccgagaaacctaagctgaaggccacgggccacgtgtttcaggctctgcagtacttgaggaagttgtgcaaccaccctgctttggtgctgactccccaacacccagagttcaaaactacagccgagaagctggccgtacaaaactcgagtctgcatgacattcagcacgctcccaaactgtcagcgctgaagcaattgctcctcgattgtggcttgggcaacggatcaaccagcgaaagcgggacggaatccgtcgtcgcgcagcatcgaatcctaatattttgccagctgaaaagtatgctcgatattgtcgagcacgacctgctgaagcctcacttacctagcgtgacctatctgcgcctcgacgggtctattcccccgggacagaggcattccattgtaagtaggttcaacaacgatccttccatagatgtgttgctgctgactacacacgtaggcgggcttgggctgaacttaactggggccgataccgtggtgttcgttgaacatgattggaatccgatgcgcgatctccaggccatggaccgtgctcatcggatcggccagaaaagggtggtcaacgtctataggctgattaccaggggcacccttgaagagaagattatggggctacagaagttcaagatgaacatagcaaataccgtaatctcccaggaaaactcgtccctgcagagcatgggcacagatcagcttctggacctgtttactctggataaggatggtaaggcagaaaaggcagatactagtacaagcggcaaggcgtccatgaaaagcatccttgaaaatctgagcgatctgtgggaccaggagcaatacgactcagaatactccttggagaacttcatgcatagcctgaagtag

SEQ ID NO: 110061 - DNA, 2100 bp, Artificial Sequence
  Description of Artificial Sequence: Synthetic coding sequence
aaactatggttcaagaacacagaagactaccggagaacagccctgacgcgcttaactagcggggtgatggagcagctggatgttgggattgtaccatatattgtactcttggtggtccccgtactgggtcgcatgtccgatcagaccgatagcgtcagattcatggctacacagtgttttgccacactaattcggttgatgccgctggaagctggcattcccgaccctcccaacatgagtgccgaactaattcagctgaaagcaaaggaaagacacttcttagagcaactgctcgacggcaaaaaactggaaaactataaaattcccgtgccgatcaatgcagagctacgcaagtatcagcaggatggagtcaattggctcgccttcctgaataagtataagctccacggcatcctgtgcgatgatatgggcctgggtaaaactcttcagagcatctgcatcttggctggagaccattgccatcgagcacaggagtacgcacggtcaaaattggccgaatgtatgccactgccttcgctggtggtgtgccccccaacgctcacaggccactgggtggatgaggtcgggaagttctgtagcagagagtatctcaatccccttcactacaccggaccccccacggaacgaattcggttgcagcaccaagtaaaacgccacaatctgatcgtcgcttcctacgatgtggtgcgaaacgacattgatttttttagaaatattaaattcaattactgtatcctcgatgaagggcacgtgattaaaaatggcaaaacgaaactaagtaaagccgtgaaacagttaacagccaactatcgcataatcctcagcggcacaccaatccagaacaacgtcttggaactgtggtccctcttcgattttctgatgcccggattcttagggacagaacgccaatttgctgctagatacgggaagcccatcctggctagcagagatgcacggtcaagtagtagagaacaggaggcgggagtcctggctatggatgccttgcacagacaggtccttccttttttactccggcggatgaaagaagatgttttgcaagacttgccaccaaagatcatccaggattactactgcaccctgagtcctcttcaggtgcaactctatgaggactttgctaagtcccgcgctaagtgtgacgttgacgaaaccgtaagttcagccacattatcagaagagaccgagaagcctaagctcaaagcaacaggtcacgtgtttcaagcactacagtacctgagaaaactgtgcaaccatccagcactcgttctgacacctcagcaccctgagttcaaaactaccgctgaaaagctcgcagtgcagaattcctctctgcatgacatccagcacgcccccaagttgtcggctttgaaacagctgctgctggattgcggtctagggaatggatctacatctgagtccggaaccgaatctgtggtggcccagcatcgcatcttgattttctgtcaactgaaaagcatgttagacattgttgagcacgatctgctcaaacctcacctaccaagtgtgacctacctgaggctggatggatccatcccaccgggccaacggcactcaatcgtctcccgttttaacaacgacccatctatcgacgtactgctgctcacgactcacgtgggcggtttgggcttgaatttgacaggcgcagatacagtcgtctttgtcgagcatgattggaatcctatgagagaccttcaagccatggatagggcccatcgcatcggacagaagcgggtggttaacgtgtacagactaatcacaaggggaaccctggaagagaagatcatgggactccagaagtttaagatgaacattgctaacacagtgataagtcaggagaactcttccctacaatccatgggcactgaccagttgctggatctattcaccctggacaaagatggcaaagctgagaaagccgatacttcaacatcagggaaggcatccatgaaatccatcctcgagaatttgagtgatttgtgggaccaggagcagtatgactccgagtattcccttgagaattttatgcactcgttgaaatag

SEQ ID NO: 110062 - DNA, 2034 bp, Artificial Sequence
  Description of Artificial Sequence: Synthetic coding sequence
atggaacagctggacgtagggattgttccatatatagtacttcttgtagtccctgtgctggggagaatgtctgaccagaccgactccgtgcgatttatggcaacccagtgttttgccacccttattaggctgatgcctctggaagctggtatcccagacccacccaacatgagtgccgaactaatacagctaaaggcaaaggagcgccacttccttgagcagctgctggatggtaaaaagctagagaactacaagataccagtgccaatcaacgccgagctgcgaaagtatcaacaggacggggtgaattggctggccttcctgaacaaatacaagctgcacggtattctttgtgacgacatgggcctgggaaaaacactacagtctatctgcatcctcgcgggagaccattgccatagggctcaagagtacgcccggtcgaagcttgccgagtgtatgcctctgccctctcttgtagtctgtccgcccactctgaccggacactgggtagatgaagtgggcaagttctgcagccgggaatatcttaaccccctccattatacgggaccgcctactgagcgaatccggctgcaacaccaggtaaagagacataatctgattgtggctagttacgatgtggtacgcaatgacattgactttttccggaatatcaagttcaattactgtattctggacgagggccatgtgattaaaaatggcaaaacaaagctgagcaaggccgtgaagcagcttactgctaattatagaattatcctgtccggtactccaatacagaacaacgttctggagctgtggtccctttttgacttcttgatgccgggcttccttggtaccgagagacagttcgccgctaggtacggtaaaccgattctcgcaagccgcgatgcccggagtagctctagagagcaggaagctggcgttctggcgatggatgccctccataggcaggtgctgccattcctattgcgccgaatgaaggaggatgtactacaggatctgccacccaaaattatccaggactattactgcacattgtcccctcttcaggttcagctctacgaggacttcgcaaagtctcgtgcgaaatgtgacgtggacgagactgtgagttccgcaactctatcagaagaaaccgagaagccaaagttaaaagcaacaggccatgtctttcaagccttacagtacctcagaaagttgtgcaatcacccagccttggtactcactccacagcaccccgagttcaagacaaccgcggagaagttggcagtgcagaacagttccttacacgacattcagcatgctcccaaactgtctgccctgaagcagcttctccttgattgcggcctgggcaatggctcaacgtcagagtccggaacagagtcagtggtggcacaacacagaatcctgatcttctgccaactgaaaagcatgctggatatcgtggagcacgatctactgaagccccacttaccttcggttacgtatctgcgtctcgatggatctattccacccggtcaacggcactcgatcgtgtcccgattcaacaacgatcccagtatcgatgttctgctcttgaccacccacgttggaggtctgggcttaaatcttactggggccgacactgtcgtattcgtggaacacgattggaacccgatgcgggatcttcaggcgatggatcgagcccaccgcattggtcaaaagagagttgtcaacgtctataggttaattacgcgaggaaccctcgaggagaagatcatgggtctgcagaagtttaagatgaacattgcgaacaccgtgatttctcaggagaactcatcactgcagtctatgggcacagatcaattgctcgatctgtttactttagataaggatggtaaagccgaaaaagcggacacctcaaccagcggaaaggcaagtatgaagtcaattctggagaatttatccgacctgtgggaccaagagcagtatgacagcgagtattcccttgaaaatttcatgcacagcctgaaatag

SEQ ID NO: 110063 - DNA, 1233 bp, Artificial Sequence
  Description of Artificial Sequence: Synthetic coding sequence
atgggggctaatgccagcaattacccacattcctgcagccctcgagtgggcggaaactcacaggcccagcagacttttattggaacctcatcttactctcagcaaggatacggctgcgaaagcaagttgtactccctggatcacggacacgagaaaccccaagataagaagaagcgcactagtgggttggcaacacttaaaaagaaattcatcaagcgccgcaaatctaatcgaagcgcagatcatgctaaacagatgagagagctcctctcagggtgggatgtgagggacgtcaatgcactggtcgaagagtatgaaggaaccagtgctctcaaagaactcagtctccaggcatctttagcacggccagaggcgaggacactccagaaggatatggcagatctctacgaatacaaatactgcaccgacgtcgacctgatctttcaggaaacttgcttccccgttcaccgcgccattcttgccgcccgctgtccctttttcaagactctcctgtcaagctcgcctgagtacggcgcagaaattattatggacataaatactgcgggcatcgacatgcctatgttttcagcattgctccattacctgtatactggggagtttggaatggaggatagccgttttcagaacgtggatatattggtgcaactgtccgaggaattcggaactccgaactccctcgacgtggatatgcgtggattgttcgactacatgtgttactatgacgtggtgctttcctttagctcagatagtgagctggtcgaagcatttgggggtaaccagaattgcttggacgaagaactgaaggctcacaaagccgtgattagtgctaggtcacctttctttcggaatctactgcagcggcgaattcgcacaggcgaagagatcaccgaccgaactctgagaacaccaacccgtattatcctggacgagtccattatccctaagaaatacgccacagttatcctgcattgtatgtatactgatgtggtggacctgtctgtgcttcactgttccccctctgtgggcagcctgagcgaggtccaggctcttgtcgctgggaagcccaacatgacaagagcagaggaggcaatggaactttaccacattgccctctttttggaattcaacatgctggcacaggaagaaacaaccgtgattaggcctgcctgtgccgcggaactgtctaattcttgtctgctgccccagtcttag

SEQ ID NO: 110064 - DNA, 3399 bp, Artificial Sequence
  Description of Artificial Sequence: Synthetic coding sequence
atgggtgcaaatgcctctaattaccctcattcttgctcgccacgggtgggcggtaacagtcaggcccagcagacctttatcggaaccagctcttattcacagcagggttatgggtgtgagtccaaactatatagccttgaccatgggcacgagaaaccacaggacaagaagaagaggacgtcgggtttggctacgctcaagaaaaagtttatcaaacgaagaaaatcaaataggtccgccgatcacgcaaagcagatgagggagctgttgagtgggtgggacgtacgcgatgtcaatgccctggtagaggaatatgaagggacttccgccctgaaggagttgtctctgcaggccagcctggcccggcctgaggcacggactcttcagaaggacatggccgatctgtatgagtacaaatattgcaccgatgtagatttaatttttcaggagacctgctttcctgttcacagagcaatcttagctgcgagatgcccatttttcaaaacattactgagctccagcccagagtatggggcagagatcatcatggatattaatacagctggtattgacatgcccatgttcagtgccctccttcactacctctacacgggcgaatttggcatggaggatagccggttccagaacgtggacatcttagtgcagctctcagaggaattcggtacacctaattccctggatgtggacatgagggggctgttcgattacatgtgctattacgacgtagtactgagtttttccagcgacagcgaattagtagaagccttcggcggaaaccagaactgcctggatgaagagttgaaggcccataaagctgtcattagcgcccgctcacccttttttcgcaatctccttcagcgccgtatccggactggagaggaaataacagatcggaccctgcgaacccctacgaggatcattttagatgagtccattattccaaaaaagtatgcaaccgtgattttacactgtatgtacacggatgtcgtagacttaagcgttcttcactgtagcccctccgtggggtctctctcagaggtccaagcactggtagccggcaaacctaatatgacaagagctgaagaagcaatggaactgtaccatattgccctgtttctggaattcaacatgctggcccagggatgcgaagacatcattgccgaatccatatcactggatactctcattgctattctgaagtggtcctcccatccgtatggctcaaagtgggtccatcgtcaagcactgcatttcctgtgcgaggagttttctcaggtgatgacttctgacgtattctacgagctgtctaaggaccatctcctcacggccatccagtccgattatctgcaagccagcgagcaggatatactgaagtatctgattaaatggggggagcaccagctcatgaagcggatcgcagacagagagccaaacttgctgagcggcaccgcccacagcgttaataagagaggagtgaagagacgcgatctggatatggaggagctgagggagattctttcatctctgctgccatttgtccgcattgaacacatccttcctataaattcggaagtgctgtcagacgcaatgaagaggggcctgataagtacccctccgtctgatatgttgcctactaccgagggtggtaaatccaacgcgtggttgcgtcagaaaaacgcagggatctacgtgcgtcccagactattctctccttacgtcgaagaggcaaaaagtgtccttgacgagatgatggtggagcaaacggacctcgtacggctgcgtatggtgagaatgagtaacgtcccggacaccctatacatggtgaacaacgccgttccccagtgctgccacatgatttcacatcagcagataagctccaaccagagctcacctccaagtgttgtggccaacgagataccggtgcccagactgttaattatgaaagacatggtaaggcggctgcaggagctcagacacaccgagcaggtgcagcgggcatacgctctcaactgcggggagggtgctacagtaagctatgagatccagatcagggtgttgagagaattcgggttagcagatgccgcagctgaactccttcagaatcctcacaaattcttccccgatgagaggtttggtgatgagtcacctctgctaaccatgcggcagccagggaggtgccgcgttaactcgacaccccccgccgagacaatgttcacagatctggattccttcgtggcctttcatccccccctgccaccgccaccgcctccatatcatcctcctgctaccccgattcacaatcagctgaaggctggatggaagcagaggcccccctcccagcacccttccaggtcctttagctacccttgcaatcactctctctttcatagtcgtaccgctccaaaagcgggtcccccacccgtttacctacctagtgtgaaggccgcgccgccagattgtacttcaactgctggactcggccgccagaccgtagctgccgcggccgcaaccacaacctcaaccgctaccgccgcggcggccgcggcaagcgaaaaacaggtgcgcacacaacccgtcctgaatgacctgatgccggatatcgctgtcggcgtctcaaccctttccttgaaggaccgccggctccccgaactggctgtcgacacagagctgtctcagtctgtttcagaggccggccctggaccaccgcaacacctcagttgtatccctcagaggcatactcatacgagccgtaaaaagcacacactggagcagaagactgacacacgcgagaacccgcaggaatatccagacttctatgatttcagcaacgccgcctgtaggccaagcaccccggctctcagtaggcgcaccccttccccctcccaaggtgggtactttggcccggacctctacagccacaataaggcctctccaagtggcctcaaaagcgcttacctgccaggccaaacatctccaaagaagcaggaagaggcaaggcgagaatatccgctgtcgccagatggccatctccataggcagaagaatgaaccaattcacctcgatgttgtggagcagcctccacaacggtccgactttccgctcgccgctccagagaacgccagcaccggacccgctcacgttagaggaagaacggcagtggaaaccgacctgacatttggtctgacaccgaatcggcctagcctcagcgcttgtagctcagaagcacctgaggagcgcagcggtagaaggttggcggatagcgagtccctaggccacggagcccagagaaacacagatttggagagggaggattctatctcccgcggcagaaggtctccttcaaaaccggatttcctgtacaaaaagtcggcactgtag

SEQ ID NO: 110065 - DNA, 2121 bp, Artificial Sequence
  Description of Artificial Sequence: Synthetic coding sequence
atgtataccgacgtggtcgacctctctgtcctgcattgcagtccttctgttgggagcctctctgaagtacaggctctcgtggcaggaaagccgaatatgacacgcgccgaggaggcaatggagctataccacatagctctcttcctcgaattcaatatgttggcgcaagagcctaatctgctgtctggcacggcccactcagttaataaaagaggggtgaagagacgcgacctagatatggaggagctcagagagattcttagcagcctattaccatttgtgcgcatcgagcacatcctgcctataaatagcgaggtgttgtcggacgccatgaaacgtggcctcatttcaacaccaccctcagatatgctgcccactactgaaggtggtaagtccaacgcctggttacgacaaaaaaacgccggcatctacgtccgccctaggctgttctccccctacgtggaagaagcaaaatctgtgcttgatgaaatgatggtggagcagactgatctcgtacgactcaggatggtgaggatgtccaacgttccagataccctgtacatggtcaataatgcagtaccccagtgctgtcacatgatctcacaccagcagatcagttctaatcagagctctcccccgagtgtcgtggccaacgaaatccccgtgcccagactcctgatcatgaaggacatggtgcggcgcctacaggagcttcgtcacaccgagcaagttcagcgcgcatacgctctcaattgtggggagggtgcaactgtgagctatgaaatccagatccgggtactccgcgagtttgggctcgctgatgcagccgctgagctcctgcaaaacccccataagttctttccagatgagcgtttcggcgacgagagtcctctgctaactatgaggcaacccgggcgatgtagagtgaatagcactcctcctgctgaaacgatgttcactgacctggactcattcgttgccttccacccccctcttccccccccgcccccaccttaccatccaccagcaactcccatccacaaccagctgaaagccggctggaaacaaagacccccaagccagcatccttcccgctccttctcctacccgtgtaatcactctctctttcattcccggaccgctcccaaggctggaccgccacccgtgtatcttccatctgtgaaggcagccccaccagactgtacaagcacggctggtttgggccggcagaccgtggccgcagccgctgctacaacaaccagcacggctaccgctgccgcagctgcagcctcagaaaagcaggtgcgcacccagccggttctgaacgacctgatgcccgacatcgcggtcggtgtgtcaaccttgagtctgaaggatagacgccttcccgaactcgccgttgatacagagctcagccaaagtgtgagtgaagccgggcctgggccgccccagcatctgagttgcattccgcaaaggcacacccatacttcacgcaagaagcatacactggaacagaagacagatacaagggagaacccacaggagtatccagatttttacgatttttccaatgcggcttgtcgcccctccaccccagcgttgtctcgacggacaccgagccctagccaaggagggtacttcggcccggatttgtacagtcataacaaagcgtccccaagcggcctgaaaagcgcctaccttccggggcagacatctcccaaaaaacaggaggaggcacgaagggaataccctctgtcacctgacggccatctacataggcaaaaaaatgagcccatacatctcgacgtggtggaacagcccccacaacgctctgattttccactggccgccccagagaatgcttcaaccgggcctgcccatgtacgcggtagaactgcagtcgaaacagaccttacctttggcctaacaccgaaccgcccatctctttcagcctgctcatcggaggcacctgaggaaaggagtgggagacgcttagccgactccgaatcactagggcacggagcccagagaaacaccgatttggagagggaagactccatatctcggggccggcgctctccaagtaagccagacttcctgtacaagaagtctgccctttag

SEQ ID NO: 110066 - DNA, 2346 bp, Artificial Sequence
  Description of Artificial Sequence: Synthetic coding sequence
atggctggaggtgccggcgcaggggcggacggaggagctgggggcggaggcggcggtggggacggctccggtccttctggtagctcttccggcggccggagtctccggggctgcgaggacattatagccgagagcatctcactggacactctgatcgctatactgaagtggtctagtcacccttacgggtcaaagtgggtccacaggcaagccctgcactttctttgtgaggaattctcccaggtcatgacctctgacgtgttttatgagctgagtaaggaccacctccttaccgcaattcagagtgattaccttcaggccagcgagcaggacatcctgaagtatttgatcaagtggggggaacatcagttaatgaagcgcattgccgaccgtgagcccaatctgctgtctggcactgcgcatagcgtgaacaaacggggcgtgaaacggcgggacctcgacatggaggagttaagagagatcctctcctccctcctgcctttcgtgcggattgagcacatactcccaatcaacagcgaagtgctttccgatgccatgaaacggggtctgatttctaccccgccttctgatatgctgcctacaaccgagggaggcaagtctaacgcttggttacgtcagaaaaatgcgggcatctacgtaaggcccagactgttttcaccctatgtggaggaagctaagtccgtcctggacgagatgatggtcgagcaaactgacttagtgagactcaggatggtccgtatgagtaacgtgcccgacacgctgtatatggtgaataacgcagtcccccagtgctgccatatgatctcacaccaacagatcagcagcaaccaatctagtcccccctccgtagtggctaatgaaattcccgtgcctcgactccttattatgaaagatatggtgagacgactgcaggagctgagacatactgaacaggtgcagagagcatacgccctcaactgtggtgaaggggccaccgtctcttatgagatccagatccgggtactgagggaattcgggctcgctgacgctgccgctgagctattgcaaaacccccataagttttttcctgacgagaggttcggagacgaaagcccactgctgaccatgcgacagccaggccggtgccgcgtgaacagtaccccaccggctgagacaatgttcactgacctggattccttcgtggctttccatccaccactgccaccacccccgcccccataccacccgcccgcgacaccgatacacaaccagctaaaggcaggatggaaacaaagacccccatcccagcatccctcccgcagcttctcatatccttgcaatcacagcctgtttcacagtcgcactgcccccaaggcaggtccaccgcctgtgtatcttccctctgtcaaagcagctccgcccgactgcacctctactgctggtcttggcaggcaaacagtggccgcagctgccgcgacgaccaccagcaccgccaccgccgccgcagctgcagctagtgagaagcaggttcgtacccagccagtgttgaatgacctcatgcccgacatcgccgtgggggtcagtactctaagcctgaaggaccgcaggctccctgagctggctgtggacactgagctatcgcagtcggtgagtgaggctggaccaggaccgccccagcacctgtcttgcatccctcagaggcatacccacacatccaggaagaaacacactctcgagcagaagacagacacaagggagaacccgcaagagtacccagacttttacgacttctccaacgccgcttgccgcccgagtacacccgccctgtcgaggaggacgccttcaccatctcagggaggctactttggaccagacttgtatagccacaacaaagccagccctagcggattgaaaagcgcctacctgcctggtcagacaagtccaaagaaacaggaggaagccaggcgggaatatcctttgtccccagacggccacctgcatagacagaagaatgaaccgattcatctggatgtggttgagcagcccccccagcgatcggacttccctctggcagcacctgaaaatgcctcaactggccctgcacatgtgcgcgggaggaccgccgtcgagaccgatctgacattcgggctcacccccaataggcccagcctatctgcgtgtagttcagaggctcctgaggagcgcagcggaagacgtctggccgacagcgaatctcttggccacggggctcaacggaacactgaccttgagagagaggactccatctcacgcggaagaaggtccccatcaaaaccggactttctttataagaaatccgctctgtag

SEQ ID NO: 110067 - DNA, 168 bp, Artificial Sequence
  Description of Artificial Sequence: Synthetic coding sequence
atgggtgcaaatgctagtaactatcctcactcctgtagtccaagagttggggggaattcacaagctcagcagacatttatcggcacgagtagttattcccagcagggatacggctgcgagagcaagctttactcattagaccatggccatgagaaaccgcaagattag

SEQ ID NO: 110068 - DNA, 1635 bp, Artificial Sequence
  Description of Artificial Sequence: Synthetic coding sequence
atgagggagtctcagccagaagcagagataccactacaggacacaacagccgaggccttcaccatgctgctgaaatacatctatacaggccgggccaccctgacagatgagaaagaagaggtgctcctggactttctgtcattggcccacaaatacggctttcctgagctcgaggacagcacttcggaatacctgtgcaccattttgaacattcagaacgtttgtatgaccttcgacgtggcttccctgtactctctgccaaaactgacctgcatgtgctgtatgttcatggatcgcaacgcgcaggaggtcctgtcatcagagggtttcctcagcttatccaaaaccgccttgctcaatatagttctgcgcgactcatttgccgcccccgaaaaggacatatttctggcccttctcaattggtgtaaacacaatagtaaggagaatcacgccgagataatgcaggctgtcagattacccctcatgagtctgactgagctcctgaacgtcgtccgaccgtccggcctcctgagcccggacgcaattttagacgctattaaggtcaggagtgagagtcgggacatggatctgaactaccgggggatgcttatccccgaggagaatatcgcaaccatgaaatacggcgcacaagttgttaaaggcgaactcaagtcagccctgttggacggcgacacacagaactacgatctggaccacggatttagccggcacccaatcgacgatgactgtcgctcagggattgagattaaattgggacagcccagtataatcaaccacatccgaattcttttatgggatcgggacagtagaagctactcctatttcatcgaagtcagtatggacgaactagattgggttcgggtaatcgatcatagccagtacttatgcagaagttggcagaagctttatttccccgctagggtgtgtcggtatatccgtatagtaggaacccacaatactgtcaataaaatctttcacattgtcgccttcgaatgtatgttcacgaataagacatttaccctcgagaaagggctgattgtaccaatggagaacgtagccacaatcgcggattgcgcttcagtgattgaaggcgtctcccggtctaggaatgccctgctgaacggagatactaaaaactatgattgggatagtggctacacgtgtcaccagctggggtcaggagccatcgtggtgcagctcgcgcagccttacatgatcgggagtattaggctactgctgtgggattgtgacgacagaagttactcgtactatgttgaggtaagtacaaaccagcaacaatggaccatggtggccgaccgtaccaaggttagttgcaagtcctggcagtcagtaacatttgaaagacaaccagcttcattcattagaatcgtagggacgcataacacagcgaacgaggtgttccactgtgtccatttcgagtgcccagagcaacagtcgtctcagaaggaggagaactcggaggaatctggaaccggcgacacgtcactggcaggacagcagctcgattctcacgctctgcgcgcccccagtggatcgagtctgccatccagtccaggatctaacagtaggagtccaaaccgccagcaccagtag

SEQ ID NO: 110069 - DNA, 1839 bp, Artificial Sequence
  Description of Artificial Sequence: Synthetic coding sequence
atgagtaatagccacccacttaggcccttcacagccgttggggaaatcgatcacgtccacatcctgtcagagcatattggcgctctactcatcggagaagagtatggggacgtgacttttgtggtggaaaagaagagatttcctgcccatcgtgttatcttagctgctcgatgccagtatttccgtgctctcctgtatggggggatgagggagagccagcccgaggccgagattcccctgcaggataccaccgccgaggcatttactatgctgcttaaatacatttatacgggccgagcaacacttaccgacgagaaggaagaggtacttttggactttcttagcctagcccacaaatacggttttcccgagctagaagacagcacttctgagtacctctgcaccattctcaacattcagaatgtgtgcatgaccttcgacgtggcttctctttatagcctgccaaaattgacttgtatgtgctgcatgtttatggataggaacgctcaggaggttctgtctagcgagggcttcttgtccctgtccaaaactgcactgctgaacatagttctccgggatagttttgccgcccccgagaaggacatatttttggctctgctcaattggtgtaagcataacagtaaggaaaaccacgctgaaatcatgcaggcagtgagattacctctgatgtctctgactgaacttttgaatgttgtcagaccttccggcttactgagcccagacgctatattggacgctattaaagtgcgcagcgaaagccgagatatggacctgaattaccgcggaatgttaattcctgaggagaacatcgcaaccatgaagtatggagcccaggtcgtaaagggtgagcttaaatcagcactgttggacggagacacgcagaactacgatctagatcatgggttcagcaggcacccaatcgacgacgactgccgtagtggcatcgagatcaagttaggacaaccgagcataataaaccatatcagaatacttctgtgggatcgtgactctagatcctatagttattttatcgaggtgtctatggacgagctcgactgggtgcgggtgatcgatcacagccagtacctctgtcgcagctggcagaagctctactttcctgcaagagtctgccgatacatccgcatagtcggcacccacaatactgtgaataagattttccatatcgtggctttcgagtgcatgttcaccaataagaccttcacacttgaaaagggtctaatcgtcccaatggaaaatgtggccactatcgccgactgcgcctcagttatcgagggggtgagccggtctcgaaacgcattgctgaacggtgataccaagaattatgattgggactcgggctacacgtgtcatcagctgggaagcggcgcaattgtagtgcagctggctcagccttatatgattggatcaattagactcttgctgtgggactgcgatgacagatcatactcctactacgtggaagtttccacgaatcagcagcaatggactatggtggccgacaggacaaaagtgagttgtaaaagctggcagtctgtgacctttgaacgccagccagcttcatttatccggatcgtgggcacgcataataccgccaatgaagtgttccattgtgtgcatttcgaatgccctgagcagcagtcctctcaaaaagaagaaaactccgaggagtccggtactggggataccagtcttgccggccagcagctcgacagtcacgccctgagggccccctcaggcagctcactgccaagttcccctggatcaaactcccgatccccgaacagacagcatcagtag

SEQ ID NO: 110070 - DNA, 1635 bp, Artificial Sequence
  Description of Artificial Sequence: Synthetic coding sequence
atgcgcgagagtcagcctgaagcggagatccctctgcaggacactacggccgaagcctttactatgttgctgaaatatatctacaccgggcgcgccacgctcactgatgaaaaggaagaggtccttcttgattttttgtccctggcacataaatatggtttccctgaactggaagactcaacaagcgagtatctctgcaccattctgaatatacagaatgtgtgcatgacatttgatgtggccagcctctacagcttacccaagctgacctgtatgtgctgtatgttcatggaccgaaacgcacaggaggttctctcttctgaagggtttctatcgttaagtaagacagcactgctgaacattgtgctcagggattcgttcgccgcccccgaaaaggatatctttctcgctctcctgaattggtgcaagcacaacagcaaagaaaaccatgccgagattatgcaggcagttcgcttacctctcatgagcttgacagagctattaaacgttgtgagaccctctggcttactgagtcccgatgcaattctagacgccattaaggtgcgcagtgagtctagagacatggatctgaattaccgcggtatgctgattcctgaagaaaatatcgcgactatgaagtacggggcacaggtggtgaagggggagctaaaaagcgcgttgctcgatggggatacacagaactatgatttggaccacggctttagccgccacccaatcgacgatgattgtcggagtgggattgaaatcaaattggggcagccttcaattataaatcatattcgcattctactttgggatagggattctcggtcatacagttacttcatcgaagttagtatggacgaactcgattgggttagggtaattgaccacagccagtatctgtgccgttcatggcagaaactgtattttcctgctagagtatgtaggtatattcggatcgtcggcactcataatacagtgaataaaatttttcatatcgttgcttttgagtgcatgttcacaaacaaaaccttcaccttagaaaagggtctaattgtaccaatggagaatgtggcaactattgctgactgtgcttctgtcattgagggagtgtcacgatctcggaacgccctgttgaacggagacactaaaaactacgactgggacagcggatatacctgtcaccagctagggagcggggctatagtggtgcagctcgcacaaccctacatgataggctctatcaggttactgctatgggattgtgatgacagatcgtattcctactatgtcgaggtttccaccaatcagcagcaatggacgatggttgccgaccgcacaaaagtgagctgcaaatcatggcagtcggtgacattcgagcggcagcccgcatccttcataagaatagtaggaactcataatactgccaacgaggtttttcactgtgttcactttgaatgccctgagcaacagtcaagccagaaagaggaaaatagcgaggaaagtgggaccggtgataccagcttagctggacagcagcttgacagccatgcattacgcgccccaagcggtagttccttgccaagctccccagggagcaactcaagatcgcccaatcgacagcaccaatag

SEQ ID NO: 110071 - DNA, 1839 bp, Artificial Sequence
  Description of Artificial Sequence: Synthetic coding sequence
atgagcaattcacatcctctcaggccttttacagcagtaggcgaaatcgatcacgtgcacatcctaagtgagcatattggtgcactgttgattggcgaggagtacggcgatgtgacatttgtggtggagaagaaacggttccccgcccaccgcgtaattctggccgcacgctgtcagtattttcgcgccctgctctacggaggaatgcgcgaaagtcagcctgaagcagagatcccccttcaagataccaccgcggaggcctttacaatgctgctgaagtacatatataccggaagggcaacactcactgatgaaaaagaggaagttctgctcgattttttatcactggcccacaagtacggatttccggaattggaagactccacaagtgagtacctgtgtactatcctgaacattcagaatgtttgtatgacctttgacgtggccagcctgtattctctgccgaaacttacgtgcatgtgttgcatgtttatggacagaaatgcacaggaggtattgtcaagtgagggtttcctctctctcagcaagactgccctgctgaatatagtactgagggatagtttcgcggctcccgaaaaggacattttcctggccttactgaattggtgcaagcataactcgaaagaaaaccacgctgagatcatgcaggcagtacggctgcccttgatgtctctcacagagcttctcaatgttgttaggccctctgggctgctctccccagacgcaatcctggacgcaatcaaggtgagatcagagtctagagacatggatcttaattatagagggatgctaatacccgaggagaatatagccactatgaagtacggggcacaggtcgtcaagggagagctaaaaagcgcgctgctcgatggcgacactcaaaactatgacttggatcacgggttctcaaggcatcccatagacgatgattgccgaagcgggattgagataaagctgggtcagccaagcatcattaaccacatccgcatcctgttgtgggatagggattcacgctcctacagttactttattgaggtgtctatggacgaactggattgggtgagggtaattgaccactcccagtacctttgccgatcctggcaaaaactgtattttcccgcacgggtgtgcagatatatcagaattgttggcacccacaataccgtgaataagatcttccacatagtggccttcgaatgtatgtttactaacaagacatttacactagagaagggtctcatcgtgccgatggaaaatgtggctacaatcgcagactgtgcttccgtcattgaaggcgtgtccaggagcagaaacgcactgttgaatggtgataccaaaaactacgactgggacagcggctatacgtgccatcagctgggcagcggagcaattgtggttcagctcgctcagccttacatgatcggctcgatcagattgctcctgtgggattgcgacgatcggtcctactcctactatgtcgaggtgagcacaaatcagcagcagtggaccatggtggccgataggaccaaggtttcgtgcaaatcctggcaatccgtgacttttgaaagacaaccagcctcttttataaggatcgttgggacacacaataccgctaacgaggtttttcattgcgtgcacttcgagtgtcccgagcagcagagcagtcagaaagaggaaaatagcgaagaatcaggcaccggagacaccagtctggccgggcagcagctggacagtcacgctttacgcgcaccttcagggtcctccctgccaagctccccaggctccaactcccggagtccaaatagacagcaccaatag

SEQ ID NO: 110072 - DNA, 279 bp, Artificial Sequence
  Description of Artificial Sequence: Synthetic coding sequence
atgagcaactcccacccgctgaggccattcaccgccgtgggggagatcgatcatgttcacatattatctgagcatattggcgcgttgctgattggcgaagagtatggggatgtgacgttcgtagttgagaaaaagagatttcctgcccaccgggtgatcctggccgccagatgtcagtatttcagagccctcctgtacggaggaatgagggaaagccagcctgaggcagagatccccctccaggacaccaccgctgaagcatttactatgctgctctag

SEQ ID NO: 110073 - DNA, 1749 bp, Artificial Sequence
  Description of Artificial Sequence: Synthetic coding sequence
atgtgcagagctctcctgtatgggggcatgcgtgaatcccaaccagaagcagaaattccgctccaggacaccactgccgaagcattcaccatgttgctgaagtatatctatactggaagagctacgcttacagatgagaaggaggaagtgctgcttgatttcctcagtctcgcacacaaatatggctttcccgagctggaagactccaccagtgagtatttatgcactattctgaacatccagaatgtttgcatgaccttcgatgtagcctctttgtattcactgcctaagctgacttgtatgtgctgtatgtttatggaccggaatgcacaggaagtcttgtcttccgaaggattcctgtcactgtcaaaaaccgcactgctgaacattgtactgcgtgattcttttgcggctcctgaaaaggacatttttcttgccctgctgaactggtgcaaacacaactcaaaagagaatcacgccgagatcatgcaggcagtgagactgccactgatgagccttacagagcttctcaacgtcgtccggcctagcggtctgctgagcccagatgctattctcgacgccattaaggtgaggtcagagagccgcgatatggatcttaactacagaggcatgcttatcccggaggagaatattgcaaccatgaaatatggcgcccaggtggtcaagggcgaactgaagtctgccctgctcgacggcgatactcaaaactacgatctggaccacgggttttcaagacacccaatagacgatgattgccgcagtggcatcgaaatcaagctgggccagccctcaattataaaccatattcgaatattgctgtgggacagggactcccggtcctacagttattttattgaggtcagtatggacgaactcgactgggttcgagttattgaccactctcagtacctgtgccgctcctggcaaaaactgtattttccagctcgtgtgtgtagtggggatggtgtgagtctgtggtgcccgctatggtctcgaaccccggaattgaaacaaagcagcctgttaggcttgcccaagtgccggtacatccgaattgtggggacacacaacacagtgaacaagatttttcatatcgtagcctttgagtgcatgttcacaaacaagacgtttacccttgaaaagggactgatcgtccccatggagaacgtcgccactattgccgattgcgcgtccgtgatcgagggggtaagccgttccagaaacgccctgcttaatggtgacacaaaaaattatgactgggattccggctatacttgccatcagctgggctcgggcgctatagtggtgcagctggcccagccttacatgatcggttctatcaggcttctgctttgggattgtgacgaccggtcctacagctactacgtggaagtgagtactaaccagcaacagtggacaatggtggcggaccgcaccaaagtgtcatgcaagtcttggcagtccgttaccttcgaaagacagcccgcctcgttcatacgtatagtggggacccacaataccgcaaacgaggttttccattgtgtacactttgagtgccccgaacagcagagttctcagaaggaagagaacagtgaagagtccgggaccggcgacaccagtcttgcaggccagcagctggattcccacgcccttcgcgctccctcagggtctagtctcccttcctcccctggttccaatagcagatcacccaacaggcagcaccagtag

SEQ ID NO: 110074 - DNA, 2211 bp, Artificial Sequence
  Description of Artificial Sequence: Synthetic coding sequence
atgtctttatcagagaactccgtgtttgcctacgagtccagcgtacattccacaaatgtgcttctgtcacttaacgaccagcgcaagaaggacgtgctgtgtgacgtgaccatttttgtggaaggacagcggttccgggcgcatcgcagtgtgctcgccgcatgctctagttatttccactcacggattgtgggccaggctgatggagagctcaacattactcttccagaggaggtgacagtcaaagggttcgaacctctgattcagtttgcctatactgccaagctcatcttatccaaagagaacgtagacgaggtgtgtaagtgcgtagaatttcttagcgtccataatatcgaggagtcttgctttcagtttttgaaatttaaattcctagatagtaccgccgaccagcaggagtgtcctagaaagaaatgtttctcttcgcactgccaaaaaacagatctcaagctttccctattagaccaaagggacctagagaccgatgaagttgaagaattcttggagaataagaatgtccagacaccccagtgcaagctccgacggtatcagggaaacgcgaaggcttcccctcccctacaggacagtgcgtctcagacgtatgagagcatgtgtttagagaaggacgcagctctggccctgccgtccctctgcccaaaataccgaaagttccagaaggccttcggcactgaccgcgtgcgtacaggtgaaagtagcgtgaaagatatccacgcatcagtccaacctaatgaacgtagcgagaacgaatgtctgggcggagtaccggagtgcagagacttacaggtgatgctcaagtgcgacgagagtaagctcgccatggagccagaagaaactaagaaggaccctgctagtcagtgtccaacagaaaaatctgaggttactccattcccccacaattcttctatcgacccccacggattatattctctgtctctcctccacacatacgaccagtatggagatctcaatttcgccggcatgcaaaacacaactgtgctaactgagaagccgctgtccggaaccgatgttcaagagaagacctttggcgagtctcaagacctccccttgaaaagcgaccttggcacccgggaggacagttctgtcgcctcaagcgaccgaagttcagtggagcgcgaagtagccgagcaccttgccaagggattttggtccgatatatgtagcacggacaccccatgtcagatgcagctgtcccctgcggtagcaaaggatgggtctgagcagatctcccaaaaaaggagtgagtgtccctggttgggcatccggatctccgagtcacccgaaccgggtcagaggaccttcacaacactctcatccgtcaactgtccctttatttctacactaagcactgaagggtgctcgtccaatctggagataggcaatgacgactatgtgtccgaacctcagcaagaaccgtgtccttacgcctgcgtaatatctctgggggacgactcagaaacagacacggaaggcgatagcgaaagctgcagtgctcgggagcaggagtgcgaagtgaaacttccatttaacgcccagagaataatctccttgtcacggaacgactttcagtcacttctgaagatgcacaaattaactccagagcaattggattgcattcatgatattcggagacggtctaagaatcggattgctgctcaacgatgtcgcaagcgcaagctggattgtattcagaacttagaatccgagatcgaaaagctgcagagtgagaaagagagcctcctcaaggagagggaccacatcctttcaaccctcggggaaacaaagcagaatctgactggtctgtgccaaaaagtgtgtaaggaagccgcgctgtctcaggagcagatacagatcctggcaaagtattctgccgccgattgtcctttgtcattcctaatctcagaaaaggacaaaagcacgcccgacggagagctcgctctgccaagcatcttcagcttaagcgaccgaccacctgccgtgctgcccccatgtgcccgggggaatagcgaaccaggctatgcccgggggcaggagtcccagcagatgtccacggccactagtgagcaggccggacccgctgaacaatgtcgccagagcggcgggatcagcgatttttgtcagcaaatgaccgacaaatgtacgacggacgagtag

SEQ ID NO: 110075 - DNA, 2211 bp, Artificial Sequence
  Description of Artificial Sequence: Synthetic coding sequence
atgtcgctgagtgaaaactctgtgttcgcgtatgagagctctgtccattcaaccaatgtgctcttatcccttaacgaccaacggaaaaaggacgtgttgtgcgacgtgactatctttgttgagggacagcgcttccgggcgcacagatcagttcttgctgcctgctcctcttattttcactcccgaatcgtgggccaggctgatggtgaactcaatattacgctccccgaggaagtgaccgttaaaggattcgagcccctcatccaatttgcctacacggcaaagctgattttaagcaaagagaatgtggacgaggtctgcaaatgtgtggagtttctgtctgttcataacattgaagagagttgttttcaatttcttaagttcaagtttttggattctacagccgatcagcaggaatgccctaggaagaaatgtttctcttcccattgtcaaaagacagacctgaagctcagtctgcttgaccagcgcgatctggagactgacgaagtcgaagagtttctcgaaaacaagaatgtgcaaactccacaatgtaagctgcgccggtaccagggcaatgccaaggccagccctccacttcaggattctgccagccagacatatgagtccatgtgtctcgaaaaggatgccgcgctggctctgccatcgctctgccccaaatatcggaagttccagaaggccttcggcaccgacagggttcgcacaggagagtcgtccgtaaaggacatccatgccagcgtacaacccaatgagcggtccgaaaatgaatgtttagggggcgtcccagaatgcagagatctccaagtgatgttgaagtgcgacgagagtaaattggctatggagccagaagaaacaaagaaggatccggcttcccagtgccccaccgaaaagtctgaggttaccccttttccacacaacagcagcatcgacccacatggattatattctctctctctgcttcacacctacgaccagtatggcgatctgaacttcgccggaatgcaaaacaccaccgtgctgactgaaaagcctctatccggaacagacgtgcaggagaagacgttcggagaaagccaagatctgccattgaaaagtgacttgggaacccgcgaagactctagtgtcgccagctcagaccgatcttcagtggagagagaggtggcggagcacctcgctaagggattctggtcggatatatgttccaccgatacgccatgtcagatgcaactgtctcctgccgttgccaaggacggcagcgaacagattagccagaaacgcagcgagtgtccctggctggggattaggataagcgagtctccagaacccggtcagagaacctttacgacgctttccagcgttaattgccccttcatctctaccctgtctacggaggggtgctcctccaacctggagattggaaacgatgactacgtgagcgagccacagcaggaaccgtgcccctacgcatgcgtgatctctctcggtgacgatagcgagactgacaccgaaggggatagcgagtcctgttccgcacgagaacaggagtgtgaagttaagttgccatttaacgcacaacgcattatttcactgtctcgcaacgactttcagtccttgctgaaaatgcacaaactcacccctgaacagctcgattgcatccacgacattagaagacgttccaaaaaccgtattgccgcacagcggtgcaggaagcgaaagttagattgtattcagaatctggaatcagagatcgaaaaactgcaatctgagaaggaatctctgctcaaggaaagggaccatatcctctctactttaggagaaacaaaacagaatcttacgggcctctgccagaaggtgtgcaaagaagctgcactgtcccaagagcagatacagattctggctaagtactctgcagccgactgtcccctgtcttttctcatttctgagaaagataagtccacacctgacggggagctggcgctacctagcatcttctctctctccgaccgcccccctgctgtgttacctccatgcgcacggggaaattccgaaccggggtacgcaagggggcaggagagccagcagatgagcactgccacctcagagcaggcagggcccgctgaacagtgtagacagtcaggcgggatatctgatttctgccagcagatgaccgataaatgtactacggatgaatag

SEQ ID NO: 110076 - DNA, 513 bp, Artificial Sequence
  Description of Artificial Sequence: Synthetic coding sequence
atgagtctctctgagaactctgtgttcgcctatgaatcatctgttcactcaactaacgtcctgctgtcactcaatgaccagcggaagaaggacgtgttgtgtgacgtgacaatcttcgtggaggggcagcggttcagggcccatcggtctgtgctcgcagcctgtagcagctattttcactcacgcatcgtcggacaagcagatggggaactaaatattacgctgcccgaggaagtgacagtaaaaggcttcgagcctctgatccaatttgcatacacggccaaactgatcctgtctaaggagaacgtggatgaggtgtgcaagtgtgtagagttcctgtcagttcacaacattgaggaatcctgcttccaattcctgaaattcaaattcctggacagtactgcggaccagcaggaatgtcctcggaaaaaatgtttttcttcccactgccagaagaccgatttaaaattgagcctattggatcagcgagacttggaaactgacgaagtgtag

SEQ ID NO: 110077 - DNA, 663 bp, Artificial Sequence
  Description of Artificial Sequence: Synthetic coding sequence
atgtccctgtcagaaaattctgtatttgcatacgaatccagtgttcactctactaatgtcctcctgtcacttaatgaccagaggaagaaggatgtgttatgcgatgtgaccatcttcgtcgagggccagcgctttcgggctcacaggagtgtcctggctgcgtgcagctcttattttcattcccgaatcgttgggcaggctgacggagaactaaatattaccctccctgaagaggtcaccgtgaagggcttcgagcccctgatccagtttgcatatacagctaagctgatcctgtccaaagagaatgtggatgaggtgtgcaaatgcgttgaatttttgagcgtgcacaacattgaagaaagctgcttccagtttttgaaattcaagtttctcgacagcactgcagaccagcaggagtgcccccgaaagaagtgcttctcatctcactgtcaaaagacagacctcaagctctcccttctggaccagcgagaccttgagactgatgaggtggaggaattcctggagaataaaaatgtccaaacacctcagtgtaagcttcggcgctatcagggtaatgctaaggccagcccacctctgcaagactccgcaagccaaacttacgagagcatgtgtctggaaaaggatgctgcattggctctgtag

SEQ ID NO: 110078 - DNA, 678 bp, Artificial Sequence
  Description of Artificial Sequence: Synthetic coding sequence
atgtctctctccgaaaattctgttttcgcctatgaaagctcagtacactccaccaacgtgctcctatcactgaacgatcagagaaagaaggacgtgctttgtgatgtcacgattttcgtagagggccagcgctttcgcgctcatcggagcgtgctcgctgcatgcagctcttatttccactcccgcatcgttggacaggctgacggcgaactcaatattacattaccagaggaggtgaccgtgaagggtttcgaaccattaatacagttcgcatacaccgccaagctcatcctgtcgaaggagaacgtggatgaggtttgcaagtgtgtggagttcctgtcggtccacaacattgaagagtcctgttttcagttcctcaaattcaaattcctcgacagtacagccgatcagcaggagtgccctagaaagaagtgcttttccagtcactgccagaaaaccgatctgaaactgtcattgctggaccagcgggacctagaaaccgacgaggtggaagagttccttgaaaataagaacgtgcaaacccctcagtgcaagctgcggcgataccaggggaatgctaaggccagccccccactccaggactctgctagccagacttatgagagcatgtgcctggagaaggacgcagctctagcccttccatcactgtgcccctag

SEQ ID NO: 110079 - DNA, 78 bp, Artificial Sequence
  Description of Artificial Sequence: Synthetic coding sequence
atgagcctttctgagaattcagtgttcgcctacgagtcatctgtccactcaaccaacgtgctcctgtcactgaattag

SEQ ID NO: 110080 - DNA, 78 bp, Artificial Sequence
  Description of Artificial Sequence: Synthetic coding sequence
atgagtctgagcgaaaactcggtgtttgcttacgaaagtagcgtgcattccactaacgtgttgttgtcactgaactag

SEQ ID NO: 110081 - DNA, 78 bp, Artificial Sequence
  Description of Artificial Sequence: Synthetic coding sequence
atgtccctgagcgagaacagcgtgtttgcctacgagtcttccgtacatagtacgaatgtcctactgagtttaaactag

SEQ ID NO: 110082 - DNA, 78 bp, Artificial Sequence
  Description of Artificial Sequence: Synthetic coding sequence
atgtcacttagcgagaactctgtcttcgcgtatgagtcctctgtacattccaccaacgtcttgctttccttaaattag

SEQ ID NO: 110083 - DNA, 78 bp, Artificial Sequence
  Description of Artificial Sequence: Synthetic coding sequence
atgtcactatcagaaaactcagtcttcgcttacgagagttcagtccatagcacaaatgtccttctcagcctcaactag

SEQ ID NO: 110084 - DNA, 2526 bp, Artificial Sequence
  Description of Artificial Sequence: Synthetic coding sequence
atgagtgtggatgaaaaacctgatagtcccatgtacgtgtacgagtctacagtccattgcactaacatactgctgggcctcaatgatcagcgcaaaaaggatatactctgcgacgtgacgctgattgtagagcggaaagagtttagggcccaccgggctgttttagccgcatgctcagagtacttctggcaagcactcgtggggcagaccaaaaacgaccttgtagtgtctctgcccgaagaggtcacagctcgcggattcggaccacttttgcagtttgcctatacagccaagctccttctctctagggaaaacatccgggaggtcatccgttgtgctgagttcctcaggatgcataacctggaggattcctgcttttcctttctgcagacacaattgcttaattccgaggacggcttattcgtctgtaggaaggacgccgcatgccagcggcctcatgaggactgtgaaaactctgctggggaggaggaagatgaggaagaggaaacaatggatagtgagacggctaaaatggcttgccctagagaccagatgctgcctgaacccatctcctttgaagcagcagccattcccgttgctgaaaaggaggaggctttgttgcctgaaccagatgttcctacagatacaaaggagtcctccgaaaaggatgcactgacacagtaccctagatataaaaaataccaactggcctgtacaaagaacgtttacaacgcgtcatctcacagtacaagcgggttcgctagcacatttagagaagacaactcatcaaattcattaaagcctggattggccagaggccagatcaaatcagagccaccatccgaggaaaatgaagaggaaagtataactctgtgtctgtccggggacgaaccagatgcgaaggacagagcgggcgatgtggaaatggataggaagcaaccaagccctgctcctacccccaccgctcccgccggggcggcctgccttgaacggagccgttccgtggcctccccctcatgcctgcgttcgttgttctcgattaccaagtcagtggaactgtccggattgccaagcacttctcagcaacacttcgcacggagccctgcatgtccttttgataaagggatcacccaaggcgacctcaaaacggattatactccattcacgggaaactacggtcagccacacgtgggccagaaggaagtgagtaactttaccatggggtctccgctgcgtggaccagggctcgaagccctctgtaagcaagagggagagctggataggagatctgtgattttctcttcaagtgcctgtgatcaagttagcacgtctgtgcactcctatagcggagtctccagcctcgataaggacctgagcgagccagtccctaagggcctctgggtcggcgcaggtcagtctctgccgtcttctcaggcctacagccatggaggcctgatggccgatcacctgcccggacgaatgcgccccaataccagctgcccagttcctattaaggtgtgtccccgcagcccgccgctcgagactaggacacggacttccagcagctgctcctcctacagttacgctgaggatgggagcggcggctcgccctgttcacttcccttgtgcgagttttcttcatctccatgtagtcaaggcgcgcggtttctggccactgaacaccaagagcctgggttgatgggcgatggcatgtataaccaggtcaggccacagatcaaatgtgaacagtcatatgggaccaattcttctgatgagtccggatcgttctcggaggcagacagcgaaagctgccccgtccaggacagagggcaggaggttaaactaccattcccagtggaccagattaccgacctgcctcgcaacgatttccagatgatgattaaaatgcataaattaacgagcgagcagctggagtttatacacgacgtgagacggcgcagtaagaacaggatcgccgcacaaagatgccggaagcgaaagctggattgtatccaaaacctcgaatgtgaaatccggaagctggtctgcgagaaggagaagcttctgtcagagcgcaaccagctgaaggcctgcatgggagagctgcttgataacttctcgtgcttgtcccaggaggtatgtagggacatacagagtccagaacagatccaagccttacatcgctactgtcctgtgctccggcctatggatttgccaacagccagctccataaatcccgcccccctgggcgctgaacagaacatcgccgcttctcaatgtgcagttggagaaaatgtgccttgttgcttggagccaggtgctgcgccaccaggccctccgtgggcccccagtaacacatcagagaactgcacaagtggcaggcgactggagggaacagatccaggcacattctcggaaagaggcccccctctggaaccccgcagccagacagtgactgtcgatttctgtcaagagatgactgacaagtgcacaacagatgaacaacccaggaaagactacacatag

SEQ ID NO: 110085 - DNA, 2526 bp, Artificial Sequence
  Description of Artificial Sequence: Synthetic coding sequence
atgtctgtggacgagaagccagactccccaatgtacgtgtacgagagcaccgtacactgcacaaatattctgctcggcctgaatgaccagcgcaaaaaagatatcctatgcgacgtaactctcatcgtggaacgcaaggagttccgcgcacacagggccgtgttggcagcctgcagcgaatatttctggcaggcccttgtggggcagacgaaaaatgatttggttgtgtccttgcccgaggaagtcaccgctcgaggcttcggaccgctgcttcagtttgcctataccgccaaattacttttaagtcgtgaaaatatccgggaggttattcgttgtgcagaatttctcagaatgcacaatctcgaagatagttgttttagtttcctgcagactcagctgctcaattctgaggacggtctgttcgtttgtcgcaaggacgctgcctgtcagagaccacacgaagactgtgagaactcggcaggagaagaggaggacgaggaggaagagaccatggacagtgagaccgcaaaaatggcctgtccgagggatcaaatgttacccgagcccataagtttcgaagcggctgccatccccgtggcggagaaggaggaggcattgctgcccgagcctgatgtcccgaccgacacaaaggagtcctccgaaaaagacgcattgacgcagtaccccaggtataagaagtaccagctcgcctgtactaagaatgtgtataatgctagttcccattctactagcggctttgcatcaaccttccgagaagacaactccagcaattccctgaagccaggactggcgcgaggccagattaaatccgagccgccaagcgaagaaaacgaggaggagtccatcacgctttgcctgtccggcgacgagcctgatgctaaagacagggctggcgatgtcgagatggataggaaacaacccagccccgcgccaacgcctacagctcctgcaggagctgcatgcctcgaacgctctcgtagcgtcgcaagcccatcctgtttgcgctcattgttttcaattaccaagtctgtcgagctgtcgggcctcccgtctacgtcccagcagcactttgcgagaagccccgcttgtcccttcgataagggaattacccaaggtgacctgaaaacggactataccccatttactggcaactatgggcagccacacgtgggtcaaaaagaggtctccaactttactatgggcagcccattacgagggccaggattggaagcactctgcaaacaagagggcgagcttgatagaagatctgtcatttttagttcaagtgcctgcgatcaagtctctacatccgtacactcatacagtggcgtatcatccctggacaaagacctcagcgaacccgttcctaaaggattatgggttggcgccggccagtccctgccttcgtcgcaagcttattctcatggaggcctgatggccgaccacttgcctggcaggatgcggcctaatacatcttgccctgtacccatcaaagtgtgccctagatccccacctctggaaactcgaacacggacatcttcctcctgctcttcctattcatacgctgaggacgggagcgggggttccccttgcagcttgccgctgtgcgaattctcatcctcaccttgtagccagggagctagattcctggcaactgagcatcaggagcctggcctcatgggcgacggcatgtacaaccaggttcgcccacagataaagtgtgaacaaagctacggtacaaatagctctgatgaatccggctcattttcggaggcagatagcgagtcatgcccggttcaggacagaggccaggaggtcaaacttccatttccagtggaccagattacggatctgccacggaacgatttccagatgatgatcaagatgcataagctcacgagcgagcaattggaattcatccatgatgtgcgccgcaggtccaagaataggatagcggcacaaagatgccgaaagagaaagttggattgcatccagaatttggagtgcgagatcaggaaactggtctgtgagaaggaaaaactgctgagcgaacgcaaccaactcaaagcatgcatgggagaacttctcgataacttctcctgtctgtctcaagaggtttgccgcgacatccagagccctgaacagatccaagccctccataggtactgccctgtcctgcggcccatggatctccccacagccagctcaatcaacccagcacctctcggtgccgaacaaaacatcgccgcgagccagtgtgcagtgggggaaaacgtgccttgttgtctcgagccaggggctgcgccccctggaccaccctgggccccgtccaatacctctgagaattgtacttctggccggcgcctggaaggtaccgacccgggtacgtttagcgaacgcggcccgcctctggagcctcgcagccagaccgtgacagtagacttttgtcaagagatgaccgataagtgtaccacagatgagcagcctcgcaaggattacacctag

SEQ ID NO: 110086 - DNA, 246 bp, Artificial Sequence
  Description of Artificial Sequence: Synthetic coding sequence
atgagcgtggacgagaagccagactcccccatgtatgtgtatgagtctaccgttcattgcaccaacatactgctcggtctgaatgatcagagaaagaaggatattttgtgcgatgtgaccctaatagtggaacggaaggaatttcgcgcgcaccgggcggttcttgcagcatgttcagaatacttctggcaggctctggtaggccagactaaaaacgatttagtcgtctccctgccagaagagtag

SEQ ID NO: 110087 - DNA, 246 bp, Artificial Sequence
  Description of Artificial Sequence: Synthetic coding sequence
atgtcagtggatgagaaacctgactcaccaatgtatgtttatgagagcacagttcactgtacaaacattttgctcgggcttaatgatcagcggaagaaggacattctgtgcgacgtgactctaattgtggaacgcaaagaattccgcgcccacagggccgttctggctgcttgtagtgagtacttttggcaggctctcgttggccagactaaaaatgatttagtggtctctctacctgaggaatag

SEQ ID NO: 110088 - DNA, 2526 bp, Artificial Sequence
  Description of Artificial Sequence: Synthetic coding sequence
atgtcagtggatgaaaaaccggattctcccatgtatgtgtacgaatctacagtccattgcacaaatatactcctgggtttgaacgatcaacggaaaaaggacatcctgtgtgatgtcaccctgatagttgagcgaaaggagtttcgggcgcaccgggcggtcctggccgcctgctccgagtacttctggcaggccttggtcgggcaaaccaaaaacgacctggtggtctcactgcctgaagaagtaaccgcccggggctttggacccctgttacaatttgcatacactgccaaacttttactgtctcgagagaacatcagagaagtcatacgatgtgctgagttcttaaggatgcacaacctagaagattcatgcttcagcttcttacagactcagctgctgaactcagaagacggtttgtttgtgtgtcgcaaggacgctgcctgccaaagaccacatgaagattgcgaaaacagtgccggagaggaagaggatgaagaagaggaaacgatggactcagagaccgccaagatggcctgtcctcgagaccagatgcttcctgaacccatttcctttgaagcggccgccatccccgtggccgagaaagaagaggcactcctgcctgagcctgatgtcccgacagacacaaaagagtcatctgaaaaagacgctctgacacagtatcctcgctacaaaaagtaccaactggcctgcaccaagaacgtctacaatgcctcttctcattcgaccagtgggtttgcctcgacctttcgggaagacaacagcagtaactctttgaaaccaggcttggcccgaggccagataaagtcagaacccccatccgaggagaatgaagaggagtctattaccctgtgcctaagcggcgatgaacctgatgccaaagaccgcgccggcgatgttgagatggatcgcaagcagccttcacccgcgccgacgcccacggcgcctgctggggcagcttgcttagaaagatccaggagcgtcgcatcaccctcctgtctcagaagcttgttctctatcacaaaatcggtagaactgtctggcctccctagtacgagtcaacagcatttcgcccgctctcctgcgtgcccttttgacaaaggaattactcagggagatctgaagacggattacaccccctttacagggaattatgggcagccccatgtcggacagaaagaggtctcaaacttcacaatgggctcgccactgagaggccctgggctggaagcgctatgtaagcaagagggtgagttggaccgaagatccgtcatattctctagttctgcatgtgaccaggtctctacctctgtccacagctactctggcgtgtcttctttggacaaggacctcagcgagccagtccccaaagggctgtgggtgggcgctgggcagagcttgccatccagccaggcctactcccacggcggcctgatggccgatcatctacctgggcgtatgagacccaacacctcttgcccggtccctattaaggtgtgccctcggagtccccctctagaaacaagaaccagaacatcctcctcatgctcatcctatagttatgcagaagatggctcgggcggttccccttgttcactgcctctgtgtgagttttcatcctcaccatgtagccagggggcccgattcttagcaactgaacaccaggaacccggtctcatgggggacggcatgtataaccaggtgcggccacaaatcaaatgcgagcagagttacgggacgaatagttcagatgaatcaggatccttctctgaggcggactcagaaagttgtccggttcaggaccggggacaggaggtcaagctgccctttcctgtcgaccagatcaccgacctcccccgtaacgacttccagatgatgataaagatgcacaaactgacctccgagcagcttgaattcatccacgacgtgcgccggcgctctaagaataggatagccgcccagcgatgccggaaacgcaagttggattgcatacagaatcttgagtgcgagattcgcaaactggtttgtgagaaagaaaagcttctcagcgaacgcaaccagcttaaagcatgtatgggggaattactggacaatttttcttgcctgagccaagaagtgtgccgggacatccagtcaccagaacagatccaggccctgcaccggtactgtcctgtgttgaggcccatggacctgccaaccgcgtcaagcataaacccagcccccttaggcgctgagcaaaacattgccgcctcccagtgcgcagttggcgaaaacgtgccctgctgtttagaaccaggcgcagcacctccaggacctccatgggccccaagtaacacatcggagaattgtacctccggacgacgcctggaagggactgatccaggcacattttctgaacgtggtccccctctggaaccacgaagtcagacagtaactgtagacttctgccaggagatgacggataaatgcaccactgatgaacagccccggaaggattacacctag

SEQ ID NO: 110089 - DNA, 477 bp, Artificial Sequence
  Description of Artificial Sequence: Synthetic coding sequence
atgtctcatggtaagggaaccgacatgcttcccgagatcgccgcagcagtcggctttctgtcttccctgttgcgaactcgaggctgcgtgtcagagcagcgtctcaaggtattcagcggggcactccaagaagccctgacagagcactacaagcaccactggttccccgagaagccttcaaaagggtcaggttaccgctgtattcggatcaatcacaaaatggatcctatcatcagtcgggtcgccagtcaaatcggactctctcagccacagctgcaccagctgctcccaagcgagttgacactgtgggtcgatccgtatgaggtgtcctatcgcatcggcgaagatggttcaatctgcgtcctgtacgaggaggcaccactggccgcctcttgtggactcctgacatgtaagaatcaggtactgttgggcagatcctctcccagcaaaaactatgtaatggccgtgtcctcgtag

SEQ ID NO: 110090 - DNA, 3258 bp, Artificial Sequence
  Description of Artificial Sequence: Synthetic coding sequence
atggatacccccgagaacgtacttcagatgctagaggctcatatgcagagctataagggcaacgacccactgggtgagtgggagcggtatatccagtgggttgaggagaacttccccgaaaacaaagaatatctcatcaccctactggagcacctaatgaaagagtttctcgacaagaagaaataccacaatgatcctaggtttatttcctattgtctcaagtttgcagagtacaatagtgatctgcatcagttttttgagtttctctacaaccatgggattggcaccctgagctcccccttgtacattgcctgggccggtcacctagaagcccagggtgagcttcagcacgccagcgccgtgttacagagagggatccagaaccaggcagagccgcgagagttcctgcaacagcaataccgcctctttcagacccggcttaccgagacacatctgcctgcacaagcaagaacaagtgagcctctccacaacgtacaggttctgaaccaaatgattacttccaaaagcaatcctggtaacaacatggcctgcattagcaaaaaccaagggtcagagttatcaggggtcatcagctccgcatgtgataaggaatcaaacatggagagaagggtgattacaattagtaagagtgaatatagcgtccattcatccctagcttcgaaagtggacgtggagcaggtggttatgtactgcaaagaaaaactcattcgcggagaatctgagttttccttcgaagagctgagggctcagaaatataatcagaggcggaagcacgaacagtgggtgaacgaagatcgtcactacatgaaaaggaaggaagccaacgcgttcgaagaacagctgctgaagcagaagatggatgagctacataagaagctgcatcaagtagttgaaacctcacatgaggatctaccagcctcacaagaaaggtcagaggtgaaccccgctaggatgggcccaagtgtggggtcccagcaggagctgcgcgcaccatgtctgcctgtgacatatcagcagactccagtcaatatggaaaaaaacccacgcgaggctccacccgtcgtaccccccctcgctaacgccatttctgccgcactggtgtcaccagctacatcacagagtattgcccctcccgttcccctgaaggcccagactgtcacagacagcatgtttgcggtggctagcaaggatgccggctgtgttaacaagagtacacacgaatttaagccacagtctggcgccgaaatcaaggagggatgcgagacccataaggtggcgaacactagctcttttcataccaccccaaacaccagtctggggatggtgcaggcaactcctagcaaggtacagccttcccccacagtgcatactaaggaggcactcgggttcatcatgaatatgttccaggcccccactctccctgatatatcagatgacaaggacgagtggcaaagtctggatcagaatgaggacgcctttgaggcacagtttcaaaaaaatgtgaggtctagcggggcttggggcgtcaacaaaatcatcagttcattaagttccgctttccacgtgttcgaggatggcaataaggagaattacgggcttcctcagcccaaaaacaagcccaccggcgcccgaaccttcggagaacggtctgtctcgagactgccctctaaaccgaaagaggaagtgccacatgccgaggaatttctcgacgacagcacagtgtggggcatccgctgtaacaagacactggccccctcccctaagtccccaggagacttcacatcagctgcccaactggccagtacaccctttcacaagctaccggttgaaagcgtgcatatattagaagataaagaaaacgtcgtggctaaacagtgtacacaggcaaccttggactcctgcgaggaaaatatggtggtcccctctcgggatggtaaattttcgccaatacaggagaaatctcccaagcaggccctttctagccatatgtactccgcctcgctcctccggctctcccagcccgctgccggtggtgtcctgacttgtgaagcggagctaggtgtggaagcgtgccgcctcaccgataccgacgctgccatagctgaagatcccccagatgcaattgcgggccttcaggccgagtggatgcagatgagcagtcttggcacagtggatgctcctaactttatcgtggggaacccttgggacgacaagctcatattcaaactattatccggactctcaaaaccggtatcttcttaccctaacacctttgaatggcagtgcaagctgccagccatcaaacctaaaactgaattccagctcggtagcaaactggtatatgtccatcacttgcttggtgaaggagcctttgcccaagtttatgaggctacacagggtgacctgaatgacgccaagaacaaacagaagtttgtcctgaaagtacaaaagccagccaatccttgggagttctacattggcacgcagctgatggagagacttaagccctctatgcaacacatgttcatgaagttttacagcgcccatctcttccagaacggaagcgtgctggtaggagaactgtactcctacgggacgctcctcaatgccattaacctgtacaaaaacaccccagagaaagtgatgccacaaggattggttatcagctttgcaatgcggatgctgtacatgatcgaacaggttcatgactgtgaaattatccacggggacatcaagcctgataattttatactgggcaatggctttctcgagcaggatgatgaagacgatctgtccgcaggactagctctcattgatctgggacagagtattgatatgaaactgttccctaaaggcaccattttcacagctaaatgcgagacatctgggttccagtgtgtcgaaatgctgtccaacaaaccatggaactaccagattgactactttggagttgctgcgactgtgtactgcatgttatttgggacctacatgaaggttaaaaatgaggggggtgagtgcaaacctgagggcttattccgcagactgccacatctcgatatgtggaacgagttcttccatgtgatgttgaacattcccgactgtcaccacctgccttctctcgacctactgagacagaagctaaagaaggtgttccagcagcactacactaacaaaattcgggccttgagaaacagactgatagttctgctgctggaatgcaaaaggtcacgcaagtag

SEQ ID NO: 110091 - DNA, 3087 bp, Artificial Sequence
  Description of Artificial Sequence: Synthetic coding sequence
atggacactcccgaaaacgtgttgcagatgttagaagctcatatgcagagttataaaggcaatgacccactgggcgagtgggagagatatattcagtgggtcgaagagaattttcctgagaataaggaatacctgatcacactgctcgagcaccttatgaaagagtttctggacaagaagaaatatcataatgacccccgtttcatctcctactgtctgaagttcgccgagtacaactctgatctccatcagttttttgaatttctctataaccacggaatcggcacactttccagtccactgtatattgcctgggcggggcacctggaggcccaaggagagctgcaacacgcctctgcagtgcttcaacgaggtatccagaaccaggccgaacccagggaattcctgcagcagcaatatagactcttccagacccgactgaccgaaactcatctcccagcacaggcgaggacttcagagccgctccacaatgtccaggttctcaatcagatgatcacaagcaagagcaatcccggcaacaatatggcttgcataagcaaaaaccaagggagtgagctgtcaggtgtcatttccagcgcctgcgataaggagtcaaacatggagcggcgtgtgattactatctccaaaagcgaatacagtgtccactcgtcactggcttccaaggtggacgttgagcaggtggttatgtattgtaaggaaaagctgatcagaggcgaaagcgagttttcctttgaggaacttagagctcagaaatacaatcagcgccggaagcacgaacaatgggtaaacgaggaccggcattacatgaagaggaaagaagccaacgcattcgaggaacagttgttgaagcagaagatggacgagctacacaaaaaactgcaccaggtcgtcgagacatctcatgaggaccttcctgcctctcaggagcggtccgaagtaaaccccgccagaatgggccccagcgtaggaagccagcaggagctcagggccccatgcctgccagtgacctaccagcaaacccctgtgaatatggagaagaatccacgggaagctcccccggtagtccctccattggccaatgccatttccgccgcactcgtaagccccgccacatctcagagtattgccccccctgtaccactaaaggcccagacagtcaccgactctatgttcgcagttgcttccaaggacgccggttgtgtgaacaagtctacacatgaattcaagcctcagtctggcgcggagatcaaggaaggctgcgagacccataaagttgcaaacacttccagctttcacacgacccctaatacgtcccttgggatggtgcaggccaccccaagtaaggtgcaaccctcccctacagttcatacaaaggaggctcttggtttcatcatgaatatgttccaggcgcccacgctgcccgacatcagtgacgacaaagacgaatggcagtctttggatcaaaatgaggacgcatttgaagcacagttccaaaagaatgtacggtcgagtggggcgtggggagtaaacaagataatttccagtctgagctctgcctttcacgttttcgaagacggcaacaaggaaaattatggcctgccgcagcccaagaacaagccaactggggcgaggacttttggggagcggagtgttagtcgtttgccctccaagcccaaggaggaggtgccccacgccgaagagtttcttgacgactcgacagtatggggaattaggtgtaacaagactttagcaccctctccaaaaagccccggtgatttcacctctgccgctcagctcgcttctaccccttttcataaactgccagtggagagcgtccacattcttgaagacaaggagaacgtggtcgccaagcagtgcacacaggcaaccctcgatagctgcgaggaaaatatggtagtccctagtagagatggaaaattttcccccatccaagaaaaaagccccaaacaggcattatcctctcatatgtacagcgccagcctcctgcggctttcccaacccgccgctgggggcgtcctgacctgtgaggccgagctgggcgtggaagcgtgtcggctcacggacactgatgctgccatcgcagaggaccccccagatgcaattgcaggcctccaagccgaatggatgcaaatgtcctccttagggaccgttgatgcgcccaactttattgtggggaacccctgggacgacaagctgatcttcaagttgctcagcggtctgtcaaagcccgtttcttcttatcccaacacttttgagtggcaatgcaaacttccagctattaagccgaagacagagttccagctgggctcaaagctggtatatgtgcatcacttgcttggggagggggcattcgcacaagtgtacgaggccacccaaggagatctcaatgatgccaagaataagcagaagttcgtcctgaaggtgcagaaacctgcaaatccttgggagttctatattggtacccagcttatggagcgcctcaagcccagcatgcagcatatgtttatgaagttctatagcgcacacctatttcagaatggctccgtgctggtcggcgagctgtactcttacggaactctgctggacgacgaagatgatctgtccgccggcctcgctttgatcgacttgggtcagtcaatcgacatgaagttatttccaaaaggcactatctttactgcgaaatgcgagaccagcggcttccagtgtgtggaaatgctgtccaataagccatggaactatcagatcgactattttggcgtggcagcgaccgtctactgtatgttgttcggtacgtacatgaaggtcaagaacgaaggtggagagtgtaaacccgagggcctgtttcgcagactgccacatttggatatgtggaatgaattctttcacgtgatgctgaatatccctgattgtcaccacctgccgtccctggacctgctgcgtcagaagctcaaaaaagtgtttcagcagcactataccaacaagatccgtgctttaagaaataggctgattgtcctgcttctggagtgcaagcgatccaggaagtag

SEQ ID NO: 110092 - DNA, 3198 bp, Artificial Sequence
  Description of Artificial Sequence: Synthetic coding sequence
atggatacgcctgaaaacgtgctgcagtacattcaatgggtagaagagaattttcctgagaacaaggaatatctgatcacactgcttgagcacttgatgaaagagtttctggataagaagaaataccataacgaccctcgatttattagttattgcctaaagttcgctgagtacaactcagatttgcaccagttcttcgagtttctgtataaccacgggatcgggactttaagctcgcccctctatatcgcgtgggctgggcacctggaggctcagggagagctgcagcacgcaagtgcagtgctccagaggggtatacagaatcaggcggagccgagagagttcttgcaacagcagtatcgcctttttcagacacgcctcaccgagacccacctccccgcccaggctcgcacctcagagcccttacacaatgtgcaggtgctgaatcagatgattaccagcaaaagcaacccgggaaacaatatggcctgtatatccaaaaaccagggatcggaattgtctggtgtgatctccagtgcttgcgataaagaatctaatatggagagaagggttatcactattagtaagagcgagtacagcgtacattctagtcttgcgtccaaggtggatgtcgagcaggtcgttatgtactgcaaagagaaacttattcgcggagaatccgagttctcgttcgaggagctgcgcgcgcagaaatataaccagcggcggaagcacgaacagtgggtgaacgaagaccgccattacatgaagcggaaggaagccaatgcttttgaggaacagttgcttaaacagaagatggacgaactgcacaagaagctgcatcaagtcgttgaaacgtcacacgaggatttacccgccagccaggagcggtccgaggtgaacccagcccgcatgggtcctagcgttgggtcacagcaggaacttcgagccccctgtcttccagtgacgtatcagcagacgcctgtgaacatggaaaaaaatccccgcgaggctccccccgtggtgcctccccttgcaaacgccatttctgcagccctggtgtctcccgccacgagccaatccattgccccaccagtgcctctgaaagcccagactgtaaccgatagcatgtttgccgttgcctccaaagatgctggttgcgtgaataagtcgactcacgaattcaagcctcagtccggagcggaaattaaagaaggctgcgaaacacacaaggtggctaatacttcaagctttcacacgacccccaacacctccctgggcatggtgcaagcgactcccagcaaggtgcagcccagtccgaccgtgcataccaaggaggccctgggattcatcatgaacatgtttcaggctccgactctgccagacatttcagacgataaagacgagtggcagagtttggatcaaaacgaggatgcttttgaggcccagttccaaaaaaacgttcgtagtagtggtgcttggggggtcaataagatcatcagcagcctctcctccgccttccatgtctttgaagacgggaacaaagagaattatggtctgccccagccaaaaaacaaaccaacaggagctcggacctttggtgagcggtctgtgtcccggctgccttcaaaacctaaagaagaggtgcctcatgccgaggagtttctggatgattctacagtctggggcattcgctgcaacaaaaccctggcgcccagccctaaaagtcctggcgatttcacgtctgctgctcagctggcctctaccccctttcataagctgcccgtcgaaagcgtgcatatcttggaggacaaagagaatgtcgtcgcgaagcagtgtacccaggctacccttgattcttgtgaggagaatatggtggtgccttctcgcgatggtaaattctccccaattcaggagaagagccctaaacaggcgctgagctctcacatgtattctgcatccctgttgcgactgagtcagccggccgctggcggcgtcctgacatgtgaggccgaattgggcgttgaggcgtgtcggcttaccgacactgacgccgccattgccgaagatcccccagacgctatcgccgggctccaagctgagtggatgcagatgtcatctctcggaacagtggatgccccaaattttattgtgggaaacccatgggatgacaaactcatctttaagctcctcagtgggctgtccaagccagtgtcttcctaccctaacacattcgagtggcaatgtaaactcccagctatcaagccaaagactgaatttcaacttggttccaagctggtatatgttcatcacctcctgggtgagggggcttttgcccaggtttacgaagcgacccaaggtgatctgaacgatgccaaaaacaaacaaaagttcgtgcttaaagtgcagaagcctgccaacccttgggaattctatatcggcacacagctcatggagcggcttaagccaagcatgcaacacatgttcatgaaattttactcggcccatctgtttcagaatggatcagtgctggtgggcgaactctactcatatggaaccctactaaatgcaataaatctgtacaaaaatacgccagagaaggtgatgccccaagggctcgtaattagcttcgctatgcgcatgttgtatatgatagaacaggttcacgactgcgaaattatccatggagatataaagcccgataacttcatactcggaaacggctttcttgaacaggacgatgaggatgacttgtctgccggcctggcattgatcgatctgggccaaagcatcgacatgaagctctttcctaaagggaccatatttaccgcgaaatgcgagacatctgggttccaatgcgttgaaatgcttagtaacaagccatggaattatcagattgattattttggggttgccgccactgtctactgcatgctctttggtacctacatgaaagtgaaaaatgaaggtggcgagtgtaaacccgagggactgttcagaaggctccctcacctagacatgtggaacgaattttttcacgtcatgctcaatattccggactgtcatcatctaccgtctctcgacctcctgagacaaaagcttaaaaaagtctttcaacagcattacaccaataaaattcgtgctttacggaataggctgatagtgctactgctggaatgtaaacggtctaggaaatag

SEQ ID NO: 110093 - DNA, 2475 bp, Artificial Sequence
  Description of Artificial Sequence: Synthetic coding sequence
atggatacccctgagaatgtacttcaaatgctggaggcacatatgcagagttataagggcaacgatccgttgggcgagtgggagcgctatatccaatgggtagaagagaatttccccgagaataaggagtacctaatcactttgttggagcacttaatgaaagaatttcttgataagaagaagtatcataacgatcctagatttatttcttattgcctgaagtttgccgagtacaactcagacctgcatcaattcttcgaatttttatacaatcatgggattggcacactaagtagcccgctctacatcgcctgggctggtcatctcgaagcgcagggggagcttcagcatgcctcagccgtgctgcagagaggcatccagaaccaggcggagcccagagaatttttacagcaacagtataggctgttccagacacgtctgacagaaacccatcttcctgcacaggccagaacaagtgaacctctgcacaacgttcaagtcctcaatcagatgattacttccaaatcgaacccaggtaacaatatggcttgtatcagtaagaaccaggggtccgagctctcaggagttatatcgtctgcttgcgacaaggaatccaacatggagaggcgtgttatcacaattagtaagagtgaatattccgttcatagctctctggcctcaaaagtggacgttgaacaggttgtgatgtattgcaaggagaaactcatcagaggggagagcgagttctctttcgaagagttgcgggcacaaaagtataatcaaagacgaaagcacgagcagtgggtgaacgaagatcggcactacatgaagagaaaggaagcaaacgcctttgaagaacaactcttgaagcagaagatggatgagttacataaaaagctgcatcaggtggtggaaaccagccatgaagacttgcccgcaagccaggaacggtccgaagtgaaccctgcaaggatgggcccaagcgttggttctcagcaggaactccgggcaccttgtctacccgtgacatatcaacagactccagtgaatatggagaaaaaccctcgggaagcgcctccagttgtgccgccactggctaatgccataagcgccgcgctggtcagccctgcgacctcccagtcaatcgcgccacctgtgcccttgaaggcccagactgtgacggattctatgttcgcagttgcatccaaagacgccggctgcgtgaacaagtctacccacgagtttaagccacagtctggggccgaaatcaaagagggttgcgaaacccacaaggtcgcgaataccagttctttccacacaacacccaacacaagcctgggtatggttcaggccactccaagcaaggtacagccctcgcccactgtgcacactaaagaggccctcgggtttatcatgaacatgtttcaggcgcctaccctcccagacatttccgacgataaagacgagtggcagtccctggatcagaatgaggacgcgtttgaagctcaattccagaagaatgtgcggagtagtggcgcatggggtgttaacaaaattatttcttcactgtcttccgcgttccatgtctttgaagatggtaacaaggagaattatggtctcccgcaaccgaaaaataagcccactggtgctagaacatttggggaaaggtccgtcagtcgcctaccgtcaaaacccaaagaggaagtcccacacgcagaagagtttctggatgactccaccgtctgggggatcagatgcaacaaaactcttgctccctcacctaagtcccctggggactttacttccgccgcccagctagcttccacaccatttcacaagctgcctgtggaaagcgtccacattctagaagacaaggaaaacgtcgtagccaagcagtgtacccaggcgacattggacagctgtgaggaaaatatggtggtgccatcccgcgacggaaaattctctccaattcaggaaaaatcacctaagcaggcactgagtagccacatgtacagtgcaagcctgctgcgactgtcccagcctgccgccggcggagtgttgacgtgtgaagcagagttgggagtggaagcctgccggctcacagacacggacgccgcaatagccgaagacccccccgacgccattgcaggcctgcaggccgaatggatgcaaatgagcagtctggggacagtggacgcgccgaactttatcgtggggaacccttgggacgataagctgatcttcaagctcctcagcggcttgtccaagccagtgagttcctatcccaatacatttgagtggcagtgcaaacttccagctattaagcccaaaactgagtttcagctcggcagcaaactggtttacgttcaccatctgctgggggagggggcatttgcacaagtttacgaagccacccagggagaccttaacgatgcgaagaataagcaaaagtttgttctgaaggtaaaaagttag

SEQ ID NO: 110094 - DNA, 981 bp, Artificial Sequence
  Description of Artificial Sequence: Synthetic coding sequence
atgacaggaagtaacgagtttaaacttaatcagccccctgaggatgggatctctagtgtcaagttttcccccaatacttcacagttccttcttgtgagttcctgggatacttcggtgcggctgtacgacgttcctgcaaattccatgagattgaagtatcagcacaccggcgcagtgctggattgtgccttttacgatcccacacatgcttggtccggcggccttgatcaccagctcaagatgcatgatctgaatacagatcaggagaatcttgtgggcacacatgacgccccaatacggtgtgtggaatattgcccagaggtgaacgtgatggtaactggaagctgggaccagaccgtgaagttatgggatccaagaaccccatgcaatgcgggtacatttagtcagccagaaaaggtatacaccctgtcagtttccggcgataggctgatcgtgggcaccgcagggcggcgggtgttagtatgggatctgagaaatatggggtacgtgcagcaacggcgagaatcgtccctgaagtaccagacgcggtgtattcgggcttttcccaacaagcagggctatgtgttatctagtatagagggaagagtggcagtggaatacctggaccctagccccgaagtacaaaagaaaaaatatgcttttaaatgccatcgtctcaaagaaaataacatcgaacagatctacccggtcaacgcgatatcttttcataacatccataacacgttcgcgaccggcggatccgacgggtttgtaaacatctgggacccatttaacaaaaagcgcctgtgccagttccaccgctacccaacatctattgcctctcttgctttctccaatgacgggaccaccctggccatcgcttctagctacatgtacgaaatggatgacacggagcacccagaggatggaatcttcattcggcaggtcaccgacgccgaaaccaaaccgaaatctacttag

SEQ ID NO: 110095 - DNA, 987 bp, Artificial Sequence
  Description of Artificial Sequence: Synthetic coding sequence
atgaccggaagcaatgaatttaagctaaatcaacctcctgaggatggtatttctagtgtcaagttttccccgaatacaagtcagtttctgctggtctcatcatgggatacttctgtgaggctgtatgatgtgcccgccaattccatgcggttaaaataccagcatacaggagccgtgctggactgtgccttctacgatccaactcacgcgtggagtggcggcctcgaccatcaactgaagatgcacgacctcaacacagaccaggaaaacctcgtggggacccacgacgctcccattagatgcgtggaatactgtcccgaggtcaatgtgatggtgacgggtagctgggatcagactgtcaagttatgggaccctaggaccccatgcaatgcaggcacgtttagccagcctgagaaagtctatactctaagcgtgtcgggcgataggctcatcgtaggtactgctgggcgacgcgtgctggtctgggaccttaggaacatggggtatgtccagcagcgtcgcgagagttctctcaaataccagaccagatgtatacgcgcttttccaaataagcaggggtatgtactgtcttcaatcgagggtcgcgtggccgtggagtaccttgatccatcacccgaagtccagaagaaaaaatacgcattcaagtgccatcgcctgaaagaaaacaatatagagcaaatatacccagtgaatgccattagtttccataatatacacaatacattcgctactggaggttcagatggattcgtaaatatttgggacccatttaataaaaagcgactttgtcaatttcatcgataccccacatctattgcttccctggcattttctaacgatggcactaccctcgcaatcgccagcagttacatgtatgaaatggatgacacagaacaccccgaggacggcatcttcatccgtcaggtgaccgatgcagaaacaaagccaaagtctccatgtacctag

SEQ ID NO: 110096 - DNA, 747 bp, Artificial Sequence
  Description of Artificial Sequence: Synthetic coding sequence
atgcacgacctgaacactgatcaggaaaacctcgtgggcacccatgacgcacccattcgctgtgttgagtactgccccgaagtcaacgttatggtgacgggaagctgggaccagaccgtgaagctatgggacccccgcaccccctgtaatgcgggtacgttttcacaaccagaaaaagtgtacactctctccgtatctggggatcgactgatagtggggactgccggaaggagagttctagtgtgggatctgagaaatatgggatacgttcagcagaggcgcgagtctagcctcaaataccagactcgatgtatcagggctttcccgaataaacagggctatgtgttatcatcgatcgaaggacgagtcgctgtagagtacttagatccctcaccagaggtgcagaagaaaaagtacgcctttaaatgtcaccgcttgaaggagaacaacatcgaacagatctaccctgtaaacgcaatctcttttcacaacatacacaacacgtttgcgaccggtggcagcgatggttttgtgaacatttgggatccgttcaacaaaaagcgcctctgccagttccatcgctaccccaccagcatcgcgagcctggccttttctaatgacggaacgaccttggctatcgccagttcatacatgtatgaaatggacgatactgagcacccagaggacggcatttttattcgccaggtgacggatgctgaaactaaacccaaatctccttgcacttag

SEQ ID NO: 110097 - DNA, 1164 bp, Artificial Sequence
  Description of Artificial Sequence: Synthetic coding sequence
atggcctgcaccatccaaaaagccgaagctctcgatggagcccatttgatgcagatcctgtggtacgatgaagaggagtcgctgtatcccgctgtctggttgcgagacaactgcccctgtagcgactgttatctagatagtgcaaaggctcgcaagttgctagtcgaagccctagacgtaaacatcggcatcaaaggactgatctttgacagaaagaaggtgtacatcacctggcctgacgaacactatagcgaatttcaggctgattggctgaaaaaacgatgttttagcaagcaggctagagcaaagctccagagggaactctttttcccagagtgccaatactggggctccgaacttcaactgcccactttggacttcgaagatgtcctcaggtacgacgaacacgcgtataaatggctcagtacacttaagaaagtcggaatagtgcggctaaccggcgccagcgacaaacccggagaagtaagcaagttaggcaaaaggatgggcttcttgtatcttaccttctatgggcatacatggcaggtgcaggataagatagacgccaacaatgtagcttacacaaccggaaaactctccttccacacagattatccggctctgcatcaccctccaggagtccagctcctccactgtataaagcaaacagtgaccggcggcgactccgaaatcgtcgatggtttcaatgtctgccagaaactcaagaagaacaaccctcaggctttccaaatcctttcaagcactttcgtggactttaccgatattggagtcgactattgcgatttttcagtgcagtccaaacataagatcattgagcttgacgacaaagggcaggtggtaaggataaatttcaacaatgcaacaagggacaccatctttgacgttccagttgagagagtacagccgttttatgccgccctgaaggagttcgttgacttgatgaactcaaaggagtctaaatttacattcaaaatgaatcctggggatgttataacgttcgacaattggaggttgctgcatggccgaaggtcatacgaggccggtaccgagatctctagacatctggaaggcgcttatgccgactgggacgtagtgatgagccgcctgagaattttaaggcagcgcgtggagaacggtaattag

SEQ ID NO: 110098 - DNA, 1164 bp, Artificial Sequence
  Description of Artificial Sequence: Synthetic coding sequence
atggcctgtaccattcagaaagcagaggcattggatggcgcacatctcatgcagattctttggtacgatgaagaagaatccctgtatcccgccgtttggctccgggataattgtccatgcagcgattgctacctggatagcgctaaggctcggaaactgctggtggaagcccttgacgtcaatataggcataaagggcctcatctttgatcgaaagaaggtgtatataacatggccagacgagcactactccgagtttcaagcagattggctgaagaaaagatgtttttccaagcaagcaagagccaaattacagcgcgagctattttttccagagtgccaatattgggggtctgagcttcagctgcctaccctggacttcgaagatgtgctgcggtacgacgaacacgcgtataagtggttgtcgaccctgaagaaagtcggcatcgtgcggcttacgggagcctcagataaacctggggaagtttctaaacttggaaagaggatgggatttctgtacctgacgttttacgggcacacctggcaggtgcaggacaagatcgacgccaataacgtggcctatacaaccgggaagctgtcatttcataccgattatccagccctgcatcaccccccaggcgttcaattgctgcactgtattaaacagactgtaactggcggcgattccgagattgttgacggcttcaacgtttgtcagaagttgaagaagaacaatccgcaggctttccagattctgagtagtaccttcgtggactttacggacatcggcgtggactactgcgacttcagtgtgcagagcaagcacaaaatcatcgagcttgatgacaagggacaggtggtgcgaattaacttcaacaatgctacacgagacactatttttgatgtgcccgtcgagcgcgttcagcccttttacgcagctttgaaagaatttgttgacctgatgaactcgaaggagtcaaagtttactttcaagatgaacccaggtgatgttatcacttttgataactggcgccttctgcacgggaggcgctcctacgaggcaggcactgagatcagccgtcatctcgaaggagcctatgccgactgggatgtggtgatgtctaggctacgtatcttgcgtcagagagtggaaaacggcaattag

SEQ ID NO: 110099 - DNA, 1164 bp, Artificial Sequence
  Description of Artificial Sequence: Synthetic coding sequence
atggcatgtacgattcagaaggctgaggccctcgacggcgcgcatttaatgcagatcctatggtatgacgaagaagagagtctgtaccccgccgtgtggctcagagacaactgtccctgctccgattgttacctcgactcagcaaaagccagaaaacttcttgtggaggctctagatgtgaacattggaatcaagggactgattttcgacaggaaaaaggtgtacatcacatggcccgatgaacactacagtgaattccaggcggattggctcaaaaagcgctgtttctccaaacaggccagagcaaaattgcagagagaactgttctttcccgaatgccaatattggggttcagagctccagctccctacactggatttcgaagatgtactcagatacgatgagcatgcgtataaatggttgagcacactgaagaaggtgggaatcgtgcggctcactggggcttcagacaaacccggcgaggtgtcaaagctgggaaagcgaatgggttttctgtacctcaccttttacggccacacttggcaagtgcaggataaaattgacgccaacaatgtcgcatatactacggggaagctctcctttcatactgattatcccgctctgcatcacccacctggagtgcagttgcttcattgcatcaaacagaccgttacaggaggcgacagcgagattgtagacggcttcaacgtttgtcagaaacttaaaaagaataacccccaggccttccagatcctttcttccacttttgtggactttactgacatcggcgtggactattgtgacttcagcgttcagtctaagcacaaaatcattgagttggatgataaggggcaggtagtacgcattaatttcaacaacgctactagggacaccatctttgacgtgcctgtggagcgggtacaaccattttacgccgcacttaaagagtttgttgacttgatgaattctaaggagtccaagttcacattcaagatgaacccgggagacgtcattactttcgacaattggaggcttttgcatgggcggcgtagttatgaggcagggacagaaatctcccgccatctggaaggcgcctacgctgactgggatgttgtgatgagtaggctgcgtattctgcgtcagcgggtggaaaatgggaattag

SEQ ID NO: 110100 - DNA, 1164 bp, Artificial Sequence
  Description of Artificial Sequence: Synthetic coding sequence
atggcctgcactattcagaaggccgaggcccttgatggtgcccatctgatgcagatactttggtatgatgaggaagaatcactttatccggctgtgtggctgcgagataattgtccctgttccgactgctacctcgattctgcaaaagcacggaaactcctggtggaggcactggacgttaacattggtataaaggggttgatctttgatcgcaaaaaggtctatattacctggccggatgagcactatagtgagttccaagctgattggctgaagaagcgatgtttttcaaagcaagcccgagcaaagctgcagcgcgagttgttttttcccgagtgtcaatattgggggtcagaactgcaattgcctaccctagacttcgaagacgtgctgcgctacgatgagcatgcgtataaatggctcagcacactgaaaaaagttggaatcgtcaggctgacaggcgcttccgacaagcccggcgaggtcagtaagctgggcaaaagaatgggtttcctctatctgaccttctacggtcatacgtggcaggtacaagacaaaatcgacgccaataacgtcgcttataccacgggaaaactgagtttccataccgactaccccgcactacatcatcccccaggcgtgcaacttctccattgtattaaacagacagttaccgggggggacagcgagattgtggacggattcaatgtctgccagaagctgaagaaaaataaccctcaggcattccagattctcagctcaaccttcgtcgacttcactgatataggagtcgactactgcgactttagcgtgcagtcaaagcataagatcatcgaattggacgataagggccaagttgtaagaatcaacttcaacaatgctacacgtgatacgatctttgacgttcccgttgagcgagtgcaaccattctacgctgcactcaaagagttcgtcgacctgatgaactccaaggagagtaagttcactttcaagatgaaccccggggatgtgattacattcgataattggcgtcttttgcacgggcgccgctcctatgaggccgggaccgaaatatcaagacatctcgagggcgcatatgctgattgggatgtggtgatgtcaaggctgcggatcctacgccagagagtggagaacggcaattag

SEQ ID NO: 110101 - DNA, 207 bp, Artificial Sequence
  Description of Artificial Sequence: Synthetic coding sequence
atggcttgcaccatacaaaaggctgaagccctagatggcgcacacctgatgcaaattttatggtatgatgaggaggagtcactgtatcccgcagtttggctgcgggataattgcccatgctccgactgttatttagactctgccaaggcccgtaaattgctggtcgaggctctggatgtcaacatcggcattaaaggactgatctag

SEQ ID NO: 110102 - DNA, 771 bp, Artificial Sequence
  Description of Artificial Sequence: Synthetic coding sequence
atggagccagctgctgccctccacttcagcctcccagctagcttgctgttgctcttgttgctacttcttttgagcctttgcgcactggtctcagctcagtttactgttgtgggacccgccaacccaatcttagccatggtcggcgaaaatacaacattgcgttgccacttgagccctgagaaaaacgccgaagacatggaggtgaggtggttcaggtcgcagttttcccctgccgttttcgtatataagggcggacgcgaaaggacagaggaacaaatggaggagtataggggccgcattacatttgttagcaaagacatcaataggggctccgtcgccttggtcatacataacgtcactgctcaggagaacggaatataccgatgctactttcaggaaggaagaagctatgacgaagcaatcctgaggctcgtggttgctgagtcctttatgccgtccgcttctccttggatggtggcactggctgtcatcctcactgcatccccgtggatggtctcaatgacggttatcctggctgtattcatcatctttatggccgtgtcgatctgctgcatcaagaagctccaacgcgagaaaaaaatcctttcgggcgaaaagaaggtcgagcaggaagagaaagaaatcgctcagcaacttcaggaggaattgagatggaggagaacattcctccatgccggctacgagctccccgggatccgggggcctagctggaagaggcccctgcacggagagcctccttccgcgttctag

SEQ ID NO: 110103 - DNA, 942 bp, Artificial Sequence
  Description of Artificial Sequence: Synthetic coding sequence
atggagcccgctgcggctttgcacttctctctgcctgcgtcccttctactgctgctcctcctcctccttttgagcctctgtgctctggtaagcgagtccttcatgcccagcgccagcccatggatggtcgcactcgctgtgattctcacagccagtccttggatggtatcaatgacagtgatactggccgtgttcataattttcatggccgtttctatctgctgtataaagaagcttcaacgggaaaaaaagatcctctccggcgagaagaaggtggagcaggaggaaaaggagatcgcccagcaactccaagaggaactgcgttggcgaagaacttttctccatgccgccgatgtggtcctggaccctgatacggcacacccggagctctttttaagtgaagaccgacgctcggtgagacgaggaccctacaggcagcgcgtacctgataaccctgagcgattcgactctcagccttgcgttctagggtgggagtctttcgcttccggtaagcactactgggaagtggaggtggaaaacgtcatggtgtggaccgtgggagtgtgcagacactccgtggaaaggaaaggggaggtcctgctgattccacaaaatggattttggaccctggaaatgttcggcaaccagtacagagccctgtcttccccggaaagaatcctgcccttgaaggagagtctgtgtagagtcggcgtgtttctcgactacgaagccggcgatgtgtccttctacaacatgcgcgacagatcccatatctacacgtgccccagatctgccttcacggttcccgtacggccctttttcagactgggaagtgatgatagcccgattttcatatgtcccgcactcactggcgcctcaggagtcatggtgcctgaggagggtctgaagctccatagagtgggaacacaccaatccctgtag

SEQ ID NO: 110104 - DNA, 1608 bp, Artificial Sequence
  Description of Artificial Sequence: Synthetic coding sequence
atggttggtgaagacgctgatctgccctgtcaccttttccccacgatgagcgctgagaccatggaattgaggtgggtgtcttcttcacttcgccaagtagttaacgtttatgcagacggcaaagaggtcgaggaccgacagagcgctccctacaggggccggacatccatcctccgggatggaatcactgccgggaaggcagccctgcgcatccacaacgtcaccgccagcgactccggtaagtacctgtgctatttccaggatggagatttctacgagaaggcccttgtggaactgaaagtggcggcactcggatctgacctccacatcgaggtcaaaggctatgaagacgggggaatccacctagagtgccggtcaacggggtggtacccacagcctcagatcaagtggtcagatactaagggcgagaacattcctgccgtggaggccccggtggtggcagacggcgtagggctgtatgcagtagccgccagtgtcattatgaggggcagttctggggggggtgtttcttgcataattaggaattccctgctgggcttggagaaaacagcaagcatttcaatagcagacccattcttccggagcgctcagccatggatcgccgcactggccggaaccctgccaatctcacttcttttactcgctggtgcctcctacttcctctggcgtcagcagaaggagaagattgcactgtctcgagagacagaacgtgagagagaaatgaaggaaatggggtacgccgcaaccgagcaggaaatcagcctgcgagagtggcgcaagattcagtacatggcacgaggtgagaagtccctggcgtaccatgagtggaagatggccctgtttaaaccagcagacgtgatcctggaccccgacacggcgaacgccatcctgctggtaagtgaagaccagagatctgtacagagagctgaagagcccagggacctcccagacaacccagaacgctttgaatggcgttattgcgtgctgggatgcgagaactttacgagcggcaggcactactgggaggttgaggtgggggaccggaaagaatggcacattggcgtatgctccaagaacgtcgaaaggaagaagggctgggtgaagatgacgcctgagaacggctattggaccatgggactgaccgatggcaataaatacagggctctgacggagcctcgcactaatcttaaactgcccgagccaccccggaaggtggggatctttctggattatgaaaccggggaaatctccttttacaacgccaccgacgggtcccacatatacactttcccacacgccagtttcagcgagcccctttaccccgtatttaggatattgacactggaacctactgccctcacaatctgccccatcccaaaggaggtcgagtccagccccgaccccgatctagttcctgaccatagcttggagacacccctgacccctggcctcgctaatgagagtggtgagcctcaggccgaagttacttcattgctgttacctgcgcatcccggcgctgaggtctcaccgagcgctacaaccaaccagaaccataaacttcaagcgagaaccgaggccctgtattag

SEQ ID NO: 110105 - DNA, 1581 bp, Artificial Sequence
  Description of Artificial Sequence: Synthetic coding sequence
atggcggtgtttccttcctcgggccttccacgatgcctgctgacactgattctcctgcagctgcccaaactcgattcagcaccattcgatgtgatcggaccccccgagcccatcctagctgtggtgggcgaggatgcagagctcccatgcaggctttcgccaaacgcatctgcggagcatctggagctcaggtggttccgaaagaaggtgtccccagccgtcttggtacaccgcgatggaagggaacaggaggccgagcagatgccagaatacaggggcagggccactctggtgcaagatggcatcgctaaggggcgtgtggccttgaggatccgtggcgtcagagtctctgacgatggtgagtatacttgtttcttccgcgaggatggttcctatgaggaggccctcgtgcatctcaaagtggccgctctggggtccgatccacatatatccatgcaggtgcaggagaacggcgaaatttgtctcgagtgcacaagtgtcgggtggtatcccgagcctcaagtgcaatggcgcacaagcaagggcgagaagtttccctccacatctgagtctagaaatcccgacgaagagggcttatttaccgttgctgcatccgttattattagagacacctcagctaaaaacgtttcgtgttatatccagaacctcctgctggggcaggaaaagaaagtggagatttccattcctgcctcctctctgccccggctgacgccgtggattgtggcggtggctgttattctgatggtgcttggtctactgaccattgggtccatcttttttacctggcggctgtataatgagagacccagagagcgccgcaacgaatttagcagtaaggaacgactgctggaagagctgaagtggaagaaagccaccctacacgcagttgacgtcactctcgatcccgacactgcccaccctcacctcttcttatacgaagattctaaatctgtcaggctggaagatagtcgacagaagttgcccgagaagaccgagcggtttgactcttggccctgcgtgctcgggcgggaaacattcacatcgggccgccattattgggaggtggaggtgggggataggactgattgggccatcggtgtgtgtagagagaacgtgatgaagaaaggttttgacccaatgacccccgaaaatggattttgggctgtggagctgtatggcaatggctattgggctttgacacctctccgcacccccctcccactggcaggccccccccgaagagtcgggatatttttggactacgaatcaggtgatatcagtttttataatatgaacgacgggtctgacatttatacattcagtaatgtcacattttctggacctttgaggcctttcttttgtctttggagtagcggcaaaaaaccgctgacgatatgccctatagccgatggtcccgagcgcgtgacggtgatcgctaacgcacaagatctgagcaaagaaatccccctgtccccaatgggtgaggatagcgccccaagagacgcggataccctccactcaaagttgatcccaacccagccttcgcagggcgccccatag

SEQ ID NO: 110106 - DNA, 1485 bp, Artificial Sequence
  Description of Artificial Sequence: Synthetic coding sequence
atggctgtgttccccagctccggtctcccccggtgcctgctcacattaattctgctgcaactgcctaagctggatagcgcaccatttgacgtcatcggtccacccgaacctatcctagctgtggtcggcgaggacgctgagctgccctgccggttgtccccaaatgcaagcgccgagcacctagaacttaggtggttccgaaagaaagtgagccccgctgtccttgtgcaccgggatgggagggaacaggaagcagagcagatgcctgaatacaggggtcgcgccaccctagtgcaagacggcatagctaaaggccgagtggcactcaggattagaggggtcagggtgagtgatgatggagagtacacctgcttcttccgggaagacggttcctatgaagaagcattggtccacttgaaggtggcggcactgggcagtgatccacatatctcgatgcaggtccaggagaacggggaaatttgcctcgaatgcacctctgtgggatggtacccggagcctcaagtgcagtggcgaacctcaaaaggtgagaagttcccaagtacatctgaatccagaaatcctgatgaggaaggcctcttcaccgtggcagcgtcagtcataattagggacaccagcgccaagaacgtgtcttgttacattcagaacctgttgcttgggcaggaaaaaaaagtggagattagtatccccgcatcctccctgccacggctgacaccctggatcgtagccgtggctgtgatcctgatggtactgggtctgctgacgattggcagcatttttttcacctggaggctgtacaatgagagacctagagaacgccgcaatgaattctcttctaaggagcgactattagaggagttaaagtggaagaaggctaccctgcacgctgtagacgtaactctagatcccgacaccgcacatcctcacttatttctgtacgaagattccaagtctgtgcgactagaggattcgcggcaaaagttacctgaaaagacagagagatttgattcatggccctgtgttctgggcagggaaacattcacatctggcagacattattgggaggtagaggtcggagacagaacagactgggctatcggcgtgtgtcgtgaaaatgttatgaaaaagggctttgaccccatgactccagagaatggtttctgggccgtggagctgtacggaaatggatactgggccctaacacccctccggaccccgctgcccctcgctggcccaccccgaagagtgggcatcttccttgactatgaaagcggcgatatatccttttacaacatgaatgacggctcagatatatacacctttagcaacgtcaccgtgatcgcaaacgcacaggacctttcaaaggagatcccactatcacccatgggcgaagactcggcaccgagggatgctgataccctccactcaaagctgattcccactcagcctagccagggcgccccatag

SEQ ID NO: 110107 - DNA, 1590 bp, Artificial Sequence
  Description of Artificial Sequence: Synthetic coding sequence
atggagtctgccgcagctctccattttagcagacccgccagccttctcttgctcctgctgagcttgtgtgctctggtgagtgcgcagttcatagtcgtcggaccaactgacccgatcctggcgactgtgggcgaaaacaccacactgagatgtcatctttctcctgaaaaaaacgccgaggacatggaggtccgatggttcaggagtcaattcagccctgccgtgtttgtgtacaaaggggggcgggagcgtacagaagaacaaatggaggagtacaggggcaggactacctttgtttctaaagatatatcacgagggtccgtggctctggtcatccacaacattaccgcgcaggagaacgggacctatcgatgctacttccaggaggggagaagctatgacgaggcgatcctccacctagtcgtggctgggcttgggtcgaaacctctaatctcaatgcgcggccacgaggatggtgggattcgtcttgaatgcatatcgcgcgggtggtaccccaagccactgacggtgtggcgggacccttatggcggggtagcacccgccctgaaggaggtgtccatgccagacgctgatggcctcttcatggtgacaacggccgtcatcatacgggataaaagcgtgcgcaacatgtcctgcagcattaacaacactctgctcggccaaaaaaaggagtctgttatctttataccggagagttttatgccgtccgtgagccctccgatcgccgtgtgcatttactggataaacaaactccaaaaggagaaaaaaatcctgtcaggcgagaaagaatttgaaagagagacccgtgagatagctttaaaggaactggaaaaagagagagtgcagaaggaagaagagcttcaggtgaaagagaagctgcaggaagaacttagatggcgtagaacctttttacacgccgtcgacgtagtgctggacccggataccgctcaccccgatttgtttctctctgaagaccggcgaagtgtcaggcgctgtcctttcaggcaccttggtgaatcagtgccagataacccagagagatttgacagccagccttgcgtcctggggcgagagtcattcgcttccgggaagcattattgggaagtcgaagtggaaaatgtgatagagtggaccgtcggcgtttgtagagacagcgtggagaggaaaggcgaggttctgctgatccctcagaatgggttttggacactggagatgcacaaagggcagtatagggctgtttcttcacccgaccgcattctaccccttaaagagtcactgtgccgtgttggggtatttctcgattatgaagcaggggacgtgagtttttataatatgcgagacagatcccatatctacacttgtccacgttctgccttcagcggacccgacacttctcagtccggggacccccctgaacccattgagagtatcccatggagtcattctcatgttgataagccttggagttctcaacagccaccccacaatactcacctccccgcagctagtttcacccctacgactgatttgtcacctagttttttactgctcacaaggctgtgtttttag

SEQ ID NO: 110108 - DNA, 1584 bp, Artificial Sequence
  Description of Artificial Sequence: Synthetic coding sequence
atggagtctgctgctgctctgcacttttcgcgccctgctagtcttttactgcttttgctgagcctttgcgccctcgtatcagcccaattcattgtcgtcggccccaccgatcctatccttgcgacagtgggcgagaatacgacattgagatgtcacctcagccctgagaaaaacgctgaagatatggaggtacgctggtttaggagccagttctccccggcagtctttgtctacaagggaggaagggaacggacggaggaacagatggaagaatatcgaggaagaaccacctttgtaagcaaggatatcagtagagggtcggtagctcttgtaatccacaacattaccgctcaggagaacggcacgtatagatgctactttcaagaaggccgaagttacgacgaagcaatcctgcatctggttgtagcgggactgggcagcaaacccctcatcagtatgagaggccatgaggacggcgggattcgactagaatgtatcagccgcgggtggtatcctaagcctcttactgtctggcgggatccctacgggggagtggcacccgcgctgaaagaggtgtctatgccagacgctgatggcctgttcatggtaacgaccgcggttatcataagagacaagtctgttaggaatatgagttgtagcatcaacaacacgctgttaggtcagaagaaggaaagcgtcatctttattcctgagagctttatgcctagtgtatccccctgcgccgtggccttaccgatcatagtcgtcatactgatgataccaattgctgtatgcatttattggataaacaaactacagaaggaaaaaaagattctgtctggggagaaagagtttgagagggagactagagaaattgctttaaaagagttggagaaggaacgcgtgcagaaggaagaggagcttcaggtcaaggagaaactgcaagaggaattaagatggaggaggacctttctgcacgctgtggacgtggtgttggacccagatactgctcaccccgacctctttcttagtgaagaccgtcggtccgtcaggaggtgccctttcagacacctgggcgaaagtgtgccagataacccggagaggttcgattcccagccctgtgtgctaggcagagaatcctttgcaagcggcaaacactattgggaagtcgaggttgaaaatgtgatcgagtggaccgttggcgtctgtagagatagcgtggagcgtaagggcgaagttctgctcatcccgcaaaacggattctggacactggagatgcataagggacagtacagggctgtgtcatcacccgatcgaatcctcccccttaaggagagcctctgccgggtcggggtctttctcgattatgaggcgggagacgtgtccttctacaacatgcgagatcggtcccatatctatacctgcccaagatcagccttcagcgtgccggttaggcccttttttaggcttggctgtgaggattctcccatttttatctgtccagcactaacaggagccaatggggtcaccgtccctgaggagggcctgaccctgcacagagtcggcacccatcagagcctgtag

SEQ ID NO: 110109 - DNA, 1005 bp, Artificial Sequence
  Description of Artificial Sequence: Synthetic coding sequence
atggagtcagcagccgctctgcatttttcaagaccggcctctcttcttttgctactgttgtcattgtgtgccctcgtttcagcacagtttattgtggtgggcccaacagatccaatccttgctaccgtgggagagaataccactctacgctgccacctgtcccctgaaaagaacgctgaggacatggaagtgcggtggtttcgaagtcagttttcccccgctgtctttgtttacaaggggggaagggagcggaccgaggagcagatggaggagtaccgtggaaggacaacattcgtctcaaaggatattagtcggggttccgtcgctttggttatacataatatcaccgcgcaggagaatgggacctaccggtgctacttccaagagggacggagctatgacgaggcaattctccacctggtggtcgccggactgggctcaaaaccactgatttcgatgagggggcacgaggatggaggcatcaggctggagtgcatcagccggggctggtacccaaaaccattgaccgtatggcgcgacccttacgggggcgtggcccccgccctgaaggaggtgtccatgccggatgcagacggtctcttcatggttactactgccgtgatcatcagggacaaatcagttcgtaacatgtcttgttctatcaacaatactttgttgggccaaaagaaggagtcagtgatctttatacctgaatctttcatgcccagcgtgtctccatgcgccgtggcactccccataattgtggtaatcttaatgattcctattgcagtttgcatctactggattaataaactgcaaaaggaaaagaaaatcctgtcaggcgaaaaagagttcgagcgcgagacacgtgagattgccctgaaggagctcgaaaaggagcgagttcagaaggaggaggagctgcaggtcaaggagaagctacaagaggagttacgatggaggcgcacctttcttcacgccgaacttcagttctttagtaattag

SEQ ID NO: 110110 - DNA, 993 bp, Artificial Sequence
  Description of Artificial Sequence: Synthetic coding sequence
atggagtctgccgctgcacttcacttttctcggcccgcttccctcctgctgttgttgctttcactctgcgcactcgtatcagcacagttcattgtcgtgggtccaactgaccccatcctggcgaccgttggggaaaacaccacactcaggtgccatcttagccctgaaaaaaacgccgaggatatggaggtccgctggtttaggagccagttcagtcccgcagtgttcgtttataagggagggagggaaaggaccgaagaacagatggaggaatatagggggcgaacaactttcgtctcaaaagatatctccaggggctctgtggcactcgttattcacaacatcacagcccaggaaaatggcacctacaggtgttatttccaggagggccggtcctacgacgaggcaatcctgcacttggtagtcgcaggacttggctctaagcccctgatctccatgcgagggcatgaggacggcggaatccggcttgagtgcatttctcggggatggtatcccaagcccttaacagtgtggcgggacccctatggcggggtggcccccgccctgaaggaggtcagcatgcccgatgcagatggtttgtttatggtaacaaccgctgtgataattagggataaatcagtgcgaaacatgagctgttcaatcaacaataccctgctgggacagaaaaaggaaagtgtcatcttcatcccagagagtttcatgccctcagtatcgccttgtgccgttgcattacccattatcgttgttattctaatgattccaatcgcagtttgcatatattggatcaataaattacagaaggagaaaaagattttgagcggtgaaaaagagtttgagcgagagacaagagagattgccctgaaagagctggaaaaagaacgtgtgcagaaggaagaggaactgcaagtgaaggaaaaactacaagaggagctccgatggcgccggactttcctgcacgccggcccggtgtag

SEQ ID NO: 110111 - DNA, 1401 bp, Artificial Sequence
  Description of Artificial Sequence: Synthetic coding sequence
atggaagtgcggtggttccggtcgcagttctctccagcagtgttcgtgtataaagggggacgcgagagaaccgaagagcagatggaggaatacagggggcgcaccaccttcgttagcaaggatatttccagggggtctgtggccctggtcatccacaatataacagcacaggagaatggcacgtatcgctgttatttccaggaaggccgatcttacgatgaagccatcctccatctagttgtcgccggtcttgggtctaagccccttattagcatgagagggcatgaggacggagggattcggttggaatgtatttcacgcggctggtaccccaagcctctgaccgtctggagagacccttacgggggtgtagcacctgccctgaaagaagtgagtatgcctgatgctgacgggctgtttatggtgacaaccgccgtcatcatccgtgacaaatcagtacggaacatgtcgtgctccataaataatacgcttttaggccagaaaaaggagagtgtcatatttatacctgaaagctttatgccaagcgttagtccatgtgccgtggcattgccaatcattgtcgtgatcctgatgattccaatagctgtttgtatctactggattaacaaacttcagaaggagaagaagatactatctggggagaaggaattcgaacgcgagacgagagaaatcgctttgaaggagctcgagaaagagcgcgtgcagaaggaggaggaacttcaggttaaggagaaacttcaggaggagttgcggtggaggcgtactttcctgcatgccgtagacgtagtgctagatcccgatactgcccacccagatctgttcctatctgaagacagaaggagcgttcgacgctgtccattccgccatctgggagaaagtgtgcctgataacccagagcggtttgatagccagccttgtgtcctcggccgtgagagttttgcaagcgggaagcattactgggaggtcgaagttgaaaatgtcatcgagtggacggtgggcgtttgcagagattctgttgaacgcaagggagaagttctgcttatccctcaaaatggcttctggacactagagatgcataagggccagtatcgagcagtgagctcacccgacaggatcctccctctgaaggaaagcctatgtcgggtaggcgtcttcttggactacgaagctggcgatgtttccttctacaacatgcgcgatagaagtcacatctacacttgtcctcgcagtgcttttagcgtgccggtgcggccctttttccggttgggatgcgaggactcacctattttcatctgcccagccctcactggggccaatggggtcactgtccccgaggaaggactcaccctacatagagtgggcacccaccagagtttgtag

SEQ ID NO: 110112 - DNA, 1224 bp, Artificial Sequence
  Description of Artificial Sequence: Synthetic coding sequence
atggaacctgccgccgctctccacttctctttaccagcgagtctgctcctgctgttgttgctgctcctgctgtctttgtgcgccctggtctctggcctcggcagcaagcctctcatcgagatcaaagctcaggaagacggtagcatttggctggaatgtatcagcggaggctggtacccagagcctctgaccgtgtggagggacccatacggggaagtcgttccagcactgaaggaggtctccattgccgatgccgacggactgtttatggtgacaacggctgtgattattcgagataaatacgttcggaatgtgtcgtgcagcgtgaacaacacgcttctgggccaggagaaggagactgtgatatttatccccgagtcgtttatgccctcagcatcaccatggatggtagcactggctgtcatcctgacagcatctccctggatggtctctatgactgttatccttgccgtttttatcatcttcatggcggtttcaatttgctgtattaagaagcttcagagggagaagaagattctgagtggcgaaaagaaagtcgaacaggaggaaaaggaaatagctcagcaactgcaagaagaactgcgctggaggcgaacctttctccacgctgccgacgtggtccttgacccagacacggctcaccccgaattgttcttgagcgaggaccggagatccgtgcggaggggcccctaccgccagagggtccccgataatcccgaacggttcgactcccagccctgtgtcctgggatgggaatcctttgctagcggcaaacactactgggaggttgaagtggagaatgtcatggtgtggaccgtgggggtgtgccgtcattctgtagagcggaagggcgaggtgctcctgatcccacagaacggcttctggacccttgagatgttcggcaaccagtaccgggccctaagctcccccgaaagaattcttccactgaaggagtccctatgcagggtgggggtcttcctggactatgaagccggggatgtatccttctacaatatgcgggacaggtcccatatctacacctgcccacggtccgccttcacagtccccgtcaggccgttctttaggctcggtagcgacgactcacccatctttatttgccccgccctcactggtgcaagcggggtgatggttccggaagaaggactgaagttacatagagtgggcactcaccagtctttatag

SEQ ID NO: 110113 - DNA, 1572 bp, Artificial Sequence
  Description of Artificial Sequence: Synthetic coding sequence
atggagcccgccgccgcactgcacttctctctgcccgccagtttgctactactcttgctcctgctgctcctctccctttgcgctttggttagtgcgcagttcactgtcgtaggacctgccaatcccattctggccatggtaggggagaataccacactgcgatgccacctatcgcccgaaaagaatgctgaggatatggaagtgagatggttcagaagccagtttagtcccgctgttttcgtctacaagggaggtcgagaacgcactgaggaacagatggaagagtacagagggcgcatcacttttgttagtaaggatatcaatcgcgggtctgtggccctcgtgatccacaatgtcactgctcaagagaatggcatttacagatgctacttccaggagggccgatcctatgatgaggcgatcctaaggttagtggtggccggcctggggtctaaacccctcatcgagattaaggctcaagaagacggttccatctggctggagtgcattagcggcggctggtaccccgaacccctgactgtgtggcgcgacccatacggggaggttgtacctgcgctgaaagaggtgagcattgcggatgccgatgggctctttatggtgaccaccgccgtgattatacgcgataaatatgtgcgaaacgtgagctgctccgtgaataatacactcctaggtcaggaaaaggaaactgtgatcttcatccccgaaagttttatgcctagcgctagtccgtggatggtcgccctcgccgtcatcctgaccgcgagcccgtggatggtgtccatgacagtgatccttgccgtatttattatatttatggccgtgtccatctgttgtatcaaaaagctccagagggaaaaaaagatcctctccggagagaagaaggtcgaacaggaagaaaaagaaattgcacagcagctccaggaagaactgcggtggcggagaaccttcctgcacgctgctgacgtggtccttgatcccgacactgcgcatcctgagctttttctgtcagaggaccggcgttccgttcgccggggaccttaccgccagagggtcccagataaccccgaacggttcgactcccagccttgtgtcctgggctgggaatcattcgcatctggcaaacactattgggaagtcgaagtagagaacgtcatggtgtggaccgttggggtgtgccgtcacagtgtcgagcggaagggcgaggtactgctcatcccccaaaatggattttggactctggaaatgttcggtaaccaatacagggcactgtcaagtcctgaaaggattctgccattgaaggagtcactgtgccgcgttggggtattcctggactacgaggctggagacgtctctttttataacatgagggaccggtcccatatctatacatgtcctagatctgccttcaccgtgccagttagaccattcttcaggcttggatccgacgattcacctatctttatttgtcccgctctgaccggagcgtcaggagtaatggttcccgaagaggggctgaagctgcacagggtcggcacacatcagagcctgtag

SEQ ID NO: 110114 - DNA, 1572 bp, Artificial Sequence
  Description of Artificial Sequence: Synthetic coding sequence
atggagccagctgctgccctgcacttctctttgccagctagcctactactgttactgctcctactcttgctatccctctgcgctttagtgtccgcccagttcaccgtggtcggaccagcaaatcccattcttgctatggttggcgaaaatacaacgttgcgatgtcatctgtctcccgaaaaaaacgcagaagatatggaagttcgctggttccgtagccagtttagtccagccgtcttcgtgtataaaggtggaagggagcgtacagaggagcagatggaggagtatcgaggccgcattaccttcgtcagcaaagatatcaaccgagggtcggtggccctggtgatccataacgtgacagcccaggagaatggaatctaccgctgctatttccaggaagggagaagctatgatgaagcaatactgcgtctggtagtggccggactcggtagcaaaccattgatagaaatcaaagctcaagaggacggcagtatctggttagagtgcatcagcggaggctggtacccggagcctctgacagtatggcgtgatccatatggcgaggtcgttcccgctctgaaggaggtgtcaattgctgacgccgacggtcttttcatggtgactaccgccgtgatcatacgggataagtatgtcagaaatgttagttgtagcgtgaacaacactctgctgggtcaggaaaaggagactgtcatctttatccccgagtcctttatgccttccgccagcccgtggatggtggcactggctgtgattttgacagcatcaccctggatggtgtcgatgacggtaattctggccgtgtttattatcttcatggcagtatctatatgctgcattaagaagctgcagagggagaaaaaaattctgtccggggaaaagaaagtcgagcaggaagagaaagaaattgcacagcaactgcaggaagagctgcgctggcgtagaaccttcctgcatgctgctgatgttgttctggatcctgatacagctcaccctgagttattcctttctgaggaccggagatcagtgcgtcggggcccataccggcaacgggttcctgataatcccgagagatttgactctcagccctgtgttcttgggtgggaatcgttcgcaagtggtaagcattattgggaggtagaggttgagaatgttatggtttggaccgtgggcgtgtgtagacactctgttgagcgaaagggcgaagtgctcctcatcccacagaatggtttttggaccctggaaatgttcggcaatcagtaccgcgccttgtcgtctccagagagaatccttcctctgaaagaaagtctgtgtagagtcggggtcttcctggattatgaagccggcgacgtgagtttctacaatatgcgtgatcggagtcacatttatacatgtcctagaagcgcctttactgtccccgtgagaccattctttagactgggcagtgatgatagtcccatctttatatgccctgcactgacaggagcctccggtgtcatggttcctgaagaaggcctcaagctgcacagagttggcacacatcagagcctgtag

SEQ ID NO: 110115 - DNA, 1011 bp, Artificial Sequence
  Description of Artificial Sequence: Synthetic coding sequence
atggaacctgcggccgcgctgcactttagtcttcctgcgtccttgctgctgctgctgctgctcctcctcttgtctttgtgcgcactcgtgtcggcccagtttacggtagtggggcccgcgaacccaattctagctatggtgggagaaaacacaaccttgcgttgtcatttaagccctgaaaaaaacgcagaggatatggaagtgcgctggtttcggagtcagttttccccagccgtatttgtctacaagggggggcgggagaggaccgaggagcagatggaagaatatagagggcgcatcacgttcgtgtctaaggacatcaataggggtagtgttgccctggtgatccataacgtgacagcacaggaaaatggcatctaccgatgctatttccaagaaggtagaagctatgatgaggccattttgcgcttggttgtcgctggcctcgggagcaaaccactgattgagatcaaggctcaggaggatggcagcatttggctggagtgtatatccgggggatggtacccagagccactgaccgtctggagagacccttatggggaagtggtgccagcacttaaagaagtgtctatcgctgacgcagatggcttgttcatggtgacaacagctgtgatcatccgggacaaatatgttagaaacgtgtcatgttcagtcaataacacactgctgggccaggagaaggaaaccgttattttcattcccgagtcctttatgccatctgcaagcccctggatggttgccctggcagtgattttgaccgcgtccccctggatggtctccatgacagttattctggccgtttttattattttcatggctgtgtccatctgctgcattaagaagctgcagcgagaaaagaaaattctgtccggcgagaagaaagtggaacaagaggagaaggaaatcgcccaacagttacaggaagagttacggtggcggaggaccttcctgcatgccgatgttaacctcaccggcctgcgcaacacctag

SEQ ID NO: 110116 - DNA, 333 bp, Artificial Sequence
  Description of Artificial Sequence: Synthetic coding sequence
atggagcctgcggcagccctgcatttctccctgccagcatctctcctcctcctcctcctgctcctgctcctgtctttgtgcgccctggtgtccggtctgggctctaagccactgatagagatcaaggcccaggaagatggttcaatctggctggaatgcattagtggtggatggtaccctgaaccgctgaccgtttggagagacccttacggagaagttgtacctgctctcaaggaagttagcatagcagatgcagatgggcttttcatggttactactgctgtgatcatacgggataagtatgtccgcaatgtgagctgctcagtaaactag

SEQ ID NO: 110117 - DNA, 555 bp, Artificial Sequence
  Description of Artificial Sequence: Synthetic coding sequence
atggaacccgccgccgcactacattttagcctccccgctagtctgctgctgctcctacttttgctgctgctctccctgtgtgcactggtttcagggctgggctctaaacctctcatcgagattaaagctcaggaggatggctctatctggttggaatgtatttccggtggatggtaccccgaacctctcactgtgtggagggacccctacggagaagtagtgccagctcttaaggaagttagtatcgctgacgcagatggccttttcatggtgacaactgctgtgatcattagagacaagtacgtacggaacgtttcttgtagcgtgaataataccttacttggacaggagaaagagactgttatttttatccctgagtcattcatgccttctgcttctccttggatggtcgccctcgctgttatcttgacggccagcccctggatggtttctatgacagttatactcgcagtgttcattatatttatggcggtgagcatttgttgtatcaaaaagcttcaacgggaaaaaaaaattctgtctggggagaagtag

SEQ ID NO: 110118 - DNA, 720 bp, Artificial Sequence
  Description of Artificial Sequence: Synthetic coding sequence
atggaacccgccgccgcactccatttttccctgcccgccagcctccttcttttgcttctcctgttgctgctcagtctttgcgccttagtgtcagcccaatttactgtcgtgggtcctgccaatccgatcctcgctatggttggtgagaatactactctccggtgccacttaagccctgagaagaatgcagaggatatggaggttaggtggtttcgctctcaattcagccccgcggtgtttgtgtataagggcggcagagagagaacagaggaacagatggaagaatatagaggccgaattacatttgttagcaaggacatcaaccgggggagcgtggccctggtaatccataatgtcaccgcccaggaaaacgggatttaccggtgctacttccaggagggaaggagttacgatgaagccattctccgactagtagttgcaggactaggttcgaagcccctaatcgaaatcaaggctcaggaggacggatcgatctggctggaatgcatttcgggtggctggtatcccgagcccttaacagtgtggcgcgatccatatggggaagttgttcccgcgttgaaagaagtgtcaattgctgacgccgatggcctcttcatggtgactacagcggtcatcattcgagataagtatgtaaggaacgttagttgcagcgtgaataatacgctgctaggacaggaaaaagagaccgtgatcttttag

SEQ ID NO: 110119 - DNA, 291 bp, Artificial Sequence
  Description of Artificial Sequence: Synthetic coding sequence
atggagcccgccgccgccctgcacttcagccttcccgccagcctcctgttgctgctgctattgcttctgctctctctgtgcgctctggtttcagcccagttcactgtggttgggcccgccaatcctattctagccatggttggtgaaaatacaacactgcgctgtcatttgtctccagagaagaatgccgaagatatggaagtccggtggtttaggagccagtttagcccggccgtctttgtgtacaagggaggacgggagcgtacagaggaacagatggaggaatattag

SEQ ID NO: 110120 - DNA, 1542 bp, Artificial Sequence
  Description of Artificial Sequence: Synthetic coding sequence
atgaaaatggcctcctttttggcatttcttcttctgaacttccgcgtgtgcctcctgctgctccaattgctgatgccccatagcgcccagttcagcgtactgggaccatcaggcccaatccttgcaatggtgggggaggatgccgacctaccctgccacctgtttcccactatgtcagcagaaaccatggagctgaaatgggtctccagttctctgcgccaagtggtgaacgtctatgctgacggtaaagaggtggaggacaggcaaagcgccccatacagagggcgcacctctatactgagggatggcataaccgcaggaaaggctgctctgcggattcataatgtgacagctagtgactctggtaaatatctctgttatttccaggatggggacttctatgagaaggccctcgtagaacttaaggtggctgccctgggcagcgacctgcacgtcgatgtaaagggttataaagatggtggtatacacctcgagtgccgaagcacaggctggtaccctcagccacagattcagtggtccaataacaagggggaaaacatcccaaccgtcgaagcgcctgtagtggccgacggcgtggggctctatgccgtcgctgcctccgtgatcatgagaggaagcagtggtgagggtgtgtcatgtaccattcggtcctcgctcttaggactggagaaaaccgcctctatttctattgccgacccattcttccgcagtgctcagcggtggattgccgccctggccgggacactccctgtgctgctcctcctcttaggaggcgcgggctatttcctgtggcaacagcaggaggagaagaaaacgcagtttaggaaaaagaagagggagcaagagctccgggagatggcttggtcaaccatgaaacaggaacaaagtacacgagtaaagttgctggaagagctgaggtggagatcaatccagtacgctagtcgaggcgaaaggcacagcgcctacaacgagtggaaaaaggctctgttcaaaccagccgacgtgattttagatccgaagactgccaaccccattcttctggtcagcgaggatcagaggtctgtgcaaagagccaaagaaccccaggatttgcccgacaatcccgaacgcttcaattggcactactgtgtcctcggttgcgaaagttttatatccgggcgacattattgggaagtcgaggtcggcgaccgtaaggaatggcatattggtgtgtgttcaaaaaacgtccagcggaaagggtgggtgaagatgaccccggagaacggattttggactatgggtctaaccgatggtaataaatatagaacactcacggaacctcgcactaacctcaagttaccaaaacctcccaagaaggtaggagtcttcctggactacgagaccggagatatttctttttacaacgccgtggatggatcccacatccatactttcctcgatgtgtctttttcagaagctctttatccggtgtttcggattctcaccctggagcccactgctctgactatctgcccggcttag

SEQ ID NO: 110121 - DNA, 1386 bp, Artificial Sequence
  Description of Artificial Sequence: Synthetic coding sequence
atgaagatggcatcgtttcttgctttccttttgctcaatttcagggtgtgtttgttactcctgcagctgctgatgccccacagtgcgcagttttctgttcttggaccgtctggccccattcttgccatggtgggggaggacgccgatctcccttgccatttattcccaactatgagcgccgagaccatggaactgaaatgggtctccagcagcttacggcaggtcgttaacgtttacgccgacgggaaggaggtggaggacagacagagtgccccatatcgcggtagaaccagtatcctgagagatgggattacagcagggaaggcggctcttcgaatccacaacgtgactgcttccgatagcggcaaatacctgtgctatttccaggacggagacttttacgaaaaggcgctggtggagctgaaagtggctgacggggttgggctttacgcagtagcagctagcgtgatcatgaggggaagtagcggggagggtgtgtcatgcacaatcaggagctctttgttaggccttgaaaagaccgcctctatctccatcgccgacccattctttcgcagcgcccagcgctggatagcagctcttgcaggcactctgcccgtgctattactgctgctcggcggtgctggatatttcctatggcagcaacaggaagagaagaaaacgcagtttcgtaagaagaagagggagcaggaactaagggagatggcttggagtacgatgaagcaggaacagtcaacacgcgtgaaactcctggaagagctgaggtggagatcaatccagtacgcgtccaggggcgaacggcatagcgcttacaatgagtggaaaaaggctctgtttaagccagccgatgtcatactcgaccccaaaactgccaaccctatcctgttagtgtccgaggaccagcgctccgtgcaacgggcaaaagaaccccaagatttgcctgacaaccccgagcgttttaattggcactattgtgtgttgggctgtgagtcctttatttccggcaggcattactgggaggtcgaggtcggcgaccggaaagaatggcacatcggggtttgcagtaaaaacgttcaacggaaaggatgggtgaagatgactcccgaaaacggattctggaccatgggcctgacagacggcaataaataccgcacgcttactgagccaaggactaatctgaagctgcctaagcctccgaagaaggtgggtgtcttcctcgattacgagaccggagatatttccttttacaatgctgtagacggcagccatatccacacctttcttgatgtcagtttcagtgaggccctctacccggtttttcgcatacttaccctggagcccacagctctgactatatgcccagcatag

SEQ ID NO: 110122 - DNA, 1137 bp, Artificial Sequence
  Description of Artificial Sequence: Synthetic coding sequence
atgaagatggcgtcctttctggcgttcctgctcctgaattttagggtatgtttgctgttgttgcaacttctgatgcctcactctgcccaattctccgttctcggccccagcggacccatcttagccatggtaggtgaggacgccgatctcccctgccatctctttcccacaatgtccgctgagaccatggaactgaaatgggtaagctcttccttgcggcaggtagttaacgtctacgccgacgggaaggaagtagaggaccggcaaagcgcaccttatagaggacggacaagcatcctcagggacggcatcacagcaggcaaggcagccttacgcatccataacgtaactgccagcgactctggtaagtacctatgttatttccaggacggagatttttatgaaaaggccctggtcgagctgaaggtcgcggctctaggaagcgacctgcatgtggacgtgaaggggtacaaggacgggggcattcatcttgaatgcagatctaccgggtggtacccgcagcctcaaatacagtggagcaataataagggcgagaatattccgaccgtggaagcaccggtggtggccgatggtgttgggttgtacgcggtggccgcatccgtcattatgcggggctcgagtggcgagggggtgtcctgcacaatccggagctcactgcttgggctggagaaaacggcctcgatttcgatcgcagatccatttttcagaagcgctcagcggtggatagctgccctggctgggacgcttccggttcttctactgttgctgggcggagcggggtatttcctttggcaacagcaggaggagaaaaagactcagttccgcaaaaaaaagcgtgaacaggaacttcgggagatggcttggagcaccatgaagcaggaacaatccacccgcgtgaagctgctcgaggaacttcgctggcgaagcatccaatatgcctcgcggggtgaacgccatagcgcctataacgagtggaagaaagcattgtttaagccggggcctcctataggccaaactcaacaacagacgcgcggccagggatcccccgtcgccctgagccaggagtctgcacaacgcaccgactcttggggcccggaggaaggtggggagtcttag

SEQ ID NO: 110123 - DNA, 132 bp, Artificial Sequence
  Description of Artificial Sequence: Synthetic coding sequence
atgaaaatggcttcttttcttgctttcctcctgcttaatttccgggtttgtctgctgctgctgcaactcctgatgccacacagcgcccagttctcagtgctgggaccatcaggtccaatcctggccatgtag

SEQ ID NO: 110124 - DNA, 360 bp, Artificial Sequence
  Description of Artificial Sequence: Synthetic coding sequence
atgaaaatggccagcttcctagcatttctcctgcttaacttccgcgtgtgcctgctgctgctccagctgctgatgccccactctgcccagttcagtgtgctcggaccctcaggccctattttggctatggtcggggaagacgccgatctgccatgccacctcttccccaccatgagcgctgagacaatggaactgaagtgggtcagctcctctttgaggcaggttgtgaatgtatatgccgatggaaaggaggtggaagaccggcagtcagcgccatacagaggacggacctcaatattaagggacgggattacagccgggaaagccgccctgagaattcataacgtgaccgccagctag

SEQ ID NO: 110125 - DNA, 1059 bp, Artificial Sequence
  Description of Artificial Sequence: Synthetic coding sequence
atgaagatggctagtttccttgcctttctcctgttaaatttccgtgtgtgcctgttgctcttgcagttactgatgccgcactccgcacagttctctgtcctgggtcccagcggcccgattcttgctatggttggagaagatgccgaccttccctgccatctgtttcctactatgtcagccgagacaatggaactcaagtgggtgtcttccagcctgcgccaagtagtcaatgtttatgccgatgggaaggaggtcgaggacaggcaaagcgctccctaccgcggcaggacatcgattcttagagacggcataaccgccggcaaagccgccctaaggatccacaacgttacggcatccgacagcggcaagtacctctgctactttcaggatggcgacttctatgagaaggccttggtcgagcttaaagtggccgctttagggtctgacctccacgttgacgtcaaaggctacaaggatggcggaattcacctcgaatgcaggtctaccggatggtatccacagccccaaatccaatggtcaaataacaagggggagaacatccccactgtcgaagccccagtagtggccgacggagtcggactctatgcagtggccgcctccgtcataatgaggggaagttctggcgaaggggtgtcgtgcactattcgttccagccttttaggcttggaaaagacagccagtatttctatcgcagatcccttttttcgttctgcccaacggtggatcgccgcccttgcaggcaccctacccgtgcttctgttgctcttaggaggcgcagggtacttcctctggcagcagcaagaggagaaaaagacccagttccggaaaaagaaacgggagcaagagctcagggagatggcctggtctactatgaaacaagaacagtcaactagagtgaagctgctcgaagaactcaggtggcgctctattcaatatgctagtcggggcgaacgtcattctgcgtacaatgagtggaaaaaagctctttttaagcctggtgaggagatgctgcagatgcggctgcactttgtcaagtag

SEQ ID NO: 110126 - DNA, 279 bp, Artificial Sequence
  Description of Artificial Sequence: Synthetic coding sequence
atgaaaatggctagcttcttagcattccttctcctgaattttagagtgtgcttactgctccttcagttactgatgccgcacagcgctcagtttagcgtgttaggaccctccggaccaatcctcgctatggtcggtgaagacgccgaccttccgtgccatcttttcccgaccatgtcggccgagaccatggagcttaagtgggtctcctcatcccttaggcaagttgtcaatgtttacgcagacggcaaggaggtggaagatcggcagagtgctccttag

SEQ ID NO: 110127 - DNA, 1005 bp, Artificial Sequence
  Description of Artificial Sequence: Synthetic coding sequence
atgaaaatggccagcagcctcgccttcctcctgctgaattttcacgtgtcactgctgctggtgcagctgttaacaccatgctccgcccaattctccgttttgggtccatccgggcctatccttgccatggtcggtgaggacgctgatttgccatgtcacctgttcccaaccatgagcgctgaaaccatggagctgaaatgggtgtcgtcttcactgagacaagtagtgaatgtctacgccgacggcaaagaagtggaggatagacagtccgcaccctacagaggtcgaacatcaatattgagggacggcatcactgctggaaaggcagcacttcgaatccataacgtcaccgccagtgatagcggtaaatatttgtgttattttcaggatggcgatttctatgaaaaagcactggtcgagctcaaggtagctgctttgggctccaatctgcatgtcgaggtcaaaggctacgaagacgggggcattcatttagagtgtcgctcgactggctggtacccccagccccaaatccagtggtcaaacgctaaaggtgagaacattcccgcggtggaagcccctgtggtggcggacggagttggattgtatgaggtggctgcttctgtcatcatgagagggggtagcggagagggcgtatcctgcatcatcaggaacagcctcctgggactggagaaaaccgccagtatttctattgccgaccctttctttagaagcgcccagccttggatcgccgccctggctgggacgctcccaattctgctgcttttattggccggcgcttcttacttcctgtggcgacaacagaaggagataacagccctgtccagcgaaattgagtccgagcaggaaatgaaggaaatggggtacgctgctacagagcgtgaaattagtctgagggagtccctccaggaggaacttaaacggaagaaaattcagtatctaacaaggggagaggagagtagcagtgataccaacaaaagcgcctag

SEQ ID NO: 110128 - DNA, 1005 bp, Artificial Sequence
  Description of Artificial Sequence: Synthetic coding sequence
atgaaaatggcatcctccctggcgtttttacttttgaactttcatgtgagcttactcctggtgcagctacttacgccttgcagtgcacaatttagtgtgctggggccaagcggcccaattctcgcgatggtgggcgaagatgccgacttgccatgtcacctttttcccacgatgagtgctgagaccatggagcttaagtgggtgtcatctagtctccggcaggtagttaacgtttacgcggacggaaaagaagtggaggaccggcagtctgcgccttatcgcgggcgaactagcattctgagagacggaataaccgcaggcaaagcagcacttcgcatccacaacgtgacagcttcagacagcggtaagtatctgtgctattttcaagacggggacttttacgagaaagctttggttgagctgaaagtggcagcactgggatcgaacttgcatgtcgaagtaaagggatacgaggatggtggaattcaccttgaatgcagaagcactggatggtacccccagccccagatccaatggtcaaatgcaaagggcgagaacatccccgctgtcgaggcgccagtggtggctgacggcgtgggtctgtatgaagtcgccgcgtccgttattatgaggggaggttcaggagagggcgtttcatgcatcattcgcaattctctgcttggattagaaaagacagccagcattagcattgccgacccattcttccgatccgctcagccatggatcgccgctcttgccgggactctaccgatcctgctgctgctgctcgcaggtgctagctatttcctgtggcgacagcaaaaggagatcaccgcattgagctcagaaattgaatctgaacaggagatgaaagagatgggctacgcagccactgaaagagagatatctcttcgggaaagcttgcaagaggagttaaagcgcaagaagatccagtacttgactcgcggagaggagtccagcagtgacaccaataagagtgcctag

SEQ ID NO: 110129 - DNA, 936 bp, Artificial Sequence
  Description of Artificial Sequence: Synthetic coding sequence
atgggcatacctagggctcagttttccgttctgggcccaagcgggcccatccttgctatggtaggggaggatgccgacctcccctgccacttgttcccaaccatgagcgccgagaccatggagttaaaatgggtgagctctagccttagacaggtggtcaacgtctatgcagacggaaaggaggtggaagaccgccagtctgctccatatagagggcggacaagtatcttacgggacggcatcaccgcggggaaagccgccttgcggatccataacgtcactgccagcgattctggcaagtatctgtgttatttccaagatggcgatttttacgaaaaggcactagtggaactgaaagtagcagccctcggatccaacctgcatgtggaagtcaagggctacgaagatggcggaatccaccttgaatgccgttccactggctggtatccacaaccgcagattcagtggagtaatgctaaaggtgagaatattcctgccgtggaggctccagtagtggcagacggagtgggcctctatgaggtggcggccagcgtgattatgcgaggggggtcaggagaaggagtctcatgtatcataagaaatagccttctgggcctggagaagacggcctccatcagcatcgccgacccgttctttagatcagcccagccttggatcgccgcgctggccgggacgcttcccattctgctgctgcttctagccggcgcaagctacttcctatggcggcaacagaaagaaatcaccgctctgtcctcagagatcgaatctgaacaggagatgaaggagatgggatatgctgctaccgaaagggagattagcctgagggagagcctacaggaagaacttaagagaaaaaaaattcagtaccttacaaggggcgaagagagctcatcagatacgaacaaatccgcctag

SEQ ID NO: 110130 - DNA, 1005 bp, Artificial Sequence
  Description of Artificial Sequence: Synthetic coding sequence
atgaaaatggcatcttcactggcgtttctactcttgaattttcatgtgtcactgctactcgtccagctcctgacaccttgcagcgcacagttctcggtgctgggacccagtggaccaattttagcaatggtaggagaggacgcggatcttccttgtcatctgttccctacaatgagtgctgaaactatggagctgaagtgggtgtcgtcttctcttaggcaggtggtgaacgtttatgccgacggtaaggaggtggaagacagacagagtgccccttatagggggcggacaagcattttgagagatggcattaccgccggaaaagcagccctgagaatccataatgtaacagcctcagattctggaaagtatctctgctatttccaagacggcgatttctacgaaaaagccctggtggagcttaaggtcgccgccctgggctctaacctccacgttgaagtcaagggctatgaggatggcgggattcatctggaatgccggtccacggggtggtatccccagccacagatccagtggtctaacgccaagggggagaatattcccgcagtcgaagcaccagtggtggccgacggggtgggcctttacgaagttgcagcatccgtgatcatgagagggggctccggcgagggagtctcatgtattatccgaaactctctgctcggactggagaagactgcttcaatttcgatcgccgacccgttctttcggtctgcacagccctggatcgctgccctagccgggacccttccaattctgctactgttgctggcgggagcgtcctattttctatggagacagcagaaggagattacagcactgagttctgagatcgaatccgagcaggagatgaaagagatgggatatgccgccactgaaagggaaatttccctcagggaatcccttcaggaagagctgaagcgcaagaaaatccagtatttgactcgcggtgaagaatcatcttccgacaccaataaatccgcatag

SEQ ID NO: 110131 - DNA, 879 bp, Artificial Sequence
  Description of Artificial Sequence: Synthetic coding sequence
atggtgggggaggacgcagaccttccctgccacctcttcccaacgatgagcgcggaaaccatggaactgaaatgggtttcctctagtctccgccaggtggtaaacgtgtatgccgatgggaaagaggtggaagaccgccagtctgcaccttacagagggcggacctctattctgagagacggcattacagcagggaaagctgcgctgaggattcataacgtcacggctagtgactccggcaagtacctgtgttacttccaagacggcgacttttacgaaaaagcattggtggaattgaaggtcgcagccctgggctccaacctccatgtggaagttaagggttatgaggacggagggatccacctcgaatgtcggtccacaggctggtacccccagccacagattcagtggtccaacgcaaagggcgagaacattcctgctgttgaggccccagtggttgcggatggagtgggcctgtacgaagtcgccgcctcggtaattatgagggggggctcaggtgagggtgtttcatgcataattaggaactctcttttgggactagaaaagaccgcctctatatctattgcggaccccttcttcagatctgcacagccctggattgcagccttggccgggaccttgcccatcttgcttctgctgttagccggagcctcttattttctgtggagacagcagaaggagattactgcgctgtcgtctgagatcgagagtgaacaggaaatgaaggagatggggtacgctgctactgaacgagaaatctcactacgcgagagtctccaggaggaactgaaacgaaagaagatccagtacctgacacgcggggaggaatcgagttccgacactaataaatctgcatag

SEQ ID NO: 110132 - DNA, 1005 bp, Artificial Sequence
  Description of Artificial Sequence: Synthetic coding sequence
atgaaaatggcctctagcctggccttcctcttgctgaatttccacgtgtcactcctgctggtacagctactgaccccttgcagcgctcagttttcggtgctgggcccttccggccctatcctggctatggtcggggaggatgctgacctcccctgtcacctctttccaacaatgtcggccgagaccatggagctgaagtgggtatcctcctctctgcgccaggtggtaaacgtctacgcggacggtaaagaggtcgaggaccggcagtcagctccttatcgggggcgtacaagtattctgcgggacggcataactgccggaaaagcagcactgcgcatccataatgttacagcaagcgacagcggcaagtacctatgttatttccaagatggggacttctatgagaaggctttggttgagctaaaggtggccgccttgggctctaatctgcatgttgaagtaaaaggttatgaggacggtgggattcacctcgaatgccggtcaacgggatggtacccgcagccccaaattcagtggtctaatgccaagggcgaaaatatccctgcggtagaggcaccagtagtggctgatggagtgggactctatgaagtcgccgcctccgtgatcatgcggggcgggtctggggagggtgtgagctgcatcatccggaactcactgctcggcttagaaaaaaccgccagcatttctatcgcggacccatttttcagatcagctcagccctggattgctgctctggcagggacactgccaattctgttgctgttgttggcgggggcatcctatttcctgtggagacaacagaaggagatcaccgcactatcttccgaaatcgaaagtgaacaggagatgaaagagatgggatacgccgcaaccgagagggagatatccctccgcgagtcattacaggaagagctcaaacggaaaaagatacagtatctgacaagaggcgaggaaagttcctctgatacaaacaaatctgcatag

SEQ ID NO: 110133 - DNA, 960 bp, Artificial Sequence
  Description of Artificial Sequence: Synthetic coding sequence
atgaaaatggcaagtagcctcgcgttcttattactcaacttccacgtttccctgttgctggtgcagctgctgaccccctgcagcgcacaattctccgtcctcggaccatcaggacctatcctggcgatggtcggggaagacgccgatttgccttgtcatctcttcccaacaatgagcgcagagactatggagctcaagtgggtgtcgtcttcacttcggcaggttgtgaacgtgtacgccgacgggaaggaggtcgaggaccggcagtctgcaccttacagggggcgaacaagtatcttgcgggacggaatcacagccggcaaggccgctctgcgaattcacaatgtcaccgcatcagattccgggaaatacttatgctactttcaggacggagacttctatgaaaaggctttggtggaacttaaggtggctgcacttggaagcaacctacacgtagaggtgaaaggctatgaggacggcggcattcacctggaatgccggagcaccgggtggtaccctcagcctcagattcaatggtcaaacgccaagggagagaatatccccgcagtggaggctccagtcgtcgcagatggcgtgggattatacgaggttgcggcatctgtcattatgagagggggttccggtgaaggggtttcatgcattataagaaattccttgctgggactagagaaaaccgctagcatttccatcgctgaccccttctttagatccgcacagccatggatcgctgccctggctggtaccttgccaattctgctgcttctgctagccggggcttcttacttcttgtggcggcagcagaaggagatcacggccctttcttctgagatcgaatcagagcaagagatgaaagaaatgggctacgccgccacggaacgcgaaatttcgttgagggagtctctgcaggaggagctgaagcgaaaaaaatctagtacatag

SEQ ID NO: 110134 - DNA, 1755 bp, Artificial Sequence
  Description of Artificial Sequence: Synthetic coding sequence
atgaagatggcgtcttctcttgcattcctgcttttgaatttccacgtgtcattatttctggtgcagctgctgacaccctgctctgcccagttcagcgtgttgggaccgtccggacctatccttgccatggtgggagaggacgctgatctgccttgtcaccttttcccaaccatgtccgccgaaactatggagctacgatgggtctctagcagtttgcgtcaagttgttaatgtgtacgcagatggaaaggaggtggaggatcgtcagagtgccccttatcgcggacggacctccattctgcgggacgggatcacagccggtaaggccgcactacggatccacaacgttaccgcctcggattccggtaagtatctgtgttatttccaggatggggacttttatgagaaggccctggtggagttaaaagtggccgccctggggagcgacctgcatattgaggtgaaaggatacgaggatggcggaatccacctcgaatgcagatcaactggatggtacccccagccacagatcaagtggagcgacaccaaaggtgagaacattcccgccgtggaagctcctgttgttgccgacggcgttgggttgtacgcagttgccgcaagcgtgattatgcggggttccagtggaggcggggtgtcctgtatcatcaggaactctctgctcggtttggagaagactgcttctatctcaatcgccgacccctttttccgatccgcccagccctggatcgctgccctcgccggtacccttcccatcagccttctgctgctcgccggcgcgtcatacttcctgtggagacagcagaaagagaaaattgccctgtctcgggagaccgagcgagagagggagatgaaagaaatgggttatgcagccaccgagcaggagataagcctgcgagagaagttgcaggaggaactgaagtggcgcaaaattcagtatatggcaagaggtgaaaagtccctcgcttaccacgagtggaaaatggccctgtttaaacctgcggatgttatcctggatcctgacaccgcaaatgcgattcttctggtgagcgaagatcagcgttctgtacaacgcgcggaggagcctagggatcttccagacaatccggagaggtttgagtggcggtactgcgtgctgggatgtgagaatttcacatcagggagacactattgggaggtcgaagtgggtgaccggaaggagtggcacattggcgtgtgttcgaagaacgttgagagaaagaaagggtgggtgaaaatgactccggagaatggctactggacaatgggcttgacggatggcaataaatatcgtgccctcaccgagcctcgaacaaatttaaagctaccagagccgccgcggaaagtgggtattttccttgattatgagactggtgaaattagtttttacaatgccactgacggtagtcacatctacacatttccccatgcctctttttcagaacctctctatcctgtatttcgcatcctgaccttagaaccgaccgcactgactatctgtcccataccaaaagaggtggagtccagccctgatcctgatttggtgccagatcattctctggaaacccccctgacccctggtctggcgaacgaatctggggaaccgcaagcagaggtaacctcccttctactgcccgcacatcccggagccgaggtgtctccctctgctacaactaatcagaaccataaactgcaagctcggacagaggccctctactag

SEQ ID NO: 110135 - DNA, 1629 bp, Artificial Sequence
  Description of Artificial Sequence: Synthetic coding sequence
atggttggcgaggacgctgatcttccctgtcatctgttcccaaccatgtccgctgagaccatggagcttcgttgggtatcctcctcacttcggcaggtcgtgaatgtgtatgccgacggtaaggaagtggaagaccgacagagtgctccatatcgagggcgcacaagcatcctaagagacggtattacggcaggtaaagccgcactgagaattcataatgtgacagctagcgattcaggcaagtatctgtgttattttcaggatggggatttctacgaaaaggctctagttgagttgaaagtcgccgccctgggctcagacttgcacatagaggtcaaaggatatgaagatggcggaattcacttggagtgtcggagcactggctggtacccacagccacaaatcaagtggagcgataccaaaggcgaaaacatacctgcggttgaggcgcctgttgtggctgatggagtgggcctgtacgcggtagcagcctccgtgattatgcggggatcctctggagggggagtgtcatgtattatcagaaattccttactaggtctagaaaaaacggccagtatttccatagccgatcccttcttccggagcgcccaaccttggatcgccgctctagctggtacattgccaattagtcttctactgctggccggagcgtcctactttctctggaggcaacagaaggaaaaaatcgctctctccagggagacggagcgcgagcgggagatgaaagaaatggggtacgccgctacagaacaggagatctcactaagggagaagttacaagaagagctcaagtggcgcaagatccagtacatggcacgaggggaaaaatccttagcttatcatgagtggaagatggctctgttcaagcccgccgacgtgattctagatcccgacaccgccaacgcaatattactagtctccgaagaccagaggagcgtccagcgcgctgaggagccaagagatttgccagacaatccagaaaggttcgaatggcggtactgcgtcctcggatgcgaaaattttacatcagggaggcattactgggaggtcgaagtgggggatcgcaaggagtggcacataggggtctgctccaagaacgtcgagcgaaagaaaggatgggttaagatgacccctgaaaatggctactggacaatgggtttgactgacggtaataaatacagggccctgacagagcccaggacaaacttgaagctgcccgagcccccgcggaaggtgggaatcttcctggactatgagactggagagatctccttctacaatgccactgacggctcccacatctataccttcccccacgctagtttctccgagcccttataccctgtgttccggatcctgaccttagagccaaccgctttgacaatttgtccaataccaaaggaggtggagtcatccccagaccctgacctcgtgcccgaccacagtctcgagactccactaactcctgggctcgccaacgagtctggcgaacctcaagctgaggtaacaagtttactgttgccagcccatcctggggccgaagtctccccctctgccactacgaaccaaaatcataagctgcaggcacgtacagaagccctctattag

SEQ ID NO: 110136 - DNA, 417 bp, Artificial Sequence
  Description of Artificial Sequence: Synthetic coding sequence
atgaaaatggccagcagcctcgcctttctgttactgaattttcatgtgagtctctttctggtccaactgcttaccccttgcagcgcgcagttcagtgtgcttgggccgtctggaccgatcctggctatggtcggcgaagatgctgacctgccttgccatctgtttcccacaatgagtgctgagacgatggaactgaggtgggtgtcttccagtctacggcaagttgtcaatgtctacgccgatggaaaagaggttgaggaccggcaaagcgccccctaccgcgggcgcaccagcatcctccgcgatggcatcacagccggaaaagctgcgctgcgcatccataacgtcacagcttccgattccgggaagtatctttgctatttccaggacggagacttttatgagaaggcactttag

SEQ ID NO: 110137 - DNA, 717 bp, Artificial Sequence
  Description of Artificial Sequence: Synthetic coding sequence
atgaagatggccagctccctcgcgtttctgctgttgaatttccacgtgtcactgtttctcgttcagctactcactccctgttctgcccagtttagcgttctgggaccaagtggcccaattctggcaatggttggggaagacgccgacctgccttgccaccttttccccacaatgagcgctgagactatggaattgcggtgggtctcttctagtctgcgacaagttgtgaatgtgtacgctgatggaaaggaggtggaagacagacagtccgctccctaccgcggaaggacaagtatcctcagagatggtatcacagctggcaaggcagcattgcggatccacaacgtgaccgcatccgattcggggaagtatctttgctactttcaagacggggatttttacgagaaggctttagtcgagcttaaggtcgcagccttgggatcagacctgcacatcgaagtgaaagggtacgaagacggcggaatccaccttgagtgtaggagcactggctggtacccacagccacagataaagtggagcgataccaaaggagagaatattccggctgtagaggctccagtggtggctgacggggtgggcttgtacgccgtcgctgcatcggtgataatgcgcggttcgagtggggggggcgtgagctgcataattcgcaactctctgctgggattagagaaaacggcctctattagcattgcttag

SEQ ID NO: 110138 - DNA, 1368 bp, Artificial Sequence
  Description of Artificial Sequence: Synthetic coding sequence
atggttgattttcctggttataatctttccggagctgttgcatcatttctctttatcctactgaccatgaagcagtctgaagacttcagagtgatcggccccgcccaccccatactggccggagtcggcgaggacgccctcctcacctgtcaactgctccctaaacgaactactatgcacgtcgaggtgagatggtaccggtcagagccctcgacccccgttttcgtgcaccgggatggagtggaagtgactgagatgcaaatggaggaataccggggctgggtggagtggatcgaaaacggcattgcgaaaggcaacgttgccctcaaaattcataacatccagcccagcgacaatgggcagtattggtgccactttcaggacggcaattattgcggtgaaacgagcttacttctgaaggtagcggggttgggaagtgcccccagtatacatatggagggacccggggagtctggggttcagctggtgtgcacagcccgcgggtggttcccggagccacaggtgtattgggaggatatccgcggggaaaaactgctagccgtcagcgaacatcggattcaggataaggacggtctcttttacgcagaggcgacattggtagttcggaatgcctccgcggaatctgtgagttgcttagtgcataaccccgtgttaacagaggagaagggctccgtgatttcactgccagagaagttgcagaccgagcttgcttccctgaaagtcaacggaccctctcaacctattctcgtacgcgttggtgaggatatacagctgacctgttacctctcacctaaagccaacgctcaatccatggaggtgcggtgggacagatcacaccggtatccagctgttcacgtgtacatggacggtgaccatgtggcaggggaacagatggccgagtacagagggaggaccgtattagtgagcgacgctatcgatgagggccggctgaccctgcagattctgtcagcccggccatccgatgacgggcaatacagatgtcttttcgagaaggacgatgtttatcaggaggcttctctggatttgaaagttgtcagtctgggtagttcgccactcattaccgtggaagggcaggaggatggggagatgcagcctatgtgctcctctgatggctggtttccccagccccacgtaccatggcgggacatggagggaaagactatcccaagctcaagccaggccctgactcagggaagccatggactctttcacgtccagaccctcctgagggtcaccaatattagtgccgtagatgtgacttgttctatttctatcccctttcttggggaagaaaagatcgctactttctcccttagcggatggtag

SEQ ID NO: 110139 - DNA, 1167 bp, Artificial Sequence
  Description of Artificial Sequence: Synthetic coding sequence
atggtggactttcctggttataaccttagcggggccgtagcgagcttcttgtttatcctgctgacgatgaagcaaagcgaggacttcagagtcatcggcccagcacacccaatcctggcgggtgtaggcgaggacgccctcctgacctgtcagctcttgcccaagaggaccaccatgcatgttgaagtacgctggtatcggtcagaaccaagtactcctgtcttcgttcaccgcgatggcgtggaggtaacagaaatgcaaatggaggagtacagaggctgggttgaatggattgagaacggcatagccaagggtaatgttgcccttaaaattcataatattcagccaagtgacaacgggcaatactggtgccatttccaagacgggaactactgtggcgagacctcgctgctgttgaaagtggcggaaaagttgcttgcagtactaagctccttgaaggtgaacggaccttcgcagccaatcctggtgcgggtaggggaggacatccaactgacatgttatctgtctcctaaggccaatgcacagagcatggaggtgcgttgggaccgatcgcaccgttaccccgctgtccatgtctatatggacggcgaccacgtggctggagagcaaatggcagagtacagaggaagaacagttttagtgtctgatgctattgacgagggacggcttacgcttcagatcttgtcagcacgcccttctgatgacggtcagtaccgatgcctttttgagaaggacgatgtctatcaagaagccagcctggacctgaaagtggtttctttgggctcgagtcctctcattacagttgaaggccaagaggacggcgagatgcagccaatgtgtagttctgacggctggttccctcagcctcacgtcccctggagggatatggaagggaagaccataccgagcagcagccaggccctgacccaggggagtcatggattgtttcacgtacagactctgttgcgtgtgacaaatatttctgccgtcgacgttacatgttctatcagtatccctttcctgggggaggagaagatcgctactttttctcttagcgagagcagaatgacttttctgtggaagacccttcttgtctggggtctgcttcttgcagtagcagttggccttcctcggaagcgatcctag

SEQ ID NO: 110140 - DNA, 738 bp, Artificial Sequence
  Description of Artificial Sequence: Synthetic coding sequence
atggtggattttccgggctataatctgagtggagccgtagcttcttttctttttatcttgctcactatgaagcaatcagagaaactgcagacggagctggcatcattgaaagtcaacggccctagtcagcccatattagtgagagtcggtgaggacattcaactcacctgctacctttcacccaaagcaaacgctcagagcatggaagtgcgctgggaccgatcccataggtatccagcagttcatgtttacatggatggcgaccatgtagccggggagcagatggctgagtaccgcgggaggaccgttctagtaagcgatgcgatcgacgagggtcgactgacactgcagatcctgagtgctagaccatcagatgatggccagtaccgctgcttatttgaaaaggatgacgtttatcaggaagcctccttggacctcaaagtggtttcattggggagctcccctcttattacagttgagggacaagaggacggagaaatgcaaccgatgtgttccagtgatggttggtttccccagccgcacgtcccatggagggacatggaaggcaaaaccattccgagcagttcccaggcattaacccaaggatcccacgggttgtttcatgttcagaccctgttgagagtgacgaacatttctgccgtcgatgtcacatgttcaataagcatccccttcttgggcgaagaaaaaattgcaaccttcagtctctcaggatggtag

SEQ ID NO: 110141 - DNA, 327 bp, Artificial Sequence
  Description of Artificial Sequence: Synthetic coding sequence
atggtagatttccctggctacaatctcagtggtgctgtcgcgtccttcctgtttatactcctaacaatgaaacagtccgactttagggtcatcggccccgcacaccccatactcgcaggcgtgggagaggatgctctgctgacttgccagctgcttcccaagaggaccacgatgcacgtggaagtgcgctggtatagaagcgaaccgagcacacctgtgttcgtgcatcgggatggagtggaggtcaccgaaatgcaaatggaagagtatagaggatgggtggagtggattgagaacggaattgcgaaaggcaacgtggccctgtag

SEQ ID NO: 110142 - DNA, 780 bp, Artificial Sequence
  Description of Artificial Sequence: Synthetic coding sequence
atggtggattttccaggttataatctgtcaggcgcagtggcttcttttcttttcatcctcttgaccatgaagcaatccgaggattttagggtgatcggtcccgcccaccctatcctcgccggcgtaggagaagatgccctcctgacttgtcagctactccctaaacgcaccaccatgcatgtggaggtgcgctggtataggtccgagccatccactcccgtgtttgtgcacagagatggggtggaagtcacggagatgcagatggaggagtataggggctgggtggagtggatcgaaaatggtattgccaaaggtaatgttgcgttaaagattcacaacatacagccctccgataacgggcagtactggtgccatttccaggatggcaactattgcggcgaaacttcgctgctgcttaaagtcgccggattggggtccgccccgtccatccacatggaaggtcccggtgagtcaggggtgcagctggtgtgcaccgctcggggctggttccccgagccccaggtctactgggaggacatcagaggagaaaagctcttggctgtatcagaacatcgcatccaggacgaagacggtctgttctatgctgaggctactctggtggtccgcaacgcatcagccgaaagcgtgtcatgcttggtgcacaatccagttctcacggaggagaaggggagtgtgatctcattgcctgaaaagctgcagacagaacttggcaaatacgaagttttggcacatacctgcggggggagtctgtgtccctag

SEQ ID NO: 110143 - DNA, 780 bp, Artificial Sequence
  Description of Artificial Sequence: Synthetic coding sequence
atggtcgatttccccggatacaatctgagtggcgctgtcgccagtttcctgtttatcctgctgacgatgaaacagagcgaagattttcgggtaattgggccagcacaccccatattggccggagtaggagaagatgccctacttacatgtcagctcctcccaaaacgcacaacaatgcacgttgaggttcggtggtacagaagcgaaccaagcacccccgtgtttgtccaccgggacggcgtggaagtgaccgagatgcagatggaagaatatcggggttgggtcgaatggatcgagaatggcatcgcaaaaggaaacgtcgcgctgaaaatacataacatccaacccagcgataacggacaatactggtgccatttccaggacggcaattactgtggagaaaccagtctcttgcttaaagtcgctggactcggctccgcaccttcgattcacatggagggaccaggcgagagcggtgtgcagctggtgtgcacagcacgcgggtggttcccagaacctcaggtgtactgggaggatatcagaggcgagaagctccttgccgtcagtgagcaccgaattcaagataaggatggcctcttctatgccgaggcaacactcgtcgttagaaacgcgtccgcagaatcagtttcttgcctcgtgcataaccctgtactgacagaagagaagggcagcgtgattagtctccccgagaagctccagaccgaactggggaagtacgaagttttagcacatacctgcggaggtagtctgtgcccctag

SEQ ID NO: 110144 - DNA, 636 bp, Artificial Sequence
  Description of Artificial Sequence: Synthetic coding sequence
aaggccaacgcccaatccatggaggtgaggtgggaccgctcacacagatacccagcagtgcatgtatatatggacggagatcatgtggctggagagcagatggccgagtacagagggagaacggttttggtttctgatgctatcgacgagggacgtctgactcttcagattctgagtgctagaccttctgatgacgggcaatatcgatgtctgttcgaaaaggacgacgtctatcaggaagcttcactcgacctgaaggttgtgtctttgggatcctctcctttgatcacagtggaaggacaagaagatggggaaatgcagcccatgtgctcctctgatggttggttcccgcagccacacgtgccttggagagatatggagggtaagacgatcccaagctcctcccaggccttaactcagggtagtcatggcttgttccacgtgcagactttactgcgggtgacaaacatctctgcagtagatgtgacctgtagcatctccatccccttccttggagaggaaaagatcgctaccttcagcctgagcgagtccagaatgactttcctgtggaagacattactggtctgggggcttctgctggccgtggcagtgggacttccccgcaagcggtcatag

SEQ ID NO: 110145 - DNA, 780 bp, Artificial Sequence
  Description of Artificial Sequence: Synthetic coding sequence
atggtggatttcccaggctataaccttagcggggccgtcgcatcattcctgttcatccttcttactatgaaacagagcgaagattttcgtgtgatagggccagctcaccccatcctggccggcgtgggcgaggacgccttgcttacttgtcagcttttacccaaaagaactaccatgcatgtggaggtgcggtggtaccgctcagaaccttccacccctgtatttgttcaccgggatggagttgaagtcaccgaaatgcaaatggaggaatacaggggatgggtagaatggatagaaaacgggattgccaaggggaatgtggccctcaagattcacaacatccagccaagtgacaacggacaatattggtgtcactttcaagacggcaactactgcggggagacttcattactgctcaaggtggcggggctcgggtcggctccgtcgatacacatggagggccccggcgaatccggagtacagcttgtttgtaccgctagaggatggtttcctgagcctcaggtttattgggaagacatccgcggcgagaaactcttagcagtgagcgagcacagaattcaggataaagatggcctgttttacgccgaggccacactcgttgtgaggaacgcttccgccgagtccgtcagttgtctcgttcacaatccagtgctcactgaggagaagggtagcgttatctctctgcctgagaagctgcagactgagcttggaaagtatgaagtgctcgctcacacgtgcggtgggagcctgtgcccttag

SEQ ID NO: 110146 - DNA, 327 bp, Artificial Sequence
  Description of Artificial Sequence: Synthetic coding sequence
atggtggactttcccggttacaatctgagtggcgctgtggcatcttttttatttatcctactgaccatgaaacagagcgatttccgagtgattggacctgcccaccctatcttagctggcgtgggggaggacgcacttttaacatgccagttactgcctaaaagaactactatgcacgtggaagttaggtggtataggtcagagccctctacccccgtctttgtccatcgcgacggagtggaagtgaccgaaatgcaaatggaagaatatcgaggttgggtggaatggattgagaacggcattgcaaaaggcaacgtcgccctatag

SEQ ID NO: 110147 - DNA, 327 bp, Artificial Sequence
  Description of Artificial Sequence: Synthetic coding sequence
atggtcgattttcccggatataatctgtcaggggctgtggcatcattccttttcatactgctaaccatgaaacagtccgactttagagttatcggccccgcacacccaatcctcgccggtgtcggtgaagacgccctgcttacctgccagctcctgcctaaacgcactacgatgcacgttgaggtgcgctggtatagatcagagccctccacgcccgtgttcgtgcacagggacggggtggaagtgaccgagatgcagatggaggaatatcgcggatgggtcgagtggattgaaaacggaatcgccaagggaaatgtggccctctag

SEQ ID NO: 110148 - DNA, 636 bp, Artificial Sequence
  Description of Artificial Sequence: Synthetic coding sequence
aaggctaatgcacagtctatggaggtgcggtgggataggtcccaccgctacccggcagttcacgtatacatggatggggaccacgtagctggggaacagatggccgagtatcgtggacgtaccgtgctggtctccgatgccatagatgaaggccggctgactctccagattctgtccgcgcgcccttctgacgatggacagtacaggtgtctgttcgagaaggatgacgtatatcaggaagcgtctctcgacctgaaggttgtcggattaggaagcagtccactaattaccgtggaaggacaagaagatggggagatgcagcccatgtgttcaagcgacggatggtttccgcagccccatgtaccatggagagacatggaagggaaaaccatcccaagcagtagtcaagcgctgacccaggggtctcacggcttgttccatgttcaaacattgctcagagtgacaaacatttctgcagtggatgtcacctgtagcatcagcatcccttttcttggggaagagaaaatcgccactttctccctgtcagagagccggatgactttcctgtggaagacactgttagtctggggtctgctgctggctgtcgctgttggcttgcctcgaaagagaagctag

SEQ ID NO: 110149 - DNA, 816 bp, Artificial Sequence
  Description of Artificial Sequence: Synthetic coding sequence
atggtggactttccaggctataacctctcgggggcggtggcgtcttttctttttatcctgctcacaatgaagcagtccgaggattttagagtcatcggccctgctcatcctatcttggctggtgttggtgaagacgcactgctgacttgtcagctgctgcccaagagaacaacgatgcatgtggaagtgcgatggtataggtctgaaccctcaacaccagtgtttgtgcatcgggacggagtggaggtgacagagatgcagatggaggaataccgaggatgggtggagtggatcgagaacgggatcgcgaagggcaatgttgcactcaaaattcataatattcagcctagtgacaatggccaatactggtgccactttcaggacggcaactactgtggtgagacctccctccttctgaaagtagccgccgtgctccgggatgacatcatcgcttcattaaaagttaatggcccctcccagcctatcttggtgagggtgggcgaggacattcagctcacttgctacttaagccctaaagccaacgctcagtctatggaagttcgctgggacagatcacatcgctatcccgcagtgcatgtgtatatggacggcgaccatgtagcaggcgaacagatggctgaatatcgggggcggaccgtgcttgtgagcgatgctatcgatgaaggccgcttaacattgcagattctgtcagctcgaccttcggatgacggccagtatcgctgtctgtttgagaaagacgacgtctaccaagaggcctccctggatctgaaggtcgtgtgggtgctgcctcattag

SEQ ID NO: 110150 - DNA, 327 bp, Artificial Sequence
  Description of Artificial Sequence: Synthetic coding sequence
atggtggattttcccggatataacctaagcggcgcggtggccagcttccttttcatcttgttaaccatgaaacagagtgattttcgggtgatcgggcctgcccatccaattttggcgggcgttggggaagatgcgctgctgacatgtcagctattgcctaaaagaacaaccatgcatgttgaagtcagatggtataggtcagagccatcaacaccagtttttgtccaccgggacggcgtagaagtgactgaaatgcaaatggaggaataccgcgggtgggtggaatggatagagaacggcatcgctaagggaaacgtcgctttgtag

SEQ ID NO: 110151 - DNA, 780 bp, Artificial Sequence
  Description of Artificial Sequence: Synthetic coding sequence
atggtggacttccctggctacaacctatctggggcagtcgcttcctttctttttatcctgcttactatgaagcaatcggaggactttcgggtgatcggccctgcccaccccattttggccggcgtgggagaggacgctctactaacatgccaactcctcccaaagaggaccaccatgcatgttgaagtgcgttggtatcggagcgagccttctaccccagtgttcgtccatagggatggtgtggaagttacggaaatgcagatggaggaatatcgcggctgggttgagtggattgagaacgggattgccaaagggaacgtggccctgaaaattcacaacatccagccgtccgacaatgggcagtactggtgtcatttccaggacggtaattattgcggggagacctccctacttctcaaggtggcaggcctcggttctgcaccttcaattcacatggaaggaccaggggaatctggggtgcagctagtgtgcactgctcgaggatggtttcctgagcctcaagtgtattgggaggacatcagaggcgagaaacttctcgcagttagcgaacataggatccaggatgaagatggactgttctatgccgaggcaactttagttgttcggaacgcttcagccgagagcgtcagctgcctagtccataaccctgtgcttaccgaagagaaaggcagcgttatctcactgccagaaaaacttcagacagagcttggcaaatacgaagtactcgcccacacttgtggtgggtcactgtgtccctag

SEQ ID NO: 110152 - DNA, 327 bp, Artificial Sequence
  Description of Artificial Sequence: Synthetic coding sequence
atggtggactttcccggatacaacctgagtggcgcagttgcttccttcctcttcatactgttgacaatgaagcagagtgacttccgagtgatcggtccagcccaccccattctcgctggtgtaggggaagacgcactgttaacatgtcagttgctgccaaagcggactacaatgcacgtcgaagtgcgttggtaccgaagtgaaccgtctacccccgtctttgtccacagggacggggtagaagtgaccgaaatgcagatggaggaatacagaggttgggtggaatggatcgagaacggcattgcaaaagggaatgtcgccttgtag

SEQ ID NO: 110153 - DNA, 636 bp, Artificial Sequence
  Description of Artificial Sequence: Synthetic coding sequence
aaggctaacgctcagtcaatggaagtgcggtgggatcgctcacaccgttacccagccgtgcacgtgtacatggacggggatcacgtggcaggcgagcagatggctgagtacaggggccggactgtcctcgtctcggacgcaatcgatgagggacgattgacactgcagattctgtctgcccgtcctagtgacgacggacagtatcggtgtctgtttgagaaagacgatgtctatcaggaggccagcctggacctgaaggttgtcgggcttggcagctccccgctgatcacggtggaaggccaggaagatggcgaaatgcagcccatgtgttctagcgatggctggttcccacaacctcacgtgccctggagagacatggagggcaaaacaatcccatcctcctctcaagcccttactcagggtagccatggcctcttccatgtccaaaccttgctgcgcgtgactaatatcagtgccgtcgacgtgacatgtagtatttccatcccgttcctgggggaagagaagatcgctacattcagcctgagcgaatcccggatgacatttctatggaaaactttgttagtgtggggacttctcttggccgtggcagtgggcttacctaggaaacggagctag

SEQ ID NO: 110154 - DNA, 780 bp, Artificial Sequence
  Description of Artificial Sequence: Synthetic coding sequence
atggtggatttccccggttataacctctctggggctgtggctagctttctgtttattcttctaaccatgaagcagtctgaagattttagagtcataggacccgcccatccaatcctggccggggttggagaggatgccctgctgacctgtcagctccttcctaaaaggacaacaatgcatgtggaggtgcgttggtacagaagcgagccctctactccagtcttcgtccaccgcgatggtgtagaggtgaccgagatgcagatggaggaatatcgagggtgggtagaatggatcgagaacggaattgccaaggggaatgtagccctgaagatccataacatacaacccagcgataacggacagtactggtgtcattttcaagacgggaactattgcggagagacgtccctgctgctgaaggttgcaggcttggggtccgcgccaagtatccatatggagggcccaggagagtctggcgtccagttagtctgtacagcccgaggctggttccccgaacctcaggtgtactgggaagacataagaggggagaaactgctggctgtcagtgagcatcgcatccaagatgaagatgggcttttctatgcggaagcaacgctcgttgtgagaaacgcctccgccgagtctgtgtcatgcctcgtacataatcctgtgttaaccgaagagaagggctctgttatttcccttccagagaagctccagactgaactggggaagtacgaagttctggctcacacctgtggggggtcactctgcccgtag

SEQ ID NO: 110155 - DNA, 780 bp, Artificial Sequence
  Description of Artificial Sequence: Synthetic coding sequence
atggtcgattttccaggttacaatctatccggagccgtcgcgtcattcttgtttattcttctcacaatgaaacagagtgaagacttcagagtcatcggccctgctcatcccatcctagccggcgtgggcgaggacgccctcctgacatgccagctgctgccaaagagaacaaccatgcacgtggaggtgcgttggtatcgaagcgagcccagcactcccgttttcgttcaccgggatggggtcgaggtgactgagatgcagatggaggaataccgcggctgggtcgagtggattgagaatggtatagctaagggtaacgttgccctcaaaatacacaatatacagccctccgacaacggccagtactggtgtcactttcaggatgggaactactgcggcgaaacttctcttctgctgaaagtggctggactgggatctgcacccagcatccatatggaagggccaggggagagtggtgtgcagctggtgtgcacggcccgaggttggtttccggagccccaggtctactgggaagatatccgcggagaaaaactgcttgcagtcagcgaacacagaatacaagacaaggacggccttttttacgctgaggcaacattagtggtgcgcaatgcttcagccgagtcagtatcatgcctggttcacaacccggttttaaccgaagagaaaggatccgttatatctttacccgaaaaacttcaaactgaactgggcaaatatgaggtgctcgcccatacgtgcggcgggagtttgtgcccatag

SEQ ID NO: 110156 - DNA, 327 bp, Artificial Sequence
  Description of Artificial Sequence: Synthetic coding sequence
atggtggactttcccggctacaacctgtctggagcggtagcttccttcttgtttattttgttgaccatgaaacagtctgactttcgagtaataggacccgcacatcctattcttgctggggtgggggaggacgccctgttaacctgccaactcttgccaaagcgcacaaccatgcacgtcgaggtgcgttggtaccggtctgagcccagtaccccggtcttcgtgcaccgggacggcgtggaagtgaccgagatgcagatggaggagtacaggggatgggtggaatggatcgagaatggaatcgccaaaggaaacgtggcgctatag

SEQ ID NO: 110157 - DNA, 780 bp, Artificial Sequence
  Description of Artificial Sequence: Synthetic coding sequence
atggtagacttcccaggctacaatctgtctggggctgtcgcgtcattcctatttattctgctgacaatgaagcaatctgaggatttccgggttattggacccgctcatccgattctggcaggcgtgggggaagacgcactgctgacctgtcagctgctccctaaacgaaccacaatgcacgtggaagtcaggtggtatcgctctgagccatccactcctgtgttcgtccatcgcgatggcgtggaagtcaccgagatgcagatggaggagtaccgcgggtgggtggaatggatagagaacggaattgccaaaggaaacgtggcccttaagatacataatatacagccgagcgacaatggccagtattggtgccactttcaggacgggaattactgcggtgagacatctcttctcctgaaagtggccggactgggcagcgccccatccattcatatggaggggcctggcgaatctggcgtccaactggtgtgtacggcccgcggctggttccccgaaccacaggtatattgggaagatataagaggtgaaaaactactggcggtcagcgaacaccgaatccaggataaggatggcttgttctatgccgaggcgactctggtggtgagaaacgcatcagctgaaagtgtgtcctgcctggttcacaaccccgtactgaccgaagaaaaaggttccgtgatcagtcttcccgagaaactgcagaccgagctcggtaaatacgaagttctggctcacacatgtggcggatcattgtgtccctag

SEQ ID NO: 110158 - DNA, 636 bp, Artificial Sequence
  Description of Artificial Sequence: Synthetic coding sequence
aaggctaatgcacaaagcatggaagtacgctgggaccgcagtcaccgttacccggccgtgcacgtgtacatggatggcgatcacgtagcaggcgaacaaatggcagagtaccggggtcgcacggtgttggtatctgatgcaatcgacgagggcaggctcaccctgcagatcctgtctgccaggccgtccgatgatggccagtatagatgcttattcgaaaaagatgatgtgtaccaggaggctagcctcgacctaaaagtggtaggattgggcagctcgcccctcatcacggtggagggtcaggaggatggcgaaatgcagccaatgtgctcttccgacgggtggttcccccagccccacgtcccctggcgggatatggagggcaaaacgatccccagttcctcgcaggctctgacccaagggtctcacggcctgtttcatgtgcagactttgttgcgggttactaacattagtgcagttgatgtgacatgctctatcagtatcccctttttaggagaggaaaagattgccacctttagtctatctgaatcccggatgacgtttttgtggaagacgctactggtgtggggcctgctgttggccgtcgcagtgggcctaccccgcaaaaggtcctag

SEQ ID NO: 110159 - DNA, 636 bp, Artificial Sequence
  Description of Artificial Sequence: Synthetic coding sequence
aaagccaacgcacagtcaatggaggttaggtgggacagaagccacaggtaccccgcagtgcatgtgtatatggacggggaccatgtggcaggggagcagatggcggagtatcgcggaagaacagtgctggttagcgacgctatcgatgaaggccggcttacactccagatactttcagcccgcccgtctgatgacggacagtatcgttgtctctttgagaaagatgacgtataccaggaggcgtccttggatctcaaggttgtttctcttgggtcttccccgcttattaccgtggagggacaggaggacggtgagatgcagcccatgtgctcttcagacggttggttcccccagcctcacgtgccgtggcgcgacatggagggcaagactattccaagttcatcacaggccctgacccaggggtcccatgggcttttccatgtgcagaccctgctgcgcgtgactaacatcagcgcggttgatgttacttgttcaatatcgattccattcctaggagaggaaaaaattgccaccttttctctgtctgaaagccgcatgacatttctttggaaaaccctgctggtgtggggtctacttctggccgtcgcggtcgggctgcctcgaaagagaagctag

SEQ ID NO: 110160 - DNA, 636 bp, Artificial Sequence
  Description of Artificial Sequence: Synthetic coding sequence
aaggccaacgcccagagtatggaggttaggtgggatcggtcccaccgctatccagccgtccatgtgtacatggatggcgaccacgtcgccggagagcagatggccgaatatcgtggcaggactgtgttggtgagcgacgcaattgatgagggtcgactgacactccaaatcctgagtgctaggccatccgacgacggacaatatagatgcctatttgagaaggatgatgtgtaccaggaagcatcgctggacttgaaggtcgtgtctctgggcagttctccactcattacagtggaagggcaggaggacggggaaatgcagcctatgtgcagtagcgatggctggttcccgcagccccatgtcccatggagggacatggaaggtaagaccatcccctcctccagtcaggccctgacgcagggttcacacggcctattccacgtccagacactcctccgcgtcactaatatctctgcggtcgatgtgacctgctcaatttccatcccattccttggggaagaaaaaattgcaacgttctctctatccgaatcccggatgacctttctgtggaaaacactgctggtgtggggcttactcttggccgtggcggtagggctcccaagaaagcgctcatag

SEQ ID NO: 110161 - DNA, 327 bp, Artificial Sequence
  Description of Artificial Sequence: Synthetic coding sequence
atggttgactttccggggtataacctgagtggcgccgtagccagcttcctgttcattctgctcacaatgaagcagagcgattttcgagtgatcggcccagctcaccccatcctcgccggcgtgggcgaagacgccctcctgacatgtcagctactgcccaaaaggaccacaatgcatgtggaggtacggtggtataggtctgaaccctctacgcccgtgttcgtccatagggacggagtggaggtgacagagatgcaaatggaggagtacagaggatgggttgagtggatcgagaatggcatcgccaaggggaacgtggctctgtag

SEQ ID NO: 110162 - DNA, 636 bp, Artificial Sequence
  Description of Artificial Sequence: Synthetic coding sequence
aaagctaatgctcagagtatggaggtgcgatgggataggtcacacagataccccgccgtacacgtgtacatggacggggaccatgtcgccggggagcagatggccgaatacagaggccgaactgtgctcgtgagcgacgccatcgatgagggacgcctcactctgcaaatactttccgcccgccctagcgatgatgggcagtataggtgcttattcgaaaaggatgacgtgtaccaggaagcaagtctagatctcaaggtggtttctctagggagctcccctctaatcacagtggaagggcaggaggacggggaaatgcagcctatgtgctcatccgacggctggttccctcaaccacacgttccctggagggatatggaaggcaagaccatcccaagtagtagtcaagcgctcacacagggctctcatgggctgtttcacgtgcagactctgctgagggtgactaacatcagcgcagtcgacgtgacttgctctatatcaatacccttcctgggggaagaaaaaatcgcgaccttctccctctcagaaagtcggatgacattcctttggaagacactgctggtgtgggggctgctcttggcagttgcagtgggtttgccaaggaaaaggtcatag

SEQ ID NO: 110163 - DNA, 1449 bp, Artificial Sequence
  Description of Artificial Sequence: Synthetic coding sequence
atggtcgattttcctggatataatctgagcggggccgtggcctccttcttgtttattctgcttacgatgaaacagtcagaagattttagagtaatagggcccgcccatcctatactcgccggggtgggagaggatgcactactgacatgccagcttttgcccaagcggaccactatgcacgttgaggtgagatggtatcggtccgagcccagtacaccagtgttcgtacaccgagatggcgtggaggtgactgagatgcagatggaagagtacagaggatgggtagagtggatcgagaacgggattgcgaaagggaatgtggctttgaagatccacaacatacaacctagtgacaatggtcagtactggtgtcattttcaggacggcaattattgcggagaaaccagtctgttgctgaaagtggccggactggggagcgcaccctctattcatatggaagggcctggcgaaagcggagtacaactggtttgtaccgctcgcgggtggttccccgaacctcaggtgtactgggaagatatcaggggtgaaaaactgcttgcagtctccgagcacagaatacaggataaagacggtctattttacgctgaagcgactctcgtagtgcgcaacgcatctgctgaaagcgtaagctgtctcgttcataacccggtgttgaccgaggagaaaggctcagtcatttccctgcccgagaagctgcagacagaattagcaagtctgaaggtgaacggacctagtcagcctatactggtgagggtgggcgaggatatccaattgacttgctaccttagtccaaaagctaacgcacaaagcatggaagtgcggtgggacagaagtcatcgatatccagcggtgcatgtctatatggacggcgaccacgtcgctggcgagcagatggccgagtataggggcagaaccgttttggtgagcgacgcgatagatgagggtaggttaacacttcaaattctgagcgcccgccccagtgatgacggccagtatcgctgtctcttcgaaaaggacgatgtgtaccaagaagccagcctcgatctgaaagttgtgtcactgggctcatccccgttgatcactgtagaaggccaggaggatggcgaaatgcagccaatgtgctccagtgatgggtggttccctcagcctcacgtaccatggagagatatggaaggtaaaacaataccctcctcttcacaggcgctgacccagggatcccacggtctattccatgttcaaaccctcctgagagttacaaatatttcagccgttgacgtcacttgctccatttccataccatttcttggcgaggagaaaatagcaacattctcactaagcgaaagtaggatgacctttttgtggaaaacactgctcgtttgggggctgctgctggccgtggcggtgggactccctcgaaagcgctcatag

SEQ ID NO: 110164 - DNA, 738 bp, Artificial Sequence
  Description of Artificial Sequence: Synthetic coding sequence
atggtggatttccccggctacaatctttcaggagctgtggcttcatttctgtttattctccttacaatgaaacaatccgaccgtctggatacgccaaaggcctcgctcaaggtgaacggccctagccagccaatcctggtgcgcgtgggagaggacattcagctgacatgctacctaagccctaaggctaatgcccagtctatggaagtccgatgggatcgcagccaccgctacccagccgtgcatgtctacatggacggggaccacgtagccggcgagcaaatggctgaataccgagggcggactgttcttgtgtcagacgccatcgatgaaggccggctgactctgcagattttatccgccagaccttcagacgacgggcaataccgctgcctgttcgaaaaggatgacgtgtaccaggaagcttctctggatttaaaagtggtaagtctcggatctagccccttgatcactgtcgagggccaggaggacggtgaaatgcagcctatgtgcagctccgatggctggtttcctcagcctcacgtcccctggagggatatggaaggaaagactataccgagtagtagtcaggctcttacacaaggttcacacgggcttttccacgtgcaaactttacttagggtgacaaatatcagcgccgtagatgtcacttgttcaatcagtattccattcctgggcgaggaaaagattgccacattttcgctgagtggttggtag

SEQ ID NO: 110165 - DNA, 537 bp, Artificial Sequence
  Description of Artificial Sequence: Synthetic coding sequence
atggaggttagatgggatcggtcacatagataccccgcagtgcatgtttatatggacggcgatcatgtcgctggagagcagatggcagagtaccgcgggagaaccgtcctggtcagtgacgccatcgatgagggacgattgacactccaaatcttgtctgctcggccctccgacgacggacagtaccggtgcttgtttgagaaggacgatgtttaccaggaagcctctctggacttaaaagtggtctccctgggctcttcacccttgattaccgtcgaagggcaggaagatggtgagatgcagcccatgtgcagctctgacggatggttccctcagcctcatgtcccctggcgcgacatggaaggtaagacaattccttcgtcctcgcaggctctgacccaaggctcacatggtctttttcacgttcaaacactactgcgcgttaccaatatttccgccgtggatgtcacttgtagtatctcaattccatttctcggcgaggagaagatcgcgacctttagtttaagcggatggtag

SEQ ID NO: 110166 - DNA, 1167 bp, Artificial Sequence
  Description of Artificial Sequence: Synthetic coding sequence
atggtcgacttcccaggctacaacctctctggcgccgtggcatcctttctattcatcttgctgaccatgaaacagagcgaagacttcagagtgatcggccctgctcacccaatcctcgccggtgttggcgaggatgccctattgacgtgccagcttttaccaaaaagaaccacgatgcatgttgaggtcaggtggtatcggtccgaacccagtactcctgtgtttgtgcacagagatggagtggaggtcactgaaatgcagatggaagaataccgaggatgggtggagtggattgagaacggaatcgccaaaggtaacgttgctctcaagattcacaacattcagccttcagacaacggacagtactggtgtcacttccaggatggcaattattgcggggagacttcgttactactaaaggttgcagaaaaattactggccgtgctgagttccctcaaagtaaatggccccagtcagccaatccttgtgagggtcggggaagatattcagctgacatgttacttgtctccaaaggccaatgcccaaagtatggaagtccgctgggatagatcacaccgctacccggccgtgcacgtctatatggatggcgatcatgtagcgggtgaacaaatggctgagtatcgcgggcgcacagtcctggtttcagatgcgatcgacgagggccgattaaccttgcagattttatctgcgcggcccagcgacgatggtcagtatcggtgcctgttcgaaaaggacgacgtctatcaggaagcttcgttagatctcaaagtcgtatctttgggcagctccccgttaattacagtcgagggccaggaagatggagaaatgcagccaatgtgctcaagtgacggttggttccctcaaccccacgtgccatggagggacatggagggaaagacaatcccaagttcctcccaggcattgactcagggaagtcatggccttttccatgtgcagactctgctgcgggtcacaaacatcagcgcggtggatgtgacttgtagtatatccattccatttctgggcgaagagaaaattgcaacattttccctctccgaatctcgcatgactttcctctggaaaacactcctggtttggggactgttattagcagtagctgtgggactgcccaggaaaagatcttag

SEQ ID NO: 110167 - DNA, 1167 bp, Artificial Sequence
  Description of Artificial Sequence: Synthetic coding sequence
atggtggatttcccaggctacaacctgtctggcgccgtcgcgtccttcctgttcattctcttgacaatgaagcaatcagaagactttagggtcatcgggcccgctcacccaatccttgccggagtgggcgaagacgccttgcttacatgccagctcctcccaaaaaggacaaccatgcacgtcgaagtgcgatggtaccgctcagaaccctctactcccgtgttcgtccatcgagatggggtggaggtgacggaaatgcagatggaggagtataggggttgggtggagtggattgagaatggcatcgcaaagggcaatgtagcccttaagatacacaatattcaaccgtctgataatggacagtattggtgtcattttcaagatggaaactactgcggggagacgtcgctcctcctgaaggttgctgagaaactgttagccgtactatcaagcctcaaagtcaatgggccttcacagcccattctggtccgcgtcggggaagacatacagctgacatgctacctttctccaaaagctaacgcccaatctatggaggtgcgctgggacagatcacacaggtatcctgccgtccatgtctacatggatggggaccacgtggccggagagcagatggctgagtaccggggcaggacggtgctggtgtccgacgctatcgacgaaggacgcctaactctgcagatcttatccgccagaccctctgacgacggccagtatagatgcttgtttgaaaaggatgacgtgtaccaagaggcatccttggatttgaaagtggttggccttggctcttcgcccttgataacagtggagggccaagaggacggcgaaatgcagccaatgtgttcatctgatggctggtttccacagcctcacgttccctggcgcgatatggaaggcaagacaatcccttcttccagtcaggcactgacccagggttcacatggccttttccacgtgcaaaccctgcttcgagttactaacatctcggcagtcgatgttacctgttcaatcagtattccctttttaggcgaggaaaagatcgcaacattcagtttatctgagtcaagaatgacgttcttatggaaaacattactcgtgtggggtctcctcctggccgttgccgtgggcttgcctagaaaacgctcctag

SEQ ID NO: 110168 - DNA, 1167 bp, Artificial Sequence
  Description of Artificial Sequence: Synthetic coding sequence
atggtcgactttcccggctataatctcagcggggcagtcgcctcctttttgttcattttgctgaccatgaagcagtctgaagacttccgggtaatcggtccagcccatccaatccttgccggtgtgggagaggacgccctcttaacttgccagcttctgcctaagaggactaccatgcacgtggaggtgaggtggtatagatcggaaccttctactcccgtgttcgtgcacagagacggagtggaagtaacggaaatgcagatggaggaatacaggggttgggtcgaatggatcgagaacggaatagctaaaggcaatgtcgccctcaaaattcacaatatacaaccctcagataatggacagtactggtgtcatttccaagacggcaattactgtggggagaccagtctgttgctcaaagtggccgaaaagctgcttgcagtgctcagctccctgaaggtgaacgggccaagccagcctatcttggtccgggtgggcgaggatatacagctgacctgttacctttctcctaaagctaacgcccagagcatggaggtccgttgggaccggtctcacagatacccagccgtgcacgtctatatggacggggaccatgtggccggcgaacaaatggcagaatataggggtagaactgtgttggtgtcagacgcaatcgacgagggccggctcaccctccagatcttaagcgccaggccctcagatgacggccaatatcgttgcctcttcgagaaagacgacgtctaccaggaagcatccttagatctgaaggtggtgagtctggggtcctcacccctgattacggtcgagggacaggaggacggggagatgcagccaatgtgttctagcgatggctggtttccccagccacatgttccatggagagatatggaggggaaaaccattccgagtagttctcaggccttgacacaggggtctcacggactgtttcacgtacagacactgctccgggtgaccaatatctctgctgtcgatgtgacttgttccatctcaattccttttcttggagaggagaaaattgctaccttttcattatcagagagcaggatgacatttctgtggaaaactttgttagtgtggggccttctactggccgtggcagtcggcctcccccgcaagcgaagctag

SEQ ID NO: 110169 - DNA, 738 bp, Artificial Sequence
  Description of Artificial Sequence: Synthetic coding sequence
atggttgacttccccgggtataacctgtcaggcgccgtcgcgtcattcttatttatccttctcacgatgaaacagtccgaccggttagatactcctaaggcctcactcaaggtcaacggacccagtcagcctattttggtgcgtgtaggcgaagacattcagctcacctgctacctgtcacccaaggctaacgctcagagtatggaggtacgctgggatagatctcacaggtacccagctgtgcacgtatacatggacggagaccatgtggccggagagcagatggccgaataccgcggccggaccgttctcgtctccgacgcaattgacgaggggcgtctaacactgcagatactctctgccaggccatcagacgatgggcagtatcgctgcctcttcgaaaaagacgacgtgtatcaagaagcaagcctggatctgaaagttgtggggcttgggtcatcccctctgatcacagtcgagggccaggaggacggcgagatgcagcctatgtgtagcagcgacggttggtttccgcagccacatgtcccctggcgggatatggaagggaaaaccattcctagcagctcgcaggccttgacccaaggttcccatggcttgttccacgtccagacactgttgcgcgtaacaaatatctctgccgtcgacgtcacttgttcaatttctataccctttctgggtgaagaaaagatcgctacgttcagcctatcgggatggtag

SEQ ID NO: 110170 - DNA, 738 bp, Artificial Sequence
  Description of Artificial Sequence: Synthetic coding sequence
atggtggacttcccaggctataacctctccggcgccgtggcttctttcttgttcatcttactaacgatgaaacagagtgatagactagataccccgaaggcaagcttgaaggtcaatggcccgagccagcccatactagttagagtgggtgaggacatccagctcacctgctatctcagcccaaaggccaacgcacagtccatggaagtgcggtgggacaggagtcatcggtaccctgccgtccacgtgtacatggacggcgaccatgtggccggtgaacagatggctgaatataggggaagaacggttctcgtctcagacgctattgatgaaggtaggctaacgcttcagatactgtccgcaagaccaagcgacgatggccagtataggtgtctcttcgagaaagacgatgtttatcaggaagcatccctcgacctgaaggtggtcagtctcggaagctctcctctgattacagttgagggccaagaagacggtgagatgcagccaatgtgctcaagcgatggatggttcccgcaaccgcacgttccttggcgggatatggagggaaaaactatcccttccagctcccaagcattaacacaggggtcccacggactgtttcatgttcagaccttgctgagagtcactaacatcagcgctgtggatgtcacatgttctatctctattccttttctgggtgaggaaaagatagccactttctcactcagcggctggtag

SEQ ID NO: 110171 - DNA, 1167 bp, Artificial Sequence
  Description of Artificial Sequence: Synthetic coding sequence
atggttgatttcccagggtacaacctctccggggccgtagcctccttcttgttcatccttctcaccatgaagcagagcgaggattttcgtgtcatcggcccggcccatccgatcctcgccggggtgggcgaagacgccctcctcacatgccaactcctgcccaagagaaccaccatgcatgttgaggtccgctggtatagaagtgagcctagcactcccgtgttcgtgcatcgcgacggcgtggaggtgacagaaatgcagatggaagagtacagaggctgggtcgagtggattgagaacggaatagcaaaaggcaacgttgcactgaaaatccacaatattcagccatctgacaatggccaatactggtgccacttccaggacggaaactactgtggcgagacgtccttactcctcaaggtcgcggagaagctcctggcagtcctttccagcctgaaagttaatggtccttctcagcctattctggtgcgggtgggcgaagacatacaattgacctgttatctgagcccgaaagccaacgcccaaagtatggaggtaaggtgggacagatcccataggtatcccgccgtacacgtctatatggacggggatcatgtcgcaggtgaacagatggcagagtataggggccggaccgtcctggtttccgatgcaatcgatgaaggccggttgacactgcagatcctgtcagcccgccctagcgatgatggacagtatcgttgtcttttcgagaaggacgacgtctaccaggaagcttcgctggacctgaaagtagttagtctgggtagctctcccctgattacagttgaaggacaggaagatggcgagatgcaacccatgtgctcttctgacggctggtttcctcagccgcacgtgccttggcgcgacatggagggcaagactattccaagctcatcccaggcccttacccagggatcccacgggctttttcacgtacagacattacttcgcgtgacaaatataagcgcggtggacgttacatgcagcatttccatccccttcctgggggaggagaagattgccacattttcactctcagaaagtaggatgacatttctctggaaaactttgttggtgtggggcctgcttcttgctgttgccgttggtctaccacggaaacgcagttag

SEQ ID NO: 110172 - DNA, 816 bp, Artificial Sequence
  Description of Artificial Sequence: Synthetic coding sequence
atggtggatttccccggttacaacttgagcggcgcggtggcgagctttttattcatactgcttacaatgaaacagtccgaggatttcagggtaatcggacctgcccacccaatcctcgcaggggtgggggaagacgctctactgacatgtcaactccttcctaaacgcaccaccatgcacgttgaggtccgctggtataggagtgaaccgagcacacctgtgtttgtgcacagggatggagtcgaggtgactgagatgcaaatggaggagtaccgggggtgggtagagtggatcgagaacggcattgccaagggaaacgtggccctgaagattcacaacattcaaccttccgataacggccagtattggtgtcactttcaggatggcaactattgcggcgaaacctcactgctgctcaaggtggctgcagtgttgcgggacgacataattgcctcgttaaaggtgaatggacctagccagcctattctggtgagagttggtgaggatatccagctcacatgctacctgagccccaaagcgaatgcccaatctatggaggttcggtgggataggtctcataggtatccagccgtgcatgtgtacatggacggcgaccacgtggccggagagcagatggccgaataccggggcaggacagttctggtgagtgatgccatcgacgaggggcgcctgacactgcagattctgagtgcccggccctccgacgacgggcagtacagatgtctgttcgagaaagatgatgtgtaccaagaggcttctctcgatttaaaagtcgtgtgggtgctgcctcactag

SEQ ID NO: 110173 - DNA, 738 bp, Artificial Sequence
  Description of Artificial Sequence: Synthetic coding sequence
atggtggactttccaggttacaacctttctggcgccgtcgcatcattcctttttatcctcctgaccatgaaacaaagcgagaagcttcagacggaattggcttcactcaaggttaacgggccctcacaacctatactcgttcgggtgggcgaggacatccaactgacgtgttacctgtctcccaaggctaacgctcagtctatggaagtgagatgggatcgctcccacagatacccggcagtgcacgtctatatggacggagaccatgtggccggtgagcaaatggccgagtatcgagggaggacggtgttggtgtctgatgccatcgatgaaggcaggttgacactgcagatcctgagcgctaggccaagcgatgacgggcagtacaggtgccttttcgagaaggatgacgtgtatcaggaggcaagcttagatttgaaagttgtgggcctcggctcaagcccattaattacagtggaggggcaagaggacggcgaaatgcagccgatgtgttcatcagatggctggtttccccagccccacgtgccctggcgggacatggaggggaagaccattccaagcagctctcaggccctgacccaaggatcccatgggctatttcacgtgcagaccctgcttcgagttacgaacatcagtgcagtggatgtcacgtgttccatttccattccgttcctcggcgaagaaaagatcgccacctttagcttaagcggctggtag

SEQ ID NO: 110174 - DNA, 537 bp, Artificial Sequence
  Description of Artificial Sequence: Synthetic coding sequence
atggaagtccgatgggacaggtcgcataggtaccccgccgtgcatgtgtacatggacggagaccatgtggccggagaacagatggcggaatacaggggccggacggtgctcgtcagcgacgctatagacgaggggcgcctcactttgcagattcttagcgcaagaccctcagacgacggccaatatagatgtctgtttgaaaaggacgacgtttatcaggaggccagcctcgatttaaaagtcgtgggcctgggctcatcacccttaatcaccgtggagggtcaggaggacggcgaaatgcagcctatgtgttcctcagatggatggtttccgcagccccacgttccttggcgcgatatggaggggaaaaccataccttcaagtagtcaggccctgactcagggcagccacgggttattccatgtgcaaactctcctgcgggtgacaaacatcagcgcagtcgacgttacgtgttcgatttccattccatttctgggcgaagagaagattgccacgttctccctcagtggatggtag

SEQ ID NO: 110175 - DNA, 738 bp, Artificial Sequence
  Description of Artificial Sequence: Synthetic coding sequence
atggtggatttccctggctacaacctgtccggggccgtggccagtttcctttttatattgctgacgatgaaacagtctgaccgactggatactccaaaagcgtcgctgaaagttaacggtccctcacagcccatcttagtccgggttggagaggatatccagctcacttgctacctctcacctaaagcaaatgctcagtcaatggaggtcagatgggataggtctcatcgttatcccgcagtgcatgtctatatggatggcgatcacgtggctggcgagcagatggcagagtaccgaggccggactgtgctggtaagtgatgccatcgatgaggggaggctgaccctgcagatcctgagcgctaggcccagcgacgatgggcagtatagatgtctgttcgaaaaagatgacgtgtatcaggaggcatctctagatcttaaagtggtcagcctaggctcatctccactgatcacagttgaaggccaggaagatggcgagatgcaacctatgtgcagtagcgacggttggtttccccagccccacgtgccatggcgggacatggagggcaaaactatcccatcgtcatcacaagccctcactcaggggagtcatggactgttccacgtgcagactctcctacgagtcacaaacatttccgctgttgacgtgacgtgctcaatatcaattcccttcctgggagaggagaagatcgctactttctcgctgtccggctggtag

SEQ ID NO: 110176 - DNA, 1368 bp, Artificial Sequence
  Description of Artificial Sequence: Synthetic coding sequence
atggtggatttccctggttacaatttgtcgggcgcggttgcttcatttctttttattctgctgactatgaaacagtccgaagacttccgggtaattggccccgcccatccaatccttgccggagtaggtgaagacgcactgctgacatgtcagctgctaccaaaacgaacgactatgcacgtggaggtgagatggtacagaagcgagcccagtacgccagtgttcgtccatcgggacggtgtggaagtcaccgaaatgcagatggaggaatatcgcgggtgggtcgaatggattgagaacggaatcgccaaggggaatgtggcactcaagattcacaatattcagccgagcgacaacggacagtactggtgccattttcaggatggcaactattgcggcgaaaccagtctgctgctcaaagtggccgggttgggaagtgctccttctattcacatggagggacccggtgaatcaggcgttcaacttgtgtgtacagcgcgtgggtggtttcctgagccccaagtttactgggaggacatccgcggcgagaagctgctcgccgtgtctgagcacagaatccaggatgaagacggactgttctatgccgaagctacgctggtcgtacgtaatgcgtcagcagaatccgtctcctgtctggtccacaatcccgtcttgaccgaggaaaaggggtccgtgattagcctgccggagaaactacagactgaactcgcttcccttaaagtgaatggcccctcccagcctattctggtcagagtgggagaagatatccaactgacttgctatcttagccccaaagctaacgctcagagcatggaagtccggtgggataggtctcatagatatcccgctgtgcacgtgtacatggacggggaccatgtggccggagaacagatggcggagtaccgtggacggaccgtcctagtgtccgacgctatcgacgagggtcgactgactctgcaaattctttcagcgcggccatctgatgatggccagtataggtgtctgttcgagaaagatgacgtctatcaagaagcctcgctggatctgaaagtggtcggattggggtcaagcccgcttataaccgtcgaaggccaggaggatggcgagatgcagccgatgtgctcaagtgatggttggttcccccagccccatgtgccctggagagacatggagggcaagacgataccttcatcttcgcaggccctcacccaggggtcccatgggctgttccacgtgcagactttgctgcgggtgaccaacatttccgctgtggatgtgacgtgcagtatctcaattccattcctcggagaagaaaaaatcgctaccttctccctctcaggctggtag

SEQ ID NO: 110177 - DNA, 816 bp, Artificial Sequence
  Description of Artificial Sequence: Synthetic coding sequence
atggtagattttcctggctacaacctgtctggggctgtggcaagcttccttttcatcctcctgactatgaagcagagcgaggacttcagagttatcggacccgcacatcctatcctggccggagtcggggaggatgccttgctcacatgtcagcttctgcctaagcgaacaaccatgcacgtggaggttcgttggtaccgctcggagccttccactccggtgttcgtccatcgcgacggagtcgaggtgaccgaaatgcaaatggaagagtaccggggctgggttgaatggatcgaaaacggaatcgctaaggggaatgtagccctaaagatccacaacatacagccgtccgacaacggccagtattggtgtcattttcaagacggaaactattgcggcgagacaagcctattacttaaagtagccgcagtcttgagagatgacataatagcctccctaaaagtcaatggcccatcacagccaatcttagtgagagtaggtgaggacatacagctgacctgttacctgagtccaaaggccaacgcgcaaagcatggaagtgcgctgggaccgcagtcaccgataccctgcagtgcatgtgtatatggacggcgatcatgtagccggcgaacagatggccgagtataggggccgtacggtcctggtctctgatgcgatcgacgaaggacggctcaccctgcagatcttgtcagcacggccaagcgatgacggccagtacagatgtctgttcgaaaaggacgatgtgtaccaagaggcctcactagacctcaaggttgtctgggtattgccacattag

SEQ ID NO: 110178 - DNA, 816 bp, Artificial Sequence
  Description of Artificial Sequence: Synthetic coding sequence
atggtggactttcccgggtataacctgagcggtgcagtggcttcatttctcttcattctgctcactatgaagcagtcggaggactttagagtgataggcccagctcaccctatcctggcgggcgttggcgaggacgctctgctgacatgccaactgctgcctaagcgcactactatgcacgtggaagttcggtggtacagatctgagccttctactcctgtgttcgttcacagagatggagtggaagtgactgaaatgcagatggaagagtatcggggctgggtcgaatggatcgaaaacgggatcgccaaagggaatgtcgctttgaaaattcacaacattcagccctcggacaacggacagtactggtgccacttccaggatggtaattattgtggggaaacttccttgttgctcaaagtcgccgcggtactcagggacgatatcatagcgagcctgaaagttaacggtcccagtcagcccatacttgtcagggttggggaggacatccagctgacttgctatttaagccccaaagccaacgcccaaagcatggaagtacggtgggacagaagccacagataccctgctgtccacgtctacatggatggcgaccatgtcgcaggcgagcagatggccgagtatcgcggacgaactgtgctggtgtctgacgctattgacgagggccggctgactctgcagattttgtcggcacgcccctcagacgacggacagtaccggtgcctgttcgaaaaggatgacgtgtatcaggaggcctcgctggacttgaaggttgtctgggtgctcccccactag

SEQ ID NO: 110179 - DNA, 738 bp, Artificial Sequence
  Description of Artificial Sequence: Synthetic coding sequence
atggtggatttcccaggctacaacctgtctggtgctgtagcttcatttctgttcattttactaaccatgaagcagagcgatcgcctggatacacctaaggcctccttgaaagtgaacggaccatcacagcctatcctggtacgggtgggggaagacattcagctgacctgctacctgtcccctaaagcaaacgcacaatctatggaggtgcgatgggaccgctcccatagataccccgcggtgcacgtgtacatggatggggaccacgtggctggagaacagatggcagagtatcgggggcggacagtcctcgtttccgatgcaattgacgagggcagactgacactgcaaattctgagcgcccggccatccgatgacggacagtaccggtgcctgttcgaaaaggatgatgtgtatcaggaggcatccttagatcttaaagtcgtaagcttgggtagctctcctcttatcacagtcgagggacaggaggacggcgaaatgcaaccaatgtgcagttctgacggatggttccctcagccgcacgtcccatggcgtgatatggaggggaagacaataccaagctcatcgcaagctctgactcaggggtctcacgggctgttccatgtccagacacttttgcgagtcactaacattagcgctgtggacgtaacgtgttccatctccattcccttcctgggcgaggagaagatcgctactttcagcctgagtggctggtag

SEQ ID NO: 110180 - DNA, 816 bp, Artificial Sequence
  Description of Artificial Sequence: Synthetic coding sequence
atggtcgattttcctggatacaatctgtcaggcgcagttgctagtttcctcttcatattgctgacaatgaagcagtcggaagactttcgggtaattgggcctgcccacccaatcttagcgggggtcggcgaagatgctttactgacatgccagctcctgccaaagcggacaacaatgcatgtcgaggtgcgctggtatcgtagtgagccctctacccctgtgtttgtgcatcgggacggcgtggaggtcactgagatgcagatggaagagtaccgtgggtgggtcgagtggattgagaatggaattgccaaaggtaacgtcgccctgaagatccacaacattcagccatctgacaacgggcaatattggtgtcatttccaggatggcaattactgtggagagacttcattgttgctaaaagtcgctgctgtactgcgagatgacatcatcgccagccttaaagtgaacggacccagccaacccatcctcgttcgtgtgggggaagatatccaactgacatgttacctgtcccctaaagctaacgctcaatcgatggaagtgcgctgggacagatctcaccgttacccagcggtccatgtgtacatggacggagatcacgttgccggggaacagatggctgagtatagaggaagaacagtcctggtgagcgatgccattgacgaaggacgccttacgctgcagattctgtccgccagaccatctgacgacggccagtatcggtgcctgttcgagaaagatgacgtgtaccaggaagcgtctcttgacctgaaggtggtgtgggtgttaccacactag

SEQ ID NO: 110181 - DNA, 738 bp, Artificial Sequence
  Description of Artificial Sequence: Synthetic coding sequence
atggtagactttcccgggtataacctgtccggagccgtggctagtttcctgtttatccttctcactatgaagcagtcggacagactggacacccccaaggccagcctgaaagtcaacgggccctcgcagccaatcctcgtgcgagtaggtgaagacatacagctcacatgctacctgagccctaaagccaacgctcagtctatggaagtcagatgggataggtctcaccgctaccccgctgttcatgtgtatatggatggcgatcatgttgcaggggagcaaatggctgagtatcgcggcaggacagtgcttgtctcagacgcgatcgatgagggccggttgaccctgcaaattcttagcgcccgcccctccgatgatggccagtacaggtgcctattcgaaaaggacgatgtctaccaggaagccagcttggatttgaaggttgtaggactgggctcaagccctttgattaccgtggagggccaggaggacggtgagatgcagccaatgtgctctagtgatggttggttcccacagccccacgtgccctggagagatatggagggcaaaacaatcccatccagctcacaggcgctcacgcagggatcccacgggctgtttcatgtgcagaccttgctgcgcgtgactaacatcagcgcggtagatgttacctgctcaatttcaattccatttctaggggaagaaaagattgccacgttcagcctcagtggctggtag

SEQ ID NO: 110182 - DNA, 738 bp, Artificial Sequence
  Description of Artificial Sequence: Synthetic coding sequence
atggtggattttcctggttacaacttaagcggagccgtcgcctcgttcctgttcatcctgctgaccatgaagcagagtgaccgactggacaccccaaaggccagcctgaaggtcaacggaccttcgcagccaatcctcgtacgcgttggtgaagatattcagctgacctgttatctgtcccctaaagcaaatgctcagtccatggaagtgcgctgggaccggtcacaccgatatcctgctgtgcatgtctacatggacggtgatcacgtggccggagaacagatggcagagtataggggaagaaccgtcttggtgagcgacgccatagacgagggacgactcaccctccagattctgtcagctagacccagcgacgatggacagtaccgatgtttatttgaaaaggacgacgtgtaccaggaagcctccttggacctgaaggttgtgagtctcgggtcttcgcctctgattactgttgaaggccaggaggacggggagatgcagccaatgtgctcctcagacggatggttcccccagccgcacgtgccctggagggacatggaggggaagaccatcccatcatcctcacaggccctaacccagggatcccacgggctgtttcacgtacaaacccttctgcgggtaaccaacatttctgctgtggatgtcacctgctccatatcaattccatttttgggcgaggaaaaaatcgctacgttcagcttaagcgggtggtag

SEQ ID NO: 110183 - DNA, 1368 bp, Artificial Sequence
  Description of Artificial Sequence: Synthetic coding sequence
atggttgacttccctgggtacaacctcagcggcgccgttgcgtcttttctgtttatcctcttgacaatgaaacagtcagaagatttccgcgtaatcggcccagcgcaccccattctcgctggggttggggaggacgcactccttacatgccagttactgcctaaacgtaccacaatgcacgtggaggtcagatggtacaggagcgaaccttctacacccgtttttgttcacagggacggggtggaagttaccgagatgcagatggaagagtatagaggatgggtggagtggatagagaatggcatcgccaaaggtaacgtggcactgaagattcataacattcagccttccgacaacggccagtactggtgccactttcaagacggcaattattgcggtgaaactagtttactcctgaaagtggctgggttaggctctgccccaagtatacacatggaaggccctggagaatcaggtgtgcagctcgtttgtacggcaagaggatggttcccagagccacaagtatactgggaagacattaggggggagaagttgcttgctgtgtctgaacataggatccaggataaggatggcttattctacgctgaggcaactctagttgtacgtaatgccagcgccgagtctgtttcatgcctggtgcacaacccagtgctgacagaagaaaagggctcggtcatctctctgcctgagaagctacaaacagagttggccagcctgaaagttaacggaccgtctcagcctatactggtgcgcgtgggcgaggatatacagcttacctgctacctttcgcccaaagccaacgctcagtcgatggaggtgcgctgggatcgctcacacaggtatccagctgtacatgtctatatggatggtgaccacgtggccggggagcaaatggcggagtaccggggccgtactgttttggtatccgatgctatcgatgagggccgtctgaccctgcagatcttgagtgctagaccctccgatgatggacagtaccgctgtctttttgaaaaggacgacgtgtaccaggaggccagcctggacttgaaggtggtgtcactgggctcctctcccctgatcaccgtggagggccaggaggatggcgagatgcagcccatgtgttcgtctgacggctggttcccacaaccccacgtgccatggcgtgacatggagggtaagactattcctagcagctcacaagccctgacccaggggagtcatggcctgttccatgttcaaacactgctacgtgtgactaacatcagcgccgtagacgtcacctgttcaatttctatacccttcctaggagaagaaaaaattgcgactttcagcttatcgggctggtag

SEQ ID NO: 110184 - DNA, 1368 bp, Artificial Sequence
  Description of Artificial Sequence: Synthetic coding sequence
atggtggatttcccagggtataatctgagtggtgcagtcgcttcttttctgttcattctgttaactatgaaacagtcagaggatttccgcgtgataggacccgctcatcccatacttgcaggggtgggcgaggatgctctccttacttgccagttgttgccaaagcgaactaccatgcacgtggaagtgagatggtatcgatccgagccctcgactcctgtttttgtgcaccgggacggggtcgaggtgaccgaaatgcagatggaggagtataggggctgggttgagtggatcgagaacggaatcgctaaggggaatgttgcattgaagatccataacatccagccaagtgataacggtcagtactggtgtcatttccaagatggaaattattgcggagagaccagcctgctcctcaaggtcgctgggttgggaagcgcccccagcattcacatggagggtcccggcgagtccggcgtgcagctagtttgtaccgctcgtggctggtttcccgaacctcaggtgtattgggaggatattcgtggtgaaaaactgctggcggtatccgaacaccgtattcaggataaggacggtctgttctacgccgaggccacacttgtagttcggaacgcctcagccgagtctgttagctgcctggttcataatccagttctaacagaggagaaaggtagtgtgataagtttgcccgaaaagctgcaaaccgagctggctagcctgaaggttaacggtccctcccaaccgattctggtcagagtgggggaggatattcagctgacctgctatttgagtccaaaagctaatgcacaaagcatggaggtgagatgggatcggagccatcgttacccagctgtgcatgtctatatggatggggaccacgtggccggcgagcagatggccgagtaccggggccggactgtgctcgtgtctgacgcgatcgatgagggaaggctgaccctgcagattcttagtgccaggccatcggatgacgggcagtaccgctgtctattcgaaaaagatgatgtgtatcaggaggcatcgcttgacctcaaagtggtctctctggggtcttctcctttaatcacagtcgaaggacaagaggatggggagatgcagccgatgtgctcgtctgatggctggttcccacagccacacgtaccgtggcgcgatatggaagggaagaccatcccctcctcgtctcaggccctgacccaggggtctcacggactgttccacgtgcaaaccctgttaagagtgacgaacatcagtgccgtcgatgtgacctgcagcatttccatacccttcttaggcgaagaaaagattgctacgtttagcctctccggctggtag

SEQ ID NO: 110185 - DNA, 537 bp, Artificial Sequence
  Description of Artificial Sequence: Synthetic coding sequence
atggaggttagatgggatcgctcccacagatatcctgctgtccacgtgtatatggatggggaccatgtagctggagagcaaatggctgaataccggggcaggacagtcctcgtgagcgacgccattgacgagggacgcctgactctccagatactcagcgctagaccttcagacgacggtcagtaccgttgtttattcgagaaagatgacgtctatcaggaagcgagccttgacctcaaggtcgtgagtctgggcagttctccgcttattaccgtggaaggtcaggaggacggggagatgcagcctatgtgttcttctgacggatggttccctcagcctcacgtgccatggcgggatatggagggcaagaccatcccctcctcctcacaggctctgactcaaggttctcatggcctctttcatgtgcagacattgttgagagtgacaaatatttcagcagtagacgtaacttgctctatctccatcccgttcctgggagaagaaaagattgccacttttagcctctcgggctggtag

SEQ ID NO: 110186 - DNA, 1368 bp, Artificial Sequence
  Description of Artificial Sequence: Synthetic coding sequence
atggttgatttcccaggctacaatctgtccggcgccgtagcttcattcttattcatactgttgaccatgaaacagtcagaagatttcagagttattgggcccgcgcaccccattctggctggagtcggcgaggatgctttactcacgtgtcaactgctgccaaaaagaactactatgcatgtggaggtgcgttggtatcgatctgaaccatcaacacctgttttcgtacatagggatggtgtggaggtgaccgagatgcagatggaagagtacagggggtgggtcgaatggatagaaaacggaatcgctaagggaaacgtggcccttaaaattcataacatccagccatccgacaacggacagtactggtgccatttccaagatggtaactattgcggtgagacctccctgctccttaaggtggcaggacttggctcggcgccctccatccacatggaaggaccaggtgagtcaggcgtgcaattggtgtgcaccgctagaggatggttccccgaacctcaagtatattgggaggatatcagaggggagaagctcttggctgtatccgagcaccggatccaggacaaggacggtttgttttatgccgaggccacgctggtcgtgcgcaatgcttccgccgagtcagtgagttgcttggtccataaccccgtcctgaccgaggaaaaaggatctgtcatttcccttccagaaaaactgcagacagagctcgcctccctgaaggtaaatggtccttctcaacctattttggtccgggtgggcgaagacatccagttgacttgctacctgtctcctaaagcaaatgcccagtctatggaagttaggtgggaccgcagccatcggtatcctgctgtgcatgtctatatggacggggaccatgtagcaggagaacagatggctgaatacagaggccgaaccgtactcgtgtcggatgccattgatgagggacgcctgaccctgcaaattctttcagcgaggccttctgacgacggacaatatagatgtctgttcgagaaagacgatgtatatcaggaagcctcactggacttgaaggtcgtgagtctcggttcaagtccattaattaccgtcgaggggcaagaagacggcgaaatgcaacctatgtgcagcagcgacggttggtttcctcaaccgcatgttccatggcgtgacatggaaggcaagactatccccagttccagtcaggccctcacccagggatcgcatggactctttcatgtgcagaccctcctgagagtgacgaacatcagcgcggtcgatgtgacatgcagcatctctatccccttccttggtgaggagaagattgcgacgttctcactgagcggttggtag

SEQ ID NO: 110187 - DNA, 816 bp, Artificial Sequence
  Description of Artificial Sequence: Synthetic coding sequence
atggtagattttcctggatataacttatcaggggctgtggcctcttttctgttcatcctgctcactatgaagcagtccgaagacttccgtgtgattggcccagcccaccccatcctcgccggggtcggagaggatgctctgctgacatgccaactgctgccgaaaaggaccacgatgcatgtcgaggttaggtggtaccgaagtgagcctagcactccagtgttcgtgcatcgcgatggagtggaggtgaccgaaatgcagatggaggagtaccggggctgggttgagtggattgaaaacggcatcgctaagggaaatgttgcgttgaaaattcataatatacagccctctgataacgggcaatattggtgccattttcaggatggcaactattgcggtgagaccagtttactgttaaaagtcgctgcagtgttaagggacgatatcatagccagcttaaaggtcaacggtccctctcagcccatcctagtgcgcgtgggtgaggatattcaattaacatgctatttatctcctaaggctaatgcccagtccatggaagtgcggtgggaccgctcacaccgctatcctgccgtgcatgtttatatggatggcgaccacgtcgcaggcgaacaaatggcagaataccgcggccggacagttctggtaagtgatgccatcgatgaaggcagactgaccctgcagatattatccgctcggccctccgatgatggacaataccgctgcctgtttgaaaaggacgatgtataccaggaggcaagtcttgatcttaaagtggtatgggttttgcctcattag

SEQ ID NO: 110188 - DNA, 1368 bp, Artificial Sequence
  Description of Artificial Sequence: Synthetic coding sequence
atggttgatttccctgggtacaatctgagtggtgccgtggcaagctttctcttcatcctgctgaccatgaaacagagcgaggattttagggtgatcggccctgcccatcccatcctcgcaggtgtgggagaggatgcattgctcacatgtcagttgcttcccaagagaacaaccatgcatgtggaagtgaggtggtatcgtagcgagccctctactcccgtgtttgtgcatcgcgacggagtcgaagtgaccgagatgcagatggaagaatataggggctgggtggagtggattgagaacggcatcgccaagggaaacgttgcactcaaaattcataacattcagccttcggacaacggacaatactggtgccacttccaggacggcaattactgtggcgagactagcctgctcctgaaggtagcaggactaggatccgccccttccatccacatggagggacccggcgagtctggtgtgcagctggtttgtaccgcccgcgggtggtttcccgaaccccaggtttattgggaggacattcgcggtgagaagctgctcgcggtttcagagcacaggattcaggatgaagatgggcttttttatgcggaagccacactggtggttagaaacgcatccgccgaatcagttagctgcttggtccacaaccccgtcctcacagaggagaaggggtctgtgatctcgctgccggaaaagctccagacagagttggcttctctgaaggtgaacgggccctctcagcccatcctggtgagagtgggtgaagacatccagctcacctgttacctctctccgaaagccaacgcacaatccatggaagttcgatgggacagatctcaccgatatccagccgtgcacgtttatatggacggcgatcatgtagccggagagcagatggccgagtatcggggacgtactgtattggtcagtgatgctatagacgaggggaggctgactttgcagatcctctctgcacggccttcagacgacggacagtaccggtgtctattcgaaaaagatgatgtgtaccaggaagcatcacttgacttgaaggtagtgggccttggaagcagcccattgataacagtggaaggtcaggaggatggagagatgcagccgatgtgctcctccgacggatggtttccacagccccatgtcccatggcgagatatggagggcaagacaatccccagttctagccaggcattaacgcagggctcgcacggtctatttcatgtgcaaactctgctgagggtaactaatatttctgccgtggatgtcacctgctctatttctatccctttcttaggtgaggaaaagatcgcgacttttagccttagcgggtggtag

SEQ ID NO: 110189 - DNA, 1368 bp, Artificial Sequence
  Description of Artificial Sequence: Synthetic coding sequence
atggttgatttccccgggtacaacctgtccggggcagtcgccagcttcttgttcatcctgctgactatgaagcagtccgaggactttcgggtaatcgggccagctcatcctatactcgctggcgtgggcgaagacgctctgcttacatgtcagctcttgcccaagcggacaaccatgcacgtggaggttcggtggtatcggtccgaacccagcacccccgtgttcgtccatcgcgacggcgtggaagttacagagatgcagatggaggaatatcggggctgggtggaatggattgagaatggtatcgctaagggaaacgttgccctcaaaatccataatattcaacccagcgataacggccaatattggtgccacttccaggatggaaattactgtggggagaccagccttctgctcaaggtggccggactgggttccgccccttccattcatatggagggtcctggagaatccggagttcaattagtgtgtactgccaggggatggtttcctgagccccaggtgtattgggaagatattcgcggagagaagcttctcgccgtgtcagaacaccggatccaggacgaggacggactcttttatgcggaggccactctggttgtacggaatgcttcagcagaatctgtgtcttgtctggtccacaaccctgtgctgacggaggagaagggaagcgtgatatcccttccagaaaagctccagactgagttggccagccttaaagtgaatggtccctcccagccaatcttggtgagggtgggcgaggatatccagttaacatgctatctgagcccgaaagctaacgctcagtccatggaggtgcggtgggatagatcacaccggtatcccgcagttcatgtgtatatggacggagatcacgtcgcaggagaacagatggctgaatatcgaggcaggacagtgttggtcagcgatgcaattgatgaggggaggctgaccctgcaaattctgtctgccaggccctccgacgacggacagtaccgatgtctattcgaaaaggacgacgtgtatcaggaggcttctctggacctgaaggttgtagggttagggtcttcgcccttaatcacggtagagggtcaggaagacggagagatgcaaccaatgtgttcttctgatggatggttcccccagccacacgtgccatggcgggacatggaagggaagacaatcccaagcagcagccaggccctgacacaggggtcccatgggttgtttcatgtgcagacccttttgagggtgaccaacataagtgcagtagatgtaacatgtagtatatccatcccatttctcggcgaggaaaagatcgctaccttcagtctttccggctggtag

SEQ ID NO: 110190 - DNA, 816 bp, Artificial Sequence
  Description of Artificial Sequence: Synthetic coding sequence
atggtagactttcccgggtacaacttaagcggcgctgtggcaagtttcctgttcatcctattgacaatgaagcaaagtgaagacttcagggtcatcgggcctgcccatccaatcttggctggcgtgggtgaagatgcactgctgacctgccagttgttgcctaagcggaccactatgcacgtcgaagtcaggtggtatcggagtgagccctccactccggtcttcgtgcatagagacggcgtggaagtgacggaaatgcagatggaagagtaccgaggctgggtggagtggatcgagaatggtatcgctaaggggaacgtagcattgaagatccataacattcaaccatccgataacgggcagtactggtgccatttccaggacggtaactactgcggtgagacatccctgctgctgaaagttgctgccgtcctcagggacgatattatcgccagtttaaaagttaacgggccaagtcagcccatcctggtgagggttggcgaagacattcagcttacctgttacctctcgccaaaagccaatgctcagtcaatggaggtgagatgggacagatctcatcgctatcccgccgtccatgtatacatggatggagaccatgttgcaggggaacaaatggccgagtatagaggtcgaaccgtgttagtgtcggacgctatagacgagggcaggttgactctgcagattctaagtgcccgaccctctgacgacggacagtaccgctgcctgtttgagaaggacgatgtgtatcaggaggccagcctggacctgaaagtcgtgtgggtcctgcctcactag

SEQ ID NO: 110191 - DNA, 537 bp, Artificial Sequence
  Description of Artificial Sequence: Synthetic coding sequence
atggaagtaagatgggatcgatctcatcggtatcccgccgtgcacgtttacatggacggggaccatgtggccggtgaacagatggctgagtacagaggccgcacggtcctcgttagcgacgctatcgacgagggacgcttgactctccagatcttaagtgctagaccctctgacgacggccagtatcgatgcctgtttgaaaaggatgatgtatatcaggaggcgtcactcgatctgaaggtggtggggctgggtagttccccactcattacagtcgaggggcaagaggacggtgaaatgcaacccatgtgctccagtgatgggtggtttccccagcctcatgtgccctggagggatatggagggcaaaactatccctagcagcagccaagctctaacacaaggcagtcacgggctgttccacgtacagacactattgagggtgaccaacatcagcgccgtcgacgtgacctgctctatctctattccgttccttggtgaagaaaagatagctaccttctccttatcggggtggtag

SEQ ID NO: 110192 - DNA, 738 bp, Artificial Sequence
  Description of Artificial Sequence: Synthetic coding sequence
atggtggactttcccggatacaatttgtctggagccgtcgcctcatttctttttatactgctgacaatgaagcaaagcgagaagttgcagaccgagctggcttccctgaaggtgaatggcccttcacagccgattttagtccgcgtgggtgaggacattcagctcacttgctacttgagcccgaaggcgaacgcacagagcatggaggtgagatgggacagatctcacaggtatcctgcagtgcacgtctacatggacggtgaccatgtggcaggcgaacagatggccgaatacagaggtcgaactgtactagtcagtgacgctatcgacgagggccggttgacacttcagattctgtcagcgagaccttcagacgacggacagtacagatgtctgttcgagaaggatgatgtttatcaggaagcctccctggatctaaaggtggtggggctgggctcctctcccctcatcactgtcgaaggacaggaggacggggaaatgcagccaatgtgctcaagcgatgggtggtttccgcagcctcacgtgccttggcgtgacatggaggggaagactatcccttcaagttctcaagcgttaacacaaggctctcatggccttttccatgtccagacgctcttgcgggttaccaatatttctgcagttgatgtcacctgttcaatttcaattccctttctgggagaagaaaagatcgctaccttcagcctgtccgggtggtag

SEQ ID NO: 110193 - DNA, 738 bp, Artificial Sequence
  Description of Artificial Sequence: Synthetic coding sequence
atggttgactttccaggttacaacctctccggggcagtggcttccttcctgttcatcttgctgaccatgaaacagagcgagaaattacagacggagctggcctcattgaaagtcaacggtccatcgcagcctatactcgtgagggttggcgaggatatacagctgacctgttatctgtccccaaaggctaatgcacaaagcatggaagtgcgctgggaccggtcccatcggtatcccgcggtccatgtttatatggatggggatcacgttgccggtgagcaaatggctgagtaccgtggccgcaccgttctcgtgtccgacgccatcgatgagggtagactgaccctgcagatcttaagcgcccgcccctcagacgacggacagtatcgatgtcttttcgagaaggacgacgtgtatcaagaagcctctctggatttgaaggtcgtgagcctgggttcatccccgctcattacggtggagggccaggaagatggcgagatgcagcccatgtgttcctccgacggctggtttccacagccccacgtcccctggcgggatatggaagggaaaaccatcccttcctcatcccaggctttaacgcagggaagccatggtctttttcatgtccaaactctattgcgcgtgactaatatatctgctgtggacgtaacatgcagtatcagtataccattcctgggagaggaaaagatagccactttttccctgagcggatggtag

SEQ ID NO: 110194 - DNA, 1167 bp, Artificial Sequence
  Description of Artificial Sequence: Synthetic coding sequence
atggtggacttccccggctacaacctgtctggggctgtcgcaagcttcctcttcattctgctgacgatgaagcagtcagaagatttccgcgtgatcggccccgctcaccccatcctggcaggtgtgggggaggatgctcttctaacctgtcagctgctgccgaaaagaacaacaatgcacgtcgaagtccgttggtatcggagtgagccttcaactcccgttttcgtgcaccgggatggcgtggaggtcacagagatgcagatggaagagtatcggggctgggtagaatggatcgagaacggcattgcgaaagggaatgttgctcttaaaatccacaatatccagcccagtgacaatggtcaatactggtgtcatttccaggacgggaattattgtggggagacaagcctgctgcttaaggtggcagaaaaacttctggccgtgcttagttccctcaaagtgaatgggccatcacagcccattctggtacgagttggcgaagacatacagctcacatgttacctgtcgcccaaagctaatgcacagagtatggaagtgaggtgggacagatcccaccgctatccagccgtccacgtttacatggatggagaccatgtcgctggggaacagatggctgagtatcgggggaggaccgtactggtgtctgacgcgatagacgagggccgattgactcttcagattctgtcagccagacccagcgatgatgggcaatacagatgcctcttcgagaaggatgacgtctatcaggaggccagcctcgatttaaaggtggtatcactcggtagcagcccactcataacagtcgagggacaagaggatggtgagatgcaaccaatgtgctcttctgacggttggtttcctcagcctcatgtgccttggcgcgacatggaaggcaaaaccattcccagcagttcccaggctttgactcagggcagccatggtctgttccatgtacaaacactgctcagagttaccaatatcagcgcagtggatgtcacgtgttccatttctatcccctttctcggagaagagaaaattgcaactttcagcctgtccgaatctaggatgacttttctgtggaaaactctgctggtgtggggcttactgctggccgttgccgtgggtctaccacgtaagagatcatag

SEQ ID NO: 110195 - DNA, 1368 bp, Artificial Sequence
  Description of Artificial Sequence: Synthetic coding sequence
atggtggatttcccaggctacaatctctctggagccgtggcctccttcctctttatcttactgaccatgaagcagtcggaagacttccgtgtaattggcccagcacacccaattctggctggagttggcgaggatgccctgctcacatgtcagctgctccccaaacggacaacgatgcacgtagaagtgagatggtaccgctctgagccaagcacacccgtgttcgtgcatcgcgacggggtggaggtaaccgagatgcaaatggaagagtatcgcgggtgggtggaatggattgaaaacggcatcgccaaaggaaacgtcgcgctcaaaatccataatattcagccatccgataatggacaatattggtgccacttccaggacggcaactactgcggtgaaacttccctactcctcaaggtggcgggcttgggatctgctccatctatccacatggaaggccctggtgagtccggtgtgcagcttgtgtgtactgctcgcggatggtttcctgagcctcaggtatactgggaggacatcaggggtgagaaacttctcgctgtgtccgaacatcggattcaggacaaagatggactgttctacgctgaagcaacactggttgtgcgcaatgcctccgcggaatcggtgtcctgcctggtgcacaaccctgttcttacggaagaaaaaggatccgttataagtctgcctgagaaactgcagactgagttagcaagcctgaaggtgaacgggccgagccaacccatcctggtgagggtgggcgaggatatacagctcacctgctacctttccccgaaggctaatgcgcagagtatggaagtgaggtgggatcggagccacagatatccagcggttcatgtctacatggacggggaccacgtggccggggaacagatggcagagtatcgcggcaggactgttttggtgtcagacgccatagatgaaggccgcttgaccctgcaaatactttctgcccggccatctgatgacgggcagtaccggtgcctgttcgagaaagatgacgtgtaccaggaagcttctctggacctaaaagtcgtcagtcttgggtcatctccactgattactgtcgaaggccaggaagacggggagatgcagcccatgtgctcttcggatgggtggtttcctcagcctcatgtgccttggagggatatggagggtaagacgatcccctcttcttctcaggcactgacccagggctcccacggcctgtttcacgtgcaaaccctgcttagggtaactaacattagtgcggttgacgtgacgtgtagtatatctataccttttttgggtgaggaaaaaatagccactttctccttaagcggatggtag

SEQ ID NO: 110196 - DNA, 1167 bp, Artificial Sequence
  Description of Artificial Sequence: Synthetic coding sequence
atggtggatttccccgggtataacctgagcggcgctgtggcatcctttctctttatactgttaacaatgaaacaatcagaggacttccgggtgattggccccgcacatcccatcctggctggagtcggcgaggacgccctgctcacttgtcagctcctgcccaaacgtacaactatgcacgtcgaagtgcgatggtaccggtctgaaccctctactcctgtctttgtgcacagggatggcgttgaggtcacagagatgcaaatggaagagtatcgggggtgggtggaatggattgagaatggcatagccaaagggaacgttgccctgaagattcacaatatccagccctccgacaacggccagtattggtgccacttccaggacggcaattactgtggcgaaacaagtctcctgcttaaggtggccgaaaagcttctggccgtgctctctagcttgaaggttaacggccccagccaaccgatcctcgtgagagtgggcgaagatatacagttgacctgttatctaagtccaaaggctaatgcgcagtctatggaggtccgatgggaccggagccatagataccccgcggtgcatgtgtatatggacggcgaccacgtggccggggagcagatggctgagtaccgcggaagaactgtcctcgtgagtgatgcaattgacgagggccgtcttacactccagattctgagtgcaaggccctcagatgacggccagtaccgttgcctcttcgaaaaggacgatgtgtaccaggaagccagccttgacctgaaagtggtaggtctggggtcaagtccgctgataaccgtggagggacaggaggacggtgaaatgcaacccatgtgttccagcgacggctggtttccccagccccacgttccatggcgggatatggaaggcaagaccatcccttcatccagccaggccctgacccagggctcacatggcctatttcacgtgcagacactgcttagggtgactaatatatcagccgttgatgtcacctgttccatttctatccctttcctgggggaggaaaagatcgcgacattttccctttctgagtcccgcatgactttcctatggaaaaccttgctggtgtgggggctgctgctggcagtggccgtgggattacctcggaaacgctcgtag

SEQ ID NO: 110197 - DNA, 738 bp, Artificial Sequence
  Description of Artificial Sequence: Synthetic coding sequence
atggtggactttccaggctataacctctctggtgctgtggcgtctttcctcttcatccttctcaccatgaagcagtcggatcggctcgatacacctaaagcgagtctcaaggtgaatggcccatcacaacctatactggtgcgcgtgggagaggacattcagctcacatgttacctttcgccaaaagccaatgcccagagcatggaagttcgctgggatagatcccataggtaccccgccgtgcacgtttacatggacggcgaccatgtggcaggtgaacaaatggccgaatatagagggcgcactgtgctcgtgtccgatgctatcgatgaaggcaggctcacccttcagattctctcggccaggccgtctgacgatgggcaatacagatgcttgttcgaaaaggatgacgtataccaggaagctagtttggacctgaaggtcgtggggctcggatctagccccttgataacggtcgaggggcaagaggacggtgaaatgcaacctatgtgcagtagtgacggctggtttcctcaacctcacgtgccctggagagacatggaaggcaagaccattccaagcagctcgcaggcattgacccaaggctcacacggtctcttccatgttcagaccctgctgcgggtgactaatatcagcgccgtagacgtgacatgctctatctccatcccattcttgggggaagaaaagatagccaccttctccctctccggctggtag

SEQ ID NO: 110198 - DNA, 816 bp, Artificial Sequence
  Description of Artificial Sequence: Synthetic coding sequence
atggttgattttcctgggtataatcttagtggcgcagtagctagctttctgtttatcctgctaaccatgaagcaaagcgaggacttccgggttataggacccgcacatccaatacttgccggcgtcggagaggatgccctgcttacatgccagctcctccctaaacggaccaccatgcacgtggaagtgagatggtatcgcagtgaaccgtcgactcccgtgttcgtgcaccgcgacggagtcgaggtgactgagatgcaaatggaagagtatcggggatgggtcgaatggatcgagaatggcattgccaaaggtaacgtcgcgctgaagatccacaacatccaaccctcagataatggtcagtactggtgccactttcaggacggaaactactgtggagagacctccctgctgctaaaagtcgcagcagtactgcgcgatgacatcattgctagcctcaaagtgaacggaccatcccagcctatcttggtccgcgtgggagaagatattcagctgacttgctatctgtccccaaaagcaaatgctcagtcaatggaggttagatgggaccgctctcataggtatcctgcagtgcacgtatacatggacggcgatcacgtagccggcgagcagatggccgaatatagaggccggacggttctggttagcgacgctatagacgaaggacggctcaccttgcagatcctctcagctcgcccctctgacgacggccagtatcgctgtctgttcgaaaaggatgacgtctaccaggaagcctccttggatctgaaagtcgtgtgggtacttcctcattag

SEQ ID NO: 110199 - DNA, 1167 bp, Artificial Sequence
  Description of Artificial Sequence: Synthetic coding sequence
atggtggattttcccgggtataacctctctggggctgtcgccagctttttgttcatattacttacaatgaagcagtcagaggactttcgagtgatcgggccagctcaccccattcttgctggtgtgggtgaagacgcccttctgacgtgccaactgttgccgaagcgaacaaccatgcatgtggaggtgagatggtaccgttccgaaccatcaactcctgtctttgttcatcgggatggcgtcgaagttaccgagatgcagatggaggagtatcggggctgggtggagtggattgaaaatgggatcgcaaagggaaacgttgccttaaagattcataacatccaaccttcagacaacgggcagtattggtgtcacttccaggacggcaattattgcggcgagacatcattgttactcaaagtggcagaaaaactgctagccgttctctcctctcttaaggtaaacggaccctcccagcccatcctggtgcgtgttggtgaagacattcagttgacttgttatttgtcccctaaagcaaacgcccagtccatggaagtccgttgggatcggagtcacagataccctgcggtgcacgtctatatggatggcgatcacgtggcaggagaacaaatggctgagtatcggggcaggacggtcctagtgagtgacgcgattgacgagggccggctcacactccagatacttagtgctaggccaagtgatgacggacaatatcgttgtctgtttgagaaagatgacgtttatcaggaagcttcattagacctgaaggtcgtagggctgggctcaagccctctcatcaccgtggagggccaggaagacggggagatgcagcccatgtgctcctccgacggctggttcccccaaccccatgtaccttggagggacatggagggcaaaaccatccctagttcttcccaggccctgacgcagggcagccacggcttgttccacgtgcagaccttgcttcgagtgaccaatatctctgctgtcgacgtgacttgcagcatttccatcccattcctaggggaggagaaaatcgcaaccttttcactaagcgaatcacggatgacattcctgtggaagaccctactggtttgggggctgctgctggctgtcgctgtcggtctgcccagaaagcggagctag

SEQ ID NO: 110200 - DNA, 1401 bp, Artificial Sequence
  Description of Artificial Sequence: Synthetic coding sequence
atggcattcgtcttgatcctagtgctgagcttctacgaattagttagcgggcaatggcaggtgacaggtccaggcaaattcgtgcaggcactcgtgggtgaggatgctgtattcagttgttccctattccccgaaacaagcgctgaggccatggaggtgcggttttttagaaatcagtttcacgccgtggtccacctatacagggacggggaggattgggagtctaaacagatgccgcagtataggggcaggactgagtttgttaaggactccattgccggcggtagagtctcactgaggttgaaaaacatcactcctagtgacatcggactatatggctgctggttctcgagtcagatatacgatgaggaagcaacatgggagctccgggtggccgcactcggctctcttcccctcattagtatagtagggtacgtggacgggggaatccaactgttgtgccttagttctggttggttccctcagcccacggccaagtggaaggggccacagggacaagacctctcatcagatagcagagccaacgctgatggatactctctgtatgacgtggaaatctcaattatcgtacaggagaatgccggctctatcctatgtagcattcatctcgccgagcagtcgcatgaagtagagtcaaaagtcttgattggagagaccttctttcagcccagtccatggcggctcgccagtatccttttggggcttttgtgtggggcactgtgcggcgttgtgatgggcatgataatcgtcttctttaaatcaaagggaaagatacaagcggagctcgactggcgccggaagcacgggcaagccgagttacgcgacgcgcgcaagcacgcagtcgaagtgaccctcgaccccgaaactgcacacccaaagctgtgtgtctccgacctgaagactgtcacacatcggaaagcccctcaagaggtgcctcactctgagaaacggttcacccgcaagtcagtggtcgcctctcagggatttcaagcaggtaaacactattgggaagtagatgttggacaaaacgtgggttggtatgtcggggtctgtagggacgatgttgatcgcggcaaaaacaatgttacgctgtccccgaataatgggtattgggttctcaggctgactacagagcatctatattttacctttaatccgcacttcatatccctcccgccgtcaactcccccaacacgagtaggagtgttcctggactatgagggaggcaccatttctttcttcaacacgaacgaccagagcttaatttataccctcctgacatgccagttcgagggtctgctgcggccatatatccagcacgcaatgtatgacgaggaaaagggcactcctatatttatttgtccagtatcctggggttag

SEQ ID NO: 110201 - DNA, 1299 bp, Artificial Sequence
  Description of Artificial Sequence: Synthetic coding sequence
atggcatttgttctgatccttgtactatcattctacgaactggtgagcggacaatggcaggttactggccccgggaaatttgtacaggccctggtcggcgaggacgcagttttttcatgctctctttttccagagacgtccgccgaagctatggaggtgcgctttttccgtaatcagttccacgccgttgttcatctctatcgcgacggcgaggattgggaatccaaacagatgcctcagtatagaggtcgaacagagttcgtcaaggatagcatcgccgggggccgagtcagtctccgactcaaaaatattacaccctctgacattggcctctatggctgctggttctcgagtcaaatatatgatgaagaggctacctgggaactgcgggtcgccgcactagggtcgctccctcttatcagtattgtgggctatgttgacggcggaatccagctgctgtgcttgtcgagcgtccaaccatccccctggcgcctggcctcaatcctgctgggactgctgtgcggcgctctgtgtggggtcgtcatgggcatgatcattgtattctttaaaagtaaaggtaagatccaagctgagctggggatgtgccacgttctttcccttccacacatggtgctgcctggcccgagcctgattcattctctaagcctctggaccactctggcagccggctggacggggagcacagactggcgcaggaagcatggacaagccgagcttcgggacgcgcgtaagcatgcggtagaagtcactctggacccggagactgctcaccctaagctgtgcgtctcagatctgaaaaccgtgacacatcgaaaggccccacaggaagtgccgcactccgagaagcgattcaccagaaaaagcgtggttgcatcacaggggttccaagcaggcaagcattactgggaggtggacgtgggtcagaacgtggggtggtatgtgggcgtctgtcgggatgatgttgacaggggaaagaacaacgtgaccctctcgcccaacaacggatactgggtgctccggttgactacagagcatctgtactttaccttcaacccacatttcataagtctcccccctagcacacctcctacgcgcgtgggcgtcttcttagattatgaaggcggtactatttcatttttcaacactaacgaccagagtctgatctatactttgctgacttgtcagttcgaggggctgttgaggccatatatccagcacgctatgtacgacgaggagaagggtacacccattttcatttgcccagtgtcctggggctag

SEQ ID NO: 110202 - DNA, 1809 bp, Artificial Sequence
  Description of Artificial Sequence: Synthetic coding sequence
atgcacagtaaggtcactatcatctgtatacggtttcttttctggttcttgctactgtgcatgcttattggcaagtcccatacagaagatgacattataatcgctaccaaaaatggtaaggtccgaggaatgaatctgaccgtcttcggagggacggtgaccgcctttctcggaatcccatatgctcagccccctttaggaaggctgagatttaagaagccccagtccctcactaagtggagcgatatttggaatgcaaccaaatacgccaactcatgttgtcagaacatcgatcagtcatttcccgggttccacggaagtgaaatgtggaatccgaacaccgatttgtccgaagactgcttgtacctgaacgtgtggatcccggcgcccaaacccaagaacgcaacagtacttatttggatatacggcggtggcttccagaccggaacctcctccctgcatgtgtacgatgggaagttcctcgcacgggtggagagggtcatagtggtgtctatgaattaccgagtgggcgctcttggattcctcgctctgcccggtaaccctgaggctccgggaaatatgggcctctttgaccagcaactagctctgcagtgggttcagaagaacatcgctgctttcggcggcaatccaaagtctgtgaccctgttcggagagagcgctggagcagcatctgtcagcctccacctgctgtcccccggatcgcatagtctgtttactcgggctatcttgcagtctgggtcctttaacgcgccctgggcagtgacttccttgtacgaagccagaaaccgaacgctgaacctggccaagttgactggttgttcccgggaaaacgagactgaaattatcaagtgcctgcgcaacaaggatccacaggagattctcctcaacgaagccttcgtcgtaccctacggaacgccactttccgtgaactttggaccaaccgttgacggagacttccttacagacatgcctgacatactgttggagctcggccaattcaaaaaaacacaaattctagtaggcgtcaacaaagacgagggcacagcatttctggtttatggggcacctgggtttagcaaggataataactcaatcatcacaaggaaagaatttcaggaaggactcaaaattttttttcccggcgtgtcggagtttgggaaagaatcaatactcttccactataccgactgggttgacgatcaacggcctgagaattaccgagaagccctcggtgacgtggttggagactacaatttcatttgccccgccctagaatttacaaagaaatttagcgaatggggtaataacgcgtttttctattatttcgagcaccggtcaagcaaattgccttggccggaatggatgggcgttatgcacgggtacgagattgaattcgttttcggattgcctctggagaggcgcgataattacacgaaggcggaagaaatattgagtagatctatcgtcaagcgatgggctaactttgctaagtatggcaatcccaatgaaacacagaataatagcacttcatggcctgtgttcaagtctactgaacagaagtacctcacactcaatacagagagcactcgcataatgaccaagttgcgggctcagcagtgtaggttttggaccagcttttttcccaaggtactggagatgacaggaaacattgatgaagcggagtgggaatggaaggccgggttccatcgctggaacaattatatgatggactggaagaaccagtttaacgactacacatctaaaaaggagtcttgcgtcggcctgtag

SEQ ID NO: 110203 - DNA, 399 bp, Artificial Sequence
  Description of Artificial Sequence: Synthetic coding sequence
gcggtacagtttaccggttggtcttcctcttgcattctccacttcccagaagtgctccacgactttcattcactgcagactctcccatctttgttgcagcgaattggaaacccaaacgaaacacaaaataattcaaccagctggccagttttcaaatctacagaacagaaatatctgaccctgaacaccgagtccactcgtatcatgaccaaactgcgtgcgcaacagtgccgattctggacatcattttttccaaaagtactggagatgaccgggaacatcgatgaggccgagtgggaatggaaagcagggtttcatcgctggaacaactacatgatggactggaagaatcaattcaatgattacacttccaagaaagagtcgtgcgtcggactctag

SEQ ID NO: 110204 - DNA, 195 bp, Artificial Sequence
  Description of Artificial Sequence: Synthetic coding sequence
atgaccaaactcagagctcaacagtgccggttctggacgagctttttccccaaggtgctggagatgacaggcaacattgacgaagccgaatgggagtggaaggcggggttccaccgatggaacaattatatgatggactggaagaatcagtttaatgattatacttccaaaaaggagtcttgcgtggggctgtag

SEQ ID NO: 110205 - DNA, 1431 bp, Artificial Sequence
  Description of Artificial Sequence: Synthetic coding sequence
atggctagtcggatagggctgcggatgcagctcatgcgggaacaggcccagcaggaggaacagcgcgaacgcatgcagcagcaggctgtcatgcactacatgcagcagcagcagcaacagcaacagcagcaactgggtgggccccctacacccgcgataaacacaccagtgcacttccaatcgcctccccctgtcccaggcgaggtcctcaaggtccagagctatctcgagaaccccaccagctatcatttgcagcagagtcagcaccagaaagtcagagagtacctgtcagaaacctatggaaacaagtttgccgcacatatctcgcccgcccaaggctctccaaagcctccccccgccgcctctcccggcgtgagggctgggcacgtactcagttcaagtgcaggcaactcggctcctaactcccccatggccatgcttcatatcggtagtaatcccgaacgcgagctggatgacgtgatagacaatatcatgaggctggatgatgtgctggggtacataaatcccgaaatgcagatgcccaacacgctccctctctcttcctcccacttgaacgtgtactctagcgatccacaggtgacagcttccctggtcggcgtgaccagtagcagctgcccggcagatttgacacagaaacgggaactgaccgacgccgaatcccgggccttggctaaagaaagacagaagaaagacaatcacaacctaattgaaaggcggcgaaggtttaacattaacgaccggataaaggagttggggatgcttatccccaaggcaaacgatctggacgtccggtggaataagggtaccattctcaaagcatccgtggattatatcagaagaatgcagaaggacttacagaagagccgcgagctggaaaaccattcacgccgcctcgaaatgacgaataagcaactgtggcttagaatccaggaactggaaatgcaagcgagggtccacgggcttcccacaacatccccgagtgggatgaatatggctgagcttgctcagcaggtagttaagcaggagctcccctccgaggagggcccgggagaggcactgatgctgggcgctgaggtgcctgaccccgagcctctgccagccctgcctcctcaggctcccctgcctctccctacacagccaccgagcccttttcatcacttagattttagccactctctctcatttggcggacgcgaggacgaaggaccacccggttacccagagcccctcgcgccaggccatggcagcccattcccatctttgtctaaaaaggatcttgatctgatgctcctggatgatagccttctccctcttgcaagtgatcccctcctgtcaaccatgtctcccgaagcttccaaagcaagcagccgtaggagcagtttttctatggaggaaggcgacgttctctag

SEQ ID NO: 110206 - DNA, 426 bp, Artificial Sequence
  Description of Artificial Sequence: Synthetic coding sequence
atggccggtgaggagatcaatgaggactatcccgtagagattcacgaatacctgtccgcttttgagaatagcataggcgccgtcgatgaaatgctgaagactatgatgtcagttagccgcaatgagctgctgcaaaagttggaccctttggagcaggccaaagtcgacttggtatccgcatacaccctcaattctatgttttgggtgtacctggccacgcagggggtgaacccaaaagagcatcctgtgaaacaggaactggagcgaattcgagtctatatgaatagagtgaaggaaatcacagacaagaagaaagcgggaaagctggatagaggcgccgcatcaagattcgtgaagaatgcgctctgggagccgaaatccaagaatgcatctaaagtggctaacaaaggtaaaagcaagagctag

SEQ ID NO: 110207 - DNA, 543 bp, Artificial Sequence
  Description of Artificial Sequence: Synthetic coding sequence
atgcccagcccgagcgtgtcaacatccgcagccagcgtgcttgaaggggtttgtggacgagcaagatccacataccggacgccagaagagggcgaggaacagagttggagcgccatcatggctggcgaggagattaacgaagactatccggtggaaatccacgaatatctgagcgctttcgagaacagcattggcgctgttgacgaaatgctgaagactatgatgagcgtaagtcgaaatgaacttctgcagaagctggatccgttagagcaggcaaaagtagacttagtctcagcctacaccctcaattctatgttttgggtgtacttggcgacccagggcgtcaatccgaaggagcatccagtgaagcaggagctggagaggatccgcgtgtacatgaatcgtgtgaaggagatcacagataaaaaaaaggctgggaaactcgatcggggcgccgcgagccggtttgtcaaaaatgcgctgtgggagccaaaaagtaaaaacgctagcaaagtggccaacaaaggcaagagtaaatcctag

SEQ ID NO: 110208 - DNA, 426 bp, Artificial Sequence
  Description of Artificial Sequence: Synthetic coding sequence
atggcaggcgaagagataaacgaggattatcccgttgagatccatgaatatctcagcgcattcgaaaattctatcggtgccgtggacgagatgttaaaaaccatgatgagtgtgtcacggaatgagctgctgcagaagctggatcccttggaacaggcaaaggtggatctggtatccgcctacactctgaacagcatgttttgggtatacctagctactcagggagtaaatcctaaagaacacccggtcaaacaggaattggagcgcatccgtgtgtatatgaatcgtgtgaaggagataactgacaaaaaaaaggccgggaagttggataggggcgccgctagccgtttcgttaagaacgccctatgggagccgaaatccaagaatgcctctaaagtcgctaataaaggaaagtccaagtcctag

SEQ ID NO: 110209 - DNA, 426 bp, Artificial Sequence
  Description of Artificial Sequence: Synthetic coding sequence
atggcgggcgaggagatcaacgaagattatcccgtcgagatccacgagtacctgtctgcttttgaaaatagcattggcgctgtggatgagatgctgaagaccatgatgagtgtatccaggaatgagctcctgcagaaactagatcccctagaacaggcgaaggtggacctggtgtctgcgtatacacttaattctatgttttgggtttatctcgctactcagggggtcaatcccaaggagcaccccgtgaaacaggaattggaaagaatacgagtctacatgaaccgagtgaaggaaattacggacaagaaaaaggccgggaaactggatagaggcgccgcgagcaggtttgtgaaaaacgcactgtgggagcccaagtccaaaaacgcctctaaggtggctaataagggtaagtccaagtcatag

SEQ ID NO: 110210 - DNA, 957 bp, Artificial Sequence
  Description of Artificial Sequence: Synthetic coding sequence
atgctgagtgaaagttcatcttttctgaaaggcgtcatgctggggagcattttctgcgctctcatcacaatgctggggcatattcgaatcgggcacggcaaccgcatgcaccaccatgaacaccaccatctccaagctcccaataaggaagacatcctgaaaatttccgaagatgagcggatggaactaagtaaatcttttagggtgtactgtatcatcttagtcaagccgaaggacgtctcactgtgggcggctgtgaaggaaacatggaccaaacattgcgataaggccgaatttttttcatctgagaacgtgaaagtctttgagtcaatcaacatggacacaaatgatatgtggctgatgatgcgcaaggcatataagtatgcatttgataaatatagagaccaatacaactggttcttcttagcaaggccgacgacgttcgccattatagagaatctgaagtactttctgctgaagaaggacccatctcagcccttctatctgggacatactataaagtcaggcgacctcgagtatgttggcatggagggcggcatagtgctgtcagtggaatcaatgaaacggttgaattcgctactcaacatccccgagaaatgtcccgagcagggaggaatgatttggaagatttcagaggataagcagctagcagtgtgtctcaagtacgccggcgtcttcgcagagaacgcagaagacgcagatggcaaagacgtattcaacacaaagagcgtaggactgagtatcaaggaagccatgacctaccaccccaaccaggtggtagagggctgttgttcagacatggccgtgacattcaatggcctgacaccaaaccagatgcacgtgatgatgtacggcgtgtacagattgcgcgcttttggacatatattcaacgacgcacttgtgtttctgccacccaatggatccgacaacgattag

SEQ ID NO: 110211 - DNA, 957 bp, Artificial Sequence
  Description of Artificial Sequence: Synthetic coding sequence
atgctttctgagtcatcatctttcttgaagggagtcatgctgggcagtatattctgcgccttgataacaatgctgggccatatccggattggacatggcaaccgtatgcaccaccatgaacatcatcacctgcaggccccaaacaaagaggatatcctgaagatttctgaggacgagcggatggagctttcaaaaagtttcagggtgtactgtattattctggtaaaaccaaaggacgtatcgctttgggcagccgtgaaagaaacctggacgaaacactgcgataaagccgaattttttagttctgagaacgtcaaagtgtttgaaagcatcaacatggacaccaatgacatgtggctgatgatgcgaaaagcctacaagtatgcattcgacaagtatcgcgaccagtacaattggttttttttagccagacctacaactttcgcgattattgaaaacctgaaatatttcctacttaaaaaggacccttctcaaccattctatctgggacacaccattaagtcaggagacctcgaatatgtcgggatggagggaggaatcgtcctcagcgtggagtctatgaagaggcttaattctctgcttaacatccctgaaaaatgccctgaacagggcgggatgatttggaaaatttctgaggataagcaactggctgtgtgtctgaaatacgctggtgtctttgctgagaacgctgaggatgctgacggtaaagacgttttcaataccaagtccgttggcctttcaatcaaagaggctatgacttatcaccccaaccaggtggtggagggctgttgctcagacatggctgtaacattcaatggactgacgcccaatcagatgcacgtgatgatgtacggtgtttacagacttagggctttcgggcatattttcaacgacgccctggtcttccttccaccaaacgggagtgacaacgactag

SEQ ID NO: 110212 - DNA, 732 bp, Artificial Sequence
  Description of Artificial Sequence: Synthetic coding sequence
atgagacctttattggtactgctcctcctcggcctcgcagcaggcagccctcctcttgatgacaacaagatcccttctctgtgtccgggccaccctggcctgcccgggacccccgggcatcatggatctcaaggactgcccggacgagatggcagagatggaagggatggcgccccgggagctccaggggaaaagggggaaggcggaaggcctggacttcccgggccacggggcgaccctggcccccggggagaggctggaccagccggaccgaccgggccagccggcgagtgttccgtcccccctcgttcagctttttctgctaaacgcagtgagtcccgtgtgccaccacccagcgacgctccattaccgtttgacagagtcctggtgaacgagcagggacattatgacgccgtcaccggtaaattcacatgccaagtgccaggagtatactacttcgctgtgcatgcaaccgtgtacagagctagtctgcagtttgatctcgtgaagaatggcgagagtatagcctcttttttccagttcttcggtggatggccaaaacctgcttccctttccgggggcgctatggttaggttggagccagaggaccaagtgtgggtccaggtgggagtgggggattatatcgggatttatgccagtatcaagactgactctacctttagtggcttccttgtgtattccgactggcattcaagtcccgtctttgcgtag

SEQ ID NO: 110213 - DNA, 732 bp, Artificial Sequence
  Description of Artificial Sequence: Synthetic coding sequence
atgcgccctttactcgtactcctcctcctggggctggccgccggcagccctccactagacgacaacaagatcccatccctgtgcccagggcaccccggtctgcccggaactcccggccaccatggcagtcaagggctaccagggcgggacggtcgagatggcagggacggagcccctggagcaccaggagagaaaggcgaggggggaaggcccggactgcccggcccccgtggtgatcctggcccccggggtgaagcaggaccagccgggcccacgggtcccgctggggagtgttctgtacctcccagatctgccttttcagctaaacgctctgaatctcgcgtgccccctccatccgacgccccattgccatttgacagggtgttggtcaatgagcaagggcattacgacgccgtgactggcaagttcacttgccaagtgccaggcgtctattactttgcagtccatgcaacggtctaccgggcgagtctgcagttcgatctggtgaagaatggcgaatccattgcttctttcttccagttttttggcggatggccaaaacccgcctccctctctggtggcgcgatggtgagacttgagcctgaagatcaggtttgggtgcaggtgggcgttggtgactacataggaatttacgcttcaattaaaaccgatagcacgttcagtgggtttctggtgtactcggactggcactcaagtcccgtgttcgcttag

SEQ ID NO: 110214 - DNA, 759 bp, Artificial Sequence
  Description of Artificial Sequence: Synthetic coding sequence
atggccgcccccgctttgctgcttcttgccttgttgctccctgtcggagcatggccaggcctcccgcgccgaccatgtgtgcactgctgtagaccagcctggcccccaggaccttatgccagggtctccgacagagacctctggaggggggatctgtggagaggcctgcccagagtaagacccaccattgacattgagattttaaagggcgaaaaaggcgaggcgggcgtgaggggccgcgccggccggtcagggaaagaagggccgccaggggcacgagggctgcagggtcggcgcggtcaaaaaggtcaagtgggccctccaggcgccgcttgtagacgcgcttatgcggctttctctgtgggcaggcgcgagggattgcactccagcgatcactttcaggccgtgcctttcgacaccgagttggtcaatcttgacggtgcgttcgaccttgcagccggaagattcctgtgcacggtgccgggagtgtactttttgtcgctcaatgtccacacatggaattacaaggagacctatcttcatattatgttgaaccgcaggccagctgccgtgctgtatgctcagcccagcgagagatccgtgatgcaagctcagtcgttgatgctcctgctagccgctggggatgccgtttgggttaggatgttccaacgggatcgggataacgcaatatatggcgagcacggcgatctctacatcaccttctctggccaccttgtcaaaccagccgctgaactttag

SEQ ID NO: 110215 - DNA, 1002 bp, Artificial Sequence
  Description of Artificial Sequence: Synthetic coding sequence
atgcggatttggtggttgcttctggctattgagatttgtaccggcaatatcaatagccaggatacctgtcggcagggccacccaggaattccaggaaacccggggcacaacggactgccgggcagagatggtagggacggagctaagggtgacaagggcgacgcaggggagcccgggagacccggatccccaggtaaggacggaacgagcggtgagaagggagagcggggggcagacgggaaggtcgaggccaaaggcatcaaaggtgaccagggcagccgaggcagtcccgggaagcacggccctaagggtctcgccggaccaatgggagaaaaggggctgcggggagagacagggccacaggggcaaaagggaaacaaaggggacgttggcccgaccggacctgagggtccacgtgggaacatcgggccattggggcctaccggtctgccaggtccaatgggcccaattgggaaacccggtcctaagggtgaagctggaccaactggcccgcagggagaacccggcgtccggggaatcagaggatggaagggagacaggggagaaaaaggaaaaattggagaaacgttagtgctacctaagtcagccttcaccgtgggtttaaccgtcctctcaaaattcccatcgtccgacatgccaataaagttcgacaaaatcctctataacgaatttaaccactacgacaccgctgcaggaaagttcacttgtcatatagcaggtgtgtattatttcacctaccatattacggtgttctctcgaaacgtacaggtgagcctcgtcaagaatggggtcaaaattcttcacaccaaagatgcatacatgtcaagcgaggaccaggcatcagggggcatcgtcctacaacttaagctcggagatgaggtttggctacaggtaaccggcggagagcgttttaacggcttgtttgccgatgaggatgatgatactacgtttacggggttcctcctgttcagcagcccttag

SEQ ID NO: 110216 - DNA, 1002 bp, Artificial Sequence
  Description of Artificial Sequence: Synthetic coding sequence
atgcgtatctggtggttacttctcgctatcgagatctgcactgggaacataaactcacaggatacgtgtcgacaagggcatcctggcatccctggaaatccagggcataatggtttaccaggcagggacggcagagacggagctaagggcgataagggagacgcaggcgaacctgggcgccccggtagtcccggaaaggacggaacttctggtgagaaaggcgaaaggggcgccgacggcaaggttgaggccaaggggatcaaaggcgaccaaggtagccgcggttcgccaggaaaacatggacccaaaggcctggctggccctatgggagagaaagggttaagaggggaaactgggcctcagggtcagaagggaaacaagggagacgtgggtcccactggtcccgagggaccccgcggcaatatcggaccattgggcccaacaggcctgcccggcccaatgggacctatcggcaagccaggccccaagggcgaagcagggccaactggtcctcagggggagccaggagtccggggaatcagggggtggaagggagatagaggcgaaaaagggaaaatcggagaaaccctggtgctgccgaagagtgcttttaccgtgggcctaaccgtcctgtctaagtttccctcaagcgatatgcctatcaaatttgacaagatactgtacaacgagtttaatcactatgatacagccgccggaaagttcacctgccacattgccggtgtatattactttacgtaccatattacagtgttctccagaaatgtgcaggtgagtttggtgaagaatggcgtgaaaattctgcatacaaaggatgcctatatgtcctctgaagatcaggccagcggaggcattgtgctgcagttgaaactaggggacgaggtgtggctgcaggtaacaggtggagaaagatttaatggtctcttcgccgacgaagacgacgatactacctttacaggattcctcctattctcctccccctag

SEQ ID NO: 110217 - DNA, 300 bp, Artificial Sequence
  Description of Artificial Sequence: Synthetic coding sequence
atgaggatctggtggttgctgcttgctatagagatctgtacagggaatatcaactcacaagatacttgccgccagggccatcctggcatccctggcaacccaggccataatggcttaccaggacgcgacgggcgtgatggcgcaaaaggggataaaggtgatgctggcgagcccggttgcccagggtcccctggcaaggacggcacaagtggcgaaaaaggagagcgcggcgctgatggcaaggtagaggccaagggtattaagggaatgttccgctgcctctggagcaaaacagaatag

SEQ ID NO: 110218 - DNA, 1002 bp, Artificial Sequence
  Description of Artificial Sequence: Synthetic coding sequence
atgaggatctggtggctcttgctcgcaattgaaatctgtaccggcaatatcaacagtcaagacacatgcagacagggacaccctggtattccaggcaatcctggacataacggactgcctgggcgggacgggagagatggcgccaaaggcgacaaaggggacgctggagagccgggatgtccaggatccccgggtaaggatggaacgtctggcgagaagggcgaacggggtgccgatggcaaagttgaagcaaaggggatcaagggcgatcagggctcccgagggtctccaggcaagcatggccctaagggcttggctgggcccatgggggagaagggtctaaggggcgagaccggcccacagggccaaaaaggcaataaaggcgatgtcggacccaccgggcccgagggtccaaggggaaacattggtccactgggaccgaccggcctgccagggccaatgggtcccatcgggaagccaggccctaagggagaggccggcccaacgggaccccaaggggaaccaggagtcagagggattcggggatggaaaggagatcgtggagagaaagggaaaattggagagactctagtactacctaaatcagccttcactgtcggcttgacggtgttaagcaaattcccctcttccgacgtgcctataaaatttgacaaaattttatacaacgagttcaaccattatgatacagcggtggggaagtttacttgtcatatcgcgggtgtgtactacttcacttatcacatcaccgttttttctcggaatgtgcaagtctccctcgtgaagaatggcgtgaagattttacacacgcgcgatgcatacgtgagctccgaagatcaagcttccgggtctattgtactgcaactcaagttgggcgacgagatgtggctacaagtgacgggcggcgaaagattcaatggactctttgctgatgaggacgacgatactacattcactgggttccttctcttctcttctcagtag

SEQ ID NO: 110219 - DNA, 1002 bp, Artificial Sequence
  Description of Artificial Sequence: Synthetic coding sequence
atgaggatctggtggcttctgctcgcaatcgaaatttgcactggaaacattaatagtcaagatacttgccgccagggccatcccggaattcctggcaaccccgggcataacggcttaccaggtagggatggcagggatggtgcaaaaggcgataagggagatgccggcgaacctggttgccctgggtctcctgggaaagatggaaccagcggtgagaaaggtgagcggggggccgacggaaaggtggaggccaaaggtatcaaaggcgatcaagggtctcgcggtagccctggcaagcatggaccaaagggcctggcagggcccatgggggagaagggtcttcgaggggaaacaggcccacagggtcagaagggcaacaaaggggacgtgggccccacagggccagaagggccgagagggaacattgggcctttaggaccaacagggctgcccggccccatgggtcctattggcaagccaggccccaaaggcgaggctggccctaccggaccccagggtgagccaggcgtgcggggcatacggggctggaaaggcgaccggggcgaaaaaggaaagatcggggaaactcttgtactgccaaagtcagcttttacggtgggcctgaccgtgctgagcaaattcccaagttccgatgttccgatcaagttcgacaaaattctctataatgagttcaatcactacgacaccgccgtgggcaaatttacatgtcacatagctggggtttattacttcacataccatattaccgtgtttagtcgcaacgtccaggtaagtttggtgaagaatggggtgaaaatattacacacccgtgatgcctatgtgtctagtgaggatcaggcctccgggagcattgtgctgcaacttaagttaggcgatgaaatgtggctccaagtgacaggtggagagcgtttcaatggactgtttgccgacgaagacgacgacacgacgtttactggattcctgctcttttcgagccaatag

SEQ ID NO: 110220 - DNA, 150 bp, Artificial Sequence
  Description of Artificial Sequence: Synthetic coding sequence
gttgggcccactgggcccgaagggccgaggggaaacatcggtccactggggcccactggcttgcccggtccgatggggccgattggtaagccaggacctaagggagaagcaggccctactgggccccaggtgtttcccttctgcatctag

SEQ ID NO: 110221 - DNA, 1110 bp, Artificial Sequence
  Description of Artificial Sequence: Synthetic coding sequence
atgtggtgtctggagagactgaggttagggcctgaatgcctgagacgatccggagattggctcctccccggccgggcccgcggcgcgaaaagcaggaccaccgccgcctgtgctaatgtcctgacccccgatcgaataccagaattctgcattccgccgcggctgatgccaaggttggcactggcagcacttcgcaatagctgggtagaggaagctgggatggacgagggagctggcagaaccgactgggacccaaggtctcaggccgctctttccctaccacacttgcctagggtccggaccgcttatgggttctgcgctctgctggagtctcctcatacaaggagaaaggagtccctcctgctcggcggaccacccgccccacgacctcgcgctcacacatacggcgggggaggcggccctgacgcattgctcggcaccctcagggttccccgagccccaggccccgctactccggctgcccccgggtgtccgcgtccgccgcaggacgcccttgcacggagacctaggggctgtcggctcctgcgtgtgcccgatggtctcttgtcaagagcactgcgcgccgggaggagcagacgtctaacccgggtgcgttcagtttccagcggcaacgaggataaagagcgccgtgcgggatctcagtcgcctgctagggcccctagcaccagtcctccaagctctcgagtgccatttccagaaaggctggaggcggagggaacagtcgcacttggcagggcaggcgatgccctaaggctcgctgcagagtactgtcctgggaccggaagacttagactgaggctcttgcgggccgagtctcccgcagggggcgctcctggcccaagagccgtgtcctgtagactatctctagtcctgaggcccccagggaccgctctcagacagtgttcaaccgttgtgggtaggtccagaaaagcctcattcgatcaggacttttgttttgatgggctcagcgaggacgaggtgcgaaggctcgcggttagagtgaaagctagggatgaggggcgagggcgggagcgcggtcgactgctgggtcagggtgagcttagtctcggggcgttgttgttactgtag

SEQ ID NO: 110222 - DNA, 1095 bp, Artificial Sequence
  Description of Artificial Sequence: Synthetic coding sequence
atgcgattattagaaaagctctgtagctcagccgccggctcaagcgcccccaaaccagcctttgccaaggtgcttactcctaatcgcatcccagaattctgcattccaccccggcttccggctccttgcaccctcgaatcacctatccgagccgcagcggtccctcgccggtgcgcagcagagtcagatctctggccaagagccgccgacgaagatgccggccgcaccgattgggacccacgttctcaggccgctcttagtctgcctcaccttccacgcgtccggactacctatggtttttgcgccctgttagagagtccacacaccagacgcaaggagagcttgctgttgggaggtcccccagctcctagaccacgggctcacagctgcggtggaggcgggggacccgatgctccgttgggcacactctgtggtcctagaggcccgggcccagctaccccagcagctccggggggcccacgacttccacaagacgccttggccgccggcccccgtcgctgtaggttgctgcgggtgccagacggacttctcagcagggccttacgagctgggaggtctagaaggctagctagagttcggtcagtaagttccggtaacgaggatgaagaaagaagagccggcagcgaatctccagctcgagcgccaagtagttcgcccctgagcagccgtgcacctctgcctgagcgactcgaagcgaaagggacagtggctttgggaagggctggggatgccctccgactggccgcggagtattgtccggggacgcggagattgcggctccgccttctcagagccgagtctctgttcggcggcgcccctgggcctcgtgcagtccgctgtaggctgagcctcgtgctcaggcccccgggtaccgctcggtggcagtgtagcgccgtggtcgggcgctctagaaaagctagtttcgatcaagacttctgcttcgatggcctgtcagaagacgaagtccggaggctggccgtcagggttaaggcgcgagatgagggcagaggtcgggacagagggagactgctgggtcaaggcgagctcagtttgggggcactcctactgctttag

SEQ ID NO: 110223 - DNA, 1266 bp, Artificial Sequence
  Description of Artificial Sequence: Synthetic coding sequence
atgagaaaaacaaacatgtggtttctggagagactccgaggaagcggggagaacggcgccgctcggggcgtcggtagcgaagcaggcgataaagccagcaagggacccctttattccaacgtcttgactcccgataaaatccccgatttcttcatacccccaaaactgcccagcggtccagcagagggagagggccaggccgctttggggcctagtacgtctgagcagaacttggcatcggctgcacctaggcaaactccccgatccccgagactgccagctaaactagctgcggagagcaaatctcttctgaaggccgccaccagacacgtcatacagatagaatccgccgaggattggctgagcgaggaagccaccgacgccgatccacaggcgcagggcgcaatgtcccttccatccgttccaaaggctcagacttcctatggcttcgcgatgctggcagaaagcccccataccagacgcaaggagtctttgttccattccgagcatggggctcttgcacaggtcgggtcacctggagctgggaggaggcgagccgccgccaaggctaatgggggcgacggaggaccccgagaagccggtggtgccttgatgtcacctgggcggtatttctccgggggtgagagcgacaccgggtcaagtgctgagagttccccgttcgggagccccctgctaagtcgatccgtctcgttgcttaaagggtttgctcaggactcccaggccaaggtgtcgcagctcagacactccgtcgggcgtcacggttcacttagtgcagacgattcaacgccagacgcttctcctggtagccggaggagacttactagaagggccccacctgagcctgggcccgaatccggccaggcgaggggcgagcataccgtgcacgtaggacctcgcgggagtgtccgtctcctggccgagtacgaagcggggcaggcacggctgagggtgcacttgcttgccgcagaagggctttatgacaggctttgtgatgctagatccataaactgctgtgtgggcttatgcttggttcccggaaagctccaaaagcagcgcagcaccatagtcaagaacagccggaggccagtcttcaatgaagacttcttttttgacggtttaggtccagcaagtgtgagaaagctagctcttagaattaaagtcgtcaataaggggagctctctcaagagggataccctgctgggtgaaaaggaactgcctttgaccagtctgctccccttcctgtag

SEQ ID NO: 110224 - DNA, 3945 bp, Artificial Sequence
  Description of Artificial Sequence: Synthetic coding sequence
atgttggatccttcctcctctgaggaagaaagtgacgagattgttgaagaggagagcggcaaggaagtcttggggagcgcaccttcgggtgctcgcttgagtccctctcgcacaagtgaaggaagcgccggatcggccggcctagggggcggcggtgcaggggccggggcaggtgtcggtgccggcggggggggtggctccggggcctccagcggcggtggcgcaggtggcttgcagccttcctccagagccggtgggggtaggcccagctcaccatcaccgagtgtagtgtcagagaaagaaaaggaggagctggaacgccttcaaaaagaagaggaagaaaggaagaaacgtttacaactgtatgtgttcgtcatgcggtgcattgcatatccgttcaatgccaaacaacccaccgacatggcacgccggcagcaaaagatcagcaaacaacagctgcagacagtcaaggatcgatttcaagcgttcctgaacggtgagacacaaattatggcagacgaggcctttatgaatgccgtgcaaagctattacgaggtattcctgaaatccgacagggtcgccaggatggtccagtcaggcggctgtagcgccaatgattctcgagaggtgtttaagaagcacatagagaagcgggtccgcagtctgcccgagattgacgggctgagcaaggaaaccgtgctaagcagctggatggcaaagtttgacgcaatctatagaggggaagaagatcctcgaaaacagcaggcacgcatgactgcgagtgccgcaagcgagctgatcctatcaaaagagcaattatatgaaatgtttcaaaacatcctgggaattaagaagttcgaacatcagttgctctataatgcttgccagctggacaacccggacgaacaggccgcacagattagacgggaactagacggcagattacaaatggccgatcagatagcccgcgagaggaagtttcccaagtttgttagcaaagaaatggagaatatgtatatcgaagaactcaaatcatctgttaatctgcttatggccaacctggagtctatgccagtctcaaagggtggcgagttcaaactgcaaaagctgaagaggagccacaacgctagtattattgatatgggtgaggaatctgagaaccagctgtccaagagcgacgttgtgctgtccttctccttggaggtggtaatcatggaggtccagggtctgaagtcactggcccccaataggatcgtctattgcactatggaggtggaaggaggcgagaaactgcagactgaccaagctgaggcttccaagcctacctgggggacacaaggtgacttctctacaacacatgccctccctgctgtgaaagtgaagctcttcacagaatcaactggcgtgctcgctctagaggataaggagctggggagagttattctgcatccaactcccaactctccaaagcagtctgagtggcacaaaatgacagttagtaaaaactgccctgaccaggatctgaagatcaaactggctgttcgcatggacaaaccccagaatatgaaacactcggggtatctgtgggcgatcggcaagaacgtctggaagcgctggaaaaagcggtttttcgttctggtgcaagtgtcacagtatactttcgcgatgtgtagttatagggagaagaaggcagaaccccaggaactgctgcagctggacgggtacaccgtagattacactgaccctcagcctggcctggaggggggacgagcgttctttaacgccgttaaggagggagatacggtaatcttcgcatccgacgacgaacaggacagaattctctgggttcaggccatgtacagagcaacagggcagagccataagccagtcccacccactcaagtacagaaattaaacgcgaaggggggaaacgtgccccagctcgacgctcccatctcccagttttacgctgaccgggcccaaaaacacggcatggatgaatttatttcatctaacccttgtaatttcgaccatgcttctctgtttgagatggtccagcgtctaacgctcgatcaccggctgaacgactcctactcttgcctaggatggttctccccaggccaagtttttgttttggacgagtactgcgctagaaatggggttaggggatgtcacagacatctttgttacctccgcgacttgctggaacgggcggagaacggggcaatgattgatcccaccctactgcactatagtttcgccttttgtgccagccatgtccacggtaataggccagacgggatcggtaccgtgactgtggaggagaaagagcgcttcgaggagatcaaggagagactgcgtgtgttgctggaaaaccagattacacactttcgatactgctttccatttggacgtcctgaaggcgctctgaaagccacactatcgctcctggagcgggtactcatgaaagacatcgtgactccagtccctcaagaggaagtcaagacagtcatacgaaagtgcctggaacaggcagctctggtaaactatagtaggctgtccgagtatgctaagattgagggcaaaaagcgcgagatgtacgagcacccagtgttctgtttagctagccaggttatggacctgacgattcaaaatgtgggcaggttgattacaccagctaaaaaacttgaagatacaatacgactcgccgaactcgtcatagaagtcctccagcaaaatgaagagcatcacgccgaggcttttgcttggtggtcagacctgatggtggaacatgctgagactttcctgagtctgttcgccgtggatatggatgctgctctcgaagttcaaccacctgacacgtgggatagtttcccattgttccaactcttaaatgactttctcaggaccgattacaatctatgcaatggcaagttccacaaacacctgcaagacctatttgctcctctcgtcgttcgatacgtggacctcatggaatcatctatcgctcagagcatccatcgtggatttgagcgagaaagttgggagcctgtcaataacggatccggcacatctgaggacctcttttggaagctggacgccctccagacatttatcagagatctgcactggcccgaggaggaattcgggaagcatctggagcagcgtctgaaattgatggcttccgacatgattgagtcctgcgttaagaggaccagaattgcttttgaagtcaaactgcagaaaacctctcggagcacggatttccgggtgcctcagtcgatttgcactatgttcaacgtcatggtggatgcaaaagcgcaatcaactaaactgtgctctatggagatgggccaggagcaccaataccatagtaagattgatgagctgatcgaagaaaccgtgaaagagatgataactttactagtagcaaaatttgttaccatcctggaaggcgtcctcgccaagctcagtaggtacgacgaaggtactctgttcagcagcttcctttcttttactgtgaaagctgcttctaaatatgtagatgtgccaaagccaggaatggacgttgccgatgcatatgtcactttcgtccgccactcgcaggacgtactgcgggacaaagtgaacgaggaaatgtacatcgaacgcctcttcgaccagtggtacaattcgtccatgaatgtgatttgcacttggctgactgaccgcatggacttgcagctccacatctaccagctaaaaacattgatcaggatggtcaagaaaacctatcgagattttaggctacaaggtgttcttgactctactcttaacagcaaaacgtacgagacgattcggaaccggctgactgtagaggaggcaacagccagcgtcagcgaaggcggtggcctccaggggatctcaatgaaggactccgacgaagaggacgaggaggacgactag

SEQ ID NO: 110225 - DNA, 3825 bp, Artificial Sequence
  Description of Artificial Sequence: Synthetic coding sequence
atgctagacccgagttcatctgaggaagagtcggacgagattgttgaagaggagtcaggcaaggaggtactgggatcagcacccagcggtgccaggctaagtccttcgagaacaagtgagggcagtgctggctccgctggtttgggcggcggaggcgccggagctggagccggggtgggtgccggtgggggcggagggtcgggagcatctagcggaggaggagccggcggcctacaaccaagttccagggccggtggaggacgtcctagtagtcccagtccttctgtcgtctcagaaaaagagaaagaagagctggaacgtctccaaaaggaggaagaggagaggaagaagaggctgcagttgtacgtgttcgtgatgcgctgtatcgcctaccccttcaacgctaagcaacccacagatatggcccggcgacagcaaaagatcagcaaacagcaactccagactgtaaaagataggttccaggctttcctcaatggtgagactcagatcatggctgacgaggctttcatgaacgccgtgcagagctattacgaagtcttcctgaaatcggatcgggttgcaaggatggtgcagtccggcggatgctcagcaaacgactctcgtgaagtgttcaaaaaacacatcgaaaagcgagtacggagcctgccagaaatagacggccttagtaaggaaaccgttctctcatcttggatggctaaattcgatgctatatatcggggcgaagaggatcctagaaagcagcaagcccgcatgactgcttcagccgcatccgaactgatcctgtcaaaggaacaactatacgagatgttccaaaacattctggggattaagaagtttgaacatcaactcttgtataatgcgtgtcagctggacaaccctgacgagcaggccgcccagattagacgggagcttgacggacgtctgcagatggccgatcaaatcgctcgggaaagaaagtttccaaagttcgtcagtaaggaaatggaaaatatgtatattgaggaacttaagtccagcgtcaaccttctgatggccaatcttgagagtatgcctgtctccaagggcggggagttcaagctccagaaattgaagcggagccacaatgcttcaattattgacatgggcgaggaatctgaaaatcaattatccaaaagcgacgtggtcctttcattctcgctcgaagtcgtaataatggaagttcagggcctgaagagtctcgcaccaaaccgcatagtgtattgcacaatggaagttgagggtggcgagaagttgcagacagaccaggctgaagcaagcaagcctacctgggggacgcaaggggacttttctaccacgcatgcactgcctgcggtgaaggttaaacttttcacagagagcacgggcgttctggcactggaggataaagaacttgggcgggttatcctgcatccgaccccaaatagccccaagcagtccgagtggcacaaaatgacagtgtccaagaattgccctgaccaggaccttaaaatcaaactggcggtccggatggacaaaccccagaacatgaagcattccggttacctctgggccattggtaagaacgtatggaagcgctggaaaaagagatttttcgtgttagttcaggtaagccagtatacttttgctatgtgtagttacagagaaaaaaaagccgaaccccaagagcttctgcagctcgacggatataccgtggactacaccgatccacagccaggcctagaaggggggcgcgctttttttaacgccgtcaaagaaggggacaccgtcatatttgcatctgatgacgaacaggataggatcctgtgggtgcaggccatgtatcgggcgacaggccagagccacaaaccagttcctccaacccaggtgcagaagctgaacgccaaaggggggaacgtgcctcagctagacgctcccatttcccaattttacgcggacagggcccagaaacacggcatggacgaattcatctcaagtaatccctgcaattttgatcacgcatctcttttcgaaatgggatggttctctcccggccaggtgtttgtgttagacgaatattgtgcaaggaatggcgtgcgcggatgccatagacacttgtgttatctgcgtgaccttttggagagagcggaaaacggagctatgatagatccgaccctcttgcattattcatttgccttttgtgcaagccacgtacacggaaaccgccctgacggcattggaaccgttacagtagaggagaaagaacgctttgaagaaattaaggagaggctgcgggtgcttctggagaatcagatcactcacttcaggtactgtttccctttcggccggcctgaaggggctttgaaggcaactttgagcctgctggaaagagttctaatgaaggacatcgtgacacctgttccacaagaagaggtcaagaccgtgatccgcaagtgtctagaacaagctgcattggtgaactactcccggctgtccgagtatgctaagatcgaggagaacgtgggtcgcctgataacccctgctaaaaaacttgaggacaccatcagattagccgaactggtaattgaggtgctacagcagaacgaagagcatcatgccgaggcctttgcttggtggtcagacctgatggtcgagcatgccgaaacctttctatcactgttcgccgtggatatggacgctgccctggaggttcagcccccagatacctgggactcttttcccctattccagctgctgaacgacttcttgcgaaccgattataacctgtgcaatggtaagtttcataaacatctgcaggatctcttcgcaccactggtggtgaggtatgtagatctgatggagagcagcatcgctcagtctatccaccgagggttcgaacgggaatcgtgggaacccgtaaacaacggtagtggaacatccgaagacctattctggaaattggatgcactgcaaacttttatccgtgatctgcactggcctgaggaggaattcggtaaacatctggagcagcgcctcaagctcatggcaagcgacatgatcgagtcatgtgtcaagcgaactcggattgcgttcgaggttaagctgcagaaaactagtcggtcgactgattttagggtgccacagtctatctgtactatgttcaacgtcatggtggacgcaaaggcacagagtactaaactgtgcagcatggaaatgggtcaggaacaccagtaccacagcaagattgacgaactgatcgaagagaccgttaaagagatgatcacactattggtggctaagtttgtgacgatactggagggcgtcttagccaagctgagccgctacgatgagggcacactgttcagctctttccttagctttacagtgaaagctgcatccaagtatgtggatgtgcccaaacctggtatggacgtggctgatgcatacgttacctttgtgaggcattcacaagatgttctccgtgacaaagtgaacgaagagatgtatattgagagactgttcgaccagtggtataacagcagcatgaatgtgatctgtacgtggttgaccgataggatggatctgcaactgcacatttaccagttgaagacactgatccgaatggtcaagaagacctatcgtgattttcggttacaaggcgttctcgatagcaccttaaacagtaaaacatacgagactattaggaatcgactaaccgtcgaagaagccactgcgtccgtcagcgagggcggcggactgcagggaatcagcatgaaggacagcgacgaagaggatgaagaagatgactag

SEQ ID NO: 110226 - DNA, 4080 bp, Artificial Sequence
  Description of Artificial Sequence: Synthetic coding sequence
atgctggaccccagtagctctgaggaagaaagtgacgaaattgtcgaggaggagtcaggtaaagaagtgctgggaagcgctcccagcggggcgcgcctgtctcccagtcgcaccagcgaaggatctgcaggttcagcaggcctcggtgggggaggagcgggggccggggccggcgtaggggcgggcggcggtggtggatctggggccagctccggcgggggggctggcggcctccagccatctagcagagcaggagggggcagaccttcaagcccctccccatcagtggtctctgagaaggagaaggaagagttggaacgcctgcagaaagaagaagaggaacgcaagaaaagactacagctgtatgtctttgtgatgcgctgcattgcataccctttcaatgctaaacagccaaccgatatggccaggcgacagcagaaaatcagtaaacagcaactgcagacggtgaaggaccgctttcaggcgttcctcaacggcgagacgcaaatcatggctgatgaggccttcatgaatgctgtgcagagttattacgaggtcttcctgaagtccgatcgtgtagcgcggatggttcaaagtggtggctgctcagccaatgacagcagagaggtttttaaaaaacatatcgagaaaagggttcgctctttgcctgaaatcgacggtctgtcaaaggagacagttctgagttcgtggatggccaaatttgatgctatttatcgcggagaagaggatccacggaagcagcaagctcgcatgaccgcgtcagcagcttctgagcttatcctctcaaaagaacaactgtacgagatgtttcagaatattctgggtatcaagaagtttgagcaccagctcttgtacaatgcctgccagctggataaccccgacgaacaagctgcgcagattcggcgggagctggatgggcgtctgcaaatggcagatcaaattgcacgtgagcgcaagtttcctaaattcgtctccaaggagatggaaaatatgtacatcgaagagctgaagagctcggtcaacttactgatggccaatctggagtctatgcctgtcagcaaagggggggaatttaaactgcagaaacttaaacgaagccataatgctagcatcatcgatatgggcgaggagtcggaaaaccagttgagcaaatcggacgtggtgctgtccttctcccttgaggtcgtgatcatggaggtccagggcctcaagagtcttgccccgaaccgcattgtgtactgtacaatggaggtggaggggggagaaaaactgcagaccgaccaagctgaagcaagcaaacctacctggggaacccagggtgatttctccaccacccatgccctccccgccgtcaaagttaaactgttcactgaatcaaccggcgttctcgcactggaggacaaagagctggggcgtgtgatcttgcaccccaccccaaacagtccgaaacagagcgaatggcacaagatgacagttagcaagaattgtcccgaccaggacctcaaaatcaaacttgctgtgagaatggacaagccccaaaacatgaaacactcaggctatctttgggcgatcggcaagaatgtttggaagcggtggaaaaaacggttttttgtgttagttcaggtgtctcaatatacatttgccatgtgtagttacagggagaagaaagccgagccacaggaactgctgcagctcgacggttatacagtagactatacggatccacagccagggctagaaggtggacgcgctttttttaacgctgtgaaggagggagacaccgtcatttttgcttctgatgacgagcaggaccgaatactttgggtacaggccatgtaccgcgccactggacaaagccataagcctgtgccccccacgcaggttcagaagttgaacgccaaaggcggcaatgtgcctcagctagatgccccgattagccagttttatgctgaccgcgcccagaagcacgggatggacgagtttatttcatctaatccatgcaactttgatcacgctagcctctttgagatggtgcaacgtttgaccctcgatcaccgcctgaacgattcatactcctgcttaggatggttcagccccgggcaagtttttgtgttggacgaatattgtgcacggaatggagttcggggatgccacagacatctctgctatctcagggacctcctagaacgagctgagaatggggcaatgatagatcctaccctgttgcactattccttcgctttttgtgcatcccacgtccacggcaatagacccgacggaattggtactgtcactgttgaagagaaggaacgttttgaggaaatcaaggaacggttgagggtgcttcttgaaaaccagataacccacttcagatactgctttcccttcggccggcccgaaggcgcgcttaaggcaaccctgtccctcctggaacgagtgttaatgaaagacatcgttactcccgttccccaggaagaagttaagactgtaatacgaaagtgccttgagcaggctgccctcgtgaactatagtcgcctctctgaatatgccaagatcgaggctaacagctgtacgacagagaatgtcgggcgcctgatcactcccgctaaaaagctcgaagataccattcggttagctgagctggtcatcgaggtgctgcaacagaacgaagagcatcacgccgagccacatgtggataaaggcgaagccttcgcttggtggtctgacctgatggtcgaacatgctgagacctttctttccctatttgccgttgacatggacgctgccttggaagtacagccccctgatacctgggacagtttccccctttttcagttactcaacgacttcctgaggaccgactataatttgtgcaacggcaagttccataagcacctgcaggatctgttcgcccctttggtcgttaggtacgtcgacctgatggagagcagcatcgcacagtctatccacagaggtttcgaacgcgagtcttgggagcctgttaagtctttgactagcaatcttccaaatgtgaatctccccaacgtaaacctgcccaaagtgcccaatctacctgtcaacataccactgggcataccccagatgcctactttctccgccccctcctggatggcggcaatctacgacgcggataatggctctggcactagcgaagatctgttttggaagctggatgctcttcagacatttatcagggatcttcactggccagaagaagaatttggaaagcacctggagcaacgcctaaagttaatggcctccgacatgatcgaaagctgtgtgaaacggacacggatcgccttcgaggtgaagctgcaaaagacgagccgcagtaccgattttcgggtgcctcagagtatttgcaccatgtttaacgttatggtcgacgccaaggctcaaagcaccaagctgtgctccatggagatgggccaggagaagtacaagaaaatgaggcatcagtaccatagcaaaatagacgagctgattgaagaaaccgtgaaggagatgattacactcttggttgcaaaattcgtgaccatcctcgagggggtactcgcaaaactctctcggtatgacgagggcaccctgttcagcagcttcttaagctttactgtaaaagcagccagtaaatacgtggacgtccctaagcctggtatggatgtcgccgatgcttacgtcacctttgtgaggcacagccaagacgtcctccgagataaagtcaatgaagaaatgtacatcgaaaggctgtttgaccagtggtacaactctagcatgaacgtgatttgcacctggcttactgatcggatggatctccaattgcacatttatcagttaaagacactcatcagaatggtgaaaaagacatatcgcgatttccggcttcagggagtgctagattccacccttaattcgaagacctatgagacaatccgcaaccgtctgactgtggaggaagccactgcctcagtctcggaaggaggcggcctgcagggcatttccatgaaagacagtgatgaagaggatgaggaggatgactag

SEQ ID NO: 110227 - DNA, 4062 bp, Artificial Sequence
  Description of Artificial Sequence: Synthetic coding sequence
atgctggacccctcctcctccgaagaggaaagcgatgaaatcgttgaagaagagtccggaaaggaggtcctgggaagcgctccaagtggagcccggctcagcccctccaggacaagcgagggcagcgcaggttccgctggactagggggagggggggctggagcaggcgccggagtgggcgcgggtggaggcggcggctccggtgcgagctctggagggggggccggcggcttgcagccttcctcccgtgcaggcgggggcaggccctccagcccaagcccgtccgtcgtttctgaaaaggagaaggaagagctggaacggctgcagaaagaagaagaagagagaaagaaacggctacagctgtatgtttttgtgatgcgctgtatcgcttaccctttcaacgccaaacaacctaccgatatggcaagaaggcagcagaaaattagcaaacagcaactgcagactgtgaaggaccggttccaagcgttcttgaacggcgagacacagattatggcggacgaagcttttatgaacgcagtgcagagctattacgaagtctttttaaagtcagaccgagtggcgaggatggtgcaatcaggtggctgcagcgccaacgattcccgggaagtattcaaaaaacatatagagaaacgggtaaggtcactgcccgagatagacggcctgagtaaagagactgtgctgtcgtcctggatggcaaaattcgatgcgatctaccggggggaggaggatcctcgaaagcagcaggccaggatgaccgcatccgccgctagcgaactaatcttatcaaaggagcagctatacgaaatgtttcagaatattctgggcattaaaaaatttgagcaccagttgctctacaatgcatgtcagctcgataatccggatgagcaagcagcacagattcgccgcgagctggatgggcggctgcaaatggcagaccaaatcgcgagggagcggaaatttccaaaatttgtgagtaaagagatggagaatatgtatatcgaggaactcaaatccagcgtcaacctgcttatggctaatctggagtccatgccggtcagtaagggaggcgaatttaagctgcaaaagctgaagagatctcacaatgcctctattatcgacatgggcgaggagagcgagaaccaacttagcaagagcgatgttgtgctgtctttcagtcttgaagtggtgatcatggaggtgcagggacttaagtccctggctccgaacaggattgtctattgtacgatggaagtggagggtggtgaaaagctgcaaacagatcaggccgaggcatcaaagcccacctgggggacacagggagatttctccaccacgcacgccctgcctgccgtgaaggtgaaactgttcactgagtccaccggggtcctcgcactggaggacaaggagttgggacgcgtaattctacaccctaccccaaacagtcctaagcagtctgaatggcataagatgacagttagtaaaaactgtcccgatcaggacctcaaaataaaactggccgtgcgcatggacaaaccccaaaacatgaaacactctggatacctgtgggccatcggaaagaacgtttggaagaggtggaagaaaagattttttgtgctcgtgcaggtgtcacaatatacatttgctatgtgtagttatcgggagaagaaggctgaacctcaggaactcttgcaactagatggctatacagtggactacactgatcctcagccagggctggaaggtggacgggcctttttcaacgctgttaaagaaggcgacactgtgatatttgcaagcgacgatgagcaggatcggattctttgggtgcaagccatgtatcgcgccaccggccaatcacacaaacccgtgcccccaacccaggtgcagaagctgaacgctaaaggaggtaatgtgccgcagctggacgcgccaatatcccagttctacgcggatagagcccagaagcacggaatggatgagttcattagcagcaatccctgcaacttcgatcacgcttcactctttgaaatggtgcagcgtctgaccctagatcacaggctcaatgattcttatagctgtttaggttggtttagccctggccaagtgtttgtgctagacgagtattgcgctaggaatggggtgagagggtgtcatcgacacctttgttatctccgggacctgctggagagagcagagaacggggctatgattgatccaacactcctacactactcttttgcattctgcgcaagtcatgttcatggaaataggcctgacggcattggaacggtgaccgtggaggagaaagagaggttcgaggaaattaaggagcgactgcgcgtgctgctcgagaaccagatcacgcacttcaggtattgttttccattcggacggcctgaaggagctcttaaggctactttgtccttactggaacgcgtgcttatgaaagacatcgtgacacccgtccctcaagaggaggtgaaaactgtgataagaaaatgcctcgaacaggcagccctcgtgaattactcccgcctcagcgaatatgctaagattgaagagaaccagaaagacgccgagaacgtggggaggctcataacacctgcaaaaaaactggaggacactatcagactcgcagaactggttatcgaggtcttgcagcagaacgaggagcaccatgcggagccacacgtggataagggggaggcctttgcctggtggtccgatttaatggtcgagcatgctgagacgttcctctcactgtttgctgtggatatggatgctgcactcgaagtgcagcccccagacacctgggactctttccccttgtttcagctgctaaacgatttcctgcggactgattacaatttgtgcaatggaaagttccacaaacacctccaggatctgttcgcccctctggtcgtgaggtacgtggaccttatggaatcctctatcgcccagtccatacacagagggttcgagagggagtcatgggagcccgtaaagtcccttactagcaacctgcccaatgtaaatttgcctaatgtgaatcttcctaaggtgcccaacctacccgtcaacatccccttgggaattccccagatgcccactttctctgctcccagctggatggcggcgatctatgatgccgataacggctcagggaccagtgaagatctgttctggaaactcgatgcgctgcagacattcatcagggatttacattggcctgaagaggaatttgggaaacacttggagcagaggctcaaactgatggctagcgacatgatagaatcctgtgtgaagcgcacaaggatcgctttcgaggtgaaactccaaaagacttccaggtcaaccgatttcagggtcccccagtcaatttgcacgatgtttaacgttatggtcgacgccaaggctcagtccaccaagctgtgctcaatggaaatgggccaggaacaccagtaccactctaagattgatgaactcatagaggaaaccgtgaaggagatgattaccctgctggttgctaaatttgtcactattttggagggggtgttggccaagctgtctcgatacgatgagggaactctgttctcatctttcctctcctttactgttaaggccgcatccaagtacgtagatgttccaaaaccaggcatggatgtagcggatgcatatgtaacttttgttaggcattcacaggatgtccttagagacaaagtgaatgaggagatgtacatcgaaaggctctttgaccagtggtacaactcctctatgaatgtgatctgtacttggctgactgataggatggacctgcagctgcacatttaccagctcaagaccctgatacggatggttaaaaagacctatagagactttcgcctccagggcgtcttggactctaccttaaactcaaagacatacgagacaattcgcaaccggctgaccgtggaagaagccaccgcctccgtcagcgagggcggaggtctgcaggggatctcaatgaaggattccgatgaggaggacgaagaggacgactag

SEQ ID NO: 110228 - DNA, 1038 bp, Artificial Sequence
  Description of Artificial Sequence: Synthetic coding sequence
tgactgcctaacgttaatttgccgaatgtgaacctccctaaagttcccaacttgcctgttaacatccccctgggtattccacagatgcccacattttctgcaccaagctggatggccgctatctacgatgcagacaacggaagcggcacctctgaggatctcttctggaagctggacgcacttcagacttttatacgagacttacattggcctgaggaggagtttggaaaacatctggagcagaggttgaagttaatggccagcgatatgatagagagctgcgttaagagaactagaattgctttcgaggtgaagctccagaagacgtctagatctactgattttagggtcccacagtcaatctgtaccatgttcaacgtgatggtggatgccaaagcccagtcgactaagttgtgctctatggagatgggccaggaatttgcaaaaatgtggcaccagtaccactctaagatcgacgaactcattgaggaaaccgtcaaagagatgatcactctcctggttgccaagttcgtaacaatcctcgagggcgtcctggccaagttgagtcggtatgacgaagggacccttttttcctcattcctgtcttttaccgtcaaagccgcttcaaaatacgtagatgtgcctaaacccggtatggacgtagcagatgcttatgtgacattcgtacgacacagccaggacgtgctgagagacaaagtgaacgaggagatgtacatcgagagactctttgaccagtggtacaactcaagcatgaatgtcatctgcacctggttgacggatcgaatggaccttcaactgcatatctaccaattgaagacactcatcaggatggtgaagaaaacttaccgcgattttcgcctccagggggttcttgattctactttaaatagcaaaacttacgaaaccataaggaacaggcttaccgtggaggaggctacagctagtgtgagcgaaggaggcgggctgcaaggtatctccatgaaggacagtgacgaagaagatgaggaagatgattag

SEQ ID NO: 110229 - DNA, 3768 bp, Artificial Sequence
  Description of Artificial Sequence: Synthetic coding sequence
atgctcgatccctcttctagcgaggaagagagcgatgaaggcttggaggaggaatctagagacgtgctggtggccgcaggcagctctcagagggctcccccagccccgacacgggaagggcgaagggatgccccagggcgtgccggcggtgggggagctgcgagaagcgtaagtccctctccgtcagtgctctctgagggcagagacgagcctcagagacaactggacgacgaacaggagcgccgaatcagactgcaactgtacgtctttgtggtccgctgcatcgcctacccatttaacgctaaacagcctacagacatggcgcggcgtcagcagaagctgaacaaacaacaactgcagctgctgaaggaacggtttcaggctttccttaatggggagacgcagatcgtcgccgatgaggcgttctgcaatgccgtgaggtcctactatgaggtttttctgaaatctgatcgggtggcgcgaatggtgcagtcagggggatgttctgctaatgattttcgggaagtgttcaaaaagaatattgagaagcgggttcgcagtctccccgagatcgacgggcttagcaaagagaccgtattaagctcctggatagccaagtacgacgcgatttaccgaggtgaggaagacctctgtaaacaaccaaaccgaatggctctgagcgcggtatccgaacttattcttagtaaggaacaactctacgaaatgttccagcagatcctcggcatcaagaagctggagcatcaacttctgtacaatgcctgccagctggacaacgcagatgaacaggcagcccaaattcgacgcgagttagatggacgcctgcagttggcagacaagatggcaaaggaacgaaagtttcctaaattcatagctaaagatatggaaaacatgtacatcgaagaacttcgatccagcgtaaatctgcttatggcaaatctcgagtcactgcctgtgagcaagggcggccccgaattcaaactccaaaaacttaaacgcagccagaactccgcttttctggacataggggacgagaatgagatacagctctctaaaagcgatgtggttctctccttcacactggagatcgttataatggaggtccagggcttaaagtctgtggctccaaatcgtatcgtctattgtactatggaggtggaaggtgagaaattgcagacagatcaggctgaggcttccaggccccagtggggtacccaaggggatttcacaacaacgcatcctcgaccagtcgtcaaagttaagctctttactgaatccactggtgtcctggcccttgaagacaaggagctgggacgtgtgattctttacccaaccagtaactccagcaaaagtgctgaactacacagaatggtggtccccaagaacagtcaagactccgatttgaaaattaaacttgcggtgcgcatggacaaaccagcccacatgaaacattctggatatctctacgccttaggtcagaaagtgtggaaaagatggaagaaacggtattttgtcctggtgcaggtgtctcagtacacctttgccatgtgcagttacagggagaaaaagtcagagccacaggaactcatgcagctagaaggctatacagtggattacacagatcctcatccaggccttcagggtggatgtatgttttttaacgctgtgaaggagggagatactgtgattttcgcctcagacgacgagcaagaccggatcctatgggtccaggccatgtacagagctacggggcagagctacaagccagtcccagcaattcagacccagaagttaaaccccaagggcggtactctacacgcagatgcacaactctatgccgataggttccagaaacacggtatggacgagttcatatctgctaatccctgtaagctcgatcatgcatttctgtttcggatcttgcaaaggcagactctggaccatagactgaatgatagctactcgtgtttgggctggttcagcccaggacaggtctttgtgcttgacgagtattgtgcccgctatggggtccgggggtgtcatcggcatttgtgctaccttgctgagttaatggaacattcagagaacggagcagtgattgacccaactctgctgcattacagcttcgccttctgtgcatcccatgtgcacggaaatagacccgacggcatcggcactgtgtccgtggaagaaaaggagcgctttgaggagattaaagaacggctgtccagccttctcgagaatcagatttctcacttccggtactgcttcccttttgggcggcccgagggcgccctgaaggcgactctctctctgctcgaacgagtgctcatgaaggacatcgccacccctattcccgctgaggaggttaaaaaagtcgttcggaagtgtctggaaaaggcggcccttatcaactatacaagattgactgagtatgctaagatagaggagactatgaaccaagcgagcccagcgagaaagttagaggaaattttgcacctcgccgaattatgcattgaagtgctccaacaaaatgaggaacaccatgctgaggcttttgcttggtggcctgacctgctcgcagagcatgcagagaaattctgggctctcttcacagtcgacatggatacagctctggaagcccagcctcaggactcatgggacagttttccacttttccaactactaaacaacttcttgcgcaacgataccctcctttgcaacgggaagtttcataaacacctgcaggagatcttcgtccctttggtagtgagatatgttgacttaatggaatcttccatcgctcagagcatccacagagggtttgaacaagaaacctggcagcctgtgaacaatggctctgcaacctctgaggatctgttttggaaactagacgcccttcagatgttcgtgttcgatctacattggccagagcaggaattcgcacaccatctggaacagcgtctgaagcttatggctagcgatatgcttgaagcatgcgttaagagaacccggactgcctttgaattaaagttacagaaggccagcaagacgactgacctccgtataccagcttctgtgtgcactatgttcaacgttctcgtggatgctaaaaagcagagcaccaagttgtgcgccctggatggtggacaggaagtgtgcagaatttttcagcagtaccactccaaaatagatgaccttattgacaacagtgtgaaggaaattatttcacttttagtgagcaaatttgtgtctgtgttggaaggcgtgctgagtaagctgtctcggtacgacgagggcacgtttttttccagcatcctgagtttcactgtgaaggcagccgcaaagtacgtggatgtgccaaagccaggcatggacctggctgacacatacatcatgtttgtccgccagaaccaagacatcctccgggaaaaggtgaacgaggagatgtatattgaaaaactgttcgaccagtggtactcatcttctatgaaagtgatttgcgtttggttaactgatcgcttagacttacagctacatatctaccagcttaagacactcatcaaaattgtaaagaaaacgtaccgtgattttcggctgcagggagtgctcgaaggcaccttgaactccaagacatacgacaccgtccaccgacgcctcacagtagaggaagcgactgccagcgtgtccgagggcggaggactccagggcattactatgaaggatagcgacgaagaagaggaaggttag

SEQ ID NO: 110230 - DNA, 3885 bp, Artificial Sequence
  Description of Artificial Sequence: Synthetic coding sequence
atgcttgatccatcaagttcagaggaagaatctgatgagggcctggaggaggaaagccgcgacgtattagttgcggcagggagctctcaacgggcgcctcccgccccgacccgcgagggaaggagggacgcaccgggccgagcgggcggtggcggcgctgcgaggagtgtatccccgtcaccgagcgtactcagtgaaggaagggacgaaccccagcggcagcttgatgacgagcaggaaaggcgcatccggttacagctatatgtgtttgtggttaggtgtatcgcataccccttcaacgccaagcagccaaccgatatggcaaggagacagcagaaactcaataagcagcagttgcaactcctgaaagagagattccaggcctttctgaatggggaaacacaaatcgttgcagacgaggccttctgtaatgccgtgcgatcttattatgaggtgttcctgaaatccgatagagtggcaaggatggtgcagtctggaggatgctcagcgaacgatttccgtgaggttttcaaaaagaacattgaaaaaagagtgcggtccctgcctgaaatagatggcctgtccaaagagactgtcctgagcagctggatcgctaaatacgacgctatctatcgaggggaagaagatctgtgcaagcagcctaatcgcatggctcttagtgccgtaagtgagctgattctctcaaaagaacaactgtacgagatgttccaacagatactgggcataaagaaattggaacaccagcttctgtataatgcgtgccagcttgataacgccgacgagcaggcagcccaaattcgaagggaattagatggtagactacagctggccgataaaatggcaaaagagagaaagttcccaaaatttattgcgaaggacatggagaatatgtatattgaggaactgcgtagctctgttaatttacttatggccaatttagagtccctccctgtcagtaaagggggcccagaatttaagctgcagaagctgaaacggtcccagaactccgcttttttggacatcggagacgagaatgagatacagcttagtaagtcagatgttgtgcttagtttcaccctcgagatcgtcattatggaggtgcaggggttgaaatccgtggcacccaaccggattgtctactgtacaatggaggtggagggcgagaagctccagacagaccaggccgaagcatcccgaccacagtgggggacgcagggcgattttacaacaacccaccctagaccagtggtcaaagtgaagctgtttaccgaaagtacaggagttttggcccttgaggataaggaattgggtagagtaatcctgtatccaacatctaactctagtaaatcagccgagttgcataggatggtggtgcctaaaaattcacaggattccgacttgaagatcaaactggccgtgaggatggacaaacccgcccacatgaagcacagcggctacctctacgctctgggacagaaagtgtggaagcgttggaagaagaggtactttgtgttagtgcaagtaagccagtacacctttgctatgtgttcataccgcgagaagaaaagtgagccacaggagctgatgcagctggagggctacacagtggactatacagatccccaccctggccttcagggcggatgcatgttctttaatgctgtgaaagaaggcgatacagtgattttcgccagcgatgacgaacaggatcgcatattatgggttcaggccatgtaccgcgcgacagggcagagctacaagcctgttcctgctatccagactcagaagttgaaccccaagggaggcaccctccacgcagatgcacagctgtctgagttcaccgacgcggaccgtttccagaagcatggaatggatgagttcatctctgctaacccctgcaaactcgaccatgcctttctgtttaggatcctccagcgacagactttagatcatagactcaacgattcttattcttgtctcggttggttcagccccggccaggtgttcgtcctggacgagtactgtgcacgctatggagtgcgagggtgtcaccggcacctgtgctatttggccgaactgatggaacatagtgagaacggcgcagtgatcgatcccactcttctccattattcattcgcattctgcgcttctcatgtacacggcaataggcccgatggcattgggacagtgtcagtggaagagaaagagcgatttgaggagatcaaggaacggctgtcatctctactggaaaatcagatctcacacttcagatattgctttccctttggccgcccagagggggcccttaaggccaccctgtctctcctggagagagtcttaatgaaagatatagccacccctatccctgctgaggaggtgaaaaaggtggtgagaaagtgcctggagaaagccgccctcattaattacactcgcctgactgagtacgccaaaatagaagagactatgaaccaggcgtctccggcacgaaagctggaggaaatactgcatctagctgaattatgtatagaggtcctgcagcagaatgaggagcaccacgctgaagcttttgcttggtggccagacctgctcgcggaacacgctgaaaaattctgggctctcttcactgtcgatatggacaccgccctcgaagcacagccccaggattcctgggactcctttcctctgttccagctcctgaacaattttctgcgaaacgatacactgctttgcaacggcaaattccataagcacctgcaggagatttttgtgccactcgtggtgcgctacgtcgatctgatggagtcaagcatcgcacagagcatccatcgcggcttcgagcaagagacctggcagcccgtgaagaacattgcgaacagccttcccaatgttgctctccctaaggtgccgtctctacctctcaatctacctcagatccccaatataagcacggcatcttggatgccctcactgtatgaaagcactaacggctctgctactagtgaggatctattttggaagctcgacgcactccagatgtttgtgtttgacttgcactggcctgagcaggagtttgcccaccacctggaacagagactcaaattgatggcctcagatatgctggaggcatgcgtcaagcgaactcggacagcattcgagttgaaactacagaaggccagtaagaccacagacctgcgcatacccgcgtctgtttgtacaatgtttaatgtgttggtcgacgcgaaaaagcaatccaccaaactgtgcgcactcgatggtggacaggagcaacaatatcattctaaaatcgacgatttgattgacaacagcgtgaaggagattatcagcttgcttgtgtcaaaattcgtgagtgttctggagggcgtactctccaaactgtctcggtacgacgagggtacattcttttcttcaatattgtcttttaccgttaaggctgccgcgaaatacgttgacgtgcccaagccaggcatggatcttgcagacacttatatcatgtttgttagacaaaatcaagatatattaagggagaaggtcaacgaggagatgtatatcgagaaactctttgatcagtggtactcgtcaagtatgaaagtcatctgcgtgtggctgacagatcgacttgaccttcaactccatatatatcagctcaaaaccttgattaagatagtcaagaaaacatacagggatttcagactccagggggtgctggaaggcacccttaactcaaaaacctacgacacagttcatcgccgtttgacagtcgaagaagcaacggcttctgtgagcgagggaggtggactgcagggcattacaatgaaagactcggatgaggaggaagaaggctag

SEQ ID NO: 110231 - DNA, 1410 bp, Artificial Sequence
  Description of Artificial Sequence: Synthetic coding sequence
atgaatcaggcttctccagcacgcaaattggaagagattctacacttggccgaattgtgcatcgaggtcctgcagcagaacgaagagcatcacgctgaactcagacacgcctttgcttggtggccagacctgttggccgaacacgctgagaagttttgggcactgtttaccgtggacatggacacagccctggaggctcagccccaggattcatgggacagcttccccctctttcaacttctcaacaacttcctcagaaacgataccctgttgtgtaacggaaaatttcataagcacctgcaagaaatcttcgtccctctggtggttaggtatgtggatctaatggagtcgtccatagctcagtccatccaccgaggttttgaacaggagacctggcagcccgtgaagaatattgcgaactctctaccaaatgtcgctcttccgaaagtgccctccctgcccctaaatttaccgcagatcccaaacatatctacagcttcctggatgccttcactatatgagtcaaccaacggctctgctactagcgaggacttgttctggaagcttgacgccctccaaatgttcgttttcgatcttcattggccggagcaagaatttgcccatcatctggaacagaggctgaagctgatggcaagcgatatgctggaagcctgcgtgaaaagaaccaggacagccttcgagctcaagctccaaaaagctagtaaaaccacggacctgagaataccggcatcggtgtgcactatgttcaacgtgttagttgacgctaagaagcagtcaacaaagctgtgtgctctggacggcggacaggaacagcaataccattcaaagattgatgaccttattgacaacagcgttaaggagatcatctccctgctggtctcgaaatttgtgagtgtacttgaaggtgtgctcagtaagctgagccgctacgacgagggcacctttttttcttcgatactgagcttcaccgttaaggctgcagcaaaatatgtggatgtgccaaagcccggcatggacctggctgatacttacatcatgttcgtacggcagaaccaggatattcttagggagaaggttaacgaggaaatgtacatcgagaaattatttgaccaatggtactcctcctctatgaaggttatttgcgtctggctaactgaccgtctggacctacagcttcatatctatcagctcaaaacccttatcaaaattgtaaaaaagacatacagggacttccgtcttcagggagtgttagagggcacactgaacagcaagacttacgacactgtgcaccggcggctcactgtggaagaagccaccgcttcggtaagcgaggggggtggacttcagggtataacaatgaaggatagcgacgaagaggaagagggatag

SEQ ID NO: 110232 - DNA, 2700 bp, Artificial Sequence
  Description of Artificial Sequence: Synthetic coding sequence
tgagagatccagctttctaaatccgatgtagtgttgagtttcacactggagatcgtcatcatggaggtccaaggcctcaagtctgtggcaccaaacagaatagtgtattgtaccatggaagtggaaggggagaagcttcaaacagaccaggcggaggcatcgcgaccacaatggggcacccagggtgatttcacaacaacccacccccgccccgtcgtgaaagttaaactgttcacagaatccaccggagtcctggccttggaagacaaggaactgggccgggtaatattgtacccaacttccaacagttcaaagtccgccgaacttcacagaatggttgtccctaagaatagtcaggattctgacctgaaaataaaactggcagtgcgcatggataagcctgcgcacatgaagcattccggctacctgtacgcccttggacagaaggtttggaaacgctggaaaaaacggtattttgtgctggtccaggtctcccagtacacttttgccatgtgttcttatagggagaagaaatccgaacctcaggagctgatgcagctggaaggttacactgtggattacactgatccccatccgggcctacaaggaggctgcatgtttttcaacgccgtgaaagagggagataccgtaatatttgccagtgatgacgaacaggatcgaatactatgggttcaggcgatgtacagagctaccggccagtcttataagccggtccctgccattcagactcagaagctgaatcccaagggagggacactccatgccgatgctcaactgtacgcagatcgatttcagaagcatggcatggatgaattcatatcagccaatccctgtaagctcgatcatgccttcctgtttcgaatcctgcagcgacagacactggatcaccgtcttaatgacagttattcttgcttgggatggttttcgccagggcaggtttttgtgttagacgaatactgcgcccgatatggtgtcaggggatgtcatcgacacctatgttaccttgccgaattaatggagcacagtgagaatggcgccgtgatagaccctacactcctgcactatagctttgctttttgtgccagtcacgtgcacggaaacaggccggatggtatcggaacggtatccgtcgaagaaaaagagagatttgaggagatcaaagagcgcctgtcatcacttctcgagaatcagatatcacatttcaggtattgttttccgttcgggaggccagagggggccctgaaagccaccctctcactgctggaacgtgtcttgatgaaggacatcgccacccccatcccagcagaggaggttaaaaaggtggttagaaaatgcttggaaaaagctgctcttatcaactacaccagactgacggaatacgcgaaaatcgaagaaaccatgaatcaggcctcacctgccagaaaactggaggagattcttcacctggctgagctgtgcattgaggtgctgcaacagaatgaagaacaccatgctgaggccttcgcatggtggcctgatttactcgcggaacatgctgagaagttttgggccctgtttacggttgatatggatacagcattggaagcccagcctcaggactcttgggactctttccctctgtttcaactattaaacaatttcctcaggaatgataccctgctgtgtaacggaaagttccacaagcatctccaggagatctttgtccctctggtggttcgctacgtcgacctgatggagtctagtattgcacagagcatccatagaggctttgaacaggagacatggcagcctgtaaataacgggtccgcaacatctgaagacctgttttggaaattggacgcgctgcagatgtttgtcttcgacctgcactggcccgagcaggagttcgcgcatcatctggagcaacggcttaaactgatggcctctgatatgctggaagcttgcgtcaaacgaacaagaactgcattcgagttaaagctgcaaaaggcctcaaaaaccactgatcttcgcatccccgccagcgtctgtacaatgtttaacgtgcttgtggacgcaaaaaaacagtccacaaagctgtgcgctcttgacggcggccaggagcagcagtatcactctaaaattgatgacctcatagataacagtgtgaaggaaattatttcactgctggtgagtaaatttgtgtctgtactcgaaggcgtgctgagtaaactgagcaggtatgacgaaggaacgttctttagctcaatcctatcctttacagttaaagctgcagccaagtacgtggatgtgcctaagcccgggatggatctggccgatacatacataatgtttgttaggcagaaccaggacattttgcgcgagaaagttaacgaagagatgtacatcgagaagctatttgatcaatggtattcgagctccatgaaggtgatttgcgtttggctgactgacagactcgacctgcaactacatatctatcagctgaagacccttataaagattgtgaaaaaaacatatcgtgatttcagactgcaaggcgtgctggaggggaccctcaatagcaaaacatatgacacagttcatcgacgtctgacggttgaggaagccaccgctagcgtcagtgagggaggcgggctgcagggcattactatgaaggattcagatgaggaggaagaaggctag

SEQ ID NO: 110233 - DNA, 3768 bp, Artificial Sequence
  Description of Artificial Sequence: Synthetic coding sequence
atgctggacccgagctcatctgaagaggaatcagatgaaggtcttgaggaggagtcaagggacgtcctcgtcgctgcaggatcgagtcaacgcgcgcctcccgcacccacgcgggagggtagaagagatgcacccggccgtgccggtggtggaggggcagcccgctcagtcagccccagcccatcagtcctgtctgaggggcgcgatgaaccacagcggcagctcgatgacgagcaggagagacgtattcgcttgcagctctacgtgttcgtggtgaggtgcatcgcctacccattcaacgctaaacagccaacagatatggctcgtagacagcagaagctgaacaaacagcagctgcagctgctaaaagagcgcttccaggccttcctgaatggggaaacccagattgttgccgacgaagctttctgcaacgctgtgcgcagttactacgaagtttttcttaagtcagatagagtggcccgcatggttcagagtggcgggtgttccgctaacgacttcagggaagtcttcaagaagaatatcgagaagagggtccggtcccttcctgagatagacggactgagcaaggagacagtgctgagctcttggatcgcgaaatatgacgcgatctatcggggagaggaggatttatgtaaacagcctaaccgaatggctctgtcggccgtcagtgagcttatactttccaaggagcagttgtacgagatgtttcagcagattctcggcatcaaaaagctggagcatcagctcctttacaacgcctgccagctggacaatgcggacgaacaagccgcccagatccggcgggagctcgatggaaggctgcagcttgcagacaaaatggcaaaagaaaggaagttccccaagttcatcgctaaagatatggaaaacatgtacatcgaagagctgcgatcaagcgtgaatctactgatggctaatctggaaagtctccctgtgtctaaaggcgggccggaattcaaactccagaaactcaaacggtcacagaacagcgcctttctggacataggggacgagaacgagattcagcttagcaaaagcgatgtcgtgctgagctttacattggagattgtgataatggaggtgcaggggctaaagagcgtggctccaaataggatagtttattgcacaatggaagtggaaggcgaaaagctccagacagatcaggctgaggccagtaggccgcaatggggaacgcaaggagattttaccaccacacaccccagacccgtggtgaaggtgaaactcttcaccgaatcaacgggggttcttgctctggaggacaaagagctagggcgcgtgatcttgtacccgacatctaactcctcaaaaagtgctgagctacacagaatggtcgtccccaagaacagccaggacagtgacctgaaaataaaactcgccgttcggatggacaagcccgcgcacatgaaacacagcggttacttatacgccctggggcagaaggtgtggaaacgttggaaaaaacgatattttgtgttagttcaggttagtcagtatacctttgctatgtgcagctatagagaaaagaaatctgagcctcaggaattaatgcaattggagggctatacagtcgattacacagatccccaccctggtctgcaaggcgggtgtatgttcttcaacgccgttaaagaaggagataccgtgatcttcgcatctgatgacgagcaagatcggatcctgtgggttcaggctatgtaccgggccaccggccagagttacaaaccagtgccagccatccagacacagaagttgaaccctaaggggggcacccttcatgctgacgctcagctctacgccgatcggttccaaaaacacggaatggacgagttcatttccgctaatccctgtaaacttgatcatgccttcctttttcgaatcctgcaaaggcagactctggaccaccgtctcaacgatagttactcatgtcttggctggttctctccgggccaggtgtttgtccttgacgaatactgcgccaggtatggcgttagaggttgtcataggcatctgtgttatttggctgagctgatggaacacagtgagaacggggctgtcatcgacccaaccctcctgcactattcttttgccttctgcgcctcccatgtgcatggtaatcggcctgacggtattggcacagtctccgtagaggaaaaagagagattcgaggagataaaggaaaggttgtccagcctgctggagaatcagatttcccatttccggtattgctttccttttggtagacccgagggcgcactcaaagccaccttgtccctgctcgaaagagtcttaatgaaggatattgctacgccaattcctgccgaggaggtgaaaaaggtggtcaggaagtgcctggagaaggccgctttgatcaactatacccggctaaccgagtacgccaaaattgaggagacgatgaaccaggccagtcccgcaaggaagctcgaggaaattctgcatctggccgagctgtgcattgaagtgctccagcagaacgaagaacatcacgctgaggccttcgcttggtggccagatctgctagccgagcacgcagagaagttttgggctctgttcaccgttgacatggataccgcactcgaagcacagccccaggatagctgggatagcttccctcttttccaactgcttaacaatttcctccgcaacgacactttgctctgtaatggaaaattccacaaacatttgcaagaaatcttcgtccctctggtagtgaggtacgtcgacctgatggaaagttccattgctcagtcaatccatcgaggatttgagcaggagacctggcagcctgtaaacaatggctcagccacctcggaagacctgttctggaagttagatgccctgcagatgtttgtatttgatctgcactggcctgaacaggaatttgcccaccacctggaacagcgcctgaagcttatggccagtgacatgctggaggcatgcgtgaagagaacacgcaccgcattcgaattgaaactacaaaaggcctcaaaaacaacagaccttaggattccagcaagtgtgtgtacaatgttcaacgtgcttgttgacgcaaaaaagcagtccaccaagctctgtgccttggacggcggccaggaattcggatctcagtggcaacagtatcacagcaagatcgacgacctaatagataacagtgtgaaggagatcatctctctcctggtgtccaagttcgtgtctgtattggaaggggtcctgagcaaacttagtcgctatgacgagggaacattcttttcctcaatcctctccttcaccgtgaaagctgccgcgaaatatgttgacgttccaaaaccagggatggacctggctgatacatatattatgttcgtcaggcagaatcaggatatcttgagagagaaagtcaatgaggagatgtacattgaaaaactttttgaccagtggtactcctcttccatgaaggtcatttgcgtgtggcttaccgatagacttgatctacagcttcatatttatcagcttaagacactgattaaaatcgtcaagaagacttacagggattttaggttacagggtgtgctggaagggacactcaactcaaaaacatacgatacggtccatcgacggcttaccgtggaggaggccacagcttccgtgagtgagggtggtggcctccagggcattacaatgaaagactcagacgaagaagaggagggctag

SEQ ID NO: 110234 - DNA, 3906 bp, Artificial Sequence
  Description of Artificial Sequence: Synthetic coding sequence
atgctggacccctcctccagcgaggaggaatcagacgaaggattagaggaggagtcccgagatgtattagtagccgctggctcgagtcagcgggctcctcccgcaccaacccgggagggacgaagggatgcccccggtcgcgccggcggggggggggctgctagatcagtctccccgagcccctccgtcctgtcagagggccgtgacgaacctcagcgccaactggacgacgagcaagaacgaaggatcaggttgcaattatacgtgtttgtggtccggtgtatagcctatcctttcaacgcgaagcagcccactgatatggctcggcggcaacagaaactaaacaaacaacagctccagctgctgaaggaacggttccaagcttttctaaacggggagactcagatagtggccgatgaggcattttgtaacgctgtgaggtcttattatgaagtttttctaaagtctgatagagtggctagaatggtacagtccggcggatgttcggcaaacgatttcagagaagtgttcaaaaagaatatagaaaagagagtccgctctctgccagaaatcgacggccttagtaaagaaaccgtgttgtccagttggatagccaagtacgacgccatatatcgaggggaagaagacctttgcaagcaaccaaaccgcatggcactgtctgccgtatccgagctcattctatctaaagagcagttgtacgagatgttccaacagatcttggggatcaaaaaactggagcaccagctcttgtataatgcatgccaacttgacaatgccgacgagcaagccgcacagatccggcgggaattagatggaagattgcaattggcggataaaatggctaaagaaaggaaattcccgaagttcatcgcgaaggatatggagaacatgtatatcgaggagctcaggtcttcagttaatttactgatggccaacctcgagtcactccctgtctctaaaggtggccctgagtttaagcttcaaaaactcaagcggtcacagaattcggcgttcctggatatcggcgacgaaaacgagatccagttaagcaaaagtgacgtggtcttgtcctttactctcgagatcgtcatcatggaagtccagggcctgaaatctgtagcccctaataggatcgtgtattgtaccatggaagtagaaggggagaagttacagacggatcaggccgaggctagccgtcctcaatgggggactcaaggtgacttcaccacaacccaccccaggccggtggtaaaagttaaattgtttactgagtctacaggggtcctggccttagaggacaaagagttgggtcgcgtcatcctctacccgacctccaattcgagtaagagcgcagaactgcaccgtatggtggttccaaaaaattcacaagacagtgatctaaagatcaaactggctgtaagaatggacaaaccagcccacatgaaacattctggatatctgtacgctctaggccagaaagtttggaagaggtggaaaaagaggtacttcgtgcttgttcaggttagccagtacaccttcgccatgtgttcctaccgggagaaaaagtcggaacctcaagagctgatgcaacttgaaggctacaccgtggattatacagatccacacccaggcctgcaaggaggctgcatgttcttcaatgcggtcaaggagggagacactgttatctttgcatctgacgatgaacaggaccggatcctgtgggtccaggcaatgtaccgcgccacaggtcaatcctataagccggtccctgcgatccaaacccaaaagctgaacccaaagggaggcacgctgcacgccgatgcgcagctatcagagtttactgatgcagacagattccagaaacacggaatggacgaattcattagcgccaacccgtgtaaacttgaccacgccttcctttttcggatcttgcaaaggcaaacattggatcatcggctcaacgatagctatagctgcttgggatggttcagccctgggcaagtcttcgtgcttgacgagtattgcgccaggtatggcgtgcgaggttgtcatagacatctctgttacctggcagagctcatggagcatagtgaaaacggagccgtgatcgaccctactctgctccactactccttcgccttttgcgccagccacgttcatgggaacagacctgacggcatcggtactgttagtgtcgaggagaaggaaagattcgaggagatcaaagagcgactgtcttccctgcttgaaaatcagatttcacattttagatactgctttcctttcggccgtcctgaaggggcactgaaagccactctgagccttctagaacgagtccttatgaaagatatagcaaccccaataccagctgaagaagttaagaaagtggtccggaagtgtctagagaaggccgccttgattaactacaccagattgacagagtacgccaagattgagggtccagccgagaaggagaccgagacgatgaatcaggctagcccagccagaaaattggaggaaatattacacttggccgagctgtgcatcgaggtgcttcagcagaatgaagagcaccatgcggaagccttcgcatggtggcctgacttactggcagaacatgccgagaagttctgggccctttttaccgtcgacatggatactgccttagaagcccagccccaggactcatgggattcatttcccttgttccagctcctgaacaactttttgagaaatgacaccctgttatgtaatggaaaatttcataagcatctacaggagatatttgtgccccttgtagtgagatacgtcgacctgatggagtcttccatcgcacagagcatccataggggatttgagcaagaaacatggcagccagtcaagaacattgctaactccttgccaaacgtagcactgcccaaggtcccgtccctgcccctcaaccttccgcagatccctaacatttcaacagcttcatggatgcccagtttatacgaaagtactaacggaagcgcaacgtccgaggacctgttctggaaactcgacgctttgcaaatgtttgtcttcgacctccactggcctgagcaggagttcgcccaccaccttgagcaaagactcaagctcatggctagtgatatgttggaggcttgtgtgaaacgcactcgaaccgccttcgagctcaaactgcagaaggcttctaagacaaccgacctccgcattcctgcttctgtgtgcaccatgttcaatgtcctggtcgacgccaaaaagcagtctacaaagttgtgcgcgcttgacgggggccaggaacagcagtaccactcaaaaattgacgatttgatcgataactccgttaaagagattattagcctgctggtcagcaagttcgtgagtgtccttgaaggggtgctatccaaactctcacgctatgatgagggaacattttttagcagcattctctccttcaccgtgaaagcagcggccaagtacgtagacgttcccaagcccggcatggatctggccgacacatatattatgttcgtcaggcagaaccaggacatcctgagggaaaaggttaacgaagagatgtatatagagaaattgttcgaccagtggtacagctctagcatgaaagtgatatgcgtgtggcttaccgatagattggatcttcagctgcacatttatcaactgaaaaccctgatcaagatcgtgaagaaaacctatcgggattttagactgcaaggggtcctggaaggcactctgaatagcaagacttacgatacagttcaccggcgactgaccgtagaagaggccacagcatccgtatcagaagggggtgggttgcagggaataacaatgaaggatagcgatgaggaagaagaggggtag

SEQ ID NO: 110235 - DNA, 3891 bp, Artificial Sequence
  Description of Artificial Sequence: Synthetic coding sequence
atgctagatcctagcagcagcgaggaggagagcgatgagggcttggaggaggaaagcagagatgtactagtcgccgcagggtcaagccagcgagcgccccccgcccccacaagagaaggcaggagagatgctccgggaagagcaggaggtggaggagctgcacgaagcgtttccccatcccctagtgttctgagtgaggggcgcgatgaaccacagcgacaactcgacgatgaacaagagaggcggattagactgcagctgtacgtgtttgtagtcagatgtatcgcatacccattcaacgccaaacagcccaccgatatggctaggagacaacagaaacttaataagcaacagctgcagctcctgaaggagaggttccaagcattcctgaatggcgagactcaaatagtggctgacgaggcattctgtaatgcagtgagaagttactatgaagtgttcctaaagtccgacagagttgctcgaatggtgcagagtggtgggtgctccgcaaatgatttcagagaggtgtttaagaagaacatcgaaaaacgggtgcgcagcctccctgagattgatggcctgagtaaggaaaccgtgctttccagttggatagccaagtatgatgctatatatagaggtgaggaggatctgtgcaagcagccgaaccgcatggctctgtcagcagtctcagagcttatcctgagcaaagagcaactgtatgaaatgttccagcagatactgggaatcaaaaagcttgagcatcagctgctgtacaatgcctgccagcttgacaatgctgatgagcaggccgcacagatcaggcgggaacttgacggacggctgcaactggcagataagatggccaaggagaggaagttccccaaatttatcgccaaggacatggaaaatatgtacattgaggagctccggagctctgtcaatttgttaatggctaatctggaatctctccctgttagcaaaggcggtccagagtttaagctgcagaagctgaaacgtagccaaaatagcgcattcttggacatcggagatgaaaacgagatccagctgtctaaatcagacgtggtcctttccttcactctcgaaatagttatcatggaggttcaaggtcttaaaagcgtggcaccaaaccggatcgtgtactgtacaatggaagtagaaggagagaaactgcagactgatcaggcagaagcctctaggccccagtggggcactcaaggtgactttacgacaacccatccccgtccagttgttaaagtcaaactgttcaccgagtcaacaggcgttctggcactggaagacaaagaactgggtagagtcatcctctacccaacttctaattcctccaaatcagccgaactccacaggatggtggtgcccaaaaattcccaagactctgacctaaagattaaactggccgtccgcatggataagcctgcccatatgaagcactcaggatacctctatgcactggggcaaaaggtgtggaagagatggaagaagaggtatttcgtactcgtgcaggtgtctcagtatacattcgcaatgtgcagttatcgggaaaaaaaatctgagccgcaagagctaatgcagttagagggatatacagtggactatacagacccacaccctggactgcaggggggctgcatgttttttaatgccgtcaaagaaggcgacaccgttatctttgccagcgacgacgagcaggaccgcatcctgtgggttcaagccatgtaccgagccactgggcagtcttacaaacctgtgcccgcaattcagacccagaagctgaatcccaaagggggaaccttacacgccgatgcgcagttgtcgggcaaagatgcggatagatttcagaagcatggaatggacgaattcatcagtgcaaatccatgtaaacttgaccacgcttttctctttcggattctgcagaggcagaccttggatcaccgcttgaacgatagctacagttgcctgggatggttctcccccgggcaagtattcgtgctggatgaatattgcgcacggtacggagtccgagggtgccacagacatctctgctacctggcagaattgatggaacactcagagaatggcgcggtcatcgatcctacactactacactatagcttcgccttttgcgcaagccatgtccatgggaatcggcccgacgggatcggcaccgtcagtgttgaggaaaaagagaggttcgaagaaataaaggaacggcttagcagtctgcttgagaaccaaattagccacttcaggtactgtttccccttcggaagacccgagggagcgctgaaagcgaccctttccctgctggagcgtgtgctcatgaaggatattgctacgcccatccccgctgaggaggtcaaaaaggtcgtgcgcaaatgtctggagaaagctgctttaattaactacaccagactgacggagtatgcgaaaattgaggagactatgaatcaagctagcccagccaggaagcttgaagagatcctgcacctggccgagctttgcatcgaggtgctccagcaaaacgaagaacatcatgctgaaggaagggaggcctttgcctggtggcctgacttactcgcagaacacgcggagaagttctgggctctattcactgttgacatggatactgccctcgaagcccagccccaggatagctgggacagtttcccactcttccaattgctcaacaacttcttacgtaacgatactcttttgtgcaatggcaagtttcacaagcatctgcaggagatcttcgtcccactcgtggtgcggtacgtggaccttatggagtccagcattgcacagtccatccaccggggtttcgagcaggagacctggcagcccgtgaagaatatcgccaactctttgcccaatgtggccctgcctaaggtaccgtccttacccttgaacttaccgcagatccccaacatttccacagcctcatggatgcctagcctgtatgagtcgaccaatggaagtgcaacatccgaggacctgttttggaaactggatgcactgcagatgtttgtgtttgacctacactggccagagcaggagtttgcgcatcacctggagcagcgtctaaaactcatggctagcgatatgctggaagcctgcgttaaacgcacgcggactgcgttcgagctcaaattgcagaaagccagcaagacaacggatctaaggatccccgcaagcgtgtgtacaatgttcaatgtgctggtcgatgccaagaagcagagcactaagctgtgcgctcttgacggcggccaggagcagcagtatcattctaaaatagatgatctgattgataatagcgtgaaagagatcattagcctcctggtctctaagtttgtcagtgtccttgagggtgtgctgtccaaattgagccgctatgacgagggcacattttttagctcaatactgtcattcaccgtcaaagcggccgctaaatacgtggatgtccccaaacctggaatggacctcgcggatacttatatcatgttcgtgcggcagaaccaggacatcctgcgggaaaaggtaaatgaagagatgtatatcgagaagttattcgatcaatggtacagttcaagtatgaaggttatctgtgtctggttaaccgaccgccttgacctccagctccacatataccagttaaaaaccctcatcaaaatcgtaaaaaaaacctacagggatttccggctacagggcgtgcttgagggcaccctcaactctaaaacttacgatacagtgcacaggcggctcacagttgaagaggccaccgccagcgtcagtgagggtggggggctccagggtatcactatgaaggactccgatgaggaggaagaggggtag

SEQ ID NO: 110236 - DNA, 1473 bp, Artificial Sequence
  Description of Artificial Sequence: Synthetic coding sequence
taatatacacggctcaccgagtatgcgaagatcgaggggcctgcagaaaaagagacagaaacaatgaaccaggcctctcccgctcggaagttggaagaaatcctccacctagccgagctttgtattgaagttctgcaacagaacgaggagcatcacgcagagggcagggaggcgttcgcctggtggccagatcttctagccgagcacgctgagaagttctgggcactcttcaccgtggatatggataccgccctggaagcccaacctcaggacagttgggacagtttcccgctgttccagctgctgaacaacttcctgcggaacgacacattgttatgtaatggtaagtttcacaagcatctacaggaaattttcgtccccctggttgtcagatatgtagaccttatggaatcaagtattgctcaatccattcaccgcggcttcgagcaggagacatggcagcccgtgaaaaacattgccaattccctgcccaacgtggccctgcctaaggtaccctccctgccccttaatttgccacagatacccaatatttctaccgcttcctggatgccctctctgtatgaatccaccaatggatccgccacctcggaagatttattttggaagctggacgctttgcagatgttcgtgtttgacttgcattggcctgagcaggaatttgctcatcatctggaacagcggctgaaactgatggctagcgatatgttggaggcttgcgtgaagcgaacgagaacggcatttgagctgaagttgcagaaagcttctaaaacaactgatctgcgtataccagcctctgtgtgcaccatgtttaatgtcctcgtggatgccaaaaagcagtccactaaactctgcgccctcgacggcggccaggaacagcagtatcacagcaagatagacgacctgattgacaacagcgtcaaggagatcatttccctgcttgtcagtaagttcgtttctgttctggagggcgtgcttagcaaactgagccgctacgatgaggggactttcttctcctctatcctctcttttactgtgaaagcggccgcaaagtatgtggatgttcctaagcccggtatggacctagcagacacatacattatgtttgtgaggcagaatcaagacattctgcgcgaaaaggttaacgaagaaatgtacatcgagaagcttttcgatcagtggtacagctccagcatgaaagtgatctgcgtatggttaactgatagactcgacctgcagctacacatatatcagttgaagactctgattaagatagtaaagaagacctatcgggacttccgactgcaaggtgtgttggagggcacgctaaattctaagacttatgatacagtccacagaagattgactgttgaggaggcaactgccagtgtcagcgagggaggtggtctccagggcattactatgaaggatagcgatgaagaggaggagggctag

SEQ ID NO: 110237 - DNA, 3669 bp, Artificial Sequence
  Description of Artificial Sequence: Synthetic coding sequence
atgctggatccaagctccagtgaagaagagtcagacgagggtcttgaggaggagtctcgtgatgttttggtggcagcgggctcatcccagcgggctccccccgccccgactagagagggccaactggacgatgagcaggaacggagaattaggttgcagctgtatgtctttgtggtacgctgcattgcgtaccccttcaatgcaaaacagccaacagatatggcacgaagacagcagaaacttaacaagcaacagctacagttgctgaaggagcgcttccaggcttttttaaatggggaaacccagatcgtggctgacgaggccttttgcaacgctgtccgctcatactacgaggttttcttgaagtccgatagggtagcgcggatggtgcaaagcgggggctgcagcgccaatgacttccgggaggtgtttaagaaaaacattgagaagcgggtgcgcagtctgccagaaatagatggactttcgaaggagacagttctgtcaagctggatcgcaaagtacgatgccatttatagaggcgaagaagacttgtgtaaacagcctaataggatggctctctcagctgtgtccgaactgatcctgtccaaggagcagctgtacgagatgtttcagcaaattttgggaataaagaaactcgaacatcaactgctttacaacgcttgtcagctagataatgcagacgaacaggccgcccagattaggcgcgagctagacggtaggctgcaactcgccgacaagatggcaaaggagcggaaattccccaaatttattgccaaggatatggaaaatatgtatattgaggagctccgctcctcagtgaatctgctgatggccaaccttgagtcactgccggtctctaagggcggcccggaattcaaattgcagaagctcaagagatcacaaaactcagcatttcttgacattggggatgagaatgagatccagctgtctaaatctgatgtcgtgttgtccttcacactggaaatagtgataatggaagtccaggggttaaaatctgtagcccctaataggatagtctactgtactatggaggtggagggggagaaactgcagacagatcaagccgaagcctcacgtcctcagtggggtacacagggcgactttaccacaacccatccaaggcccgtcgtaaaggtcaagttgttcaccgaaagtacgggggtactagcgttggaagacaaggagcttgggcgggtgatcctatatcctacctctaatagcagcaaaagtgccgagctgcaccggatggtggtgcccaaaaattcccaagactcagatttgaaaatcaaactcgcggtaagaatggataaacctgcgcatatgaagcactctggctacttgtatgcattaggacagaaggtttggaagcgttggaagaagaggtattttgtcctcgtccaggttagtcagtacacctttgcaatgtgctcatacagagagaagaaaagtgagcctcaggagttgatgcagctggagggttatactgtcgattacacagatccccaccccggtctccagggcggctgtatgttctttaacgccgttaaggagggggacaccgtgatctttgccagcgacgacgaacaggaccggatcctatgggttcaggcgatgtacagggccaccggccagagctacaaacctgtgcctgcaatccaaacacagaaactgaatccaaaaggtggaaccctgcacgcagatgcacaattgtatgctgacaggttccaaaagcatggcatggacgaattcatttctgccaatccctgcaaactggatcatgcctttctattcagaattttgcagagacaaactctagaccatagacttaacgactcatactcatgcctcggctggttttcccctggccaagttttcgttctggacgagtactgtgcccgctatggggtacggggatgccaccggcacctctgctacctcgccgagttgatggagcacagcgaaaacggagccgttatcgatcctacactattacattacagcttcgccttttgtgcaagccacgtccacggaaaccgccctgacggcatcggcaccgtgtccgtggaggaaaaagagcgctttgaggaaatcaaagaacggctctccagtctgctcgaaaaccagatcagtcatttcaggtactgctttccctttggtaggcccgagggagctctcaaggcgacactgtcgctgctggagcgagttctgatgaaggatattgccacgccaatacccgctgaggaggtaaaaaaagtggtgagaaagtgtctggagaaggccgcactgatcaactacaccagactcacagagtatgccaaaatcgaggaaactatgaaccaggcaagtccagcaaggaaacttgaggagattctccacttggcagaactgtgcattgaggttctacaacagaatgaagagcaccacgccgaggcctttgcatggtggccagacctcctggcggagcatgcggaaaaattctgggctctgtttactgtggacatggacaccgctctggaagcacagccccaggactcatgggactcctttccactgttccaactgttaaacaatttcctgaggaacgacaccctcttgtgcaatggaaaatttcataagcacctccaagaaatctttgtgccattggtcgtgcgctatgtagacttaatggaaagctcgattgcacaatccatccatagaggcttcgagcaggaaacgtggcagcctgtcaataatggatctgccacgtccgaagacctcttctggaagttggacgcactgcagatgttcgttttcgaccttcactggcctgagcaggaatttgctcatcacttagaacagaggctcaagctaatggcatccgacatgctggaggcatgcgtgaaaagaactagaacagcctttgaactgaagctccagaaagctagcaaaacaactgatttgcgcattcctgcatccgtgtgcacaatgttcaatgtgctcgtcgacgccaagaaacaatcaactaagctgtgtgctcttgatggaggccaagagttcggctctcaatggcagcagtatcattcgaaaatcgacgacctgattgataattctgtgaaggagataatttcactgctggtgtcaaaattcgtgtccgtgctcgagggcgtactgtctaaactgagtaggtatgacgagggtacgtttttctcatctatcctctctttcactgtgaaggctgccgctaagtatgtagacgtccctaagcctggaatggacttggcagacacctacatcatgtttgtgcggcaaaaccaggacattctccgtgagaaagtaaacgaggaaatgtacatcgagaagctgttcgatcagtggtactcatcatccatgaaggttatctgtgtgtggctcacagatagactggatctccaactccacatttaccagctgaaaacactgataaaaatagtcaagaagacctatcgggactttcgcctacagggagtgctggagggtacattaaattccaaaacatatgataccgtgcatcgacggctcacggttgaggaggccaccgccagcgtgtcagagggcggtggcctgcagggcattaccatgaaggattcagatgaggaggaggaagggtag

SEQ ID NO: 110238 - DNA, 2367 bp, Artificial Sequence
  Description of Artificial Sequence: Synthetic coding sequence
atgactatccaccaatttcttctgctctttttgttttgggtgtgtttgccccacttttgtagcccggaaatcatgtttcgacgcaccccagtgccccaacagcggatcctcagtagtcgcgtccctaggagtgacggaaagatcctacatcggcagaagcgcggatggatgtggaaccagttctttctgttggaagaatataccggttctgactatcagtacgttggaaagttacactcggatcaagataagggcgacggatccctgaagtatatcctctcgggagatggtgccgggaccttgttcattatcgacgaaaaaacaggagacatccacgccacgcggagaatcgatagagaggagaaggccttttatactctgagagctcaggctataaaccgtcgaacgcttagaccagtggagccagaatctgaatttgtaatcaaaattcacgacatcaacgacaatgaaccaaccttccctgaagagatctacaccgcctctgttcccgaaatgtccgtggtcggcaccagcgttgtgcaggtgacagcaacagacgctgatgaccctagctatgggaacagcgctagggtgatctactcaatcctacagggtcagccctactttagcgtggaaccagagacaggtatcataagaaccgcactgcccaatatgaatcgagaaaatcgggagcaatatcaggttgtgatccaggcaaaggacatgggcggacagatgggcggcctcagcgggacaactacggtcaatatcacactaacggatgtaaacgacaaccccccccgattcccacaaaacaccatccatctgcgcgttctggagtctagtcccgtggggaccgctatcgggtcagtgaaagctaccgacgccgataccgggaagaatgctgaggtggagtacagaataattgatggcgatgggaccgacatgttcgatattgtgaccgaaaaagacacacaggagggaatcataacggtcaaaaagcctctggactacgaatcaaggagactgtacacattaaaggtggaggccgaaaacacacatgtagaccccagattctattatctcggaccatttaaggacaccacgattgtgaaaatttccatcgaggacgtggatgagcctcctgtattctctagatccagttatctctttgaggtgcatgaggatatagaagtggggacaattatcggaactgtcatggcgagggatccagatagtatttcctcccccatcagattctcactcgatcggcacaccgacttggacaggatttttaatattcacagcgggaatggttccctgtacacttccaagccactggacagagagctgtcacagtggcacaatctcaccgtcatcgccgccgagatcaataaccccaaggagacgacgcgggtggccgtcttcgtccgcatactggacgtgaatgataacgcgccccagttcgcagtattctatgatacatttgtttgtgagaatgcaaggccggggcagctgatacagactatatcggctgtagataaagatgatcccttaggcgggcagaagttcttcttctcactggcggctgtgaaccctaatttcactgtccaggacaatgaggacaatacggccaggatactgacgagaaagaatggcttcaaccggcacgagataagcacatatctcctgcctgtcgtgatatccgataacgactaccccattcagtcttctaccggcaccttaacaataagagtatgtgcctgtgactcccagggtaatatgcagagctgttcagccgaggctctactgcttcccgctggactgtcaactggagctttgattgccatactgctgtgcataattatccttcttgtcatagttgtgctcttcgccgctctgaaaagacagcgcaaaaaagaacctttgatcctgagcaaggaagacataagagacaacatcgtcagctacaacgatgagggcgggggcgaggaagatacgcaagctttcgacatcgggactttacgcaacccagccgcaatagaggaaaagaagctgcgacgggatatcatccctgaaaccctcttcatcccccgccgaacacccactgcaccagacaatactgacgtcagggacttcatcaatgagcggttaaaagagcatgacttagaccctaccgctcctccatacgattctttggcgacctatgcttacgaagggaacgatagcatagctgaaagcctctctagtctcgaatctggaactacagagggcgatcaaaattacgactatctgagagaatggggcccccgtttcaacaagctggccgagatgtatggaggaggtgagtcagataaggatagctag

SEQ ID NO: 110239 - DNA, 2385 bp, Artificial Sequence
  Description of Artificial Sequence: Synthetic coding sequence
atgctcacaaggaattgcctgtctttactcctgtgggtgcttttcgacggaggacttttaactcccctgcagccacaaccacaacagaccctagctaccgagccaagggaaaatgtgattcacctgccgggacagagatcccacttccagagggtgaaacgcgggtgggtgtggaatcagttcttcgtgcttgaggaatacgtcgggtcggagcctcagtatgtcgggaaactgcattccgacctggataagggagaagggacagtgaaatacaccctcagcggcgatggtgccggaacagtcttcaccatcgatgaaaccaccggggacattcatgccattagatccctcgaccgagaagaaaaaccgttctatacgctgagagcccaggctgtggacatcgagactcggaagcctctggagcccgaatctgagtttatcattaaggtccaggatatcaatgacaatgagccaaagtttctagatggcccctacgtcgctacagtgcccgaaatgtcaccagtaggtgcttacgtactgcaagtgaaggctactgacgcagatgaccctacttacggtaactccgcaagggtggtgtattctatccttcaggggcagccatatttcagcattgacccgaagacaggcgttatccgaactgctctcccgaacatggatagggaggtgaaagaacagtaccaggtgttaattcaggccaaggatatgggcggccagctcggtgggctggcagggacaactatcgtcaacatcaccctgacggatgtcaatgacaacccacccaggtttcccaagtcgatatttcacctgaaagttccagagagttcgccaatcggtagcgccattggaaggattcgagcagtggacccggacttcggacagaatgcagagatcgaatacaacattgtccctggagacggcggcaacctgttcgatatagtgactgacgaggatactcaagagggtgtgataaaattgaaaaaacctcttgactttgaaaccaagaaggcctataccttcaaggtcgaagcatccaacctgcacctggatcacagatttcacagcgcgggaccatttaaggacactgctactgtgaaaatttctgtgcttgatgtcgatgagcccccggtcttctcgaagcccctgtacaccatggaagtctatgaagacaccccggtcgggactatcattggcgccgtaacagctcaagatctggatgtcggcagtagcgcagtccgctatttcatcgattggaagtcggacggtgatagttatttcaccattgacggcaatgagggaaccattgccacaaacgaattactggatagggagagcaccgcgcaatataatttttccatcatagcatctaaggtatccaatccccttttaacctccaaagtgaacattctgattaacgtgttggatgtcaatgaattcccgcctgagatctccgtgccgtacgagactgccgtgtgtgagaacgccaagcctggtcaaattatccagatcgtgtcagccgcggatagagacctgagccctgcaggacagcaattttcatttcgtctgagccccgaggctgccattaagccaaactttaccgtacgggattttcggaataatacagcaggaatcgaaaccagacgcaacggttattcccgacgtcagcaggaattgtatttcctcccagtagtgatagaggatagttcttatccggtccagtccagtaccaataccatgacaatccgggtctgcaggtgcgactctgacgggacaatcctcagctgtaacgtggaagctatatttttaccagtgggactgtcaactggagcgctgattgccatccttttatgcatcgtgatattactcgccatagttgtcctgtatgtggcattacgcagacagaagaaaaaggataccctgatgacaagcaaggaggacattcgggataatgtcattcattacgatgatgagggcgggggagaggaagatactcaagcgttcgacataggagctttacggaaccctaaggtcatcgaagagaataagatccgaagagatatcaagcccgattctctctgtctgccgaggcaacgaccccccatggaagataatactgatattagggatttcatccaccagcggttgcaggagaatgacgtcgatccaaccgcccctccttacgatagcctagccacatatgcatacgaagggagtggatccgtggctgaatctctgagttccattgactctctgactacagaggctgaccaggactatgactacctgactgattggggcccacggtttaaggtgctcgccgacatgttcggcgaggaggagtcgtacaatcctgacaaagtaacatag

SEQ ID NO: 110240 - DNA, 2385 bp, Artificial Sequence
  Description of Artificial Sequence: Synthetic coding sequence
atgctcactcgcaactgtttgagcctcttgctgtgggtactgttcgatggtgggttattgactcccctgcagcctcagccacaacaaaccctggctaccgaaccacgagagaatgtcatccacctgccaggccagcgtagtcattttcagagggtcaaacggggatgggtttggaaccagtttttcgttttagaggaatacgtgggtagcgagccccagtacgttggaaaactgcacagcgatttagataagggcgagggaaccgtgaagtatacactctcaggggatggcgcggggactgttttcacgatcgatgaaaccaccggagatattcatgccatcagatctctggaccgagaggaaaaacctttctatacactcagagcccaggctgtggatatcgagacgcgtaaacctctggaacccgagagcgagttcattataaaggtgcaggatattaacgataatgaacccaagttccttgacgggccttacgtcgctactgtgcctgaaatgtcacccgtcggggcatatgtgttgcaggtgaaagccaccgacgcagatgatcctacctacggaaacagcgccagggtggtctactccattttacaggggcaaccctacttctcaatagatcccaagactggggtgattagaacagcactaccaaacatggacagagaggttaaagaacagtatcaggtgttaatacaggcaaaggatatgggtggtcagctggggggtcttgcaggcaccactattgttaacatcacgttgacagacgtgaatgataatccacctcgctttcccaagagcattttccatttgaaagtccctgagtcttctcctatcgggagcgcaatcggtcggatccgcgccgtagaccctgatttcggccaaaacgccgaaatcgagtacaacattgtccccggtgacggcgggaacctgtttgacattgtgaccgatgaggacacccaggagggcgtcataaaactgaaaaaacctttggacttcgaaacaaagaaagcctacacatttaaagtggaggcctcaaatctgcacttggatcatcggtttcacagtgctggccctttcaaggatacggcaactgttaaaatatccgtactggatgtggacgagccacccgtcttctcaaaaccgctgtataccatggaagtgtacgaggacacacccgtgggcactatcattggagcggtgaccgcccaagatctggatgtgggcagcagcgctgtgcgctatttcatagattggaagagtgacggcgatagttacttcactatagatgggaacgagggcacaatagcaactaatgagcttcttgaccgggagtccactgctcagtacaatttttcgattatagcgtccaaggtttccaatcctctgctgacctcaaaggtgaatattctgatcaatgtgctggacgtcaacgaattcccgcctgaaatctcagttccctacgagacagcggtgtgtgaaaacgccaagcccggccagatcatccagatcgtatccgctgccgacagagatctgtcaccagcagggcagcagttttctttccggctttcacccgaggccgccattaaacctaattttaccgtccgagactttcgaaacaatacagctggaatcgagactaggcgaaatgggtatagccgccgacaacaggaactctacttcctacctgtggtgatcgaggacagttcctaccccgttcagtcctctacaaatacaatgaccattcgggtctgccgctgtgattcagacggtaccatcctcagttgtaatgtggaagcaatttttctccctgtcggattgtccacaggagcccttattgcaatcctgctgtgcatcgtaatcctgctcgctattgtggtgctctacgtggcattgagaaggcagaagaagaaagatactctcatgaccagtaaggaggacataagagataatgtgatccactatgacgacgagggggggggcgaggaggacacacaagcattcgacattggcgctctacgcaatccaaaggtgatcgaggagaacaagatccggcgagatattaaacccgactcactttgtctgcccagacaacgccccccgatggaggacaatacagatatcagagactttattcaccaacgactgcaggagaacgacgttgacccaaccgctccgccttatgactccctcgccacctatgcctatgaaggatcaggcagcgtggcagagtccctctcaagcatagactctctcaccaccgaggcggaccaagactacgactacctgactgattgggggcccaggttcaaagttctcgctgatatgttcggagaagaggagagctataaccccgataaagtgacatag

SEQ ID NO: 110241 - DNA, 2265 bp, Artificial Sequence
  Description of Artificial Sequence: Synthetic coding sequence
atgcttacgcggaactgtctgagtctgctgctgtgggtcctcttcgacggcgggcttttaacaccactccagccacaaccccaacagactctcgctaccgaaccacgggagaacgtgatccacctacctggtcaaagaagccacttccaaagggtgaagcggggctgggtgtggaatcagttttttgtcctggaggagtatgtggggtccgagccacagtacgtggggaagttacactctgatctggataagggcgagggaactgttaaatacactctaagcggagacggcgcagggactgtatttaccattgacgaaacaacaggggacattcatgccattagaagcttagacagagaggaaaagcctttttacacactccgggctcaagccgtcgatatagaaactcgtaagccactggaaccagagtccgagtttattatcaaggtccaagatataaacgacaacgaaccgaagttcctggatggtccctacgttgcaaccgttcccgagatgtcacccgtaggcgtgatacgcactgcattgcctaacatggatagagaagtaaaggagcaataccaagtcctgatacaggccaaggatatgggcgggcagctggggggcctggctgggactaccattgtgaacattaccctcacagacgtgaacgacaaccctcctcgttttccgaagtccatcttccacttgaaagttccggaatcctctcccatcgggtcagccatcggtcgcatccgggctgtcgacccagatttcggtcaaaatgccgagatcgaatacaatatcgttcccggagatggaggcaacctgtttgacatcgtgaccgatgaggacactcaggagggcgtgattaaactgaaaaagcctctggacttcgagaccaagaaggcttatacatttaaagtggaggctagcaacttgcacttggaccatcggttccattctgccggcccatttaaggatacggccacagtgaagatatccgttcttgatgtcgatgagcctcccgttttctccaagcccctttacactatggaagtgtacgaagataccccagttggaaccatcataggggctgttacggcccaggatctggacgtggggtcttctgccgtgcgctactttatcgactggaaaagtgatggggactcctattttacaatcgacggaaatgaaggtactatcgccacgaatgagttgttggaccgcgaatccactgcacagtataacttctctatcattgcaagcaaggtaagcaacccactgttgaccagcaaggtaaacattctgatcaatgtgttagacgtgaacgagttcccacctgaaattagtgtcccctatgaaaccgctgtgtgtgagaacgcaaaacctggtcaaattattcaaattgtttcggctgcagaccgagatcttagtcccgccggtcaacaattctcttttaggctcagccctgaagcggctatcaaaccaaattttacagtgcgcgactttagaaacaacactgccgggatcgaaacccgtagaaacgggtacagccgccgccagcaggagctgtacttcctcccagtcgtaattgaagatagcagctatcccgtacagagcagcacgaataccatgaccataagggtttgtagatgtgatagcgatggcacgattttgtcatgtaacgttgaggccatttttcttcccgtcggtctctctactggcgccttgattgccatactgctatgcatcgtgatcttattggctatcgttgtcctgtacgtggccctgaggagacagaaaaagaaggacaccctgatgacctccaaagaggacattagggataacgttatccattatgatgacgaaggaggaggcgaagaggacactcaggctttcgatatcggggccctgcggaaccctaaggtcatcgaagaaaacaaaattagaagggacatcaaacctgactccctgtgtctgcctcgacagagaccacccatggaggacaatacagatatccgggactttatccaccaaagactgcaagaaaatgacgtcgacccaactgccccaccttacgatagtctcgccacatacgcatacgagggcagtggttccgtggctgagtcactttcctccatagatagtctgacgacggaggcggaccaagactacgattacctcacagactggggacccaggttcaaagtcctggccgatatgttcggagaagaagagagctataacccagacaaggtgacgtag

SEQ ID NO: 110242 - DNA, 2445 bp, Artificial Sequence
  Description of Artificial Sequence: Synthetic coding sequence
atggatgccgcattcctcctggtgcttggtctgctggcgcagtcactgtgcctgagcttgggagttcccgggtggcggcgacctaccacgctttatccatggaggcgggcaccagctctcagccgcgtgcggcgcgcatgggtaatccctcccattagcgtttcagagaatcacaagcgattgccttatcctctggtccagatcaaaagtgacaagcaacaactgggttcggtgatatattcaatccaaggtcccggtgtagacgaggagccgcgcggcgtgttctcaatcgacaagttcaccggtaaagtattcctcaatgccatgctagaccgggaaaagaccgacagattcaggttacgcgctttcgcgcttgatctgggcgggtcaaccttagaggacccaaccgatctcgaaattgtagttgttgatcagaatgacaaccggcccgcttttcttcaggaagcctttactgggagagtcttggagggagcagttccaggcacctatgttactagggcagaggccaccgatgccgatgatccggagacagacaatgccgcattacgattctccattttacagcagggctctccagaacttttcagcattgatgagctgactggtgaaatcaggaccgtgcaggtgggcctggatagagaagttgtggctgtttacaacttaaccctgcaggtagctgatatgtcaggcgacgggctgacagcaaccgcctctgccataataactctggacgatatcaacgataacgcccccgaattcacgcgcgacgagtttttcatggaggctattgaggccgtgagcggagtggacgtgggaaggctagaagtggaggaccgggatttgccagggagccctaactgggtcgcccggttcactatcctggagggagatcctgatggccagtttacaatacgaaccgacccgaagaccaacgagggagttctgtctatcgttaaagctcttgactacgagtcttgcgagcattacgagctgaaggttagcgtacagaacgaagcaccactccaggctgcagccctgagagccgagcggggtcaggctaaggtgagagttcacgtccaagatactaatgagccccccgtgtttcaggagaaccccttacggaccagcctcgctgaaggtgccccgccaggcaccctggtggcgacctttagtgcccgggaccctgacactgagcagctgcagcggctgtcttactccaaggactatgatccggaggactggctgcaggtggacgcggccaccggaaggatccaaacacagcacgtcctctcccccgcgtctccctttttgaaaggcgggtggtatcgcgccattgtcctggcccaggacgacgcgagtcagccccgaacagcaacaggtacccttagcatcgagattttggaagtaaacgaccatgcccctgtgttggctccccccccccccggctctctgtgcagcgaaccccatcagggacccggtttgcttctcggagccacagacgaggatctccccccccacggcgcgcctttccacttccagttatcacccaggctgccggagttaggtcgcaattggtctctatcacaagtgaatgtctcacatgctcgactgagaccacggcatcaggttcccgagggcctgcacaggctgagcctcctcctcagggacagcgggcagcctccgcaacagagggagcaaccacttaatgtgaccgtgtgtcgctgcggcaaggacggcgtttgccttcccggcgctgccgctctcctggccggcggcacaggcttatccctgggggcgctagttattgtgctcgcgtcagcactattgttgctcgtgctggtcttgctggtggccctacgcgctcgcttttggaagcagagccggggaaagggtctcttgcacgggccccaggacgatctaagggacaacgtcctcaactatgacgagcagggtggaggggaagaggaccaagatgcatacgatattagtcagctgaggcaccctaccgccctgagcctgcccctaggcccccccccattgcgacgcgatgccccccaggggaggttgcaccctcagcccccaagggtgcttcctacctctcctttggacatcgccgactttatcaatgatggcctagaagccgccgactctgacccatcagtgcccccttatgatacggcgcttatttatgactacgaaggcgacggaagcgttgccggcacacttagctctatcctgagttcccagggggatgaagatcaggattacgactacctgcgggactggggcccaagatttgcgcggctggcagatatgtatgggcacccatgcggactggagtacggagcccgttgggaccaccaggccagagagggcctatcccctggcgccctcttgcctcggcaccgaggacgaaccgcatag

SEQ ID NO: 110243 - DNA, 2373 bp, Artificial Sequence
  Description of Artificial Sequence: Synthetic coding sequence
atggtcccagcctggttatggctcctgtgcgttagcgttccccaggcactgcctaaggcacagcctgcagagctatccgtcgaagtgcctgaaaattacggcggcaatttccccctgtacctaaccaaacttcccctaccccgggagggagctgaggggcaaatcgtactcagtggagattcgggaaaggccaccgagggtccttttgctatggatcctgatagcggcttcctcctggtgacccgggccttggatcgcgaggagcaagctgagtaccagctgcaggtgaccttggaaatgcaggacggccatgtgctgtggggaccccaacccgtgctggtacatgtaaaggacgaaaatgaccaggtcccacactttagtcaggcgatttatcgtgcaaggttgtccaggggaaccagacctggcatccctttcctgtttttggaggcgtctgatcgtgacgaacctggaaccgccaactccgacttgcggtttcatattctgtcacaagccccagctcagcccagcccggacatgttccagcttgagccccgacttggggctctggctctctctccaaaggggagcactagcttggatcatgccttagagcgcacttaccagctacttgtacaggtcaaagacatgggtgatcaggcatccggccaccaggccactgcaactgtggaagtttccatcattgagtcaacttgggtgagcttggagccgatacacctcgccgaaaacttgaaggtgctctatccacaccacatggctcaggttcattggagcggaggggacgttcactatcacttggagtctcatcctcccggaccatttgaagtcaatgccgaaggcaacctgtacgttacccgagaactagacagagaagcgcaggctgagtacttgctgcaggtgcgggcacaaaattcacacggcgaggattatgcggcacccctggagttgcatgtgctcgttatggacgaaaatgacaatgtgcctatctgtccccctagggatcccaccgtttccattccagagttgtcccctccaggcacggaggtgacaaggttgtccgcggaagacgccgacgcacctggctcgccaaatagccatgttgtgtatcaactcctgagccccgaacctgaggacggggtggaaggtcgtgctttccaggtggaccctacctctggatcagttaccctcggggtgctccccctgcgtgccgggcagaacatcctccttttagtgctcgccatggatctggccggagcagagggcggcttcagttctacctgcgaggttgaggtggccgtaacagatatcaacgaccatgcccctgaattcatcacttcacagattggaccgatcagcctgccggaagatgtcgagccaggcacgctcgttgccatgttgacagcgattgacgcagatttagaacccgcattccgcctgatggattttgctattgaacggggcgacacagagggcaccttcggccttgattgggagccagactcaggccatgtccggctacgcctgtgtaaaaatctgtcttatgaggccgctccaagtcatgaagtggtcgtggtggtgcagagtgtcgctaaactggtgggccccggaccaggacccggggccaccgcaaccgtaaccgtgttggtcgagcgggtgatgcctccacctaaactggaccaggagagctatgaggcaagcgttcccatctccgctccagcaggatcattcttgttaaccattcagccatctgatcctattagtcggacacttcgattttcacttgtcaacgactctgaaggatggctgtgtattgagaagttcagcggcgaagtacatactgcccaatctttacagggggcacagccaggagatacctacactgtgctggtagaggctcaggacactgaccacggactgatagtttcgggtcccagcaaggatccagacttggcctccggtcacggcccatatagcttcacactagggcctaatcccaccgtgcaacgggactggagactgcaaaccctcaatgggtctcatgcttacctcaccctagctctgcactgggtcgagcctcgagagcatataatcccggtagtagtgagtcacaacgctcagatgtggcagttgctggttagagtgattgtatgtaggtgtaacgttgagggccaatgcatgcgcaaggtggggcgaatgaagggcatgccaactaagctgtcggctgttgggatcctggtgggcacactcgtcgccatcgggatcttcctgatattgatctttacacattggaccatgtctaggaaaaaggacccagatcagcccgctgactctgtacctctcaaagcgacagtttag

SEQ ID NO: 110244 - DNA, 2199 bp, Artificial Sequence
  Description of Artificial Sequence: Synthetic coding sequence
atggtgcccgcttggctgtggctgctgtgcgtttctgtgccacaagcgctcccaaaggcccaacctgccgagctctccgtggaagtgccggagaactacggaggcaactttcctctgtatctcacaaagctgccgttgccaagggagggagccgaaggccagattgtcctcagcggagactcgggcaaagccacagagggcccatttgctatggatcccgactctggatttctcctggtcacacgcgccctagatagggaagaacaggccgagtatcagctgcaagtgaccctggaaatgcaggatgggcatgtactctggggccctcagccagtgttggtgcatgtgaaggatgaaaacgaccaggcttccggacatcaagctacagccactgtggaggtgagcatcattgagtctacatgggtgtcactggagcccatccatcttgcagaaaacctgaaggtgctctacccacaccacatggcccaggtccattggagtgggggcgatgtacattaccatctggaaagccacccacccggccccttcgaggtgaacgcggaggggaacctttacgtcactcgcgagctggaccgcgaggcacaggcagaatatctgctacaggtcagggcccagaatagccacggggaggactatgccgcccccttggagctgcacgttctagtaatggacgaaaatgataacgtgcccatctgcccaccacgcgatccaaccgtgagcattcctgagctttccccccccgggacagaagtcactcgcctatcagcagaagacgccgacgccccgggcagcccaaattcacatgtagtgtatcaactgttaagtcccgagccagaggatggagtggaaggcagagcgtttcaggtggatccaacttccggtagcgtcaccctgggggtgctcccactgagagctggacaaaatatcctgctgttagtgctcgccatggatctagctggggcagaggggggcttctcatctacctgcgaggtagaggtggcagttaccgacatcaatgatcacgctccagaatttatcacatctcagatcggacccatctccctcccagaggatgtggagcccgggaccctggtagccatgttaaccgcgattgatgccgatctcgaaccggcgttcaggctgatggacttcgccatagaacgaggcgacactgagggaacctttggtctggactgggagcccgactcaggacacgtgcgcctgaggctgtgtaagaacctgagctacgaggcagccccctcacacgaagtagtcgttgtggttcaatctgtggccaagctggtggggcctggccccggccctggagcaaccgcaaccgtgactgtgctggtggagagagtcatgcctccaccaaaactcgaccaagaaagctacgaggcctccgttcccatcagcgctcctgccgggtctttcctgttaacaatacaacccagtgatcctatctctcggacactgcgttttagcctcgtcaatgattccgagggttggctctgcatcgaaaagttttcaggggaggtgcacacggctcagtccctacagggggcacaaccaggagatacatataccgtgctggttgaagcccaggacaccgatgagcctagactcagcgcttcagcccccctggtgatccacttccttaaagccccgcccgccccagccctgaccctggcccctgtaccgtctcaatacttgtgcactcctcgtcaggaccacggactgatcgtgtcgggcccttcaaaagacccagacctggcctccggccatggtccctattcattcacgctcggtcctaatccaaccgtacagcgggactggaggcttcagactttaaacgggtcccatgcttacctcacactcgccctccactgggtcgaacctcgggagcatattattcctgtggtggtgtcgcacaatgcacagatgtggcaactgctagtgagggtaattgtctgcagatgcaatgtcgagggccagtgtatgcgaaaagtggggcgtatgaagggaatgcctacaaaactcagcgccgtgggcatccttgtgggaacgcttgtggccattggaatcttcctgattctgattttcacccattggacaatgagcaggaaaaaggacccagaccaacccgccgattcggtgccactcaaggccactgtgtag

SEQ ID NO: 110245 - DNA, 2490 bp, Artificial Sequence
  Description of Artificial Sequence: Synthetic coding sequence
atggttccggcatggctttggctgttgtgtgtttctgtgcctcaggctctgcccaaggcccaaccagccgagctcagcgtggaggtgccagagaattacggcgggaactttccactctacttgacaaagttgccgttgccgagggagggggccgaaggacagattgtgctcagtggagatagcggaaaggcaaccgaaggccctttcgctatggatcccgattctggatttctgctcgtgacccgcgcacttgaccgtgaagagcaggctgaataccagctgcaggtgaccctggagatgcaagacgggcacgtgctgtgggggccacaacctgttctggtgcacgttaaggacgaaaacgaccaggttccccacttctcgcaagctatctatcgcgctcgcctctccagaggcacccggccaggtataccgtttctctttcttgaagccagcgacagggacgaaccaggcacagctaactcggacctcaggtttcatattctctcacaagctcctgcccagccttcccccgatatgttccagctagaaccacgcctgggcgctcttgctctctcccccaaaggatctaccagcctcgatcatgctttggaaaggacataccaactccttgtgcaagtcaaagacatgggggaccaagcctcaggacaccaggcgactgctactgtcgaggtgagcatcatcgagtccacatgggtcagcttagaacccatccatctggctgaaaatctaaaagtcctgtatccacatcatatggctcaggtccattggtccggcggagatgttcattatcacctggagagccacccccctggacccttcgaagtcaatgccgaggggaacctgtacgtgactagggaacttgacagggaagcccaggctgagtacctgttacaagtgcgcgcgcagaattcccacggcgaggattatgccgcgcccctcgagttacacgttctcgtaatggacgagaacgacaacgtgcctatctgcccacctcgtgaccccactgtcagtattcctgagctgtcgccgccgggtaccgaagttacacgactctcagctgaggacgccgatgccccgggcagccctaacagccatgtggtgtatcaactgctgtcccctgagccagaggacggggtggaggggcgggcctttcaagtagacccaacctccggctcggtgactctcggtgttctccctcttcgggccggtcaaaacatactgctgctggttctcgccatggatctggccggcgccgaaggcggattctcctccacttgcgaagttgaagtggcggtgactgacattaacgatcatgctccagaattcattacctctcagattgggcctatcagcctgcccgaggacgtagagccaggtacccttgtcgctatgctgacagccatcgatgcggaccttgagccagccttccgtctgatggactttgcaatcgaaaggggggacacagagggaacatttggactcgactgggagcccgactccggacacgtccgactgcgtctgtgcaaaaatttgtcttacgaggctgcaccgagccacgaagttgtggtggtggtacagagtgtggcaaagctggtgggtccaggccccggcccaggtgctaccgctaccgtcacagtcttggttgaaagggttatgcctcctcctaaactggatcaggagtcctatgaagcatcagtacccattagcgctcccgccggaagtttcttgttaaccattcaaccaagtgatccaataagccgcacgttaagattttcccttgttaatgacagtgagggatggctgtgtatcgaaaaattttccggcgaagtgcacacagcccaaagcctccagggggctcagcctggggacacatatactgtgcttgttgaagcgcaggacaccgacgagccacggctgagcgcaagtgctccgctagttatacactttttgaaggcacccccggcaccagctctaactctggcaccggtaccctctcagtatctctgcacaccccggcaggaccacggtctgattgtctccggcccaagtaaggaccctgaccttgcatcgggtcatggcccatatagtttcaccctgggtcctaaccccactgtccagcgcgattggaggttgcagacattgaacggctcgcacgcatacctgactctggctttacactgggtagagccaagggaacatatcatcccagtggtggtgtcacataacgctcagatgtggcagttgttagttagggttattgtctgccgttgcaatgtagaaggccagtgcatgcggaaggtggggcggatgaaggggatgcccaccaagctgagtgccgtcggaatcctcgtgggtacactggttgcaattggcatcttcctgattctcatcttcactcattggactatgtctaggaaaaaggatccggatcagccggcagattcagtccccctcaaagccaccgtgtag

SEQ ID NO: 110246 - DNA, 2424 bp, Artificial Sequence
  Description of Artificial Sequence: Synthetic coding sequence
atggttcctgcctggctatggctgctgtgtgtgtccgtcccgcaagccttacctaaggcacagccagctgagctgtcagtggaagtgccagaaaattacggcggtaatttcccactgtatctgactaaactaccattgcccagggagggtgctgagggccagattgtcctgagcggcgattccgggaaggctaccgaggggcccttcgctatggaccccgattcgggattcttgctggtgacacgcgctctggatagggaggaacaggcagagtaccagcttcaggttactctagaaatgcaggatggacacgtgttatggggtccacagcccgtcctggtgcacgtcaaggacgaaaatgaccaagtgcctcacttcagccaagctatttacagggcccgcctttcacgaggcacaagacccggtattcccttcttgttcctagaggccagcgaccgagacgagccagggaccgctaactccgatctccgatttcatattctgtcacaggccccagcccaaccatcaccggatatgtttcagctagaacccagattaggcgccctggctctctcaccgaaggggtcaaccagtcttgaccacgcattagaaaggacctatcagctcctggtgcaagtgaaagatatgggtgaccaggctagcgggcaccaggcaacggctaccgtcgaggtctccataatcgagtcgacatgggtcagcctggagcccattcatctggccgagaatctaaaggtcctttatccccaccatatggcccaggtgcactggtccggcggggacgttcattatcatctggagtctcatcctcctgggccatttgaagtaaatgcagaaggcaatctctacgtgactcgagaacttgaccgggaggcacaggcagagtacttgctgcaggtcagggctcagaacagtcacggagaggactatgctgcaccattagagttgcacgtcctggtcatggatgagaacgacaacgtcccaatttgtcctcccagagaccctaccgtgtctatcccagagctctctccccctggaacagaagtgacaagactgagcgccgaggatgccgatgccccaggaagcccaaattcccacgtggtctaccaacttcttagccctgagcctgaagacggcgtggaaggtagagctttccaggtagatccaacttctggctccgtcactttgggggtcctccccctccgtgctgggcagaatatcttactgctggtactcgccatggaccttgcaggtgcggagggagggtttagctctacatgtgaggtggaggtagctgtgacagatatcaatgaccatgcccccgagttcattacttcacagattggaccaatctccctcccggaggacgtcgagcccggcaccctggtagccatgttgacggccattgacgcagacctggagcccgcctttagactgatggattttgccatcgagaggggggacactgagggcacattcggcctagactgggaacccgatagtggccatgttcgcctgagactgtgcaagaatctgagctacgaggccgcaccgtcccacgaggttgtggtggtggtccagtccgtggctaagcttgttgggcctggtcccggtcctggagcaactgccactgttaccgtacttgtcgaacgcgtcatgcccccacccaagctggatcaggagtcatatgaagcctcagtccccatctctgccccagctggcagtttcctgcttacaatacagcccagcgacccgatctcacgaacccttcgtttcagtctggttaatgacagtgagggatggctgtgcatcgaaaagttctccggagaagttcacacagcccagtctctgcagggggcccaacctggggacacttataccgtcctcgtcgaagctcaggacactgccctgacactggcccccgtgccgtctcaatacctctgtaccccccgacaagatcatggattaattgtatccgggcctagtaaggaccctgacttagcctccggacatggcccatacagtttcaccctgggaccaaatccaaccgtacagcgcgattggagactccagaccctgaacgggagccacgcgtaccttacccttgccctgcactgggttgaacctagagagcatataattcccgttgttgtgtcgcataatgcacaaatgtggcagcttttggtgcgcgtaatcgtatgtcgatgcaatgtggagggccagtgtatgagaaaagttgggaggatgaaaggtatgccaaccaaactttccgccgttggaatattggttggcactctggtagcgatcggaattttccttatcctgatctttacgcactggactatgagtagaaaaaaggatccagaccagcctgcagacagcgtacccctgaaggcaaccgtttag

SEQ ID NO: 110247 - DNA, 2382 bp, Artificial Sequence
  Description of Artificial Sequence: Synthetic coding sequence
atggtacccgcctggctatggttattatgcgtgagtgtaccacaggccctgccaaaggcacagccagccgagctttccgtggaggtgcctgagaattatggtgggaattttccactgtaccttaccaaactcccactgccgagggagggcgccgagggacagattgtactttccggcgagcaagcagagatgcaagatgggcacgttctatggggcccccagcccgtattggtgcacgtgaaggacgaaaacgatcaagtgcctcatttcagtcaagcaatttaccgggcgagactgagtcgggggacccgccctgggatcccattcctctttctggaggccagtgacagggatgagcctggcacagccaacagtgacctgcgcttccacattttgagccaagcgccggcccagccctctcccgatatgttccaactcgagccccgtctcggggcactagctttatcgcccaagggaagcacaagtctggaccatgccctggagaggacttatcagcttcttgtacaggtgaaggatatgggcgaccaggcatcaggacaccaggcaacagccaccgtggaggtttcaatcatcgagtccacctgggtcagtttggaacctatccatttggccgaaaatctgaaagtgctgtacccccaccatatggctcaggtgcactggagcgggggcgacgttcattaccatctggagtctcacccccccgggccgtttgaggtaaatgccgagggtaacttgtacgtgacacgcgaactggatcgcgaggcccaggcagagtaccttctgcaggtgagagcccagaactctcacggggaggattatgccgcccctcttgagctgcatgttctcgtcatggatgaaaacgataatgtaccaatttgtccacctcgggaccctactgtgtccataccagagctctcacccccaggcaccgaggtaacccggctttccgctgaagatgccgacgcccccggcagccctaactcccacgtcgtgtaccaactactgagccccgagccagaggacggtgtcgagggcagagcatttcaggtagaccctactagcgggagcgtgaccctcggagtgctccccctccgcgctggtcagaatatactgttgctagttctcgcgatggacctggccggcgcggaaggcggctttagctctacttgtgaggtcgaggtcgccgtgactgatataaatgaccatgcccctgagtttatcacatctcaaattggacctataagtttacccgaggacgtggagccaggaaccttggtagctatgctaaccgcaatcgacgccgacctggagccggccttccggcttatggatttcgcaatagagcgcggagatactgaggggactttcggacttgactgggagcctgactccggccatgtgaggctgcgtttatgcaagaatttgagctacgaggccgcaccgtcacacgaggttgtcgttgtggtgcagagcgtcgccaaactcgttgggcctggaccgggtccgggcgcaactgctacggtgactgttttggttgagagggtgatgcccccccctaaactcgatcaggagtcatacgaggccagcgttcccatctccgcccccgcaggatcttttttattgaccattcagccctccgatcctatctctaggactcttcgatttagcctggtgaacgactcagagggatggctctgtattgaaaagttcagcggagaagttcatacagctcagtctcttcaaggggcgcaacccggggatacttatactgtgcttgtggaggctcaagatacagacgaaccaagacttagcgcctccgctcctctcgtgatccattttctgaaagctcccccggctccagcgttgacgttggcacctgtgccctcccaatacctctgtactccccggcaggatcatggcttaattgtgtctggaccctctaaagatcccgatctcgcttctggccacggaccctatagcttcactcttgggcccaatcccacagtccaaagggactggcgcttacagactctcaatggatcacatgcatatctgacactggcacttcattgggttgagcccagggagcatataatccctgtcgtagtgagccataatgcacagatgtggcagctgttggttcgggtgatcgtgtgccgctgtaatgtggaggggcagtgtatgagaaaggtgggccgcatgaaaggcatgcccaccaaattatcggctgtggggatcctagtggggacccttgttgccataggcatcttcctcatcttgattttcacccactggacaatgtcacgcaaaaaagaccccgaccagcccgccgattccgttccccttaaggctacggtctag

SEQ ID NO: 110248 - DNA, 2499 bp, Artificial Sequence
  Description of Artificial Sequence: Synthetic coding sequence
atgatcctgcaggctcaccttcacagtctgtgcctcctgatgctgtatttagccacaggatatggccaagagggtaagttctctgggccactaaaaccaatgacattcagcatatacgaaggccaggaaccatcccaaatcatatttcagttcaaggctaacccacccgcggtcactttcgaattgacaggagagacggataacatattcgtaatcgagcgagagggcttactgtactataatcgagcccttgacagggagacccgctctacccacaacttacaggtggcagcgctcgacgcaaatggtattatcgtcgaggggcccgtccctattacaataaaggtgaaagatatcaatgacaaccggcctacctttttacagagcaaatacgaaggtagtgtgaggcaaaacagcaggcctggcaaacccttcctatatgtgaacgctactgacctagacgatcccgccacccctaatggtcaactatattaccagattgtcatccaattgcccatgatcaataacgtgatgtacttccaaattaacaataagactggtgcgatcagcctgactcgagaaggctcccaggaactgaatcctgcaaaaaaccctagttacaacctggtcatctctgtaaaggacatgggtggacagagtgagaactccttcagtgacacaacctccgtcgacataattgtaacagaaaacatctggaaggctcctaaacccgtagagatggtagaaaactccactgacccgcatcccatcaaaattacccaggtccgttggaacgacccgggggcacagtacagcctggtggacaaagagaaactcccccggttccctttcagcatcgatcaggaaggggacatatacgtgacccagcctctcgacagagaggaaaaagatgcttacgtcttttatgccgtcgctaaggacgagtatggtaagcccctctcttaccctctggaaatacatgtgaaagttaaggatattaatgataacccaccaacttgtccttcacctgtgaccgtcttcgaggtgcaggaaaacgagcgactcgggaatagcattgggacactcacggcccacgatagggacgaagagaatacagcaaattctttcctgaattataggattgtagagcagaccccaaagttgcccatggacggattgttcctcattcagacttacgcagggatgctccagctggccaagcagtctctcaagaagcaggataccccacagtataatctgacaattgaggtgagcgataaggacttcaaaacactttgtttcgtacaaataaacgttattgacatcaatgaccagatacctattttcgagaagtccgactacggtaatcttactctggcggaggatacgaacattgggtctaccattctgactattcaggctaccgatgcggatgagcccttcacaggctctagtaaaattctatatcatatcatcaaaggggactcagaaggccgacttggcgtggatacagacccacataccaacacgggttatgtcatcataaagaaacccctggattttgagacggccgctgtgtcgaacatagtgtttaaggccgagaaccccgaaccactcgtgtttggagtgaaatacaacgcatcaagtttcgcaaaatttactttgatcgtgaccgacgtaaatgaggccccccagtttagccagcacgtgttccaggccaaggtgtctgaagacgtggctattgggacaaaagtcggaaatgttaccgccaaggatcccgaagggcttgacatcagttactcgttgcgtggggatacgcgtggatggctgaagatcgatcacgtcacgggggagatattcagtgtagcccccctggatcgggaagcagggtctccctatagagtccaggtcgtagccacagaggtagggggaagctctctcagtagcgtgagtgagttccatctgatcctaatggacgtcaatgataatcctccgcggctcgccaaggattacacaggtctgttcttttgtcaccccttgtccgctcccggctccctgattttcgaagcaaccgacgacgatcaacacctctttcgtggtccacattttaccttttcacttggttctggcagcctgcagaatgattgggaagtctctaagattaacggcacgcacgcccgcttatccacccgccataccgagttcgaggagagagagtacgtggtcctgattcgaatcaacgatggcggcagacctccattggaagggatcgtgtcgctgcccgtcaccttttgttcttgtgttgagggatcatgttttcggccagccggacaccagacaggaataccaaccgtgggaatggccgtggggatcctgctgaccacattgcttgtaattggaattatcctggcggtggtgttcattcggattaaaaaagacaaaggcaaagataatgttgagagcgcccaggctagcgaagtgaaaccgctccggtcttag

SEQ ID NO: 110249 - DNA, 2499 bp, Artificial Sequence
  Description of Artificial Sequence: Synthetic coding sequence
atgattctccaagcacatcttcactcgctgtgcttgctgatgctctatcttgctacaggatacggtcaggaaggcaagttcagcgggcctttaaaacctatgacattctcaatctatgagggccaggagccgagccagatcattttccagtttaaggccaatccacccgctgtgacctttgaattaacgggcgagacagacaacatttttgtcattgaaagagaggggcttctctactacaatcgagccttagacagagaaactaggagcacgcataacctccaggtggctgctctagacgctaatggaatcatagttgagggccccgttcccatcactatcaaagtcaaagacatcaatgacaacagaccaacgtttcttcagtctaagtatgaaggatctgtcaggcaaaactcacgacccggcaaacccttcctctacgtcaacgccactgacttagatgacccggccacaccaaatgggcagctgtattatcagatcgtgattcagctcccaatgatcaacaatgtaatgtatttccagattaacaataaaactggtgccataagcctcacacgcgaggggagccaggagctcaatccggcaaagaatccatcctacaatctggtcatttccgtgaaggatatgggtggtcaatcggagaattcgttctccgatactacatcagtggatatcattgttacagagaatatctggaaggctccaaaacctgttgaaatggtagaaaactccaccgatccacaccctataaaaatcacccaagtccgctggaacgacccgggtgcacagtactccctggttgacaaagaaaagctaccccgcttcccattcagcattgatcaagagggcgacatatacgtgacccagcccctcgatagagaagagaaggacgcttacgtcttttatgccgtggctaaagatgagtatgggaagcccttaagctatcccctggagatacacgtgaaagtcaaagacatcaacgataatccacctacatgcccttcaccagtgacagttttcgaagttcaggaaaatgaacggttaggcaactccattggcacgctaaccgcccatgacagagacgaggaaaacactgccaatagttttttaaattacagaattgtggagcagactccaaaactccccatggatggccttttcctcatccagacctacgctggcatgctgcagctggccaaacagagtctgaaaaagcaggacactccccagtataacttgaccatagaagtgagtgataaagattttaaaaccctttgttttgttcaaatcaacgtgattgacatcaacgaccagatacccatttttgaaaaaagcgattatggtaatctgaccctagcggaagataccaacatcggaagcactatcttgacaattcaagctacagacgccgacgagccctttactggctctagtaagattctgtaccatattatcaagggcgacagcgaaggcaggctgggtgtggacaccgatccccacactaacacggggtatgtgataattaagaagcccctcgattttgagacggccgccgtctccaacattgtgttcaaagccgaaaatcctgaaccgctcgtgtttggagtgaagtataatgcctcatcatttgccaagttcacactgattgtgacagacgtgaatgaagcccctcaattctctcaacacgtttttcaggccaaggtgagcgaagacgtggcgatcggcacaaaagttggcaacgtcacagccaaagacccggagggcctggacataagctactccctccgcggagatacgcggggatggctgaaaatagatcacgtcacaggtgagatattcagtgtcgcacccctggatagggaggctggtagcccatatcgggtgcaggtagttgctaccgaagtggggggctcgagcttatcttccgtcagcgaattccatctgattctgatggacgtgaacgacaacccaccacgacttgccaaggactatacaggcctctttttttgtcatcctctgtccgcgcctggttccctcatttttgaagccacagacgacgatcaacatttgttccgcgggccccattttactttttctctgggaagcgggagcctccagaatgactgggaagtttccaaaatcaacgggacccatgcgcgcctcagcactcggcacactgaattcgaggagcgggaatacgtggtgctcatcaggataaatgacggtgggagacccccactcgaaggcatagtgagcctgccagttaccttctgctcctgcgtggagggaagttgtttcaggccggccgggcaccagaccgggattcccactgtgggaatggcggtgggcatactgctgaccacccttctggttatcgggattattctggcggtcgtgtttatcaggatcaagaaggacaagggaaaagataacgttgaatccgctcaggcctctgaagtgaagcccctcagatcatag

SEQ ID NO: 110250 - DNA, 444 bp, Artificial Sequence
  Description of Artificial Sequence: Synthetic coding sequence
atgatccttcaggcccatctgcatagcctctgtcttctgatgctgtacctggctaccgggtacggacaggaaggcaagtttagcgggcccctcaaacccatgacattttctatatacgagggccaagagcccagtcagataatcttccagttcaaggccaacccgcctgctgtcacttttgaattaactggcgagactgacaatatatttgtgatcgagcgagagggactactctactataatagggccctggatcgggaaacacggagcacacataatcttcaagttgccgccttggatgcaaacgggatcatcgtagaaggtcccgtgccgattacaattaaagtgaaggatattaacgacaacagacctaccttcctgcagtctaagtatgaagggtctgtgaggcagaattccagaccaggaaagccttttctctactag

SEQ ID NO: 110251 - DNA, 2373 bp, Artificial Sequence
  Description of Artificial Sequence: Synthetic coding sequence
atgaagattacctccactagctgtatctgtcctgttctcgtctgtctgtgctttgttcagcggtgttacggaactgcccatcactcatctatcaaggtgatgagaaatcagaccaagcacatcgagggagagacagaagtgcaccacagaccaaaacggggatgggtgtggaaccagtttttcgtgctggaggaacatatgggcccagatccacagtatgtgggcaaacttcatagcaatagcgataaaggcgatggaagcgtgaaatacatacttaccggcgaaggcgccgggacaatatttattatcgacgatacgaccggggacattcattccaccaaaagcttggacagggagcagaagactcactatgtgctccacgcacaggcgatcgacagacgcacaaataaacctctggagcctgagtccgaatttatcatcaaagtacaggatattaatgacaatgctcccaagtttaccgatgggccttacatcgttaccgtgcctgagatgagcgatatgggaacctcagtactgcaagtgactgcaactgatgcagatgaccctacctacggtaattcagcccgagtcgtctactcaattctgcagggtcagccgtatttctccgtggatcccaaaacaggtgtcataagaaccgctctgcacaacatggaccgcgaagcccgagagcactatagcgtggtgatccaggccaaagatatggcgggtcaggtggggggtctgagtgggtctacaacagttaacattactctgacggacgtgaacgacaacccccctaggttcccgcagaagcactaccagctttatgtgcccgagagcgcccaggtgggatcagcagtcggcaaaatcaaggctaatgacgccgatacaggctccaatgcagatatgacatattctatcataaatggtgacgggatgggtatcttttctataagcacggataaggaaactcgtgaaggcatactgtccctgaagaagccactaaattacgagaaaaaaaaaagttacaccctcaatatagagggcgccaacacacatctggacttccgtttctcccacctgggtccttttaaggacgcaactatgctaaaaattatcgtgggggacgtggacgagccacctcttttctcgatgccatcctacctgatggaggtctacgaaaacgccaagatcggaactgtggtgggaaccgtactggcgcaagaccccgacagcacgaactctctggtacgttacttcatcaattacaatgtggaggatgacaggttctttaacatagatgccaatactggtactataagaacaactaaagtgcttgatagggaagaaacgccgtggtataacattaccgtcacagcatcggagattgacaacccagatctcctgagtcatgtgacagtcggtatccgggttcttgacgtgaatgataacccaccagagctggcccgagagtatgatattatcgtttgtgagaatagtaaaccagggcaagttatccacaccatatctgctaccgataaagatgatttcgccaatggtccacgctttaacttcttcctggacgagagactgcctgtgaaccctaatttcaccctcaaggacaatgaagacaataccgctagtatcttgactagacgacgacggtttagtcgtacagtgcaggatgtctattatttacctatcatgattagcgatggcgggattccttctctgagcagtagctccacactaaccattcgggtctgcgcctgtgagagggacggaagagtacgaacttgtcatgctgaagcatttctgagtagtgcgggactgtccacaggagccctcatagcaatcctcctctgcgtgttgatcctcctggccattgtcgttctcttcatcacactccggcgctccaagaaagagcccttgataatctctgaggaggatgtacgcgagaacgtggtgacctatgacgacgagggcgggggcgaggaagacaccgaggcattcgacattaccgccctgaggaaccctagcgccgccgaagagttaaaatatcgcagagacattaggcccgaagtgaaattaacgcctcgccaccagacaagcagcacattagagtctattgacgtccaagagtttattaaacagcggctggccgaagcggaccttgaccccagcgtcccaccatacgactcgctgcagacctatgcctacgagggccagcggagcgaggccggatccatcagtagcctggactcagccacaactcaatccgaccaggattaccattacctgggggactggggaccagaatttaagaagcttgcggaactttatggggagatcgaaagtgagcgaactacctag

SEQ ID NO: 110252 - DNA, 2373 bp, Artificial Sequence
  Description of Artificial Sequence: Synthetic coding sequence
atgaaaattactagtaccagttgcatctgccccgtcctagtgtgtttatgttttgtgcagagatgttatggaactgctcatcactcctccataaaggtgatgcgtaaccagacaaaacatattgagggtgagacggaagtccaccatcggccaaaacgcgggtgggtgtggaatcagttttttgtgcttgaagagcacatgggccccgacccacaatacgtgggcaaactccatagcaattccgacaagggggatggaagcgtcaaatatatccttaccggagagggggctgggactatattcattatcgacgatactactggagatattcattccactaaatctctcgaccgggaacagaaaacccattacgtgctccatgcccaagcgatcgaccgaaggacaaacaagcctctggagcctgaatctgaattcatcatcaaggtacaggatatcaacgataacgcaccaaagttcacagacggcccatatatcgtcaccgtgcccgagatgtccgatatgggcaccagcgttctccaagtcaccgcgactgacgcggatgatccaacgtacggtaactccgcgcgcgtggtctattccatcttgcagggacaaccctacttctccgtcgaccccaaaaccggtgtgattcggaccgcccttcacaacatggatagagaggcaagggaacattatagcgtggtgatccaggccaaagacatggctggacaggtagggggtttatccggtagcacaacggtgaacattacactcactgacgtaaatgataacccccctcgattccctcaaaagcactatcagctctatgtgccagagtccgcacaggtggggagtgcagtggggaagatcaaagcaaacgatgccgataccggaagtaatgcagatatgacctactcaatcataaatggtgacggaatgggaatttttagtatttccactgacaaagaaacacgggagggcattctttccttgaagaagccccttaattacgaaaagaaaaagtcttacactctgaatatcgagggcgctaacacccacctagacttccggttctcgcacctgggcccattcaaagacgccacaatgcttaagatcatcgtaggtgacgtcgatgaaccccctctgttcagtatgccatcctatttgatggaggtctatgagaacgccaaaatcgggactgtggtgggtaccgtgctagctcaggatcccgactctactaattccctggtgaggtactttattaattacaatgttgaggacgaccgcttcttcaatatcgacgctaacactgggacaatacggacgaccaaagtcctggaccgcgaagagacaccatggtataacatcactgtgactgcaagcgaaatcgacaacccagatctccttagccacgtgaccgtggggatccgagtgcttgacgtgaatgacaacccacccgaattggcaagagagtacgacatcatcgtgtgcgagaacagtaagcccggccaagttatccacaccatttccgctaccgacaaggacgacttcgctaatggtcccaggttcaacttcttcctggacgagaggctgcctgtcaaccccaactttaccctcaaggataatgaggacaacacagctagtattttaaccaggcggcgccggttttctcgcacagtccaggacgtgtattacctgcccatcatgatttcagatggcggcatacccagtctgtctagctcatcaaccctgaccatccgcgtctgtgcatgtgagcgagacgggcgagtgcgtacctgccatgcagaagcatttttatcttctgccggcctctcgaccggtgcgctgatagctatactcctgtgcgtgttgatcctcctcgccattgtggtcctattcatcacgctccgcaggtctaagaaggagcctttgatcatcagtgaggaggacgtgagggaaaacgtggtcacatatgacgacgaaggagggggcgaggaggacacagaggccttcgacatcacagccctgcggaatccaagcgccgctgaggaactcaaatatagacgtgatataaggcctgaggtgaagcttacccctaggcatcaaacaagctccaccttagaaagcatagacgtacaagagttcattaaacagcgccttgcggaagccgacctggacccttcagttcctccttatgactctctgcagacgtacgcctatgagggacagagatcagaagccggtagcatcagcagcttggactccgctactacccagtccgaccaggactaccactatctgggggattggggaccagagtttaagaagctcgccgagctctatggagaaatcgagtcggagagaacgacctag

SEQ ID NO: 110253 - DNA, 1725 bp, Artificial Sequence
  Description of Artificial Sequence: Synthetic coding sequence
atgaagataactagtactagttgcatttgccccgttttagtgtgtctctgtttcgttcagaggtgctacgggaccgctcaccatagctctatcaaagtcatgcgaaaccagaccaaacatattgaaggtgagaccgaagtgcaccataggccaaagcgaggttgggtctggaatcagttcttcgttctcgaagagcacatggggcccgacccacagtatgtcggcaaactgcattcaaacagtgacaaaggtgacggcagcgtgaaatacatcctgaccggtgagggggccggcaccatctttattatcgacgacaccaccggggacatccatagtacaaaatctttagatagagaacaaaagactcactacgtcctgcatgcccaggcaatagacaggaggacaaataagccattggagccagagtcagagttcattatcaaagtgcaggacataaatgataacgcacccaagtttacagacgggccctatattgtaaccgtacctgagatgagtgacatggggacatcagtgctgcaggtgacggccaccgatgcggatgaccccacatacgggaactctgctagggtcgtatacagcatccttcaggggcagccctatttttccgtcgacccaaagacgggcgttatacgtacagccctgcacaacatggaccgggaggctagggagcactatagcgttgtaatccaggctaaggatatggcaggtcaggttggtgggttgagtggaagcacaaccgtaaatattacactcaccgatgtaaatgacaacccaccacgcttccctcagaaacactaccagctgtacgtgccggaaagcgcgcaagttggctctgctgtgggcaagatcaaagcaaacgacgcagacaccggctcaaacgccgatatgacctactcaattattaatggcgatggtatgggaatctttagcatctcaaccgacaaagaaacacgtgagggcatcctgtccctgaagaagccgctcaactacgaaaaaaaaaagagctacaccctgaacatcgaaggtgcaaacacccaccttgacttccgatttagccatctcgggccttttaaggacgctactatgcttaaaattatcgtcggcgatgtagatgagcctccattgttctcgatgccttcctacttaatggaggtctatgagaatgccaaaatcgggaccgtggtgggaactgtcctggcacaggatcctgacagtaccaactccctggtccgctactttatcaactataatgtagaggacgacagattctttaacatcgatgcaaacaccggaactatcagaactaccaaggttctggacagagaggagacaccttggtataatataacggtcacggcttcagagatcgacaatcctgatttgctgagccatgttacagtgggaatacgagtgcttgatgtgaacgataatcccccagaattagccagagagtacgacataattgtgtgcgaaaactcaaaacctggacaggtcatccataccattagcgctactgataaggacgatttcgctaacgggcctcgcttcaactttttcctggatgaaagactacctgtgaatcccaacttcacactcaaagacaatgaggccgctgctccatctccgtctggttttgtgcacgctcgcgaaatgggcgtgtgtggcccagcaatgcagaaaccgtcatgtcccaggctcgtctag

SEQ ID NO: 110254 - DNA, 2373 bp, Artificial Sequence
  Description of Artificial Sequence: Synthetic coding sequence
atgaagattacctccacgagctgcatttgtcccgtactcgtgtgcctgtgtttcgttcagaggtgctacggaaccgcccaccatagctccatcaaggttatgcggaatcaaaccaagcacatcgagggggagactgaagtgcatcatcggccaaagcgtggctgggtctggaaccagttcttcgtcctagaggagcacatgggtcctgacccacagtacgtggggaaactgcacagtaactccgataaaggagacgggtcagtaaagtatatactgaccggggagggcgccggaactatatttattatagatgacaccacaggtgatattcactcaacgaaaagtctggatagagagcaaaaaacacactacgtgctccatgctcaagcaatcgatcgaaggacaaacaaaccactggaacctgagtccgaatttatcatcaaggtgcaagatatcaatgataatgctcctaagttcactgacggaccttacatcgtcactgtcccagagatgtccgatatgggaacatcggtactccaggtcaccgccactgacgccgatgaccccacatatggcaatagcgcaagggtagtgtactccatactgcaaggccagccatacttcagtgtagaccctaaaaccggggttatccgcaccgccctgcacaacatggacagagaggctcgcgaacactacagtgtcgtgatccaggccaaagacatggcaggccaggtggggggcctgagtggttcgacaacagtgaatattaccttaacagacgtgaatgataacccaccacgattccctcagaagcactatcagctttatgttcccgagagtgcccaggtgggtagtgccgttggcaaaattaaggccaatgacgctgatacgggcagcaacgccgacatgacctacagtatcataaacggagacggcatgggcatcttctctatttctaccgataaggagacaagagaggggattctctcacttaagaagcctctgaattacgaaaagaaaaaaagctacactctgaatatcgaaggagccaacacccacctggactttagattcagtcacctgggcccatttaaagatgcaactatgctgaagataattgtaggagatgtcgacgagccacccttattcagcatgcccagctatctcatggaggtatacgagaacgccaaaattggcaccgtggtcggaaccgtcctcgcgcaggaccccgactcaactaacagcctggttcgatactttatcaattacaacgtggaggatgatagattctttaatatcgatgcgaatacaggaacgatacggaccactaaagttttagatcgggaagaaaccccttggtataatattaccgtgacagcttccgagattgataatcctgatctgttgtcacatgttactgtggggataagagtgctcgatgtgaatgacaatccgcccgagctcgccagggaatacgatatcatagtttgcgaaaattcgaaaccaggccaggttattcacaccataagcgcaaccgataaggacgattttgccaatgggcccaggttcaatttttttctggacgagcggctgcccgtcaatccgaacttcactttaaaagataatgaggacaacacagctagtattctgacccggaggcgccggttttcgcggacagtacaagatgtgtactatctgcctatcatgatctccgacgggggcattccaagcctctctagcagcagcacactcactattagagtttgcgcttgtgagagggacgggagagtcagaacctgccacgcagaagcctttctgtcctcagccggcctgtctacaggcgctctgatcgcaattcttttatgtgttctcattctcctcgccattgtcgtactgttcattactcttcgcagatccaaaaaggaacctttgatcattagcgaggaggacgtcagggagaacgtggtgacctatgacgatgaggggggcggggaggaagatacagaggcctttgacattacagccctgcgaaatcctagcgccgctgaagagctgaagtaccgccgggatatcaggcctgaagtaaagctcactcctcgtcatcagaccagctctactttggagagcattgatgtccaggagttcatcaagcagagactagccgaggcagatctcgatccctctgtgcccccttacgactcactgcagacttatgcttacgaagggcagcgctctgaagcagggagtatcagctcactcgattctgcaacgactcagagtgatcaagattaccactatcttggtgattggggcccggaatttaaaaaactcgctgaactctacggcgaaattgaatctgaaagaaccacctag

SEQ ID NO: 110255 - DNA, 2373 bp, Artificial Sequence
  Description of Artificial Sequence: Synthetic coding sequence
atgaagatcacctctaccagctgcatctgtcccgttctcgtttgcctgtgctttgtccagcgctgttatggaacagctcaccacagcagcattaaggttatgagaaaccagacaaaacacatcgaaggcgagaccgaggtgcatcaccgccctaagagggggtgggtgtggaatcagttcttcgtgctcgaggagcatatgggaccagacccgcagtatgtaggaaaacttcacagcaactccgacaaaggcgacgggagcgtgaagtacatactgaccggcgaaggcgccggtaccatctttataatcgatgacacaaccggggacattcactcaacaaaaagtttggatagggagcagaagacccactacgtacttcatgctcaagcaattgataggcgaaccaacaaacccctcgaacccgagtcggagtttataatcaaggttcaggatatcaatgacaacgcacctaagtttactgacggcccctatatcgtcaccgtcccagaaatgtccgatatgggtacctctgtcctgcaagtgacagcaacagacgcggatgaccccacatacggtaactccgcgcgagtcgtctatagtatcctgcagggtcaaccgtacttctccgtggatcctaaaacaggcgtgatccggacagctcttcataatatggacagagaggcgagggagcactattctgtggtgatacaagcgaaggacatggcaggccaggtggggggtctctcaggatctactaccgtgaacattaccctgacggacgttaacgacaacccccccaggtttccgcagaagcactatcagttatacgtacccgagtcagcacaggtcggcagcgcagtgggaaagatcaaggcgaacgacgcagacaccggatcaaatgctgatatgacatactcaattatcaatggcgacgggatgggcattttctccatctcaaccgacaaggaaacgcgtgagggaattctctcattaaagaagccgctgaattatgaaaaaaaaaagtcatatactttgaacatcgaaggagccaacactcatctggatttccgcttctctcatttgggtcccttcaaggacgccacgatgctcaagattattgtgggtgacgtcgacgagccaccccttttttccatgcctagctacctcatggaagtttacgagaatgccaagatcggcaccgtagtggggaccgtcctggcacaggacccggattccacaaattccctggttcgctattttattaactataacgttgaggacgaccgcttttttaatattgacgccaatacagggaccataagaaccactaaagtactcgatcgcgaggagactccctggtacaatattactgtgacagcttccgaaattgataacccagacctcctttcgcatgtaaccgtcggaatccgggtcttggatgtcaatgacaacccacccgagcttgcccgagagtacgatattatagtgtgtgagaactctaaaccaggccaagtcatccatacaatatccgcaaccgataaggatgattttgccaacggaccgaggtttaatttttttcttgacgaacgcctcccagttaaccccaatttcaccctgaaggacaacgaggacaataccgcatcaatactgacaaggcgacgtcgattctcacggacagttcaagacgtgtactatttgccaattatgatctcagatggcggaatcccttccctgagctcctcctccacgctaacaattcgggtgtgcgcgtgtgaacgcgacgggagggtgaggacgtgccacgcagaagcattcctgtcctcggcagggctaagcactggcgccttaattgcaatcttgttgtgcgtgctgattctgttagcaatagtcgtcttgtttattactctaaggcggagcaagaaagagcccctcatcatctccgaagaagacgtgcgagagaatgttgttacatacgacgacgagggtgggggcgaggaagacacagaggcgtttgacattacagctctgcggaatcctagcgccgctgaggaactcaagtatcggcgagacatccggccagaagtaaaattaacaccacgccatcaaacatcatccacactggagagtatagatgttcaggaattcatcaaacagcgtctggcagaagccgaccttgacccctcagtccctccatatgacagtctgcaaacctatgcgtatgagggtcagaggtctgaggctggatctatctctagcctggacagcgcaacaacccagtccgaccaggactatcattacttaggtgactggggtcccgaattcaagaagctcgccgagctatacggcgagatagagagcgagaggactacctag

SEQ ID NO: 110256 - DNA, 2319 bp, Artificial Sequence
  Description of Artificial Sequence: Synthetic coding sequence
atgaactgctacctattgctcaggtttatgcttgggattcctcttctgtggccatgtctgggcgctactgaaaattcacaaactaagaaagtgaagcagccggtgaggagtcacctgagggtcaagaggggttgggtgtggaatcagttcttcgttccagaggagatgaacaccaccagccatcacatcggtcagctcaggtcggatcttgataatggaaacaatagttttcagtacaaactcctcggcgcgggtgcaggctcgacctttatcatcgatgaaagaaccggagatatatatgcaatccaaaaattggaccgggaggaacgcagtctgtatatattaagagcccaggttatcgatattgcaaccggaagagccgtcgaacccgagagcgagttcgtaattaaggtctccgatatcaatgacaacgaaccaaagtttcttgacgaaccatacgaagccattgtccctgaaatgtcccctgagggaaccctagttatccaggtaaccgcaagcgacgcagatgaccctagctcgggaaacaatgctaggctcctatatagcctattacaggggcaaccgtacttctccgtcgaacctactaccggcgtgatccgcatctcatctaaaatggacagagaactgcaagatgagtactgggtaatcatacaagcgaaggatatgattggccagccgggtgccttatctggcaccacctccgtgttaatcaaactctctgacgtgaacgacaataagccaattttcaaggagagcctgtacaggctgaccgtgtctgagagcgcccctaccggcacatccatcggaacaattatggcttatgacaacgatatcggtgagaacgcagaaatggactattccatcgaagaagatgatagtcagacctttgacataatcacgaaccacgagacgcaagaagggattgttattctaaagaaaaaagtggatttcgagcatcagaatcactatggcatacgagcgaaggtcaagaatcatcatgttcccgaacagttaatgaaatatcacaccgaggccagcacaacatttatcaaaatacaggtcgaggatgtagatgagcctcccttgttcctactcccctactatgtgtttgaggtgtttgaagaaacgccccagggatcctttgtcggtgtagtgagcgctacggatccggacaacagaaagtctccaatccgatattcaattaccaggtccaaagtgttcaatattaacgacaatgggaccatcaccacatccaactccttggatcgtgaaatcagcgcctggtacaatctgagcatcactgccactgaaaaatacaatattgagcagatctcatccattcctctgtatgttcaggtcctcaatatcaatgaccacgctccagaattctcccagtattacgaaacctacgtatgcgaaaacgcaggctccggacaagtgatccaaacaatttcagccgtggacagggatgagtcaatcgaggagcaccatttctattttaaccttagcgttgaagataccaacaattccagcttcacgattattgataaccaggacaataccgccgtgattttgacaaataggaccggtttcaacttgcaggaggaacccgtattttacatttcaattctcattgcggacaatggcataccctcactgacgtccacgaacacgcttactattcacgtctgcgattgcggagattccggtagcacgcagacatgtcagtatcaagagctggtgctgtccatgggattcaagactgaggtgatcattgcaattctgatttgcataatgattatcttcgggttcattttcctgacgttaggattgaagcagagacgcaaacagattttgttccccgagaagtcagaggattttagggaaaatatctttcagtacgatgacgaggggggaggcgaggaagataccgaagcttttgatatcgccgagctgaggtcctcaacaatcatgagggaaaggaagactagaaaaaccacgtccgccgaaattcggtccctgtatagacaatctctccaggtcggacccgactccgccatctttcgcaaattcatcttagagaaactggaggaggccaatactgatccatgcgctccaccttttgatagtttgcagacatacgcgttcgaagggactggttcgctggccggatctctgtcgtccctcgaaagtgctgtgtctgatcaggatgaatcatacgactatcttaatgaactcggacccagatttaaacgacttgcctgcatgtttggaagtgccgtgcagtctaacaactag

SEQ ID NO: 110257 - DNA, 1173 bp, Artificial Sequence
  Description of Artificial Sequence: Synthetic coding sequence
atgaatactacgtcacaccatatcggtcagttgagatctgatcttgataacggcaacaactccttccagtacaaactcttgggggcaggtgctgggagtacctttatcatcgacgaacgaaccggcgacatttatgcaattcagaagctggatagggaggagcgcagcctctatatcctgagggcgcaggtgatcgacatcgcaaccggcagggcagtggagccggagtctgagtttgtgatcaaggtgtcagacatcaatgacaacgagcccaaattcctggacgaaccctatgaagccattgtccccgaaatgagccctgagggcactttagtcatccaagtcaccgcaagtgacgcggatgatcccagctcgggcaataacgccaggttactttattcgctgcttcaaggccagccctatttttccgtggagccaacaaccggggttatcaggatctcttcaaagatggacagggagctgcaagacgagtattgggtgattattcaagccaaagacatgatcggccagccgggagctctgtcagggaccaccagcgtcctcataaaactcagcgatgtaaatgataacaagcctattttcaaggagagcctgtatcgcctgacagtaagtgagtcagcgcccactggcacgagtatcggaactatcatggcctacgataatgacatcggggagaatgctgagatggattactccattgaagaggacgatagccaaacgttcgatataataacgaatcatgaaactcaggaaggcatagtaatcctgaaaaagaaggtcgatttcgagcatcagaaccactacgggattcgagcgaaggtcaagaaccatcatgtaccagagcagctgatgaagtaccacaccgaagccagcacaacatttataaagatacaagtagaagacgtagacgaacctcctctgtttcttcttccctactacgttttcgaagtcttcgaagagacaccgcagggctcgtttgtgggtgtagttagcgccactgacccggataatcggaaaagccccattaggtactccataaccaggtccaaagtcttcaacatcaatgataatggaacaatcaccaccagtaattctcttgaccgggaaatttccgcatggtacaatttgtctatcaccgccaccgaaaagtag

SEQ ID NO: 110258 - DNA, 1473 bp, Artificial Sequence
  Description of Artificial Sequence: Synthetic coding sequence
atgaattgctacctgctgctcagatttatgttaggaattcctctgctctggccatgtcttggcgccactgaaaacagtcagaccaagaaggtgaagcagccagttaggtcacacctgcgggtgaaacggggctgggtgtggaatcaattcttcgtgccagaggaaatgaacaccacaagtcatcatatcggacagttacgctcagacttggacaacgggaataatagctttcagtataagctcctgggcgccggggcggggagcacgttcattatagatgagcgcaccggagacatatatgccatccaaaaactcgatagagaggaacgttcattgtacattttacgcgctcaagtcatcgatatcgccactggaagggctgtggagcccgagtccgaattcgtgataaaggttagtgacatcaacgacaacgaacccaagttccttgatgaaccctacgaggctatcgtgccagagatgtcacccgaaggtactctcgtgatccaggtcacagcaagcgacgccgacgacccctcctcgggcaataacgcacggctgttgtacagtctgctccagggacagccttacttttcggtagagcccactaccggggtgattagaatcagctcaaaaatggaccgggaattacaggatgagtactgggtaatcattcaggccaaagacatgatcggccaaccgggcgccttgtctggcaccacgagcgtactgattaaactatctgacgtgaacgacaacaaaccgatcttcaaagaaagcctgtacaggcttactgtcagcgagtctgcccccaccggtacctccattgggaccattatggcctatgacaatgatataggagagaacgcggaaatggactactcaatcgaggaagacgattctcagaccttcgacataattaccaaccacgaaacacaggagggcattgtcatactgaaaaagaaggtagactttgagcaccagaatcactatggaatcagagccaaggtgaagaaccatcacgtgccggagcaacttatgaaatatcacactgaagctagcactacctttatcaaaattcaggtagaggacgtggatgagccccccctgttcctgctgccttactatgtattcgaggtttttgaagagaccccgcaggggagctttgttggggtggtatctgcaactgaccccgacaatcgcaagagtccaattcggtatagcattacccggtcaaaggtttttaacattaatgacaacgggactatcaccacttccaacagtttggaccgggaaatttccgcatggtataatctgtccataactgctaccgagaagtacaacatcgagcagatctctagcatccccttgtacgtccaggttctgaatattaatgaccatgctcctgagttttcccagtactatgagacgtacgtctgtgaaaatgccgggtccggacagggactgttcttttag

SEQ ID NO: 110259 - DNA, 2406 bp, Artificial Sequence
  Description of Artificial Sequence: Synthetic coding sequence
atgtggacctcagggcgtatgtcaaacgctaagaactggctcggattaggcatgagcctgtacttctggggcttaatggatctgaccaccacagtgctgtccgatacaccgacgccccagggagaacttgaggccctgttgtccgataagccccagagccaccagcgcacaaagaggtcatgggtgtggaatcagttcttcgtcctggaggagtataccggcactgacccactctatgtaggtaagttgcattcagacatggaccggggcgatggttcaatcaaatacatcctttccggcgaaggggccggcatcgtctttacaatcgatgacactaccggagatatccatgctatccagagactggatcgtgaagagcgcgcccagtacacattgagagcccaggcccttgatcgcagaacaggccggccaatggagcccgagtccgaattcatcattaaaattcaggacattaacgacaacgaacccaagtttttggacggcccctatgtggccacagttcccgaaatgagtcccgtgggcacttccgtaatccaagtgactgctaccgacgccgatgaccccacatatggcaacagcgcccgtgtcgtatactctattctccaggggcagccatatttttcagtggactccaaaacaggtgtcatccgaacggctcttatgaatatggatcgtgaagcgaaagagtattacgaagtaatcatacaagccaaggatatgggcgggcagcttgggggacttgccggtaccaccaccgtaaacataaccctgtccgatgtcaatgataaccctcctcggttcccgcaaaaacactaccagatgagcgtcctcgagtccgcccctatatctagcactgttggcagggtttttgccaaggatctggacgaaggcattaatgccgaaatgaagtacaccatcgttgatggggatggagccgacgcctttgatataagcactgatccgaactttcaggttggaatcataacagtaaagaagcccctgagcttcgaaagcaagaaatcttacacactcaaggtagaaggggccaacccacatctcgagatgagattccttaacctgggcccttttcaggataccactaccgtgcatatcagtgtagaggatgtagacgagccccctgtgtttgagcctgggttttatttcgttgaagttcccgaagacgtcgccatcgggaccactattcagattatcagtgcgaaagatcccgacgtgactaataactcgattagatacagtattgaccgctcatcagatccaggcaggtttttctacgtagacattacgaccggggcactgatgacagcacgcccactggatagggaggaattctcatggcacaatataacggtactggctatggagatgaacaaccccagtcaggtcggctcagttccagtcacaatcaaggttctggacgtgaacgataacgcgccagaatttccgaggttctacgaagccttcgtatgtgagaatgcaaaagccgggcaattgatccagaccgttagcgccgtggaccaggacgacccacggaacgggcagcatttttattactcgctcgctcctgaagctgccaataacccaaatttcactatacgcgataaccaagataacactgctaggattctcacaaggagatccggattccgacagcaagagcagtccgtgtttcatttacccatactgattgctgattcggggcagcctgtgctttccagcacgggaaccctcacaattcaggtgtgctcctgcgacgatgacggacacgtaatgtcctgtagcccagaggcctacatgctgcccgtttctctctcgaggggcgccctcattgctatcctggcttgcatattcgtgctgttagtcttggttctgctcattcttagcatgcgcagacaccggaagcagccatatatcatcgacgatgaagagaatatccatgagaatattgtgcgctacgacgacgaagggggcggggaggaagataccgaggcatttgatattgccgctatgtggaaccccagagaagctcaagcaggggcagcgccaaaaacccgccaggatatgttacccgagatagaatccttgtcccggtacgtgccgcaaacctgtgcagtgaattccacagtgcatagttacgtgcttgctaagctgtacgaggccgacatggatttgtgggcaccccccttcgacagcctgcagacctacatgttcgaaggggacggatcagtggctggatctctcagctccttgcaatccgccactagtgacagtgagcaatcattcgacttcttgactgactggggcccgagattcagaaagctagccgaactgtatggggcgtctgaaggacccgctcctctttggtag

SEQ ID NO: 110260 - DNA, 2406 bp, Artificial Sequence
  Description of Artificial Sequence: Synthetic coding sequence
atgtggaccagtggccgcatgtccaatgcaaagaattggctgggactaggcatgtcactctatttctggggtctgatggaccttaccactacagtgctgtccgataccccgaccccccagggcgaactcgaggccctgctgagcgacaaaccgcagagtcaccagagaactaagcgctcatgggtttggaaccagtttttcgtgctggaggaatataccggaaccgaccctctgtacgtggggaaactgcattccgacatggaccgaggcgatgggtcaataaagtacatcctaagcggagagggcgccgggattgtgtttaccattgatgataccaccggtgacattcacgccatacagcgtctcgaccgcgaagagagagcccagtacacactgcgcgcccaggccttggatagacgcaccgggagacccatggagcctgagagtgagttcatcattaagatacaggatattaatgataatgagccgaaatttctagacgggccttatgtggccactgtgcccgagatgtcacctgtggggacctccgtaattcaggtaacagcaactgacgcagatgaccccacatacggcaatagcgctagagtggtgtatagcatcttgcaaggccagccatacttctctgttgactccaaaacgggagttattcgcactgctttgatgaatatggacagggaggccaaggagtattacgaggtgatcatacaagccaaggatatgggtggccagctcgggggcctggctggaacaacaacagtgaatatcacactgagtgacgttaatgataaccctcccagattccctcagaagcattaccagatgtcagttctagagtccgccccgatatccagtactgtcggaagggtgtttgctaaagacctggacgagggaatcaatgcagagatgaagtatacaatagtcgacggcgacggagccgacgcatttgatatttctacagacccgaattttcaggtaggcatcatcacggtcaaaaagcccctgagcttcgagtccaagaaaagctacaccctaaaggtcgagggtgccaatcctcacctggaaatgaggtttctgaaccttgggccattccaggatacaacaacagtgcatatttccgtcgaagatgtcgacgagcctcccgtgttcgagcctggcttttattttgtggaagtgccagaggacgtggctataggaaccaccatccagatcatctctgccaaagaccctgacgtcaccaataactcaatccgctattcgatcgacagaagcagtgatccagggcgcttcttttatgtggacatcaccacaggcgcactcatgacagccaggccgttagatcgcgaggaatttagctggcacaacatcaccgtcttagctatggagatgaataacccatcccaggtcggctccgttcctgtgaccataaaggtgctggacgtcaatgataatgcccctgaattccccagattctacgaggcctttgtgtgcgagaatgctaaagcaggacagcttattcagacggtcagcgctgtagaccaggacgatcccaggaacggacagcatttctactacagcctcgcacctgaggcggcaaacaatccaaacttcactatcagggacaaccaggacaacacggcaagaattctgacaagaaggtccggtttcagacaacaggagcagagcgtattccacttgccaattctcatcgcagatagtggccagcctgtactgtcatccacaggaaccttgaccattcaggtctgttcttgtgacgatgacggccatgttatgtcttgctcccccgaggcttacatgctccctgtgagcttatcccgtggcgcactcatagcaatcttagcttgcatctttgtgcttttagtgctcgtgctgcttatcctgagcatgcgtagacatcggaagcagccgtatataattgatgatgaagagaacattcatgagaatattgtgcgctacgatgatgaaggaggcggcgaagaggacactgaagcttttgacattgccgctatgtggaaccccagagaagctcaagctggagcagcccccaaaacccgccaggatatgctgccggagatagagtcattgtccagatatgtccctcagacatgtgctgttaacagcaccgtgcatagctacgtgctggcaaagttgtacgaggccgatatggatctctgggctccaccctttgacagcctgcagacttatatgttcgagggggacggctccgttgctggcagtcttagcagtttacagtccgcaaccagtgactcagagcagtcttttgactttctgaccgactgggggccacggtttcgtaagcttgcagaactgtacggagcgtcggaggggccggccccactgtggtag

SEQ ID NO: 110261 - DNA, 2406 bp, Artificial Sequence
  Description of Artificial Sequence: Synthetic coding sequence
atgtggacgagtggtcgcatgagcaacgccaaaaactggttgggcctcggcatgtctctgtacttctggggcttgatggatctgaccacaaccgttctgtccgacactccaacaccgcagggcgagctggaggctctcttgagcgacaagccccagtctcatcagcgtaccaagcgctcctgggtctggaaccagtttttcgtcctcgaggagtacacaggaactgacccattatatgtcggcaaattgcactcagacatggatcgaggcgacggttctatcaaatatatactctcaggcgaaggggcaggcattgtatttaccattgacgacacgacaggggatattcacgcgattcaacgcctcgaccgtgaggaaagagcacagtacacactgcgcgcacaagcactggaccgcagaaccggcaggcctatggaaccagagtcagagtttattatcaagatccaagacattaatgacaatgaaccaaagttcttagacggaccgtatgttgccacagtaccagagatgagccctgtgggaactagtgtgatacaagttacagccactgacgccgatgaccctacatatgggaactcagctcgtgtggtctatagcatcctccagggacagccatacttctctgtggattctaagacaggcgtaatcaggaccgccctcatgaacatggatcgggaggctaaggagtactacgaggtgatcattcaggccaaagacatgggggggcagctcggtggactggcggggacaacaacagtgaacataacactcagcgatgtgaacgataaccctccacgtttcccacagaagcactatcagatgagtgtcctggagtccgcgcctatatcttctacagtcggccgcgtatttgctaaagaccttgacgaaggtataaacgctgaaatgaaatatacaatcgttgacggggatggcgcagatgcttttgacatttccaccgatcctaatttccaggtgggaattatcacggtcaagaagccattgtcctttgaatcaaagaaaagctacaccttaaaagtcgaaggtgccaacccgcaccttgaaatgcgctttctgaatctaggtccttttcaggatacaacaaccgtccacatatctgtggaggacgtggatgaaccccctgtttttgagcctggtttttacttcgtggaagttcccgaagacgtggctataggcaccaccatacaaatcatctccgccaaggatccggacgtcacaaataacagcatccggtatagcatcgaccggtcatccgatccagggcgtttcttttatgtagacatcacaactggggcacttatgactgcacggcctctggaccgggaggaattcagctggcataatatcaccgtcctggctatggaaatgaataacccttcacaggtcgggtcggtaccagtgacaatcaaggtgctggacgttaatgataacgcgccggaattcccgcgcttctacgaggcctttgtatgcgaaaacgccaaagccggccagctaatccagactgtatccgccgtggatcaggatgacccgcgcaacggtcagcacttctattatagtttggcacctgaggctgctaataatcctaattttactattagagataaccaggacaatacagctcgtatcctaacaaggaggtccgggttcagacagcaggaacagtctgtgttccaccttcctatcctgatcgcggattcaggtcagcctgtcctatcctctaccggcacactcaccattcaggtctgcagctgcgatgacgatggacacgtgatgtcctgcagtccagaggcctatatgctgcccgtaagcctttcgagaggagctctcatagccatcttggcatgcatttttgtgttgctggtgctggtgctcctcattctctctatgagacgccatcggaagcaaccctatataattgacgacgaagagaatatccatgaaaatatcgttaggtatgatgacgagggcggaggagaagaagacacagaagctttcgatatagccgctatgtggaaccctcgtgaggcccaggctggtgccgccccaaagactagacaagacatgcttcccgaaatcgaaagcctgtcacgatatgtgccgcagacatgcgccgtgaacagcaccgtccactcctacgtgctggcgaaattatatgaggctgacatggacctctgggcgcctccattcgacagcctgcagacatacatgttcgagggcgacggctcagtcgctggtagtcttagttccctgcaatcggcaacatctgactccgagcagtccttcgacttcttaactgattggggccctcgatttcgcaaactggccgagctttacggggcatccgaagggcccgcgccactgtggtag

SEQ ID NO: 110262 - DNA, 2487 bp, Artificial Sequence
  Description of Artificial Sequence: Synthetic coding sequence
atgcggcctcgccctgaggggcgcggtctacgagctggcgttgcgctgagtcccgcactgctgctccttctgctgttgccacccccacctaccctgctgggtcgtctgtgggccgcagggactccttccccctcagcgcccggtgccaggcaggatggcgccctcggtgccgggagggtgaaacggggatgggtctggaaccaattctttgttgtcgaagagtatacagggaccgagccgctctatgtaggcaaaatccacagtgactccgacgagggggatggggccatcaaatacacgatcagcggagaaggcgccgggactatcttcctaattgatgagctaacaggcgatatccatgccatggaacgactcgacagggagcagaaaaccttctatacccttcgagcacaggcaagggaccgcgccaccaaccgactgcttgaacccgagagcgagtttattatcaaggtgcaggatataaacgatagcgagccacgctttctgcacgggccgtatattgggtctgtggccgagttatctccaaccggaacttctgtgatgcaagtgatggcatccgatgcagacgaccctacttacggttcgagtgccaggctggtgtacagtgtgctggatggagaacaccacttcacagttgacccaaaaaccggagtgattcgcaccgcagttccggatctcgatcgcgagagccaagagaggtacgaagtcgtcatacaggcaacagacatggccggacagctgggggggctgagcgggtcaactactgtaaccatcgtcgttaccgacgtaaacgataaccccccccgctttccacagaagatgtaccagttttccatccaggagagcgcccccatcggaacagcagtagggcgtgttaaggctgaggatagcgatgttggcgagaacacagatatgacataccatctgaaggacgagagctcatcaggaggagacgtgttcaaggtgaccaccgactccgacacccaggaggccattattgttgtgcagaaaagattggacttcgagagccaacctgttcatacagtgattctagaggccttgaataagttcgtagacccgaggtttgcggacctggggacatttagggaccaagccatcgttcgcgtggcggtcacggatgtagacgagccacccgagtttcgtcctccatccgggctcctagaagtgcaggaagatgcgcaagtaggtagcttggttggcgttgttaccgcccgcgatccggacgccgccaatcgaccagtccggtacgctattgaccgagagtcggatctggaccagatattcgacatagatgccgacaccggcgccattgtgactggtaagggcctcgaccgggagacagcgggatggcacaacatcactgtgctcgctatggaagcggataatcacgcccagttaagcagggcgtcactgagaattcggatcttggatgtgaacgacaacccccccgagttagctacaccttacgaagctgccgtgtgtgaggatgcaaaaccaggtcagctcattcagacaatcagtgttgtcgacagggatgagccccaggggggccacagattttactttcgtttagtacctgaggccccatcgaacccccatttcagtctgctggatatccaagacaacactgccgcagtgcatacacagcatgtgggtttcaaccgccaggaacaggatgtgtttttcctgcctatcctcgtggtcgatagtgggccgcccaccctgtcatccacaggcaccttgaccatccgcatttgtgggtgtgatagttctggaactattcagagctgcaacacaaccgcgtttgtcatggccgcctccctctctccaggcgccctaatcgccctgctggtgtgtgtactcattttagttgtcctcgttctcttaattttgactctcaggcgtcaccacaagtcacacctttctagtgatgaagatgaagacatgcgcgacaatgtcattaaatataacgacgagggtggcggtgagcaggataccgaggcctacgatatgtcagcgctccggtccctgtatgatttcggggagcttaaagggggggacggcggcgggagtgccggcgggggtgccggcggaggtagcgggggtggagcggggagccccccccaggcccacctcccctcagagcggcattctctgcctcagggtcctccaagcccagaacctgacttctccgtgttccgggattttatctctcggaaggtggcactcgccgacggcgacctctcagtgcccccctacgacgccttccagacttacgctttcgagggggccgactcgccagcagcaagtttatcttcattgcattcaggctcgagtggtagcgagcaggactttgcatacctgtcctcctggggccctcgatttcggcctctggctgccctttacgccggtcacaggggcgacgacgaggctcaggcttcatag

SEQ ID NO: 110263 - DNA, 2487 bp, Artificial Sequence
  Description of Artificial Sequence: Synthetic coding sequence
atgcggccaagaccagaagggcgcgggctcagagctggcgtggcacttagccctgccttacttctcctcttgctgctgccaccccctccgaccctgctggggaggctctgggcagccggaaccccgtcaccaagtgcccccggagcacggcaagacggcgccctgggggccggccgtgttaagaggggatgggtgtggaatcagtttttcgtagttgaagaatatacagggacagagcccctgtacgtggggaagatccacagcgattcggatgaaggggacggggctatcaaatacacgataagcggcgaaggcgcaggcacaatttttctgatagacgagctgaccggggatatccacgctatggaaaggctagacagggaacagaagaccttctataccttgagagcgcaggccagagatcgcgcaaccaatagattgttggagccagagagcgagtttatcatcaaagtccaggacatcaacgattctgagccacgattcctccacggcccgtatatcggctcagtggctgaactgtcccccactggtaccagtgtaatgcaagttatggctagcgacgccgatgatcctacgtacggatcttctgcgcgtttggtttactccgtgctggatggcgaacaccattttacagtggacccgaaaacaggggtcatccggaccgcagtccctgacctggatagggagtctcaggagcgatacgaggtagtcatccaggctaccgatatggcaggacagctcgggggactgagcggcagcacgaccgttactatcgtggtaaccgacgtcaatgataaccctcctcggtttccacagaagatgtaccagttcagtatacaggagtccgcacccataggaactgccgtgggcagggtgaaggctgaggacagtgacgtcggtgagaatacagatatgacttaccatctaaaggacgagtcatcatcagggggtgacgtgtttaaagtgacaactgactccgatacgcaggaggcaatcatcgtggtgcagaaaagattagacttcgagagccagcccgtgcatactgtcattttagaggctttaaataagttcgtggaccccaggttcgcagatctgggtacgtttcgagaccaggccatcgtccgggttgcagtaaccgatgtagatgaacctccggagttccgacctccaagcggcctcctggaagtgcaagaggatgctcaggtcggatcactggtcggggtggtgaccgcccgagaccccgatgccgcgaaccgaccagtgaggtacgctattgaccgcgaaagtgacctggaccagatctttgatattgacgccgatacaggagcaatcgtgacgggcaagggactggatagagagacggcgggctggcacaacataaccgttctggccatggaggcagacaatcacgcccagctctccagggcttctctccggataagaatcctcgatgtcaacgacaaccctcctgagttggcaacaccatacgaagccgccgtttgtgaagacgctaaaccaggccagctaatacagaccatcagcgttgtcgacagggatgagcctcagggaggccataggttctattttcgcctggtgccagaagctcctagcaacccgcatttctcactgctcgatattcaggacaacacggccgccgttcatacccagcacgtcggctttaaccgccaggaacaagacgtgtttttcctccccattctggtcgtggactccggccctccaaccctttcatctactggcacactgaccatccgcatctgtggctgcgattccagcgggacgattcagtcttgcaacaccacggccttcgttatggcagcctccttgtcgcccggcgcgcttattgcactgctggtttgtgtactgatcctcgtcgtcttggtgttgcttattctcacattaagacggcatcataaatcccatctgagcagtgacgaagacgaagacatgagagacaacgtcatcaagtacaacgacgagggcggcggtgagcaggataccgaagcctacgacatgagcgctttaagatccttgtacgactttggcgagctgaaagggggagatgggggcgggtccgcaggtggaggggccggtggggggtccggtggaggcgctggtagcccaccccaggcccatttgccatctgaacgtcattctttgccacagggcccaccttcgccagagccagattttagcgtatttcgggattttatttcaagaaaagtggcgttagccgacggggatctttccgtccccccttacgatgcctttcagacgtacgccttcgaaggcgccgactcaccggccgcaagtctgagctctctccatagtggctcgagtggatctgagcaggattttgcttatcttagcagttggggtccccgcttccgtcctctggcagctctgtatgcaggacaccggggcgacgacgaagctcaagcctcttag

SEQ ID NO: 110264 - DNA, 2490 bp, Artificial Sequence
  Description of Artificial Sequence: Synthetic coding sequence
atggggctgcctcgtgggcctctcgcgagtctcttgctgctgcaagtttgctggttgcagtgcgcagcaagcgaaccgtgtcgggccgtgttcagggaggctgaggtgaccttggaggccggcggtgctgagcaggagcctggacaggctctgggtaaggtctttatggggtgtccaggacaggagcccgcactgttctccacggacaatgatgacttcactgtgcggaacggggaaaccgtgcaggaaagaagatccctgaaggaacggaacccacttaagatattcccatcaaaaagaattttacgcagacacaagagagactgggtggtggcccccatttcagtcccagaaaacggaaagggtcccttcccacagcggttaaatcaactcaaatcaaataaggatcgcgacacaaagatattttactccatcaccgggcctggggcagactctccacccgaaggggtctttgccgtggagaaggaaacgggctggctgttgcttaacaagccgctggatcgagaagagattgctaagtacgagttgttcggtcacgcggtgtctgaaaacggtgcctcggtggaggacccaatgaatatcagcatcatagtgacagatcagaacgaccataagcccaagtttacgcaggacactttcagagggtccgttctagaaggtgtgctgcccggtaccagcgtgatgcaagtaactgcaacggatgaggacgatgctatttatacttacaacggagtggtcgcctacagtattcactcccaagagcccaaagacccccacgaccttatgtttaccattcaccgcagcaccggaaccatttctgtgattagctcaggcctggacagagagaaggtaccggagtacacactgaccatacaggcaacggacatggacggggacgggagtacgactacagccgtcgcggtggttgagattctggatgccaatgataacgctccgatgtttgacccacagaaatacgaagctcatgtccccgaaaacgctgtggggcacgaggtccagcggctgacggtgacggacctcgacgcccccaactcccctgcctggagggcaacatatctgatcatggggggggatgacggggatcactttacaataactacgcatcccgagtctaatcagggaattctaactacgcggaaaggactcgactttgaggccaagaatcagcacactttgtacgtggaggtgacgaacgaggccccttttgttctaaagctgcccaccagtacagctaccatcgtcgtgcacgtggaggatgtcaacgaggcccccgtctttgtccccccatccaaagtcgtagaggtgcaggagggcatacctacgggcgaacccgtgtgtgtctacaccgccgaggatccagacaaggagaaccaaaagatctcctacagaatactgagagatccagctgggtggctggcaatggaccccgattcgggccaggtcacagccgttgggaccctcgacagggaggacgagcagttcgtaaggaacaatatatatgaggtgatggttcttgccatggacaatgggtcaccccccaccacagggactggcaccctgctgctgaccctgattgacgtaaacgaccacggccctgtgcctgaacccagacaaataactatttgtaatcagtcccccgtacgccaggtccttaatattacagataaggatttgtcacctcatacatccccattccaggcccagctgaccgatgacagcgacatctactggaccgcagaagttaatgaagaaggagatacagttgttctgtctctgaaaaaatttctgaagcaagatacatatgacgtacacttgtctctttcagaccacggcaacaaggagcagttgacagttatcagagctaccgtgtgcgattgccatgggcacgtggaaacctgcccaggtccctggaagggcggcttcatactgcctgtactgggggcggtcctagccctgctctttctgctgttagtgctcctgctactcgtgcgaaaaaagagaaagataaaggagccgttactgctccctgaggacgacacacgtgataatgtgttctattacggagaggagggtgggggcgaagaggatcaggactatgacattacgcagttgcacagagggctggaggcgcgaccggaagtggtgcttcgcaacgatgtcgctcccacaatcattcccactccaatgtatcgacctcgcccggctaatccggatgagattgggaatttcatcatcgagaacctgaaggccgccaataccgacccgactgccccgccttacgataccctgcttgtgtttgactacgaggggagcggctccgacgccgcgtcacttagctcactgacgtcctcagcgagcgatcaggaccaagactatgactacctcaatgaatggggctctaggttcaagaagttggctgatatgtatggcggaggagaagacgactag

SEQ ID NO: 110265 - DNA, 2355 bp, Artificial Sequence
  Description of Artificial Sequence: Synthetic coding sequence
atgggtctcccacgcggccccctcgcctctctcctactgcttcaagtctgctggctgcagtgcgcagcctctgaaccatgtcgcgctgttttccgtgaggccgaagttacacttgaggctggaggcgccgagcaagaaccaggacaggctctcggtaaagtcttcatgggctgccccggccaggagcccgccctcttttctactgacaacgacgacttcacggttaggaacggggagactgtgcaggaacgtcggtcactgaaagagcgaaaccctctcaagatatttccatctaagaggatcctcaggcgccataaacgcgattgggtcgtggcacccatcagtgtaccggagaatggcaagggtccctttcctcagagactcaatcagctgaagtccaataaggatagggacacaaagattttttatagcatcactggtcctggcgccgacagtccacctgagggtgtttttgccgtagaaaaagagacagggtggctgcttctgaataagcctcttgacagggaagagatcgctaaatatgagctgtttggtcatgccgtttccgagaatggagcctccgtcgaggatcccatgaatatctcaataattgtgaccgatcagaacgaccataaaccgaagttcacacaggacacctttagaggaagcgtgcttgagggagtcctccccgggacaagcgtcatgcaggtgaccgcaactgatgaggatgatgcgatttatacatataacggggtagtggcctactccatacacagccaagaaccgaaagacccgcatgatctcatgttcacaattcaccgcagtaccggaacaataagcgtgatcagttcgggcttagacagagaaaaggtccccgagtacacactcaccatccaagccactgatatggatggcgatgggtcaacgaccactgccgtggcagtcgttgagattctagatgccaacgacaacgctccgatgtttgatcctcagaaatacgaagcacacgtgcccgagaacgcagtggggcacgaggtgcagcgactaacagtcactgatttagacgctcctaattccccggcatggcgtgctacctatttaattatggggggggacgatggggatcacttcacaattacaacgcatcccgaaagcaatcaggggatcctgaccaccagaaaaggtctcgactttgaggccaaaaaccaacacacactgtatgtggaggtgacaaacgaggcccccttcgtcctgaaactgccgactagcactgccacaatagtggtccatgtcgaagacgtcaacgaggcccctgtctttgttccccccagcaaggtggtagaagtgcaagaaggcatcccaactggcgaaccagtgtgcgtgtacacggccgaggatcccgacaaggaaaaccaaaaaatctcctaccggatcctgagagacccggctggatggctcgctatggaccccgattcaggacaggtgacagccgtcggcactctggaccgagaggatgaacagttcgtccgtaacaacatctacgaagtgatggtgctggccatggataacggcagcccacccaccacagggaccggcacccttctcctgactctgatcgatgttaacgatcatggaccagttcctgagccccgtcagattacaatttgcaaccagagtccagtgagacaggtactcaatatcactgacaaggacctgtccccccacacctccccctttcaggctcagctgacggatgactcagacatctactggactgccgaggtaaacgaagagggagacacagtcgtattatccttgaaaaaattcctgaaacaggatacctatgacgtgcatctcagcctgtcggaccacggtaataaagagcagttgactgttatcagggccaccgtctgcgattgccacggccacgtggaaacttgtcctggtccctggaaggggggattcatcttgccagtgctgggtgcggtgttagccctgctgttccttctgttggtgcttctgctcctcgtcaggaagaagaggaaaattaaggaacctctattgctgccagaagatgatacaagggacaatgttttctactacggtgaggaaggcggaggcgaggaggatcaggactatgatataactcagctgcatagaggcctcgaagcgagaccagaagttgtactgaggaatgacgtggcgcctaccatcattccaactcccatgtatcggcctcgccctgccaaccccgacgaaattggcaacttcattatcgaagggcggggcgaaaggggttcacagcgcggcaacggggggctccagctagctagagggaggacccggcggagctag

SEQ ID NO: 110266 - DNA, 2325 bp, Artificial Sequence
  Description of Artificial Sequence: Synthetic coding sequence
atggggtgccctggccaggagccagccctattttccaccgataatgatgacttcaccgttagaaatggggagacggtccaggagcgtagaagtctgaaggaacggaatccattgaaaatatttccatctaaaaggatcctgaggagacataagagagactgggtcgtggcacctatcagcgtgccagagaatggaaaggggccatttccccagagactcaaccaacttaagagtaataaggacagagatacgaagatcttttattccattactgggcccggcgctgactcaccaccagaaggtgtgttcgcggtcgaaaaagaaacgggttggctgcttttgaataagcctctggatcgcgaggagattgccaagtatgagctttttggacacgctgtgtctgaaaacggagccagcgtggaagaccctatgaacatcagcatcatcgtgacagaccagaatgatcataagcctaagttcactcaggacaccttcagaggcagcgtcttggaaggcgttctccctggcacatcagtcatgcaggtgacagccaccgacgaagatgacgccatctatacttataatggagtggtagcttattctatacactcacaggaacctaaggaccctcacgatctaatgttcacgattcataggagcacgggcacaatatccgtgatttcaagcggtttggatcgcgaaaaggtgccagaatacacactgaccatccaggctacagatatggatggagacggctccactacaacagcagttgctgtcgtcgaaatcctggacgcaaacgataacgcacccatgttcgatccccagaagtatgaggcacacgtgccagagaacgctgtgggccacgaggtgcagcggctcactgtcaccgacctggatgcacccaattctcctgcctggcgggcgacgtatttgattatgggtggcgatgacggcgaccactttacgatcactacccatccagagagcaaccaaggtatcctgactaccagaaagggcttagattttgaggcgaagaatcaacatacgctgtacgtcgaggttactaatgaggcaccctttgtgctgaaactgccgacatccacggccaccatcgtcgtgcatgtggaggacgttaacgaggcacccgtcttcgttcctccaagtaaagtggtggaagtccaggagggaattcctactggcgaaccggtgtgcgtgtatacggcagaggaccctgataaggagaatcagaaaatcagttaccgcattctacgcgaccccgcagggtggctggctatggatcccgacagcggccaggtgacagcagtgggcaccctcgatcgtgaggatgaacagttcgtgcgcaataatatttatgaggtgatggtgctggcaatggacaacgggagtccgcccacaaccggtacagggaccctgttgttgacgttaattgacgtgaacgaccatggaccagtcccagagccacgtcagatcaccatttgcaaccagtcaccagtccgccaagttctcaatattacggacaaagatctgagcccccataccagcccctttcaggctcaactcaccgatgacagtgacatctattggacggctgaggttaatgaagagggcgacacagtggtcctatccctcaagaagtttcttaaacaggacacctacgatgtgcacctatctctgagcgatcacggcaacaaggaacaactcaccgttatccgcgccactgtctgtgactgtcacggtcacgtggaaacttgccccgggccgtggaagggaggatttatactgcccgttcttggagccgttctggccctactgtttttacttctggtattattgctgctggtcaggaagaagcggaaaatcaaggagcccctgctgctgcccgaggacgacacacgagacaacgtgttctactacggcgaagaaggaggcggtgaagaagaccaggactacgacatcactcagttgcaccgtggccttgaagccagacctgaagtcgtgctcaggaacgacgtggcaccaaccattattccgaccccaatgtatagacctagaccagccaaccccgatgaaattggcaatttcattattgaaaatctaaaggccgccaataccgaccccactgcacctccatatgatacgctactcgtttttgactacgagggctcagggagcgacgctgcctcgttgtcttcattaacttcctcagcttcagatcaggaccaggactacgactacctcaacgagtggggatctcgcttcaaaaaacttgcggacatgtatggcgggggagaggatgattag

SEQ ID NO: 110267 - DNA, 2751 bp, Artificial Sequence
  Description of Artificial Sequence: Synthetic coding sequence
atgacagcgggagctggcgtgctgctgctactgctgtcactaagcggggcccttcgagcacataacgaggatctgacaacaagagaaacttgcaaagctggattcagcgaagatgactacactgctcttatatcacagaacatactggagggggagaagctattgcaggtgaagttcagtagctgcgttggtaccaaggggacgcagtacgaaaccaatagcatggactttaaggtcggtgccgacgggactgtttttgccactcgagagctccaggtgccttccgagcaggtcgcctttacagttaccgcttgggactctcaaactgccgagaaatgggacgcagtagttagattactagtggcacaaacttcttcccctcattcaggccacaaaccacagaaaggtaagaaggtggtggctctcgatccctccccccctcccaaagatactcttctgccctggccccagcaccagaacgccaacgggcttcgccggcggaaaagagactgggtaataccgccgattaatgtgcctgaaaacagtcgtggacccttcccacagcaactggttcgcattagatctgataaagacaatgatatcccgattcgttattccatcacaggagtgggggcggaccagccgcctatggaagtattcagtatcgacagcatgagcggccgtatgtacgtaacacgtcctatggacagggaagaacatgcaagttaccaccttagggcacatgccgtggacatgaacgggaataaagtagagaatccaatcgatctgtatatatacgtgatcgacatgaatgacaaccgtccagaattcataaaccaggtttacaatggctccgtcgacgagggcagtaaaccagggacatacgtgatgaccgtcacagccaacgatgcggatgatagcacaacggcgaatggaatggtacgatacagaattgtgacccagacaccacagtcaccctctcaaaacatgttcacaatcaactcagagacaggcgacattgtgacagtggcagccgggctggacagagagaaggttcagcagtatacagtgatagtgcaggctaccgatatggagggtaacctgaattacggcctctccaatacagcaactgccatcatcaccgtcaccgacgtgaatgacaacccccccgagtttaccgcaagtacttttgctggggaggtacccgagaacagagtggagactgtggtggccaacctgaccgttatggacagggaccaaccccatagccccaactggaacgctgtgtataggattataagcggggatcccagcggacacttctcggttaggactgaccccgtcaccaatgagggtatggtcacagtggtcaaggccgtggactacgaactcaatcgagcgtttatgctcacagtaatggtcagcaatcaggctccactggcctctggaatccagatgagctttcagtccactgccggagtgactatatctatcatggacataaacgaagccccgtactttcctagcaatcacaaactgattcggctggaggaaggtgtaccccctggaacagtgctgactacatttagcgctgtggatcctgaccgtttcatgcaacaggcagttagatattccaagctgtccgatcccgccagctggctgcacataaacgcaaccaacgggcagatcacaacggctgctgtcctggaccgggaatcactttatactaagaataacgtatacgaagcgacatttttagccgcagataacggcatcccacccgctagtggaaccggcactctccaaatctatcttatagatatcaacgacaacgctccagaattactgccaaaggaggctcagatctgcgaaaaaccgaacctgaacgcaatcaacatcaccgctgccgatgcagatgtagaccccaacataggaccttacgtgtttgagctcccttttgtacctgccgccgtcagaaagaattggactattacacggctgaacggggactatgcccagcttagccttagaattctctatttggaagcagggatgtacgacgtgcccattattgttaccgactccggcaatccacctctgagcaatacaagcattatcaaggtgaaggtgtgcccttgcgacgacaacggtgactgtaccacaatcggcgctgtggctgcagcagggttaggaacgggtgccatcgtcgctatcctgatttgcatactgatcctgctgacaatggttcttctgttcgtaatgtggatgaagaggagagagaaggagaggcacacaaagcagctgctaatcgacccagaggatgacgtgcgggataacattcttaagtacgacgaggaaggaggcggggaggaagaccaggattacgacctgtctcagctgcagcagccggaggccatgggccacgtcccaagcaaggcaccaggcgtacgacgcgtggacgaacgtcccgtcggcgccgaaccacagtatcccatccggcctatggtgcctcaccctggcgacattggggacttcatcaacgagggtctccgggctgccgacaatgaccccacagcacctccttatgactcactgctggtctttgactatgagggctccggttcgaccgcggggagcgtatcctcactgaacagttcaagcagcggtgaccaagactatgattacctgaatgactggggcccccgctttaaaaagctggcggacatgtatggcgggggcgaagaagactag

SEQ ID NO: 110268 - DNA, 2475 bp, Artificial Sequence
  Description of Artificial Sequence: Synthetic coding sequence
atgcccaaatctacgggcatgctgcacggagggagagaaaacgccggggtgaaattcagcagctgcgtgggcaccaaagggacacagtacgagaccagctctccacactccggccacaaaccccagaagggtaaaaaagtagtggcactggacccatccccacccccaaaagatacactgctgccatggccacagcatcaaaacgcaaacggtctaagacgacggaaacgtgactgggtgatccctcctattaatgtccccgaaaattctcgaggtccattccctcagcagttggtacggattcgtagtgataaggataatgacatccctattaggtactcaatcacgggcgtgggcgctgaccagcctcctatggaagtgttctctatcgatagtatgtcagggagaatgtacgttacccgccccatggatagggaggaacacgcaagctatcacttgagagcccacgcggtcgacatgaatggaaataaggtggaaaatccaatagacctgtacatctatgtgatcgatatgaatgataatcgccctgagttcataaaccaagtctataacggatccgtggatgagggtagcaagcctggcacttatgtcatgaccgtgactgccaacgacgctgacgattctacaacagcaaatggcatggtgagataccggatcgtgacccagacccctcagtcacccagccagaacatgttcactatcaactctgaaaccggggacattgttaccgtcgcagccggcttggatagagaaaaagtccagcagtacactgtgattgtgcaagcaaccgatatggagggtaacctgaattacgggctatcaaatacagccaccgcgataatcacggtgactgatgttaacgacaatccacccgaatttaccgccagtactttcgctggagaggtccctgaaaatagagttgaaactgtggtggctaatctgacggtcatggacagagaccagccacattctcctaactggaacgccgtgtaccgcattatatcaggtgacccgtccggtcacttcagtgtgaggaccgacccagttactaatgagggtatggtgaccgttgtgaaagccgtcgactacgagctaaatcgggccttcatgctgaccgtgatggtgtctaatcaggctcccctggcatcagggatccagatgagcttccagagcactgcaggagtcacaattagcattatggacatcaacgaggccccctacttcccgtccaaccacaaactcattcggcttgaagagggcgtaccacctggtacagtgttgacaaccttttcagccgtagaccctgatcgcttcatgcagcaggctgtgcgctacagtaagctgtcggatccggcctcctggctgcatattaatgccaccaatggtcagatcacaaccgccgctgtgctggatagggaaagcctgtatactaagaataacgtatatgaggccaccttcctggctgcggataacgggatcccaccagcctccggaactgggacactgcagatctatctaattgatataaatgacaacgcgccggagctgcttcccaaagaagctcagatctgcgaaaagcccaacctgaatgctatcaatataacagccgccgatgccgacgttgaccctaacattggcccatacgtgttcgaacttcccttcgttcccgctgcagtccggaagaactggacaataaccagacttaacggagattacgcacagttatccttacggattttatatcttgaagccggtatgtatgacgtgcccattattgttacagattcaggtaatccccctctgagcaacactagcatcatcaaggtaaaggtctgcccctgtgatgataatggagactgcactactattggcgccgtcgccgcagcaggacttggcacaggcgctattgttgccatcctcatctgtatcttaattctgctcactatggtcctgttgtttgtgatgtggatgaagcggcgtgaaaaagagcggcacacgaaacaactgttaatcgaccctgaggatgatgttcgcgacaatattcttaagtacgacgaggagggcggtggggaagaagaccaagactatgacctatcacagctccaacagccagaggccatgggccacgttcccagtaaagctccgggggttcggcgggtggacgaaagaccggtgggcgctgaaccccagtacccaatcagacccatggtcccgcatcccggcgacatcggtgactttatcaacgaaggtctgcgggccgcagacaatgaccctaccgccccgccttacgactctcttctggtgtttgactatgaaggatcaggttctacagccggcagcgttagtagcctcaattcatccagctcgggcgaccaggattatgattacctaaacgactgggggccacggtttaagaaactcgccgacatgtacggaggaggggaggaagactag

SEQ ID NO: 110269 - DNA, 2529 bp, Artificial Sequence
  Description of Artificial Sequence: Synthetic coding sequence
atggacttcaaagtcggagcagatggaaccgttttcgccactcgggaactgcaggtgccttcagaacaggttgctttcactgtaacagcctgggacagccagacggccgagaagtgggacgctgtcgttagacttttggtcgcccagactagctcaccccatagcgggcacaaaccacaaaagggaaagaaggtggttgccctggacccctcgccccctcctaaagatacactcctaccctggccccagcaccagaacgctaatggtcttcgtcggagaaagagagattgggtaattccacccattaacgtgcccgagaacagccgcggcccattccctcagcaactggtgcggattcgatcagacaaagataatgatatacctatccggtacagcatcactggggtgggggccgaccagccgcctatggaggtcttctccatcgattcaatgtccggacgaatgtatgttactcgccccatggaccgagaggagcatgcaagttaccatcttcgggcccacgccgtggacatgaatggaaacaaggtggaaaatcccatagacctgtacatctacgtcattgacatgaatgataacagacccgagttcataaatcaggtgtacaacggcagcgtcgacgaggggtctaaacccggcacatacgttatgacagtcaccgccaatgatgctgatgatagcacaaccgcaaacggcatggtgaggtaccgaatagtcacacagacccctcagtctcccagccagaatatgttcacaattaattccgaaactggagatattgtgacagtggcagcaggacttgatagagaaaaggtgcagcagtatactgttatcgttcaggccactgacatggaaggcaatctaaattatggattgagtaatacggcgaccgccataatcacagtgactgacgtcaatgataaccccccagagtttaccgctagcacatttgccggtgaggtgccggagaatcgggtggaaacagtggtggcaaatctgactgtgatggatcgggatcagccacactcccctaattggaatgcagtgtaccggatcatcagcggtgatccttcaggtcacttctcagtacgcaccgatccagtcaccaacgaagggatggttactgtcgtgaaggcagtagactatgagctgaatcgcgccttcatgctgaccgtgatggtctccaatcaggctcccttggcatccgggattcagatgagttttcaaagcactgctggagtcacaataagtatcatggatattaatgaagctccttattttcccagcaaccacaagctgatccgactggaagaaggagtccctccgggaaccgtcctgacaacatttagcgccgttgatcccgataggtttatgcagcaagcggttagatatagcaaattaagcgacccagcttcatggcttcacatcaacgcgacaaacggtcagataaccaccgcggccgtgctggatagggagagtctctacacaaaaaacaacgtatatgaagcgacctttctggccgcagataatgggatcccgccggcttccggcaccggcacacttcaaatttacctcattgatattaacgacaacgccccagaattgcttccaaaagaagcacagatctgtgagaaacctaacttgaatgcaatcaatatcactgccgcagatgcagacgtagacccaaacattggcccttacgtttttgaactgccattcgtgccggcggcagtgaggaagaattggacaattaccagactgaacggggattacgctcagttgtctctccgcatcttgtacctcgaagcaggtatgtacgacgtgccaatcattgtcacagactcaggcaaccctcctttgtccaacacgtcaatcataaaagtgaaggtatgcccctgcgatgataatggggactgtactaccatcggagctgtagcagcagcggggctgggcacgggagcaatcgttgcaatcctaatttgtattctgattctcttgacgatggttctgctgtttgttatgtggatgaaacgccgcgagaaggaaagacatactaagcagctgctgattgatccagaggatgacgtaagagacaatatccttaaatatgatgaggagggcggcggggaggaggatcaagactacgatctgtctcagcttcagcagcctgaagccatgggacacgttccaagtaaggcgccaggcgtccgccgagttgatgaaaggcccgtgggagccgagccccaataccccattcgccccatggtaccccaccctggggacatcggagactttattaacgaggggctgcgggccgctgacaatgacccgaccgcccctccatatgatagcctgctggttttcgattacgaaggttcaggaagtacggcggggagcgtgagttcactaaactcctcctcaagcggcgatcaagattacgattatctgaatgattggggtccacgcttcaaaaagttggccgacatgtacggggggggggaggaagattag

SEQ ID NO: 110270 - DNA, 2358 bp, Artificial Sequence
  Description of Artificial Sequence: Synthetic coding sequence
atgaaactgggcaaggtggagttctgccactttcttcagcttatcgctctctttctgtgtttttccggaatgtcccaggccgagctgagtcgcagtcgtagcaagccttatttccagagcggcaggtctcgtactaaaagatcttgggtgtggaatcagttttttgtgctcgaggaatatatgggcagtgacccactatatgtgggaaaactgcatagcgacgtggacaaaggggatggtagtattaaatacatactcagcggcgagggggcgtcatctatcttcatcattgatgagaacacaggcgatattcatgctactaaacggctagaccgcgaggagcaggcatactatacactcagggcccaggctcttgacagattaactaataaacccgtcgagcctgagtccgagttcgtcataaaaatacaggatataaacgacaacgaacccaagtttctggatggcccttacactgccggggtgcctgaaatgtctccggttggcacctcagtcgtccaggtgacagctaccgatgccgatgaccccacctatggaaattctgcgcgggtagtttactccattttgcaaggtcagccttattttagcgtggagcctaagaccggcgtaatcaaaaccgctctgcccaatatggaccgcgaagcgaaagaccagtacttacttgtgatccaggctaaggacatggtgggacagaacggcgggctgagcggcacaaccagcgtgaccgtcaccctcaccgacgtgaatgacaatccccctagattcccacggcggagttaccaatataatgtgcctgagagtcttcccgtggcctcagtggtagctcgcatcaaagccgcagatgctgatattggcgccaacgcagagatggagtacaaaatcgtcgacggcgatggcctgggcatctttaagatctctgtggataaagagacccaagagggcatcatcactattcagaaggaactggattttgaggcaaagactagttatacgctgagaatcgaagcagccaacaaagatgcagatccaaggttcctgagcctaggcccattcagcgacactaccacagtcaaaattatcgtggaggacgttgatgagccccctgttttcagcagtcctctgtaccctatggaggtttctgaggctactcaggttggtaatatcataggaacggtggccgcccacgaccctgactcctcgaactctcccgtgcgttattccattgatcgcaataccgacctggagcggtatttcaatatcgacgcgaactccggcgtcatcactactgctaaatcactggatagagaaacgaatgcaatacacaatatcaccgtgcttgccatggaatcccagaaccctagtcaggtaggacggggatacgtagccattactatcctggacattaacgacaacgctccggagttcgcgatggattatgagaccacagtttgcgaaaatgcacaaccgggtcaggtgatacagaaaatttccgcagtggataaggatgagccttccaatggtcatcagttctacttctctctgaccaccgacgccactaataaccacaacttctcactgaaggacaacaaagataacaccgcctcaatactcacacggcgaaacggattcaggagacaggagcaaagcgtctattacctcccgatctttatcgtagatagcggcagtccttctctttcatccacaaacactttgacaatccgtgtctgcgattgtgatgctgatggagtggctcagacatgtaatgcagaagcctatgtgttgcccgccggcctgtctacaggtgcattgatagcaatactggcctgtgtgctcacgcttctggtgttgatactgctcatcgtgactatgaggcggagaaaaaaggagcccctgatttttgacgaggaacgggacatccgggagaatatagtcagatatgacgacgaaggaggcggggaggaagacacggaggcattcgatatggcagccctgaggaatttaaatgtaatacgtgacaccaagaccagaagagacgtcactccagaaatccaatttctgtctcgcccagcatttaagagtattccagataatgtgatcttccgagaatttatctgggagcgtctgaaagaggctgatgtcgacccgggcgctcctccatacgactcactccaaacctatgcatttgagggaaatggcagcgtcgcagagtccctgtcaagtctggattccatcagtagtaacagtgaccagaactatgactacctctccgattggggtccccggttcaagcgtctcgcagacatgtatggcacaggtcaggaatcattgtattcttag

SEQ ID NO: 110271 - DNA, 2358 bp, Artificial Sequence
  Description of Artificial Sequence: Synthetic coding sequence
atgaagctcggaaaagtcgagttctgccacttcttgcagctgatcgccttatttctctgtttcagcggtatgtctcaggctgagctttctagaagccgatcaaaaccttatttccaatctggcaggtctaggaccaagagaagttgggtgtggaaccagttcttcgtgttagaggaatacatgggaagcgaccctctttacgttgggaagttgcactccgacgtcgataagggggacggctcgattaagtatatactcagcggcgagggcgcctcttccattttcatcattgacgagaataccggcgacatacacgccaccaagagacttgatcgcgaggaacaggcctactacaccttaagggcccaggccctggatcggttgacaaataagcccgtcgaaccagaaagtgagttcgtgattaagatccaggatattaatgacaacgaacctaaattcctcgacggaccctacacggctggcgtgccagagatgtccccagtgggcaccagtgttgttcaggtcactgcaaccgacgccgacgatccaacttacggtaatagcgctcgggtggtttactcaattttacagggtcaaccctatttttcagtggagcccaagaccggagtgatcaaaactgccctgccaaacatggatagggaggcgaaagatcaataccttttagtcatccaggccaaagatatggtcggtcaaaacggcgggttatcagggacaaccagcgtgactgtgacactcacagacgtcaatgacaacccgcctcggtttccccggcgatcttaccagtataacgtcccagagtctctgccagttgcaagcgtggtggcgagaattaaggccgccgatgcagatatcggcgccaatgccgaaatggagtataaaattgtcgacggtgacggcttaggcatttttaagatcagtgtggacaaagagactcaggaaggcattatcacaatccaaaaggagctggattttgaggctaagacgagttacacactcaggatagaagcagctaataaggacgccgaccctaggtttctatctctggggccattctccgatactactacagtgaagattattgtggaagacgttgacgaacctccagtctttagcagccccttgtatcccatggaggtgagtgaggccactcaggttggtaacatcatcggcactgtagctgctcatgatccggattcctctaactcccccgtaagatactccatcgacaggaacacggatcttgagaggtattttaacatcgatgcaaattccggagtcatcacaacagctaagagcctcgaccgagaaactaacgctatccataacattaccgtactcgctatggagagccagaacccgtcgcaggtgggacgagggtatgtggctatcaccatcttggatattaacgataacgctcccgagttcgccatggattatgagacaacagtttgtgagaacgcgcaacctggccaggtgattcaaaagattagcgccgtcgataaggacgagcccagtaacggccaccagttttatttcagcctgactaccgatgcgactaataatcacaattttagcctgaaagataacaaagataatactgcctctattctcaccagacggaacgggtttcgcagacaagaacagtcggtatattacctgcccatcttcatcgtcgattccggatccccctcattgagctctacaaacaccctgaccatacgggtctgcgactgtgacgccgatggcgtcgcacagacctgtaatgccgaggcctacgtgctgccagctggcctgtcgaccggagctctcatcgcaatactcgcctgcgttttaaccttgctggtgttgatcctgttgattgtcaccatgcggcgaagaaaaaaggagcctcttatattcgacgaggaacgggatatcagggagaacatcgtgcgctacgatgacgaaggggggggagaggaggacacagaggctttcgacatggcggccctccgcaaccttaatgtcatccgagataccaagactcggcgagatgtcacccccgagattcagttcctgagtagacctgctttcaagtccattcccgataacgtgatatttagggagttcatctgggagaggcttaaggaagccgacgtcgacccaggcgctcccccatacgattcccttcagacatatgcctttgaaggaaacgggtccgtagctgaaagcttgagtagtcttgactcaatcagcagtaacagcgaccagaattatgactatctgtcggactggggccctcgttttaaacgactggccgatatgtacgggacagggcaggagagtctctattcctag

SEQ ID NO: 110272 - DNA, 2358 bp, Artificial Sequence
  Description of Artificial Sequence: Synthetic coding sequence
atgaaactcggcaaggtagagttctgtcattttttacaactgatagccctcttcctctgcttctcagggatgtcccaggcagagttgtcacgctccagatccaaaccctattttcagagtggtcgctcgaggactaagagaagctgggtctggaatcaattcttcgttcttgaggagtacatggggtcggacccattgtatgtcggaaagcttcattcggacgttgacaaaggcgacgggagcatcaaatacattctctctggggagggtgcttcttctattttcattatcgacgaaaacactggggacatccatgccactaaaaggctggacagggaagagcaggcatactatactttacgcgcacaagctctggatagactcacaaataagcccgtggaacctgaaagcgaattcgtaataaaaatccaagatattaatgacaacgagccaaagtttctcgatgggccctacaccgcaggggtgcctgagatgtcaccagtgggaacctctgtggtccaggtgaccgctaccgatgcggacgatcccacatacggaaacagtgcacgggtcgtctacagtatcctccaaggtcagccctatttctctgttgagcccaagacaggcgtgatcaagactgccctccccaacatggacagagaggctaaggaccagtatctgctggtgatccaggcaaaggatatggtggggcagaatggcggcctgtccggcacaacctctgtgaccgtgaccctgactgatgtgaatgataatccaccaaggtttccaaggcgaagttatcagtataacgtcccagagtcacttcccgtggcttctgtggttgcccggatcaaggctgccgacgcggatatcggggctaatgccgagatggagtacaagattgtagatggggacggactggggatcttcaaaatctccgtggacaaagagacccaagaaggcataattactatacagaaggagctggatttcgaggctaagacatcctatactctgagaattgaggctgcgaataaggatgcagacccccgcttcctgagcctgggacctttttccgacaccactactgtgaaaatcatcgttgaggatgtggacgagcctcctgtattcagttctcccctgtatccgatggaggtctccgaggccacacaggttggtaacattataggaacagttgccgcgcatgatccagatagcagtaatagcccagtcagatatagcattgacagaaataccgatctggaacggtattttaatattgatgccaattccggggttatcactacggcaaagagcctagatagagaaacaaatgccattcataacattacagtgctggctatggagtcccagaacccgagccaggtcgggagaggatatgtggcaattaccatacttgatattaacgataatgcgccagaatttgcgatggactacgagactacagtgtgcgaaaacgctcagcctggacaggtgattcagaaaattagtgcagtcgataaagatgagccaagcaatggtcaccagttctatttttcattaacaactgacgccacaaataaccataatttcagtctgaaagacaataaggacaatactgcctccatcctgacccggcgtaacgggttcagacgccaggaacaaagcgtgtactatctgcccatctttatcgtagactcaggctctcccagtctttcttcaactaacactctgaccatccgagtgtgcgactgtgacgcggacggtgttgcccagacctgtaacgccgaggcttatgttctgcccgctggactgagtaccggagccctgattgccattttagcctgcgtgcttactctgttggtgctcattctgttgatcgtgaccatgcgcagacggaagaaggaacccttgattttcgacgaggaacgggatattagggagaatattgtgagatatgacgacgaggggggaggggaggaggataccgaagcgtttgatatggccgcccttcgtaatcttaacgtgatccgagacacgaagactcggagggatgttactcctgagattcagttcctaagccgaccagcgtttaagtccattcccgataatgtcattttcagagagttcatctgggagagactgaaagaggccgacgtcgacccaggcgccccaccttatgatagtttgcagacatatgcctttgaaggaaatgggagcgtggccgagagcttgagcagtttggacagtatcagctctaacagcgaccagaattatgactatctttccgactgggggcctcgctttaagcggcttgccgatatgtatggcactggacaggaaagcctgtacagctag

SEQ ID NO: 110273 - DNA, 1893 bp, Artificial Sequence
  Description of Artificial Sequence: Synthetic coding sequence
atgaaactaggcaaagtggagttctgtcactttctgcagctcatcgcactgtttctgtgtttttcaggcatgagccaggccgaactgagcagaagccgctctaaaccatacttccagtccggaagaagccggaccaagcgttcttgggtctggaaccaatttttcgtcctagaagagtatatggggtctgatcctctttatgtcgggaaactacacagtgacgttgacaagggagacggctcaatcaagtacatcttgagcggagaaggcgccagctctatttttattatcgatgaaaatacaggtgacatccacgccaccaaacgcctggatagagaggaacaggcatactataccctgcgggctcaagccctcgatcgtctcacaaacaaaccagtcgagcctgagagcgaatttgtcattaaaattcaggacattaatgataatgaaccaaaatttctagatggaccatacacagcaggagttccagagatgagtccggtgggaacctccgtcgttcaagtcacggctactgatgcggacgatcccacgtacggaaatagtgcaagggtagtgtactctattctgcaggggcagccttatttcagtgtggaacccaagacgggagtgatcaaaaccgcactgcccaatatggacagggaggcgaaggatcagtaccttctcgtcatacaggccaaagacatggtgggccagaacggcgggctctcaggcactacaagtgttaccgtaactctgaccgatgtgaacgataacccacccaggttcccccgccggtcctaccaatataatgtgccggagagcctgccagtagccagcgttgtagccaggattaaggcagctgatgccgatatcggggccaacgcagagatggagtataagatcgtggatggagatggcctggggatcttcaaaatctcggtggacaaggagactcaggaggggattatcactatacagaaggaactcgactttgaagcgaagacaagttacaccctgcgaatagaggccgcaaataaggacgccgacccaaggttcctcagcttgggcccatttagcgacacgacgacggtgaagataatagtggaagatgtagacgagccaccggtgttttcgagcccactgtatcccatggaggtatccgaggccacacaggttggtaacattatcgggaccgtggcagctcacgatcccgattcatcaaactcaccagtgaggtattcaatcgacagaaatacagatttggaaagatatttcaatattgatgccaactcgggtgttattacaacagctaaatcactggatagggaaacaaacgctattcacaacattacagtgctggcgatggagtcccaaaatccgtctcaagtcggaagaggatacgtggccatcactattctcgatatcaacgacaatgctccagaattcgccatggactatgaaaccaccgtatgcgaaaacgcgcagccaggccaagtgattcaaaaaatcagcgcggtggataaagatgagccctctaatggacaccagttttatttctcccttaccactgacgccacgaataaccacaacttctccctgaaagataataaggataatacggcctctatcttaacaagacgtaatgggtttaggcggcaggagcagtcagtctactatctgccgatcttcatagtggattcaggctccccctcccttagttctacaaataccctgactatcagagtgtgcgactgcgacgcggacggagtagcgcagacgtgtaatgcagaggcttatgtcctgcctgctggcctctcgaccggagcactgattgcaattctcgcatgtgtgctgactcttctaggaagatattgtttccagggcctgctctag

SEQ ID NO: 110274 - DNA, 2400 bp, Artificial Sequence
  Description of Artificial Sequence: Synthetic coding sequence
atgcccgaaagacttgcagagatgcttttggacctgtggacccctctgattattctctggattaccctcccgccatgcatatacatggcaccaatgaaccagagtcaggtcttaatgagcggttcgcccctggaattaaacagtctgggagaggagcagaggattctgaacagatccaaacgaggctgggtgtggaatcagatgtttgtcctggaggagttcagcggtcccgaaccaattctggtcggcagattacacacggatctcgaccccggctcaaagaagattaagtacatccttagcggggacggagccgggaccatattccagatcaacgacgtaacaggagatattcatgcgatcaaacgtctggaccgcgaggaaaaagcggagtacacccttacagctcaggccgtggattgggagaccagcaaacctttagagccacccagcgagttcattattaaagtccaggacatcaatgacaatgctcctgaatttcttaatggcccgtaccacgccaccgttcctgagatgtcgatcctaggcacatcagtgactaacgtgacagctaccgatgctgatgacccggtatacggcaactcggccaaacttgtgtactctattctagaaggccaaccttatttctctatcgaaccagagactgcaattattaagaccgccctaccaaacatggatcgtgaagccaaagaagagtatctggtggtcatccaggccaaggacatgggaggccactctgggggtcttagcggcacaactactctgacagtgactctgaccgacgtgaacgacaaccctccaaagtttgcccagtccctctaccatttttccgtgccagaggatgtcgtcctaggcactgcaattggacgtgtgaaagccaatgaccaagacatcggtgaaaacgcacagagcagctacgacataatcgacggggatggcacagcgcttttcgaaattacctctgacgcccaggcccaggatggaattatacggctgaggaaaccgctggacttcgaaaccaaaaagtcttacacactaaaagtggaagcggcaaatgtgcacatcgatcccaggttttccggcaggggaccattcaaggacaccgccaccgtgaaaatagtggtggaggatgccgacgagcctcctgtgttctcctccccaacgtacctgctggaggtgcacgaaaatgccgctctgaactccgtcatcgggcaagtgaccgctagagatcccgacatcacatcctctcccattagattctccattgataggcatactgatctggaacggcagttcaatatcaatgctgatgacggaaagatcacactggcaacaccattagatcgggagttgtcggtctggcataatatcacaataattgcaaccgagattcggaatcactcacagatttctcgagtgccggtcgctataaaggtcttagacgtgaatgataacgcccccgagtttgcaagtgaatacgaagcctttctttgcgagaatggaaaacccggacaagtgatccagaccgtgagcgctatggacaaggacgaccctaagaacggacactacttcctgtatagcctgttgcccgaaatggtgaacaatccgaatttcaccataaaaaagaacgaagataacagtctgagcattctcgccaaacacaatggtttcaaccgccagaagcaagaggtgtatctacttcctatcatcatatccgatagtggcaatccgcctctgtccagtacaagcactctcaccataagggtgtgcgggtgctctaatgacggtgttgtgcagtcctgcaacgttgaggcctacgtgctgccaattggtttgtctatgggagcgttgattgccatccttgcttgtatcatcctcctgctggtaattgtggtcctcttcgtcacactgaggcgacacaaaaatgaaccactcattataaaggatgatgaagacgtacgggaaaacattatcaggtacgacgacgaagggggcggggaggaagatacggaagcctttgacatcgcaacattacaaaacccagacggaatcaacggctttctgccacgcaaagacattaaacccgatttgcagttcatgccccgtcagggcttggccccggtccccaacggagtcgacgtggatgaatttatcaatgtccgactgcacgaagcagataatgatcctacagcgccaccatacgactccattcagatctatgggtatgaggggagagggtcagtagctggatccttatcctctctggaatcgaccactagcgacagcgatcagaacttcgactacctttccgattggggcccacggttcaagagactcggggagctctatagcgttggcgagagcgataaggagacctag

SEQ ID NO: 110275 - DNA, 2400 bp, Artificial Sequence
  Description of Artificial Sequence: Synthetic coding sequence
atgcccgaaaggttggctgagatgttactggacctgtggactcctctgatcatcctctggataacactacccccttgcatctatatggcacctatgaatcaaagtcaggttctcatgtccggatccccactggagctgaactccctgggcgaggaacagcggattttgaatcggagcaaacgtggctgggtgtggaatcagatgttcgtccttgaggaattttccggtcctgagcccatactcgtggggcgcttgcacaccgacctggatccaggatctaagaagatcaaatatatactgtccggcgacggtgcaggcaccatcttccagattaacgacgtcacaggggatattcacgcaattaaaaggttggacagggaagagaaggcagagtacaccctcacagctcaggccgttgattgggaaaccagcaagcccctcgagccaccatctgagtttattatcaaagtgcaagacatcaacgataacgcacccgagtttctgaacggtccctaccacgccacagtgccagaaatgtctattctaggtaccagcgtaacaaacgtaacagccaccgacgcagatgaccccgtatatggcaattccgctaaactggtctatagcattctggagggccagccctatttttccatagagcccgaaaccgccataatcaagacggcactcccaaacatggaccgggaggctaaggaggagtacctcgtagtgatccaggccaaggacatgggaggccactctggcggcttgtccggtacaaccactctgaccgtgactctgacagatgtaaacgataatccaccaaagtttgcgcagagtctgtaccatttctccgtccccgaggacgtagtgctaggaactgctattggccgcgtcaaggcgaacgaccaagatataggcgagaacgctcagagttcctacgatattattgatggagacggaactgcgctattcgaaataacttcggacgcacaggcacaggacgggattattaggctacgcaagcctcttgacttcgagaccaaaaaaagctacaccttgaaagttgaggctgcgaatgttcacattgatcctaggttttcaggacggggacccttcaaagacacggcaaccgttaagattgttgtcgaagacgccgacgaaccgccagttttcagcagtcccacctatttgctggaagttcacgagaatgcagccctcaatagtgtgatcggccaggtgaccgctagggatccagacatcacgagtagccctatcagattttctattgatcggcataccgatcttgaaaggcagttcaacataaacgcggatgatggtaaaatcacactagcgacgcctctggacagggagctgtcagtgtggcataacatcacaatcatcgctacagaaatacgtaaccattctcagatcagcagggtgcccgtcgccattaaagtcctcgacgtcaacgataatgcaccagaatttgcctctgagtacgaagctttcctgtgtgaaaacggaaagcccgggcaggtcatccagacagtgagtgccatggacaaggatgatcctaaaaatggacactactttctttacagcctgctacccgaaatggtcaataaccctaattttacaattaagaaaaacgaggacaactctctgagcatactcgcgaaacacaacggctttaaccgccaaaaacaggaggtgtacctcttaccgataattatcagtgatagcgggaatccgccactgagctctacgagcacattgaccatccgggtgtgtggttgtagcaatgacggggtcgtccagagctgtaatgtggaagcgtatgtcctgcccattggattatccatgggggctttgatagcaatcttggcctgtataattctgttactggtgattgtggttctgtttgttacacttcgccgacacaaaaatgagcctctgataatcaaggacgatgaggatgtgagggaaaatataattcgctatgatgatgaaggaggcggggaggaagacacagaagcctttgacattgccacactgcaaaatccggacggcattaatgggtttcttcccaggaaagacatcaagccagatctgcaattcatgcctaggcaaggccttgcccctgtgcctaacggagtggacgttgacgagttcattaatgtgcggctccacgaggctgacaacgatcccaccgctcccccttacgactcaatacagatttacggttacgagggtagaggttctgtggccgggtcactcagctccctcgagtctaccacatcggatagcgaccagaacttcgattacctgtccgactgggggcctagattcaagcgtctgggtgagctgtactctgtgggggaaagtgacaaagagacttag

SEQ ID NO: 110276 - DNA, 795 bp, Artificial Sequence
  Description of Artificial Sequence: Synthetic coding sequence
atgacaaagttcagttctttctcattgtttttcttgattgtgggagcctatatgacgcatgtgtgcttcaatatggagatcataggcggcaaggaagtgtcccctcactctcgccccttcatggcttccatccagtatgggggccaccatgtgtgcggaggagtgctcattgacccccagtgggtgttgactgccgcacactgccagtacagattcacgaaagggcagagtcccacagtggtactcggcgcccactccctgtcaaagaacgaagcttcaaagcagacgctggagatcaaaaagttcattccgtttagcagagtaacttctgatcctcagtccaacgacataatgttggtgaaactgcagactgcagccaagttgaacaagcacgtgaagatgctacatatccgttccaaaacttctctgcgttctggcaccaaatgtaaggtgaccggctggggggccaccgaccccgatagcctccggccctctgatacactgcgagaagttacagtgacggtcctgtcgcgcaagttgtgcaattctcagtcctattacaacggcgaccctttcattaccaaggacatggtgtgcgcaggggatgctaaggggcagaaggatagctgtaaaggtgactccggtggaccactcatttgcaaaggtgtgtttcacgctattgtgtccggtggtcacgagtgcggggtggcaaccaaacctggcatatatacattactgactaaaaagtatcaaacctggatcaaatcaaatctggtgcccccccacacgaactag

SEQ ID NO: 110277 - DNA, 246 bp, Artificial Sequence
  Description of Artificial Sequence: Synthetic coding sequence
atgcggacttaccattacatccccttgttcatctggacttacatgttccatacagtggatacaatcctcctccaggagaagcccaacagttatctttcatcaaagaagatcgcaggcctcaccaaggacgacggcaaaatgctgagacgcaccaaacgggggtggatgtggaatcaatttttcctgcttgaggaatataccggtactgatacacagtacgtggggaagctccacaccgatcagtag

SEQ ID NO: 110278 - DNA, 399 bp, Artificial Sequence
  Description of Artificial Sequence: Synthetic coding sequence
atgcggacttatcactatatccctctgttcatctggacatatatgtttcacactgtcgacacaatattgctgcaagagaaaccaaatagctatttgtcttcgaagaaaatagccggtctcactaaagacgacggcaagatgcttcggcgcaccaaaagaggctggatgtggaaccagtttttcctgctggaagagtacacaggcacagacacacagtacgtgggcaagttgcataccgatcaggataagggggatggcaatctgaaatacattctgacaggcgatggggctgggagcctctttgtgatcgatgagaataccggggacatccacgccgccaagaagttggatcgcgaagaaaagtctctgtatattcttagagccaaggctatcgactag

SEQ ID NO: 110279 - DNA, 9045 bp, Artificial Sequence
  Description of Artificial Sequence: Synthetic coding sequence
atggcccctccccccccccccgtcctccccgtgctgctgctactcgcagctgccgctgccttgcccgccatgggactgcgcgctgcagcatgggagccccgtgtgccgggcgggacacgcgccttcgcgctgagaccagggtgcacgtatgccgtgggcgccgcctgcacccccagagctccacgggagcttctcgacgttggaagagacggccgactcgctggacgccgcagagtatctggggccggtcggccactacctcttcaggtgagattggttgctcgtagcgctccaacagccctttcccggagactgagggcgagaacccacctgcccggctgcggcgctcgcgcccgcctgtgcggcaccggagccaggttatgcggcgccctctgctttcccgttccaggcgggtgcgccgcggcacagcactctgctctggctgcacccacaaccctgccagcttgtaggtgccctccccgccctaggcccagatgccctgggagaccaatctgcctgccccccggcggttcagtgagactgaggctcctgtgtgcacttcgccgcgcagctggtgccgtgcgagtagggctggccttagaagctgctactgccggtaccccctccgcatccccatcgccctctccacccctgcctccaaatctccccgaagctcgtgccgggccagctaggcgagcccggcgaggtacttcaggcaggggctcacttaaatttccgatgccgaactatcaggtcgccttgttcgaaaatgagcccgcagggacactcatcttacagctccacgcgcattataccattgaaggagaggaagagcgcgtgtcctactacatggaaggactttttgacgaaaggagccgcgggtatttccgcatcgacagcgctaccggggccgtatcgaccgactcagtgctggatagagagaccaaggagactcacgtactgcgcgtgaaagccgttgactactctaccccacctcgtagcgctacgacatacattacggttcttgtgaaagacaccaatgaccatagtccggtattcgagcagagtgaatatcgagagagggtgcgagagaacctcgaagtaggttacgaagtcctgactatccgggctagcgaccgtgatagcccaatcaacgcaaacctgagatatcgggtgctgggtggcgcatgggacgtcttccagctgaatgagagcagtggcgtcgtgtccacaagggctgtcctcgaccgcgaggaggccgccgagtaccaactgctggtggaggcaaacgatcagggtagaaatcccggtccgctgagtgccacagccaccgtttacatcgaggtcgaagacgagaacgacaattacccccagttcagcgaacagaactatgtcgtccaagtccctgaagatgtgggtcttaatacggctgtactgagggtgcaggccaccgatcgcgaccagggccaaaacgctgcgatccattattctattttgtcggggaacgttgccggccagttttacctgcactcactgagtggcattcttgatgttatcaaccctctcgactttgaggacgtgcagaaatactcactgtccatcaaagcgcaggacggaggccgtcctccgttgatcaacagcagcggcgtggtgtccgtccaggttttggacgttaatgataatgaaccaatctttgtgagcagtccctttcaggccaccgtgttggaaaatgtcccgctgggataccctgtggtgcacatacaggcggtggacgctgattccggcgaaaacgccagactgcattaccgcctagttgatacagccagcacttttcttgggggtgggagtgccggcccaaaaaacccggcacccacccctgactttccctttcagatacacaacagcagtggatggatcaccgtgtgcgctgaactggacagggaagaagttgaacactatagcttcggtgtagaggctgttgatcatggcagtcctcctatgtcctcaagtacatccgtgtctatcactgtgttagatgtcaatgataatgacccagtattcacccagccgacatacgaactccgactcaacgaggatgccgccgtgggtagttccgtgctgactctccaagcacgggacagggatgcaaactcagtgattacttaccagctcacaggcgggaacacacgcaatcgatttgcactgagcagccagcggggtggagggctgattacacttgcattgcccctggactataaacaggagcaacaatatgttctggctgtgactgcaagtgacggcactcggtcgcacacggcgcacgtgcttataaatgtgaccgacgccaacacccacagacccgtattccagagctctcactacaccgtgtcagtctcagaagatagacctgtaggcaccagtattgccaccctgtctgctaacgacgaagatacaggcgaaaatgcgcgaatcacatatgtcatacaagaccctgtccctcagttccgcattgatcctgactccggaaccatgtacactatgatggagctcgattacgaaaatcaagtggcgtacaccctgaccattatggcgcaggataatggaatcccccagaaatctgacacgactacactggaaatcctgatcttggatgctaatgacaatgcccctcagttcctttgggatttttatcagggaagtattttcgaggatgcccccccttcaacaagcatactccaagtgtcggctaccgatcgtgacagcggccctaatggacgcctcctctacacattccagggcggggacgatggcgacggggacttttatatcgagcccacaagcggagtcatccgaacacagcgacgtctggaccgtgagaacgtggccgtctacaatctctgggctctggcagttgatcggggatcgccaacaccactttctgcgtctgtcgagatccaggtcactatactcgacatcaacgataatgcccccatgttcgaaaaggatgaactggaactgttcgtagaggagaacaaccctgtgggatccgttgtggcaaagatccgggctaatgatcccgacgagggtccgaacgcccagattatgtaccaaattgtcgagggcgacatgcgccacttctttcagttggatctactcaacggggacctgagagccatggtggaactggatttcgaggtgcgtcgggagtatgtgctcgtggtgcaagccactagtgcccctttagtgagcagagctacggtccatatcctactggtggatcagaacgataaccctcctgttctaccagattttcagattctattcaataactacgtgacaaacaaatctaattcttttcctacaggggtgatcggctgcattcctgcccatgaccccgacgtgagcgactccctaaactacacattcgtgcagggcaacgagctcagactactgctactggatcctgctacaggcgagctacagctgtcacgggacttagacaataacaggcccctggaagccctcatggaagtttcggtttcagatgggattcattcggtgactgccttttgcactctgagagtgactataatcacagatgacatgctcaccaacagcatcacagttcggctggagaatatgtcacaggagaaatttctgagcccactgcttgcactgttcgtagaaggtgttgcagctgtgctcagcacaaccaaagacgatgtcttcgtgtttaatgttcaaaacgacaccgatgtgagttcgaacatcctgaatgttacattcagtgcgctgctgcccggaggtgttcgaggccagttttttccgtccgaagacttacaagaacagatctacctcaaccgaaccctgcttactacaatttcaacccagcgggtgctgccttttgacgacaacatctgccttagggaaccatgcgagaattatatgaagtgcgtctccgtcctgcgcttcgattcgagcgcgcctttcctgtcgtctactactgttttgttccgccccatacacccaatcaatggactgcgatgtagatgtccgcccggctttactggcgactattgtgagacagaaattgacctttgctattccgacccctgcggtgccaacgggcgttgtaggtctcgcgagggaggatacacttgcgagtgcttcgaggacttcaccggggagcactgtgaggttgatgccagaagtggccgctgtgcgaatggggtgtgcaaaaatggtgggacctgcgtcaacctccttattggcgggttccattgtgtctgtccccctggcgagtacgagaggccctactgcgaagtgaccaccaggagcttccccccacagtcctttgtgacttttagaggtttacgtcagagatttcatttcactattagtctcacgtttgccactcaggagcgaaatggactcctgctgtataatgggagatttaatgaaaaacatgatttcatcgccttggaaatcgtagacgaacaggtccaattaacatttagtgctggtgagactacaacgactgtggctcccaaggtcccttcaggcgtgtctgacggtagatggcacagtgtccaagtgcagtactataacaaacctaacatcggacacctgggcctgccacacgggccatctggcgagaaaatggccgttgtgacagtggacgactgtgacactacaatggccgtgagatttggtaaggacatcggcaactactcctgtgcagcccagggaacacaaacaggctcaaagaagtctctggacctcactgggcctctgctgctgggaggagtcccaaatctgcctgaggacttccccgtccacaatcgccaattcgtgggctgcatgcgcaatctgtcggtggacggcaagaacgtggacatggccggcttcattgctaacaacggaacgagggagggatgcgcagctcgacgcaatttctgtgatgggcggcggtgtcagaatggaggaacttgcgtgaatcgctggaacatgtatctgtgtgaatgccctctcaggttcggagggaagaattgcgaacaagctatgccccatccccaattgttttcgggcgagtccgtggtctcctggagcgacctgaacattatcatctctgtcccttggtaccttgggctgatgttcagaactaggaaagaggactcagtgctgatggaggcaacttcaggaggacctacttcgttccgcttacagattcttaacaactatttgcagtttgaggttagccatggcccatctgacgtagagtcggtgatgctgtcagggctgcgggtgacagacggggaatggcaccatcttttaattgagctgaaaaatgtgaaagaggacagcgagatgaagcatctggttactatgacactcgactacgggatggatcaaaataaagctgacatcggaggtatgttgcccggactgacggtccggagtgttgttgtgggcggtgcatcagaagacaaggtttctgtgagacggggatttagaggatgcatgcagggcgttcggatgggtggcactcctacaaacgtggctacattgaacatgaataatgctctgaaagtgcgagtgaaggacggatgtgacgtcgacgatccatgcacatccagcccctgccccccgaattccagatgccacgacgcttgggaggattattcatgcgtttgtgataaaggatatctggggattaactgtgtcgacgcctgtcatctcaacccgtgcgagaatatgggggcatgcgtgcggtctcccggcagcccacagggttacgtgtgcgagtgtggtccttcacattacggtccctattgcgaaaacaagctagacctcccctgtccacggggctggtgggggaacccggtttgcggtccttgtcactgtgccgttagcaagggcttcgatccggattgtaacaaaacgaatggccaatgccagtgcaaggagaactattacaagctactagcccaggacacatgtctgccctgcgactgcttcccacatgggtcgcacagtcgtacttgcgatatggctactggccaatgcgcttgtaagccaggcgtgattgggaggcaatgtaacaggtgtgataaccctttcgcggaggtcacaacactgggctgcgaggtcatttacaacggctgccctaaggccttcgaggccgggatatggtggccgcagacaaagtttggacaacccgctgctgtaccatgccccaaaggatctgtgggcaacgcagtgaggcattgttcgggtgaaaagggttggcttccgcctgagttatttaactgcactacaattagttttgtagacctgagagctatgaacgaaaagctctcccgaaacgagacgcaggtcgacggcgccagagccctgcagctggtgcgagctctaagatccgccactcagcacactggaacactattcggtaatgatgtccgaactgcctatcaactgctcggacatgtactccagcacgagagctggcaacaggggttcgacctggccgccacccaagatgcagacttccacgaggatgtcatacacagcggtagcgctcttctggcacctgccacccgcgccgcttgggagcagatacagcggagtgaaggaggcaccgctcaactgttgaggcggcttgaggggtactttagcaatgtggcacgtaacgtacgccgaacctatcttaggccctttgtgatcgtaaccgccaacatgattctggcagttgatattttcgataagtttaactttactggggcgcgagtgcctcgattcgatacgatacacgaggagtttcctagagagctggagtcatccgtgtccttccctgcggatttcttcagaccacctgaagaaaaggaaggccccctcttgcgccctgcgggccgcaggaccacacctcagacaaccagacccggccctggcaccgagagggaagcgcctatctctcgtcgtcgcagacacccagacgacgcaggccagtttgctgtagcactcgtcatcatctacaggacactggggcagcttctgccagaaagatatgatcctgatagacgctccctgaggctcccccacaggcccataattaataccccaatggtgtccacactggtatacagtgaaggtgcgccccttccccggcccctcgaacgccctgtcctggtcgaattcgccctgttggaagtggaagaacgtacaaagcccgtgtgcgttttttggaaccattctctggccgttgggggcacagggggatggtccgcccgggggtgcgaactcctttctagaaatcggacccatgttgcctgtcagtgctcgcatactgcgtcctttgcagttctgatggacattagcaggcgggagaacggtgaggtgctccctcttaaaatagtcacatacgctgctgtgtccctgagtctggctgccctgttggttgcatttgttctgcttagtctggtccggatgctgcgctctaacctacactcgattcacaagcatcttgcagtggcactttttctgagccagctcgtttttgtcatcgggataaaccaaaccgagaatccatttttgtgtacagttgtggccatcctccttcactatatatacatgagcaccttcgcctggacactggtggaaagtttgcatgtataccgcatgttgaccgaagtgaggaatattgataccggccccatgcgtttttactacgtggtgggctggggcatcccagctattgtgaccggcctggccgtgggattggaccctcaggggtacggaaatccagacttttgctggctctctttgcaagacaccctcatctggagctttgccggtcctatcggggcagtaataataatcaacaccgtcacttcggtgctttcagcaaaagtttcctgtcagagaaagcatcattattatggcaagaaagggattgtatccctgctcagaacggctttcctgctgctactgctgatatccgccacgtggctcctcggcctgttggcggtaaatcgcgacgcacttagcttccactaccttttcgccatcttcagtggactgcagggcccctttgtacttctgttccactgtgtattgaaccaggaagtgcggaaacatttgaagggtgtccttggcggacggaagctgcaccttgaggactctgcgaccacaagagccactcttttgaccaggtctcttaattgtaatactaccttcggagatggacccgacatgcttagaaccgatctaggcgaatcaacagcttctctagatagcatcgtaagggatgaagggatccagaaactgggcgtgtcatccggtttagtgagaggctcgcacggcgagcccgacgcgtcccttatgccccgaagttgtaaggaccctcccggccacgatagcgattctgattcggagctgtcgttggacgaacagtcatccagttacgccagttcacactcaagcgactcggaggatgatggggtgggagctgaagaaaagtgggatccagcacggggagccgtccatagtactccaaagggggacgctgtggcaaatcatgttccagctgggtggcccgaccagtcacttgccgaatcagacagtgaggatcccagcggtaagcctcggctgaaggtcgagaccaaagtctcagtcgagttgcatagggaggagcagggcagtcacaggggtgagtacccccctgaccaagaatccggcggagccgcacggctcgcgtcttcacaaccacctgagcagcgaaaaggcatcctcaaaaacaaggtcacatatccaccccccctcacattaacggagcagaccctcaaggggcgcctgcgagaaaagctggctgactgcgagcagagcccgaccagcagtcgcacctctagccttgggagtgggggtccagactgcgctatcacagtcaagagccccggacgcgaaccaggtagagatcacctcaacggtgttgccatgaacgtgaggaccggcagcgctcaggctgatgggagcgactctgagaaaccctag

SEQ ID NO: 110280 - DNA, 4194 bp, Artificial Sequence
  Description of Artificial Sequence: Synthetic coding sequence
atggccccccctccaccacctgtgcttccagtgctgctcctgttggccgcagcagctgcactcccagccatgggcctgcgggctgcagcatgggaaccccgcgtcccggggggcacccgcgctttcgctctgaggccaggatgcacctacgctgtgggcgccgcttgcacacccagggcccccagagaactccttgacgtcggccgagacggacggctggccgggaggcgcagggtcagtggggccggcagaccgttaccgctgcaggtgcgactagtcgcacgttctgcgcccacagcgctttcccggcgcctccgcgccaggacgcatctccccggttgcggcgccagagcgagactttgtggtacaggcgcccgcctatgcggggccttatgttttccagtccccggtggctgtgcggccgcccagcactccgcgctcgcagccccaaccactttacccgcttgccgctgccccccaagaccccgacctaggtgccctggcaggcccatttgcctcccgcccggaggatccgtgaggcttcggctcctctgtgcactgagaagggcggctggggcggtgagagttggactggcattagaggccgctactgccggcactccctctgcttcgccatcccccagccctcccctgcccccgaatctccccgaggcccgcgccggcccagcccgccgtgctcggcgcggaacgagcggtcgcgggagcctgaagtttccaatgccgaactaccaggtggccttgtttgaaaacgagccagctggaacactgatcctgcaattacacgcacattataccatcgaaggagaggaggagagggtcagctactatatggaggggctcttcgacgaacggagcagaggatactttagaatagattctgccaccggggccgtctcaaccgattctgtgctcgacagggagaccaaagaaacacacgtgctgcgtgttaaagccgtcgactattctaccccacctagatcagccactacatacataaccgtgttagtaaaggacacgaacgaccacagtcctgtgttcgagcagagtgagtaccgagaacgggttcgggagaacctggaggtggggtatgaggtcttgacaatccgggctagtgatcgcgattctccaattaacgctaatcttaggtaccgcgtcctgggcggggcatgggacgtttttcagctcaatgagtcgtctggcgtcgtgagtacgcgagccgtgctcgaccgggaggaggcagctgagtaccagctgctagtggaagccaatgaccaggggcggaaccccggccctctctcagctactgcaacagtctatattgaggtagaagatgaaaacgataattacccgcagttttcagagcagaattatgtggtgcaagtgcccgaggacgtgggattaaatactgcagtgctgagggtgcaggccacagatcgcgatcaggggcagaatgcagcgatacactacagtatcctgtcaggcaatgttgctggccagttttacctccattccctctcgggcattttggacgtgataaaccccttagatttcgaggatgtccaaaagtattccctctcaatcaaggctcaggatggaggccgccctcccctaataaacagctctggggtcgtgagtgtgcaggtcttggacgtcaatgataatgagcctatctttgtttcatcaccattccaggccacagtgctagagaacgtaccgctgggctaccctgtggtgcacattcaggccgtcgatgctgacagcggggaaaacgcacggcttcactacagactcgtggataccgccagtacattcctcgggggcgggtccgcgggccccaagaacccagcacccacacctgattttccgttccaaattcacaactctagcggctggataacagtgtgtgcagagctagatagagaggaggtggagcactatagtttcggagtcgaggcggtggaccacgggagtcctccaatgagctctagtacctccgtcagtattaccgtgttggatgtgaatgacaacgacccggtcttcactcagcccacctatgagttgcgacttaatgaagatgctgctgttggctctagcgtgctgaccctgcaggcgcgtgacagagacgccaattcagtaattacttatcaattaacgggcgggaatacacgcaatcgattcgcactgtcttcccaacgggggggagggcttatcactctggccctcccactagattataaacaagaacaacagtatgtactggcggtcacagcttctgacggcacccgcagccataccgcccatgtcttgattaatgtaacagatgccaacacccaccgcccagtcttccaatcctcccactatactgtgagtgtcagtgaggaccgcccagtcggcacatcaattgcgacgctatcagcaaatgacgaggacaccggtgaaaatgcccgtatcacatacgttattcaggacccagtcccacagttccgcattgaccccgatagtggcactatgtataccatgatggagctggactacgaaaatcaggtggcctacaccctcaccataatggcacaggataatggaatacctcagaagagcgataccactacgctcgaaatcctgatcctcgacgcaaatgacaacgcgccacagtttctttgggatttttatcagggttccatctttgaggacgcacccccctctacatcaatcctgcaggtaagtgcaactgacagggacagcggccccaatggccggctgctgtacaccttccagggcggagacgatggggacggggacttttacattgagcctacttctggcgtgattagaacccaacgccgcctggaccgggaaaatgttgctgtctacaacttgtgggcgctcgccgtcgataggggttcccccacaccacttagtgccagtgtggaaatccaagtgactatccttgacattaacgacaacgctcccatgtttgagaaggacgagctagaattatttgtggaagagaacaaccccgtgggatccgttgtggcaaagatccgggcaaatgacccagatgaaggccctaacgctcagatcatgtatcagatcgtggagggggacatgcgacacttcttccagctggatctgctgaatggagatttgagggctatggtggaactggattttgaggttcgtcgcgagtatgtgctagtcgtgcaggcaacttccgctccccttgtgtctagggcgaccgttcatatactgctggttgaccagaacgataatccaccagtgctcccagatttccagattctgtttaacaactatgttaccaataagagcaactcctttcctacaggggtcattggctgcatccctgcacatgatcctgacgtcagcgacagcctcaattatacctttgtgcagggtaacgagctccgcctgctactcctggatccagccacaggagaactgcagctgagccgagacctcgacaataaccggccgctcgaggctctcatggaagtgtctgtcagcgatgggatacacagcgttacagccttttgtacactccgggtgacaattatcacggacgacatgcttacaaacagcattaccgttcgcctggagaatatgagtcaggagaagtttttgtcacctctgcttgccctttttgttgagggcgtggccgccgtgctgagcacaacaaaggacgatgtgtttgtttttaatgtgcagaatgacactgatgtgtcgtccaatatcctgaacgtcacattttcggcgctgctccctgggggtgttcgggggcaatttttcccaagtgaagatctgcaggagcaaatctacctgaaccggaccctgcttaccacaatctccacgcagcgcgttctgcctttcgatgataatatctgtttgagggaaccctgtgaaaactatatgaaatgcgtgagcgtcttgcgatttgactcctccgccccctttctttcttccaccacagtactttttcggccaatccaccccatcaacggactgagatgtcgctgcccacctggttttaccggcgattactgcgagactgagattgacctctgttattccgacccttgtggtgccaatggccgttgtcgtagccgggaggggggatacacctgtgagtgttttgaagactttaccgccgtgtcctag

SEQ ID NO: 110281 - DNA, 2319 bp, Artificial Sequence
  Description of Artificial Sequence: Synthetic coding sequence
tgagattttcctttccagatccataactcctccggatggattaccgtctgcgccgagctcgacagagaggaagtagaacactactcttttggcgtggaggccgtggatcacggcagtccgccgatgtctagctctacatcagtatctatcactgtgttagacgtgaacgataatgaccctgtgttcacccagcccacatacgaactccggctcaatgaggatgctgccgtggggtcatcggtattgactctgcaggcgcgtgatagagacgcaaattcagtgatcacataccagctcaccggcggcaacacccgcaacaggtttgcgctctcatcacagcgaggtgggggcctcattacgctggccctccctctagattataagcaggaacagcagtacgtgttagcggtgacggccagtgacggcacgcgtagtcatactgcgcatgtgctgattaatgtgaccgatgccaacacacacagaccagtgttccaatcatcccactatacagtttccgtgagcgaagacaggcctgtcgggacaagtatagctacactgtctgctaatgatgaagatacaggcgaaaacgcgagaattacatacgtcatacaagatcccgtgccacaatttcggatcgatccggatagcggcacaatgtacaccatgatggaacttgattatgaaaatcaggttgcttataccctgacaataatggcgcaggataacggaattcctcagaagtccgacacaaccacactggagattctcatcctggacgctaacgacaatgcgcctcagttcctttgggacttttatcaggggtccattttcgaggatgctcctccctccacgtccattctgcaggtgtccgcaacagatagggatagcggacccaatgggagattgctctacacctttcaggggggcgacgacggagatggggacttctatatagaacctacatctggagtgattaggactcagaggaggcttgacagggagaacgttgcagtgtacaatctgtgggcactggcagtcgatcgcggctccccaacccctctgtccgctagcgttgagatccaggtaactattctggacatcaatgataatgcacccatgttcgaaaaggatgagttggagctctttgtcgaggagaacaacccagtgggttccgtcgttgcaaaaatacgagctaacgaccccgatgagggtcctaacgcgcagattatgtaccagattgttgaaggagatatgagacacttcttccagctcgacctgttgaatggtgatctccgcgcaatggtcgagctggatttcgaggtgcgccgcgagtatgtactggttgtccaggccacatccgccccgctggtcagtcgggccacagtgcatatcctattggtggaccagaatgataacccccccgtgctgccagactttcagattcttttcaacaattatgtgaccaataagtccaactcttttcctaccggagtgattggttgcattcccgcccacgatccagatgtgtcagacagcctgaactataccttcgttcagggtaacgagctgcgcctgttgctcctggaccctgccacgggtgaattgcaactgtctcgggatctagacaataaccgaccgctggaggcgctgatggaagtttcagtgtccgacgggatccattccgtgacggccttctgtacgttacgggtaaccatcattaccgacgacatgcttactaattccataacagtccgcctagaaaacatgtcccaggagaaatttctgagcccactgctggccctgttcgtcgagggagtggccgccgtccttagtacgaccaaggatgatgtattcgtgtttaatgttcagaacgacactgacgtctcttctaacatcctcaacgttactttcagcgcacttctccccggcggtgtgcgcggccagttctttccatcagaagacctgcaggagcagatttaccttaatcgaaccttactgaccaccatctccacacagagagtactcccctttgatgataacatctgcctgcgcgaaccatgcgagaattatatgaagtgcgtgtctgtgctacggttcgactcctcagctccttttttgagctcaactacagtgttatttagacctatccatcctattaacggccttagatgcagatgtccaccaggctttacaggcgattactgcgagacagagattgacctctgctattccgatccttgtggcgctaacgggaggtgcaggtcccgagagggagggtacacctgcgaatgtttcgaggattttacagaaatcagttag

SEQ ID NO: 110282 - DNA, 8772 bp, Artificial Sequence
  Description of Artificial Sequence: Synthetic coding sequence
atgagatcacctgctacgggcgtgcctttaccaactcccccacctcctttacttctcctgctcctccttttgcttccccccccgctactcggagatcaggtgggcccttgccgatctcttggaagccgcgggagaggctcgagtggcgcgtgtgcccctatggggtggttatgccccagtagcgcgtcaaatctgtggctctatacttcacgatgtcgggacgccggcactgagctgaccggacatcttgtaccacaccatgatgggttgagagtgtggtgtccggaatctgaagcccatatcccactgcccccagccccagaaggatgcccatggtcctgtcgcttattaggcataggcggccacctgtctcctcaggggaagctcactctgcctgaggaacatccttgtctgaaggctcctcggttaaggtgccagtcctgtaagttagctcaggcccccggcttaagggcaggcgaaaggtctcctgaggaaagcctgggcggcaggcgcaagcggaacgtgaatactgctcctcaatttcagcctcccagttatcaggcaaccgtgccagagaaccaaccagccggcacccctgttgccagtttgagggcgatcgatcctgacgagggcgaggccggcaggctcgaatacaccatggatgctctgttcgactcaaggtccaaccagttcttttcacttgaccccgtgaccggtgccgtcaccaccgctgaagaacttgatcgggagaccaagtccacgcatgtatttcgggtgaccgcccaggatcacggaatgccccgcagaagcgccttggccaccctgacgatcctagtcaccgacaccaacgatcatgacccggtgtttgagcaacaggaatacaaggaatccctgagagagaacctggaagtaggctacgaggtactaactgtgagggcgactgacggcgatgctcctccaaacgccaacatactgtacagactactcgagggctccggggggagtccttcagaagtattcgaaatcgaccctaggtcgggtgtgatacggacccgcgggccggttgaccgtgaggaggtggaatcctatcagttaacagtagaagccagcgatcagggcagagaccccggccccaggtctaccacagcagcggtgtttcttagcgtggaagatgacaacgacaatgcccctcaattctccgagaaacgttacgtagtccaagtgagagaggatgttacccccggagcccccgtcctacgcgtgacagcgagtgaccgagataagggttcaaacgcagtggttcattattccatcatgagtggcaacgcacgcggacagttctatctggacgcacagactggggctcttgacgtggtgtcccccctcgactatgagaccaccaaagagtatactcttagggttcgagcgcaggatggaggccgacctcctctgagcaatgtctccggcttagtcacagtgcaggtgctcgatatcaatgataacgctcccatcttcgtttccacccccttccaggctactgttttggagtctgtgcccctcggatacctggtgttgcacgtgcaggccatagacgctgacgcaggagacaatgctcggcttgagtataggctagcaggcgttggtcatgactttccttttactatcaataacggaaccggctggattagcgtggcggcagagttggaccgcgaagaggtagatttttatagttttggagtggaggcccgtgaccatggaacgcccgcccttaccgcctcagcaagtgtgagcgtcaccgttctagacgtgaacgacaataaccctacgtttacacaacctgagtacactgtcaggttaaacgaagacgcagctgtagggaccagcgtggtgacagtgtccgccgtggaccgcgatgcccatagcgtcatcacctatcagatcacttccgggaatacccgtaataggttctccatcactagtcagtctggcgggggattggtgtcactcgctctgccactcgactataagctggagagacagtacgtgctggccgtcacagcctccgacggaactagacaggatacggctcagattgtggtgaacgtcactgatgctaacacccatcgtccggtattccagtcttctcattatactgtaaacgtgaacgaggacaggcccgctggtacaaccgtggtgctcatatcagccaccgacgaagataccggggagaacgcccggatcacgtacttcatggaagactctatacctcaatttagaatagacgccgatacaggcgctgtcacaacgcaggccgaactcgattacgaggatcaagtgagctatactttagccattactgccagagataacggtataccacagaagtccgacacgacatacctagagatcttggttaacgacgtcaacgacaatgcaccccaatttctcagagacagctatcagggctcagtctacgaagatgtacccccattcaccagtgtgctccagattagcgccactgaccgggactctggactcaacggtcgggtcttttatacatttcagggcggcgatgacggcgatggtgactttattgtcgagtctaccagtggtatcgtgcggactctgaggaggctggaccgcgaaaatgtggctcaatacgtattgagagcatatgcagtggataagggcatgcctcccgcaagaacgcccatggaggtgacagtgactgtactggatgtgaatgacaatccacctgtctttgaacaggacgagttcgatgtgttcgtcgaggagaacagtcctattggactggcagttgcgcgcgtcactgcaacggaccctgatgaggggaccaacgcccaaatcatgtatcaaatcgtcgagggaaacatcccagaagttttccagttagacatttttagcggggagctcaccgcactggtcgacttagattatgaggaccggcctgagtacgtgctggtcatccaagctacttctgccccgctggtctctagagctacagtgcatgtgagactgctggaccggaatgacaacccccccgttttagggaattttgagattctgtttaacaactatgttacaaatagatcttcatcctttcctgggggggccatcgggcgggttccggcccacgacccagatattagcgattctcttacatattccttcgagcggggcaacgaactgagcctggtgctgctgaatgcttcaacaggagagctcaagttatctcgcgctctggataataatcgtcctcttgaggccatcatgtctgttttggtttccgacggcgtgcattcagtcacagcccagtgcgctctcagggtgacaattatcacagacgagatgctaacccattcgatcacgctgcgtctagaagatatgtctcctgaacgattcctcagccccctgttgggcctgttcatccaggccgttgcagctactctggccactcctccagaccatgtcgtcgttttcaatgtgcagagggatacagacgcacccggcggacacattctcaatgtatcactatccgttggacaacctcccggccccgggggtggccccccttttctaccgagcgaggacttacaggaacgtctatacctgaaccggtccctgttaaccgccatctcagctcagagagtccttcctttcgatgacaacatctgtctcagggagccctgtgaaaattacatgcggtgtgtttcagtcctccgtttcgactcttcagccccgtttatcgcctcctcgtccgtgctgttcagacctatacaccccgttggtggattaagatgccgctgtccacccggctttacgggggattactgcgagaccgaggtggatctgtgttatagccgtccttgcggtccacatggacgttgtagaagtcgggagggggggtacacttgtctgtgccgggacggatatactggcgagcactgtgaggtttccgctcggtcaggaagatgtaccccaggagtgtgtaagaatggcgggacatgcgtcaatctattggtcggaggctttaagtgcgattgcccttcaggagacttcgagaaaccttattgccaggtgaccacaaggtcttttcctgcccacagctttatcacctttcgggggttgcgccaaaggttccatttcaccctggcgctgagcttcgcaaccaaagaaagagacggactgctgttgtacaacggaaggtttaatgaaaaacacgactttgtggctctggaggtcatacaagagcaagtgcaactaacattctcagctggggaaagcacaaccacagtgtcaccttttgtccccggcggagtatccgacgggcagtggcatacagtccagctaaaatattacaacaaacctcttttggggcagacggggctacctcagggaccaagcgagcagaaagtcgcagtggtcaccgttgatggatgtgatacgggtgttgccctccgcttcgggtccgtcctggggaactattcctgcgcagcccaggggacgcagggaggcagtaagaagtcattggacctgacaggtccccttcttcttggcggagtgcccgatttgcctgagtctttccctgtgcggatgcgccagttcgtggggtgcatgagaaacttgcaggttgacagtcgccatattgacatggcagatttcatagccaacaatgggacagtgcccggttgtccagccaaaaaaaacgtgtgcgactcaaatacttgccataacggcgggacctgcgtgaatcagtgggatgccttttcctgcgagtgccccttggggttcggtgggaaatcttgtgcacaagaaatggccaatccacaacactttctgggttcaagcttagtcgcctggcatggtctttcccttcctataagtcagccttggtatctgtccttgatgttccggaccagacaggccgatggagttttactacaggccatcacacgaggacgatccacaattacactccaattgcgagagggccacgtgatgctgagcgttgaaggcaccggactacaggcatcctcactgcgcctggaacctggacgggccaacgacggtgattggcatcacgcccagcttgcactgggcgcttccggcgggcccggccacgctattctgtccttcgattacggccagcaacgagcagaggggaacctcggaccacgtctgcatggtctgcatctctccaatatcacagtgggcggtatccccgggcctgccggcggcgttgcacggggcttcagaggctgtctgcaaggcgtaagagtgtccgacacccccgaaggggtgaatagcttagatccctcacatggagaaagcatcaacgtggaacagggatgctctcttccagatccctgtgattctaacccctgtcccgcgaacagttactgctccaacgactgggatagttatagctgctcttgtgaccccgggtattacggtgacaactgcactaatgtttgtgacctaaatccctgtgaacaccaatcagtatgtacccggaaaccatcagccccccacggatacacatgcgaatgtcctccgaattatctgggaccctattgcgagaccaggatcgatcagccctgcccacgaggttggtgggggcatcctacgtgtggaccttgcaattgtgacgtttcaaaagggttcgaccccgattgcaataaaaccagtggggagtgtcattgtaaggaaaatcattatcgtcctccagggtccccgacttgtcttctgtgcgactgttatcctacaggaagcctgagtcgagtttgtgacccagaggatggccagtgtccctgcaagcctggggtgatcggtaggcagtgcgaccgctgtgacaatccttttgcggaagtgacaacgaatggctgcgaagtcaattatgatagctgccccagggctatcgaagcagggatttggtggcctcgcacgagattcggtttgccagcagcagctccttgccctaaggggagcttcggtacagctgttcgtcattgcgacgagcatcgcggctggttgcccccaaacctattcaattgcacaagcattacctttagcgaactgaaagggtttgccgaacggttgcagcggaacgagtccggcttagatagcgggagaagccagcagctcgccctcctcttaaggaacgctacccagcacaccgcagggtatttcgggagcgacgtaaaggtggcctaccagctggccactcggcttctcgctcatgaatccactcaaaggggtttcggtctgtccgcaactcaggacgtgcactttactgagaatttgctaagggtgggaagcgctctccttgataccgccaacaagaggcattgggaactgattcaacagacagaagggggcacggcctggttgctccaacactatgaggcttatgcatccgctcttgcgcagaatatgagacacacttatctgtcgccatttacgattgtcactcctaatatcgtgatttcagtggtacgcctggacaagggcaattttgctggggctaagcttccccgctacgaggctctgcgtggggaacaacctccagacctggaaaccacggttattctcccagaaagcgtgttcagggaaaccccgcccgtcgtgaggccagctggccccggagaggctcaggagcccgaggaacttgccagacgccaaaggcggcatccagagttgtctcaaggcgaggcagtagcttctgttattatctatagaaccctggccggcttactccctcacaactatgatcccgataagaggtctctgagagtccctaagcggccgattattaacacaccagttgtgagcatcagtgtccacgatgacgaagaattgctgccccgcgccctggacaaacctgtgaccgtccaatttaggctgctggagaccgaggagagaacgaaaccaatctgtgtattttggaaccattcgatcctcgtgtcaggaaccggcggttggtcagcacgcggctgtgaggttgtgttccgcaacgaatcacacgtatcgtgccagtgcaatcacatgacatccttcgccgtcctgatggatgtgtctagaagagagaacggcgagatcctacctctcaagaccttgacctacgtggcactcggagttactttggccgccctgctcctgacttttttctttttgaccttgctgaggattctaaggagtaatcagcatggaattcggcggaacctcacagccgcgttggggctcgctcagctggtttttctgttgggcattaatcaggccgatctgccttttgcttgcacagttattgccatcctcttacatttcctttacctatgtactttctcatgggctttacttgaagcactgcacctgtaccgggcactcaccgaggtacgggatgtaaacacaggcccaatgagattctactatatgttggggtggggagtcccggccttcatcacgggtctggcagtgggactggatccagagggctatgggaaccctgatttctgttggcttagcatctacgacacactgatttggagctttgcaggcccagtagcgttcgcagttagtatgagcgtgttcttgtatattcttgcagcaagggcctcctgcgcagcccagagacagggcttcgagaagaagggacccgtaagtggccttcagccaagctttgcagtgttgctgcttctctctgccacttggctcttggccctgctgagtgtcaactcggatacactcttgtttcattatctgttcgccacctgtaactgcatccagggcccttttatctttctcagctacgtcgtcttgagtaaggaggttaggaaggccctcaagctcgcttgctcccgaaagccgagtccggatcctgctttgaccaccaaatctactctaacctccagctataactgcccttctccctacgccgacgggcgcctgtaccaaccctacggtgattcagcagggtcactgcacagtaccagcagatctggcaagtcccagccttcctacatcccattcctccttagagaggagtctgctttgaaccctggtcagggcccccccggcctgggagatccgggctctctgttccttgaggggcaagatcagcaacatgaccctgataccgacagtgattctgatctctcactggaagatgatcaatctggttcctatgcttccactcattcatcagacagcgaagaggaggaggaggaagaagaagaggaggctgctttcccaggtgagcaaggatgggacagcttactggggccaggagcagagcgcctccccctccattcaactcccaaagacggcggcccaggccccggtaaggccccttggccaggtgatttcggtacgaccgccaaggagagctccggtaatggggctcccgaggagagactccgcgagaacggcgacgcgctgagtcgcgagggatccctcggccctctacctggatcaagcgcacaaccacacaagggcattctaaaaaaaaagtgtctgcctaccataagcgagaagagctctctgctccggcttcccctggagcaatgtaccggaagttctagaggtagctctgccagtgagggaagccgcggtggtcctccacctcggcctccacctagacagagcctgcaggaacagctgaacggggtgatgcccatcgcaatgtcaattaaggccgggaccgttgacgaagattccagtggcagtgaattcctgtttttcaattttctgcactag

SEQ ID NO: 110283 - DNA, 9939 bp, Artificial Sequence
  Description of Artificial Sequence: Synthetic coding sequence
atgatggcccgaagacctccttggagaggcctgggggggcgatcaactcctatcctgcttctgctgttactaagtctattccccttgagtcaagaagagttaggcgggggtggccatcaggggtgggatcccgggcttgctgccacaaccgggccccgagcccacattgggggaggggccctggctctgtgccctgagtcgtccggcgtgcgagaagatggcggaccgggactcggtgtgcgcgagcctatttttgtaggactgagaggaaggaggcagagtgcaaggaacagccgcggaccaccagaacaacccaacgaagagctagggatcgagcacggtgtccagcctctgggctcccgtgaaagagagaccggtcaggggcctggcagtgttctgtactggaggcctgaggtttcctcctgtggacggaccgggccactgcaaaggggttcattatcccccggagccctctcgagcggcgtccctggcagcggcaattccagccctctgccctccgactttctgattcggcaccatgggccaaaacctgtcagctcccagcggaacgcaggtaccggtagtagaaaacgagtcggtacagctcggtgctgcggggagctgtgggccaccggctctaagggacagggagagcgtgccaccacaagcggcgccgaacgtaccgcaccccgcagaaactgccttccaggggcttctggcagtggaccagagctagactccgccccacgcacagctaggactgctccagcatcaggcagcgccccgcgtgagagccggacggcaccagagccggcaccaaagcggatgaggtctcggggcctattccgatgccgattcctcccacagcgacctggccctcgtccacctggtttgccggcgcgccccgaggcccggaaggtgacttcagccaatcgtgcgcgctttcgaagagctgcaaaccgccacccccagtttcctcagtataactaccagacactggtgcctgagaatgaggccgctggcactgccgtactgcgcgtcgtggcacaagatccagacgctggcgaggctggaaggcttgtatatagcctagctgctctgatgaacagcagatcattggagctgttctctattgatccacagtccggtctgataagaactgctgccgccctggatagggagtccatggagcgccattatctgcgggtaactgcacaggaccatggaagccctaggttgtcggccactactatggttgctgtcaccgtagccgaccggaacgaccatagccccgtattcgagcaggcccaatatcgcgaaactctgcgcgaaaacgttgaagagggctaccctattctccagctgagagcaacagatggcgacgcacctcctaatgcaaaccttcgctaccggtttgttgggcctcccgccgcccgggccgccgctgccgctgcctttgagatagaccctcgcagtggcctgatctccacatcaggtcgtgtggatagggaacacatggagtcctacgagctagtggtggaggcttcggaccagggtcaggaaccaggaccccgttcagcgaccgttagagtccacataacagtgctggacgagaacgacaacgccccgcaattttctgaaaaaaggtatgttgcccaagtacgagaggacgtacgcccacacactgtggtcttgcgagtgactgcaacagatcgggacaaagatgcgaatgggctagtccactataacatcatttcagggaattctcgaggccacttcgccatcgattcactgacaggtgaaattcaggtagttgcccccctggattttgaggccgaaagggaatatgccctgaggatccgggcccaggatgccggtaggcccccactctcaaataacaccgggctggctagcatccaggtggtggatatcaacgaccacatccccatctttgttagcacaccctttcaggtgtcagtgttggagaacgcccctcttggccactctgtaattcacattcaggctgtggatgctgaccacggagagaacgctcgactggagtattcactgaccggtgtcgcccctgacaccccatttgtgattaattctgccactggctgggtgagcgtgtctggaccacttgatagagaatctgttgaacactacttcttcggagttgaggcaagagatcacggctcccctcccctgtccgcatcagccagtgtcacagtgaccgtactagatgtgaacgataaccgacctgaattcacgatgaaggagtatcatttgcgccttaacgaggacgccgcagtgggaacttccgtggtgtccgttacggccgttgacagagacgccaacagcgcaatttcttatcagattacaggcgggaacacacggaacaggttcgcaatttctacccaggggggcgtcggtctggtcaccctggccctcccactcgattacaagcaggagaggtacttcaaactcgtgctgactgcatccgacagggcgcttcatgaccactgttatgttcacattaacatcactgatgccaacactcatagacctgtgttccagagtgctcactattccgtttctgtcaatgaggatcgccctatgggaagtacaattgtcgttatcagcgcaagcgacgacgatgtcggagaaaacgcccggatcacctacctgctggaagataatcttccccagtttcgaattgatgctgacagcggggcgattacactgcaggcccccctggactatgaggatcaggtcacttacacactggccataacagctcgggacaacggaatcccacagaaagccgacacaacctacgtggaggtgatggtcaacgacgtgaacgataatgctcctcagttcgtcgcgagtcactacaccggtcttgtgtccgaggatgcgcccccattcacatctgtgttgcagatctcagccactgaccgtgatgctcacgcaaacggccgcgtacaatacacattccaaaatggcgaggacggggatggggactttacaatcgagcccactagtggtattgtccgaactgttaggcggctcgacagggaggctgtctccgtgtacgaactgacagcatatgccgtggacagaggggttccccccctaaggacgccagtcagcattcaggtcatggtgcaagatgtcaatgacaatgcccccgtctttcccgcagaggaatttgaggtgagggtcaaagaaaactcaatagtcgggtccgtggtggcacaaatcaccgctgtggaccccgacgagggccccaacgcacatattatgtaccagattgtcgaaggcaacatccccgaactgttccagatggacattttttctggagagctgacagcgctgattgacctcgactacgaggcccgtcaggaatatgtgatcgtcgtgcaggcgacctcagcacccctggtgtctagggctaccgtgcacgtcagactggtcgaccaaaacgacaacagtccagtgctgaataactttcagatcctgtttaacaattacgtatcaaacaggagtgatactttccccagcgggatcatagggcgcatcccagcgtacgaccccgatgtctcggatcacttgttctattcttttgaacgaggaaacgagctgcagttgctggtggtcaaccagaccagcggggaactgcggctctcccgaaagctagacaacaacagacctcttgtggcaagcatgctcgtgacggtcaccgacggcctgcatagcgtgactgcccagtgcgtattgagagtagtgatcatcactgaggaactcctggccaactccctgaccgtaagactggaaaacatgtggcaagagcggttccttagtccgctcctgggtaggttcttagaaggagtcgctgcagtcctagctactccggcggaagacgttttcattttcaacatacagaatgatactgacgtgggcggtacagtgctgaatgtgtctttttctgcgttggcgcctcgcggcgccggcgccggggcagctggaccctggttttcttctgaagaattgcaggaacaactctacgtgcgtcgcgcagccctagccgctagatctttactggatgtgctcccgttcgatgacaatgtttgcctgagagagccttgtgaaaactacatgaaatgcgtttcggtcttacgttttgattcctccgcccccttcctggcctctgcttccacactctttcggcctatccagcccattgcaggactgcgatgtagatgccctcctggcttcacaggtgacttctgcgagacagagttggacctctgttatagtaatccctgccgcaacggaggtgcgtgtgcccggcgtgaaggtggctacacatgcgtgtgtaggccccggtttaccggagaggattgtgagttagatactgaagcaggacgatgtgtgcctggagtgtgtcgtaatggcggtacgtgcaccgatgcacccaacggtggatttaggtgccagtgcccggcaggcggggcattcgaaggtccccgttgtgaagtcgcggccagatcatttccccctagctcatttgttatgtttaggggactgcggcagcgcttccacttaacactctccctgtcatttgctaccgtccagcagtctggcctcctcttttataatggtcgtctgaacgagaaacacgactttctcgccctggagctcgttgcagggcaggtccggctgacttatagcactggtgagtctaacaccgttgtctctccaacagtgcccgggggattatccgacgggcagtggcacacagtgcacttgcgttattacaacaagcctaggacggacgcgctgggcggcgcacagggtccttcgaaggataaggttgcggttcttagtgtcgacgactgcgatgtagccgttgctctccagttcggggcagagattggcaactactcctgtgccgctgcaggagtccagactagctcgaagaagagtcttgatctgacaggccccctgctcttggggggggttcctaacctgccggagaatttcccagtaagtcacaaggatttcatcgggtgtatgcgggatctccatatcgacgggcgaagagtggacatggctgcgttcgtggccaacaatggcaccatggccggctgtcaggcaaaactgcacttttgcgactccggcccatgcaaaaactctgggttctgttccgaaagatggggatcgttcagttgtgattgccccgttgggttcggagggaaagattgtcagctgactatggctcaccctcatcattttcggggcaatggtaccctttcatggaactttggctccgacatggccgtgtctgtgccttggtacctcgggctggcatttaggactcgggccacacagggcgtgctgatgcaagtccaagccgggccacattccaccctcttatgtcaactggaccgtggcctcttatcagtcacagttaccaggggctctgggcgcgcttctcacctgttgttggatcaggtgacagttagcgatggaaggtggcacgacctcaggctggagttacaggaggagccaggagggcgcaggggtcatcacgtgctgatggtttccctggattttagccttttccaggatacaatggctgtggggtctgagctccagggcctcaaagtgaaacagctacatgtgggaggcttacctccagggtcagcagaggaggcacctcagggactggtcggatgtatccagggagtatggctgggcagcaccccctccgggtcacccgccctgctccctcctagtcacagagtgaatgcagaaccaggatgcgtagttaccaatgcttgcgcttccgggccatgcccaccacatgcagactgcagggatctgtggcagacctttagttgcacttgtcagcctgggtattatggaccaggttgcgtggatgcttgtctgctcaacccatgccagaatcagggatcttgccgacatctccccggcgcaccacacgggtacacatgtgactgcgtaggcggatactttggccatcattgtgagcacaggatggaccaacaatgtcctaggggttggtgggggtcccccacctgcgggccttgcaattgcgatgtccacaagggatttgacccaaactgtaacaagaccaacggtcaatgccattgcaaagagtttcattacagaccaaggggatctgattcctgccttccttgtgattgttatccagtggggtccacttcaaggagctgtgcaccacacagcggacagtgtccctgcagacccggagctctcggaaggcagtgtaatagctgcgacagtccttttgctgaagtgaccgcgagcggctgccgcgtgctgtatgacgcatgtccaaaaagcttacggtcaggcgtctggtggccccaaacaaaatttggcgttctggcgacagtgccctgtcctcgtggcgcactgggcgctgccgtgagactctgtgacgaggcacagggctggctggaaccagacctctttaactgcactagtcccgccttcagagagctatctttgctactggacggcctagagctgaataagaccgctctggatacgatggaggctaaaaaactggcacaacgcctgagggaagtgactggccacaccgaccactacttctcccaggacgtgagggttactgctcgcctactcgcgcaccttctggcctttgaatcacaccaacaaggatttgggctgacagccacccaagatgcacactttaacgagaatcttctatgggcaggatccgccctccttgctccagaaactggtgatctttgggccgccctcggacaacgcgctcccgggggatcgcccggatcggctggactagttaggcaccttgaggagtatgctgcaacactggccaggaacatggagctgacttaccttaacccaatgggtttggtcacaccaaacataatgctctcgatcgaccggatggagcacccatcatcgcctcgcggagcgagaagatatccacggtaccactccaacctgtttcgtggccaggatgcttgggacccacatactcacgtccttctgccatctcagagtcctcgtccttcaccgagtgaagtgctgccaacatcatcaagtattgagaactctacaacaagcagcgtggtacccccaccagcaccacccgagcctgagcctggaatctccattatcatcctgctggtctacagaactttgggcggactcttgcctgcacagttccaagcagaacggagaggtgcacgcctgcctcagaacccggtgatgaactcacctgtggtttcagttgcagtgtttcatggacgcaattttctgaggggtatccttgagtctccaatctctctcgaatttcggttgttgcagaccgctaacagaagtaaggccatctgcgtccagtgggatccacccgggctcgcagagcagcatggggtatggactgctcgggattgcgagctggttcaccggaacggttctcatgcacggtgccgctgcagccgcaccggcacgtttggagtgctaatggatgcctccccacgagaacgcctggagggcgatctcgagcttctggctgtgtttacccatgttgtggtggctgtaagcgtcgccgccctcgtgctgaccgccgctatcttactgtctttgcgtagcctgaaaagcaacgttcgaggcatccacgcaaatgttgcagcagccctgggggtcgccgagctcctgtttctgctagggatccaccgtactcacaaccagctagtctgtaccgcggtcgcaatattgttacattatttcttcctcagcacattcgcatggctttttgtgcaaggtctgcatttgtacagaatgcaagtggagcctagaaacgtggacaggggagccatgcgcttctatcatgcccttgggtggggcgtgcccgcagtacttttgggattagcggtcggtctcgaccctgagggctatgggaatcccgacttctgctggattagcgtgcacgagccactgatctggagtttcgctgggcccgtggtacttgtaattgtgatgaatggaaccatgtttctcctagcggcgaggacctcatgctcaaccggtcaacgtgaagctaaaaagaccagcgctctgaccttgagaagcagtttcctactcctcctgctggtgtccgccagttggctgttcgggttgctggccgtgaaccattccattctggccttccactaccttcatgcgggcctctgcggcttacaggggctggccgtactactccttttttgcgtgttgaacgccgatgcccgagccgcttggatgcctgcatgtctggggcgcaaggcggcccctgaagaagcccgccctgcccccggccttggaccaggcgcttacaacaataccgcgctgttcgaggagtccgggctgattaggatcacactcggcgcgagcaccgtgagtagcgtctctagcgcccgatccggccgaacacaagaccaggattctcagaggggacgctcttatttgagagataatgtgctggtgaggcacggatctgcagctgatcacacagaccatagtctccaagcccatgcaggacctactgacctggatgtggctatgtttcacagagacgctggagctgattccgactccgactcagacctgtccctagaggaagaacggtccctgtcgatcccctccagtgagtccgaggataatgggcgcaccaggggaagattccagaggcctctctgccgagccgcacaatccgaacggctcctcactcaccccaaagatgtcgacgggaacgacctgctgtcttattggccggccctgggagagtgtgaggcggctccctgtgctcttcaaacctgggggtcggaacgccggctgggcctggatacctcgaaagatgccgctaacaacaatcagccagaccccgcccttacatcgggggatgagacgagcttaggcagagcacaacgccagaggaaagggattctcaagaacagactgcagtaccccctcgtccctcagacccgcggcgcaccagagctgtcatggtgtcgggcggcaacactgggccaccgtgctgtgcccgcagcctcctatgggcgtatctatgcgggggggggaacggggtctttatcccagccagctagtcgttactcttctagagagcaactggatctcctcctccgacggcagctgtctcgagaacggctggaggaggcccccgcccccgtccttcggccattgtctcgcccaggctcgcaggaatgcatggatgcagcccctggacgtttggagccaaaagatcgaggttcaacactaccgcgcagacagccacccagagattatcccggcgccatggccggcagattcgggagtcgcgatgcgctggacctaggcgcaccgcgcgaatggttgagcacactgccacctcccagaagaactagagatctcgacccccagccaccacccttgcccctgagccctcaaaggcaactgagtcgggatcccttactgccatctagaccacttgatagcctttccagaagctcgaacagccgcgagcaattggaccaggttcccagtagacacccaagcagggaggcccttgggcccctgcctcagctgcttagagctagagaagactccgtgagcgggcctagtcatggtccctcaacggagcaactggatattctgtctagtattctggcaagctttaattcatccgcattgtctagcgtccagtccagctcaactcctctaggcccccatactacagccacaccctctgccacagcctcagtgcttgggccctcaactccccggtctgccacttcacatagcatcagcgagttgtcacccgatagcgaggtcccccgatctgaaggtcattcctag

SEQ ID NO: 110284 - DNA, 9954 bp, Artificial Sequence
  Description of Artificial Sequence: Synthetic coding sequence
atgatggcgcgccgtcccccctggcggggcttgggtggtcgaagtactcccatcttactcctcctgctcttgtcactcttcccactcagtcaggaagaactgggcggggggggccatcagggatgggaccccggtcttgcggccaccacgggaccaagagcccacattggaggcggagctctggcactttgtcctgagagttccggcgttcgagaagacggtggccccggcctcggagtccgagaaccaatattcgtcggccttcgcgggagacggcagagcgcacgcaattctcgagggcccccagagcaacctaatgaagagctcggaatagaacacggagtgcagccgctcggaagtagagaacgagaaaccgggcaggggcccggatctgtactgtactggcgaccagaagtgtctagctgtggtcggacgggtcctctgcaacgtggcagcttatcacccggtgcactgagtagcggagtgccaggatcgggcaactcatcccccctgccgagcgactttttgatcagacatcacggccccaagccagtgagtagccagcgcaatgcaggaaccggttcaaggaagcgggtcggtacagcacggtgctgtggcgagctctgggctaccggctccaagggacaaggagagagagcaactacaagcggggccgaacggactgctcctaggcggaactgcctaccaggagccagcggctctggcccagaactggacagcgcccctcggaccgcccggaccgcccccgcctctggatcagcccccagagagtctaggaccgcgccagaaccggcccctaagagaatgcggagtcgaggactcttcaggtgcaggttcctaccacaacgcccgggtccacgacctcctgggctgcccgccaggccggaagctcgcaaggtcacaagtgccaatcgtgcgaggtttagaagggctgctaatcgacaccctcagtttccgcagtacaattatcagactttggtgccagaaaatgaagccgctggaaccgcagtgttacgtgtggtcgcccaagatcctgacgccggagaggccgggagactcgtatattccctcgccgcactaatgaacagccgtagtttagagcttttctcaatagatccacagtcaggtctcataagaaccgccgctgccctggaccgcgagtcgatggagcggcactacctcagagtgacagcacaggatcacggctctcctagactgagcgctaccaccatggtcgccgtgacggtcgctgacagaaatgaccattcgccggttttcgaacaggctcagtaccgcgaaacactgagagagaacgttgaggagggctaccccattctccagctgagagccacagatggtgatgcccccccaaatgctaacctgcggtacagatttgtgggcccccccgctgctcgcgccgctgcggcggcagccttcgagatcgatccgcggtcaggactaatatcaacctcaggcagggtcgaccgcgagcatatggaaagctacgaactcgtcgtcgaggcaagcgaccagggacaggaaccagggcctcgttcagccaccgtacgggtgcatatcaccgttctcgacgagaacgacaacgctcctcagttttccgaaaagcggtatgtcgcgcaagtacgagaggacgtacggcctcataccgtggtattgcgcgtgactgcaacagatcgggacaaggatgctaacggcctggtacattacaatatcattagcgggaattcacgcggtcacttcgcaatcgatagtctgacaggcgaaattcaagttgttgcacccctcgattttgaagccgagcgcgagtatgcactgagaattcgcgcccaggacgctggccgcccacctctttcaaacaacactggattggccagcatccaagtcgtggatatcaacgatcacattccaatatttgtgtcgacacccttccaggttagtgtgctggagaatgcaccgcttggtcactctgtcatccacattcaggcagtggacgccgaccatggagaaaacgctcgcctcgaatattctctgacaggagtggcgcccgatacacctttcgtgatcaatagcgctaccgggtgggtctcagtgtccggaccgctagaccgagagagtgtggagcactatttttttggcgtcgaagcgcgggaccacgggagtccccccctgagtgcctctgcctctgtgaccgtaacagtgctcgatgtcaatgacaaccgacccgaattcacgatgaaggagtaccatctgcggctgaatgaggatgcagctgtgggaacttccgtcgtatccgttaccgctgttgaccgagacgccaactctgctatcagttatcagattaccggagggaatacacggaaccgattcgctatatcaacccaggggggcgtgggattggtgactttagctctcccccttgactataaacaggagcggtactttaaactggttttaactgcttccgatagagccctgcacgaccactgctatgtacacattaatattaccgacgcgaatacccacaggcccgtgttccagagtgcccactacagcgtgagtgttaacgaggaccggcctatgggcagtacgatcgtggtgataagcgccagcgatgatgacgttggggaaaatgctaggattacttacctgctagaagataacttaccccaatttcgcattgatgctgattccggagccataacacttcaggcaccgctggattacgaagatcaagtgacatacaccctagctattacggcgcgagataatgggataccacaaaaggctgatactacctacgtggaggtgatggtcaacgatgtgaatgacaacgctcctcaattcgtggcgagccattacacgggtctggtgagtgaagatgcccctccttttaccagcgtgctgcagatctccgctaccgacagagacgcacatgctaatggccgcgtacagtacactttccagaacggggaggatggcgatggggactttacgattgagcccacctcaggaatcgttcgaaccgtcaggagattggatagggaagccgtgtctgtttacgaactgaccgcctatgctgtggaccggggcgtaccaccactgagaactccagtgtcaatccaagtcatggtgcaagacgtgaatgacaacgctcctgtatttcccgctgaggagtttgaagtcagggttaaggagaattccattgtcggaagtgttgtagcccagatcacagctgtggaccccgacgagggccctaacgcacatatcatgtatcagatagtcgaagggaatatcccggagttgttccagatggatattttttccggcgagctcactgcactaattgaccttgattacgaagccagacaggaatacgtgattgttgtccaagctactagtgcgccactggtgtcaagggccacggttcacgttcggctagtcgatcagaacgataatagcccagtactcaataatttccaaatactgtttaataactatgtatccaataggtcagatacatttccctccggtattatagggcggattcccgcgtacgatccggacgtttccgaccacttattttatagtttcgagagaggcaacgaactgcaactgctggtggtgaaccaaacaagtggagagctcagattgtcacggaagctggataacaacagacctctggtcgcctctatgctggtaactgtaaccgatggtctccacagcgtgacggctcagtgcgtcttgcgcgtggtgataattactgaagagctactagccaattctcttaccgtccgccttgagaacatgtggcaggagcgattcctcagccccttgctggggagatttctggagggcgtcgctgccgtcttagctactcccgccgaggatgtctttatctttaatatacagaatgatactgatgtcggtggcactgtcctgaacgtctcctttagtgctctcgcccctaggggcgctggagcaggtgcggctggtccgtggttttccagcgaagagctccaggaacagttatatgtccggagagccgccctagcagccaggagcctccttgacgtcctacctttcgatgacaacgtctgtctgcgtgaaccatgtgagaattatatgaaatgtgtgtctgttctaagattcgattcatccgctccgtttctcgcatcagccagcacactctttcgccccatccaaccgattgccggactgaggtgcagatgcccaccagggttcactggggatttttgtgaaacagaactagatttgtgttactcgaatccttgtcggaacggaggagcctgtgcgcgcagggagggcggctacacttgcgtttgcaggcctcgtttcactggagaggactgtgaactggacaccgaagctggaaggtgcgtacccggagtgtgtaggaacggcggtacttgtaccgatgcccccaatggtggcttccgctgtcaatgtcctgccggcggggcatttgaaggacctagatgcgaggttgccgcccggtcttttccaccaagctctttcgttatgtttcgcggcctgcgccaaaggttccacctgacactctctctgtctttcgcgacggtacaacagagtggccttttattttataacggacgcctcaacgaaaagcacgacttcctggccttagagctggtcgccgggcaagtgaggctcacttactcaaccggtgagtccaataccgtggtttctccaacagtgccggggggcctctcagacggtcagtggcatacagttcatttgcgatactacaataaacccaggactgatgcattagggggggcacaggggccaagcaaagacaaagtcgccgtcctttctgtcgacgattgcgacgttgcagtcgccttgcagtttggggcagagatagggaattacagctgtgcggcagctggggtacagaccagctcaaagaaatccctggatttgactggaccccttctgcttggcggcgtcccaaacctccctgagaatttcccagtgtcacacaaagatttcatcggttgcatgcgggatctgcatatcgacggaagaagggttgacatggccgccttcgtcgccaataatggcaccatggcaggctgccaggcaaaattacacttctgtgatagcggaccttgtaagaactccggtttttgttccgagcggtggggcagcttctcctgtgactgcccagtggggttcgggggcaaggattgccaactaacaatggctcacccacatcatttcagaggcaatgggacgctcagctggaatttcggcagcgacatggccgtatcagttccatggtatctaggcctcgcatttaggacaagagccactcaaggcgtgcttatgcaggttcaagcggggcctcattccacactcttgtgccagctggaccggggcctcctgtccgtcacagtcacccgcggatctggccgcgctagccatctcttgctggaccaggttacagtttccgacggcaggtggcatgacctacgtcttgagctgcaggaggaaccgggaggccggagaggacaccatgtgctgatggtgagcctggacttctcactcttccaagatactatggccgtggggtcagagctccagggtctcaaagtcaagcagttacatgttggcggactcccaccagggtcagctgaggaagcccctcaaggcctggttgggtgtattcaaggcgtgtggctgggctctaccccgagcggctcgccagccctgctccccccatcccacagagtcaatgctgagccgggatgtgtcgtgacaaatgcgtgcgcttctgggccctgtcctccccacgcagattgtcgcgacttatggcagacattctcctgcacatgtcagcctggctactatggccctggatgcgttgacgcatgtctcctgaacccttgtcagaatcagggcagctgtaggcatctgcccggtgcgcctcacggctatacctgcgattgcgttgggggttattttggccaccactgtgagcaccgcatggaccaacaatgtccccggggatggtggggctcacccacctgcggcccctgtaattgtgacgttcacaaaggtttcgatcctaattgcaataagaccaacggccagtgccattgtaaggagttccactataggccccggggctctgacagctgtttgccatgcgattgctatcccgtagggtctacatctcgctcatgcgccccccattcaggacagtgtccatgtcgtccaggcgccttaggacggcagtgcaattcatgcgatagtccctttgcagaagtcacggcaagcggctgtcgggtactgtatgacgcctgccccaagagtctgagatcaggtgtgtggtggccccagacaaagttcggagttctcgccaccgtgccatgcccaagaggagctctggggcttcgtggggccggagctgctgtgagactgtgcgatgaggcgcagggatggctggaaccagacctgtttaattgtacatctcccgcttttcgcgaactctcattactcctggatggactggagctcaacaagaccgccttagatacaatggaagctaagaagctggcacaacgcttaagagaggtgaccgggcatacagaccactatttttctcaggacgtcagggtaactgcccgactcttggcacacctgctggctttcgaaagccaccagcagggtttcggtctgacagcaactcaggacgcacacttcaatgagaacttgttgtgggccggctcagctctgctggcacctgaaacgggggatttgtgggcagctttagggcagcgcgccccaggcggtagccctgggagcgccggtctcgtgcgccacctcgaggagtatgcggcaactctagcacgtaatatggagctcacctacttgaaccccatgggcctggtcacaccaaatattatgctttcgatcgatagaatggaacatccatctagcccgcgcggagccaggcgttaccccagataccactcaaatctgttcagaggacaggatgcctgggaccctcacacccacgtcctcctcccttctcaatctccgaggccttccccttccgaagtcctgcccacttcatcaagtattgagaattcaactaccagcagcgtagtgcccccccccgctcccccagagccagaacctgggatcagcatcattatcctgctggtgtatcggaccttaggcggcctgctgcctgcccagttccaggcagagcgacgcggcgcacggcttcctcagaacccggttatgaatagccccgtcgtctccgtcgcagtgttccacggccgaaattttctgaggggcattctcgagtctcctatttctctggaatttcgactcctgcagaccgccaatcgcagcaaggccatctgtgttcagtgggatccccctgggttggccgagcagcacggagtgtggaccgctagggattgtgaactcgttcaccgcaacggctctcacgctcgttgtagatgctcgcggaccgggacatttggcgttctgatggatgcaagtccacgggaacgcctagaaggcgatctggagttactcgcggtgtttacacacgttgtcgtggcagtctcagtggctgctcttgtccttacggccgctatactgcttagcctccggtccctaaagtcgaacgtcagggggatccacgcaaatgtggcagcagctctgggtgtcgccgaactgctgtttctgttgggaattcatcggacccataatcagttagtgtgtaccgctgtggccatcctgctgcattacttttttctcagcacattcgcctggctgttcgtgcaaggactgcacctttatcgcatgcaggtggaaccgcgtaacgtggaccgaggggctatgcgtttctatcacgctcttggatggggtgtacctgctgtgctattgggcttggccgtgggccttgatccagagggatacggcaaccccgatttttgctggatttccgtccacgagccacttatatggagtttcgcagggccagttgtcttggtgatcgtaatgaacggcactatgttcttgctggcagccaggacctcatgctctacaggccaacgagaggccaaaaaaacatcggcgctaaccctgcgaagtagcttcttgttactgctgctggtgtccgcaagctggttattcgggctgctggcagtcaatcactctattcttgccttccattacctgcatgctgggttatgtgggttgcaggggttggctgtgctcctgttgttctgcgttctgaacgctgacgcaagggctgcatggatgcctgcttgtctcggccgaaaggcagcgccagaagaagctcgccctgcacctggtctaggaccgggagcctataacaatactgcccttttcgaagaatcagggttaataagaattaccttgggcgctagcactgtgtcatccgtgtccagcgctcggtcgggaagaacacaagaccaggacagtcagcgcggtagatcttacttgagagacaacgtgctggtgcgccacggatcagctgcagatcatacagaccacagcctgcaagctcatgcgggaccaaccgacctggacgtggcaatgtttcacagagacgcaggcgccgactctgactctgatagtgacctctcactggaagaggagcgatccctaagcattcctagttctgagtccgaagataatggacgcacaagaggccgattccagaggccactctgtcgggccgctcagagtgaaagactgctgacacaccccaaggatgtggacgggaacgatctgctcagctattggcccgctctaggcgagtgtgaagcagctccctgcgccctgcagacttggggatctgaacgccggctgggcctggacacgtctaaagacgccgcgaataacaaccagccagaccccgctctaaccagtggtgacgagacctctctgggcagggctcagagacagaggaagggcatccttaaaaatcgcttgcagtatccactcgtcccccagaccagaggagctcctgagctgtcatggtgccgggccgccactctagggcaccgggcggtgcctgctgcaagctatggcaggatttacgcgggtggaggcacaggttcgctgtctcagccggcctctcgctacagttccagagaacaactagacctcctcctgaggagacaacttagccgcgaacggctagaggaagccccggcccccgttctgcggcccctcagccgacctggcagccaggagtgtatggacgcagctcctggtcggctggaacctaaggacagagggtctaccctgcctcggcggcagccacctcgggactaccccggggcaatggctggaagattcggaagccgtgacgccttggacctgggagcacctcgagaatggttatctacactgcccccaccaaggaggacccgcgaccttgacccccaaccacccccactgccactgagcccacagaggcagttatctagagaccctctcttgccctccagaccattagactcactctcccgtagctcaaactcaagagaacagcttgaccaggtgcccagccgccaccccagccgcgaggctctgggacccctccctcagctgttgcgggctagggaggattcagtgagcggaccgtcccacggcccttccacagaacagctcgatattctctcatctatccttgcttcttttaattcctccgctcttagcagtgtgcagtctagttcaactcctctcggccctcacaccaccgccacccccagtgccacagcctcagtccttggaccatcaacccccaggtctgccaccagtcattccatttcagagttgtctccagacagcgaggtgcctcgcagcgaggggcacagctag

SEQ ID NO: 110285 - DNA, 1557 bp, Artificial Sequence
  Description of Artificial Sequence: Synthetic coding sequence
atggcattctgggccggaggttcccctagtgtggtagactactttccaagcgaggatttctatcggtgcggatattgtaagaatgaatctggtagtcgttccaacggcatgtgggcccatagtatgactgtccaggactaccaggatctaattgatagaggctggcggagatcaggtaaatacgtctacaaaccagtgatgaatcagacctgttgtccccagtacacgattcgctgtcggccgctgcaattccagccctctaagtcacataaaaaggttttgaagaagatgttgaaatttcttgctaagggtgaggtgcctaaagggagttgtgaggacgaaccaatggactcaactatggacgatgctgtcgctggcgattttgcactgattaacaaactcgatatccagtgtgatttgaaaaccttgagtgacgacatcaaggagagcttagaaagcgagggtaagaattcaaaaaaggaggaaccccaggaattgctacagagtcaagactttgtaggggaaaaacttggatccggggaaccaagtcactcagtcaaggtgcacacagtgcccaagcccgggaagggagctgatcttagtaagccaccatgcagaaaagcgaaagagatcaggaaagaaaggaaacgtctaaaattgatgcagcagaatcccgcaggggaattggagggctttcaggcacaggggcacccaccgagtttgttcccccctaaagcgaaatcgaatcaacccaaaagtctcgaggacctgatctttgaaagcttaccggagaatgcatctcataaattggaagttagggtggtgaggtcctccccaccttcaagccagtttaaggctacattgctcgagtcttatcaagtctataagcggtatcagatggtcatccataaaaacccacccgataccccaaccgagtctcagttcacgcgattcctttgttcaagtcccctggaggccgaaactccccccaacggtccagactgcggatacggatcctttcatcaacagtattggctggacggtaagatcattgcagttggcgtaatcgacatcctccctaactgtgtgtcttccgtgtacttgtactatgacccagactacagtttccttagtctgggtgtgtatagcgctctccgggaaatcgcttttacccggcagctgcatgagaaaacctctcagttgagctattattacatgggcttctatatccatagctgccccaaaatgaaatataaagggcaatatagaccttccgacctcctgtgtcctgagacgtatgtgtgggtgcccatcgaacagtgtctcccttcccttgagaattccaagtactgccgcttcaaccaagatcccgaagccgttgatgaggacagatccactgagccagaccgactgcaagtgttccacaagcgagctattatgccatacggggtgtacaagaagcaacagaaggaccccagtgaagaagccgcagtgctccaatatgccagtctggttgggcagaagtgcagcgagagaatgctgctgttccgcaactag

SEQ ID NO: 110286 - DNA, 3195 bp, Artificial Sequence
  Description of Artificial Sequence: Synthetic coding sequence
atgggcagacacgtcgcgactagctgtcacgtggcttggttacttgtcctgatcagcggttgctgggggcaggtgaacagattgccgttctttactaatcacttcttcgatacctatctgctgatatccgaagacacccctgtgggatcctctgttacgcagttgctggcccaagatatggataacgaccctctggtatttggcgtgagtggagaggaagcctcccgcttctttgccgtggagcccgatacaggagttgtctggcttcgtcagcctctagaccgcgagactaaaagtgagttcactgtcgagttctccgtgtcagaccaccagggcgtgatcaccaggaaagtgaatatccaagtgggtgacgtcaatgataacgccccaacctttcataaccagccatactctgtgagaatcccggaagtaggtgccaccggtaatactccggtggggacccctattttcattgtgaatgcaacagatccagaccttggcgcgggaggttctgtgttgtactcatttcagcctccttctcagttttttgcaatcgattccgctcggggaatagttaccgtgattagggaactggattatgaaactacccaggcatatcaactgactgtgaacgctaccgaccaggacaagacacggcctctctccactcttgcaaatctggcaattataattacagatgtacaagatatggacccgatcttcatcaatcttccttactcgaccaatatctacgagcactccccgcctgggacaacggttagaatcatcacggcaattgaccaggacaaaggtcggccacgtggcataggttacacaattgtgtcaggaaatacgaatagcatcttcgcgctggactatatcagcggcgtgctgaccctgaatggccttctggacagggaaaaccccctttactcccacggcttcatcctcacggttaaggggacagagctgaatgatgacagaactccctctgacgcgacagtgactaccacattcaatattttggtcatagatatcaacgacaacgcacctgaattcaactcttctgagtacagcgtggcaatcaccgagttagctcaagtgggatttgccctgcccttattcattcaggtagtcgacaaagatgaaggtctgaattcaatgttcgaagtctatctcgtaggcaacaactctcatcatttcatcatctcacctacttccgtccaaggtaaggccgacattagaattagggtcgctattccgctggattacgagacggttgaccggtacgattttgacttgttcgcgaatgagtcagtcccagaccacgtgggttacgctaaagtgaagatcacgttaatcaatgagaacgacaaccgcccaatttttagccagcccctgtacaacatttctctatacgagaacgtcactgtgggcacatcagtgttaacggtgcttgctacagataatgacgcggggactttcggcgaagtgtcctactttttcagtgacgatcctgaccgctttagcctcgataaggataccggcctgatcatgctgattgcaagactcgattacgagcttatccaacgcttcactctcacaattattgccagggacgggggaggtgaagagaccaccggtcgtgtgcggataaacgttctcgacgtcaatgacaacgttccaacattccagaaagacgcctatgtgggagctctgcgcgagaacgaaccttctgttacccaactggttcgcctcagagctacagacgaggatagccctccgaataaccagatcacatatagcattgtgtctgcatcagcatttggatcatattttgatatctccctctatgagggatacggggttatttcagtttcacggccgcttgactatgagcagatatcaaatggattgatctatttaaccgttatggctatggacgctggtaaccccccactgaatagtacggtacctgtgaccattgaggtttttgatgagaacgataacccaccaacgttttccaaacccgcctacttcgtatctgtggtagaaaacattatggccggcgctacggttctgtttctgaacgccacggatctggacagatccagggaatacggtcaggagtccataatctacagcctcgagggaagcacccagttcaggattaatgctcgatcaggcgaaataaccaccacttcattgttagacagggagacaaagtcagagtatatccttattgttcgagccgtcgatgggggggtgggacataaccagaagaccggtattgcaaccgtgaacatcactctgctggatatcaatgataaccacccgacatggaaagatgcgccatactatataaacctagtggaaatgacgcccccagactcagatgtgacgaccgttgtggcagtagatccggacctgggggagaacggaaccctggtgtactccatccagccccccaacaagttttactctctaaattcaactacaggcaaaatccggacgactcatgccatgctggaccgggagaatcccgaccctcacgaggccgagctgatgcgaaagatcgtggtttctgtaaccgattgcgggagaccgcctctgaaggccacatcaagcgccaccgtttttgttaaccttctagacttaaacgacaatgatcccaccttccaaaacctcccattcgtcgcggaggtattagagggcattcccgcaggggttagcatttatcaggtggttgcaatcgatctggacgaggggcttaacggtctggtgtcttacagaatgccggtgggaatgcctcggatggatttcctgattaatagcagttcaggagtcgttgtgacgaccacagaactggatagagagcggatcgcagagtaccagctcagggtcgttgccagcgatgcaggcacccctaccaagagcagtacctcgacccttaccatccacgtgcttgatgtgaatgatgaaacaccaacatttttccccgccgtgtacaacgtttctgtcagcgaggacgtcccacgggagtttagagtggtttggttaaactgcactgacaacgatgtgggcctcaacgccgaattgtcttatttcattacaggcgctgcgcccgcttccgcacacctgtgcaggccccctggcgcactccctcccccgctgcctgacggccagccggactag

SEQ ID NO: 110287 - DNA, 3345 bp, Artificial Sequence
  Description of Artificial Sequence: Synthetic coding sequence
atggtgaaatcccccatgaatcgtgagctggttgccacatacgaagtgacactgtccgtcatcgataatgcttcagatctgcctgagcgctccgtctccgtcccaaatgctaaactcaccgtgaacgtgctggacgtgaatgacaatacacctcagtttaagcctttcgggatcacgtattacatggagcgcatactggaaggcgccacacccgggactacgcttattgccgtggccgccgtcgatccggataaaggtttgaatggcttggtgacatatactctgctggatctggtccctccagggtatgtgcagttggaagactcttccgccggtaaagttattgcgaatcgtacagtggattacgaagaggtccactggttaaattttactgttcgggcctcggataatggctctccgccccgcgctgctgaaattcccgtctacctcgaaatcgttgatattaacgataacaatccaatctttgaccagcctagttatcaggaggccgtctttgaggacgtgcccgtgggcacaattattctgactgtcacggcaactgatgccgattcagggaatttcgctctcatagaatactccctcggcgacggagaatcgaagttcgcgatcaatccaaccaccggcgatatctatgttctgagtagccttgaccgtgagaagaaagatcactacattctcacagcactcgccaaagataatcccggtgatgttgcttccaacaggcgcgaaaactccgtgcaagttgtcatccaggtgctcgacgttaatgactgtaggccacaattctccaagcctcagtttagcacaagtgtctacgagaatgagcccgccggcacttccgtgattacgatgatggccactgatcaggatgagggccccaacggagaattaacctacagtttggaggggcccggagtcgaggcgttccatgtagatatggacagcggtctggtcaccactcagagacccttacaaagttatgaaaaattttcacttacagtggtcgcaactgacgggggggagccaccactctggggcacaactatgctccttgtagaggtaattgacgtgaacgacaaccgtccagtgttcgtacggccacctaatgggacgattctgcacatccgtgaggagatccctcttcggtccaatgtgtacgaagtttatgccaccgacaaggacgagggccttaacggtgccgtacggtacagcttcttgaaaactgcgggaaatcgtgattgggaattcttcattattgaccccatctccggactcatacaaactgcacagcgcctggacagggaatctcaggcagtgtatagtctcattctggtagcaagcgatctcgggcagcccgtcccctatgagaccatgcaacccctccaggtggctcttgaagacattgatgataatgagcctttgtttgtgcgtccacctaaagggtcaccccaataccagctcttgacagtgccagagcactcaccaaggggtacgctcgttggaaacgtaacaggtgcggtcgacgcagatgagggtcccaatgctatcgtgtactattttatcgccgccgggaacgaggagaagaactttcatcttcaacctgatgggtgcctcctggtgctccgggacctggatagagagagggaggctatctttagctttatcgtaaaagcaagcagcaacagatcatggactcctcctcggggcccatcgccgactctggatttagtggccgacctgacactgcaggaagtaagagtggtgcttgaagacatcaatgaccagcctccccgattcaccaaggccgagtacacagcaggtgtggcgacggatgctaaggtgggctcggagttaattcaggtgctagcccttgatgctgacatcggaaacaactcgctcgtattttactccatcctcgctatccactacttcagggctctggctaacgatagcgaggatgtcggacaggtattcaccatgggttctatggatggcatcctgcggaccttcgatctttttatggcttactcgcctggctatttcgtggttgacatcgtggcccgcgacttggccggccacaatgatacggctatcatcggtatttacatccttagagacgaccagagggtcaaaatagtgattaacgagattccggatcgagtccgcggattcgaggaagaatttatccacctcttgagcaatatcactggtgctattgtgaatacagacaacgtgcagtttcacgtggacaaaaaaggccgcgttaacttcgctcagacagaactgctcattcatgtcgtgaacagggacactaaccggatcttagatgtggacagagtgattcagatgattgatgagaacaaggagcagctgcgaaacctttttagaaattacaacgttctagacgtgcagcctgccatcagcgtccgccttcccgacgatatgagtgctctgcagatggccattattgtcctggccatcttgctgtttctggccgccatgttgttcgtcctgatgaactggtattaccgcaccgttcacaaaaggaagctgaaagccattgtcgccggatctgccggcaatcgtgggtttatcgacatcatggacatgccaaacaccaataagtattcttttgacggggcgaatcctgtgtggttggacccgttttgccgcaatctggaacttgcagcccaggctgaacacgaggacgatctgccagagaatctttcagaaattgcagatctctggaacagtcccaccagaacacatggtacattcggacgggagcctgccgccgtcaagccggatgacgacaggtatctgagagccgcgattcaagaatatgacaatatcgcaaaactggggcagatcatcagagaaggcccaattaaagggagtctcttgaaagtcgtgctggaggattacctacgcctcaagaaactcttcgcccaacgcatggtgcaaaaagcctcctcgtgtcacagctccatcagtgagttaatccagactgaactcgacgaagaacctggcgaccactctcctggtcagggcagcttacggtttaggcataagcccccggtcgagttgaaaggaccggatggcatccatgtggttcatgggagcactggtaccttgcttgccaccgacctgaattcgttgccagaggaagaccagaaaggcctcggccggagcctggagaccctcaccgccgctgaggctacagcatttgaaaggaacgcccgcaccgaatctgccaaatccaccccactccacaagctccgagacgtgatcatggaaacacctctcgagatcaccgagctatag

SEQ ID NO: 110288 - DNA, 1368 bp, Artificial Sequence
  Description of Artificial Sequence: Synthetic coding sequence
atgagggcttccctcggcgtgtgcggaaccgcttcatcaatggttattgtatatgttgaagacatcaacgatgaggcaccagtgtttacccaacagcaatactctcgcctgggactgcgggagaccgctggaatcggcacgagtgtgatcgttgtccaggccacagaccgcgactcaggagacggcggactggtaaattataggattttgagcggcgccgagggaaagtttgagattgacgagtctacagggctgatcattaccgtgaactacctggactatgaaacaaaaacctcttatatgatgaacgtgtctgcgaccgatcaggctccccccttcaatcaggggttttgctccgtatacatcactttattgaatgagttagatgaagcagtacagttcagtaacgcctcttacgaagccgcgatcctggagaacctcgccttaggaacggaaatagtgagagtccaagcttattcaatcgacaatctgaaccaaattacctaccggtttaatgcctatacctccactcaggcaaaagcactctttaagatcgacgccattaccggcgtcataacagtccaaggccttgtcgatagagaaaagggcgacttctacaccctcacggttgtcgctgacgacggaggaccaaaggttgatagcacggttgtttacattacagtcctggacgaaaacgacaattcacctcgcttcgattttacttctgactcagccgtgtctataccagaagattgtcccgtgggtcagcgggtcgccaccgtcaaagcatgggacccagacgctggctccaatggccaagtcgtgttttctctggctagcgggaacatagcaggcgccttcgaaatagtgactactaatgattctatcggggaggtgttcgtggcgcggcctctagatcgtgaagagcttgatcactatatactacaggttgttgcatctgatcgcggcacccccccaaggaagaaagaccacatattacaggtcactatcctagacatcaacgataaccctccagtaatagagagccccttcggttacaacgtgtccgtcaatgaaaatgtgggaggcggtactgccgtagttcaggtgagggcaacagaccgtgatattggcatcaactctgtgctttcatattacatcaccgagggcaacaaagatatggcctttcgcatggatcggatttcgggcgagatcgccacccggcctgctccaccagatagggagcgacagtctttctaccatttagtggctaccgtagaggatgagggaaccccgacactctccgtttccgatgggggtggccatcgcgaggagagagttggacaggggtcctccgcttctgaatag

SEQ ID NO: 110289 - DNA, 1593 bp, Artificial Sequence
  Description of Artificial Sequence: Synthetic coding sequence
atggggaggcatgtggcaacctcctgtcacgtggcctggctcctggttctgattagcggatgttggggacaggttaacaggctcccattctttacaaatcacttttttgacacatatctacttatctcggaagatactccagttgggagcagcgtgacacagctgttggctcaggacatggataacgaccccttagtctttggtgtctctggcgaagaagcaagcagattttttgccgtggagccagatacaggggtcgtttggcttagacagcctctggaccgagagactaagtccgaattcactgtggaatttagtgtcagtgatcaccagggcgtgatcacaagaaaggtgaacatccaggttggtgacgtaaatgataatgctcctacgtttcacaaccagccctactccgtccggattcccgagaacacacccgtgggaacacctatcttcatcgtaaacgccacagatcccgaccttggggcaggcggcagtgtgctctactcttttcagcctccgtctcaattcttcgcaattgacagtgccagaggcatcgtgacagtgatccgagaattagactatgagacgacacaagcctatcaattgactgtcaatgcgacagaccaggacaaaacacgacccttaagcaccctggctaatctggctataattattacagacgtgcaagacatggacccgattttcattaatctgccgtactcgacgaacatttatgagcacagccctcccggcacgactgtcaggattatcactgcaatagaccaggacaaaggacgaccccgaggtatcggctataccatagtcagcggcaatacgaacagcatcttcgccctggattatatttccggcgtcctgacccttaatggactactcgaccgggaaaatccactgtatagtcatggcttcatactcaccgtgaaagggactgagctgaatgatgacagaacgccatcagatgccacagtcacgactacatttaatattctcgtgattgatataaatgataacgccccagagtttaactcgtccgagtactccgtggccatcaccgaactcgcgcaagttggattcgctctgccattattcattcaggtggtagacaaggacgaaaacttaggcctcaactctatgtttgaggtttacctggtaggcaataactctcaccactttatcatttctcccacctccgtacaggggaaggcggacatccgcatccgagtggccatccctctagattacgaaaccgttgaccgatatgacttcgacctcttcgccaatgaatctgtgcccgaccatgtgggttatgccaaagttaaaataacgttgataaacgagaacgacaaccgcccgatttttagccagcccctgtataatatttctctttatgaaaacgttaccgtcggcacgtctgtactgacagtcctggtttcccctcgtttcaccgccggcccacttagctctcctgggcccacagtcgtacggcatccagagggcttttgccccagagatttatccaaccaaggaagacggcatccccaaataccagagctgtgtctgctcgtttactag

SEQ ID NO: 110290 - DNA, 3639 bp, Artificial Sequence
  Description of Artificial Sequence: Synthetic coding sequence
atgggacgacacgttgccacatcctgccacgtggcctggctccttgtactgatctccggctgctgggggcaggtgaaccgcctgccattcttcaccaatcacttcttcgatacctaccttttgatcagtgaggacacaccagtgggatccagcgttactcagctcctagctcaggacatggataatgatccactcgtttttggcgtctcgggcgaagaggccagcagattcttcgccgtagaaccggacacaggtgtggtatggctccgccagccactggaccgggaaactaagtcagagttcactgtggagtttagtgttagcgatcaccaaggcgtgatcaccagaaaagtgaatatccaggttggagacgtgaacgacaatgcccctaccttccataaccagccctattcagtgagaatccccgagaataccccagtgggcactccaattttcattgtgaacgccactgaccctgatctgggagccggcgggtcggttctgtactcctttcaaccgccttcccagttttttgctattgactctgcgcgcggaatcgtcaccgtgatccgtgagctggactacgagaccactcaggcttaccagctgactgtgaatgcaaccgaccaggacaaaacacggcctctcagcacactggccaatctggccatcataatcaccgacgtgcaggacatggacccaatattcattaatctcccctactctactaacatctacgagcacagtcccccaggcacaacggtcaggatcattacagccattgaccaggataagggccgaccacggggaattggctataccattgtctccggtaatacaaattcaattttcgccctggactacatctcaggcgttctgacgcttaacggactgctcgatagggagaaccctctatattcacacggatttatcttgacagtcaagggcactgaactgaatgacgatagaactccttctgacgcaaccgtgaccacaacttttaacatcctcgttattgacatcaacgacaatgcccctgagttcaacagctctgaatactcagtcgccataaccgaactggcacaagttggctttgcattacccctgttcatccaggttgttgacaaagacgagactcagggcctaaattccatgtttgaggtctacttggtcgggaacaattcgcaccacttcattatttcacccacctcagtccagggcaaagccgacatccgcataagagtcgcaatccctcttgactacgaaacggtggatcggtacgactttgacctgttcgctaacgaatctgtgcccgaccacgtcggctacgccaaagtgaaaatcacactgattaatgagaacgacaatcggccaatcttcagtcagcctctgtataacatctcactgtatgaaaacgtcacagttgggaccagcgtcctcacggtcctagccactgacaatgacgccgggacatttggagaggtttcatatttcttctccgatgacccggatcggtttagtctggacaaggataccgggctgataatgcttatcgccagattggattatgagttaattcaaagattcaccttaaccatcattgctcgggatggtggcggggaagagaccactggccgggtgagaatcaatgtgctggatgtgaatgacaatgttccaacttttcagaaagacgcttatgttggcgctctacgagaaaatgagccatctgttactcaactcgttagactgagggccactgatgaagactctccccctaacaatcaaatcacatattcaattgtttctgcatctgccttcggctcttactttgacattagcctgtacgagggctacggtgtgatctctgtctcacggcctctggattacgagcagatctctaacgggctgatctatcttaccgttatggctatggatgctggcaatccccccctcaattcgaccgtgccggtaaccatcgaagtgtttgatgagaacgacaaccctccaactttcagcaaacctgcctacttcgtgagcgtggtggagaatattatggctggagccactgtactgttcttgaatgctaccgatctcgatcgttccagggagtatgggcaagaatcaatcatatacagccttgagggcagcacccagttcagaattaacgcccgatccggagaaataactaccacaagtctgctggaccgggagactaaatcagagtatattttgatagtgcgcgcagttgatgggggggttggccacaaccagaagactggcatagccacggtcaacattacacttctggacattaatgataaccacccgacatggaaggatgctccatattacatcaatctggttgagatgactccacctgactccgacgtgacaaccgtagtagcggtggaccctgacctgggcgagaacgggacgctcgtctactctattcagcccccgaacaagttctattcgctgaatagcaccacgggcaaaattagaacaactcacgccatgctggacagggagaacccagaccctcacgaggccgagcttatgcggaagatcgttgtctcagtcaccgattgtggaaggccaccgctgaaggcgacgtcctccgccacggtattcgtgaatctattagatctaaacgataacgaccccacctttcagaacttgccatttgttgcagaggtactggaggggatccccgccggcgtttcaatatatcaagtggtcgcgatcgaccttgatgagggtctgaatggtctggtgagctatcgtatgcccgtcggaatgcctagaatggactttctgatcaattcaagctcgggggtggtagttaccacgaccgaactggatagagaaaggattgcagaataccagttgcgcgtggtggcttctgatgctggcacgccaacgaaatcctcgacatcaaccttaaccatccatgtcctggacgtgaacgatgagacacctactttctttcccgctgtgtataatgtttccgtgagtgaggatgtgccccgcgagtttagagttgtttggctaaattgcactgacaatgacgtgggtttaaacgctgagttgagttatttcatcaccggtggaaatgtcgatgggaagttctctgtgggttacagggatgccgtagtgcggacagtggtcggattggacagggagacaaccgctgcctatatgttgattctggaagctatcgataatggtcctgtaggcaaacgtcacaccgggaccgctacagtgttcgttacagtgctggacgtcaatgataaccgccccatcttcctgcagtcgtcctacgaggcgtctgtcccggaggacatcccggaagggcactctattcttcaagaagaagacctcgcctctccttgcatatcacccgcacccccgagaagagcatttcaatcctcaggggagaaagagaccagccagttccccggtaaagaactgaggagggaacctggccctagtaaggcacagaatcgcgcagcctttaccgagcctcttgccgaagcgccactgctcggcagtaagcaggcccaagaggaacgcgcccccctgcctagagagcaagctcagcagctgcagggttcagagggcgagaagggcggcccctag

SEQ ID NO: 110291 - DNA, 1593 bp, Artificial Sequence
  Description of Artificial Sequence: Synthetic coding sequence
atggggaggcatgtcgccactagttgccacgtggcgtggcttctggtcctgatatctggttgctggggccaggttaaccgcctgccattcttcacgaaccacttctttgatacatatctgctgatcagtgaagacacgcccgttggaagtagtgtcacccaactcctggctcaggatatggataatgaccctttagttttcggagtgagtggcgaggaggccagtaggttcttcgcggttgagcccgataccggcgtggtctggctccggcagccacttgacagggagactaaatccgagttcaccgtggaatttagcgtgtctgaccatcagggagtgatcactcggaaagtaaatattcaagtgggagatgtgaatgataacgctccaacttttcacaaccaaccttatagcgtgcggattcctgaaaacacccccgtcggcacgcccattttcatagtaaacgccaccgatcctgacctgggggccggtggaagcgtgctgtactcttttcagcccccttcccagttttttgcaatcgactccgcacgcggcatagtgaccgtgattcgggaacttgattacgagacaacccaagcttaccaactgaccgtaaacgcgacagatcaagataagactagacccttaagcaccttagccaatcttgctatcatcataacggacgtgcaggatatggaccccatttttatcaatttgccctacagtaccaacatttatgaacacagtccccctggcaccaccgttagaatcataacggctatcgaccaagataagggacgccccaggggcatcggatacaccatagtgagtgggaacacgaatagcatctttgcattggattatatttccggtgtgttgacgctcaacgggctgcttgacagggaaaatcctctctacagtcatgggtttatcctgacagtgaaaggaaccgagctgaacgacgacagaaccccttcagatgcgaccgtgaccaccacctttaacatcttggtaatcgacatcaacgataacgcccccgagttcaattcatctgagtatagcgtcgccataaccgagttagcacaagtagggttcgctcttcccctgttcatacaagtggtggacaaagatgagacttggggccttaacagcatgtttgaggtttatctagtcggaaataactcgcatcacttcataatcagcccgacttctgtgcagggaaaggctgatattagaatcagggtcgcgattcccctggactacgagaccgtggatagatatgatttcgacttatttgctaatgaatcagtccctgatcacgtgggctacgccaaagtgaaaattaccctcatcaacgagaatgataaccggcctatctttagtcaacccctctataatatttcgctgtatgagaatgtcactgtgggcacgtcggttctgaccgtgctggtttcaccaaggttcacagctgggcctctgagctcccctggcccgaccgtggtaaggcacccagagggattttgcccgcgggacctgtctaatcaaggtcgccggcacccccagattccagagctctgtctactggtctactag

SEQ ID NO: 110292 - DNA, 9960 bp, Artificial Sequence
  Description of Artificial Sequence: Synthetic coding sequence
atgggccgccatgtggccacaagttgccacgtggcctggctccttgtgttgataagcgggtgctggggacaagtcaacaggctgccctttttcactaaccactttttcgatacttatctgcttatcagtgaggatactccagtaggttcttctgtgacacagctcctcgcccaggacatggacaacgacccgctggtcttcggagtttcaggcgaggaagcatcaaggttctttgcggtcgaacccgacaccggcgtggtatggctccgccagcctctagatagagaaacaaagtccgagtttacagtggagttcagcgtcagcgatcaccagggggtgattactcggaaggtaaatattcaggttggtgacgtgaacgacaatgcacctacattccacaatcaaccttattctgtgagaatacccgagaatactccggtgggcactcccatttttatcgtcaacgccaccgacccagatcttggagccggaggatccgtgctctacagctttcagccccctagtcagtttttcgccatcgattccgctcgcggtatcgtgaccgtaattcgcgaactcgactacgaaaccacacaggcctatcagctcaccgtcaacgctaccgatcaggacaaaacccggccactgtctacgctggctaacctggcaatcatcattactgatgtgcaggatatggaccccattttcatcaaccttccgtattcgactaacatatacgagcacagcccacccggaactactgtgagaatcatcaccgcaatagaccaggacaagggcagaccccgtggcatcggttataccatagtgtccggtaatacgaattctatctttgcgctggactatatttcgggggtgctcacccttaacggcttgctggaccgtgagaatccactatatagccatggtttcattttaactgttaaggggaccgaacttaatgacgatagaactccctctgatgcaaccgtaaccaccaccttcaatattctagtcatcgacattaacgataatgctcccgaatttaacagttccgaatacagtgtggctattacagaactggcccaggttggattcgccctccccctattcatccaggtcgttgataaggatgagacacagggcctgaactctatgtttgaggtgtacctcgtcggcaataatagtcaccattttatcatttcaccgacctctgtccagggaaaggcagacatcagaataagggtggccattcccttagattacgagacagtggaccgatatgactttgatcttttcgcaaatgagagtgtcccagatcacgtcggttatgcgaaggtgaagataactctgattaacgagaacgataaccgccctattttctctcagcccttgtataacatatcgctgtacgagaatgtaaccgtgggcacctctgttttgaccgtccttgcaacagacaacgatgcgggaacgtttggagaggtctcatatttttttagcgatgatcctgaccgctttagcctcgataaggacacggggctcatcatgctgattgccagactggactacgagctaatccagcgattcactttaacgatcattgctagggatggggggggggaggagactactggacgtgtacggattaacgttctagatgtgaacgataatgtgccaaccttccagaaagacgcatatgtgggagccctacgcgaaaacgagccttcggttacacagctggtgcggctcagagccacagacgaggatagcccccccaacaaccagatcacctatagcattgtgagcgcgagtgcatttggttcttacttcgacatcagtctgtatgaaggctatggagtgattagtgtgagtagaccactcgattatgagcaaatctctaacgggctcatatacctgacagtgatggctatggacgccggcaacccgccgctcaacagcaccgttccggtaactattgaagtcttcgatgaaaacgacaaccccccaactttcagcaaaccagcgtactttgtatctgtggtcgaaaacattatggcaggagccaccgtactctttctcaatgccactgacctggacaggagtcgcgaatacggacaagagagtatcatctactccctggagggcagcacacagtttcgaatcaacgcccggagtggcgagatcacaacaacctcactgcttgatagggaaaccaagtcagagtatatcttaattgtccgtgccgtcgacggtggagtgggacacaatcagaagactggaatagcaaccgtcaacatcacgcttctagacataaacgataatcaccccacatggaaggacgctccctactacattaatctagtcgagatgactcccccagattccgatgtcacaacggtcgttgccgtagacccggacctgggggagaacgggactctggtttactctattcagccccctaacaaattctactcacttaatagtaccactggaaaaatccgaacgacccacgcaatgctggatcgagaaaacccagacccacatgaggcagaattgatgcgcaagatcgtggttagtgtgaccgattgtggcagaccacccttaaaagccaccagctctgctacagtttttgtgaacctgctggatctgaacgataacgatccgactttccagaatttgccattcgtggctgaagtccttgagggcattcccgcaggagtgtcgatataccaggtggtagccatagatctggacgagggactcaatggcctcgtatcttaccggatgcccgtggggatgccaagaatggacttcctcattaactcctcttccggagtggtcgtgaccaccaccgagttagatcgcgagagaattgcggaataccagctcagagttgtggcatccgatgccgggacaccaactaagtccagcactagcacactcactatacatgtgctggatgtgaatgatgaaactcccacattctttcccgccgtgtacaacgttagcgtgagcgaagacgttccgagagaatttcgtgtcgtatggttgaattgcactgacaacgacgtgggcctgaacgcagaattaagttattttatcaccggaggtaatgtggacggaaagttcagcgtgggataccgcgacgccgtggtgcggacagttgtgggactcgatagggagacaacagcagcctacatgctgatattggaggcgatagacaacggacccgtcggcaagaggcatacgggcaccgccactgtgtttgtgacagtgctcgatgtcaacgacaacaggcccatattcctccaatctagctatgaggcttctgtacccgaagatatccctgaggggcatagcatcctgcagctcaaggcaaccgacgccgatgaaggagaattcgggcgcgtttggtacaggattctgcatggcaatcacggcaacaatttccgcattcacgtttcaaacgggctgctaatgcgtggaccccgtcctctcgaccgcgagcgcaactcatctcatgttctcatagtggaagcatacaaccacgatctgggcccaatgcgctccagtgtccgggttattgtgtacgttgaagacatcaatgacgaagcccctgtgttcacacagcagcaatatagtaggttaggcttgcgggaaacagccggtattggcacatccgttattgtcgtgcaggcgacggatcgagattccggcgatgggggccttgtgaactaccgtattctgtccggcgcagaaggcaaattcgagattgacgagagtactgggctgattataactgtcaactacttagactacgagacaaaaacgagttatatgatgaatgtttctgccaccgaccaggccccccccttcaaccaaggtttctgttccgtctatattacacttctcaacgagctggacgaggccgtccaattcagtaatgccagctatgaagccgctatccttgagaacctagcattgggaacagagattgtgagagtgcaggcgtacagtatcgataacctgaatcagattacatatagattcaatgcctatacctccactcaagctaaggcccttttcaaaattgacgctattacaggcgtgatcacagtccagggcctcgtggaccgcgaaaaaggggacttttacacactgaccgtagtcgcggacgacggaggccccaaggtggactcaaccgtgcaggtgtacataactgttttggatgagaacgataacagtccacgctttgatttcacttccgacagtgctgtgagcatcccggaagattgtcccgtcggccagagggtggccactgttaaggcctgggatccggatgccggtagcaacgggcaggtggtcttcagcctggccagcggcaatatcgccggcgcatttgagatcgtcaccactaatgactctatcggagaggtatttgtggcccgccctttagacagagaagagctggaccactatatcctccaggtggtggcctccgaccggggtacaccaccaaggaaaaaagaccatattttgcaggtcactatcctggacatcaatgataatccacctgtaatcgagagcccattcggctataatgtcagcgttaatgaaaatgttgggggaggtacagcagttgtacaagtccgggcgaccgacagggacattggcataaactcagtcctctcctactacattacggaaggcaacaaggatatggcctttagaatggatagaatttctggcgagatagccactcggcctgcacccccggaccgtgagaggcaatcattttaccatctcgttgctacagtggaggatgagggtactcccaccctctccgccactactcacgtttacgtgacaatcgtcgatgaaaacgataacgcacccatgttccaacaacctcactatgaagtgctgctggacgagggtccggacacgctgaacacatccttgattactatacaagcgctggaccttgacgaaggtccgaacggaacagtcacttacgctattgtagccggtaacatcgtcaacacctttagaattgaccgtcatatgggtgtgattactgcggccaaagagctcgactacgagatcagtcacggtcgctatacactcatcgtgactgccaccgaccagtgcccaattctgtcacacagactaacttcaacaaccacggtcctggtcaatgtgaacgacataaacgacaatgtgccaacatttccacgggattatgaggggcccttcgaagttactgaaggccagcccgggccaagagtatggacattcctggcccacgatcgcgactcaggacctaacggccaagtggagtactcgatcatggatggcgaccctctcggcgagtttgttatcagccccgtcgagggggtgcttcgtgttcgcaaagatgtggaattggacagagagacgatcgctttttataacttgacgatctgcgccagagatcgaggtatgcccccgctgtcatcgacaatgttagtcggaatcagagtgcttgatatcaacgacaatgaccctgtgctcctgaacttacccatgaacatcacaattagcgagaattcaccagtgagcagcttcgtcgcgcacgtgttagcctctgatgctgatagtgggtgtaacgcacggctgacatttaacatcactgccgggaatagggaacgcgccttctttattaatgccacgacaggaattgtgactgtgaatcggccactggaccgagagagaattccagaatataagttgactatctccgtaaaagacaatcctgagaatccaagaatagctcggagagactacgatttgttactcattttcttgagtgacgagaacgataaccatcctttgttcaccaaatctacatatcaggctgaggtgatggaaaacagtcccgccggtaccccgctgaccgtcttgaatgggccaatactggccctggacgccgaccaggacatttatgccgtggtcacgtaccagctgctgggtgcacagtctggtctcttcgacataaatagctctacgggtgtggtcaccgtacgaagcggagtgataatcgacagagaggcctttagcccccccattctggagctgcttctgttggcagaagatatcggactgctcaactcaactgcccatctgttaattaccatcttagacgacaacgacaataggcccaccttctctccagcaacgctcactgtgcaccttctggaaaactgtccacctgggtttagcgtgcttcaagtgaccgccacggatgaagacagcggcctgaacggtgagttggtatatcggatagaggccggagcccaggacaggtttctcatacatctggttacgggcgttattcgggtcggcaatgcgactatcgatcgggaggagcaggagtcttatagactcactgttgtcgcaacagataggggaacagtaccgctatcaggcactgccatcgtgaccattcttatcgacgatattaacgactccaggccagagttcttaaacccaatacaaacagtgagcgttctcgagtccgccgaacctggcaccgtcattgctaacatcactgcaattgatcatgacctcaatcctaaacttgagtaccatatcgtaggcatcgttgcgaaggacgacactgacagattggtaccaaaccaagaggatgcattcgctgtgaacatcaacactggatctgtaatggttaagtcacctatgaaccgtgagttggttgcgacctatgaagtgacactttcagttatcgacaacgccagcgacctgcctgaaagatccgtttctgtcccaaatgctaagcttaccgtgaacgtcctagacgttaacgataataccccccaattcaagccttttggaataacatactacatggagcgtatcctggagggagccacgccgggaaccactctcattgccgtcgcagcagtcgacccagacaagggacttaatggactagttacctacacactattggacctagttccgccgggctatgtgcagttggaggactcttccgccggcaaagtgatcgctaaccggacagtcgactacgaggaagtgcactggttaaacttcacggttcgcgcttcagataatgggagcccccctcgggcggccgagatcccagtctaccttgagatcgtggatatcaatgacaacaaccctatcttcgaccagccatcataccaggaggcagtctttgaagacgtccccgtgggcacaatcatactgactgtgaccgcaacagatgcagattcaggcaacttcgcactgattgagtattcacttggggacggcgagagcaaattcgcaataaatcccacaaccggcgacatctacgtgctcagctctctagaccgcgagaagaaggatcactacattctcacagcgttagcgaaggacaacccgggtgatgtcgcaagtaataggcgagaaaactccgtccaggttgtgatacaggtgcttgacgtgaatgactgccggcctcagttttctaagcctcaattcagtacgagcgtatatgagaatgagccagcaggaacatctgtcattacaatgatggccactgatcaggatgaggggcccaatggtgaactgacatactcgctggagggcccaggcgttgaggctttccatgtcgacatggacagcggtcttgttaccacgcagcgcccattacagagctatgaaaaattcagtttgactgtggtcgcaaccgacgggggagaaccacctctgtgggggaccacgatgctgctagtggaagtcattgacgttaacgacaatcggcctgtattcgtcagacctccgaatggaaccatccttcacatcagggaagagattccactgagatctaatgtgtatgaggtgtacgcgacagacaaggacgagggtttaaacggggctgtaaggtactcattcctgaagacggctggcaatagggactgggaattctttatcattgaccccatcagcggcctcatccagacagcccagagattggaccgtgaatcccaagcagtgtattctcttattcttgtggcctcagacctggggcagccagtaccttacgagaccatgcagcctctccaggtcgccctggaagacatcgacgataatgagcctctcttcgtccgcccgcccaaaggatcaccgcagtaccagctccttaccgtgcctgagcactccccacgcggcacgctggtggggaatgtcaccggggctgtggatgctgatgaaggtccaaacgcaattgtgtactattttattgcggcaggaaacgaggagaagaactttcacctccagcccgatggatgtcttctggttctgagggacctggaccgagagcgggaggcaatattcagttttatcgtgaaggcttcaagtaacaggagttggacaccacctagaggtcctagccccacccttgacctcgttgccgatctaacactgcaagaagtcagggtggtgcttgaagacattaacgatcagccccccaggttcacaaaggccgaatacacggccggcgtggcaaccgatgctaaagtcggatctgaactgatacaagtgctcgcgctggacgccgatattgggaacaacagcctggtcttctattcgatcctggccatacactacttcagagccctggcaaatgacagcgaggacgtcggacaggttttcactatgggctctatggatggtattctgagaacattcgacctgttcatggcttactcaccggggtacttcgtcgtggatatagtggctcgggacttagccggacataatgatactgcaattatcggtatttacatcctgagggatgatcagcgggtgaagatcgttatcaatgaaatccctgacagagttcgaggattcgaggaagaatttatccatttacttagtaatataacaggggccattgtgaacaccgacaatgtgcagtttcacgttgacaaaaaggggcgcgtcaattttgcccagacggagctgctaatccacgttgtgaatcgcgatacgaacaggattttggatgtggaccgagttatccagatgatcgatgaaaataaggagcagctccggaatctgttcagaaattataacgtgctggacgtccagcctgccattagtgttcgcttgccagacgacatgagtgccttacagatggccatcattgtgcttgccatactgttatttcttgccgccatgctctttgtcctgatgaattggtactaccgcacagttcacaagcgtaagctgaaagccatcgtagctggcagcgccgggaatcgaggcttcatcgacatcatggatatgccaaacaccaataagtattcatttgacggagccaaccccgtgtggctcgatcccttttgcaggaacctggagctggccgctcaggccgaacacgaagacgatctgcctgaaaatctgagcgaaatcgccgatttatggaattcgccgacccgaactcatgggacgtttggcagagagcctgctgccgtgaaacccgacgacgataggtacctgagagcagccattcaggagtacgataacatcgccaaattaggtcagattatccgggaaggtccaatcaaacttatacagacagaactagacgaggaaccaggcgaccattctcctggtcagggttcactcagattccggcacaaacccccggtggagctgaaaggccctgacgggattcatgtcgtccatggctcaactgggactctgctcgcaacggatcttaacagcctacccgaagaggatcaaaagggccttgggcgctcattagaaacactgaccgctgctgaagctactgctttcgagagaaacgccaggacggagtcagcgaagagcacaccccttcataagctccgggacgtgattatggaaaccccactcgagattactgagctttag

SEQ ID NO: 110293 - DNA, 10080 bp, Artificial Sequence
  Description of Artificial Sequence: Synthetic coding sequence
atggggcgccacgtggcaacctcttgccacgtcgcatggctcctggtgctgatttctgggtgctggggccaggtgaatcgacttccttttttcactaaccatttctttgacacatacttactcattagtgaggacactcccgtgggttcctctgtgactcaactgttggcacaggatatggataacgatccattggtgttcggggtaagcggcgaggaagcctctcgcttcttcgcagtcgaacctgatactggcgtagtgtggttacgccagccactggaccgggagacaaaaagcgagttcaccgttgagttctctgtatctgaccatcaaggcgtcatcactagaaaggtcaatattcaagtgggggacgtgaacgataacgccccaaccttccacaatcaaccatactccgtgcgcatacccgaagtaggtgcaacagggaataccccggtgggcacaccaatctttatcgttaacgcaaccgatcccgacctaggagctggtggaagtgtgctgtatagtttccagccccctagccaattttttgcgattgattcagcccggggtatcgtaacggtgatcagggaactggattacgaaacaacccaggcttatcagctgaccgtcaatgcaaccgaccaggataaaactcgaccactgagcactttggctaatcttgccatcattattaccgatgtgcaggacatggacccaatatttattaacctcccatattctactaatatctacgagcattctccaccaggcactacggtgcgtatcatcactgccatcgaccaggacaagggacgtcccagaggcataggttacactatagtgtcagtcgctggcaataccaacagtatctttgcactggattatatctccggcgtcctgacattgaacggacttctggatcgagaaaatcccctttattctcacgggtttatcctcaccgtcaagggcaccgaactcaacgatgatagaaccccatctgacgccacagtcacaaccacctttaacatcctggttattgatattaatgacaatgccccagaatttaattcctccgaatattctgtggctataaccgaactggctcaagtcggattcgcattgccccttttcatacaggtcgtcgacaaagatgaaggactgaactctatgtttgaagtgtacctggtcggcaacaacagccaccacttcatcattagccccacctccgtgcaagggaaagccgatattcgtattagggtggcaattcccctggactacgagacagttgataggtacgacttcgatcttttcgctaatgagtcagtacccgatcacgtgggctacgccaaagtaaagatcacgctcattaatgaaaacgacaataggcccatattcagccagcctctgtataacatctccctgtacgagaacgtgactgtaggaacttcagtcctgaccgtcctggctaccgacaacgatgcggggacctttggcgaagtgagctacttcttctcagacgatcccgacagatttagcctcgacaaagacactggcttaataatgctgatcgcccgtctggactatgaattgatccagcggttcacacttactatcatcgcccgcgacggggggggcgaagagactaccggccgggtgcgaatcaacgtgctggacgtgaacgacaacgtacctacattccaaaaagatgcctacgttggagcacttcgggaaaatgagccaagcgtgacccaattggttaggctgcgagccaccgacgaagactcaccgcctaacaatcagatcacttactctattgtgtctgccagcgcctttggatcatactttgacatctctctatatgagggttacggtgtaatttcagtgtcacgaccactggattacgagcagatcagcaatggattgatctaccttaccgtgatggctatggacgcaggcaacccacccctgaatagcacagttcctgttacaatagaagtatttgatgaaaatgacaacccccctacatttagcaaaccagcgtattttgttagcgtggtggagaatattatggcaggagccactgtgctgtttctgaacgctactgatctggaccggtctcgggagtacggacaggaaagcataatttatagtctggagggtagtacgcagtttcgaattaatgcacgtagtggggaaattaccaccaccagtctgctcgatcgcgagactaaaagtgaatacatactcattgtgagagctgtcgacgggggagtgggccataaccagaaaactggaatcgctactgtgaacattacactcctggatattaacgataatcatccgacttggaaggatgctccttattatattaacctggtggagatgacgccacccgactctgacgtcaccacagtggtggcggttgatcctgacctgggggagaatggaacgctggtgtacagtatccagccccctaacaaattttatagtctgaactctacaaccggcaaaattcgcacaacacatgctatgcttgatcgggaaaatccggacccacacgaagcagaattaatgcgcaagatcgtggtttccgtgaccgattgcggccggccacccctgaaagccaccagttccgccaccgtattcgtcaatcttttggatctaaatgacaatgatcccacattccaaaatctgccttttgttgccgaggtattagaaggcattccagccggggttagcatctaccaggtcgtagcaatcgacctcgacgaaggcctcaatggtctggtgagttaccgcatgccagtgggcatgccccgaatggacttcctcattaacagttcctctggcgttgtcgtgaccacaacagaattggatagggagcggatagctgagtatcaacttagagttgtcgctagcgatgcggggacacccacgaaaagcagtacttccaccttgactattcacgtgctcgacgtcaatgatgagactcccactttctttccggctgtctacaacgtatcagttagcgaagacgtgcctagagagttcagggtcgtgtggctcaactgcaccgacaatgacgtcggtctgaatgcagaactgtcttattttataactggaggtaacgtggacggcaaattttctgttggctatagggatgccgtggtcaggacagtcgtgggtctcgaccgcgagacaaccgccgcctatatgctgatcctggaggccatcgacaatgggccagtcggaaagagacacaccggaaccgcgacggtctttgtgaccgtcctggatgtgaatgacaatcgccccattttcctgcagtcatcctatgaagctagtgtgccggaggacatccccgaaggacatagtatacttcaactcaaggccacggacgccgatgaaggcgaattcggacgagtgtggtacaggatcctgcatggtaaccatggtaacaattttcgaattcacgttagtaacgggttgctgatgcgaggcccacgcccactcgaccgtgagcggaattcctctcacgttctgatcgtggaagcctacaatcatgatctcgggcccatgagaagcagtgttcgcgtcattgtgtatgttgaagacatcaacgatgaagcgcctgtgttcacccagcagcaatactctagactgggactccgggagacggctgggattggaacaagtgtgattgtcgtgcaggccaccgatcgcgacagtggcgacggaggattggtcaactaccgcatattgtccggagctgaggggaagttcgagattgacgagtctaccggtctgattattacggtgaattatctcgactacgagacgaagaccagttatatgatgaacgtgagcgcaaccgaccaggccccacctttcaatcaggggttttgttccgtatatatcactttgctcaacgaattggatgaggccgtgcagttcagtaatgcctcctatgaggcagcaatcctggaaaacttggctctagggaccgagatagtaagggtgcaggcttactccatcgataatctgaatcagattacttatcggttcaatgcatacacctcaactcaggctaaggctctgttcaagattgatgctatcacaggcgtaatcacggtacagggacttgtggatagggagaagggtgatttttacaccctgaccgtcgtagcagacgatggcgggcctaaagtggattccaccgtgcaggtgtatatcacagtattggacgagaacgacaactctccacgattcgactttacaagcgattccgcagtgtctatacctgaagattgtcctgtcggtcagcgggtcgccaccgtgaaggcctgggatcccgacgccggctcaaatgggcaggtagttttttcgctggcatcaggcaatatagccggtgcctttgagatcgtcacaactaacgacagtattggagaggtgttcgtcgcccgccctctggatagggaggaattagaccattacatacttcaggtcgttgcctccgacagaggcactcctccccgcaagaaagatcacatattgcaggtaaccatccttgacataaacgataacccgccagttatcgaatctcctttcggctacaatgtgagtgtgaacgaaaatgtgggagggggaaccgcagtggtgcaagttcgcgcgaccgaccgcgatattggcattaactcagtgcttagctactatatcacagaaggaaataaagacatggccttccgaatggacagaatctccggcgaaatcgctactaggcccgctcccccggatcgagaaaggcagagtttctatcacctagtggccacagtggaggacgaaggcacaccaactttgtcagccactacccacgtatacgtgaccattgtggatgaaaatgataatgcccccatgtttcagcaacctcactatgaagtgctactggacgaaggacccgatactttgaacacctcactgattactattcaagccttggatctggacgaggggcccaacgggaccgtgacctacgctatcgtggcagggaacatcgtgaacacatttcggatcgacaggcacatgggcgtcataaccgccgcgaaagagctagactatgagatatctcacggaaggtacaccctgatagttacagcaactgatcagtgtcctatcctgagccaccggctgacctcaactaccacagtcctagtgaacgtcaatgacattaatgacaatgtaccgacgtttcccagggattatgagggaccattcgaggtgaccgaggggcaacccggaccccgagtgtggacttttctagcgcatgatagggacagtggtccgaacggacaggtggagtactccatcatggacggcgaccccctcggagaatttgtcatttctcccgtggaaggagttttgcgggtcaggaaggatgtcgaattagacagagagaccatcgcattctataatcttacgatatgcgcaagggatagaggcatgccaccattaagtagcacgatgttggttggcatcagagtgctggatataaacgacaatgacccagtcctgctgaatctcccaatgaacattactattagcgagaactctcccgtgagcagctttgttgcacacgtcttagcaagcgacgccgactctggatgtaacgccaggctgacatttaacataaccgcaggtaatcgcgagagagcgttctttatcaatgcaaccactggtatcgtgaccgtcaatagacctctggacagggaaaggatccctgagtataaactgacgatatctgtgaaggataatcccgaaaatccaaggatagccaggagggactatgacctgttgttgatttttctgtccgacgagaatgacaatcatcccctgttcactaagtctacctaccaggccgaggtcatggagaatagccccgcaggaactcctctaaccgtgctgaatggacctatcctggctcttgatgccgatcaagatatatacgcggttgtgacatatcaactccttggtgctcaaagcggcttatttgacatcaactcttctactggggtcgttactgtgcggagcggtgtgatcattgaccgcgaggcatttagcccaccaatcttggaactcctgctgctggccgaagatatcggtttgctgaactcaaccgcccacctactcataactattcttgacgacaacgacaatcggcctacttttagtcccgcgactcttactgtgcacctcttagaaaattgtcctccaggtttttcagtgctgcaggtaacggcaaccgatgaggatagtggccttaatggcgagcttgtttaccgcatcgaggcgggcgcccaggacaggttcctgattcacctcgtgaccggggtgatccgggtggggaacgcaacaatcgaccgagaggagcaggaaagttatagactgacggttgttgccactgatagaggcaccgtgccactaagtggcaccgctatcgtgacaatcctgatcgatgacatcaacgatagcaggcccgaatttctgaatcctatccaaaccgtgagtgttttggagagtgccgaacctgggaccgtgatcgcgaatattactgccatagatcatgatttgaacccaaaactggaatatcacatcgtcggcatcgtagcaaaggatgatacagataggctggttcctaatcaggaggatgcttttgcagttaatattaacaccggatccgtaatggttaaaagccctatgaatagagagcttgttgcaacttacgaggtgaccttgtccgtgatagacaacgcttccgacctgcccgagcgatctgtgtccgtcccaaatgcaaagcttaccgtgaatgtgctggatgtaaatgacaacacgcctcagttcaagcctttcggaatcacttactatatggagcgtatcttagagggcgcaaccccgggtactacactcatcgccgttgctgccgtcgaccctgataagggtctcaacgggttagtgacctatacactgttagacttagtcccacctgggtacgtgcagctagaggattcaagcgccggaaaagttattgctaaccgcactgttgactacgaggaagtgcactggttaaacttcaccgtgagggcttcggataacggatcacctcctagggccgccgaaattcctgtctatctggaaattgtggatattaacgataataacccaatttttgaccagcccagctatcaggaggcagtctttgaagatgtcccagtgggcacgattattttgacagtgaccgctacggatgctgactctgggaactttgcactgatcgaatattccctcggagatggggagagcaaatttgccataaatcccacaactggggacatctatgtgttgtcctcccttgacagggagaaaaaggatcactacattctgaccgcactagctaaggataaccccggcgacgttgcttctaaccggagggaaaactctgtgcaggttgttatccaggtgttggacgtgaacgactgtcgcccccaattctctaaacctcaattctcgacatctgtgtatgagaacgagccggccggcacctcagtgatcactatgatggcaacagatcaggacgaaggacccaatggcgaactgacatatagcctcgaagggccaggtgtcgaggcattccacgtggacatggactccggacttgtgaccacgcagcgccccttacagtcgtatgagaaattttctctgactgtggttgcaaccgacggaggagaaccaccactgtgggggacgactatgctgctggtcgaagtaatcgatgtgaacgacaaccgccctgtctttgttcgcccgcctaatggtactattctgcacattcgcgaggagatccccctgcgctcaaacgtgtacgaggtgtacgctaccgacaaggacgaaggccttaatggggccgtccgttattcttttctaaagaccgctggcaatcgggattgggagttttttatcatcgaccccatctctggtttgatccaaactgcccagagattagacagggagtcccaggctgtctacagcctgatcttggtcgccagcgatctggggcagcctgtcccatacgagacaatgcagccactccaggtcgcattggaagatattgatgacaacgaacctttgttcgtcaggcctcccaaaggcagtccgcagtaccagctcctcactgtgccagagcatagccctcgcggcactctcgttgggaacgtcaccggggcagtggacgccgatgaggggcctaacgctatcgtctattactttatcgccgcggggaacgaagaaaagaatttccacctgcagcctgatgggtgcctgctagtgttgcgggatttggaccgggagcgggaagccatcttctccttcatcgtgaaagcctcatcaaaccggagctggacccctccccgtggcccatcacctactctggacctcgtggctgacctgactctgcaagaggtgcgcgttgtgctggaggacataaatgaccaaccccctaggttcactaaagccgagtacacagccggggttgcgactgacgctaaagttggctccgaactaatccaggtgcttgctctggacgctgatattgggaataatagccttgtgttttattccattctcgccattcactattttagagcactagccaacgatagcgaagacgttggacaggtctttactatgggttcaatggacggcattcttcggactttcgatctgtttatggcttacagtccgggctactttgttgtggacatcgtggctagggacctcgctgggcacaacgacaccgccattattgggatttacatcctgagagacgaccagagagttaagatagtcatcaacgaaattccagatagggtccgtggttttgaggaggagttcattcacctgctctctaacattacaggagcgatagttaatacggacaacgtccagtttcatgtggataaaaaggggcgcgttaacttcgctcagacggagttattaatccacgtggtgaatagagatacaaacagaatcttggacgtggacagagtgatccaaatgatagatgaaaacaaggagcagctaagaaatctgttccggaattataatgtgctggacgtgcaaccagccatatccgtccgcctgcctgacgacatgtccgctttgcagatggctatcattgtgctcgcaatcttactctttctggccgccatgctgttcgtgctgatgaactggtactatcggaccgtgcataaacggaaactaaaggccattgtggctggcagtgctggaaatcgggggttcatagacatcatggatatgcccaacactaacaagtattctttcgatggggctaatcccgtgtggcttgaccccttctgtagaaaccttgaacttgccgctcaagcagagcatgaggacgacttgcccgaaaacctatcagaaattgccgatctctggaacagtcctacccggacccacgggacattcggtagagagccagccgccgtcaaacccgacgatgaccggtatttgagggcagccatccaagagtatgataacatcgccaagctcggacagattatccgtgaaggccctattaaaggttcactcctcaaagttgttctggaagactatttgaggttgaaaaaactcttcgcccaacgtatggtccaaaaagcttcctcttgtcactcaagtatatctgagctgatacaaaccgagcttgatgaagaacccggtgaccatagtccagggcaggggtctctgcgctttaggcataaacccccggtcgagctaaaagggcccgacgggattcacgtggtgcatggtagtacaggtacacttctggccaccgacctgaattcgcttcctgaggaggatcagaagggcctggggcgctccctggagaccttgaccgccgcggaggctaccgcctttgagaggaatgcgcgaacagagagtgcaaagtccacacctcttcacaagctgagagatgtcattatggagacacctctcgagatcacagaattgtag

SEQ ID NO: 110294 - DNA, 1338 bp, Artificial Sequence
  Description of Artificial Sequence: Synthetic coding sequence
atggacaacgatccattggtctttggagtctccggcgaagaggcaagcagattcttcgctgtcgaacctgatactggagtggtctggctgcgacagccgctcgaccgtgagaccaagagcgagttcacggtggagttctctgtatcagaccaccagggcgtgatcactagaaaagtcaacattcaggtgggagacgtgaatgacaatgctcctacgtttcataatcagccttattctgtaagaattcctgaaaacacacctgttggtacccctattttcatcgtaaatgcgacagaccctgatctgggagcaggcggctccgtgctgtacagcttccagcccccgtcacagttctttgccattgacagcgcaaggggcatcgtgactgtcatcagagaacttgactacgaaactacgcaagcctaccagctcactgtcaacgctctcgctattatcataactaacctcccatacagtactaatatttatgagcattctccgcccggtaccactgtgaggattatcaccgccattgaccaggacaaggggcgtccgcggggaatcgggtacaccattgtttcagggaatactaactctattttcgcgttggactacatctccggagttctgacactgaacgggttgttggatagggagaatcccctgtacagccacggattcattctgactgtcaaggggactgaactgaacgatgatcgcaccccttctgatgccactgtcacaactactttcaacatcctggtgattgatatcaacgacaatgcgcccgagtttaattccagtgaatatagtgttgctatcaccgagctggcccaggtcggcttcgccctacctctgttcatccaggtggtggataaggacgaggggctgaactccatgtttgaagtgtatttggtaggtaataacagccatcattttatcatatctcccacaagtgtccagggcaaagcggacatacggataagagtagctatcccccttgattatgagaccgtagaccggtatgactttgacttatttgccaacgagtcggttccagaccacgtgggatatgccaaggtgaaaatcaccctcataaacgagaatgacaatcgacctattttctcacagcccttatacaacatctctctgtacgaaaatgtgactgtcgggaccagtgtcttgacggtcttggtgtccccaaggttcactgccggtccactgagctcccctggacctactgtagtacggcacccggagggattttgcccccgggatctgtctaatcaagggcgccggcaccctcagatccctgagctctgcctgttggtctactag

SEQ ID NO: 110295 - DNA, 2187 bp, Artificial Sequence
  Description of Artificial Sequence: Synthetic coding sequence
gctactgacaacgacgccggcacattcggcgaggtgtcctatttcttcagcgatgaccctgaccggttttctctcgataaggacaccggtctgataatgctgattgctagactggactatgagttgattcagagattcacactgaccattatagctagggacggaggaggcgaggaaactacagggcgcgtgcggattaacgttcttgacgttaacgacaatgtacccacttttcagaaagacgcttacgtcggggctctgagagagaacgagccatccgttactcaactggtgaggttacgagcaacagatgaggattctccgcctaataaccagattacatactccatcgtcagcgcgtctgcattcggctcatacttcgacatcagcctgtacgaaggatatggcgtgatttccgttagccgtcctctcgattacgaacagatctctaatggtttaatctacttgacagtgatggccatggacgccggaaatcctcccctaaactccactgtcccagtgaccatcgaagtatttgacgaaaatgataaccctccaacattcagtaaacccgcgtacttcgtcagcgtggtagagaacataatggctggggcaactgtgctgttcctcaatgccacagatcttgatagaagccgagagtatggacaggagtcaataatttactctctggagggatccacacagttccgcattaatgccagaagcggagagatcactactacgtcactgttagatcgtgagaccaagtccgagtatatcctcattgtgcgcgctgtcgatggcggagtgggacacaaccagaagaccggaatcgccactgtaaacatcacgctcctggacatcaatgacaatcatccaacttggaaggatgccccatactacataaatttggtcgagatgactccccccgactccgatgttacaaccgtggtcgctgttgaccccgacctcggggagaatgggactctcgtctacagcatccagccccctaataagttctactctcttaactcaaccaccggcaagatcagaactacgcacgccatgttagatagggagaatcccgatccccacgaggccgagcttatgcgcaaaattgttgtgagtgtgactgactgtggaaggccaccgctgaaagctacatctagcgcgacggtgtttgtgaacctccttgatttgaacgataacgaccccaccttccagaacctgccattcgtcgctgaggttctggagggcatcccggccggggtttctatatatcaggtggtggcaattgatttggatgaaggcctgaatgggttggtttcgtatcgcatgcccgtaggcatgcctcgtatggacttcctaattaactccagcagtggagtcgttgtaactacaactgagctggatcgcgaacgaattgcagaataccagctacgtgttgtggcctccgacgctgggacgcccaccaagagctccacttcaacccttacaattcatgtgcttgacgtcaacgacgagactccgaccttcttcccggccgtgtacaatgtcagcgtcagcgaagacgtgcctcgagagtttcgggttgtgtggttaaactgtacagacaacgatgtgggtttgaacgccgaactgtcctattttattaccggcggaaatgtggatggtaaattttcagtgggctatcgagatgccgtggtgagaaccgtggttgggctagatcgtgagactaccgcggcttacatgctaattctagaggcaattgacaatggcccagtggggaagcgacacacgggtactgccaccgtatttgtcaccgtcttggacgtaaatgacaatcgcccaatctttctacagagctcgtacgaggcttccgtgcctgaggatatccctgagggccatagcatccttcaagaagatttggccagtccttgtatcagccccgcgccgccgaggcgggcattccagtcaagcggagagaaagagacaagtcagtttcctggcaaggagctgcggagagagcccggcccaagcaaagcgcagaacagagcagcgttcactgagccccttgccgaggcgcctctgttgggctctaagcaggcacaagaagagcgcgctcccctcccccgtgagcaggcacagcagctgcagggctccgagggagaaaagggtggtccatag

SEQ ID NO: 110296 - DNA, 2238 bp, Artificial Sequence
  Description of Artificial Sequence: Synthetic coding sequence
atgagacgctgtcggtgggccgcgcttgccctgggtttactgcgcttatgcctcgctcaggcaaactttgctccacactttttcgataatggggtgggatccacaaatggcaacatggcgttgttctccctccctgaagatacccctgtgggttcacacgtgtacaccctcaatgggaccgatccggagggcgaccccattagttatcatattagctttgacccttccacacgttctgttttcagcgtggaccccaccttcggcaacattaccctggttgaggagttagaccgtgaacgggaggacgaaatcgaagccatcatctccatctcagacggactcaacctagtggccgaaaaggtggttattctcgtgacagacgccaatgatgaggccccacgctttattcaggagccgtatgttgctttggtcccggaggacatcccagcaggttctatcatcttcaaagtgcatgctgtcgaccgagatacaggctcggggggttctgtgacctactttttgcagaacctgcacagcccattcgccgtcgaccgacactctggggtcctgagactccaggctggggcaaccctggattacgagcggagccgcacccattatatcacagttgtggcaaaagacggggggggccgccttcacggagccgatgtagttttttcagctaccacaaccgtgactgtgaatgtagaggatgtgcaggacatggctcccgtgttcgtcggcaccccctactatgggtacgtgtacgaggacaccctgcccgggagcgaggttctgaaggttgtcgctatggatggtgatcgcggcaagcctaatagaattctctactctctggtgaatggaaacgacggggcctttgagatcaacgagaccagcggcgcaattagcatcacacagagccctgcgcagcttcaacgcgaggtgtacgagctccacgtacaggtgactgaaatgagccccgcaggttctccggccgcacaggcaactgtacctgtgaccatccggatcgtggacctgaacaatcaccccccaacattctacggagagtctggacctcagaataggttcgaactttcaatgaacgaacaccctccccagggcgaaatccttcgagggctgaagatcacagttaatgactcagatcagggtgcgaatgctaagttcaacctccagcttgtggggcccagaggtattttcagagtggtccctcagacggttctgaacgaggcacaggtgacaatcatcgttgaaaacagtgcggctatcgacttcgaaaaaagcaaggtcctgacttttaagctgcttgctgtggaagtcaatacccctgaaaaattctccagtaccgccgacgtcgtgattcaattgctggacaccaatgacaacgtccctaagtttgactctctttattacgtagcccggatacccgagaatgctccagggggtagttcagtcgtggccgtaacagctgtcgatccggataccggcccttggggggaggtaaagtactcgacttatggcactggcgccgacctgttcctcatacaccccagcacaggattgatctacacgcagccctgggcctctttagatgccgaagccactgcaagatacaacttctacgtaaaggccgaagacatggaaggaaaatattccgtagctgaagtattcattactctcctggacgtgaacgaccatcctccacagttcggcaagtctgttcagaagaaaaccatggtcctgggcacccccgttaagatcgaagccatcgacgaggatgcagaggagcccaacaacctcgtcgactattctataacccacgcagaacctgcaaacgtgtttgacatcaacagtcacactggcgaaatatggctgaaaaactcaatccgttccctggatgccctccacaatattacaccggggcgagactgcctgtggagtctggaggttcaggctaaggaccgtggcagcccgtcgttttccaccaccgcactgctaaaaattgatattaccgatgccgaggttcggaggttgcgatacatgaagaactccaacttcccgggcaccacaaagtccgtgcgtaagccaaagtttaagcccaagaagccacattcaagccaaggcttgtttctccatccccattgtgagatcgcattgtttaaccttagcaacgtgaacctctatagtagggtcttccaaggagccgcccaggcctcctag

SEQ ID NO: 110297 - DNA, 2580 bp, Artificial Sequence
  Description of Artificial Sequence: Synthetic coding sequence
atgaggcgctgccgctgggctgccctggctttagggctgctgaggctctgcctcgcccaggctaacttcgcccctcacttctttgacaacggggttggatctaccaacggtaacatggctctcttttcactccccgaggatacccccgtaggatcacacgtctacaccctgaatggcaccgatcctgaaggtgatcctatttcctaccatattagcttcgatccctccaccagatctgtgtttagtgttgatccaactttcgggaatataacattggtggaagagctggatcgagagcgcgaggatgaaattgaggctataataagcatatcagacgggctcaaccttgtggctgagaaggtcgtcatactggtgacagacgcgaacgacgaggccccccgctttatccaggagccatacgttgccctagtgcccgaagacatccccgccggatcaatcattttcaaagtgcacgccgttgatcgagataccggatctggggggtccgtgacctattttttgcagaaccttcacagcccgtttgctgttgaccgtcatagtggagttctacggctgcaggccggcgccaccttggactacgaaaggtcaaggacacattatataacagtagttgccaaagatggtgggggccggctccatggagcagacgtcgtgtttagtgccacaactaccgtcactgtgaacgtcgaggacgtccaggatatggccccggtttttgtcggcactccctactatggatacgtctatgaggacaccctaccaggatctgaggttcttaaagttgtggccatggatggagaccgtggtaagcccaacagaatcctgtacagtcttgttaatggaaacgatggagcctttgagattaacgagacaagcggggcgatcagcattactcaatctccggctcagctgcagcgggaggtttatgagctccacgtgcaggtgacagaaatgtctccagcaggttcccctgccgctcaagctacagtaccagtgactatacgtattgtcgatctgaacaaccatcctccaaccttttacggggaatctgggccacagaatcggttcgagctcagcatgaatgagcatccgccccaaggcgagattctacgcggcctgaagattaccgtcaacgattctgaccagggcgccaatgcgaagttcaacctgcaactcgtgggacccagagggatcttcagagtcgtgcctcagactgtgctgaacgaagcacaggttaccattattgttgagaattcagcagctattgacttcgagaaatccaaggtcctgacttttaagctcctcgcagtggaagtcaacactcccgaaaaattctccagtaccgcagacgtggtgattcagctgctggacaccaacgataatgtgcccaagttcgacagtctgtattacgtggccaggattccggagaacgccccaggaggttcctctgtggttgccgtgacggcagtcgaccccgatacagggccctggggggaagtgaagtacagcacctatggaactggcgccgatctgttcttgatccatccatccacgggattgatttacacacagccatgggcctctttggatgctgaagcaaccgcccgttacaatttctatgtcaaagccgaagacatggaagggaaatacagcgtcgccgaggttttcatcactctcctagatgtgaacgatcaccctcctcaatttggaaaatctgtacagaaaaagacgatggtgttgggcacgcctgttaagatagaggctattgatgaagacgctgaggagcctaacaacttggtggattactcaattacgcacgccgagcctgctaatgtatttgatattaacagtcataccggtgagatctggctgaaaaactcaattcggagtctggacgcattacataacatcacccctggccgagactgcctctggtccctggaggttcaggctaaggacagaggctccccttccttcagcactactgctttgctgaagatcgacatcacggatgcagaaacactgagcaggtctcccatggcagcattcttaatccaaactaaggacaatcccatgaaggctgttggtgtgcttgctggaactatggcgactgtggttgccattaccgtcctcatctccacggctaccttttggcgtaataagaagagcaataaagtgcttcctatgcggagagttcttaggaaacgaccttcacctgctccacgcacgatcaggatcgaatggttgaagagcaagagcactaaggcagctacgaagttcatgttgaaggaaaaaccgccaaatgaaaattgtaataataattctcctgagagcagtctcctgcctcgtgcccctgctctcccccctccccctagcgtcgccccatccacaggtgccgcgcagtggacagttcctactgtttctggaagccttacaccccaacccactcagcctcctccgaaaccaaaaacaatgggttctcccgtccagtccacactcatcagcgagctgaagcagaaatttgaaaagaagtccgtgcacaataaagcctacttttag

SEQ ID NO: 110298 - DNA, 1692 bp, Artificial Sequence
  Description of Artificial Sequence: Synthetic coding sequence
atggctcccgttttcgtgggcacaccatactatggatatgtctatgaagataccctgccgggcagcgaagttctgaaagtcgtggccatggacggagaccgcgggaagccaaatcgcatattgtacagtctggtgaatggaaatgatggcgccttcgagattaatgagacctctggcgctattagtattacacaaagcccggctcagttgcaaagggaagtgtatgagctacacgtccaagtcaccgaaatgagtcccgccggctcgccagctgcacaggcgacagtcccggtgacaattcggatcgttgatctgaataaccatccaccaaccttttacggagagtccggacctcagaatcgtttcgaactctccatgaacgagcacccaccccaaggggaaatcttgcgtggactgaaaattacagttaatgacagcgaccagggtgctaatgcgaaattcaacctacagctagtgggccctcgcgggattttccgagtggttccacagacggtgctaaacgaagcccaagtgacgattatcgttgaaaactctgccgcaattgattttgagaaatccaaggtgcttacgtttaaggctgtcgatcctgatacaggcccttggggtgaggtaaaatattccacctacggcaccggtgccgacctcttcctcattcatccatctaccgggctgatatatacgcaaccctgggccagtctcgacgccgaagctactgctcggtataatttttacgttaaagcagaggacatggaaggtaagtactcagtggcagaagtgttcattacattactggacgtgaatgatcatcctccacagtttggtaagtcagtccagaaaaagactatggtccttggcactccagtgaagatcgaggcgatagatgaagacgcggaagagcccaacaatctggtagactactcgatcacccatgccgagcccgcaaacgtctttgatatcaactcacatactggtgaaatttggctgaaaaactcaattcgttccctggacgctcttcacaacataacacccggcagagattgcctgtggagcttggaagtgcaggccaaagacagaggatctccttcattctcgaccaccgcactgcttaagatcgacataactgatgctgagacgctgtcaagatcccccatggctgcctttctcatccagaccaaggacaacccgatgaaggcagttggagtgttggcaggtactatggcaaccgtggttgcaatcaccgtcttgatctctaccgccactttctggcgtaataagaaatccaacaaggtcctgccaatgaggagagtgctgcggaagcgcccgtcgcctgcaccgcggacaattcggatcgaatggctgaagtctaaatctaccaaggccgccactaagttcatgcttaaagaaaagccccccaatgagaactgcaacaacaactcaccagaaagttcccttctgcccagggcccccgcactacctccacccccatctgttgcacctagcacaggcgccgctcagtggacagttccaactgtcagcggctctctgacaccccagcctacacagcctccgccaaagcccaagaccatggggtcgcccgttcagtcgaccttaatcagcgagctaaagcagaaattcgagaagaaatcagttcacaacaaggcatacttctag

SEQ ID NO: 110299 - DNA, 1464 bp, Artificial Sequence
  Description of Artificial Sequence: Synthetic coding sequence
atgggaagttgggcactgctgtggccgcccctgttgttcaccggactgctcgttaggccccccggtacaatggctcaagcacagtattgtagcgtaaataaagatatatttgaagtcgaggagaacactaacgtgacagaacctctggtggatattcatgtgcccgagggacaggaagtgacccttggagccttatctacccctttcgcattcagaatacaagggaatcagctgttcctaaacgtaacgcctgattatgaggagaaatccttgttggaagcgcagcttctgtgtcagtcaggcgggacactcgtgacccagctccgcgtgttcgtgagcgtcctcgatgtaaatgataatgcccccgagtttcctttcaaaaccaaagaaattagggtagaagaggataccaaggtgaatagcactgtgattcctgaaacccaactccaggctgaagaccgagataaggacgacattctgttctatacactccaagagatgacagcgggagcctccgactacttcagcctcgtgagcgtcaatcggccagcactgcggctggatcgccctctggacttttatgagagacctaatatgactttttggctcctagtccgcgacacccccggggaaaatgtggagccttctcacacagcaacggctacactagtgctgaacgtcgtgccagctgaccttcgtcccccttggttcctcccttgcacattctctgacggatacgtgtgtatccaggcacaatatcacggggccgttcccacagggcacattctgccttcacctttggtgttgaggcctggccccatttatgctgaggatggggaccgtgggattaatcaacccattatctactccatcttccgggggaacgtcaacggtacttttatcattcaccctgactctggcaacctcaccgttgcccggtcggtcccaagccctatgacctttctgctactggtgaaaggccagcaagcagacctggctaggtacagtgttacacaggtcaccgtggaggcagtggccgccgcaggcagccccccaaggtttccacaacgactctaccgaggaaccgttgcccggggggccggcgctggagtggtcgtgaaggacgccgctgcccctagtcaacctctgagaatccaggcccaggaccctgaattctctgacctgaactccgcaatcacgtaccgaataacaaaccacagtcacttccgtatggagggagaggttgtccttactaccaccactctagctcaggcaggggccttctacgccgagccaccgacatgcacgggcgacctccgccaccctgcacacctcaggcccccagccccagatcccactcagcgtcttcctggtgaagccgaagaacctatgcagacccctaaagctacccacctgggcgctggagggctgaaacatctcccaggagttctcgtccctttctag

SEQ ID NO: 110300 - DNA, 1956 bp, Artificial Sequence
  Description of Artificial Sequence: Synthetic coding sequence
atgggatcctgggccctgttgtggcccccactgctgtttaccggtctgctggttagacccccaggtaccatggcacaagctcagtattgttcagttaataaggacattttcgaggtcgaggagaataccaacgttactgaacccctggtggatatccacgtgcctgagggccaggaggtcaccctcggtgccctttccaccccgttcgctttccggattcagggaaaccagttgtttctgaacgtgacccctgattacgaggagaaatcactgcttgaagcacagttattatgtcagtccggtggcacgctggtgacacaattacgcgttttcgtttccgtgctcgacgtcaacgataatgcccccgagttccccttcaagacaaaggagattcgggtcgaggaggatacaaaggtcaatagtactgtgattccagaaacccagcttcaggcggaggatagagacaaagatgacatcttattttacacactgcaagagatgacagcaggggccagcgattatttcagcctcgtttctgtgaatcgtcccgcgctgcggctggatcgccccctagatttttacgagcggcctaacatgacattctggttgctagttagggacacccccggggagaacgtagagccttcacacaccgctactgctactctagttctcaatgtcgtgccagccgacttaaggccgccctggttcctcccatgtaccttcagtgacgggtacgtttgtatccaagcccagtatcatggcgcagtgcccactggtcatattctgccaagccctctcgtcctgcggccaggtcccatctacgcagaggatggggatagaggcatcaaccagcctataatttattcaattttccgaggcaacgtcaacggcaccttcatcatccacccagactccggcaatctgaccgtcgcccgatctgtgcctagcccaatgaccttccttctgctcgtcaagggtcagcaggccgatctggcacgttacagcgtaacccaggtaacagtggaggccgttgccgccgccggaagccccccgaggttcccgcagagattatacagaggtacagtggcacggggagccggcgcaggcgtcgtggtcaaagacgccgccgcaccctctcagccactgaggatacaagcccaggacccggaattttcagacctgaactcggccattacgtaccggatcactaatcactcccatttcagaatggaaggggaggtggttttgactaccaccactctcgcccaggccggagctttttatgcggaggtggaggcacacaacaccgtcacatccggaactgccacgaccgtcatagagatccaggtgagcgagcaggaaccacctagcacgggcggtggtccttccgaagataagcggttcagcgtggtcgacatggcggcacttgggggagtgctgggagccctactactgctcgcactcttgggattagctgtgctcgtgcacaagcattacgggcctcggctcaaatgttgttgcggaaaagcccctgagccccaaccccagggctttgataaccaagccttcttgcccgatcacaaagccaattgggccccagttccatcacccacccacgaccccaagcctgctgaggctcccatgcccgccgagcctgctccccccggcccagcctcccccggcggagctccagagcccccagctgcggcgagagcaggcggttccccaaccgctgtgcgttctattctcaccaaagaaaggcgcccagagggaggttacaaggctgtgtggtttggcgaggatatcggcaccgaggccgacgtggtggttctgaatgctcccaccctggatgtggatggcgccagtgactcaggctccggggatgaaggagagggcgctggtcgtggaggagggccctacgatgctccaggcggggatgactcctacatatag

SEQ ID NO: 110301 - DNA, 2538 bp, Artificial Sequence
  Description of Artificial Sequence: Synthetic coding sequence
atggggagttgggctctactgtggcctcccttacttttcaccgggctgctggtaaggcccccaggaactatggcccaagctcagtactgtagcgtcaacaaagacatctttgaggttgaggagaatacaaacgtaactgaaccactggtggacatacacgtgcccgagggacaagaagttaccttaggtgccctgagcactccatttgcctttcgaatccaggggaatcaactatttctgaatgtgacaccagactatgaagagaagagtctgctggaagcacaattgctctgtcaaagcggaggcacattggtgactcagctacgggtctttgtttccgttctagacgtgaacgataatgctcctgaatttcccttcaaaacaaaggaaatcagggtggaggaggatactaaagtcaactctactgtgataccggaaactcaactgcaagctgaggacagggataaagacgacatcctgttctacactctccaggagatgaccgccggcgccagcgattactttagcttagtatctgtaaaccgtcctgctctgagactcgatagacctctggacttctatgaacgacctaatatgacattttggctgctagtcagggacacccccggcgaaaacgtcgaaccaagtcatacagccaccgctacgctcgttctaaacgtggtgcctgcagatctccggcccccttggttcctgccctgcacattttccgatggatatgtctgtatccaggcccagtatcatggcgccgtccctaccgggcacatcctgccctcacctctggtgcttaggcccggccctatctatgccgaggacggcgaccgaggaataaatcaacccatcatatacagcattttcagaggtaatgtaaatgggacctttatcatccaccccgatagcggcaacttgacagtcgccaggtccgtcccaagcccgatgaccttcctgctgttggtaaaaggacagcaggcggacttagctaggtattcagtgacgcaagtcactgtcgaggcagtcgccgctgctggcagccctcccagattcccccaacgtctgtacaggggtactgtcgcgagaggagccggcgcaggggtggtggttaaggacgccgccgcccccagccagcctctcaggattcaagcccaggacccagagttttccgatctgaattccgcaattacttacagaatcacaaatcactcccattttcgcatggagggggaagttgttttgaccactactacactagcacaagctggcgccttctacgcggaggtagaagcacataacacagtaacttccggcacggctacaaccgtgattgaaatccaggtgtctgagcaggagcctccctctactgacgttccccctagccctgaggcggggggtactactgggccctggacaagcaccacatctgaagtacccagaccacctgagccatcgcagggtccatctaccacttcctctgggggcgggacaggacctcacccgcctagtggtacaaccctccggccccccaccagcagcactccgggcggcccgcccggcgcggagaattcaactagtcaccagccagcaaccccgggcggagacaccgcacagacccccaaacctgggacatcacagcctatgccccctggggttgggacctcgacatctcaccagccggccaccccttctgggggcactgctcagacccctgagcccgggacaagtcagccgatgccaccatccatgggtacctccaccagccaccagcctgcaacaccaggaggcggcacggcacaaaccccagaagctggcacaagccagcctatgccccccggaatgggaacctccacgtcacaccaacctacgaccccaggtggcggcacagcacagaccccagagccaggaacctcccaacccatgccattgtcaaagtctactccatcctctgggggcggtccctccgaggacaaacggtttagcgtggtcgatatggccgccctaggaggagtgttgggggcattgctcctgctcgcattgttgggacttgccgtactggtgcacaagcattatggccccaggttgaaatgttgttgtgggaaggcaccagagcctcagccacaggggtttgacaaccaggcctttctccctgatcataaggccaattgggcccccgtgcccagccccacacacgatcccaagcccgcggaggcacctatgcctgctgagccagccccgcccggacccgctagcccaggaggtgccccggagcctcccgctgccgcccgcgcgggcggctctcccaccgccgtgcggtccattctcaccaaagagcgccgccctgaaggcggctataaggccgtgtggtttggggaggatattgggaccgaagccgatgtagtcgtactgaacgctcccaccctggacgttgacggcgccagcgatagcggttcaggtgatgagggggagggcgccggacgcggagggggaccctacgacgctcctgggggagacgactcatacatatag

SEQ ID NO: 110302 - DNA, 2538 bp, Artificial Sequence
  Description of Artificial Sequence: Synthetic coding sequence
atgggttcctgggcccttctgtggccaccactgctgtttactggacttctggtgcgtccccctggcactatggcccaggctcagtattgtagcgtgaataaggacattttcgaggtggaggagaatactaacgttaccgaaccactagtggatattcatgtgccagaaggtcaggaggtaaccctgggggcactctcaaccccctttgctttccgcatccaagggaaccagctgtttctgaatgtaacccccgactacgaggaaaagagcctgctggaagctcagctcctctgccagtccgggggtactcttgtaacccaactccgggtgttcgtaagtgtcctggatgtcaatgacaacgcccccgagttccccttcaaaacgaaagaaattagggtagaagaagataccaaagtgaacagcactgtgatacccgagacccagctgcaggccgaggaccgcgacaaagacgacatactcttttatacgctccaggaaatgactgccggagccagtgattatttctctctggttagcgtcaaccgcccagccctgcggttagaccggccattagacttttacgagagacctaacatgacattttggttattggtccgcgacaccccaggagagaatgtggaaccctcccatacagcaacagccacattggtcctgaacgtggtgcccgcggacctgcggcccccttggttcctgccatgtactttttcagacggatatgtgtgtattcaagcccagtatcatggtgcggtcccaactggtcacatcctgccgtccccactggtgctgcgtcccggaccaatctacgcagaagatggagaccgggggataaaccaaccaattatctacagcatctttcggggcaacgtcaatggtacttttattattcatcctgattccggcaacttgaccgtcgcgcgctccgtaccttccccaatgacatttctgcttctggtgaaaggacagcaggccgaccttgcccgctactctgtgacacaggtaacggtggaagcagttgccgctgccggttcacctccaaggtttccccagcgactgtacaggggaaccgtcgcgcggggtgcaggggcaggcgtggtcgtcaaagacgcggcagcaccgagtcagccgctaaggatacaggcacaagaccccgaattttcagatctgaactcggcgattacttaccggattaccaaccactcgcacttcagaatggaaggcgaggtcgtcttaacaactactaccctggcgcaggcaggagccttctatgccgaggtggaggctcataacactgtgacatctgggaccgccaccacagtgatcgagattcaggttagtgagcaggaacctccctctaccgacgtcccaccgagtcctgaagccggcggaacaacaggcccctggacaagcactacatcagaggtcccgaggccgcccgaacccagtcaaggcccgagcactactagctccggggggggaacaggaccccatcctcccagcggcactaccttacgccctcctacctctagcactcctggcggaccccccggagctgaaaattccacctctcaccagcccgcaactcccggtggcgacactgcacagactccgaagcccggcacgtcccagccgatgccccccggcgtaggaactagtactagccaccagccagctactccttccggtgggacagctcagacacctgagcccggaaccagccagccgatgcccccctctatgggtacaagcacgagccaccagcccgctacccctggggggggcacagcacagacccctgaggcaggaacttcccaacctatgccacctggcatgggcacttccacgtcccaccagccgaccacaccgggtggcggcactgcccagactccagagccaggaaccagtcagccgatgcccctgtccaaatctaccccaagcagcgggggcggaccttccgaggacaagcgattttcggtggtcgatatggccgctctgggaggcgttctgggagctctgctgctgctggctctgttgggtctcgcagttctggttcacaaacattacggtccaaggctgaaatgttgctgtggaaaggcccccgaacctcagcctcaaggatttgataatcaagctttcctccccgaccataaggcaaactgggccccagtgcctagtccaacacacgatcccaaaccagccgaagcacccatgcctgctgagcccgctccacctggaccagcctcccctggcggagcccctgagccgcctgcggctgcaagggccggcgggtcaccaaccgccgttaggagtattctcacaaaggaacggagaccagagggaggttacaaagcagtgtggttcggagaggatatcgggactgaggctgatgtcgtggttctgaacgctccaaccctcgacgtagacggagcgtccgatagtggcagcggagatgaaggggagggcgccggcagagggggaggcccctacgatgccccaggaggcgatgactcctatatctag

SEQ ID NO: 110303 - DNA, 786 bp, Artificial Sequence
  Description of Artificial Sequence: Synthetic coding sequence
atggcagaatcccacttgcagagctcactgattactgcgtcacagtttttcgagatctggttacactttgatgccgatggcagcggctatttagaggggaaggaattgcagaaccttattcaggagctgcagcaggctcggaaaaaggcgggacttgagctttcacctgagatgaaaacctttgtggatcagtatggccagagggacgatggcaagatcggaatagtggaactggctcacgtgctaccgacagaagagaactttctgctcctattccgctgccagcagctcaaatcatgcgaggagttcatgaagacctggcgcaaatacgatactgaccatagcggttttatcgagactgaggagctgaaaaacttcctgaaggatctcctggaaaaagccaacaagaccgtggatgacacgaaattggccgaatacacagatctgatgctcaaactattcgactctaacaatgatggaaagttggagctgaccgaaatggcgcgactattgcccgttcaggagaatttcctgctgaagttccaggggataaaaatgtgtggcaaggaattcaacaaagccttcgagctatatgaccaagatggcaatgggtatatcgacgagaatgaactggacgctctgctcaaggacctgtgcgagaaaaataaacaggatctggatattaataacatcacaacatataagaaaaatatcatggccctctcagatggcgggaaactctatcggacagacctggccttgattttgtgcgcgggcgataattag

SEQ ID NO: 110304 - DNA, 615 bp, Artificial Sequence
  Description of Artificial Sequence: Synthetic coding sequence
atgaaaacatttgtggaccagtacggacaaagggatgacggcaagattggcattgtagagctggctcacgtgttgccaacggaggagaactttctgctgctgttccggtgccaacagctaaagagctgcgaggagtttatgaagacttggagaaagtacgatacagatcatagcggctttattgagacggaagaactgaagaatttccttaaagatctgctggagaaagcaaacaaaactgtggatgacacaaaactcgccgagtacacagatttaatgcttaagctctttgactctaacaacgatggcaagctcgaactgaccgaaatggcgcgcttactcccagtgcaggagaattttctcctgaagttccaagggataaagatgtgcggaaaggaatttaacaaagcttttgaactgtatgatcaagatggaaatggctacatcgacgaaaatgagctcgacgcactgcttaaggatttatgtgagaagaacaaacaggaccttgacatcaacaacattactacctataagaaaaacatcatggccctaagtgatggaggcaagttataccgcacggacctcgcgctgattctctgtgccggggacaactag

SEQ ID NO: 110305 - DNA, 816 bp, Artificial Sequence
  Description of Artificial Sequence: Synthetic coding sequence
atggctggcccccagcagcagccaccatatttacacctggcagagttgacggcttcccagttcctggaaatatggaagcactttgacgcagacggtaatgggtatatagaagggaaagaattagagaacttttttcaagagctggaaaaggcccgcaaaggctcggggatgatgagtaaatctgacaactttggagagaagatgaaggaattcatgcagaaatacgacaaaaattccgatgggaagatcgagatggccgaactggcgcagattctgcctaccgaggaaaactttcttctgtgctttaggcaacacgttgggagctccgcagagttcatggaggcctggagaaaatatgatactgatcgtagcggttacattgaagccaacgagcttaagggctttctgagcgaccttctcaagaaagctaatcgtccatacgacgagcccaagttacaagagtacacgcagactatcttgagaatgtttgatttgaatggcgatgggaagttgggactgtcagagatgagtagattgctgcctgtgcaggagaactttctgttaaaattccaagggatgaaattgaccagtgaggaattcaacgccatctttaccttctatgataaggataggtcgggatacatagacgaacacgagctggacgctctattaaaggacctgtatgagaagaacaaaaaggaaatgaacatccagcagctgacaaattatagaaagtctgtcatgtctctcgctgaggctggtaaactctataggaaagaccttgagattgttttgtgctcagagccccccatgtag

SEQ ID NO: 110306 - DNA, 579 bp, Artificial Sequence
  Description of Artificial Sequence: Synthetic coding sequence
atggctgggcctcaacagcagcctccttatctgcacctggccgaactcacggcctcacagttcctcgaaatctggaagcacttcgatgccgacggcaatggttatattgaaggcaaagagctggagaacttctttcaggaactggagaaggctaggaagggctccggcatgatgagtaagagcgacaacttcggcgagaaaatgaaggaattcatgcagaagtacgacaagaatagcgacgggaagatcgagatggcagaactcgctcagatactccccactgaggaaaatttcctgctctgttttagacaacacgttgggagttccgcggaatttatggaagcatggcgcaagtatgacacagatcggagtggctacatcgaggctaatgaactgaaaggctttctgagtgacctgttgaagaaggctaacagaccttacgatgaacctaagctgcaagagtacacgcagaccatcctgcggatgttcgacctgaacggtgacggaaagctgggcctcagcgaaatgagccgaatagaggcagccactcttacttcaatgtcctggatgccattttag

SEQ ID NO: 110307 - DNA, 6663 bp, Artificial Sequence
  Description of Artificial Sequence: Synthetic coding sequence
atgattcgcatcgccgcactaaacgcttctagcacaatcgaggacgaccatgaagggtcctttaagagtcacaaaacacagacaaaagaggctcaggaagcagaagcttttgcactctaccacaaagccctcgacctccagaaacacgaccgatttgaggagagcgccaaggcttaccacgaactcctggaagccagcctgttgagggaggcagtcagttctggtgacgaaaaggaaggcctcaagcaccccggtctcatccttaagtattcgacatataaaaacctcgcccagctggccgctcagcgggaagatctggaaaccgctatggaattttacctcgaggcagtgatgctcgactctacagatgtgaatctgtggtataagatcggacacgtggccctccggctgatccgcatcccactcgcgcgccatgctttcgaggaagggctgcggtgtaatcccgaccattggccctgtctggacaacctgatcaccgttctgtataccctgtccgattacactacttgtctgtacttcatttgcaaagccttggaaaaagattgcaggtactcgaagggactggttttaaaagaaaaaatcttcgaggaacaaccctgcctgagaaaggattctttgcgtatgttcctgaagtgcgatatgtccattcatgacgtctctgtgagcgccgctgagacacaggctatcgttgacgaagctctgggccttcggaaaaagcgacaggctctaattgtgagggagaaggagcccgatctcaaactcgttcagcccatccctttctttacatggaaatgtttgggcgaatctctactggcgatgtacaatcacctgaccacatgcgaaccccctcgcccttcgctgggcaagcgaatagacctctcggactatcaagacccctcacagccgttggaatctagcatggttgtgaccccagttaatgtaatccagcctagcaccgtttccaccaatccagcagtggccgttgccgaacccgttgtgtcctacacatccgttgccaccacctctttccctcttcactccccaggtctgctggagacaggagctcctgtgggtgatattagcggcggcgataaaagcaagaaaggggtaaaacgtaagaagatttctgaagagagtggtgaaactgctaaaaggcgaagtgcccgtgtgcgaaacactaaatgtaagaaggaggagaaagtcgatttccaggagctcctcatgaagtttctgccatctaggctgcgaaagctggaccctgaggaggaggatgacagcttcaacaattatgaggtccagtccgaagccaagctggagtcattcccgagtatagggccacagcggctgagtttcgattcagcgacttttatggaatcagaaaaacaagacgtgcacgaatttctccttgagaatctgaccaacggagggatacttgaactcatgatgaggtacctgaaagccatgggccacaagttcctggtgcgctggcctcccggtctagccgaagtagttcttagtgtgtatcactcctggcgcagacacagtacaagcctgcccaatccactactgagagactgctccaacaagcacattaaagacatgatgttaatgtctctttcttgtatggaacttcaactcgatcaatggttgttaacaaaaggcaggtctagcgccgtaagcccccgcaactgtccagccggaatggtgaacgggaggttcggtccagactttcccggaacccattgtttaggcgatctgttgcagctgagcttcgcgtctagccaaagggacttattcgaagacggctggctggagtttgtggtccgagtttactggctcaaggccagattcctggcccttcagggtgatatggaacaggcactggaaaactatgatatttgtacagaaatgctgcaaagttcaacagccattcaagtggaagcgggggcagaacggagggatatcgttatccggctgcctaacctacacaacgacagcgtggttagtctcgaggaaattgataagaacctgaagagcctcgagaggtgccagagcctagaggaaattcagcggctgtacgaggccggggactacaaggccgtcgtgcaccttttgcggccaaccctctgcacttccgggtttgacagggccaaacacctggagttcatgacaagcatcccagagagacccgcacaattactcctcctccaggatagcctactaagactaaaagattatagacagtgtttcgagtgtagcgatgtcgctctaaacgaggctgtccaacagatggtgaactcaggagaggctgccgctaaggaggagtgggtggccacggttactcagctcctgatgggcatcgagcaggcactgtcagccgactcttcaggctccatcctgaaagtctccagttccacaacaggtctggtccgcctcaccaataacctaatacaagtcatcgactgctctatggcagtccaagaggaagcgaaagaaccgcacgtttcctccgtgctgccttggataatcctccatcgcataatttggcaggaagaagacacgtttcactcgctgtgccaccagcagcagctgcagaacccggccgaagagggaatgtccgagactccaatgcttccaagcagccttatgctgttgaacacggcacacgagtaccttggtagaaggagctggtgctgcaactccgacggagccttgttgcggttttatgtgcgggtgctgcagaaggagctcgctgctagcacgtctgaagatacacatccttataaggaggaactggaaacggccttggaacagtgtttttactgcctgtacagtttcccttctaagaagagcaaagctcggtatctggaggaacattctgctcagcaggtggatctgatttgggaggacgctttatttatgtttgaatacttcaaacccaagacccttccggagtttgacagctacaagacctctaccgtgagcgccgacctagccaatctgcttaagaggatcgccactattgtgccaagaacggaacgccctgccttgagcctcgacaaagtgagcgcttatatcgaggggacttccacggaggtaccatgccttcctgaaggtgctgacccatctcctcctgtggtgaacgagctttattatttactggccgactatcatttcaagaataaggaacagtccaaggccatcaaattctacatgcacgatatatgtatatgccccaatcggtttgacagttgggctggcatggccttggctagagcgtcccggattcaagataagctgaacagtaatgaactgaaatccgacgggccgatatggaaacacgcaactcccgttttgaattgtttccggcgagccctggagatagattcctccaacctcagtctttggatcgagtacggtaccatgagctatgctttgcacagtttcgcttcacggcagctgaagcagtggagaggagaactgccacctgagctggtacagcagatggaggggcggagggactcaatgctggagacagccaagcactgctttacctccgccgcccggtgcgaaggcgacggggacgaggaggagtggctgattcactatatgctgggaaaggtcgcagagaagcagcagcagccgccaacagtgtatctcctgcattataggcaggctggccactatctgcacgaggaggccgcccgatatcctaaaaaaattcattaccacaacccgcccgaactcgccatggaggccctggaggtttacttccggcttcacgcatcaatcctgaaactgcttggaaagccagattcaggggttggggccgaggtcctggtgaatttcatgaaggaggcggcagaagggcccttcgcgcgtggtgaggaaaaaaacacacctaaagccagtgaaaaagagaaggcctgcttagtggatgaagactcacacagctccgcgggtacactgcctgggcctggcgctagtctgccttcctcttccggaccaggactgacctcccctccatataccgccactcccatagatcacgactacgtcaaatgcaaaaaaccccatcaacaggcgaccccagatgacagaagtcaggactctactgcagtggcactgagtgactccagctctacccaggactttttcaacgagcccacctcgctgctggaaggcagccgaaaatcttacacggagaaacgcctccctatcctgagtagccaagccggtgccacaggaaaggatctccagggcgcaacagaggaacgcggcaagaacgaagagtcacttgagtcaaccgaaggtttccgcgcagcagaacagggggttcaaaagcccgcggccgagaccccagcaagtgcgtgtattccaggcaaaccctcagccagcactcctaccctttgggatgggaagaaaagaggggacttgcccggggaaccggtcgcgttcccgcaggggctcccagccggagccgaggagcagagacagtttcttacggaacaatgtatcgctagttttcgactttgcctgagccgctttccccagcactataaatcactttatcgcctggcctttctctacacatactccaaaacccacaggaaccttcagtgggccagagacgtgctgctggggagctcaatcccgtggcaacagctgcaacacatgcccgctcagggccttttttgcgaacgaaacaagacgaacttcttcaacggaatttggcgcattccggttgatgagattgaccgcccagggagtttcgcctggcacatgaatagaagcatcgtgctgctgttgaaagtcctcgcacagctgcgcgaccacagcacccttctcaaggtgagctctatgctgcagagaaccccagatcaggggaagaagtatctcagggacgcggaccggcaggtgcttgcacagagagcctttatcctgacagtcaaagttctggaggacaccttgtcagagctggccgagggcagcgagagacccgggcccaaagtctgcgggctgcctggggctcgcatgaccacagacgtctcccataaagcctccccagaggatggccaggagggactcccacagccaaagaaaccgccgctcgcagacggtagcggccctggacccgaacccggcggcaaagtcggcctcctaaaccacagaccggtggcgatggatgccggcgattccgctgaccagtcaggcgagagaaaagacaaggagtcaccgagagctggacctactgaacccatggacaccagcgaagctaccgtctgccactctgacctggagaggaccccgcctctgttacccggacggccagcccgggacagggggcccgaaagccgtccgacggagctaagccttgaggagctcagcattagtgcccgtcagcagccaacaccactgacccctgcccaaccggccccagcgccagccccagccactaccacaggtacaagggccggcggtcaccctgaagagcccttatccagactgtctcggaagaggaagctgctcgaggacactgagtctggcaaaaccctgctgctcgacgcgtatagagtttggcagcaaggccagaaaggcgtagcatatgacctgggaagggtggagaggataatgtcggagacctatatgctcatcaagcaggtggatgaagaggctgccctagagcaagcggtcaagttttgtcaggtacacctgggagccgcagcccagcggcaggcatccggcgatacacccacaactcctaagcatccaaaggattctcgcgaaaacttctttccggtgactgtggtgcctaccgcccccgatccagtgccagctgactctgtccagcggccctctgacgctcacaccaagcctaggcccgccctcgcagccgcaacgactattattacatgccccccgtccgcctcggcatctacgctggaccagtccaaggaccccggccctccgcgcccacatcggcctgaggctaccccgtctatggcaagcctggggcctgagggcgaggagctcgctcgggtggcagaagggactagttttccccctcaggagcccagacattccccgcaggtcaagatggctccaaccagctctccagctgaaccccattgctggcctgcggaagcagctcttggcacgggcgcagagcctacatgttctcaagagggcaaactgagacccgaaccgagaagagatggggaagcgcaggaggctgcctcagagactcagcccctttcctctcctccaacagcagcatcttccaaagccccaagttcaggctcagcacagccccccgagggccaccccggcaagcccgaaccctccagggcaaagagtagacctcttcctaacatgcctaagctcgtcattcctagcgcagctaccaagtttcctccagagattaccgttacccctcctacgcccaccctcctgagtcccaaggggagcatctccgaggagacgaagcagaagctcaaaagcgcaatcctctcagcccagagtgcagcgaatgtgcggaaggagagcctgtgtcagccagccctggaggtcctggagacaagcagtcaggagtcctctctggaaagcgaaactgacgaagacgacgattatatggatatatag

SEQ ID NO: 110308 - DNA, 6663 bp, Artificial Sequence
  Description of Artificial Sequence: Synthetic coding sequence
atgattagaatcgctgctctgaatgcgagctcaaccatcgaggacgatcatgaggggtcttttaagtcacacaaaactcagactaaggaagcccaggaagctgaagctttcgctctgtaccataaggctctggacctgcaaaaacacgataggtttgaggagagcgcgaaggcctaccacgaattgctggaagcctctctgttgcgcgaggcagtatcttctggagacgagaaggagggcttaaaacatcctgggcttattttgaagtacagcacctacaagaaccttgcccagctagctgctcagcgggaagacctcgagacagctatggaattctatctggaagcggtgatgctggatagtaccgacgttaatctttggtataaaatcggacacgttgcgctgagactgatcaggatacctctggctcgccacgcctttgaggaaggcctgcggtgtaacccggaccactggccatgtctcgataacttaataacagtgttatacactctttccgattataccacctgcctgtactttatctgcaaagcgttggaaaaagactgtcgctacagtaaaggactggtcctcaaagagaaaatcttcgaagagcagccttgtctgagaaaggactcgcttcggatgttccttaagtgcgacatgagcattcacgacgtttctgtttctgccgctgaaactcaggccatcgtcgatgaggccctgggactgagaaaaaaacgacaagctctgattgtgcgggagaaagagcccgatttgaaacttgtgcaaccaatcccattcttcacttggaagtgtcttggagagagcctcctcgcaatgtacaatcaccttacaacatgtgagcctccccgaccctccctgggcaagaggatcgatctgagcgactatcaagacccctcccagccacttgagagctcaatggtggttacgccagtgaatgtgatccagccttccacagtgtccacgaacccagctgtcgccgtggccgaacctgtggtaagttatacatcggtggcgacaacttcattccctctgcatagccctggcctgctggaaactggcgcgccagttggcgacattagtggaggcgataaaagtaagaagggcgtgaaacgcaaaaagattagtgaagaaagtggggagacagcaaaaaggcggtcggcgagggtgcggaatactaagtgcaagaaggaggagaaagttgacttccaggagctgcttatgaaatttctgccctctcgcttgaggaagctcgaccctgaagaggaggacgacagctttaataactatgaggtccagtctgaagccaagttggagtcgttcccctccattgggccccaaagactgagcttcgactccgccacatttatggagagcgagaaacaggatgtccatgagtttctcctcgagaatctcacaaatgggggcattctcgaactgatgatgcgctacctcaaggccatggggcataagttcctggtgcggtggccccctggtctcgcagaggtcgtactgtcagtataccattcgtggagacgccatagcactagccttcctaaccccctgctacgtgactgttccaataagcatatcaaagatatgatgttgatgtcgcttagctgcatggaactccagttagatcagtggttattgacaaaggggcggagtagcgctgtgagccctcgaaactgccccgcaggaatggttaacggaaggttcggccccgattttcctggaacacattgtcttggtgacctgttgcagctctcttttgcatcaagccagcgggacctctttgaggacggctggctcgagttcgtggttcgtgtgtattggctgaaagcacgattcctcgcccttcaaggggatatggaacaagccctcgaaaactacgacatatgcactgagatgctgcagtcctccactgcaatacaggtggaggccggcgctgagcgccgggacatcgtcatacgactgcccaacctgcataacgacagtgttgtgtccctggaggaaatagataagaatttgaagagtctggagcggtgccagagcctggaggaaattcagcgattgtatgaagcgggggattataaagccgtcgttcatctcttgcggcccacactgtgtaccagtggcttcgacagggcaaaacaccttgagttcatgaccagcatccctgaacggcctgcccagctattactgctacaggactccctcctcagacttaaggattaccgtcagtgtttcgagtgctctgatgtggccttaaatgaggctgtgcagcagatggtgaactccggtgaggccgccgcgaaggaagagtgggttgccactgtcacgcaacttctgatgggaattgagcaggctctgtccgccgactcttcgggaagcatcttgaaggtgtcttccagcactaccggtttggtacgactgaccaataatctcatccaagtgatcgactgctcgatggccgtccaggaggaggccaaagaaccgcatgtcagctcagtgctgccgtggataatccttcaccggattatttggcaagaggaagatacatttcattcattgtgccatcagcagcagctccagaatccagctgaggagggcatgagcgagactcccatgcttcctagcagcttgatgctgcttaacaccgcccacgagtatctggggcggaggtcttggtgttgtaatagtgacggggccttgctgagattctatgtacgcgtgctccaaaaagaattggccgcatctacttctgaagatacccacccatataaggaggaactggagacggccctggagcagtgcttctactgcttgtactcttttccctctaagaagtccaaagctaggtatctcgaggagcactccgctcagcaggtagacctgatctgggaagacgctcttttcatgttcgagtatttcaagcctaagacgttgcccgagtttgattcttataagacgagcacagtgtccgcagatctcgccaatcttcttaaacggattgctaccattgtacccaggacagagaggcccgcgctgtccttggataaggtgagcgcatacattgagggcacttctactgaagtaccatgtctgcccgagggggccgatccatctccacctgtggttaatgaactctactacctgcttgccgactaccatttcaaaaacaaagagcagtccaaagccattaagttctacatgcacgatatctgcatttgccccaatcggtttgatagctgggcaggcatggcactcgcccgcgcctctaggatacaagataaactgaactccaacgaactcaagtccgatggacccatttggaaacacgccacgcccgtgctcaattgctttaggcgggcactggagattgactcttctaatctcagtttgtggatcgaatacggtactatgtcatatgcactgcactcattcgcatccagacagttgaagcagtggcgcggggagcttcctcccgaattggttcaacagatggaaggccgccgagattccatgcttgaaacagcgaagcactgctttaccagtgcggctcgctgcgaaggggacggagacgaagaggagtggctgatacattatatgctggggaaagtggcagaaaaacagcagcagcctcctacagtctatctgctgcactatcggcaggctggacactatttgcacgaggaggctgccagatacccaaaaaagatacactatcacaaccctcctgaactagccatggaggctctcgaagtctacttccgcctacacgctagtatcctgaagctgttgggaaaaccagactctggcgtaggtgccgaggttctggtcaattttatgaaggaggctgccgaagggccctttgctagaggtgaagagaagaatactcctaaggcaagtgaaaaagagaaagcatgcttggtcgacgaggactcccactcttctgcgggtaccttgccaggcccaggagcttcactccccagtagtagcggcccaggcctcacctcccccccatacaccgcgacaccaatagatcacgactacgttaaatgtaaaaaaccacaccaacaagcaacacccgatgatcgttctcaggactcaaccgctgtggctctaagcgactccagttctacccaggatttctttaatgaaccaacctcccttttagaaggctctcggaagagttacacggagaagcgcctgcctattctgagctcccaagcaggcgcaaccggcaaagatctgcagggcgcgaccgaggaacggggtaagaacgaagaatctttggaaagcacggagggattccgcgcggctgagcaaggcgtgcagaaacctgccgccgaaactccagcgagcgcttgcatcccaggaaagcctagcgcctccacacctaccctgtgggatggtaaaaagaggggcgaccttcctggcgaacctgtggcttttcctcagggtctcccagccggagctgaagaacagcgacagtttctcactgagcagtgtatcgcatcctttagactttgcctctcacgcttcccgcagcactacaagagcctgtacaggctcgcattcctgtacacctattcgaaaacccatcggaatctccagtgggcacgagatgtgttgctcgggtcatccattccctggcagcagttgcagcacatgccagctcagggactgttttgcgaaaggaataagacaaatttttttaacggtatttggcgtattcccgttgatgaaatcgaccgcccgggaagtttcgcatggcatatgaaccgatcaatcgtgttactgctgaaggtgctcgcacaactgcgggatcacagtacactcctcaaagtaagcagtatgctccagagaacacccgaccagggaaagaaatacctccgcgatgctgaccggcaagtgctcgctcagagagcttttattctgactgtgaaagtgctagaggacacattgtccgagctggccgagggctcagaacgcccgggacctaaagtgtgtggactcccaggggcccgaatgacaactgatgtgtcccataaggcttcacctgaggatggccaggagggactgccccagcccaaaaagccaccgctggccgatgggagcggacctggtcccgagcccggagggaaagtgggattattgaaccaccggccagttgcaatggatgctggagatagcgcagaccagagcggtgagcggaaggataaagagagccctagggccgggcccacggaaccaatggacacttccgaggcaacagtgtgccattccgatcttgagcgcactccacctcttctgcccggacgacctgcacgcgacagagggcctgaatccagaccaacggagctatcacttgaggagctgtcaatctctgcccgccagcaacccactcccctaacacctgcccagccagcgcccgcgcccgctcccgccacaaccacgggaactagggctggcggacaccctgaggagcccttgtcaagactgagtcgaaagcgaaagttgctcgaggatactgaatcaggaaaaacgctccttctcgatgcttacagagtgtggcagcagggacagaaaggagtcgcgtatgatctggggagagtcgagaggattatgtcagagacatacatgttgataaagcaggtcgatgaggaggcggccctcgaacaggccgtgaagttctgtcaggtccacctcggtgctgcagctcagcggcaggcttcaggcgacaccccgacaacccccaagcaccccaaggatagtcgcgaaaatttcttccctgtgactgtggtccccactgcccccgatccagtccctgccgactccgtccaaaggcctagcgatgctcacaccaaaccccgaccagctctcgcagccgccacaaccattatcacctgccctcccagcgcctctgcaagcactctagaccagtctaaggaccccggcccccctcgcccccatcgcccggaggctacgccgagcatggcctccttaggcccagagggtgaggagttggcgagagtcgccgagggaacctctttccctccacaggagccacggcactcaccccaggtaaaaatggccccgacttctagcccagcagagcctcactgttggcccgccgaggcagccctcgggacgggagcggaaccgacatgttctcaggaggggaagctccgcccggagcccaggcgggacggtgaggcccaggaggctgccagcgagacgcaaccactaagctccccacctactgctgcgagtagcaaagcgccatcctccggctccgcgcagcctccagaggggcaccccggcaaaccagagccctccagagctaagagcaggcctctgccaaacatgcccaagttggtcatccccagcgccgccaccaagttcccacctgagatcaccgtgaccccgccaacacctacactgctctcacccaagggtagcatcagcgaagaaactaaacagaagttgaagtcggctatcctgagcgcccagtcagccgctaacgttagaaaggaatccctgtgtcaaccagccctcgaagtcctcgaaacctcgtcccaggagtcgagcctcgaatctgagacagatgaggacgacgattatatggatatttag

SEQ ID NO: 110309 - DNA, 1770 bp, Artificial Sequence
  Description of Artificial Sequence: Synthetic coding sequence
atgccccgccgttcccggcgtggaatttggaggatcccagtggatgagatcgatagacccggaagctttgcgtggcacatgaatcggagcatcgtcctactcttgaaagtgctcgctcaactgcgggaccactcaaccttactcaaagtcagcagcatgttacagaggacaccagaccaggggaagaaatatctaagagatgctgacaggcaggtgctagcccagcgagcctttatcctcacagtgaaagttctggaggacactctgtcagaactggccgaggggtcagagcgtcctggccccaaagtctgcggccttcccggcgccaggatgacaaccgacgtctcgcacaaggcctctccggaggacgggcaggagggactgccacaaccaaagaagcccccgcttgctgatggctccggaccgggcccggagccaggagggaaggtgggactcctgaatcataggcccgtcgccatggatgccggagattctgctgaccagagcggagagcgcaaagataaagaaagtccacgagcaggtcctaccgagcccatggatacatcagaagccaccgtctgccactcagatctcgaacgaactccaccactgctgcccgggcgtcccgcccgagacagggggccagaatccaggcccaccgagttatctctggaggagctatcaataagcgctcgtcagcaacctacacccctgacacccgcacagcccgctcccgcgcctgccccagcgaccacaacaggcaccagagccggtgggcaccctgaggagcccctgagcaggctttcgcgaaaacggaagttgcttgaggacaccgaatccggcaaaaccttgctactggatgcatacagagtatggcagcaggggcagaaaggagtcgcctacgacttagggcgtgtcgaaaggatcatgtccgagacatacatgctgataaagcaagtggacgaggaggccgccctcgagcaggccgtgaaattttgtcaagttcacctgggtctgcctcccagagatcggccgagagatacccccaccacaccaaagcaccccaaagattcgcgggagaattttttccccgttactgtagttcccacagcgccagacccagtccctgccgattctgtacagcgcccctcagatgcccacacaaaaccacggcctgctcttgcagcggccactacgatcatcacctgcccaccttcagccagtgcctccaccctcgatcaatctaaggaccccggtcctcctcgtccacatcgtcctgaggccacacctagcatggcctcactggggcctgaaggtaaattaaggccggaaccgagacgggacggagaagcccaagaggctgcttctgaaacacagccactgtcatccccccctacagcagccagctccaaggcccctagctcaggatctgcacaaccacccgagggccatcccggcaaaccagagccttcacgggcaaagagtcgacctctccccaatatgcccaagttagtaattccatcagccgccaccaaattcccacctgaaataacagtcacgccgccaaccccaaccttactgtcccccaaagggagtattagtgaagagaccaagcagaagcttaaaagcgccatcctttccgcacaaagcgctgcgaatgtgcgaaaagagtctctctgccagcccgctctggaggtgctcgagacgagttctcaagagagctccctggagagtgagacagatgaagacgatgattacatggatatctag

SEQ ID NO: 110310 - DNA, 1224 bp, Artificial Sequence
  Description of Artificial Sequence: Synthetic coding sequence
atgatacgtattgccgcactgaacgcttcttcaacaattgaagacgatcatgaaggttcattcaagtctcacaagacccagacaaaggaagcccaggaagcagaggcatttgcgctgtaccacaaggcactagacctccagaaacatgaccgctttgaggagagtgccaaagcttatcatgagctcctggaagcctccctgctccgcgaagctgtgagctcaggagacgagaaggaagggctgaagcaccctggtctgatattgaagtattcaacttataaaaacctggcacagctggcagcccagagagaggatctggagactgctatggaattttatctcgaagctgtcatgctcgattccaccgatgtaaacctgtggtacaaaatcggccatgtggccctgagactgatcagaatccctttggcaagacatgccttcgaggagggtctccgctgcaatcccgatcactggccatgtcttgacaacctgataacggtgttgtacacattgtctgactacacaacatgcctatacttcatttgtaaagcattagagaaagattgcagatattccaaaggcctcgtccttaaggaaaagattttcgaggagcagccatgtttgagaaaggattctcttcgaatgttcctcaagtgtgatatgtctatccacgatgtgagcgtatcagccgccgagacgcaagctattgtggacgaagccttaggcttaaggaagaagcgacaagccttgatcgtccgcgaaaaagagccagatctgaaactggtgcagcccatcccattctttacttggaagtgtctgggcgagtcccttctcgccatgtacaaccatctgactacatgcgaaccccctaggccgtctctagggaaacgcatagacctttccgactatcaggaccccagccaacccctagaatcttctatggtggtgacaccggtgaatgttatccagccctctacggtctctactaatccagccgtggccgttgcggaacctgtcgtgagttacacttctgtcgcgacaacctccttcccactccattctcctgggttattagaaaccggagctccagtgggggatatttccggaggcgataaatccaagaagggcgtcaagcgtaaaaaaatttcagaagagtctggggaaaccgccaagagaaggtcggctagagtgagaaacactaagtgcaaaaaggaggaaaagtag

SEQ ID NO: 110311 - DNA, 1527 bp, Artificial Sequence
  Description of Artificial Sequence: Synthetic coding sequence
atgcagttcagcggtgaaaagatatccggtcagcgcgacctccagaagagtaagatgcgctttacctttacgtctagatgccttgccctatttctcctgctcaaccaccccacccccatactcccagcattctccaaccagacatatcctacgatcgaacccaagccattcctgtacgtggttgggcgaaagaaaatgatggatgcgcaatacaaatgctatgataggatgcagcagctgccagcttaccagggcgaagggccctactgtaaccgaacatgggacgggtggctgtgctgggacgacacacccgcaggagtgctatcttaccaattttgtcctgattacttcccagactttgacccgtcagagaaagtgacaaaatactgcgatgagaagggagtgtggttcaaacaccccgaaaataaccgtacctggtctaactatacaatgtgcaatgcttttacacccgagaaacttaagaacgcttacgtcctctattatctagctattgtaggccacagcttgagcattttcactttggtgatcagcctggggatattcgtgttcttcagaaagctgacgacaatctttcccctgaactggaaatatcgtaaggccctgagtctcgggtgtcaaagggtaaccctgcacaagaatatgttcttaacatatattttgaactccatgattatcatcatccatctcgtcgaggtagttcctaacggggagctggtgcgccgagatcccgtgagttgcaagatactgcacttcttccaccaatacatgatggcctgtaattatttttggatgctatgcgaagggatttatctccacacacttatcgtagtggctgtgtttacagaaaagcagcggttgagatggtattatctgctgggctggggctttcccctggtacccaccaccatccatgcaatcaccagagccgtctatttcaacgacaattgctggctatctgtggagacccacctgctatatataatccatggccccgtgatggcagccctggtggtaaactttttcttcctcttgaacattgtgagggtgcttgttacaaaaatgagagaaacacacgaagctgaatcgcacatgtacctgaaagctgtgaaggctactatgatcctggtccctctgctgggaatacagttcgttgtgttcccatggagaccctctaacaagatgctgggaaagatttacgattatgttatgcacagcctcatccactttcagggctttttcgtcgccaccatctactgcttctgtaacaatgaggtccagaccacagttaagcgtcagtgggcgcagtttaaaattcaatggaaccagagatggggacgcaggccttctaataggagtgcccgagccgcagcggctgccgctgaggcaggcgacatacccatttacatttgtcatcaagagcttaggaacgagcccgccaataatcaaggtgaggaaagtgctgagatcatacctctgaacattatcgagcaggaaagctccgcctag

SEQ ID NO: 110312 - DNA, 1473 bp, Artificial Sequence
  Description of Artificial Sequence: Synthetic coding sequence
atgcggtttaccttcacctcacgctgcctggccttatttttgcttctgaatcacccaacacctatcttaccagccttttccaaccagacatatccaaccatagagcccaagccattcctgtacgtggtcggccgcaaaaagatgatggacgcccagtacaaatgttatgataggatgcagcagctcccagcatatcagggcgagggtccttattgcaaccggacttgggatggctggctgtgctgggacgataccccggctggtgtcctgtcttaccagttttgcccagattacttccccgacttcgacccttctgaaaaggtcacgaagtactgcgatgagaaaggcgtttggttcaagcaccctgagaacaataggacatggtctaactacaccatgtgtaacgcctttactcctgagaagctcaaaaatgcctatgtattatattatttggcaatcgtggggcactcgctgagcattttcaccttggtcatctctctggggatctttgttttttttagaaagcttactactatctttccgctgaactggaaatatcgcaaggcgctgtcacttggttgtcagagggtgactcttcataaaaatatgtttctgacgtacatcctaaactcaatgatcataattatacatttggttgaggttgtgcccaacggggaactagtacggcgcgatcctgtgagctgcaagatattgcatttctttcaccagtacatgatggcctgcaattacttctggatgctgtgcgagggcatctatttacatactcttatagtagttgctgtgtttacagagaagcagagacttcgctggtactatctgcttggctggggcttcccacttgttcctacgaccatacatgctattaccagagcggtgtattttaatgataattgttggctctcagtcgaaacccatctgctttatattatacacggaccagtgatggcagccctggtagttaacttctttttccttctgaacatcgttagggttctggtcacaaaaatgcgtgagactcatgaggctgagagccacatgtatctcaaggcggtcaaagccacaatgattctggtgccactgctgggcatccagttcgtggtctttccttggcggccatccaacaaaatgctgggaaaaatttacgactacgtaatgcattcattgatacacttccaaggattctttgtggctacaatatattgtttttgcaacaacgaagttcaaaccaccgtcaagcgccagtgggctcagttcaaaattcagtggaaccagcgttggggtaggaggccctctaatcgatccgctcgagctgccgctgcagcagccgaagctggtgatatcccaatctacatctgccaccaggagctgaggaatgagccagcaaacaaccaaggagaggagtccgccgaaatcatcccgcttaatattatcgagcaggaaagctccgcttag

SEQ ID NO: 110313 - DNA, 1425 bp, Artificial Sequence
  Description of Artificial Sequence: Synthetic coding sequence
atgcggtttacttttacttccagatgtctagccctgtttctgctattgaaccaccctacaccaatcctgcccgcattttcaaatcagacctaccccaccatagaacctaagccattcctgtacgtagtaggtaggaagaagatgatggatgcccagtataaatgctacgaccggatgcagcagctccccgcctaccagggagagggcccttattgtaacagaacctgggacgggtggctgtgctgggatgatacaccagctggggtgctttcttaccagttctgcccggattactttcctgacttcgatcccagtgagaaggtgacaaaatactgtgatgagaagggtgtgtggttcaagcatccagaaaacaaccgtacgtggtctaattacactatgtgcaacgccttcacaccagagaaactcaagaatgcatacgtgctgtactatctggccattgtgggacatagtctctccatctttacactcgtgatatcactggggattttcgtgtttttcagatccctgggctgccagcgcgttactctgcataaaaacatgtttctaacttatattctgaatagcatgatcatcattatacatctggttgaagtcgtgcccaatggagagctggtgcggcgcgatcccgtatcctgcaagatattacactttttccatcagtacatgatggcctgcaactatttttggatgctatgtgaggggatttatctgcataccctgatcgtggtagcggtgttcaccgaaaaacagagacttcggtggtactacctgcttgggtgggggttcccattggttcctaccactatacatgcaatcactcgcgctgtttattttaatgacaactgctggctgtcggtggagactcacctgctatacataattcacggacctgttatggccgcccttgttgtgaatttttttttccttttaaacatagtgcgtgtcctcgtgaccaaaatgcgcgagacccacgaggccgaatcccacatgtacttaaaggccgtgaaggccactatgatcctggtgccacttctgggtatccaattcgtggtctttccgtggaggccctctaataaaatgctgggcaaaatctacgactatgtaatgcatagcctaattcacttccaagggttctttgttgctactatctactgcttttgtaacaacgaggttcaaaccaccgtgaaaaggcagtgggcccagtttaagattcagtggaatcaacggtggggaagaagaccctccaatcgcagcgctcgcgcagcggctgcagccgccgaggccggcgatattccaatctacatttgtcatcaggagctaagaaatgaaccagcaaacaatcaaggcgaggagtccgcggagatcatcccactgaatataatcgaacaggaaagcagcgcttag

SEQ ID NO: 110314 - DNA, 825 bp, Artificial Sequence
  Description of Artificial Sequence: Synthetic coding sequence
atgcgttttacctttacgtcgagatgtttagccctcttcctgctgctcaatcatcctacacccatcctgccagcctttagtaaccagacctaccccactattgaaccaaagccttttctctacgtggtggggcgcaaaaaaatgatggatgcacagtataagtgctacgatagaatgcagcagttgccggcataccagggcgaaggtccctattgtaaccggacctgggacgggtggctgtgttgggacgacacccccgctggcgtccttagctatcagttctgtcccgactactttccagactttgaccctagcgagaaggtgacaaagtactgtgatgagaaaggggtttggttcaagcacccagaaaacaatcgtacttggtctaactatacaatgtgcaacgcgtttacaccagaaaagctaaagaacgcctacgtcctctactacctggcaatcgtggggcactctctgagcattttcaccctggttatctcactcggaatcttcgtgttctttagatcactggggtgccagcgagttacactgcacaagaatatgtttctgacctatatccttaattccatgattatcatcatccatctcgttgaagtagtgcctaacggagaactggtccgacgcgatccagtgtcctgcaagatcttgcacttcttccatcaatacatgatggcctgtaattatttctggatgctatgcgaaggaatatatctacacacgcttatcgtcgtggccgttttcactgagaaacagcgactgaggtggtactacttgctgggttgggcccctgcattccatagggactag

SEQ ID NO: 110315 - DNA, 1473 bp, Artificial Sequence
  Description of Artificial Sequence: Synthetic coding sequence
atgcgctttacttttacaagtcggtgtctcgcgctctttctcttactaaatcatccgacccctatcctgcctgcatttagcaaccaaacttaccccactatcgagccaaagccctttctgtacgttgtaggacggaagaagatgatggacgcccagtacaagtgctatgatcggatgcaacagctacctgcatatcagggcgaaggaccgtattgcaacagaacttgggatgggtggctctgttgggatgatactcctgcgggtgtactctcttatcagttctgccctgattacttccctgattttgatccctccgagaaagtcactaaatactgcgacgaaaaaggtgtctggttcaaacatcctgagaataatagaacgtggtccaattacacaatgtgtaatgcctttacacccgagaagttgaagaacgcctacgtgctttattacctagccatagtaggccatagcctgtcaatcttcacgctggttatcagcttagggatctttgtcttcttcagaaagctgacgacgatttttcccctgaactggaaataccgtaaagccctgtcactcgggtgccagagagtcacattgcataaaaatatgttcttaacctatattctgaatagtatgatcatcataattcatttagtggaagtagtgcctaacggagaactggtgagacgcgatcctgtgagctgcaagatcttgcattttttccatcaatatatgatggcttgtaactacttttggatgctgtgtgaaggaatctaccttcatactctcatcgtcgtagctgtgtttactgagaagcagaggcttcgctggtactacctcctgggttggggttttccgctcgtccccacaaccattcacgcaataaccagggccgtgtactttaacgataactgctggctcagcgtcgagacacacctgttatacattattcacggcccagtgatggccgcactggtcgtcaacttcttcttcctcctgaatattgttcgtgtgctggtgacaaaaatgagagagactcacgaagccgaaagccatatgtacttaaaggcggtgaaagccactatgatcctggtgcccctcctggggatccagttcgtggtatttccatggcggccatccaacaagatgcttggaaagatttatgactacgtgatgcactcccttattcactttcagggcttcttcgtggctaccatctattgtttttgtaacaatgaagtccagaccacagttaagagacagtgggctcagtttaagattcaatggaatcagcggtggggcagaaggccatctaatagatcagcgcgggctgcggctgccgcagccgaagccggcgacatccctatttatatttgccaccaggagctgcgtaacgaacctgcaaataaccagggcgaggagtctgccgagatcatccccctgaatatcatagagcaggagtcttcagcttag

SEQ ID NO: 110316 - DNA, 873 bp, Artificial Sequence
  Description of Artificial Sequence: Synthetic coding sequence
atgcgctttaccttcacaagtcggtgcctggccctttttctactcctgaaccatccaactccaatcctgcctgcattcagtaatcagacatatcccaccattgaaccaaagccattcctgtacgtggtaggcaggaaaaaaatgatggacgcccagtataagtgctacgacaggatgcagcagctgccggcctaccagggagaaggcccatactgtaacagaacctgggatggctggttatgttgggatgatacaccagcaggagttctgtcctatcagttctgtccagattactttccggatttcgatccttccgagaaagtcactaaatattgtgatgaaaagggtgtgtggtttaaacacccggagaacaaccgtacatggtcaaactataccatgtgcaacgcattcacacccgagaagctgaaaaatgcatacgtgctgtattacctagctattgttggacactctctgtcgatctttacactggtcatttctctcggaatttttgtgttctttagaaagttgacaacaattttcccccttaattggaaatacagaaaagccctgtcgcttggttgtcaacgcgtgactctgcacaaaaacatgttcctgacatacattttgaattccatgataattatcatacatttggtcgaggtcgtcccgaacggtgagctagtccgccgggacccagtgagctgtaaaatcctgcacttcttccatcagtacatgatggcgtgcaattacttttggatgctatgcgaaggaatctacctgcacactctcatcgtcgtggccgtgttcactgaaaaacaacggctgcgctggtactacctcttgggttgggcccctgcttttcaccgcgattag

SEQ ID NO: 110317 - DNA, 1425 bp, Artificial Sequence
  Description of Artificial Sequence: Synthetic coding sequence
atgcggttcacatttaccagtagatgcttggcactgtttctgttgttgaaccaccctactcccattctgcctgcctttagtaaccagacttatcccaccatcgagcccaaaccctttttatacgtggtcgggagaaagaagatgatggatgcccagtataaatgctacgataggatgcagcagctgccagcttaccagggcgaggggccctattgcaaccggacctgggatgggtggctttgttgggacgacacacctgccggcgtactcagctatcagttctgtcccgattatttcccagatttcgatccttctgaaaaggttactaagtactgtgatgagaagggcgtgtggttcaaacaccccgagaataatcgtacttggagtaactataccatgtgcaatgctttcacgcccgagaagctgaagaacgcttacgtgttgtactatttagcaatcgtgggtcattctctgagtattttcacccttgtgatttctttgggcattttcgtgttcttccgaagcctgggatgtcagagggtgaccctgcataaaaatatgttcctgacatacattctgaacagcatgatcataattatccatctggtcgaggtggtcccaaacggtgaacttgtacggcgcgaccccgtgagctgcaagatcctgcatttcttccatcagtatatgatggcctgcaattatttctggatgctgtgcgagggaatttatctgcacacattgattgtcgtggccgtgtttaccgaaaaacagcggctacggtggtattacctgcttggctgggggttccccctggttcctactacaatccacgcgattacgcgggcggtttattttaatgataactgctggctatccgtagagacccatctattatatataatccacggtcctgtcatggctgctctggtcgtgaactttttctttctcctgaacatcgtcagagtcctggttacaaagatgagagagactcatgaggccgaatcccatatgtatctgaaagctgttaaagccacaatgattcttgtgcccctgctgggcattcagtttgttgttttcccatggagaccgtccaataagatgttggggaagatttacgattatgtaatgcatagtctgatccactttcaaggcttcttcgtcgcgaccatctactgtttttgtaacaatgaagttcaaacgaccgtgaagcggcagtgggctcagttcaagattcaatggaaccaacggtggggcagaaggccctccaataggtccgcccgcgcggcagccgccgctgccgaagctggcgacatccccatatatatctgtcatcaggagctgagaaacgaaccagctaataaccagggggaagaatctgccgagattattccgctgaacatcattgagcaagaatcgagtgcttag

SEQ ID NO: 110318 - DNA, 489 bp, Artificial Sequence
  Description of Artificial Sequence: Synthetic coding sequence
atgagattcacgttcacttcccggtgcttagctctttttttactcctgaatcacccaacccccatcctccctgccttcagtaatcagacctatccaacaatcgagcctaaaccgttcctctacgtggtgggtagaaaaaaaatgatggacgcacagtacaagtgctacgaccgcatgcagcaattaccggcataccagggagaaggaccatattgcaaccgcacgtgggacggctggttgtgctgggatgacacgcccgcaggagttttatcatatcagttctgccccgactactttcccgatttcgatccaagcgagaaagtcactaagtactgcgacgaaaaaggcgtgtggttcaaacaccccgaaaataataggacgtggtccaattatactatgtgcaacgccttcacccccgaaaaactgaagaacgcctacgtcctctactatctggcgattgtcggacactcctgtcagttcagcccttag

SEQ ID NO: 110319 - DNA, 1386 bp, Artificial Sequence
  Description of Artificial Sequence: Synthetic coding sequence
atggaaaaaaagtgtaccctgaacttccttgtgcttcttcctttcttcatgattttagtgactgcagagttggaggaatctcctgaggatagcattcaactcggggtgacacgcaataagatcatgacagctcagtacgagtgttaccagaaaataatgcaggatcctattcagcaggcagaaggtgtgtactgtaaccgaacctgggatggctggttgtgctggaatgatgtcgctgccggtaccgaatcaatgcagttgtgccctgattattttcaagactttgacccttcggagaaagttaccaaaatctgcgaccaggacggaaattggtttcgccaccctgcgagcaatagaacttggacgaactacacccagtgtaacgtcaacacacacgagaaggtcaagaccgctctcaatcttttttatctgacaatcattggacacggcctttcgatcgcgtccctcctgatctctctggggatttttttctacttcaagtcactttcttgccaaaggatcacgttgcataagaatctctttttttccttcgtatgtaatagtgtggtaactattattcatcttacagctgtggcaaacaaccaggccctggttgcgaccaatccagttagctgcaaagtttcacagttcattcatctgtatcttatggggtgcaactacttttggatgctttgcgagggcatttatttacatactctaatagtggtcgcagtgtttgctgagaagcagcaccttatgtggtactattttctgggatgggggtttccacttatccctgcctgtatccacgccatcgctaggtctctttattataatgataattgctggatctctagtgatactcacctgctttacataatacacggacccatctgtgccgctctcctagtgaatcttttcttcttattgaacatcgtgcgggtcctcataactaaactaaaagtgacccatcaagccgagtccaacctctacatgaaggctgtgagggcaaccctgatcctcgtgcccctactcggaattgagtttgttctgattccctggcggcccgaagggaaaatcgcagaagaggtctacgattatatcatgcacatattgatgcacttccaaggcctactcgtcagcacgattttttgcttctttaatggggaggtacaggcaatcctacgaagaaactggaatcagtacaagatacagtttggtaattcattcagcaactctgaggcattacggagcgcttcctacactgtctccacaattagcgatggtcctggatactcacacgattgtccttctgagcacctcaacgggaaaagcatccatgatatcgaaaacgtcttactgaaacccgagaacctttataactag

SEQ ID NO: 110320 - DNA, 1386 bp, Artificial Sequence
  Description of Artificial Sequence: Synthetic coding sequence
atggaaaaaaagtgtactttgaattttctggtactgcttcccttttttatgatactcgtgacagctgaactagaggagtctccagaggacagtatacaacttggcgtaacacgtaataagatcatgactgcccagtacgagtgttatcagaaaattatgcaggatccgatacagcaggccgaaggcgtttactgcaatagaacttgggatgggtggctgtgttggaacgatgttgccgcgggtaccgagtcgatgcagctttgtccagactatttccaggatttcgacccatccgaaaaggtaaccaagatctgtgaccaggatggcaattggttccgacatccagctagcaacaggacctggaccaattacacacagtgcaatgtgaatacccatgagaaagtgaaaactgctttgaacttgttctacctgaccatcataggacatgggttgagcatcgcaagcctgctgatatctttgggcattttcttttacttcaagtcactgtcatgtcagcgcatcaccttgcataagaacctgttcttttcattcgtgtgcaattctgtagtgaccatcattcatctcacagccgtggctaataaccaagctttagtggctacaaaccctgtgagctgcaaagtgagccagttcattcacttatatctcatgggatgcaactatttctggatgctttgtgaagggatttacctacatactctaatagttgtggccgtttttgcagagaaacagcaccttatgtggtattacttcctgggatggggttttcccctgataccagcatgtattcatgctattgctcggagcctctattacaacgacaactgttggatttcaagcgatacgcacttactgtacattattcatggacctatctgcgctgctctgctggtaaatctcttcttcctgctgaacatcgtgcgggtgttgattacaaagctcaaggtgactcatcaagccgaatccaacctttatatgaaggcagtgcgggccactctgatcttggtgcctctgttgggaatcgaatttgtgctgatcccgtggaggcctgagggcaagatcgcagaggaggtgtatgactatattatgcatattctgatgcacttccagggcttgttggtgtccactatcttctgcttttttaatggtgaagtgcaggccattctccgccgaaactggaatcagtataagatccagttcggaaacagttttagcaacagcgaggccctgagatctgcttcctatactgtgtcaacaatctccgacggtcctgggtacagccatgactgcccatcagaacaccttaatggaaaaagtatacatgacattgagaatgtgttgttgaagcctgagaatttatataattag

SEQ ID NO: 110321 - DNA, 1386 bp, Artificial Sequence
  Description of Artificial Sequence: Synthetic coding sequence
atggaaaagaagtgcaccctcaacttcctggtgctccttccatttttcatgatattagttaccgcagagctagaggaatcccccgaagacagcatccagcttggggtaacccgcaacaaaataatgaccgcccagtatgaatgctaccagaagatcatgcaagatccaatacaacaagccgagggggtctactgtaataggacatgggatggctggctgtgttggaatgatgtggcagcagggactgagtccatgcaactctgtcctgattactttcaagattttgatcccagcgagaaggtaaccaagatatgcgatcaggatggcaattggttcaggcatccagcaagcaataggacctggactaactacacccaatgtaacgtgaacactcatgagaaagtgaaaaccgccctaaatctcttttaccttacaatcatcgggcacggcttatccatagcttccctgctgatctctttagggatattcttctatttcaagagtcttagttgccagaggatcaccctccacaagaatctttttttctctttcgtttgcaattcggtcgtgacaatcatacacctgactgcagttgctaacaatcaggccctggtggccacaaatccggtcagctgcaaggtatcccagttcattcatctgtacctgatgggctgcaattacttctggatgttgtgcgaggggatctaccttcatactctcattgtagtggctgtctttgccgaaaagcagcatttgatgtggtactacttcctcgggtggggcttcccccttatccctgcttgcattcacgccatcgcaagaagtctgtattataacgataattgctggatttccagcgacactcacctactgtatattattcatggtcctatctgcgccgcactgctggtgaatcttttcttcttactaaatatcgttcgagtactcataactaaactgaaagtgacacatcaggctgagagtaacttgtacatgaaggccgtgagggcaacactgattctggtcccgttgctggggattgagtttgtgctcataccctggaggcccgaagggaagatcgccgaggaggtttatgactatatcatgcatatccttatgcactttcaaggtctgttggtatctaccatcttttgtttcttcaatggcgaggttcaagccatcctaagaagaaactggaatcagtataagatccagttcgggaacagcttcagcaactccgaggccctccgtagcgcttcttacactgtgagcaccatctctgacggtcccggatatagtcatgactgtccctctgagcacctgaacggaaagtctattcatgacatcgaaaacgttctgcttaagcccgagaatctctacaattag

SEQ ID NO: 110322 - DNA, 114 bp, Artificial Sequence
  Description of Artificial Sequence: Synthetic coding sequence
atggaaaagaagtgcacgctgaatttcctagtgttactacccttctttatgatcctggtcaccgctgaactggaggagtctcccgaagattcaatacagctcggcgtgacttag

SEQ ID NO: 110323 - DNA, 237 bp, Artificial Sequence
  Description of Artificial Sequence: Synthetic coding sequence
atggaaaagaagtgtacacttaacttcctggtgctcctgccattcttcatgatcctggtgaccgcagaactggaagagagccctgaggattcaattcagctgggagtcacaaggaataagattatgaccgcgcagtatgagtgctatcaaaaaattatgcaagaccccatacagcaagctgaaggcgtgtattgcaatagaacatgggacggctggctttgctggaacgacgtgtag

SEQ ID NO: 110324 - DNA, 426 bp, Artificial Sequence
  Description of Artificial Sequence: Synthetic coding sequence
atgggttttcagaaattcagcccgtttctggccctgtctatacttgtgctgctgcaggctggcagcctgcatgccgctccctttcgatccgcccttgaatcgagcccagcagatcctgctacattgtcagaagatgaggcgcgccttctgctggccgctctggtccagaactacgttcagatgaaagcctccgagctagagcaagagcaggagagggaaggaagctcgctggacagcccacgttcaaaaaggtgtgggaacctgtccacctgcatgctaggcacatacacccaggacttcaacaaatttcacacatttccgcagacagctattggtgtgggcgcgcccggcaaaaaacgcgacatgtctagcgacctggagagggatcataggcctcacgtgagcatgcctcagaacgccaactag

SEQ ID NO: 110325 - DNA, 426 bp, Artificial Sequence
  Description of Artificial Sequence: Synthetic coding sequence
atgggctttcaaaaatttagtccattcctggcactttcgatcctagttctgttgcaggccggctccctccacgctgccccattccgcagcgccttggagtccagccccgcagaccctgcaactctgtcagaggatgaggcccgtctgttactggctgccctggttcagaattacgttcagatgaaagccagtgaactagaacaagagcaggagcgagaagggtcctcactggatagccctagatccaagcgctgcggcaacctgtcaacatgcatgctaggaacctacacccaggactttaacaaatttcatacttttccacaaaccgcgatcggcgttggcgcacccgggaaaaaaagagacatgtcttccgacttggagcgcgatcacagacctcacaatcattgtcccgaagagtcactatag

SEQ ID NO: 110326 - DNA, 387 bp, Artificial Sequence
  Description of Artificial Sequence: Synthetic coding sequence
atggggtttcagaaattttctccctttttagccttgagcatccttgtcctgctccaggctggatcactacacgctgccccttttaggtcagccctcgagagttccccagctgaccctgctaccttatctgaggatgaggcgcgcctgcttctggccgccttggttcagaactacgtccaaatgaaagcttctgaactcgaacaggagcaagaaagagaaggctcacggatcatcgcacaaaagcgggcctgcgatactgctacttgcgtgacacacagactcgccggacttctctctcggtccggtggtgtggtgaagaacaactttgttcctactaacgtcggcagtaaggccttcggtcggaggaggcgagacttacaggcatag

SEQ ID NO: 110327 - DNA, 426 bp, Artificial Sequence
  Description of Artificial Sequence: Synthetic coding sequence
atgggcttccaaaaattttcaccttttctggctttgagcattctggtcctgcttcaggcaggaagcctgcacgccgccccatttaggtcagcactcgaatcgagcccagccgatcccgccactttatccgaagatgaggcaaggctgttgctggctgcacttgtacagaactatgtgcagatgaaggcgagtgaactggagcaggaacaggagcgagagggctcctcacttgactcccctcgtagcaagcggtgcgggaatttaagtacctgcatgcttggtacttacacacaggactttaacaagttccacaccttcccgcagacggctatcggagtgggggctccaggtaagaagagagatatgtcttccgaccttgaacgagaccatcgtccccacgtcagtatgccccaaaatgcaaactag

SEQ ID NO: 110328 - DNA, 387 bp, Artificial Sequence
  Description of Artificial Sequence: Synthetic coding sequence
atgggcttccaaaagttttcccctttcctggcactgtcaatcctggtgcttctgcaggccggaagtctccatgctgctccctttcgtagcgcattagagtccagtcccgccgatcctgcaaccctgtctgaggacgaggctagactcctactggcagctctggtacaaaattatgtccaaatgaaggctagcgagctggaacaggaacaggaacgcgaggggtccagaattatcgctcagaaacgggcttgcgatacagccacctgtgttacccaccgtttggctggcctgctgtcaaggagtggaggcgtcgtgaagaataactttgtcccaaccaacgtcggcagcaaggcctttggacgcaggcgccgggacttacaggcctag

SEQ ID NO: 110329 - DNA, 384 bp, Artificial Sequence
  Description of Artificial Sequence: Synthetic coding sequence
atgggctttcgaaagttttcccccttcctggctctgagtatcctggttctctaccaggctgggagcctccaggcggctccctttagaagcgcgctggagagcagccctgatcctgcgacactgagtaaggaagatgcccggctcctgctggcagcccttgtccaggactacgtccagatgaaggccagtgagcttaagcaggagcaggaaacgcaggggtcctcatctgcagcccagaaacgtgcttgtaatacagcgacctgtgttacacacagactggctggactcctgtcacggtctggaggcatggtgaagagtaactttgtccccacaaatgtgggcagtaaggcattcggaaggaggaggagagacttgcaggcatag

SEQ ID NO: 110330 - DNA, 417 bp, Artificial Sequence
  Description of Artificial Sequence: Synthetic coding sequence
atgaaaaaagaagcaaatttgcagcgaggaggtatgggcttccgcaagttcagtccattcctggccctctccatcctcgtcttatatcaggcaggcagtctgcaggccgctccttttcggtcagccctggaatccagcccagatcccgctacactttccaaagaggatgctagattgctacttgcagctctggttcaggactatgtccagatgaaagcgtcagagctcaagcaagagcaagagacgcagggatcttctagtgctgctcaaaagagggcttgcaatacagcaacatgcgtcactcaccgactggccggcttactgagtcggagcggaggcatggtgaaatccaacttcgttcccacaaatgtcgggtcaaaggcctttggaagaaggagacgggatctgcaggcctag

SEQ ID NO: 110331 - DNA, 384 bp, Artificial Sequence
  Description of Artificial Sequence: Synthetic coding sequence
atgggattcagaaaattcagcccatttctggctttgtctatcctggtactgtatcaggcaggatcactgcaagccgcccctttcaggtccgcactggaatcttcccctgatcccgcaacactgtccaaagaggacgccaggctgttacttgccgcattggtgcaggactatgtccagatgaaggccagcgagctgaagcaagagcaggagactcagggctcttcctctgccgcccagaaaagggcttgtaacaccgccacgtgcgtgacccacaggctggccggactcctgtcgaggagcggagggatggtgaagagcaatttcgtgccaactaatgtcggctccaaagccttcggacggagaaggcgcgatttgcaggcatag

SEQ ID NO: 110332 - DNA, 1206 bp, Artificial Sequence
  Description of Artificial Sequence: Synthetic coding sequence
atgccagtgcagctctcagaacaccctgagtggaacgagagcatgcattctctgaggatctccgtaggaggcctgcctgttctagcctctatgactaaagcagctgacccacggtttcgccccaggtggaaagttatactaacctttttcgtgggggcggcaatattatggttgttatgttcccatcggcccgcaccagggcgccctcccacccataatgctcacaactggaggctcggccaggctccagcgaactggtataacgacacttacccattgtctccaccacagagaacacccgccggcattcgctatagaattgccgtgatagcagatctggacacagagtctagggcccaggaggagaatacgtggttctcctaccttaagaaggggtatctcactttgagtgactcaggggacaaagtggcagtagagtgggataaagatcacggcgtcctagaaagccacctggctgagaagggacgaggcatggaactgtctgacttgatcgtgttcaatggcaagctttactccgtggacgatagaacaggggtcgtctatcagatagagggctcaaaagcagtcccttgggtgatactcagcgacggtgatggcacagtggaaaagggcttcaaggctgagtggcttgcggtgaaggatgagagactgtatgtcggaggcttaggcaaggaatggaccacaaccactggggatgtcgtgaatgaaaacccagagtgggttaaggtggttggctataaagggagcgtggatcatgagaactgggtgtctaactataatgccttacgtgccgcggctggcatccagcctcccgggtatctgattcatgagtcggcatgttggtctgacactctgcaacggtggtttttcctccctcgaagagcctcccaggaacgatattcggagaaagacgatgagaggaaaggcgcgaaccttctactgtccgcatctccagatttcggagacattgccgtgagccacgtcggtgctgtcgtaccaactcacggattctcctccttcaaatttattccaaacacagatgatcaaattatcgttgccctgaagtccgaagaagactctggcagagtcgccagctacattatggctttcactctcgacggccgcttcctgcttcctgaaactaagatcgggtccgtgaagtacgaaggcatagagttcatctag

SEQ ID NO: 110333 - DNA, 1053 bp, Artificial Sequence
  Description of Artificial Sequence: Synthetic coding sequence
atgcccgttcagttgagtgaacatccagaatggaacgaaagcatgcactctttacgcatctcggtgggtgggctcccggtacttgccagtatgaccaaagcagccgatcccaggttccggccccggtccccacctcagcggacccctgccggaattaggtatagaattgcggtgatcgcggatctcgacaccgagagcagggcccaggaggagaatacttggtttagttacctgaaaaaaggatatttgacgctctctgatagcggcgataaggtggctgtggagtgggataaggaccacggcgtgctagagagtcacctggccgagaagggacgaggcatggagctctcagatctaattgtgttcaacggtaaactatactcagtggacgacagaaccggcgttgtctatcagatcgagggatcaaaagcagtgccctgggtcatcctgtcagatggggacggtacggtcgagaagggattcaaggccgagtggctggcagttaaggatgaaaggctctacgtgggtgggctgggaaaagagtggactaccacaactggggatgtagtcaatgagaacccggaatgggtcaaagttgttgggtacaaaggaagcgttgatcacgaaaactgggttagcaactacaatgcactgcgcgcagctgccggtatccaacctcccggttatcttatacatgaaagcgcctgttggagtgatacattgcagcgctggtttttcctaccacgtagggctagtcaggagcggtatagtgagaaggacgatgagaggaagggagcgaacctgttactgtccgcaagtcccgacttcggagatattgcagtgtctcatgtgggcgcagttgttcccacccatggctttagtagtttcaaattcatcccgaataccgacgaccagatcatcgttgctttaaagagtgaggaggatagtggcagagtggcttcttatattatggcttttacactcgatggtaggtttctgctgcccgaaactaaaataggttccgtcaagtatgaggggatcgaatttatctag

SEQ ID NO: 110334 - DNA, 1206 bp, Artificial Sequence
  Description of Artificial Sequence: Synthetic coding sequence
atgcctgtacaactgagcgaacaccccgaatggaatgagtctatgcactcactccggatttctgtcggtggcctgcctgtgctagcctcgatgacaaaggctgcagacccccggttccgcccccgatggaaggtcatactgactttctttgttggcgccgcgatattatggctgctgtgttcgcatcggcccgctccgggtaggcctcccactcacaatgcacacaactggaggttgggccaggctccagctaactggtataatgatacataccccttatcacccccccagcggacaccggcaggcatcagatatcggatagccgtcatcgctgacttggataccgagagccgggcccaggaggaaaacacatggttctcttacctgaagaaaggatatctgaccctgtctgactccggagataaggtcgcggtcgagtgggataaggaccacggcgtgctggaatctcatctcgccgaaaaaggacgcggcatggagctgtccgacctcattgtgttcaatggcaagttgtattcagtcgatgataggacgggagtggtataccagatcgagggatctaaggcagtgccctgggtgatactgtctgacggggatggaaccgttgagaaggggtttaaggctgaatggctggccgtgaaagatgagaggttatacgtggggggtctggggaaagaatggaccacaactaccggggatgtggtaaacgagaaccccgagtgggtcaaagtggtgggatacaagggctctgtcgaccacgagaattgggtgtcgaattataatgccctgcgcgcggccgccggaatacagccccctggttacctaatccatgagtcagcctgttggtcggacacactgcagagatggtttttcctgccccgacgggcttcccaagaacgttatagtgaaaaagacgatgagagaaagggtgctaatctacttctgtcagccagccccgacttcggtgacattgcagtaagccatgtaggtgccgtagttcctactcacggtttcagcagtttcaaattcatacctaataccgacgaccagatcattgtggccctgaagtcagaggaagatagcggccgtgtggctagctacatcatggcgttcacattggatggaagatttctcctccctgaaaccaaaatcgggtccgttaagtacgaggggatcgagtttatctag

SEQ ID NO: 110335 - DNA, 738 bp, Artificial Sequence
  Description of Artificial Sequence: Synthetic coding sequence
atgccggtgcagctttcagagcatcctgagtggaacgaatcaatgcacagcctgaggatctccgtgggggggttaccagtactcgcatccatgacaaaggctgcagaccccaggtttcggccgcggtggaaagtcatcctcaccttcttcgttggggccgccattctgtggctcctgtgttcccatcgacccgcacccgggcgccctcctacccacaatgcacacaactggcgcttgggacaggcacctgcaaactggtataatgacacctatcctctgagtcccccccaacgaacacctgcgggaatcagatatcgcatagcagtaattgctgacttagatacagagagccgggctcaagaggaaaacacttggtttagctacttaaaaaagggttatctgaccttatccgacagtggtgacaaagtggcagtcgaatgggataaagatcatggagtccttgagagtcacctggccgagaaggggcgcggtatggaactcagtgacctgattgtgtttaatggaaaactgtatagcgtagacgaccgcacaggcgtcgtgtaccaaattgaaggatccaaggccgtgccctgggtgatcctttcggatggggacggaaccgtggagaaaggcgtcggcggggaatgggaggccgtgagagagatagtgaggaagagatggagactggtgaaacaggtctcacacgtgggcgtcttgggtcagtggatccaaaggtag

SEQ ID NO: 110336 - DNA, 663 bp, Artificial Sequence
  Description of Artificial Sequence: Synthetic coding sequence
atgggtaattgtgccaaacggccctggcggcgcggtccaaaagacccactgcagtggcttggaagcccgcctcgcggcagttgccccagtccaagctcttctcccaaggagcagggagaccccgcccctggcgtacagggttactccgtgctgaacagcctggtagggcccgcttgtatctttctaaggcccagtatcgcagccacacagctcgatagggagttaaggccagaggagattgaagagctgcaggttgcattccaggaatttgatcgggaccgcgatggttatatcggatgccgggagcttggggcttgcatgcgcaccctggggtacatgccaactgagatggagttgattgagatttcccagcagatctcgggggggaaagtcgattttgaagacttcgtggagctgatgggacctaaactgctggcggagaccgccgatatgattggcgtgagggagctgcgagatgcatttagagagtttgatacgaatggtgacggacggatatcggtgggtgagctgcgcgctgccctaaaggcccttctgggagagcggctgtcccagcgcgaggttgatgagattctccaggacgtcgatctgaacggagacggtctagtggactttgaagagttcgttagaatgatgtcgcgctag

SEQ ID NO: 110337 - DNA, 1026 bp, Artificial Sequence
  Description of Artificial Sequence: Synthetic coding sequence
atgccctttccattcggcaagtcccacaagagtcccgcggacattgtgaagaatctgaaggagagcatggctgtgctggaaaagcaggacatttcggataaaaaggccgaaaaggcaaccgaggaggtatccaaaaacctggtcgcgatgaaagagatcttgtatggaacgaatgagaaggaacctcaaacggaggccgtggcccagcttgcgcaagagctgtacaacagtggcctattgagcactctggtggcagatttacagttgattgattttgaaggcaagaaagacgtagcacaaatctttaataatatcctgagacgccaaatcgggactaggactcccacagtagaatatatctgcacccagcaaaatattctcttcatgttgcttaagggctatgagagcccggagatcgcattaaattgcggcatcatgctgcgggagtgtatccgccacgagcctcttgcaaagatcatcctatggtccgagcagttttatgacttcttccggtacgtggagatgagcaccttcgatattgcctctgatgccttcgctaccttcaaggacctcctcacacgtcacaaactgctgtctgccgagtttctcgagcaacactacgaccgttttttttcggagtatgaaaagctgttgcactcggagaactatgtgacaaaaaggcagtccctgaagttgcttggtgagttattgttggatcgtcacaattttaccataatgacgaagtatatttctaaacctgaaaatctgaaactgatgatgaacctcctgcgtgacaagagcagaaacatacagttcgaagcctttcacgttttcaaggtgttcgtcgccaacccgaataagacacagccaatcctggacatacttctaaaaaaccaggccaaactgatcgagtttcttagtaaattccagaatgataggacggaggatgagcagttcaatgatgaaaaaacctaccttgtgaagcagatccgggatctaaagaggccagcacagcaggaagcttag

SEQ ID NO: 110338 - DNA, 1026 bp, Artificial Sequence
  Description of Artificial Sequence: Synthetic coding sequence
atgcctttcccatttgggaagagccacaaaagtcccgctgacattgtgaagaacctgaaagagtccatggccgtactggagaagcaggatatttcagacaagaaggctgaaaaagcaacagaggaggtctcaaaaaatctggtggctatgaaggaaatactctatggaaccaatgagaaggagccccagacagaggcagtggcgcagcttgcccaggaactgtataacagcggactactgtctactctagtggccgacctgcagttgatcgacttcgaggggaagaaagatgtggcccaaatctttaacaacattcttcgaagacagatcggaacccgtacccctactgtggagtatatctgcacgcagcaaaatattttattcatgctgctgaaagggtacgagtccccagaaattgcgttgaattgtggtattatgctccgcgaatgtatacggcatgagcctctcgccaagataattctgtggagtgaacagttttatgatttttttcgatacgttgaaatgtccacatttgacatagcctctgacgcatttgcaaccttcaaagacctcctgactcgacacaagcttttgagtgcagagtttttggagcaacactacgacagattcttttccgaatacgaaaaactgctccatagtgagaactacgtgaccaagagacagagtttgaaacttctaggtgaactactcctggacagacacaattttacaatcatgactaaatacatctctaagccggagaacttgaagctgatgatgaatctgctgcgtgacaagtctaggaatatacagttcgaggcattccacgtgttcaaagtgtttgtcgcaaatccaaacaagactcaaccgatcctcgacatactgctgaaaaaccaggccaaactgattgagtttctgagtaaattccagaatgacagaactgaggacgaacagttcaatgatgaaaaaacatatttggtgaagcaaatccgagatctcaagcggcctgcacagcaggaggcatag

SEQ ID NO: 110339 - DNA, 1026 bp, Artificial Sequence
  Description of Artificial Sequence: Synthetic coding sequence
atgcctttcccctttggcaagtcccacaagagtccggccgatatagtcaaaaatctgaaggaatctatggctgtgctcgagaagcaggacatctctgacaaaaaagccgaaaaggccactgaggaagtgagtaaaaacctggtggctatgaaggagatactctatggtactaacgaaaaggaaccacagactgaagctgtcgcgcagctggcgcaagaactgtacaatagtgggctcctcagtacacttgtggccgacttgcagttgatcgatttcgagggcaagaaggatgttgcgcaaatcttcaacaatatacttcgacgccagatcgggacccggacacccactgtggagtacatctgcactcaacaaaatatcctcttcatgctgcttaaaggctatgagagtccagaaatcgcacttaactgtggaatcatgctgagggaatgcattaggcatgagccactggccaaaataatattgtggagtgagcagttttatgattttttccgatacgtggagatgtcaacattcgatatagctagtgatgctttcgctacatttaaggatttacttacccggcacaaactgctgtcagcagaatttctggaacaacattatgaccgattctttagcgagtacgaaaaactgctgcattccgaaaactacgttaccaaacgccagtctttaaagctcctgggcgagcttttgctagatcgccacaacttcacgatcatgacaaaatacatctcgaaacccgagaacttgaagctgatgatgaacctcttgagagacaagtctcggaacattcagtttgaagctttccacgtattcaaggtgtttgtggctaatcctaacaaaactcaacccattttagacattctgctgaagaatcaagccaagctgattgagtttctctcaaaatttcagaacgatagaacagaagatgaacagttcaacgacgagaaaacgtacctggtgaaacagattcgtgatctcaaacggcccgcccagcaggaggcctag

SEQ ID NO: 110340 - DNA, 1014 bp, Artificial Sequence
  Description of Artificial Sequence: Synthetic coding sequence
atgaaaaaaatgcccctgttcagtaagtcccacaagaaccctgcggaaattgtgaaaatcctaaaggataatctggccatcctggagaaacaggacaagaagaccgacaaggcctcagaggaagtatctaaaagtttgcaggccatgaaggagatcctgtgcgggaccaatgagaaggagcctcccacagaagctgtcgctcaactggctcaggagctttatagcagcggactgctcgtcactctcatcgccgaccttcagctcatcgatttcgagggcaaaaaggacgtgacccaaattttcaacaacatcctccgccgacagattggaactcgctccccgacggtcgaatatattagcgcccacccacatatcctttttatgctactcaagggctacgaggccccccagatcgctttacgttgtggcatcatgttacgcgaatgtatcaggcacgaacccctggccaagataattctgttctccaaccaattcagagatttcttcaaatacgtggaactatccaccttcgacatcgccagtgatgcctttgccaccttcaaagatctccttacaagacataaagttctcgtagccgattttctcgagcagaattatgacactatctttgaggattacgagaagctcctccagagcgaaaactacgtgaccaagcgacagtctctgaaacttttgggtgaactgatccttgaccgccacaacttcgctattatgacaaagtacattagcaagccggaaaacctgaaacttatgatgaaccttctccgcgataagtcaccgaacatccagtttgaagcctttcacgtgttcaaggtattcgtggcatcccctcacaaaacacagcccattgtagaaattctgctgaaaaatcagcccaagctcatcgaatttctctcaagcttccagaaagaaagaaccgatgatgagcaatttgctgatgagaaaaattatttgatcaagcagattagagatctgaaaaaaacagcaccatag

SEQ ID NO: 110341 - DNA, 1014 bp, Artificial Sequence
  Description of Artificial Sequence: Synthetic coding sequence
atgaaaaagatgccactgtttagtaaatcccacaagaaccctgcagaaattgtcaaaatcctaaaggataacctggctattctggagaagcaggacaagaaaacagacaaggctagcgaggaagttagtaaatcgctgcaagcaatgaaagagatcctctgtggaacaaacgaaaaagagccccccactgaggctgtcgcccagctggcacaagaactgtactcctccggcctactagttacgttgattgctgacctccagctcatcgacttcgaagggaagaaggacgtgacccagatcttcaacaatatactccggcgccagatagggacaagaagcccgactgtggagtacatctctgctcatccccatatattgttcatgctccttaaaggatacgaggctccccaaatcgcgctgcgatgtgggattatgctacgggagtgcatccgtcacgagcccctagctaagattatcttgttcagtaatcaattcagagactttttcaaatacgtggagctaagcacattcgatatcgcttctgatgcatttgcgacatttaaggacctgctcactcgccacaaggtgctagtggccgatttcctggagcaaaactacgacactatttttgaggattatgagaagcttctgcagtctgagaactacgtcaccaagaggcagagcctgaagctcctgggcgaactcattttagacagacataattttgcgatcatgaccaaatacatctccaagccggagaaccttaagctcatgatgaaccttctgcgggacaagagcccaaatattcagtttgaggcttttcacgtgtttaaggttttcgtcgcatcgccccataagacccagccgattgttgaaattctattgaagaaccagccaaaactgatcgaatttctcagctccttccaaaaggaaaggaccgatgatgagcaattcgccgacgagaaaaattatctgattaagcagattcgagatctcaagaaaacggccccctag

SEQ ID NO: 110342 - DNA, 945 bp, Artificial Sequence
  Description of Artificial Sequence: Synthetic coding sequence
atgcccctcttttccaagagtcacaagaatcccgcggagatcgtgaaaattctgaaggataatctggccatcttggagaagcaagacaaaaaaactgataaggccagcgaggaggtcagtaagagtctgcaagccatgaaagagatcttgtgcggaacaaacgaaaaggaaccccccactgaagccgtggctcaactagcccaggagctctactcttccggattactggtcacactgattgcagatctgcagttgattgactttgaaggtaagaaggatgtcactcaaatattcaacaacattctaaggcggcagattggaacgagaagtccgactgtagaatacatttctgcacatccccatattctgtttatgctgctgaaaggctatgaggcaccacaaattgctctgcgctgtggcatcatgctcagagaatgcattcgacacgagccactcgccaagataattcttttcagtaatcagttccgcgatttttttaaatatgtggaattgagcacctttgatatcgcttctgatgccttcgcaacattcaagatattcgaagactatgaaaagctgctgcagagcgagaactacgtgacaaaacgccagagccttaaacttctcggggaactgattctggatcggcacaatttcgcaattatgaccaagtacattagcaagcccgagaatctcaaactcatgatgaatctcctgagggataaatcacccaatatacagttcgaggcctttcacgtgttcaaggtttttgtggcgtccccacataagacacagcccatagtcgagattctgctcaaaaatcagcccaagttaattgagttcttaagtagctttcagaaggagagaacagacgacgaacagttcgccgacgaaaaaaactacctcatcaagcagatccgcgatctgaagaagacagccccttag

SEQ ID NO: 110343 - DNA, 282 bp, Artificial Sequence
  Description of Artificial Sequence: Synthetic coding sequence
atgaaaaaaatgccattattctcgaaatctcacaagaaccctgcagagattgtaaaaatcctgaaggacaatcttgcaatcctggagaaacaggataagaaaactgataaggctagcgaggaagtaagtaaatccctgcaagcgatgaaggagatactgtgtgggacgaatgagaaagagccacccacagaggctgtagcacagcttgctcaagagttgtattcgagcgggttactcgtgacgctgattgctgacctacagttgattgacttcgaggtatag

SEQ ID NO: 110344 - DNA, 1014 bp, Artificial Sequence
  Description of Artificial Sequence: Synthetic coding sequence
atgaagaaaatgccccttttctcaaagtcacacaagaaccccgctgaaattgtcaagatcttgaaggataatctcgccatcttagaaaagcaggacaaaaagaccgacaaggcatccgaggaagtgtctaagtctctgcaagcaatgaaggaaatcttgtgcgggacgaacgagaaggagccccctacagaagcggtggcccaactagcacaagaactgtacagttccggcctgctggtaactctaatcgcagacctgcagctgattgattttgagggaaagaaggatgtaacccagatttttaataatattttgaggaggcagattggaacccgaagcccaaccgtcgagtacatttccgcccatccacatatcctgtttatgctgttgaagggctatgaagctccccagatcgcgctcaggtgtgggatcatgctgagagagtgcattcgacatgaacctttggctaagatcattctattcagcaaccagtttcgggacttctttaagtatgtggagctctccacattcgacatcgcatcagatgcctttgccaccttcaaggatctgctgactaggcataaagtgcttgtggccgatttcctcgaacaaaattatgataccatcttcgaagattatgaaaagttgctgcagtctgaaaactacgtcacgaaacggcaatcccttaaactcctcggggagctaattctggatcggcataactttgctattatgacaaagtacatttccaaaccagagaacctcaagctgatgatgaatcttctccgagacaaaagccctaatatccaatttgaggccttccacgtgttcaaagtttttgttgcaagtccacataagacccaacctatcgttgagattttactaaaaaaccagccaaaattgattgagttcctctcatcattccagaaggaacgtacagacgacgaacagtttgccgatgaaaagaactatttgattaaacagatccgagatctcaagaagaccgcaccttag

SEQ ID NO: 110345 - DNA, 1014 bp, Artificial Sequence
  Description of Artificial Sequence: Synthetic coding sequence
atgaagaaaatgcccctcttcagcaaatcccacaagaatcccgctgagattgtaaagatccttaaggacaatctagctattctcgaaaaacaagataagaagacagacaaagcatcagaggaagtcagcaagtcactccaggctatgaaggagatcctctgtgggacaaatgaaaaagagccacctaccgaagccgtcgcacagctggcccaggaactctactctagtgggctgctggtcacacttatcgcggacctgcaactgatcgattttgagggcaagaaggatgtgactcaaatctttaataatatattgcgccgccagatcggcacaaggagtcccacagtggagtacatttccgcccacccccacattctgtttatgctacttaagggatacgaagcacctcaaatcgccctgagatgcgggatcatgctccgagaatgtattcggcatgaacccttggcaaaaatcatactgttttcaaaccagttccgcgacttcttcaaatacgttgagctgtcaacgttcgacatcgcctcagacgcttttgccaccttcaaagacctcctgactcgtcataaagtcctcgtggcggactttctcgagcagaactacgatacgatctttgaggattacgagaagctgctccagagcgagaactacgttaccaagcggcagtccctcaagcttttaggtgaattgatcctggataggcacaacttcgcaattatgacgaaatatattagcaagcccgagaatttgaagctgatgatgaacctgctcagggacaaatcgccgaatatccagtttgaggccttccatgtttttaaagtgtttgtagcatccccgcacaaaactcagccaatcgttgagatcttgctgaagaaccagcccaaattaatcgagttcttgtcatcatttcaaaaagaaaggactgatgatgagcaatttgctgatgaaaagaactacctcatcaagcagatcagagatctgaaaaagaccgctccatag

SEQ ID NO: 110346 - DNA, 387 bp, Artificial Sequence
  Description of Artificial Sequence: Synthetic coding sequence
atgaagaaaatgcccctcttctccaagtctcacaaaaacccggcagagatcgttaaaatcttaaaagacaacttagcaatactggaaaagcaggataagaagaccgataaagcttccgaggaggtgtccaaaagcctgcaggccatgaaggagatcctatgcgggaccaatgaaaaagagccacccacagaggcagtcgcgcaactggcccaggaattgtattctagcggcctgctggtgaccctgatcgccgatttgcaactgatcgattttgaaggtaaaaaagatgtgacccaaattttcaacaacattctgaggcgccaaataggcacaaggtctcccacagtagagtatatctcagcacaccctcacattctcttcatgtag

SEQ ID NO: 110347 - DNA, 567 bp, Artificial Sequence
  Description of Artificial Sequence: Synthetic coding sequence
atgaaaaagatgcctttattcagcaagagtcataaaaatcctgcggaaattgtgaaaatcctgaaggacaacctggctatcctagaaaaacaggacaagaaaactgataaggccagtgaagaggtaagtaagtctctacaggccatgaaagaaatactctgcggtactaacgagaaagaacctccaaccgaagctgttgcacagctggctcaggaattatactccagcggcttgctggtcactctgatagccgacctgcagctcatcgatttcgagggaaaaaaggatgtgactcaaatattcaataacattttgagacgtcagattggaaccaggagtcctaccgtcgaatacatatctgcccatccccatatcctcttcatgctcctgaagggatacgaggcacctcagatcgctcttcgatgcggcatcatgcttcgcgaatgtattagacacgaacctctcgccaaaatcatcctgttctctaaccagtttcgagatttcttcaaatatgtggagctgagcacttttgatattgcctcggacgcatttgccacatttaagtag

SEQ ID NO: 110348 - DNA, 828 bp, Artificial Sequence
  Description of Artificial Sequence: Synthetic coding sequence
atgaccacagaacaggcgcgtggacagcagggacccaacctggcgatcggacgacagaaaccaccagctggcgtcgttactcctaaatcagatgctgaagagcctccccttacaagaaaaaggtccaaaaaagagaggggacttcgcggaagccggaaaaggaccggaagttctggggaacagactgggccagaggctcccggatcttccaacaacccaccgtctactggcgagggccccgctggcgcacctcccgctagccccgggcctgccagctctagacagtcccaccggcaccggcctgacagcctgcatgatgctgcccagcgaacatatggtccattactgaatcgtgtcttcgggaaagacagggaattgggtcccgaggagctagacgaactccaggccgcctttgaggagtttgacacagaccgcgatggttatatctcacatcgtgaactaggggattgcatgcgcacacttggctacatgccaaccgagatggaacttctggaggtgtcccaacacatcaagatgcggatgggagggagggtggactttgaggagtttgttgaattgattggccctaagttgcgcgaggagaccgcacacatgttaggcgtaagggagctaagaatcgcgttcagagaatttgatcgagatcgtgacggcagaatcactgttgctgaactccgcgaagcagtgcctgccctcctgggggagccactagccggacccgaactggatgagatgctccgcgaggtggatctcaatggcgacggcactgtcgatttcgatgagttcgttatgatgctttctagacactag

SEQ ID NO: 110349 - DNA, 513 bp, Artificial Sequence
  Description of Artificial Sequence: Synthetic coding sequence
atgaccgagccatggctggcgctcggcacaagctggacactgccgctgcaagaccgagagcttggaccagaggagttagatgagctgcaggcagctttcgaagagttcgacaccgatcgtgacggttacatttcccatagagaactcggtgactgcatgagaacactcgggtatatgccaacagaaatggagctgcttgaagtgtctcagcacattaaaatgagaatgggcggccgcgtggactttgaggaatttgtcgaactgatcgggcctaagttgagggaagagacagcccatatgttaggggttagggaactgcggatagcctttagagagtttgatagagatcgcgatggtcgcataacagtggccgaactgcgcgaggctgtgccagccttgctgggcgaacctctggctggccccgaactggacgagatgcttcgggaggtggatctcaatggcgatggtacggtggacttcgatgaatttgtgatgatgctttcgcgacactag

SEQ ID NO: 110350 - DNA, 522 bp, Artificial Sequence
  Description of Artificial Sequence: Synthetic coding sequence
atgcagttcccgatgggcccagcctgtatttttcttcggaaaggcattgccgaaaagcagagggagcgccctttggggcaggatgagattgaagaactgagagaggccttcctcgaatttgacaaagatagagatgggttcatctcctgcaaagacttggggaatttgatgcggaccatgggatatatgcctacagagatggagttgatcgaattagggcaacagattaggatgaatctgggcggaagagtggacttcgatgacttcgtcgaattaatgacccctaagctactggctgagactgctggtatgatcggcgtacaggagatgagagatgcttttaaggagtttgacacgaacggcgatggagaaatcaccctggtggaattacagcaagcaatgcaacgtctgttaggcgagagacttacccctagggagatctcagaggtagtcagagaagccgacgttaacggcgacgggacagttgacttcgaggagtttgtgaaaatgatgagccgctag

SEQ ID NO: 110351 - DNA, 846 bp, Artificial Sequence
  Description of Artificial Sequence: Synthetic coding sequence
atggaaaagagtacagacacggatgaggacaacgtgaccagaactgagtattctgataaaactacgcagtttccctccgtctacgctgtgccagggacagagcaaaccgaagctgtgggaggactcagtagcaaacccgccacgccaaaaactaccaccccgccttccagcccacctcctaccgctgtcagtccagaatttgcgtatgtgccagcggacccagcccaactcgccgctcagatgctggccatggcaacttccgagaggggacaaccacctccatgctccaacatgtggacactctactgcctcaccgacaaaaaccagcaggggcacccctcccccccgcccgcaccaggaccattccctcaggccacactgtatctaccaaatcccaaggaccctcagttccagcagcaccctcctaaggtcacatttcctacttacgtgatgggcgatacaaagaaaacaagcgccccccccttcatccttgttggcagcaatgtgcaagaggcccaaggctggaagccccttcctgggcacgccgtggtgtcccagagcgacgtgctccgatacgtggctatgcaagtgcctatagctgtgcctgccgacgagaagtatcagaagcacactctgtctcctcagaatgccaaccctccttcaggacaggatgtgccccggccaaagagccccgtgttcctctcagtcgcctttcctgttgaggacgtggctaaaaaatcctcgggttctggagacaagtgcgcgccgttcgggtcgtatgggatcgccggggaagtcacagtgactacagcgcacaagaggcgaaaagcggaaaccgaaaattag

SEQ ID NO: 110352 - DNA, 1188 bp, Artificial Sequence
  Description of Artificial Sequence: Synthetic coding sequence
atggaaaagtccaccgataccgacgaggataacgtgacaagaaccgagtacagtgacaaaactactcagtttccatcagtgtacgccgtaccaggtaccgagcagaccgaagccgtgggggggctgtcatcgaagcccgccaccccaaaaacaacaacacccccatcttctccacctccaaccgccgtaagccccgagttcgcatacgtacccgccgacccagcacagcttgcagcgcaaatgcttggcaaagtgtcctccatccactcggatcagtccgatgttttgatggtcgatgtcgctacctccatgcccgtcgttattaaggaggttcccagctcagaggcagccgaagacgtaatggtggccgcccctctggtgtgtagtggcaaggtgctggaggtgcaggtagttaatcagacaagcgttcatgtggacctgggatctcagcccaaagagaacgaagcggagccatctactgcgagctccgtgccactccaggatgaacaagagcctccagcatacgatcaagcccccgaagtgaccctccaggctgacatcgaggtgatgagtacagtgcacatcagtagcgtgtataatgatgtccctgtgacagagggcgtagtgtatattgagcaattaccagagcagattgttatacctttcactgaccaagtagcttgcctcaaagaaaacgaacaatccaaggaaaacgaacagtctccaagagtgtcaccaaagagtgtggtggaaaagaccaccagcgggatgagcaagaagagtgtagagagtgttaaactggcacagctagaggagaacgctaagtattcctccgtttacatggaggcggaggccactgctcttctgagtgataccagcttgaaaggccagccagaggtcccagcacagctgttggatgcagagggggctataaagatcggctcggaaaagtcacttcatctggaagtggagatcaccagtattgtgtctgataataccggccaagaagaatccggcgagaacagcgtaccacaggagatggagggtaaaccagtgctaagcggcgaagctgccgaagcagtgcattccggtacctccgtgaagagcagcagcggccccttcccccccgcccctgaggggttgactgccccagaaatagagccagagggcgagagtacagccgaatag

SEQ ID NO: 110353 - DNA, 1140 bp, Artificial Sequence
  Description of Artificial Sequence: Synthetic coding sequence
atgatcagttctaagccccgcttagttgttccctacgggttgaaaactctactggagggtatctccagagctgttctgaagacaaatcccagtaacattaatcagtttgctgcagcctactttcaagagctgacaatgtaccgtggaaacaccaccatggacatcaaggatctggtgaagcagttccatcaaatcaaggtggagaaatggtctgagggtacaacgccccaaaagaagttggagtgtctcaaggaacccggcaaaaccagcgttgagtccaaagtccctactcaaatggagaagtcgaccgacaccgatgaagacaatgttacaaggacggaatactctgacaagaccacccagtttccttctgtttatgccgttcctggcaccgaacaaactgaagcagtagggggcctttcctcaaagccagccacgcccaaaaccaccacacccccctcatcccctccacctacagctgtctctccagagtttgcctacgtgccagccgatccagcccagctagcagcacaaatgcttgccatggctacttccgagagggggcagccccctccatgcagcaacatgtggacactatactgcttgacggacaaaaatcagcaggggcatccatctccccccccagccccagggcccttccctcaggctacgctctacctccccaaccccaaggacccccagtttcagcagcaccccccaaaggtaaccttccccacctacgtcatgggagacaccaagaaaacttcggcccccccatttattctggttggtagcaacgtacaggaggctcagggctggaagccactgcccggtcacgcagtggttagccagagtgacgtgctcagatacgttgcaatgcaagtgcccattgccgtcccggccgacgagaagtaccagaagcacactctctcgccgcagaacgcgaaccctccatcgggccaggacgttccaaggccgaaatctcctgtgtttctttctgtggctttcccggtggaggacgtcgccaagaagtcaagcgggtccggcgacaaatgcgcccccttcggctcgtacggtatcgcgggtgaggtaactgtaaccacggctcacaaacgaagaaaggcggaaaccgagaactag

SEQ ID NO: 110354 - DNA, 1140 bp, Artificial Sequence
  Description of Artificial Sequence: Synthetic coding sequence
atgatttctagtaagccaagactggtcgtcccttacggactaaaaaccctgctagaggggatcagcagagccgtcctgaaaaccaacccctctaacatcaaccagtttgccgctgcttattttcaggaactcacaatgtaccgcggaaatacaaccatggacattaaagaccttgtcaaacagttccaccagatcaaggtagagaagtggtccgaaggcaccactccgcagaagaagttagagtgcctgaaagagccaggtaagacctcagtggagtccaaagtgccaacacagatggagaaaagcaccgatacagatgaggataatgttactcgaacagaatactctgacaagaccacgcagttcccaagcgtttacgcagtgccaggtacggagcagaccgaggcagtgggcgggctttcctccaaaccagcaactccaaaaaccactacgcctccttcttctcctccccctacggccgttagccccgagtttgcctatgtgcccgccgaccccgcccaacttgctgcgcagatgctggcaatggctactagcgaaagaggtcaacctcccccatgttccaatatgtggacactgtactgtctgactgacaaaaaccagcagggccatccaagtccaccccccgctccaggcccattcccacaggcgaccctctatctgcccaaccccaaagatccacagttccagcagcaccccccaaaggttacttttcctacatacgtgatgggggatactaagaaaacatccgctccgccatttatccttgtcggatcaaacgtgcaagaagcacagggttggaagcctctcccagggcatgccgtcgtcagtcagagtgatgtgctgcggtacgtggccatgcaggtcccaatcgccgttccagcggacgagaagtatcaaaagcacactctgtccccgcagaacgccaatccaccctccgggcaggatgtaccccggccaaaatcccccgtcttcctctctgttgcattcccagtggaggacgtggcaaagaagagtagtggaagcggggataagtgcgctccctttggctcctacggtatcgcaggagaagtcaccgtgacgactgcgcacaagcggcggaaggcagagacagaaaattag

SEQ ID NO: 110355 - DNA, 666 bp, Artificial Sequence
  Description of Artificial Sequence: Synthetic coding sequence
atgatttcctcaaaaccacggctagtagtgccttacggattgaagaccctcctggaaggcatcagccgagcagtgctcaaaaccaacccatccaacatcaatcagtttgccgcagcgtacttccaggagctcaccatgtacagaggaaacactactatggatattaaagacctggtgaaacaattccaccagatcaaggtggagaagtggtccgaaggaaccactcctcaaaagaagctggaatgtctgaaagaacccggtaaaacgagcgtagagtccaaggttcccactcagatggagaaatctactgacacggatgaggacaacgtgaccaggacggagtactctgataaaacaactcaattccccagcgtgtacgccgtacctgggaccgaacagaccgaggcggtgggcggcctgagctccaagcccgccacgccaaaaacaactactcctccttcctccccaccccccaccgccgtctctccagagtttgcctacgtgccagcggaccccgctcagctagccgctcagatgctagaagatgtggccaagaaatcatctggatctggcgacaagtgcgctcctttcggttcttatggaatagcgggagaagtcacagtcaccactgcacacaaacggcgcaaggcagaaacggagaactag

SEQ ID NO: 110356 - DNA, 1482 bp, Artificial Sequence
  Description of Artificial Sequence: Synthetic coding sequence
atgatcagttcgaagccacgactcgtagtcccatatggtctaaagacacttctggaaggcatctctcgggctgtccttaagaccaatccatcgaatataaaccagtttgccgcagcttatttccaggagctgacaatgtatcgggggaatacaacgatggacataaaggacctcgtgaagcaatttcaccagatcaaggttgaaaagtggtcagagggcacaacgcctcaaaaaaagcttgagtgtctaaaagaacctggaaaaacgtctgtcgaatccaaagttccgacgcagatggagaaatccactgatactgatgaagacaatgtcacccggaccgaatattctgacaagacaacacaatttccatctgtctatgccgtccccggcaccgagcaaacagaagcagtgggaggattgagcagcaaaccggccacaccaaagactacgacaccacccagctccccaccgccaactgcagtgagtcccgagtttgcgtatgtgccggcagaccccgctcagttggccgcacagatgttaggtaaggtgagctcaatccactccgatcagtctgacgtgttaatggtggacgttgccactagtatgcctgtggttataaaggaggtcccctcttcagaggctgcagaggatgtgatggtggccgcccctctggtctgtagtggcaaagtgttagaagtccaggttgtcaatcagacctcagttcacgtagacctcgggagccagcctaaggagaatgaggctgagccttctaccgcatccagcgtgcccctgcaggacgagcaagagccccctgcctacgatcaggcccctgaagttaccctccaagcagacatagaagttatgagcaccgtccacatctcgtctgtttacaacgatgtgcccgtgactgagggagtcgtttatatcgaacagctgcccgagcagattgtgattcccttcacagatcaggttgcctgcctgaaggagaatgagcagtccaaagaaaacgagcagagtcctagagtctcccctaaatccgttgtagaaaaaaccactagtggcatgtcgaagaaatcggtagaatcagtgaagcttgcccagttggaagaaaacgctaagtactctagcgtgtacatggaagccgaggctacggccctgctgtccgatacttcactcaagggacagcctgaagtccccgcgcagctcttggatgccgagggcgccattaaaattgggagtgaaaagagcttgcacctggaagtcgagatcacatcgatcgtctccgacaacactggacaagaagaatccggcgaaaatagcgttccccaagagatggaaggcaagcccgtgttgtctggggaggcagcagaagctgtacattcaggtacttctgtcaaaagttcctccggaccatttccgcccgcccccgaagggcttactgctcccgaaatcgaaccggaaggggagtctacagctgagtag

SEQ ID NO: 110357 - DNA, 1428 bp, Artificial Sequence
  Description of Artificial Sequence: Synthetic coding sequence
atgatatctagcaagcctcggcttgtggtcccttacggcctgaagaccctgctggaaggtattagccgggctgtgctcaagacaaacccttccaacattaatcagttcgccgccgcttatttccaagagcttactatgtaccgagtcgagaaatggtcggaggggaccactccacagaaaaagctggaatgcctgaaagaaccaggcaaaacgtctgtagagtctaaagtacccacacaaatggagaagtcaacagacactgacgaagataatgtgacaaggaccgagtactcagacaaaacaacccaatttccctccgtttatgctgttcctggtaccgagcagaccgaagcagtcggcggcttatcttctaagcccgccaccccaaaaacaacaacacctccgtcttcaccaccaccaaccgctgtctcccccgagttcgcctacgtgcccgctgatccggcacaattggccgcgcagatgttagggaaggtgagcagcatacattctgaccagtccgacgtgctaatggtggacgtggccaccagtatgcccgttgtgatcaaagaggtgccttcttccgaagccgcggaagacgtgatggtagctgctccactcgtgtgcagcggtaaagtgctggaggtgcaggtcgtcaaccagacgtcggtacacgtggatctggggtcccagcctaaggagaacgaagcggaaccgtctacagcttcctctgtgccccttcaggacgagcaggaacccccggcttacgatcaggccccagaggtcactctccaagcagacatagaggtgatgagcaccgtacatatttcttctgtctataacgacgttccagtaaccgagggtgtcgtgtacattgagcagctgccggagcaaattgtgataccattcactgaccaggtggcttgtctaaaggaaaatgaacagtcaaaggagaatgagcagtctccgcgagtgagtccaaaatcggtcgtggagaaaactacaagcggcatgtccaagaagtccgtcgaatcggtaaagttggcgcaattagaagagaatgccaaatactcctctgtgtatatggaagcggaagctaccgccctgcttagtgacacaagtctgaaggggcagccagaggttcccgcacagttactggacgctgagggcgctatcaaaattgggtctgagaaatctttacaccttgaggtcgagatcacctccatcgtgtcggataatactgggcaggaagaaagtggcgagaacagcgtcccacaggagatggagggaaagcctgtcctatctggcgaggctgcagaggcagtacacagcggtacatctgtgaagtcgagctccggccccttccctcctgcccctgagggactcaccgctcctgaaattgagcccgaaggcgaaagcacagccgagtag

SEQ ID NO: 110358 - DNA, 1452 bp, Artificial Sequence
  Description of Artificial Sequence: Synthetic coding sequence
atgtctttttcagactctagcgctacgtttcttctgaatgagggcagtgcggatagctacacatcacgtccaagtttggactccgacgtgtcccttgaagaggatcgggagagcgcacggcgtgaggtggaatcacaggcccagcagcagctggagcgagccaaacataagcccgtggccttcgccgtgagaacgaacgttagttactgcggcgtactcgatgaagagtgccctgtgcagggttccggagtgaacttcgaggccaaggactttttgcatatcaaggaaaaatactcgaacgattggtggatcggacgcctcgttaaggaagggggtgatattgcctttattccttctccacagagactcgaaagtattcgcctgaagcaggagcagaaggcgcggagatccggcaatccctcatccctgagtgatatcgggaacagaagaagcccaccaccgtcactggccaagcagaaacaaaagcaggccgagcatgtccccccctatgatgtggtcccatctatgcggcccgtggtgttagtgggtccgtcccttaaggggtacgaagtgacagacatgatgcaaaaggcccttttcgactttctcaagcacagatttgatgggcggatttctatcacgagagtgactgccgacctttctctcgccaagcgcagtgtcctgaataatcccgggaagcgaacaataatcgagcgctctagcgctaggagtagcatcgcagaggttcaaagcgagattgaaagaatctttgaactggccaaaagcctccagttagtcgtactggacgccgatactatcaatcaccctgctcaactcgccaaaaccagtctggcacccattatcgtttttgttaaggtgtcgagcccgaaggtactgcagaggctgataagaagccgaggaaagtcccaaatgaaacacttgaccgttcagatgatggcctatgataaactggtccagtgcccccctgagagttttgacgtaattttagatgaaaaccaattggaggacgcctgcgaacacttggccgaatacctggaggtgtattggcgcgcaacccatcacccagcaccaggccccggccttctcgggccgcctagtgcgatcccgggacttcaaaaccaacagctcctaggggaacgaggcgaggagcattcccccctcgagcgagactctctgatgccaagcgacgaggcctctgagtcgtcacggcaggcttggacggggagcagccaacgtagctcgcggcacctggaggaggactatgccgatgcttatcaggatctgtatcagccacaccggcaacatacaagcggattgcctagtgcgaatggacacgacccccaggatcgcttgttagcccaggattccgaacataatcatagcgaccgcaactggcagcgaaatagaccctggcccaaagatagctactag

SEQ ID NO: 110359 - DNA, 1416 bp, Artificial Sequence
  Description of Artificial Sequence: Synthetic coding sequence
atggaaggctctgccgattcttacacctcccgcccctccttagacagcgacgtgagcctagaagaggacagagaaagcgcccgccgagaagtagagagccaggcccagcagcagctagagcgcgcaaagcataaaccggtggctttcgccgtacggaccaacgtcagttactgcggcgtgctagacgaagaatgccccgtacaagggtccggagtgaatttcgaggctaaggatttcctgcacatcaaggaaaagtactccaatgattggtggattgggaggctcgtgaaagagggcggtgatattgcctttattccaagcccacagcgactggaaagcattcgtctaaaacaggagcaaaaggccagaaggtcaggaaatcccagctcactctcagatatcggaaataggcgctcccctccccccagcctcgccaagcagaaacagaaacaggccgaacacgtaccgccatatgacgtcgtcccttccatgcgcccagtggtactcgtgggaccgagcctaaaaggctacgaggttactgacatgatgcagaaagcactttttgactttctcaagcacaggtttgacgggagaatctccatcacaagagtgactgccgatctctccctcgcgaagcggtctgtccttaataaccccgggaaacggactattattgagagaagctctgctcggagttctatagctgaagtccaaagcgagattgagcgcatcttcgaactagccaagtccttacaactagtcgtcctggacgctgatacaattaaccatcccgcacaactcgccaagacctcgctggcccccatcatcgttttcgtgaaggtgtccagccccaaggtattgcagcggctgatcaggtcacgtgggaaatcccagatgaagcacctgacagtccagatgatggcttacgataaactagtacagtgccctcctgagagcttcgacgtgattcttgacgagaaccaactggaagacgcttgcgagcatctcgctgaatatctagaggtttactggcgagctacgcaccatccggctccagggccaggtcttctggggcctccaagtgcaataccgggcctacagaatcaacagttgttgggtgagagaggcgaagaacatagccccttggaaagagacagccttatgcccagtgatgaagcttcagaaagttccagacaagcatggacgggatcctcccaacgaagcagtcggcaccttgaagaagactatgccgacgcataccaggacctctaccagccacaccgccaacacaccagcggcttaccatccgctaacggccatgacccgcaggatcgtctgctggcacaggatagtgagcacaatcactccgatcggaattggcagaggaatcgcccttggccaaaggattcttattag

SEQ ID NO: 110360 - DNA, 1332 bp, Artificial Sequence
  Description of Artificial Sequence: Synthetic coding sequence
atgtatgatgactcttacgttccaggcttcgaggatagcgaggctgggtcagccgactcctatactagcagaccaagccttgattccgatgtatcgctcgaagaggatcgcgagtcagccaggcgggaggtcgagagccaggcccagcaacaactggaaagggcgaagaaatacagtaacgattggtggatcggccggctggtgaaggaggggggcgatattgcgtttatcccatctcctcagaggctcgaatccataagactgaaacaggagcagaaggcacggcggtctggaaatccaagcagtctgagtgatatcggcaaccgaaggtcccccccaccctcactggcgaagcaaaagcagaagcaggccgagcacgtacccccttatgacgtagtgccaagcatgcgacctgtggttttagtggggccctccctgaagggatacgaagtgacggatatgatgcagaaggcgttgttcgactttctcaagcaccggttcgacggccgaatttctataactcgggtaaccgctgacctgtctctggccaaacggtcagtgttaaataatcctggaaagcggactatcatcgagcggagcagcgcaagaagttctatagcagaggtgcaatctgaaatcgagaggatttttgaactcgccaaaagtctgcaactcgtggtgctagatgctgataccatcaatcacccggcccaactggctaagacttccctggccccaataattgtgtttgtcaaggtcagcagtccaaaagttttacagaggcttattcggtctcggggaaaaagtcaaatgaaacatcttactgtgcagatgatggcctacgataagctggtgcagtgccctccagaatccttcgatgttatcttggatgagaatcagctggaagacgcgtgcgagcatctggccgagtatctggaagtgtactggcgggcaacccaccaccccgctccgggccccggactgttaggacctcctagcgctatacccggtttacaaaaccagcagcttctgggcgaacgcggagaagaacatagccccctggagagggactctttgatgccaagcgatgaggccagtgagtcttcacgtcaagcttggactggtagttcccaacggagttcaagacatctggaggaagactacgcggacgcctaccaagacctttatcaaccccatagacagcacacatccggcctcccctctgcgaacggtcacgatccgcaggaccggctgcttgcacaggattctgagcacaatcacagcgatcggaactggcagcgaaatcggccatggccaaaggactcatactag

SEQ ID NO: 110361 - DNA, 1377 bp, Artificial Sequence
  Description of Artificial Sequence: Synthetic coding sequence
atgagcagctcttcctacgctaagaatggcacggctgatggccctcattccccgaccagccaggtggcccgaggaaccacaactaggaggagtcggttgaagcgatcagacgggtccacaacgagcacaagcttcatcctgcgacagggcagcgctgactcttacacaagtaggcccagtgatagtgatgtctccctcgaggaggatcgcgaagccatcaggcaggaacgggaacaacaagccgcgattcaactggagagagctaaaagtaagcccgttgccttcgctgtgaaaaccaacgtgagttactgcggcgctctcgatgaggacgtccctgtaccctcgaccgccatttctttcgatgccaaagacttcctgcacataaaagagaaatacaacaacgattggtggatagggaggcttgtgaaggaggggtgcgagattggtttcattcccagccctctgcgtttggagaacatccgtattcagcaggagcagaagagggggcgcttccatggtgggaaaagcagcggcaacagcagcagtagcttgggtgaaatggtgtcaggaacctttagagctaccccaacaagcacagccaagcagaagcaaaaggtgacagaacacattccaccctacgacgtcgttcctagcatgaggccagtagtgctcgttgggccatccctcaaaggctacgaagtgaccgacatgatgcagaaggctttgtttgattttcttaaacatagattcgacgggcgcataagtatcactagggtcactgcagacataagcttggcaaaacgtagtgtactcaataatccttccaagagagctataattgagcgttccaacacgcgctcctccttggccgaggtgcagtccgaaatcgagcgaatcttcgagctggcccgcagtttgcagcttgtggttctggacgctgacactattaatcacccagctcagctaataaagacttctcttgccccaatcatagttcacgttaaagtttccagtcctaaagtgctgcagagattgatcaagtcacgtggtaaaagtcagagtaaacatctcaatgttcagctggtcgccgccgacaagttggctcagtgcccgccctcccaacggatgagacactctaatcactccactgaaaacagccctatagagcgaagatccctgatgacgtctgatgagaattatcacaacgagcgggcccgcaagtctagaaacagactgtcttcctcaagccagcactctagagaccactatcccctcgttgaggaagactacccggattcataccaggacacatacaagccccatcgtaaccgaggcagtccagggggttattcccacgactctcggcaccgtctgtag

SEQ ID NO: 110362 - DNA, 1509 bp, Artificial Sequence
  Description of Artificial Sequence: Synthetic coding sequence
atggacgtggttgcccgaggtacaactacgcgacggtcccgcctgaaaaggtctgacggcagcacaacgtccacatcctttattctccggcaaggatccgctgatagctataccagcagacccagtgatagcgacgtctctctggaagaggacagggaggctattagacaggagcgagaacaacaggctgccatccagcttgagagagctaaaagcaaacccgtcgcctttgcagtgaagaccaatgtgtcctactgcggagccctcgacgaagacgttcccgtgccctcaacagccatttcgttcgatgcaaaagacttcctacatatcaaggaaaagtataataacgattggtggatcggcaggttggtgaaagaggggtgcgaaattggatttataccctccccactccgactcgagaacataagaatccaacaagagcagaagcggggccgctttcatggcggtaagagttcaggcaattcgtccagcagcctcggggagatggtgtctggaacattccgtgcaaccccgacgtccaccgctaaacagaagcaaaaggtaactgagcatatccccccttacgacgtggtcccttccatgcgcccagttgttctcgtaggcccatctctcaagggctacgaggttactgacatgatgcaaaaggccctgtttgatttcctcaaacaccgcttcgatgggcggatatcgattactcgagtcactgcagacataagcctggccaaaagatccgttcttaacaacccttctaagagagccatcatcgaaagatcgaacacaagatcttccctcgccgaggtacaatcagaaatcgagagaatttttgaacttgctcggagcctgcaactcgtggtactggatgcggacaccattaaccaccccgctcagctgataaagacctccctcgcacccattatagtgcatgtcaaggtgtctagccctaaagtgctacagcggctgattaaatctagaggtaagtcgcagtctaaacacttgaacgttcaactcgttgccgcagacaaattggctcaatgccctcccgagatgtttgatgtgatcctggacgagaaccagctggaggatgcctgtgagcatctaggagagtacttggaggcctactggcgagcaacacataccacatccagcaccccaatgaccccgttgttagggcggaatctcggatctacagcattatcaccgtaccctactgcgatttcaggcctgcagtctcagcgcatgaggcactctaaccactcaactgaaaactctccgatcgagcggcggtcactaatgacaagcgacgagaactaccataatgaaagggcaaggaagtcccgcaatcggctctcctccagtagccagcatagcagggaccactaccctctcgtggaggaggattaccctgacagctaccaagacacttacaaacctcaccgcaaccgcggcagtccagggggatactcacatgactcaaggcaccgcctttag

SEQ ID NO: 110363 - DNA, 3438 bp, Artificial Sequence
  Description of Artificial Sequence: Synthetic coding sequence
atggccgttcctgcacgcacgtgcggggccagcagaccagggcccgctaggaccgcccgaccgtggccagggtgcgggccacaccctggcccaggaacacggaggccaacgtctggaccgcctcgaccactgtggttgctccttcctctgctgccgttactcgcggcccccggagcctccgcgtatagctttcctcagcagcatacgatgcagcactgggcccggcggctcgagcaggaggtagacggcgttatgcgcatctttggcggcgtacaacagctgagagagatttataaagataatcgcaacctctttgaagttcaggagaacgaaccacagaaattagtggaaaaagttgctggcgacatagaaagcctgttggatcgcaaagtccaggctcttaaacgcctggccgatgctgcagagaatttccaaaaagcgcatcgctggcaagacaacatcaaggaagaggacatcgtgtattatgatgctaaagctgacgctgagctggacgaccccgagtccgaggatgtagagcgcggatctaaagcctcaaccttacggcttgactttattgaggatcccaactttaagaacaaagtcaattactcatacgctgcggtacaaattcccacagatatctataaaggaagtacagtaatcctgaacgaactcaactggacggaagctttagaaaacgtgttcatggagaataggaggcaggatccgacattgctctggcaggtgttcggtagcgctactggcgtgacacggtactatccagccaccccctggcgcgcccccaaaaagattgatctttatgatgtccgtcgaaggccttggtatatccaaggagcctcttcgcctaaagacatggtcatcatcgtagacgtgtccgggtcggtcagtgggttgacgctaaagcttatgaagacgagcgtgtgcgaaatgctcgatactctctccgacgatgattacgtaaacgttgcctcattcaacgagaaggcacagcctgtgtcatgttttacacacttggtgcaagctaatgttaggaataagaaggtgtttaaggaggcggtccagggaatggtcgctaaaggcaccacaggctacaaagcagggtttgagtacgcctttgatcagctccagaacagtaacattacaagagctaattgcaataaaatgataatgatgtttacagacggaggcgaggaccgcgtgcaggacgtgttcgagaagtataattggccgaatcggacggtgcgcgtctttaccttctccgtaggccaacacaactacgacgtgacaccactgcagtggatggcatgtgctaacaagggatactattttgagattccatctatcggtgcgatccgaattaatacccaggaataccttgatgtgctcgggcggcccatggtattggcaggaaaagaagctaaacaagtgcaatggaccaacgtgtatgaggacgcacttgggctaggtctggtagtcacaggcacactgcctgtctttaatctgactcaggatggccctggcgagaaaaaaaatcagttgatactcggagtgatgggcattgacgtggcgctgaacgacatcaagcgcctgacccctaattataccctgggcgcaaacgggtatgtctttgctatcgacctcaacggatatgttttgctgcaccctaacttgaaacctcaaacaaccaactttagggagcctgtgaccttagatttcctggatgccgaactggaggacgaaaacaaagaagaaattcggcggtcgatgatcgatggaaacaagggtcacaaacaaattcgcactctggtcaagtctttggacgagcgttatatcgatgaggtaactcgcaattacacttgggttcctatacggtccactaactacagcctgggcctggttctgccaccttactctaccttctatctgcaggccaatctaagcgatcagattctgcaggtgaaatattttgagttcctgctaccctcatccttcgagagcgaagggcacgtgttcattgccccacgcgagtattgcaaggacttgaacgcatccgataacaacaccgagtttctgaagaactttatagaacttatggagaaggtcacaccagattcaaaacagtgcaacaattttctgcttcacaatcttatcctggacacagggatcactcagcagctggttgaaagagtgtggcgggatcaggacctgaacacttacagcctactggccgtcttcgcagcaacggatggcggtattacccgagtcttcccgaacaaggcagccgaggactggaccgagaaccccgagcccttcaatgcttccttttatcgccgcagtctcgacaaccacggttacgtgtttaaaccacctcaccaggacgcgctgctccgaccactggagttggagaacgacactgtgggcatactggtctcgacagcagtagaactcagtctcggccgcaggacccttagacccgcggtggtgggggttaaactggacctggaggcttgggccgaaaaattcaaggtgctagcatctaacagaacccatcaagatcaaccgcagaagtgcggacccaattcccactgcgaaatggactgcgaagtcaataatgaggacctgctttgtgtactgattgacgacggtgggttcctcgtgctgtccaaccaaaaccaccagtgggaccaggttggacgctttttcagtgaagtcgatgctaacttgatgcttgctctatataataatagcttttacacccggaaggagagctacgactaccaagcagcctgtgcgccacaaccaccaggtaaccttggggccgcacctcgtggcgtatttgtccctaccgttgcggactttctcaatctggcatggtggacgtccgcagccgcttggtccctattccagcagctgttatacggccttatctaccactcatggtttcaggcggatccagctgaggctgaagggagtcctgagacacgtgagtcatcttgcgtgatgaaacagactcagtactattttggaagcgtgaacgcctcgtataacgccattattgattgcggaaattgttctagactcttccacgcacagcgtttaaccaacactaaccttctcttcgtagtcgccgagaaacctctctgctcccagtgcgaggccggaagactcctccagaaagagacacattgtccagcagatggacccgaacagtgcgaactagttcagaggccccgatatagacgcgggccacacatctgctttgattacaacgctacagaggataccagcgattgtggaagaggtgcatctttccccccttccctgggcgttctcgtaagtctgcagctgctcttgttgttggggctgccccccagaccacaaccccaagtgttggtacacgcaagcagaaggctgtag

SEQ ID NO: 110364 - DNA, 3231 bp, Artificial Sequence
  Description of Artificial Sequence: Synthetic coding sequence
atgcaacattgggctaggagattggagcaggaagtcgatggggtaatgcgaatcttcggcggcgtacaacagcttagagaaatatataaagacaaccgcaaccttttcgaagttcaggagaatgaaccgcagaagctagtggaaaaggtggcaggtgatattgagtcattgttggaccggaaggtgcaggcattaaagcggctggccgatgccgccgaaaactttcaaaaagctcaccggtggcaggacaacatcaaggaggaagacatcgtgtactatgacgccaaagccgacgccgaactggacgatccagaatcagaggacgtggaaaggggatctaaagcctccacactgagactagactttatagaggaccccaactttaagaataaggtgaattactcgtatgctgccgtgcaaatcccaaccgatatttacaaggggtcgacagtcattctgaacgagttgaactggactgaggcccttgagaacgtctttatggaaaatagaaggcaggacccaacactcttatggcaggtcttcggatccgcgacaggtgttacgcgctattacccagctactccgtggagagccccgaaaaagatagacctatatgacgtccgccgaagaccctggtatatccaaggggcgtcctcacctaaagatatggttatcatcgtcgatgtaagcggctcagtgtctggcctcactttaaagctgatgaagacttctgtgtgtgaaatgctggacacactctcggatgatgactacgtgaatgtggcttccttcaacgagaaagcccagcctgtgtcctgctttacgcacctggtacaggctaacgtgcggaacaaaaaagtgtttaaggaggctgtacagggcatggtggcaaaaggtactactggctataaggcaggattcgagtacgcattcgaccagttgcaaaacagcaacattacgagagccaattgtaacaaaatgatcatgatgttcacagatgggggcgaggatagagtccaggacgtcttcgaaaagtataattggccgaataggaccgtaagagtctttaccttttctgttggccagcataattatgacgtgactccactgcagtggatggcttgcgctaacaagggttactatttcgagattcccagcatcggggctatccggatcaatacacaggagtacctcgacgtgctaggccgcccgatggtcttggccggaaaagaggctaagcaggtccaatggaccaatgtgtatgaggatgccctcggtctcgggctcgtggtaactggcacgctgccagtgttcaacctcactcaggatggtcctggcgagaagaaaaatcagctgattctaggtgttatgggcattgacgtggcattaaacgacattaagaggctgacgccaaattacacactgggggcgaatgggtatgtatttgccattgatcttaacggttatgtgctgctgcatcccaatcttaagcctcagactacgaatttccgagagcccgtgaccctggactttctggacgcagaattggaagacgagaataaggaggaaatccgtagatccatgatcgatggaaataaaggccataagcaaatccgaaccttggtgaagagtctggatgaaagatatatcgacgaggtgacccggaattacacgtgggttcccatccggtcaactaattattctctcggcctggtgttgccaccttattcaacgttttatttgcaagcgaacctctctgaccagatccttcaagtgaaatattttgagtttctgctgccttcaagctttgagtctgaaggacatgtgttcatagcccctcgtgagtactgtaaggatcttaatgctagcgacaacaatactgagttcctaaagaatttcattgaactaatggagaaggtcaccccagactctaaacagtgcaataacttcctgctgcacaatttgatcttggatactggtattacacagcaattggtggagcgcgtatggcgggaccaggatcttaacacctattccctgctagcagtgttcgccgctacggatggtgggattacacgagtgtttcctaataaggcggccgaggattggaccgaaaatcctgaaccgtttaacgcctcattttaccgaaggagcctggacaaccacggctacgtctttaaaccacctcaccaggacgccctgctgcgccctttagagctggagaatgacacagtcggtattctagtgtccacggctgttgagttgtccctgggccgcagaacactccggccggcggttgttggcgtcaagcttgacttagaagcctgggccgaaaagttcaaggtattggcatccaaccggacccaccaggaccaaccccaaaagtgtgggcccaactcccattgtgaaatggattgcgaggtaaataacgaggaccttttgtgcgtcttgattgacgacggcgggttcctggttctctcaaatcaaaatcaccagtgggaccaggttgggcggtttttctcagaggtagacgctaatctgatgcttgccctgtataacaacagcttctacacacgcaaggaatcttatgattaccaggccgcttgcgccccccaaccacctggaaaccttggagccgcccctcgaggggtgttcgtgccaaccgtggctgattttctgaacctcgcatggtggactagtgctgctgcatggagcttatttcagcagctgctatacgggttaatataccatagctggtttcaggcagacccagcagaggccgagggctctccggagacccgtgagagcagctgtgtaatgaagcaaacccagtactacttcgggtctgtgaatgccagctacaacgctatcatagattgtgggaactgtagccggctctttcatgcccagaggctgaccaatactaacctcctgttcgtggtggccgaaaagccgctgtgctcccaatgcgaggccggaaggctgctccagaaagagactcattgtccagctgacggccctgagcagtgtgagctcgtccagcgcccccggtaccgacggggtccacatatctgctttgactacaacgcaacagaggatacatccgattgtggacggggggcgtccttcccccccagcctcggtgtgcttgtcagcctccagctgctgctgcttcttggattaccacccaggccacagccacaggtgctggtacacgcaagccggcgactctag

SEQ ID NO: 110365 - DNA, 3441 bp, Artificial Sequence
  Description of Artificial Sequence: Synthetic coding sequence
atggcagtgccagctcgcacttgcggagcttctcgtcctggccccgctagaactgcgagaccctggcccggctgcgggccgcacccgggccctggaacccggcggccgacctccggccccccacgccccctgtggctgctgctgcctctgctgccactcctcgctgctcccggtgccagtgcctactccttccctcaacagcacacaatgcagcactgggcacgaaggctcgagcaggaggttgatggcgttatgagaatttttggaggggtgcagcagcttcgggaaatatacaaagacaaccgaaatctcttcgaggtacaggagaacgagccccagaaactcgtagagaaagtggcaggcgacatcgagtctctcttggaccggaaagttcaggctctcaaaaggttggccgatgccgccgagaatttccaaaaagctcatcgctggcaggataatataaaagaagaggatattgtctattacgacgccaaagccgatgccgagctcgatgacccagagtccgaagatgtggagagaggttcaaaagcatccacccttcggctcgactttatcgaagacccaaattttaagaataaagtgaattactcttatgccgctgtgcagatccccacagatatatataaggggagcaccgtgatcttgaacgaactcaactggacagaagccctggagaatgtattcatggaaaatagacggcaagacccaacccttctttggcaggtatttgggtctgctacgggggtgactcgttactaccccgccaccccgtggagagcaccaaaaaaaatcgatctatatgacgttaggagacgcccgtggtacatacagggggccagctctccgaaggacatggttattatcgtcgatgtctcgggctctgtgagcggtttgacactgaagctgatgaaaacctccgtttgtgagatgctagatactcttagtgatgacgattacgttaatgtggcttcctttaatgagaaggcccaacctgtcagctgtttcacacacctggtccaggccaatgtgcgtaataagaaagtgtttaaggaggctgtccagggcatggtggccaaggggacaaccggctacaaggcagggttcgagtacgcctttgaccagctccaaaactctaatattacacgagctaactgcaacaaaatgataatgatgtttaccgacggcggcgaggaccgcgtccaagacgtgtttgagaagtacaattggcccaacagaacggtcagggtctttaccttcagtgtaggacagcataattatgatgttactcccctgcagtggatggcatgcgccaacaagggatactattttgagatcccgagcattggtgctattcgcattaacacacaggaatatttagatgtgctggggagacctatggtgctcgccggaaaggaagcgaaacaggtccagtggaccaatgtgtacgaagatgctttgggtctgggtctagtcgtgactggcaccctgcccgtctttaacctgactcaagatggtcccggagaaaagaaaaatcagctgatcctgggcgttatgggaatcgacgtcgcgctcaatgacattaaacggctgacccccaactatacattaggtgcaaatggctacgtctttgcaattgatctcaacggctatgtcctactgcatcctaaccttaagcctcagacgacaaacttcagggagccagtgactctggactttttggacgctgaactggaggacgaaaataaagaagagataaggcggagcatgatagatggcaacaaaggccacaaacagatcagaacactcgtcaaatcattagatgaaaggtacattgatgaggtaacccgcaattacacctgggtccctataaggagcactaactacagcctgggccttgtcctgcccccttattctaccttctacctccaagcaaacctctcggatcagattctccaggtaaaatactttgagtttttgcttccgtcaagttttgagagcgaaggacacgttttcatcgctcctagggagtattgcaaggacctaaatgcatctgataacaatacagagtttctaaagaattttatcgaactgatggagaaagttactcccgacagcaagcagtgcaacaatttcctgctgcataatttaatacttgataccggaatcactcagcagttggtcgagcgggtgtggcgagatcaggatctcaatacttacagtctactcgccgtcttcgctgcgactgacggaggcatcactcgggtctttcccaataaagctgccgaggactggacagaaaacccagagccttttaatgcctccttctataggagatccttggacaatcatggctatgtattcaaaccgccacaccaagacgccctgctgaggcctttggagttggagaatgacacggtgggaattctggtgtcgacagccgtcgagctatccctcgggaggaggactctaagaccggccgtggtcggagtcaaattggatctggaagcatgggctgaaaaatttaaggtgttagccagcaaccgcacgcaccaggatcagcctcaaaagtgtgggcctaactcccattgcgagatggattgtgaagttaacaatgaagacttattatgtgtgctgatcgacgatgggggtttcctcgtcttatcgaatcagaaccatcagtgggaccaggtgggccgctttttttctgaggtagatgctaatttaatgcttgccctctacaacaattccttctacacccgaaaggaatcttacgactaccaggctgcgtgtgcccctcagcccccaggaaacttgggagccgcgccacggggggtgttcgtaccaactgttgcggattttctcaacttagcctggtggacctccgccgccgcttggtctctgttccagcagttgctgtatgggctaatttaccactcttggttccaggctgatcctgccgaagccgaaggcagccccgaaacacgagagtccagttgtgtgatgaagcagactcagtattacttcggatcagtcaatgcctcatataatgctataatcgattgtgggaactgcagccgcctgtttcacgcacaacggttgactaatactaacctgttgttcgtcgtcgctgagaaacccttgtgctcacaatgtgaggccggtcgtctgttgcagaaggagacccactgctgtcccgccgacggtcccgagcaatgtgaacttgttcagagacctagatataggcgcggcccacatatttgttttgactacaatgcgactgaagatacgtctgactgcggcagaggggcaagctttccccctagcctgggggttctggtgagtctacagctcttgctgcttctgggcctgcctccccggccccagccccaggtgctggtgcatgcctcacggcggttgtag

SEQ ID NO: 110366 - DNA, 3432 bp, Artificial Sequence
  Description of Artificial Sequence: Synthetic coding sequence
atggccgtgccggcccggacctgtggggcctccagacccgggcccgccagaaccgctcggccctggccgggatgcggaccacaccctggtccgggcaccaggcgaccgacatctggtccaccgagacccctctggctcttactgcccctcctaccactcctcgccgctcccggggcatccgcttattccttccctcaacaacataccatgcagcactgggcgcgaagactcgagcaagaagtggacggtgtaatgcgcatatttggtggtgtgcagcagctgagggaaatttacaaagataacaggaacctgtttgaagtccaagagaatgaaccccagaagttggtggagaaggtagcgggcgacattgaatctctgttggatcgaaaggtgcaggctcttaagcgactggccgacgccgccgaaaattttcagaaggcacaccgctggcaagataacatcaaagaggaagacatcgtgtattacgatgctaaagccgacgctgaattggatgaccctgagtctgaagacgtggagcgcggctccaaggcatccaccctgcggttggacttcatcgaggatccgaacttcaagaataaagtgaactacagctacgccgctgtccaaatccctaccgacatctacaaaggctctactgtgatactcaacgaattgaactggaccgaggctctcgagaatgtctttatggagaatcgcaggcaagatccaactctgctgtggcaggtctttggcagtgctaccggcgtgacccgctattacccagccacaccttggcgggccccaaagaaaatcgacctgtatgatgttaggcgacgcccctggtatattcaaggggcctcaagcccaaaggatatggtgataatcgtggatgtgagcggctctgtctcgggcctaaccttgaagctgatgaaaactagtgtctgcgagatgcttgatacgttgtcagacgatgattatgtgaatgtggcctctttcaatgaaaaagcgcaacctgtgagctgctttacacatctcgttcaggccaacgtgcgaaacaagaaagtgttcaaggaggccgtgcagggcatggttgccaagggtacgacgggatacaaagcagggtttgagtatgcgttcgatcagctgcagaacagcaacatcacacgcgccaattgcaataaaatgattatgatgtttaccgacggcggtgaagacagggtccaggacgtcttcgaaaaatacaattggcccaacaggaccgttcgcgtgtttacattttccgtcgggcagcataattatgacgtgacaccacttcagtggatggcttgtgctaacaaaggctactacttcgaaatcccttccattggagcaattagaataaatacacaggaatatctggatgtccttggtcggcccatggtcctggcaggtaaggaggcaaaacaggttcagtggaccaacgtctacgaagacgccctcgggttgggattagtggtaactggcaccctgccagtgtttaatctcactcaggacggacctggggaaaagaagaaccagctgatcctcggcgtgatgggcattgacgtcgcactgaacgacataaaaaggctgacccctaattatactctcggtgccaatggctacgtcttcgctattgatctgaatggatatgtgctcctgcaccccaatttgaagccgcagacaaccaacttccgcgaacctgtgacacttgattttcttgatgccgaacttgaggatgagaataaggaagagatccgccgatccatgattgacggaaacaaaggccacaagcaaattagaacactcgtgaagagcctagacgaacgatacatcgacgaggtgacccgcaactacacctgggtgcctattcggtctacgaactacagcttgggactggtactgcccccctacagtaccttctacctgcaggccaatctatctgatcagatcctccaagtgaagtactttgagttcttgttaccttcttcctttgagtcagaaggtcatgtcttcattgccccccgggagtattgtaaagatctcaatgcctccgataacaacacagagtttttgaaaaactttatcgagctaatggaaaaggtgacgcctgacagcaagcagtgtaacaacttcctccttcacaacttgatcctcgacactggcattactcagcagcttgtggagagggtgtggagagaccaggacttgaacacatacagtcttctggcggtcttcgcagctactgacggtggtatcacacgggtgttccctaataaggcagcagaggactggaccgaaaaccctgagccatttaatgcaagcttttatcggcgatcattggataatcacggatatgtgttcaagcccccacatcaagacgccctcttaaggcctctcgagttggaaaacgataccgtgggaattttggtgagtacagctgtggagctgtctctgggccggcggacactccggcccgcagtagtcggtgtcaagctagatctggaagcgtgggcagaaaagttcaaggtgctagcgagcaaccgaactcaccaggaccagccccagaaatgtggcccaaactcacactgtgagatggattgcgaagtcaataatgaagacttgctctgcgtgctaatcgacgatggaggttttctggtcctatccaaccagaatcaccagtgggaccaggtcggtcgcttcttctccgaagtggacgctaacctcatgttagctctgtacaataattcattctatacaaggaaggagagttatgactatcaggccgcatgcgcaccccagccgcctggtaatctcggtgccgctcctcggggcgtgtttgtgcccacagtggcagacttcctcaatctggcctggtggactagtgcagctgcctggtctctattccaacaactcttatacggtctgatataccacagctggtttcaagcggatccagcagaggccgaagggagccccgagacaagagaatcctcttgtgtgatgaaacagacgcaatactatttcgggtccgtgaacgcgagctataatgctatcatcgactgcgggaattgctctcgcttgtttcatgctcagcgcctgacaaacactaacctattgttcgttgtagctgagaaacccttatgctctcagtgtgaagccgggcgtctcttacagaaggagacccacagtgacgggcccgagcaatgcgagctcgtccagaggcctcgttatcgccgggggcctcatatttgctttgattacaatgctacagaggacacttcagattgcgggagaggcgcaagtttcccaccgtcattaggggtgctcgtctccctgcaactcctactcctgttggggctgcccccccgaccacaaccccaggtcctggtgcacgcaagccgtcgcttgtag

SEQ ID NO: 110367 - DNA, 3462 bp, Artificial Sequence
  Description of Artificial Sequence: Synthetic coding sequence
atggctgtccctgcccgcacatgcggcgcaagccggcctggcccagcacggaccgcgcgaccctggcccggctgcggcccacacccaggcccaggaactcgtaggcccacctctggccctcccagacccttgtggctcctcttgcccctcctgcccctgctcgccgcgccaggagctagtgcttattcttttccacagcagcacacaatgcaacactgggcccgccgcctcgagcaagaagtggacggggtgatgcgtatattcggtggcgtgcaacagctccgcgaaatttataaggataaccggaatctgttcgaggtgcaggaaaatgagccccagaagctcgtggaaaaagtggcaggtgatatcgagtccctgcttgacaggaaggtccaagctctcaagcgtctagctgacgccgcagagaattttcagaaggcccataggtggcaggataatatcaaggaggaagacatcgtgtactacgacgccaaagctgacgctgagctagacgatcccgaatctgaggatgtggagcggggctccaaagcatccacccttcgcctggactttatagaggatcctaactttaaaaacaaagtaaactatagctacgctgcagtgcaaatccccacagacatctacaaaggatctactgtaatcctgaatgagctcaactggactgaagcattggagaacgttttcatggaaaacaggaggcaggatcctacccttttgtggcaggtcttcgggtccgcaacgggcgttactcggtattaccctgcgaccccgtggcgggcccccaagaagatagacttatacgacgtgaggcgtcgcccatggtacattcaaggagccagctctccaaaggacatggttattatcgtagatgtatcagggagtgtctcaggcctgactctgaagctcatgaaaacaagtgtgtgtgagatgctagatactctgtccgatgatgattatgtaaatgtcgcttcctttaacgaaaaggcacaacccgtcagctgcttcactcacctagtgcaggctaatgttaggaataaaaaggtgttcaaggaagccgtacaaggtatggtggccaagggcactaccgggtacaaggcggggtttgagtatgctttcgaccagctgcagaactccaacatcacacgagccaactgtaataagatgataatgatgttcacagatggcggtgaggatagggtgcaggacgtttttgagaaatacaactggcctaacaggactgtgagagtcttcacattcagtgtgggtcagcacaactacgatgtgacacctctgcagtggatggcatgcgccaacaaaggctattatttcgaaattcctagtatcggcgctatccggattaatacccaggaatatttggatgtgcttggaagacccatggtgctggctggcaaagaggccaaacaggtgcaatggactaatgtgtacgaagatgcccttggattaggccttgtggtgacaggtacactgcctgtttttaacctcacgcaggatggtccaggagagaagaagaatcagctaatcctgggagtaatggggatcgatgtcgcgctcaatgacataaagcgcctcactccaaattatactttaggtgccaacgggtatgtctttgcgatagacctgaacggctatgtcctgctgcatccgaatctgaagccacaaaccaccaattttagggagcccgttacactggatttcctggacgctgagttagaggacgagaataaggaggagataaggcggtcaatgatcgacggcaacaagggacacaaacagatccgcacgttggtcaagtctttggacgagagatacatcgatgaagtaacacgaaattacacttgggtgccaattcgctctaccaattattctctggggctcgtgctgccaccgtactccacgttctaccttcaggctaacctgagcgatcagatactccaggtcaagctgcccatttcaaaactcaaggatttcgagtttctcttgccgtctagctttgagagtgagggccatgtcttcatcgcccccagggagtactgcaaggacctgaatgcatcagacaacaatactgagttcttaaaaaattttattgaactgatggagaaggttactccagactctaaacagtgcaataacttcctgctgcacaatctgattttagataccggcataacccagcagctggttgaaagggtctggcgggatcaggatctgaacacatactccctgctcgctgtgtttgccgccactgacgggggaattacgagagttttccctaacaaagccgccgaggactggaccgagaacccagagccattcaacgccagcttttaccgccgctctctcgacaatcacggttacgttttcaagcccccacaccaggacgcccttctgcggcctctggaacttgagaacgataccgtaggaattcttgtcagcacagccgtcgagttgtcactgggtcggcgcacactacgccctgccgtcgtgggcgtcaaactggatttggaagcatgggccgagaaattcaaagtactggccagcaatcgaactcatcaggaccagccgcagaagtgcggcccgaattctcattgtgagatggattgcgaagtgaataacgaggacctgttatgtgtgctgatagacgacggcgggttcctggtgctctcaaatcagaatcatcagtgggaccaggtgggccgctttttcagcgaggtagacgcaaatttgatgctggctttatacaacaattctttttacactcggaaggagagttacgactaccaggcagcttgcgcccctcaaccccccggcaacctgggcgccgcacctaggggggtcttcgttcctactgttgcagacttcttgaatctggcatggtggacttctgctgccgcttggagcttgtttcagcagttactgtatggactcatttatcactcctggttccaggctgatccagccgaagccgaaggaagtcccgaaacgcgcgagtcatcatgcgtaatgaaacagactcagtattacttcgggtcagtcaatgccagttataatgccataatcgattgtggcaattgttctaggttgtttcacgctcagagactgaccaacactaatctgctattcgtagtggccgagaagccgctgtgcagccagtgtgaggccggtcgtctcctccagaaagaaacacattgctgcccagccgatggtccagaacagtgcgaattagtgcagcgacccaggtaccgacgagggcctcacatttgttttgattataacgctacggaggatacttcagactgtggcagaggtgcttcctttcccccatccctcggtgtgctggtctcacttcagcttttgctgctcctggggcttccacccagaccccagccccaagtgctcgtgcacgcatctagaaggctgtag

SEQ ID NO: 110368 - DNA, 3453 bp, Artificial Sequence
  Description of Artificial Sequence: Synthetic coding sequence
atggccgtacccgcccggacatgcggagcaagcaggccaggtccagctcgaacagcacgaccctggcctgggtgcggtccacacccaggccccgggactaggcgccctacttctggacccccccgcccgctttggctgctgctaccactgctccccttgctcgccgctcctggggcttcagcatacagctttccacagcaacataccatgcagcactgggcccgccggctggaacaggaggtggatggggtgatgaggatctttggaggcgtccagcagctccgcgagatttacaaagacaacaggaatctgttcgaggtgcaagagaatgagcctcagaagctcgtggagaaggtggccggggacattgaatctctgcttgaccggaaagtgcaagcactgaagcgtctggcagatgcggcagagaatttccaaaaagcccatcgttggcaggacaatataaaagaggaggacattgtttattatgacgccaaagccgacgctgagctagacgaccccgagtctgaggacgtagagaggggcagcaaagctagcaccctgcggctggatttcatagaagacccgaatttcaagaacaaggtcaactactcctatgctgcagtacagattcccacggacatctacaaggggtctaccgtgatcctcaacgagctgaattggaccgaggcactggagaacgttttcatggaaaatcggcggcaggacccaaccctgctgtggcaggtgttcgggtcagcgacaggagttacccgctattatcctgccactccttggagagcaccgaagaagattgacctgtatgatgtacgaaggaggccatggtacatacagggtgcaagcagtcctaaagatatggtcatcatcgtcgatgttagtggtagcgtcagtggcttaaccctgaaactgatgaaaactagcgtatgcgaaatgctggacacgctgtcagacgatgactacgtgaatgtggcatcattcaatgagaaagcccagccagtcagctgttttactcacttggtgcaggccaatgttaggaacaagaaggtttttaaagaagccgtgcaagggatggtggcaaaaggaactactggttacaaagctggctttgagtacgccttcgaccaactccagaattccaacatcactagggctaactgcaataaaatgattatgatgttcaccgatggaggagaggatcgcgtgcaagacgtgtttgaaaaatacaattggccaaataggactgttcgggtattcacattttcagtcgggcaacacaactatgacgtaacccccctccaatggatggcgtgtgccaataaaggctactactttgagataccaagcatcggagctattagaatcaatacacaagagtacctggatgtgcttggacgccccatggtgctcgccggcaaagaggccaagcaggtgcagtggacgaacgtatatgaggacgcattaggactcgggttagtcgtcaccggcactctgcctgtgttcaacctcacgcaggatgggcccggcgagaagaaaaatcaactgatcctgggcgtgatgggcatcgacgtagcccttaatgacataaaaaggctcactccgaattacaccctcggcgccaatggttacgtgtttgctattgatctgaatggctatgtcctgcttcaccctaatctgaaacctcaaaccaccaattttagggagcctgttactcttgattttctggacgcagaactggaagacgaaaataaggaagaaattcggaggagtatgatcgacggtaacaaaggtcacaaacaaataaggacactagttaagagtctcgatgagcgttacatcgacgaggtaacccggaactacacgtgggtgccaatccgaagcactaactattccttgggacttgttttgcctccctattccaccttctacctccaggcaaatttaagcgaccaaattcttcaggtgaagctgcccatcagtaagcttaaagattttgagttcctattgccttccagcttcgaatccgaaggacacgtgttcattgctccaagggagtactgcaaagatctcaatgccagcgacaataacactgaattcctgaaaaactttattgagctgatggagaaggtgacaccagattcaaagcaatgtaacaattttctactacacaatctcattttggacactgggatcacacagcagctggtagagcgagtttggcgcgatcaggacctgaatacctactcattgctggctgtcttcgctgcaacagacggaggaataacgagagtctttcccaacaaggcagctgaggattggactgaaaatccagaaccttttaatgctagtttctaccggagaagcctcgataatcacggctacgttttcaaacccccacaccaggacgccttattacgtcccctggagcttgagaatgacaccgtggggatcctggtttctactgctgtggaactgtcactaggacgtaggactctgcgccccgcagtagtcggagtgaagctagacctggaggcttgggccgaaaaattcaaggttctcgcaagcaataggacgcaccaggatcagccccagaaatgtggaccaaatagccactgtgagatggactgcgaggtcaacaacgaggacctgctctgcgtgctgattgatgacggcgggttcctggtgctctccaatcagaaccaccaatgggaccaggtcggtagattctttagtgaggtagacgcaaatctgatgctcgccctctataacaattcgttttatacaagaaaagagtcatatgattatcaggccgcatgtgccccccagcctcctggaaatcttggagccgctccgcgaggcgtctttgttcccaccgtggcggacttcctgaatttggcttggtggacctctgcagctgcttggagtctgttccagcagctgctgtacggcttaatttatcacagctggtttcaagctgatccagccgaggccgaaggatctcccgagactcgcgaaagctcttgcgttatgaaacagactcagtactactttgggtcagtcaatgctagctataacgctattatcgattgtggcaattgttctagattgtttcatgcacaaagattgactaacaccaatctgcttttcgtcgtggctgaaaagccgctctgctcgcagtgcgaggctggcagactgctgcagaaggagactcactccgacgggcccgagcagtgtgagctggttcaaagaccccgctatcgccggggaccacacatctgtttcgattacaacgcaacggaagacacatccgattgtggcagaggagcttctttccccccttcactcggggtgctggtttctctccagctcctgcttctgcttggcctgcctccccgcccacaaccccaagtgctggtgcacgcgagcagacgcttatag

SEQ ID NO: 110369 - DNA, 3276 bp, Artificial Sequence
  Description of Artificial Sequence: Synthetic coding sequence
atggccggtcctgggtccccacgacgggcctcccgcggggctagcgccttactggccgccgccctactttacgccgccctgggcgatgtcgtgcgctctgaacaacagatccccctgagcgttgtaaaactctgggctagtgcgttcggaggcgagattaaatctattgcagccaagtatagtggcagccaactgctgcagaaaaaatacaaagagtacgagaaagatgtggcgatcgaagagatcgacggcttgcaattagtcaagaaactggcaaagaatatggaagagatgttccacaagaaaagcgaagcggtgcggcgcctcgtggaagctgccgaagaggcccatctcaagcatgagttcgacgctgatcttcaatacgagtattttaacgctgtgcttatcaacgaacgagacaaggatggaaatttcctggaacttggaaaagagtttatcctcgcacctaatgaccatttcaataacctgccagtaaacatcagcttgagcgacgtacaggtgcccactaacatgtataataaagaccccgccatcgtgaacggagtttattggtcagagtccctgaacaaggtattcgtggataacttcgacagggaccctagtctgatctggcagtatttcggatcagctaagggctttttcaggcagtaccctggaatcaagtgggagcccgacgagaatggcgtaattgcctttgattgcagaaacagaaagtggtatatccaagcagcaacctcaccaaaggacgtggtgattctggtggatgtgagcggctctatgaaaggcctccggctcaccatcgccaagcagacggtgagtagtattctggataccctgggagatgacgacttctttaacattatagcctacaacgaagaattgcactatgtggaaccctgcttgaacggaactctcgtgcaagcggaccggacaaacaaagagcacttcagagagcatttggataagcttttcgccaagggcattgggatgctggatatcgcattgaacgaggcattcaatatcttaagcgattttaaccacactggacaagggtccatctgctcccaggccataatgttgataaccgatggcgcggtcgatacttatgatactatattcgccaaatacaattggcccgaccgcaaagtgagaattttcacttacctgatcggaagggaggccgcatttgccgataaccttaaatggatggcgtgtgcgaacaagggattcttcacacaaatcagcactctcgccgacgttcaggaaaacgttatggaatatttgcacgtgctttcgcggcctaaggtcattgaccaagagcacgacgtggtttggaccgaggcctacatagacagtacgctccctcaggcgcaaaagttgaccgatgaccagggcccagtgcttatgacaacggttgctatgcctgtgttttcaaaacagaatgagacaagatctaagggcatcctgcttggtgtggtcgggaccgacgtacccgtgaaggaactcctgaagactatccctaagtacaagctcggtattcacggttatgcattcgccatcactaacaacggctatatactcacccacccggagctgcggttgttgtatgaggagggtaagaaaagacgcaaaccaaactacagttccgtagacctgtctgaggtagagtgggaggaccgcgacgacgtcctgcgcaatgccatggtgaatagaaaaacaggcaagttctccatggaggtgaaaaagactgtcgacaaaggcaaacgcgttctcgtgatgaccaacgattactattacaccgatattaaaggtactcctttctccctgggggtggctctctcacggggtcatgggaagtatttctttcgtgggaatgttactatcgaggagggccttcacgacttggagcatcccgatgttagcttggccgacgagtggagttactgcaatactgacttgcacccagagcaccggcacctcagccagctggaggctataaaactatatctgaagggaaaagaacccctgctccagtgcgacaaggagctgattcaggaggtactgttcgacgccgttgtgagtgcccctattgaagcctattggacttcactcgccctgaacaaaagcgagaactctgataaaggtgttgaagttgccttcctgggcacacggaccggactttctagaattaacctgtttgtaggggccgagcagctaacaaatcaggatttcctcaaggcaggcgacaaggagaatatcttcaacgcggatcacttccccctctggtacagacgggccgctgagcagatccccgggagctttgtttacagtattccattttcgacaggaccggtcaataagtccaatgtggtgacggctagcacttctatccagctcctggacgagaggaagagcccagtggtcgctgcagttggaattcagatgaaactggagttcttccagaggaagttctggacagcttcaagacagtgcgcgagcttagacgggaagtgcagtatttcgtgtgatgacgaaacagtgaactgttatctgatcgacaacaacggctttatcctcgtgtctgaagattacacacagactggggacttctttggtgaaatcgaaggcgccgtgatgaacaaattactgaccatgggttctttcaagagaattactctgtacgattaccaggcaatgtgtcgtgccaacaaggagtcatccgacggcgcccacggcctgctcgatccctacaacgcattcttgtcagcagtgaagtggattatgaccgagctcgttctctttcttgttgagttcaacctgtgctcttggtggcattcagacatgacagccaaagctcagaagttaaagcagaccctcgaaccctgtgacactgagtacccagccttcgtgagcgaacggaccatcaaggagacaaccgggaacatagcctgtgaggactgtagtaagagctttgttattcagcagattccttcatccaatctgttcatggtcgtggtcgacagcagctgcctgtgcgagtccgtggcccctatcaccatggctcctatcgaaattagatacaacgaaagtctgaagtgcgagcggttaaaagctcagaagatccgccgccggccagagtcatgccacggcttccaccccgaggaaaatgcaagggagtgtggtggcgctccgagcctgcaggcacaaaccgtactgctcttacttcctttgctcctgatgttgttttccaggtag

SEQ ID NO: 110370 - DNA, 2997 bp, Artificial Sequence
  Description of Artificial Sequence: Synthetic coding sequence
atgggtgagctccggcaggagcggtcaaccgctctgcagcgcttagttgaggccgctgaagaggcccacctcaagcatgagttcgacgctgatctgcagtatgagtactttaacgccgtgctgattaatgagagagacaaggacgggaactttctggaacttggtaaggaatttattcttgctcccaacgatcactttaataatcttcccgtcaacatatctttgagcgacgtgcaggtccctaccaatatgtataataaagaccccgccattgtcaacggcgtctattggtccgagtcactgaataaggtctttgtggataactttgaccgggaccccagcctcatttggcagtactttgggagcgccaaaggcttcttccggcaataccctggaattaaatgggagcccgatgagaatggcgtgattgcgttcgattgccgaaatcggaaatggtacatacaggcagccacaagcccaaaggacgtggtgatcctcgtcgatgtgtctgggagtatgaagggcttacggttgaccatagcgaaacagactgtatccagcattctagacacccttggcgacgacgatttctttaacatcatagcttataatgaggaattgcactacgtagagccgtgccttaatggcacgcttgtgcaggccgacagaaccaacaaggagcacttcagggaacacttggacaagctgtttgccaaaggcatcgggatgttagatattgctctgaacgaggcattcaacatattgtctgatttcaatcataccgggcagggttctatctgtagccaagccattatgcttatcaccgatggagctgtcgatacctacgacacaatcttcgctaaatacaactggcccgacaggaaggtacgaattttcacttacctgatcggtagggaagcggccttcgcagataatttaaagtggatggcctgtgcaaacaaagggttctttacacagattagtactctcgctgatgtgcaggaaaacgttatggaatacttacacgtgttgtctcgacccaaggtgatagaccaagagcatgacgtggtttggacagaagcatacatcgatagcaccgtgtctcaggccgaacagctgacggacgaccagggcccagtcttgatgaccaccgtggctatgcccgtcttcagcaaacagaacgagactagaagcaagggcatcctgcttggtgtggtcggtacggatgtcccagttaaggaactcctgaagactatcccgaagtacaaacttggaattcatggatacgccttcgctattactaacaacggatatatcttaactcaccctgaacttcggctgttatatgaagaaggcaaaaaaaggcggaagcctaattactcatccgttgacctctccgaagtggaatgggaggaccgcgatgacgtgctccgaaacgccatggtgaataggaaaaccggtaagttctctatggaggttaaaaaaaccgtcgacaagggcaagcgagttctcgtgatgacaaatgattactactatacggatattaaaggcacgcccttcagcctgggcgtggccttgagtagaggccacggcaagtatttctttcgaggcaatgtgaccatagaggagggcctgcacgatttagagcacccagatgtgagcctggcagacgaatggtcctattgcaacacagatttgcatccagagcataggcaccttagccagcttgaagccatcaagctctaccttaaaggcaaggagccactgttacagtgtgacaaagaactgatccaggaagttctattcgatgcagtcgtctctgctcccatagaggcatattggaccagcctggctctgaataagagtgaaaatagtgacaaaggcgtagaagtggcctttctgggaacgaggactgggctttcccgcattaatcttttcgtcggcgctgaacagctcaccaatcaggacttcctgaaagcaggcgacaaagagaatattttcaacgctgaccactttccgctttggtatagacgagctgcagagcagattcctggcagcttcgtgtactccatccccttttccactgggccggtgaataagtctaacgtcgtcacagcctctaccagcatacaactgctggacgaacggaagtcgcctgtggtcgcggcggttgggatccagatgaaactcgaattctttcagagaaagttttggacagctagcagacaatgcgcctcactggacggcaagtgctctatcagttgcgacgatgagaccgtcaactgttatctaattgataacaatgggttcatcctggtgtccgaagattatacgcagacgggagacttcttcggcgagattgaaggagcagttatgaataaactgcttaccatgggaagcttcaagagaattactttgtatgattaccaagctatgtgtcgtgcgaacaaggaatcatcagacggcgcccatggtcttctcgacccatacaacgcttttctctctgcggttaaatggatcatgactgaactagtgctgtttctcgtagagttcaacttgtgcagttggtggcactcggacatgacagcgaaagctcagaaattaaaacagactctggaaccttgcgacacagaatacccagcgttcgtgtctgaaaggacaattaaggagacaacgggaaacatagcatgtgaggactgcagcaagtctttcgtcattcagcagatcccctcgagcaacctgttcatggtggtggtggattcatcatgcctgtgtgagagtgtggctccaatcacgatggcaccaattgagatttctcaacacaacgagtcactgaaatgcgagcgtcttaaggcccagaaaatccgtcgacgaccagagagctgtcacggctttcaccctgaggaaaatgcacgcgaatgcggaggggcaccaagtcttcaggcccaaaccgtccttctccttctacctttgttattgatgctgttttcccgttag

SEQ ID NO: 110371 - DNA, 3276 bp, Artificial Sequence
  Description of Artificial Sequence: Synthetic coding sequence
atggctggaccaggcagccctcggagagcgtctcgaggagcttccgctcttctagcagccgctctgctgtatgcagccctgggcgatgtggtgagatctgaacaacagatacccctaagcgtggtgaaactctgggctagcgcctttggtggcgaaatcaaatctatcgcagccaagtacagtggatcgcagctgttgcaaaagaaatataaggagtacgaaaaggacgtagcaatcgaggagatcgatggcttgcagttagtgaaaaagctggccaaaaacatggaggaaatgtttcataaaaaatccgaggccgttagacggctggtggaggccgccgaggaagcacacttaaagcatgagttcgatgcagacctccagtacgagtatttcaatgccgtactcatcaacgagcgggacaaggatggaaattttctcgagctcggaaaggagtttatcctagcccccaacgatcattttaataatctgccagtgaacatcagcctgtcagacgttcaagtaccaacgaacatgtataacaaagacccggcgatcgtgaatggcgtctactggtctgagagtctaaataaagtgtttgtagacaatttcgaccgagacccaagtctgatttggcagtacttcgggtctgctaagggattttttcggcaatatccaggtatcaaatgggaacccgatgagaacggagtcatagcatttgactgtagaaaccgaaaatggtatatacaggctgccacttctcctaaggacgtcgtcatcttagtggacgtcagtggctctatgaagggcctcagacttaccatagcaaagcaaactgtatccagcattctggatacactcggcgatgatgacttcttcaacataattgcctacaatgaggaactgcactacgtcgagccatgtctgaacggtactctcgtacaagccgatcgtacgaacaaagaacactttcgcgaacacctggataaactgttcgccaagggcatcgggatgctggatatagcgctgaacgaggcgttcaatatactgtccgattttaatcatactggacagggctctatctgctcccaggctataatgcttatcacggatggcgcggtggacacttacgataccattttcgcaaaatacaattggcctgaccgtaaggttcgtatttttacctatctgattgggagagaggccgctttcgccgataatctgaagtggatggcctgcgccaataagggcttttttactcagatttctactcttgccgatgtccaagagaacgtcatggagtacctgcacgtgttaagcagaccaaaggttattgaccaggaacacgacgtggtgtggaccgaagcctacatcgatagcaccctgcctcaggctcaaaagctcaccgatgaccaggggcccgttctgatgacaaccgtcgctatgccagtgttttcaaagcaaaacgagacacgctccaaagggatacttctgggggtggtgggaaccgatgtgcctgtgaaggagttactgaagaccatccctaaatacaagctgggcattcatggctacgcatttgccatcaccaataacggatacattctgactcaccccgagttgaggctcctctacgaagaaggaaaaaaaaggcggaaacctaactattcatccgtggacctctccgaggtggaatgggaggaccgcgatgatgtgctcagaaacgccatggtcaatcgcaagacgggaaagtttagcatggaagtgaagaaaactgtagataagggtaagcgggttcttgtcatgaccaatgattattattacactgacattaaaggcacaccttttagtctaggagtggcgctctcacgcggtcacgggaagtatttctttaggggtaacgttacaatcgaggagggactccacgatttggagcatccagatgtgagcctagccgacgaatggtcttattgtaacacggatctgcatccggaacataggcacctttcacaactggaggctatcaaactctatcttaaaggcaaagagcctctattacagtgcgataaagaactcattcaggaagtactgttcgatgccgtggtgagcgcgccgattgaagcctattggacttctctggccctgaataagtccgagaactctgacaaaggagtggaggtcgcatttttggggactcgcacaggcctgagtagaattaacctgttcgttggcgccgaacagctcactaaccaggatttcttgaaggccggtgataaggaaaatatctttaatgcagaccattttccgctgtggtaccggagagccgctgagcaaatacccggatcattcgtctacagtataccattttccaccggtccagtcaacaagtccaacgtcgtcacagctagcacttctatccagctgctggacgagagaaagagccccgttgtggccgctgtgggaatccagatgaagctggagtttttccagcgcaagttttggacagcatctcggcagtgtgcctcgctcgacggaaagtgtagcattagttgtgatgacgagacggtcaattgttatttaatagacaacaacggctttatattggtgagcgaagactacacacagactggggacttctttggagagatcgagggcgcagtgatgaacaagctcctgaccatgggttcctttaaacgcattaccttatatgattatcaagctatgtgcagagctaacaaagaatccagcgacggagcacacggcttgcttgatccctataacgcatttctctcggccgtgaaatggattatgactgagctcgtccttttcctggtggagtttaacctctgcagctggtggcatagcgacatgacagctaaagcccagaaattgaagcagacactggagccatgcgataccgagtatcccgcttttgtctcagaacgcacgattaaggaaaccacaggcaatattgcctgcgaggattgctccaagagcttcgttatccagcaaattcctagttccaatctgttcatggtggtggtcgatagttcttgtctctgcgagtccgtggcccctattacaatggcaccaatagagattcgatacaatgaatccctgaaatgcgaaaggctgaaggcccaaaagatcagaagacgacccgagtcctgtcatggattccaccccgaagaaaacgctcgggaatgtggtggggctccaagcctccaagctcagaccgtcttgcttctgttaccactgcttctgatgttgtttagccgttag

SEQ ID NO: 110372 - DNA, 1557 bp, Artificial Sequence
  Description of Artificial Sequence: Synthetic coding sequence
gagatcctatttcaccagatgcagaaccagatcaagcgccttgtagaagccgccgaggaggcccaccttaaacacgaattcgatgcagacctgcagtacgagtatttcaacgccgtcttgatcaacgaacgtgacaaggatggcaacttcctggaactagggaaggagtttatcctggccccgaatgatcatttcaacaatctgccagtaaatatcagcctgtctgacgtgcaggtccccaccaatatgtataataaggaccctgcaatcgttaacggtgtctactggagtgagagcctgaacaaagttttcgtggacaattttgacagggacccttcgctgatctggcagtattttgggtctgccaagggattttttcgccagtaccccggcattaaatgggaaccggacgagaacggagttattgcatttgattgtcgcaatagaaagtggtatattcaggcagcaacctcccctaaggacgtagtaatcctcgttgacgtgagcggctctatgaaaggcctgcgattgacgatcgctaagcagaccgtatcgagcatcctcgacaccttgggcgatgacgattttttcaatattattgcttataacgaggagctgcattatgtagaaccatgtctcaatgggacattggtgcaggccgaccgtacaaacaaggagcacttccgtgagcatttggataagctcttcgccaaagggataggaatgctcgacattgccctgaacgaagcgttcaatatcctgagcgattttaatcataccggtcaaggctcgatttgctcccaggcgattatgctgattaccgacggcgcggtggatacctacgatacaattttcgctaagtacaattggcctgacagaaaagtgcgcatctttacttacttgatcggacgcgaagctgcatttgcagataacctcaaatggatggcatgcgccaataaggggtttttcacgcagatcagcaccctggcggacgtgcaagagaacgtgatggagtatctgcacgtcttgtccagaccaaaagtgatagatcaggagcacgacgtggtctggactgaggcctatatcgactctaccctgaccgacgaccagggccctgttctcatgacgactgtggctatgcctgtgttctctaagcagaacgaaacacggtccaaggggattctgttaggcgttgttggaaccgatgtacccgtcaaagagctcctgaagactattccaaaatataagctgggtatacacgggtacgcgtttgcaataacgaacaacggttacatactgactcaccccgagctgcgcctgttgtacgaggaaggaaagaagaggcgcaaaccaaattacagcagcgtggacctcagtgaggtggaatgggaggatcgggacgacgttctgcgaaacgccatggtaaaccgcaaaactggcaaatttagtatggaggtaaaaaagaccgtagacaaaggatttcggtgtggggcttttcaacgatcatgggagatctttcttccgcgggagtgcaaccaccggagaagacccgcctag

SEQ ID NO: 110373 - DNA, 3276 bp, Artificial Sequence
  Description of Artificial Sequence: Synthetic coding sequence
atggccggccccgggagtcccagacgagcgagcagaggggcaagtgcgctcttggcagccgccttattgtacgccgccttaggcgatgtagtccgaagtgagcagcaaattcccctgagcgtagtgaaactctgggcgtcagctttcggcggcgagatcaagtcaatagctgcaaaatatagtggcagccagctgcttcaaaagaagtacaaagaatatgaaaaagatgtggccattgaggaaatcgatggcttgcagctggtcaaaaagctcgccaagaacatggaggagatgtttcataagaaatcagaagccgtcagacgactcgttgaggctgccgaagaggcccacctgaagcacgagttcgacgcagacctgcagtacgaatatttcaatgccgtacttatcaatgagagagacaaggatggcaactttcttgagttgggtaaagagtttatcctcgcccctaacgaccactttaataacctcccagtgaacatttcactgtctgatgtccaagtaccaactaacatgtataataaggacccagccatcgtgaatggagtctactggtcagagtcgctgaataaggtttttgtggataatttcgatagagacccatcacttatatggcagtatttcggctccgccaagggtttcttcaggcaatatcccggcattaagtgggagcccgacgagaacggcgtgatcgctttcgattgtcggaaccggaagtggtacattcaggccgccaccagtcctaaggacgtagtcattcttgttgatgtaagcggatcaatgaaggggcttcgactcactattgcaaagcagactgtgtcctccatcctggacacgctgggcgatgacgatttcttcaatattattgcctacaacgaggaactgcactatgtagagccatgcctcaacggaaccctggtccaggccgatcggactaataaggagcatttcagagagcacctggacaaactctttgctaaagggattggaatgctagatatcgcactgaatgaagcattcaacatactttcagatttcaaccacaccggtcagggatccatctgcagtcaggctattatgttgatcaccgatggggcggtggatacctacgatactatatttgcaaagtacaactggccggatcgtaaggtaaggatcttcacttatttgatcggaagagaggcagctttcgctgataaccttaaatggatggcgtgcgccaataagggcttctttacacagatttccaccctggcagacgtgcaagagaatgtgatggaatatcttcacgtgctgtctaggcccaaagtcatagatcaggagcacgatgtggtctggacggaagcctacatcgacagcacactaccccaagcgcagaagctgactgacgaccagggccccgtacttatgactactgttgcaatgcctgtgttttccaaacagaatgagacacggagtaagggcattctcctcggtgtggtgggcacagatgtgcccgtcaaggagttgctcaagaccattcccaaatataagctgggcatacacggatacgcatttgccataactaataatggttatatcttgacccatccggagcttaggctactgtacgaggagggcaaaaagcgacgcaagcctaactacagttccgtggacctgagcgaagtagagtgggaagaccgcgacgatgtgctgcgtaacgcaatggttaacagaaaaactgggaaatttagcatggaggtcaaaaaaaccgtcgataagggtaagagggttctcgtcatgaccaacgattactactacacagacatcaaggggacccccttctctctcggagttgctctgagcagagggcacggaaaatacttttttcgtgggaatgtgactatagaagaggggctccatgatctggaacacccagatgtcagcctggcagacgaatggtcctactgtaatacagacctccatcccgaacatcgccacctgtcgcagctcgaagccatcaagttgtatttaaagggcaaggaacctctgctgcagtgcgacaaggaattgatccaggaagtgctgttcgatgccgtggtgtctgcccccattgaggcctactggacttctctcgcactgaataagtctgagaattccgataaaggtgttgaagtcgcgtttctggggaccagaacaggattatccagaatcaatctgtttgtgggggccgagcaactgacaaaccaagactttctgaaggcaggtgataaggagaacattttcaatgcggatcacttcccactctggtatcgccgagcagccgagcagattccagggtcattcgtgtatagcattcctttttccactggccccgttaacaagagtaacgtggtcacagccagcacatctatccagctgctcgacgagcggaaatctccagttgtggccgccgtagggatacaaatgaagctggagttctttcaacggaaattctggaccgcctctagacagtgtgctagcctcgacggcaagtgctcaataagctgtgacgatgagactgtgaattgctatttaatcgataacaacgggtttatcctcgtgtctgaggactatacgcagactggggacttctttggggagattgaaggcgccgttatgaacaagctgctgaccatgggctcattcaaacgtatcaccctgtacgattatcaagcaatgtgtagggccaataaagaaagcagcgatggcgcccatgggctgctggatccttataacgctttcctctcagccgtgaagtggatcatgaccgaactcgtgctgttcctcgtcgaatttaatctgtgttcatggtggcattcggacatgacggccaaagcccagaaattaaagcagactctcgaaccatgtgatactgagtacccagcctttgtgagcgaaagaacgataaaagagaccactggaaatatagcgtgcgaagattgcagtaagtcttttgtgatccaacagataccttcatctaatctgtttatggtggtggttgattctagttgtctgtgcgaatcagtggccccaattaccatggccccaatcgaaatacgctacaatgagtccttgaaatgcgagcgtctaaaagcgcagaagattagaaggcggcccgaatcctgtcacggttttcaccccgaggaaaacgcacgggaatgtgggggagccccaagtttgcaggcacagacagtactcctgctgcttcccctcctcctgatgctgttcagtcgctag

SEQ ID NO: 110374 - DNA, 1578 bp, Artificial Sequence
  Description of Artificial Sequence: Synthetic coding sequence
atggaggaaatgttccacaagaagtccgaggcagtgcggcggctcgtcgaagcagctgaggaggcgcatctgaaacacgagttcgacgcagatctacagtatgagtattttaatgcagtgctaattaacgagcgggacaaggatggtaacttccttgaattagggaaggaatttatcctggcccccaacgaccattttaacaacctacccgtcaacatcagccttagtgatgtgcaggtacccacaaacatgtacaacaaggatcccgctatcgtgaatggagtatactggtcggaatccctaaataaagtttttgtggacaattttgaccgggacccgtcactcatatggcagtactttgggagtgcaaagggtttttttaggcaatatcccggaatcaagtgggaacccgacgagaatggagtgattgctttcgattgccggaatcgcaagtggtatattcaggccgctacctcgccgaaggacgttgtgatactggttgacgtgtccggctctatgaaagggctgcgattgaccatcgctaaacaaacagtgtcgagcatcttggacactctcggagatgacgactttttcaatatcatcgcgtacaatgaggaactccactatgtggaaccctgcctgaacggtaccttagttcaggccgaccgtacaaataaggaacattttagagagcacctcgataaactctttgccaaaggtattgggatgctcgacatcgcactcaacgaggcctttaacattctcagtgatttcaatcatacaggacagggcagcatctgcagccaggccattatgctgattacggacggagccgtagatacttatgatacaattttcgcaaagtataattggcctgaccggaaggttcggattttcacctatctgataggccgagaggcagctttcgctgacaatttgaaatggatggcttgcgcaaataaaggcttctttacgcagattagcactttagcagatgttcaagagaatgtcatggaatatctccacgtcctgagccgacctaaagtgatcgaccaggagcatgacgtcgtttggaccgaggcctatatcgacagtactctcccacaggcacagaagctcaccgatgatcagggcccagtgctcatgacaactgtagctatgccagtgttttctaagcaaaatgaaaccaggagcaagggcatcctcttgggggtagtggggaccgacgtacccgttaaagaactccttaaaaccatccccaaatataaactgggcattcacggctacgcatttgctattaccaataacgggtacattctcacccaccccgagctccgtcttttatatgaagaaggaaaaaagcgcaggaagcctaactatagtagcgtggatttatcagaggttgaatgggaagaccgggacgacgtgctgcgtaacgctatggtgaacaggaagacagggaagtttagtatggaggtgaaaaaaactgtggataaggggttccggtgcggggcctttcaacggtcttgggagatttttctccctcgggagtgtaatcatagacgcagaccggcttag

SEQ ID NO: 110375 - DNA, 2994 bp, Artificial Sequence
  Description of Artificial Sequence: Synthetic coding sequence
atggaggagatgttccacaagaagtccgaagcggtccgaaggttggttgaggctgcagaggaggcccacttgaaacatgagttcgacgccgacctgcaatatgaatacttcaatgccgtcctgatcaacgagcgtgacaaagatggtaacttcctcgagttgggaaaggagtttatcctagccccaaacgaccattttaataatctgcctgtgaatatttccttaagtgatgtgcaagtgccaacaaacatgtacaacaaggacccggccatagttaacggcgtttattggagtgagagcctcaataaagtctttgtggataacttcgacagggacccgagcttaatctggcagtactttggttccgccaaggggttttttcgccagtacccggggatcaaatgggaacctgacgagaatggggtcatcgcttttgattgccgcaataggaaatggtacattcaggctgccaccagtcccaaggacgttgtaatactggtcgacgtgtctggaagcatgaagggactgaggctgaccatagccaagcagactgtcagcagcattctggacacgcttggcgacgatgattttttcaacatcatagcgtacaatgaagaactccactacgtggagccttgcctaaacgggacactggtccaggccgaccgcactaacaaggaacacttcagggagcacttagataaattgtttgccaagggcattggcatgttagatattgccttaaacgaggcatttaacatcctgagtgactttaaccatactggccaggggtccatctgttcccaggccattatgctgattaccgatggggccgttgacacttacgataccatcttcgcgaaatacaattggcccgatagaaaagtgcggatattcacatacctgattggaagggaggcagcgttcgccgacaacttgaagtggatggcatgcgcaaacaaggggtttttcacgcagatcagcacgctggctgacgttcaagagaatgttatggaatacttgcatgtcctgagccgccccaaggtcattgatcaagagcacgacgtggtgtggacagaagcatacattgactcaacacttccacaggctcagaaactgacagatgaccagggaccagtcctgatgactactgtggccatgcctgtgttttcgaaacagaatgagacaagatcaaaaggcattctgcttggagtcgtgggaacagacgttcctgtaaaagaattactgaagactattcccaagtataaactggggatccacggctatgcttttgcgattacaaacaacgggtatatcttgacacatcctgagctgcggttgctgtacgaggagggaaaaaaaaggcgcaagccaaattacagttccgtggatctgagcgaagttgagtgggaagaccgcgacgacgttttgcggaatgctatggtgaacaggaagaccggtaaatttagcatggaggttaagaaaactgtcgacaaggggaagcgggtgctggtgatgactaacgattactactacactgatataaaaggtaccccattcagcctcggcgtcgccctctctagagggcacgggaaatattttttcaggggcaatgttaccatcgaggaagggctgcacgacctggagcaccctgacgtcagtctggccgatgaatggtcctattgcaacacggatctgcatcctgagcacagacacttgagtcagctggaagctatcaaactgtaccttaaaggaaaagagcccctgctgcagtgcgacaaggagctgatccaagaggtgttgttcgacgccgtggtgagtgcaccgatcgaagcctattggacctctctagccctaaacaaatcggagaactctgacaagggcgtggaagtagccttcctcggaacccgcaccggactgtcacgcattaacctgttcgtgggcgctgaacagctgacaaaccaggactttctgaaagcaggcgataaggagaacattttcaatgctgatcatttcccactgtggtaccggagggcggcagagcagattccaggtagcttcgtctatagcattccattcagcaccggaccggtgaataaatccaatgtcgtaacagcatccacctctatccagttgcttgatgagcgcaagagtccggtggtggccgccgtggggatacagatgaaactcgagtttttccagaggaagttctggaccgctagccggcagtgcgcttccctcgatggaaagtgctctatatcgtgcgatgatgagacagtcaattgttacttgatcgataataatggcttcatactcgtgtctgaagactacacgcaaactggcgacttttttggagaaattgaaggagccgtgatgaataagctgctaactatggggagtttcaagcggatcaccctttatgactaccaggcaatgtgtagagcaaacaaggaaagttccgacggcgcacacggcctcctcgatccttacaatgccttcctctctgctgtcaagtggattatgacggagttggtactgttcctggtcgagtttaatctctgcagctggtggcattctgacatgactgccaaagcacagaagctcaaacagaccctggaaccttgtgacacagagtaccctgcattcgtatctgaacgcaccattaaggaaacaacaggcaacatagcatgcgaagactgttctaaatccttcgtcattcagcaaatccctagttctaacttatttatggttgtggtcgattcatcatgtctgtgtgaaagcgtcgcccccataacaatggctccaattgagatcaggtacaatgagagtctcaaatgcgagaggctgaaagcacagaaaattagacgccgaccggagtcctgtcacggcttccaccccgaggaaaacgcccgtgagtgcgggggggctccaagcctccaggcccagactgttctcctgcttctgcccttactgctgatgctcttcagccgctag

SEQ ID NO: 110376 - DNA, 381 bp, Artificial Sequence
  Description of Artificial Sequence: Synthetic coding sequence
atggaagagatgtttcacaagaagagcgaagccgtgaggaggctggtcgaggctgccgaggaagcccacctgaagcatgaattcgatgccgatctccagtacgagtacttcaacgcagtgctgatcaatgaaagagataaagacggcaacttcctcgagctgggcaaagagttcatactcgcccctaacgaccacttcaataacctgcccgtgaatattagtttgtctgacgttcaagtacctactaatatgtacaacaaagacccagccatcgtgaatggggtgtattggtccgagtccctgaacaaagtgtttgttgataatttcgaccgtgacccaagcctaatctggcagtactttggctccgcaaaaggcttttag

SEQ ID NO: 110377 - DNA, 2925 bp, Artificial Sequence
  Description of Artificial Sequence: Synthetic coding sequence
atggtttgcggttgtagtgcgttgctccccctgccgaacccacgaccaacaatgcccgcgacacctaacttcctcgctaatccctcatcgtcgtcccgctggatccccctccagcccatgccggtcgcctgggcgttcgtgcagaagacatcagccctcctgtggctgcttttactgggtacttcactgtcccccgcttggggtcaggcaaagattcctttggaaactgttaaattgtgggcagacactttcggtggagacctttataacaccgtgacaaaatattcaggttccctgttacttcagaagaagtataaagacgtggagagcagtcttaaaatcgaggaggtggatggactcgaacttgtaagaaaattcagcgaagacatggaaaatatgttgcgccgaaaagtcgaagctgtccagaaccttgtagaagccgcggaggaggctgacctcaaccacgagtttaatgaaagtctggtctttgactattacaactctgtgcttattaatgagcgcgatgagaagggtaattttgtcgaactgggagctgaattcctcctggagtctaacgcccacttttctaatctccccgtgaacacatctatttcgtccgtgcagctgcccactaatgtgtacaataaggatccagatatattgaacggcgtttatatgtcagaagcactcaacgctgtcttcgttgaaaatttccagagggaccccacgctaacctggcaatacttcggttctgcgacaggtttcttcagaatttaccccggcattaagtggacgcccgacgaaaacggggtaattacgttcgactgcaggaacagggggtggtacatccaggctgccacgtccccaaaggatatcgtgattctagtggatgtaagcggtagcatgaaagggcttcgaatgacgatagcaaagcatacaataaccaccattctggatactctgggtgagaacgattttattaacattatagcctacaacgactacgtccactatatcgaaccatgcttcaagggaatcctcgtgcaagcagaccgagataaccgggagcatttcaaactcctcgtggaggagctcatggtgaagggtgtcggcgttgtggatcaagctttgagggaagcctttcagattctgaagcagtttcaggaagctaagcaaggaagtttgtgtaatcaggccatcatgctaattagcgacggcgcagtggaagattatgagcctgtcttcgagaaatacaattggcccgattgtaaagtgagggtgtttacatacctgatcggacgcgaggtgtcctttgccgatagaatgaaatggatcgcttgtaacaataagggttattacactcaaatctccactttggctgatacccaggagaatgtcatggagtacctgcacgtcctgagccgaccgatggttattaaccacgaccacgatatcatttggaccgaagcttacatggactccaaactcctctctagtcaggcgcagagcttaaccttgttaactacagtggctatgcccgttttttccaagaagaacgagactcgttcccatggaatccttcttggggtcgtgggttcagatgtggccctgcgagaattgatgaaattggctccccgctacaagcttggcgtgcatggatatgccttcttgaataccaacaatggctacatactgtcccatcccgacctgcgccctctgtatcgtgaaggaaaaaaacttaagccgaagcccaattataactcagtagacttgtccgaggtagaatgggaagatcaggcagagtccttgcgtacagccatgattaatcgggagaccggcaccctgtcaatggacgtcaaagtcccgatggataaaggaaaacgcgtactgttcctgaccaacgactacttctttaccgatatcagcgatactccattcagtctcggagtagtgctttcgcgggggcacggagagtatattctactgggaaatacctctgttgaagagggactgcacgatctgctccatcccgatctggccctcgccggggactggatatattgtataactgacatagatcctgaccacagaaaactatcacagctcgaagccatgattcgctttctaacccgtaaagatcccgatttagagtgtgacgaggagctcgtgcgcgaagtactgttcgatgcggtggttacagctcctatggaagcttattggacagcacttgccctgaatatgtctgaggagagcgaacacgttgtggacatggcatttctcgggactcgggctgggttactgaggtcttctctgttcgttgggtccgaaaaggtaagcgatcgcaaatttctcaccccagaagatgaagcctctgtgtttaccctagatcgtttccccctgtggtatcggcaggcgtcagaacacccagccggcagtttcgtcttcaacctcaggtgggcagagggtcccgagagcgccggggaaccaatggttgtgactgccagtacagctgttgccgtgacggtagataaacgaacagcaattgcggcagccgctggtgtgcagatgaagctggagttcctacagaggaagttctgggcagccaccagacagtgttctactgtcgacggcccctgtacacagagctgtgaagacagcgatctggattgcttcgttatcgacaataatggctttattctcatctcaaaacgatctcgtgagacgggacgattcttaggagaagtagatggggcagttctcacacaactgctgtcgatgggagttttttcccaagtaacaatgtatgattatcaggcaatgtgtaagcccagctcacatcatcacagcgccgcacagcccctggtgagtcccatcagtgctttcctgactgcgacaagatggctcctgcaggaacttgtactgtag

SEQ ID NO: 110378 - DNA, 3414 bp, Artificial Sequence
  Description of Artificial Sequence: Synthetic coding sequence
atggtatgcgggtgctctgctttgttgcccctgcccaatccccgaccaactatgcccgccaccccaaatttccttgcaaatcctagctcttcctcacgttggattcctctgcagcctatgccagtcgcctgggcatttgtgcagaaaacgtctgcactgctatggctgctcctgttgggaacaagtctgtctcctgcttggggccaggccaagatccctctggaaactgtcaagctgtgggcagacacctttggaggcgatctgtacaacacggtcaccaagtactccggctcgctgctgctgcagaagaaatacaaggatgtggagtccagcttgaagattgaagaagtggatgggctcgaactagtccggaagttcagtgaagatatggaaaatatgctccgacgcaaagtggaggccgtccagaatctcgtggaggctgccgaggaggcagacctcaatcacgaatttaatgaatcattggtgttcgactactataatagcgttctgataaatgaacgggatgagaaagggaactttgtcgagctgggcgccgaatttctcctggaatccaacgcgcatttcagcaacttgcctgtaaacacctccatatcctcagttcagcttcctaccaatgtgtacaataaagacccagatatcctaaacggcgtgtacatgtccgaagctctgaacgctgtgttcgtagagaattttcaacgagatcccaccctgacatggcagtactttggttcagctaccgggttctttagaatatatcccggcataaagtggactcccgacgaaaacggtgttattacattcgattgcagaaaccgaggctggtacattcaggctgccacttctccaaaagacatcgtgatcctggtggatgtaagcggaagcatgaaaggtctgcgtatgaccatcgccaagcacacgattactaccattctggacacactgggggagaacgatttcattaacattattgcatacaatgattacgttcactatattgaaccctgcttcaagggcatacttgttcaggcagaccgtgataaccgcgaacattttaaactccttgtagaggaattgatggtcaaaggagttggggtggtggaccaggctctgcgggaagcattccagattctgaagcagtttcaggaagccaagcagggctcactttgcaaccaagctattatgctgatatcggacggcgcggtggaagactacgaacccgtgtttgagaagtacaactggcctgactgtaaggttagggtgttcacatatctaattggacgggaggtttcattcgccgatcggatgaagtggattgcgtgtaataacaagggctactatactcaaatctcgactcttgccgacacccaagagaatgtaatggagtacctccacgtgctaagcagaccgatggtcatcaaccacgaccatgatattatttggacagaagcttatatggacagcaagcttctctccagtcaggcccaatccctcacactactgactaccgtggccatgccggtgtttagtaagaagaatgagaccagaagccatggcatcttgttaggcgtggtgggaagtgatgtggccttgcgagagcttatgaagttagccccaagatacaagctcggggtccacgggtacgcttttctgaatacgaacaacggttatatactgtctcatcccgatctaagacctttataccgggaggggaagaaactaaaaccaaaaccgaactacaacagcgtggacctgtctgaagttgaatgggaagaccaagctgagtctctcagaacagcgatgatcaatcgcgagactggcactctgtcaatggatgtgaaggtccctatggataaaggaaagagggtgctattcctgacgaacgactacttttttactgacatctctgataccccatttagtctgggagtggtgctatcaaggggccacggagaatatatactcctaggtaatacttccgtggaagagggactgcacgatctgcttcatcctgatcttgccctggccggtgattggatatactgtatcacagatatagatcccgatcataggaaactgtctcagttggaggcgatgattaggtttctgactaggaaggacccagacttggagtgcgacgaggaactcgtcagagaagtgctgttcgatgcagtggtgaccgcccctatggaggcctattggacggccttggcccttaatatgagcgaagaatcagaacatgtagtcgacatggcatttctggggacacgtgctgggctgctacggtctagcctattcgtgggaagtgaaaaagtgtcggatcggaagttccttacgcctgaagatgaagcaagtgtgttcacactggacaggttccctctgtggtacagacaggctagtgaacatccggcgggttcatttgtctttaatcttaggtgggcggaaggtccagagagtgcaggggagcctatggttgtgactgcttcaacagccgtcgccgttaccgtcgataagcgaactgcaatcgccgctgctgcaggtgtgcagatgaagctggaattcttacagagaaagttttgggctgctacacggcaatgctctactgtcgatggcccctgtacacagtcatgcgaggattcggaccttgattgtttcgtcattgataacaatggtttcatcctgatctcaaagcgcagccgggagaccggaaggtttctgggcgaggttgatggtgccgtcctgacccagctgctgagcatgggagtcttctcccaggttaccatgtatgactaccaggccatgtgcaagccaagctctcatcatcatagcgccgctcagccgctggttagtccaatttctgcctttcttacagctacacggtggctgctgcaggagttagtcctgttcttgctcgagtggtctgtttggggctcctggtatgatcgtggcgctgaagccaagtcggtctttcatcactcccacaaacataagaagcaggaccctctgcagccgtgcgatactgaatacccagttttcgtgtaccagcccgccatccgggaggccaatggcattgtggagtgcggaccatgtcagaaggtcttcgtggtccagcaaatacctaacagcaatctgctgttactagtcaccgaccccacctgcgactgtagcatctttccgccggtgctacaggaagcgacagaagtcaaatacaatgccagcgtgaagtgcgacagaatgcggagtcagaagctgcggcgcagacccgatagttgtcatgctttccatcccgaagaaaacgcacaggactgcgggggggcctccgataccagtgccagtcccccattgctgctgctgcccgtgtgtgcctggggcctgctgcctcaactcctgcggtag

SEQ ID NO: 110379 - DNA, 3222 bp, Artificial Sequence
  Description of Artificial Sequence: Synthetic coding sequence
atggcggtggctctgggcaccaggaggagagacagagtcaagctctgggcggacacgtttggtggagacttatataacacggtcaccaagtactccgggagcttactgctacaaaagaagtacaaagatgtggaaagtagcttgaagattgaagaggtggacggactcgagctggtgcgaaaattttctgaggacatggaaaacatgctgaggcggaaggtggaagctgtacaaaacctggtggaggccgctgaggaggccgaccttaaccacgagtttaacgaaagtctggtgtttgattactacaattcagtattgattaatgagcgtgatgagaaaggaaactttgtggagctgggtgctgagttcctgttagaatccaatgcccacttctcaaacttgccagtgaataccagcatcagcagtgtccaactgccaacgaacgtttacaacaaagatcccgatattctgaacggagtctacatgtcagaagccctcaacgccgtatttgtcgagaacttccagcgggaccccaccctgacctggcaatatttcggctcagcaacaggattttttcgcatctatccaggcattaaatggaccccagatgagaacggagtgattaccttcgattgcaggaaccggggatggtatattcaggccgctacttcaccaaaggatatcgtaattctggtcgacgtgtccggcagtatgaagggtttgcgcatgacgatcgcgaagcacactattactaccattctggatacattgggtgaaaacgacttcataaatatcatcgcctataatgactatgtgcactacatcgagccatgctttaaaggaatcctggtccaggccgaccgtgacaatcgcgagcactttaagttactggtggaagagctgatggtcaagggggtgggggtggtggaccaggccttgcgggaggccttccagatcctgaagcagttccaagaggccaaacagggctctctgtgcaaccaggctattatgctgatcagcgacggagccgtcgaagactatgagcctgtattcgaaaagtataactggcccgattgtaaagtgagagtattcacttacctaattgggagagaagtctcctttgcagacaggatgaagtggatcgcttgtaataacaaaggatactacacccaaatctctactttagctgatacacaggagaacgtgatggagtacctccacgttctgtctcggccaatggtcatcaaccatgatcatgacattatctggactgaagcatacatggatagcaagttattgtcatcacaggcccagtctttgacgttactcactactgtagccatgcctgttttctctaaaaaaaacgagacacgctcgcacgggatcctgctgggagtggtagggtctgatgtcgccctcagggaattgatgaaattggccccacgctacaagctaggagtgcatgggtacgctttcctgaacactaacaatggctacattctgagtcatccagatctgcgacctctttacagagagggtaagaagcttaaaccaaaacctaactataattcagtcgatcttagcgaggtggagtgggaggatcaggcggagagcctgcggacagccatgattaatcgtgagactggaactctctccatggacgttaaggtccctatggacaaaggtaagcgggtactctttctgacgaacgactattttttcacagacatttccgacacccccttctccctgggagtggtgctgtcccgcgggcacggggaatacattctgctcggcaatacctctgtcgaagagggactgcacgatctcctgcatcctgatctggccttggcgggagactggatttactgtattactgatattgatccggatcatcggaagctttcacagctggaggctatgatccggttcttgactagaaaagatcctgatctggagtgcgacgaggagcttgtgagagaggttttattcgacgcagtagtcacagccccgatggaggcctattggaccgcactcgcgcttaacatgtctgaggaatcagagcacgtcgttgatatggccttcctaggcacccgggccgggctactccgatctagcttgttcgtgggttccgagaaagtatcagaccgcaaattcctcactccagaagatgaagcctcagttttcacacttgatcgcttcccgctgtggtaccgtcaggcaagcgagcacccagcaggctcattcgtattcaacctgaggtgggccgagggtccagagtccgccggcgagcctatggtagtgaccgcaagtacagcagtcgcggtcacggtggacaagagaacagcgatcgcagccgccgccggcgtgcagatgaaactcgaattcctccaaagaaagttttgggcagctaccagacagtgctcaaccgttgatggtccgtgtacacagagctgtgaggactccgatcttgattgcttcgtaattgataataatggttttatcctcatctccaagagatctcgcgaaaccggtcgctttttaggagaggttgacggagctgtcttgacccagctgttgtccatgggagtgttctctcaggttaccatgtatgattaccaggccatgtgcaaaccttcgagccaccaccattctgccgcccaacccttagtctctccaattagtgcctttctgacagccacgagatggcttctccaggagctggtgttattcttgctggaatggtcagtttggggctcctggtacgataggggggcggaggccaaaagtgtctttcatcattcccacaaacataagaaacaggatccactccagccttgtgataccgagtatcccgtgttcgtatatcaacccgccattcgcgaggcaaatggcatcgtggagtgtggtccgtgccagaaggtgttcgttgtgcagcagatacccaactctaatctgctgctactggtgactgacccaacatgtgattgcagcatctttccacccgttttacaggaggcaaccgaggtcaagtataatgcctcagtgaagtgcgatcgcatgagatcccaaaaactgcgcagaaggcctgactcatgccatgccttccaccccgaggaaaacgctcaagactgcggcggagcctctgatacctctgctagccctcccctgctgctcctcccagtttgcgcctggggtcttttgccgcagttgctgcgctag

SEQ ID NO: 110380 - DNA, 615 bp, Artificial Sequence
  Description of Artificial Sequence: Synthetic coding sequence
atgtatgattatcaggctatgtgcaaaccatcctcgcatcaccactctgcagcacagcccctggtctccccaatcagtgcctttctcaccgctaccaggtggttgcttcaggaactcgttctcttcctgctggaatggtccgtgtggggatcttggtacgacagaggcgcagaggccaagtctgtttttcaccattcacataagcacaaaaagcaggacccactgcagccctgcgacacagagtatcctgtgttcgtctaccagccagccatccgggaagcaaacgggatagtcgagtgcgggccttgtcagaaggtattcgttgtccagcagattcctaattctaatttgctgctattagtgacagatccgacctgcgattgctcaatttttccccctgtgctccaggaggctaccgaggtcaaatacaatgcgtctgtgaagtgcgatcgaatgcgctcgcagaagctgcgaaggcggcccgattcttgccacgctttccaccccgaagagaacgcgcaggattgcgggggcgccagtgacacatccgcctctcctcctcttctgttactgcccgtttgcgcatggggactgctgccacaacttctgcggtag

SEQ ID NO: 110381 - DNA, 615 bp, Artificial Sequence
  Description of Artificial Sequence: Synthetic coding sequence
atgtatgattaccaggccatgtgcaagccctccagccaccaccatagtgctgcccagcccctggttagtcctatttcagcattcctgaccgctaccagatggctgttgcaagaattggtgctgttcctgctggagtggagtgtgtggggcagttggtacgacagaggagccgaagcgaaatctgtgttccaccattctcacaagcacaagaagcaggaccccctccagccatgtgacaccgaatacccagtcttcgtgtatcaacccgcaatccgcgaggctaacggcatagtggaatgtggaccttgtcagaaagtgtttgtggtccagcagatccccaactctaacctcctcctgctagtgaccgatccaacgtgcgactgtagcatttttccccccgtcctgcaggaagctacggaagtcaagtataatgcctcagtgaaatgtgatcggatgcggtcccagaaattaagaaggaggcccgattcttgccatgcctttcatccggaagagaacgctcaagattgtggcggcgcaagtgacacaagcgcaagcccaccactcctcctactgccagtatgtgcctggggtctgcttccccaactgctcaggtag

SEQ ID NO: 110382 - DNA, 804 bp, Artificial Sequence
  Description of Artificial Sequence: Synthetic coding sequence
atgaaacttgagttcctccagcgcaagttctgggctgctacccggcaagatctagattgcttcgtaatcgataataatggctttatcctgataagtaagcggtcgagggagaccggtcgatttctcggtgaggtggatggtgcggtattaacgcaactgctgagtatgggtgtgttctcgcaagttaccatgtacgactaccaggccatgtgcaaaccgtcttcacatcaccactcagccgctcagccattggtatcccctatctcagcattcctgaccgccactcgatggcttctgcaggagttagtgctcttcctactggagtggtcggtctggggcagttggtacgatcggggcgcagaagctaaaagtgtattccaccacagccataaacataaaaagcaggaccctctgcagccttgtgacaccgagtacccggtattcgtgtaccagcccgccatcagggaggcaaatggtatcgtcgagtgcggcccctgccagaaggtgtttgtggtgcaacagatcccaaattctaacctgctcctgttggttaccgacccaacgtgcgactgcagtatctttcctccagtgttacaagaggccacagaagtcaagtacaacgccagcgtgaagtgcgaccgaatgaggagccagaaactgagaaggcgcccagattcttgtcacgcgttccacccagaagagaacgcacaagattgtgggggtgcttcagatacaagcgctagtcccccactgctactcctccctgtgtgtgcctgggggctgctgccgcaattgctcaggtag

SEQ ID NO: 110383 - DNA, 615 bp, Artificial Sequence
  Description of Artificial Sequence: Synthetic coding sequence
atgtacgattaccaagcgatgtgcaaaccgagcagtcaccatcactccgccgcacagcccttggtatctccgatatcagccttcctgactgccacaaggtggctgctgcaggaactggtgctgtttctcctggaatggagcgtgtgggggagctggtacgacaggggagctgaggccaaaagtgtttttcaccatagccataagcataagaaacaagaccctctccagccatgcgacactgaataccctgtgtttgtgtaccagcccgcaatacgcgaggcgaatgggatagttgaatgcggcccctgccaaaaggtcttcgtagtccaacagatccccaatagtaatctcctgctactggtgactgaccccacctgcgactgcagcatttttccgccggttctgcaagaggccactgaggtgaaatataacgcctccgtgaagtgcgacagaatgcgctcacaaaaactaagaaggcgaccggactcgtgtcacgcctttcacccggaagagaacgcccaggattgcgggggcgcctctgatacatctgcatcccctccactgctactactgcccgtctgtgcctggggcctccttcctcagcttctgaggtag

SEQ ID NO: 110384 - DNA, 1572 bp, Artificial Sequence
  Description of Artificial Sequence: Synthetic coding sequence
atggtgcagaaaacatcaatgtccaggggcccatatcctccatcccaggagatacccatggaggtttttgacccatccccccagggtaagtatagcaagaggaaaggtaggtttaaacggagcgatggaagcacgagctcagatacaactagcaactcatttgttagacaggggagcgccgaatcctatacaagccggcccagcgactccgacgtgagtctggaggaagacagggaagctctgcgcaaagaggccgagaggcaggccctagctcagctagagaaggccaagacaaaaccggtggcatttgccgtgcgaacaaatgtagggtataatccatccccgggggatgaggttccagtgcaaggtgtcgccattacatttgagcctaaagattttctgcacatcaaggagaagtacaataacgattggtggattggtcgtcttgttaaggagggttgcgaggtgggctttattccctcccccgtgaaactggacagtctgcgtttgcttcaggagcagaagctgcgtcagaatagactaggtagctccaagagtggcgacaatagctcctcttctctcggagatgtcgtcaccggcacaaggcgtcccacacccccagcttcgggcaacgaaatgacaaacctggcttttgaattggatccgctcgaacttgaggaagaggaggcggaacttggcgaacagagtggtagtgctaaaacttcagtaagcagcgtgaccacgcctccgccccatggcaaaagaatcccattttttaagaagactgagcacgtcccaccttatgacgtggtgccctccatgcgacccattatcctcgtcggtccgagccttaagggatatgaagtgacggatatgatgcagaaagctttattcgatttcctgaagcatagattcgacggtagaattagcatcacaagggtgacagcagacatctcactcgcaaagagaagcgtgcttaacaaccccagcaaacacattatcatcgagcgttcaaacacacggtcatctctcgcggaagtgcagtctgaaattgagagaatctttgaactggccagaacactccagctggtcgctctcgatgccgataccatcaatcacccggctcagctgtctaagacaagtcttgccccaataatagtttacatcaagatcacctcgccgaaggttcttcagcgactgattaagtcaagaggcaagagtcagagcaaacacttaaacgtacagatcgccgctagcgagaagttggctcagtgcccgcctgagatgttcgacattatcctcgacgagaaccaactggaggacgcatgtgagcacctggcggaatatctggaagcctactggaaagccacacatcctccgagctccacacctcccaaccccctgctgaatcggacaatggcaactgctgcgttggccgcatccccagcccccgtcagcaatctccaggttcaagtcctgacatccttgcgccggaatttgggcttctggggcggattggagtcaagtcagcgcggctccgttgtgcctcaagaacaggagcatgctatgtag

SEQ ID NO: 110385 - DNA, 1797 bp, Artificial Sequence
  Description of Artificial Sequence: Synthetic coding sequence
atggtgcagaagacaagcatgtctcgcggaccctatccaccgtctcaggaaatccctatggaagtatttgacccaagccctcaaggcaagtactcaaagcgtaagggtaggtttaaacgatccgatggctctaccagcagcgacactacctccaattcttttgtgcggcaaggttccgccgagagctataccagccggccctctgacagcgacgtttccctggaggaggaccgcgaggcactgaggaaggaagccgaacgccaagcccttgcacaattagagaaagcaaagactaagcctgtcgccttcgccgtcaggaccaacgtgggctataatccctccccaggggacgaagtgccagtgcagggcgtcgctatcaccttcgaaccgaaagattttctccacattaaggaaaagtacaataatgattggtggatcggccgccttgtgaaagagggatgcgaggtcgggttcataccgtcccctgtcaaactagattctctacggttgttacaggaacagaaattacggcaaaatcggttaggaagctcaaagtccggcgacaactcatcatcttccctgggggacgtggtcaccggcacacgacggcccacgcctccagcatccgcaaagcagaaacagaagtcaacagagcatgtacctccctacgatgtggtgcccagtatgcgaccaatcattctcgtagggccttcgctgaaggggtacgaagtcactgatatgatgcagaaggccttgtttgatttcctcaaacacagattcgacggaaggattagcattacccgagttacagcggacatctccctcgccaagagatctgtgcttaacaatccctccaagcacataatcattgagcgttccaatactcggtctagtttggccgaggtccagagtgaaatcgagcgtatattcgaactagccaggaccctacagctcgtcgcccttgatgcagacactattaaccaccccgcccaattaagcaagacatctcttgcccctatcatagtgtacataaagattacctctcccaaggtgctgcaacggctcattaagtctcgtggaaaatcacagtccaagcatttgaacgtccagattgccgccagcgagaaactggcgcagtgcccaccagaaatgttcgacatcatacttgatgagaatcagctcgaagacgcgtgtgagcatttagctgaataccttgaggcgtactggaaggcgacgcaccctcccagcagcacgccccctaaccccctactaaaccgcactatggcaactgcagcgctagcagcatcacctgcacccgtcagcaacctgcagggcccctatctggcctccggggaccagcccctcgaacgcgctacaggcgagcacgccagtatgcacgaatatccaggagaactaggccagcctcccggactgtatccaagcagccaccctccagggcgtgcaggtacccttcgcgctctcagcaggcaggatacattcgatgctgacacaccaggatctaggaattcggcctatacggagctgggtgattcatgcgttgatatggaaaccgacccttccgaagggcctgggctcggcgacccggcaggagggggcactcccccagcccggcagggttcttgggaggatgaagaagaagattacgaggaggagctgactgataatcggaaccgtgggaggaataaggcaaggtactgcgccgaggggggggggcctgtgttaggcaggaataagaatgaactcgaaggctgggggcgcggtgtatacattagatag

SEQ ID NO: 110386 - DNA, 1437 bp, Artificial Sequence
  Description of Artificial Sequence: Synthetic coding sequence
atggtgcagaagacctccatgtctagggggccctaccctcccagccaggagatccctatggaggtgtttgacccctcaccccagggaaaatactcgaagcggaagggacgctttaagcggtcagacggatccactagctctgatacaactagtaacagcttcgtccgacagggctcagcagagagctacacgtcgaggccatctgatagtgacgtgtcgctcgaggaagatagggaggcattgcggaaggaggctgaacgtcaggcactggcccagctggagaaggctaaaaccaaacccgtggcttttgctgtccggaccaatgttggatataatccatccccaggcgacgaggttccagtgcaaggcgtcgccataactttcgagcctaaggacttcctacatatcaaagagaagtacaacaatgactggtggatcggaagactggtgaaagagggctgtgaggtcggattcatcccttcccctgtgaagttggacagtttgaggttgctgcaggagcagaagctgcgccagaaccggctcggctcttctaagtccggagataacagtagcagcagtttgggggacgtggtgacagggacaagaagacccacccctccagccagcgccaagcagaagcaaaagtccaccgagcacgtacctccttatgacgtagtgccatcgatgcgtccaattattttggttggccctagtttaaaaggctacgaggttactgatatgatgcagaaggccctgtttgatttccttaagcaccggttcgatggacgcatctctatcactcgtgtgaccgcggatatctcccttgcaaagaggtcagttttaaacaacccttctaagcatataattattgaaagatctaacactaggtcctcgctcgccgaggtccagtcagaaatagaacgaatatttgagctggctcggaccctccagctagtcgcacttgacgcagacaccattaaccaccctgcccagctcagcaaaacctctctggccccgatcattgtgtatatcaagatcacaagtcctaaagtactgcagcggctgattaagtcaagaggaaagagtcagtctaagcacctgaatgttcagatcgctgcatctgagaagctggcgcagtgtccacccgagatgtttgacatcattctggatgagaaccaactcgaagatgcatgtgagcatctggccgagtatctcgaggcctattggaaggccactcaccccccatcatccactccgcccaatcccctgctgaaccggaccatggcaaccgcggctcttgccgccagccccgcacctgtttctaatctccaggtgcaggtgctgacctccctcaggagaaatctggggttctggggtgggctagaatcctcacaacggggaagtgtggtgccgcaggaacaggaacacgctatgtag

SEQ ID NO: 110387 - DNA, 1290 bp, Artificial Sequence
  Description of Artificial Sequence: Synthetic coding sequence
atggaggccccgagtagaaccgtggtggtcggttcagccgagtcatacacgtccaggccatccgattccgatgtgtcgctggaggaggatagggaggccctacggaaggaggcggagcgccaggcgcttgcccaacttgaaaaagccaagaccaaaccagtggccttcgccgttagaactaacgtgggctacaaccctagtcctggcgatgaagtacccgtccagggtgtcgctatcacctttgagccgaaggactttcttcatatcaaagagaaatacaacaacgattggtggattggcaggctggttaaggaagggtgtgaagtgggcttcatcccatccccagtgaagctcgatagtctccgtcttctgcaagaacaaaagctgaggcagaatagactcggatcctctaaaagcggcgacaattcctcgagttcgctgggagacgtggtgaccggaacccgccggcctacacccccggcctctgactctcccgtccagacggaacacgtgccaccctatgatgttgtgccctctatgcgaccaatcatcctggtgggacccagccttaagggctacgaagtgacagacatgatgcaaaaagccctcttcgacttcctgaagcaccggttcgacggccggatctctatcacaagagtgactgcagatatctccctcgccaaaaggtccgtcctgaataatccgtcgaaacacatcattattgaacgctctaacacccggtctagtctggccgaagtccaatccgagatagagagaatttttgagctggcccggacgttgcagctggtggcgttggacgctgacactatcaatcacccagcccaattgtcaaagacatccttagcacccatcatcgtgtacataaaaatcacatctcctaaggtcctgcagaggctgattaaaagccgcggaaaaagccagtccaagcacctgaacgtccaaatcgccgcctcagagaagctggctcagtgcccgcccgagatgttcgacatcatactcgatgagaatcaactggaagatgcttgtgaacacctggccgaatacctggaagcctactggaaggctacccatcctccctcttctacacccccaaatcccttactgaacagaaccatggcaactgccgctttagccgcttcacctgctccagtatctaatcttcaggtccaggtactgacctcacttcgccggaacctcggattctggggtggtctggagagctctcagaggggtagcgtggtgccacaggagcaagagcacgctatgtag

SEQ ID NO: 110388 - DNA, 1647 bp, Artificial Sequence
  Description of Artificial Sequence: Synthetic coding sequence
tccgggagcctgtattttcagggcagcgccgaaagctacacaagccgccccagcgatagtgacgtatcacttgaagaagacagggaagctctccgaaaagaagctgagcgccaggctctggcccagttagaaaaggccaagaccaagcccgtggcttttgccgtccggactaatgtcgggtacaaccccagtcctggcgacgaggtgcccgttcagggggttgcgattacatttgagcccaaagattttctacatataaaggagaaatacaacaatgattggtggatcggtagactggtgaaggaaggttgcgaggtaggtttcataccttcccctgtcaaactggattctcttcggcttctccaggaacagaagttgaggcaaaatagattgggctccagtaagagcggtgacaactccagctcctcacttggcgatgtagtgactgggacacgacgacccactccccccgctagcggcaagagccaccgtcacgcaacagagcacgtgcctccatacgacgtagtgccctcaatgaggcccattatcctggtcgggcccagcttgaagggctacgaggtgacagacatgatgcaaaaagcactgttcgacttcctcaagcacagattcgacggacgaattagcataactagggtgacagccgacattagcctcgccaaacgttctgtgttaaacaatccctctaagcacatcataatcgagcgctccaatacacggtctagtctcgctgaggtccagtcagagattgaacgcatctttgagttagctcgaacactccagcttgtcgcactggacgctgataccattaaccatccagcccagctgagtaagacctccctagccccgataatagtatatatcaaaattacatcccccaaggtgctgcagcgccttatcaagtcaagaggtaagtcccagtccaagcatttaaacgtccagattgcggcctctgaaaaacttgctcagtgcccccctgagatgttcgacatcatcctggacgagaatcagttggaagacgcctgcgaacacctcgccgagtacttggaggcttactggaaagcaactcatcctccctctagcacccccccaaaccctctcctcaataggacgatggccaccgcggccttagccgcttccccagcacccgtgagtaatctgcaaggtccgtatctggctagcggcgaccagcccctggagagggccactggggagcacgcgagcatgcacgaatatccgggcgaactcggccagccccccggcctgtacccatcaagccacccccctggtagagctggcacattacgagccctgagcagacaggacacattcgacgccgatacccccggatctcgtaactccgcctacacagagttgggcgatagctgtgttgacatggaaacagacccttctgagggcccaggcttgggtgaccctgccggtggcggcacccctcccgctcgacaaggctcatgggaagacgaggaagaggattacgaagaagagttgacagataataggaataggggacgaaataaagccagatattgcgctgaaggagggggaccggtgctgggcagaaacaagaacgagctcgaaggatgggggaggggggtttacatcaggtag

SEQ ID NO: 110389 - DNA, 1899 bp, Artificial Sequence
  Description of Artificial Sequence: Synthetic coding sequence
atgaatcagggatcaggattggatctcctcaaaatttcttacggaaaaggagcacgaagaaagaatcgattcaagggctctgatggatcgaccagttccgatacaacttcaaattcatttgtgcggcagggatccgcagatagctacacatctcgcccttcagactctgatgtttcactggaggaggacagagaggccgtccgccgcgaagccgagcgccaagcccaggcacaactcgagaaggccaaaaccaaacccgtagcatttgctgttagaactaatgtttcatattccgcagcacacgaggacgacgtgccagtgccggggatggcaattagctttgaggcaaaagatttcctgcatgtcaaagagaaatttaataatgattggtggatcggaagacttgtcaaagaaggctgcgaaattggttttattcccagcccggtcaagcttgagaacatgcggctacagcatgagcagagggccaaacagggcaagttttactcttccaaaagcggaggcaactcttccagcagcctcggtgacatcgtgccaagctctcgtaagagcacaccgccctcaagcgctatcgacattgatgctactggccttgatgcggaagaaaatgatatacccgccaaccatcggagcccaaagcccagcgctaacagtgtcaccagccctcacagcaaggagaaacggatgccgttcttcaagaaaacagagcacactccaccttacgatgtggtaccaagcatgagacctgttgtactggtgggaccttcgctgaaggggtacgaggtgaccgatatgatgcagaaagctctttttgactttcttaaacacagattcgaagggcgcatcagtattactagggtaaccgctgacattagcctggccaagcgaagcgtcctgaacaacccttctaagcatgcgatcattgagagatccaacacacgttcgtccttggcagaggtgcagagtgagattgaacggatttttgaactggcaagaacactccagttagtggtcttagatgcggacaccataaatcacccagcccaattatctaagacatcgctagcgcccattatcgtgtatgtcaaaatctcttcacctaaggtgctgcagaggcttattaagtcccgaggaaagtctcaggccaagcacctcaatgtgcaaatggtcgccgccgacaaattggcccagtgccctcccgaattatttgatgtgattctggatgagaatcagctggaggacgcttgtgaacacctggccgactatctcgaggcgtactggaaggcaacgcatcccccttcgtcgtcgctgcctaaccccttgctgagcaggaccctcgccacatcctcattacccctgtccccaactctggccagcaactcacagggctctcagggagaccagcgaactgacaggtctgccccaattagatcagccagccaggccgaggaggaaccctcagttgagccagtaaaaaagagtcaacaccggtcttcctctagtgcccctcatcacaatcacagaagcggcacttctaggggactgagtcgccaggaaactttcgactctgagactcaggagtccagagacagtgcctacgtagaacctaaagaagattacagccatgaccacgtggatcactatgcgtcacacagagatcataaccaccgcgatgaaacgcacgggtcatccgaccaccgccacagagaaagtcgtcatcgttcaagagatgtcgatagagaacaggaccataatgaatgcaataaacagcggtctcgacataagtccaaggatcgctattgcgaaaaggatggcgaagtgatctctaaaaaaaggaatgaggcaggcgagtggaacagggacgtttatatccgccagtag

SEQ ID NO: 110390 - DNA, 1983 bp, Artificial Sequence
  Description of Artificial Sequence: Synthetic coding sequence
atggtgcagagagatatgtccaaatccccaccaacagccgccgccgcagttgcccaggagattcagatggaactgctggaaaacgtggcaccagctggcgccctgggcgcagccgctcagagctacggcaagggggccaggaggaagaaccgcttcaaaggaagcgatggctcaacctcaagcgacacaacatccaattcttttgtcagacagggaagcgcagacagctacaccagtcggcccagtgactccgacgtttccctggaggaggaccgggaggccgtccgacgggaagctgagaggcaggctcaggcccagcttgaaaaggcaaagactaagccagttgccttcgctgtccgtacaaatgtcagctacagcgcagcccacgaagacgatgtacccgtgccaggcatggcgatttcctttgaagccaaagacttcctccacgttaaggagaaatttaataacgactggtggatcggaaggttagttaaagagggctgtgagatagggttcatacccagccctgttaagctggaaaacatgaggctgcagcatgagcagcgcgccaaacaggggaagttctacagcagcaaaagtggcggcaacagctccagctccctcggagatatcgtgccaagctcccgcaagtcaacccccccatcgtctgccatcgacattgacgctactggcctggatgcagaagaaaatgacatacctgccaatcaccggagccctaagccttcagctaacagtgtaacatctcctcactcaaaagagaagcgcatgcctttttttaagaagactgaacataccccgccatacgatgttgtgccgagtatgcgcccagtagtccttgtgggcccatccttaaaggggtatgaagttactgatatgatgcaaaaagctctattcgatttcctcaagcaccgcttcgaaggccggatctcaataaccagagttaccgcggatatctctctggccaaaaggagcgtgttgaacaacccttccaagcatgcaattattgaaagaagcaatacaagaagttccctcgccgaggtacaaagtgaaatcgaacgcattttcgagctcgccagaacactgcagcttgtggtgctggatgcggatacaatcaaccacccagcacaacttagtaaaacttctctggcgccaattatagtgtatgtgaaaattagctcccctaaggtcctccagaggctgatcaagtcccggggtaagtctcaggcaaaacatctgaacgtgcagatggtggccgccgacaaactggcacagtgcccacctgaactgtttgatgtgattcttgatgaaaaccaactggaggacgcgtgtgagcacttggctgattatctggaggcttactggaaagctacccatcctccctcctcctctcttccaaatcctctgttgtctaggaccttggctacctcctctctgccgctgtctcccacactggctagtaattcgcagggtagccaaggcgatcagcgcactgataggtctgccccgattagatccgcatcccaagccgaggaggaaccaagtgtggaaccagtgaaaaagtcccagcataggtcttcgagttccgctccccatcacaaccacaggagcgggacctcacgaggtctgagtaggcaggagaccttcgatagtgaaacgcaggagtccagggactccgcttacgtggagcctaaagaggactacagccatgatcatgtcgatcactacgcatcccacagagaccacaatcatcgcgatgaaactcatggctcatcagatcaccggcatagggagtctcgtcaccgctccagggatgtggatagagaacaggatcacaacgaatgtaacaagcagagatctcgtcataaaagcaaagatcgatattgcgaaaaggacggagaggttatttccaagaagcggaacgaagccggcgagtggaaccgtgacgtgtacatccgccaatag

SEQ ID NO: 110391 - DNA, 1911 bp, Artificial Sequence
  Description of Artificial Sequence: Synthetic coding sequence
atggtgcaaagagatatgagcaaaagtccccccacagccgcagctgccgtggcccaggaaatccaaatggagctcttagaaaatgtggcacccgccggcgccctgggggcggccgctcagagctacggcaagggagctagaagaaagaatcggtttaaagggagtgatggatccacttcttccgacactacatcaaattccttcgttcggcaggggtccgccgatagctacacttcgcgacctagcgatagtgacgtgtctctagaagaggaccgtgaagcagttagacgggaagccgaaagacaggcccaggcacagctggagaaagctaaaactaaacccgtggcattcgctgtgcgcacaaatgtttcctatagtgccgcccacgaagacgatgtgccagtgccaggaatggccatctctttcgaggctaaggattttctccatgttaaagagaagttcaataatgattggtggatcggacgactggttaaggaggggtgcgaaatcggtttcatcccctcccccgttaagcttgagaatatgagacttcagcatgagcagcgggccaagcagggtaagttttactccagcaaatcaggagggaactcctccagctctctcggtgatatcgttccgagcagtcgcaagtcgactccaccctcttctggtgccaagagcgctgatgaacaagaccaatggaagacggcagggctcttctggagattcaccacagagcacaccccaccctatgatgtggtgccctccatgcgacctgtggtgctcgtggggccatcccttaaggggtatgaggtgaccgacatgatgcagaaagcccttttcgacttcttaaaacaccggttcgagggtcggatatctatcactagggttactgccgatatttctctggcaaagagatcagttttgaacaatcctagtaagcatgcaattatcgagagatctaatacacgttcaagtcttgccgaagtacagtccgaaatcgagcgtatttttgagcttgcaagaactctgcaattggttgttctggatgcggacacaattaaccatcccgcccaactctctaaaacctctctggctcctatcattgtgtatgtgaagatctctagccccaaagtcctgcagcgactcattaaatcaaggggcaagtctcaggccaagcatctcaacgtccaaatggtagctgcggacaagctcgctcagtgtccccccgagctgtttgacgtcatcctcgacgaaaatcagctggaagacgcttgtgaacacctggctgactatctggaggcatattggaaagccactcacccaccttcttcctctcttcctaaccctttgctttctagaactttggcgactagcagcctacccctgtcccccacactggcatcaaatagtcaagggtctcagggggatcaaagaactgatcggtccgctcccatccgctctgcctctcaggcggaagaagaaccttctgtggagccagtgaaaaaaagtcagcacagatcttccagctcagccccacaccataatcaccgctccggaactagtcggggtttgagcaggcaggagacttttgatagcgagacacaggagtcccgtgacagtgcctacgtggaaccgaaagaagactacagtcacgatcatgtcgaccactatgcatctcatcgcgaccacaatcaccgggacgagacccacggctcaagcgaccacagacatagggagtcacgtcaccgttcgcgtgacgtggatcgcgagcaggatcacaatgaatgcaacaaacaacggtctaggcataaatccaaggacagatactgcgagaaagatggcgaagtgatctccaagaagcgcaacgaagccggcgaatggaaccgggatgtatacatccggcaatag

SEQ ID NO: 110392 - DNA, 1839 bp, Artificial Sequence
  Description of Artificial Sequence: Synthetic coding sequence
atgaaagcaacatggattcggttgttaaagagagctaaagggggccgcttaaagaactctgatatctgtgggtccgctgactcttacacaagtaggccgagtgattcagacgtctcgctggaggaggacagggaggcagtgcgacgcgaggcagaaagacaggcccaggctcagcttgagaaggctaaaaccaagcccgtggcgtttgctgtacgcacgaacgtatcgtattctgccgcccatgaagatgacgtcccggtgcccggcatggcgatctcatttgaggctaaggattttctgcatgtgaaagagaaattcaacaatgactggtggatcggccgccttgtgaaggaagggtgtgaaattgggtttatcccctctcctgtgaagctcgaaaatatgcggcttcagcacgagcaaagagctaagcaggggaagttctattcttcaaaaagcggtggaaattcctcatctagcctgggggatatcgtgcccagctctcgcaagtcaaccccccctagctcagctatcgacatagatgctaccgggttggacgccgaagaaaacgacatccctgccaatcaccgatcacctaagccatccgccaactcagtcacctctcctcattcaaaagaaaaacgaatgccctttttcaaaaaaactgagcacacacccccatatgatgtggtgccatccatgcgtccagtcgtacttgtcggcccatcgctaaaggggtacgaagttaccgacatgatgcagaaagccctttttgatttcctaaaacatcgctttgaagggcgtattagcatcaccagagtgaccgcggatatctccctggccaagcgttcagttctgaataatccctcaaaacacgcgattatcgagaggagtaacacgaggagctcgttagcggaggtgcaatcagagatcgagcgtatcttcgaactcgcgcggaccttacaattagtggtgctcgacgccgacaccataaaccacccagcccaattgagtaagactagcctcgcccccattatcgtgtatgtgaaaatcagcagccctaaggttctgcagcggctgattaaatctcggggcaaaagccaggccaaacacctaaatgtccagatggttgcggccgataaactggcacaatgcccaccagaattgtttgacgtgattcttgacgaaaaccagttagaggatgcgtgtgaacacctcgccgactatctcgaagcttactggaaagccacacacccaccgagcagttctcttcccaatcccttgctgagccggacactggccacaagctcactgcccctgagcccaacactcgcctcaaatagtcaggggagtcagggtgatcaacgcacagacagaagtgcgccaattcgctccgctagccaagctgaggaggaaccctctgtggagccagtaaagaagtcccagcatcgctcctcgtcaagtgctccacaccataatcatcgatcagggactagcagaggtctgagccggcaggaaacattcgacagcgagacacaggaaagccgtgatagcgcttacgtcgaacctaaagaggattactcccacgatcacgtcgatcattacgctagtcaccgagaccacaatcacagggacgaaacacacggttctagcgaccaccgacaccgagaaagtagacaccggagccgtgacgtggatagagaacaggatcacaatgagtgtaataagcagcgctctcgccataagtcaaaggaccgttactgcgagaaggacggggaggtgatttccaaaaagcgcaacgaagcgggggagtggaatcgggacgtgtacatcagacaatag

SEQ ID NO: 110393 - DNA, 1704 bp, Artificial Sequence
  Description of Artificial Sequence: Synthetic coding sequence
atgcaatgttgtggcctcgtgcaccgtagaagagtcagagtaagttatggcagcgctgattcctacacctcccgcccttctgatagtgacgtttctttggaggaggacagagaggcagtacgacgggaagccgaacggcaggctcaggcccaacttgaaaaagcgaaaacaaaacctgtggcattcgctgttaggactaacgtatcatactccgcagctcatgaggacgatgtgcccgtccctggcatggccatttctttcgaagcaaaagacttcctacacgttaaagagaagtttaacaacgactggtggatcggcagacttgttaaagaggggtgtgagatcggttttatccccagtccagtgaaattggaaaacatgcggcttcagcatgagcagcgggctaagcagggcaagttctattcatcgaaatccggggggaatagtagtagctccttaggagacattgttccatcctctcgaaagtcgacccctccctcctccgcgaagcagaaacagaagagtactgaacacactccgccttatgatgtcgtcccaagcatgagaccggtcgtgttagtgggaccttcacttaagggctatgaagtgactgacatgatgcagaaagccctcttcgatttcctcaagcatcgatttgaaggacggatcagtattaccagggtaaccgccgacataagcctcgcaaagcgttccgtgctgaacaacccctcaaaacacgcaattatcgagagatccaatacacgctctagcttggctgaagtccagtccgagatcgagagaattttcgagctggccagaactctgcagctcgtggtgctggatgcggatacgattaatcacccagcacagcttagcaaaacgtcccttgctcccatcatcgtttacgtaaagatcagctcccctaaggtgctgcagcggcttattaaatcgagaggaaagtcccaggctaaacacttaaacgttcagatggttgcggcagataagctggctcagtgtcctcccgagctctttgacgtaattctggatgaaaaccagttggaggacgcctgtgaacatctagcggactatctcgaggcctattggaaagctacccacccaccctctagctccctgcccaacccattactctctcggactctcgcaacgtcctccttgcctctttctcccaccctggcttctaacagccaaggatcccagggggatcaacgcacagatcgatctgccccgatccgatccgcctcacaggccgaggaggagccatcagtggagccggtgaagaagtcccagcaccggtcttctagctctgccccccaccacaaccatcgctctggcacgagtagggggctgagccgtcaggaaaccttcgacagcgagacccaggagtctcgcgatagcgcttatgttgagcctaaagaggattactcgcacgaccatgtcgatcattatgcgtcccaccgagaccataatcaccgcgatgagacgcatggctcaagcgaccaccgtcacagagagagtagacatcggtcaagggatgtcgaccgggagcaggatcataatgaatgcaataaacagaggtcccggcacaagagtaaagacagatactgcgaaaaagatggtgaggtcattagcaagaaacggaacgaggctggagaatggaatagggatgtgtatatacgacaatag

SEQ ID NO: 110394 - DNA, 1821 bp, Artificial Sequence
  Description of Artificial Sequence: Synthetic coding sequence
atgttggacagacgactgattgccccgcagacaaagtacatcattccaggaggttccgcagactcttatacaagcaggccttctgatagcgacgtttcccttgaagaggaccgcgaggcggtgcgacgcgaggccgaacgccaggcacaggcacagttggaaaaggctaagacaaaacctgtagcctttgccgtccgcacaaacgtttcctactccgccgcccatgaggatgatgtgcccgtgcccgggatggccatttcgttcgaggcgaaggatttcctgcacgtgaaggagaagtttaacaatgattggtggatcggccggctggttaaggagggatgcgaaatcggatttataccaagccctgtgaaattggagaatatgcgtctgcaacatgaacagagagctaagcagggcaagttttattctagcaaatctggaggcaatagctcttcttccctgggcgacattgtaccttccagccggaagtcgacacccccaagttccgctattgatattgacgcaaccgggctggacgctgaagagaatgacatccctgcaaatcaccgtagcccaaaaccttcggcaaatagtgtgaccagcccccacagcaaagagaaaagaatgcctttttttaaaaaaacagagcacactccgccttacgatgtggtcccatctatgcggcctgtcgtgcttgttggccctagccttaagggctacgaggtgaccgacatgatgcagaaagctttgttcgacttcctgaaacatagattcgagggccgcatttcgatcacccgagttacggccgacatctcattagccaaaaggtctgtgcttaataatcctagcaagcacgctatcatcgaaagaagcaatacacgtagcagtcttgcagaagtgcagagtgaaattgaaagaattttcgagttagccaggacattgcagctggtggtgttggacgccgacaccataaatcatcctgcccagttgtccaaaacgagcctggcacccataatagtgtatgtcaaaatctcttctccaaaggtgctccagcgacttattaagtctcgaggcaagagccaggcgaaacacctgaatgtgcaaatggtggccgctgataaactcgcgcagtgtccacccgaactatttgacgtgatcctagatgagaaccagctggaagacgcatgcgagcatttggccgattatctggaggcatattggaaggccacacatcccccctcatcctcccttcctaatcctctgctgtctcggacactggcgactagctccctgcctctcagcccgactctcgcctccaattcccaaggcagccagggcgaccagcgtacagatcgcagcgcacctatccgatccgcatcccaagctgaggaggagccttcagtcgaaccggtcaaaaagagtcagcaccgatccagcagtagcgcaccgcaccacaaccaccgaagtggaactagccggggactgtcaaggcaggagacattcgactccgaaacgcaagagtcacgtgattcagcgtacgtcgaaccaaaggaggattatagccacgatcatgtggatcactacgcttcacaccgggaccataaccacagggacgagacgcacgggtccagtgatcatcggcatcgagagagcaggcataggagtagggacgtcgatagagaacaggatcacaatgagtgtaacaagcagcgttctaggcataagagtaaggaccgctactgtgagaaggatggggaggtaatctctaaaaagagaaatgaagccggagaatggaatcgcgacgtctatattagacagtag

SEQ ID NO: 110395 - DNA, 1827 bp, Artificial Sequence
  Description of Artificial Sequence: Synthetic coding sequence
atgaaccaggggagcggcttagacttacttaagatctcctatggcaagggcgctcgccgcaaaaatcggttcaaaggatctgatgggagcacttcttccgacaccacgagtaactcctttgtgcggcaggggtccgcggattcctatactagtagaccatcagacagcgatgtctctctggaggaggacagggaggctgtgagacgcgaagcagagaggcaggcacaggcccagttagaaaaagctaaaactaagcctgtggccttcgcggtgagaacaaacgtttcctactctgccgcccacgaggacgatgtgcctgtgcctggcatggcgattagcttcgaagcaaaggacttcttacacgtgaaggaaaagttcaacaacgactggtggatcggtaggctggtgaaggaaggttgcgaaatcgggttcatcccttctccagtgaaattggagaacatgcgtttacagcacgagcagagagcaaaacaaggtaagttctacagcagtaaatctggtggcaactcaagctccagcctaggcgatattgtcccttcctcccgcaaatccaccccgccatcatccggcgctaaaagtgctgatgagcaagaccaatggaagaccgccgggctcttctggcggtttacaactgagcacacccccccttatgacgtagtgccaagtatgagacccgtggtccttgtgggcccctcactgaagggttatgaggtaacagatatgatgcagaaggcactgtttgactttttaaaacacaggtttgaggggcgtatctccataacgcgagtcactgctgacatcagtctcgctaagaggagcgtgctcaacaatccctccaagcacgccatcattgagagatcaaacaccaggtcttccctggccgaggtccaatccgaaattgaaaggatctttgaactagcacgcaccctccagttggttgtgctggacgctgatacgattaatcatccagcccaactgtcgaagacttcactggccccaattatcgtgtacgtgaagatatcttccccgaaagtgctccagcggctgatcaagtccagaggtaagagccaagccaagcatctaaatgtccaaatggtggcagctgacaagctggctcagtgcccaccagagctgttcgatgtcattctggacgagaatcagttggaggacgcctgcgaacacctcgcagactatctcgaggcttactggaaggcaacgcatccgccttcttcctcactgcctaaccctctgttatcgagaacgctcgctacatcaagtctcccactctctcctacactggccagtaatagccaaggaagccagggcgatcagcggaccgaccgcagtgctcccatcagatccgcttcccaggccgaagaggagccatctgtagagcctgtcaagaaatcacagcataggtcttcatctagcgccccccaccacaaccatcggagcggaacatccagggggctatctagacaggaaacctttgactcggaaactcaggaaagtagggattcagcgtacgtcgaacccaaagaggattattctcacgaccatgtggaccattacgctagtcatcgggatcataatcatcgggacgagacccatggaagctccgatcaccgccatcgcgagtcgcgacaccggagcagagatgtggatcgtgagcaggatcacaacgagtgtaacaaacagcgttcacggcataagtctaaggatcgatactgtgaaaaggatggcgaggtgatcagcaaaaagagaaatgaagctggagaatggaatagagatgtatatataaggcagtag

SEQ ID NO: 110396 - DNA, 1818 bp, Artificial Sequence
  Description of Artificial Sequence: Synthetic coding sequence
atgcagtgctgtggcctggtccacaggaggagggtgagagtctcttacggctctgcggattcttacacctctagaccatccgactccgacgtcagtttagaagaagatagagaggcagtccgcagggaagcagaaagacaggcacaggcccaactggaaaaggccaagacaaaacctgtggcctttgctgtgaggaccaacgtgtcttactcagcagcacatgaggacgacgttcctgtgcccgggatggcaatctcattcgaggctaaagattttcttcatgtgaaggagaaattcaataatgattggtggatcggccggctggtgaaagaaggctgtgaaattggcttcatccctagccctgttaagctggagaacatgcgcctgcagcatgaacagcgcgccaagcagggtaagttctactcaagcaagagtggcgggaattcatctagctccctcggtgacatcgtaccaagttctagaaaaagcacacccccatcatccgccatagacatcgatgctactggcctggatgctgaggagaatgatataccagcaaaccatcgatcccctaagccttcagcaaattctgtgacgtctccccactctaaagaaaaaagaatgcctttctttaagaagaccgaacacactcctccatatgatgtggtacctagcatgcggccagtcgtcctcgtcggaccatctttaaagggatatgaagtaaccgacatgatgcaaaaagcgctcttcgatttcctcaaacaccgctttgagggcagaatctctattacacgagtgacagccgacatcagtcttgccaagagaagcgttctgaataatccatctaaacatgccataatcgaacgaagcaatactcgaagctctctggcagaggtccagtccgagatcgagcggatatttgaacttgcacgcacgctccagctggtagtgctggacgctgacacgatcaatcatcctgcacagctatcgaagacgtctcttgcacccataattgtatatgtgaagatttcatctcccaaggtgctacaacggctgatcaagtcccgcgggaagtcccaggccaaacacttgaatgtgcagatggttgccgcagacaaattggcccagtgcccacccgagctcttcgacgttatcttggacgagaaccagctagaggacgcctgcgaacacttggctgactatctagaagcctactggaaggcaacacacccaccgtctagctccctgccgaatcccctgctgtcccgcaccctagcaacaagttcgctccccttgtctcctaccctcgcgagtaattctcaggggtcccaaggagaccagcggacggaccgctccgcccctatacgctcagccagtcaagccgaagaggagccctcggtagagcctgtgaaaaagtctcagcacaggagcagctccagtgcgccacaccacaatcaccgaagtggtacatcccgcggtctgtcccgacaggagaccttcgatagtgaaacccaagagtcccgggattctgcctatgtcgagcccaaagaggactactcccatgaccacgtcgatcattatgcgagccaccgtgatcataaccaccgcgatgagacacatggcagctccgatcacagacaccgcgaaagcaggcataggtccagggatgtagaccgcgaacaggatcataatgagtgtaacaagcagcgaagtaggcacaaatcaaaggatcggtattgcgagaaggacggggaagttattagtaagaaaagaaatgaggccggagaatggaatcgggatgtatacatccggcagtag

SEQ ID NO: 110397 - DNA, 1455 bp, Artificial Sequence
  Description of Artificial Sequence: Synthetic coding sequence
atgtatgacgacagttatgtgcccggattcgaggacagtgaggcgggaagtgctgactcatacaccagccgcccaagtctcgattctgacgtgtccctggaggaggacagggagtcagccagacgtgaagttgaatcccaagcgcagcaacagctcgagcgagctaagcacaaacctgtagcctttgcggtcagaacaaatgtaagttactgcggagtcctcgacgaagagtgccccgttcaaggcagcggcgtgaactttgaagcaaaagacttcctccacattaaagagaagtattccaacgattggtggattggacgcctggtgaaggagggcggggatatcgccttcattcccagccctcagcgcctcgaaagcatccgcttaaaacaggagcaaaaagcaagaaggtccggtaaccctagctctctttcggacataggaaataggcggtcacccccacccagcctcgctaagcagaagcagaaacaggccgagcacgttcctccatacgatgttgttccttctatgcgcccagtggttctagtcggtcctagtctgaaggggtatgaggttacagatatgatgcagaaggccttattcgacttcctgaaacaccggtttgacggcagaataagtataacacgcgtaacagctgacttatctctggctaagagatccgtccttaataatccaggaaaaagaactatcatcgaacgctcttcagctcggtcttccattgcagaagtccagtcagagattgaaaggatcttcgagctagcaaaaagccttcagctggttgtgttagacgccgatactattaaccatccagctcaactggcaaagacatcactcgctccaataatagtcttcgtcaaggtgtcatcacccaaggtgctgcagcgcctgattcgatctaggggaaaatcccagatgaaacatctcaccgtccaaatgatggcttacgataaactcgttcagtgcccacctgaatcatttgacgtcattctcgacgaaaatcagttggaggacgcatgcgagcacctcgccgagtacttagaggtgtattggcgcgcgactcatcatcccgccccggggcccgggctgctcggccctccttcagctatacccggtttgcaaaaccagcagctattgggggaacggggagaggagcatagtcccttggagcgggacagcctaatgccaagcgacgaggcctctgaaagtagccgacaggcttggaccggatcgagccaacggtcctcaaggcatttggaagaggactacgccgatgcttatcaggatctgtaccagcctcacagacaacacaccagcggcttaccgtctgcaaatggccacgatcctcaggacagacttctagcacaggatagcgagcacaatcacagcgatcggaactggcagcgaaatcgaccctggcctaaggacagctattag

SEQ ID NO: 110398 - DNA, 1566 bp, Artificial Sequence
  Description of Artificial Sequence: Synthetic coding sequence
atgagttctagcagctacgccaagaatggcacggccgacgggccccactccccaacttcacaggtggcacgcgggactaccactcgacggtcccgcctcaaacgctcagatggttctaccacttccacaagctttattctccggcaggggtctgccgactcctatacctccaggcccagtgactccgatgtgtctttagaagaagatcgggaagccatccgacaggagcgtgaacagcaagccgctattcagctggagagggctaaatctaagcccgtggcctttgcggtgaagactaatgtatcatattgtggagccctggatgaagacgtgcctgttcccagcacagccatctccttcgacgccaaggatttcctgcatatcaaagagaaatataataatgattggtggatagggcgcctggttaaagaaggctgtgagatcggttttattccatcaccacttcggctcgagaacattagaattcaacaggaacagaagagaggccgttttcacggcggcaaaagtagcggcaactcgagttccagtctgggcgagatggtgtcgggaacatttcgagccacccctacctcgacagtcaagatggtacttaagatccacaccgaacacattcctccttacgatgtcgtcccctcgatgcgtcctgtcgtcttggtagggccaagtttgaagggctatgaggtgacggatatgatgcaaaaagctctttttgacttcctgaaacacagattcgacgggagaatatcaatcacccgggtaacagcagatataagccttgctaaaagatccgtcctcaacaacccgagtaagcgcgccattattgaacgaagcaatactcgaagcagcctcgctgaagtgcagtcagaaattgagaggattttcgaactggccaggtccctgcaactggtggtactcgatgctgatacgattaatcaccccgctcagctgatcaaaaccagcctggcaccaatcatcgtgcatgttaaagtctctagtcccaaagtactgcagcggctcattaaatcccgaggcaaaagccagtccaagcacctcaacgttcaactggtggccgccgataaactggctcagtgcccccctgaaatgtttgatgtgatacttgatgagaaccaactcgaagatgcatgcgagcatctaggtgagtatctcgaggcttattggcgggccacgcataccacctcttctactccaatgactccgctgctagggcggaacttggggagcacagcactgtctccatatcccacagccattagcgggctgcagagccagaggatgcgtcactccaaccacagcactgaaaactctcccatagagaggagatcactgatgacctccgatgagaactatcataacgagagggctaggaaatcccgcaacagactgtcatcgtcaagtcagcacagccgggatcactatccattagtggaagaggattaccctgatagctaccaagacacctacaagccccaccgcaaccgggggagccccggcggctatagccacgacagcagacaccgtctatag

SEQ ID NO: 110399 - DNA, 1464 bp, Artificial Sequence
  Description of Artificial Sequence: Synthetic coding sequence
atgtacgacaatctgtatctgcatgggatagaagactctgaggcaggtagcgccgattcctacacctccaggccatccgactcagacgtgagcctggaggaggatagggaagctataagacaagagagagagcaacaggccgccatccagctagagcgtgcaaaatccaaacccgtagccttcgcggtaaagacaaatgtgagttattgtggcgcactggatgaagacgttcccgtaccctctacagccatctcattcgatgcaaaagattttttgcacattaaggaaaaatacaataacgattggtggattggccgcttagtgaaggagggttgcgagatagggttcatcccatctccactgaggttggagaacatccgcatacaacaggagcagaagcgtggccgcttccacggggggaaaagctccggcaatagtagctctagccttggagagatggtctcaggcaccttcagagccacgcccacgagcaccgtcaagatggtgctgaagatccataccgagcatatacctccctatgatgttgtcccatcaatgcgccccgttgtgttggtaggaccaagtttgaaagggtatgaagttactgacatgatgcagaaggccctttttgacttcctgaagcatcgttttgacggaagaatcagcattacacgtgtgacagctgacatcagcctggcgaaacggagcgtcctgaacaatccatccaagagggccatcatcgagcgaagtaatacacgctctagccttgctgaagtgcagagcgaaattgagcggatctttgaactcgcgaggtctctgcagcttgtggtccttgacgccgacaccattaaccacccagctcagctgatcaagacttccctggcacctattattgtccatgtgaaggtgtccagcccgaaggtacttcaacggctcataaaatcaagggggaaatctcagagtaaacacctgaacgtgcagctggtggctgcagacaagcttgctcagtgtccccctgagatgttcgacgtgattcttgatgagaatcagctagaggacgcttgcgagcacttaggggagtatttagaagcctactggagggccactcacactactagctccaccccgatgacgccattactgggacgaaatcttggcagcactgctctgagtccctaccctacagccattagtggtctgcagagtcaaaggatgcgccactccaatcatagtacagagaactctcccatcgagaggcgaagtctgatgactagcgacgagaactaccataatgaacgggcacgcaagtctcggaaccgtctgtcttcctctagtcagcatagtagggatcactatcctctagttgaagaagattatccagatagttaccaagatacatacaagccacaccgtaaccgagggagtcctggaggatatagtcatgacagccgacacaggctgtag

SEQ ID NO: 110400 - DNA, 1461 bp, Artificial Sequence
  Description of Artificial Sequence: Synthetic coding sequence
atgtacgataacttgtacttacacggcatcgaagacagtgaagctggtagcgccgattcgtatacaagccgcccctccgattcagatgtctccctcgaagaggatcgcgaagcaattcgtcaagagcgagagcagcaggcggccatacaactggaacgggccaagtccaagcccgttgccttcgcggtgaaaaccaatgtgtcttactgcggagctctcgatgaagatgttcctgtgccctcaaccgccatctccttcgatgcgaaagatttcctccacattaaagagaaatataataatgattggtggattggaagacttgtgaaggaggggtgcgaaattggcttcatcccctccccactgcggctcgaaaacatcaggatccagcaggagcagaagcgagggcggttccacgggggaaagtcttccgggaacagtagctcatctcttggtgagatggtgtcaggcacattccgggccaccccaacatccaccgctaagcagaaacaaaaggtaactgagcatataccaccgtatgatgttgttccttccatgagacctgtcgtgttggtcgggcccagtcttaaaggctacgaagtgaccgacatgatgcaaaaagcccttttcgatttcctgaaacacaggtttgacggtaggatttccattacccgggtaacagcagatatctcactggccaaaagatctgtactgaataacccttccaaacgggctatcatcgaaagatctaacacacggtcttcactagctgaagtgcagagtgaaattgagagaatatttgaactggcccggtctttgcagctagtcgtcctggatgcagacactattaaccaccccgcgcagctcatcaagaccagtttggccccaattatagtccacgttaaggtgtcgtccccaaaagtcctgcaaaggctcataaagtctcggggaaagtcccagtccaaacacctgaacgtgcaactggtggcagccgataaattggcacagtgtcctccagaaatgtttgatgtgatccttgacgaaaatcagcttgaggatgcttgtgagcacttaggcgaatatctcgaagcctattggagagcgacacacaccacctcaagcacccccatgacaccattgcttggacgaaatcttgggagtaccgctctgtccccctacccaacggccatctccggacttcagtcccagcggatgaggcattctaatcactcgaccgagaattcaccaatagagagacggtccttaatgacaagcgatgaaaactaccataatgagagggccaggaaaagtaggaaccgcttgtcgtcttcttcgcagcacagccgcgaccattatcctcttgtagaagaagactatcccgatagctatcaggacacctacaaaccacatagaaatagggggagccctggggggtacagtcatgactcgagacaccgtctgtag

SEQ ID NO: 110401 - DNA, 1563 bp, Artificial Sequence
  Description of Artificial Sequence: Synthetic coding sequence
atgtcttcttcttcctatgccaagaacggtaccgctgacggaccccacagccctacgtcccaagtggctagaggaactaccacccggcggagccgcctgaagcggagtgatgggtccactacgagcacttcctttattctgagacaaggatctgcagattcgtacacgtcccggccatctgactcagacgtcagcttggaggaagatagagaagccatcagacaagagagggagcagcaagccgcaatccaactggagcgcgcaaagtccaaacccgtcgcctttgcagtcaaaaccaacgtttcatattgcggggctttggatgaggatgtaccagtaccatccacagcgatctccttcgatgccaaggacttcctgcacataaaggagaaatacaacaatgattggtggattggtcgcttggttaaggaaggttgcgagatcgggtttattccttcacccttaagattagagaatattcgtatccagcaagagcagaagcgcggacgctttcacggcggtaaaagcagtggcaattcctcaagctccctgggtgagatggtctctgggacctttcgagccactcccaccagcacggccaagcaaaagcaaaaggtcaccgaacatattccgccgtatgacgtggtgccaagtatgaggcctgtcgtcctggtgggtccttctctgaaaggttacgaagtcactgatatgatgcagaaggcccttttcgacttcctaaagcacaggtttgacgggaggatctcaataacccgagtgaccgcagacatctccctggctaagagaagtgtgctgaacaatccatccaagcgggctattatcgagaggtcaaacacccgatcgagcctggccgaggtccaatccgaaatcgagaggatttttgaattagcaagatcccttcagctggtggttttagacgcagatacaatcaatcatcccgcacagcttatcaagacatcacttgccccaattatagtacacgtgaaggttagctcccctaaggtgctgcagcggctaatcaagagcagaggtaagtcccagagtaaacaccttaacgtgcagttggtggccgcagataagctggctcagtgccctcccgagatgttcgacgtcatcttggatgaaaaccaattggaggatgcctgcgagcacctgggtgaataccttgaagcatactggagggctactcacaccacttcatcaactccaatgaccccccttctgggtcgtaatttgggctccacagcccttagtccgtacccaactgcaatttcaggactccagtcacagagaatgcgccatagtaaccactctactgagaattctcctatcgagcgccgcagtctaatgaccagcgacgaaaactaccacaacgagcgggctcggaagtctagaaatcgactgagtagcagcagtcagcatagtcgagaccattacccattagtcgaggaggattatcctgatagctatcaggacacttataaaccccatcggaaccgtgggtctccaggaggctattcccacgactctcgccaccgtctatag

SEQ ID NO: 110402 - DNA, 1248 bp, Artificial Sequence
  Description of Artificial Sequence: Synthetic coding sequence
ttctattttctctgtcagggaagcgcagatagctacacctcccgccccagcgactctgatgtgtccttggaggaggaccgggaagccattcgccaggagcgcgagcagcaagcagccattcagctcgagcgcgcgaagagcaaaccagtggcgttcgctgtgaagacaaatgtctcgtactgcggagctctggacgaggacgtaccggttccatcaactgccatctccttcgacgcgaaagattttctgcacattaaagaaaaatataacaatgactggtggatcgggaggctagtgaaggaagggtgtgagataggctttatcccttcccctctcaggttagaaaacattcggatccagcaagagcaaaaaagaggcaggtttcacggcgggaagtcaagtgggaactcgagcagtagcctgggcgagatggtgagtggcacgttccgtgcgacacccacttccacggcaaagcaaaaacagaaagtgactgaacatatacccccatacgatgttgttcccagcatgagacccgtcgtgcttgtcggaccttcactgaagggctacgaagtcacagacatgatgcagaaagcactcttcgactttctgaagcaccggtttgacggcaggatatctataacaagggtgacagcagatatttctctggcaaagagaagcgtgttaaacaacccttcaaaaagagctataatcgagcgaagtaacaccagatccagtctggctgaggtacagtcagaaatcgagcggattttcgaactggcccgaagcttgcagttagtggtactggacgccgacaccattaatcaccctgcccagctcattaagaccagtctcgcccccatcatagtgcacgtgaaggtgtccagccccaaagtgttgcagaggctgatcaagagcagaggcaaatcccaatcaaaacatttgaacgttcaactcgtcgccgcagacaagcttgcccaatgccccccctctcagagaatgagacatagtaaccactccaccgaaaattctccaattgaaaggagaagtttgatgacctcagacgagaactatcacaacgagagggcaagaaaatcccggaatcggttgagtagctccagccagcattctagggatcattaccctcttgtcgaagaagattacccagacagctaccaggacacgtacaaaccacaccgaaatcgaggtagtcctggcggatacagtcacgacagtcgtcaccgtctctag

SEQ ID NO: 110403 - DNA, 558 bp, Artificial Sequence
  Description of Artificial Sequence: Synthetic coding sequence
atgtccggcagctttgaactgagcgtgcaagacctgaatgacttgttaagcgatggttccggctgttactccttgccaagccagccatgcaatgaagtgacaccgcggatttatgtaggaaatgcctcggtggctcaagatatcccaaagctgcaaaagcttggcatcacacatgttctgaatgctgccgaaggcagaagttttatgcacgtgaatacaaatgcaaatttttacaaggacagcggtattacttacctgggcataaaggccaacgatacccaagagtttaatctctcagcttattttgagagggctgctgacttcattgatcaggcgctcgcccagaaaaatggtagagtgctggtgcattgcagagaaggctacagtcgctcccccacgctggtgatagcatacctgatgatgcggcaaaagatggatgtgaaatcggccctgtcaattgtcaggcagaatagggagattgggccaaatgacggattcctcgcacagctgtgccaactgaatgatcgactggccaaagagggaaaattaaagccttag

SEQ ID NO: 110404 - DNA, 972 bp, Artificial Sequence
  Description of Artificial Sequence: Synthetic coding sequence
atggggctatttgatagaggcgtgcaaatgttgctgacaacagtcggagcatttgccgccttttcactaatgactatagctgtgggaacggactactggctttactctcgaggcgtctgcaaaaccaagagcgttagcgagaatgaaactagcaaaaaaaacgaagaagtgatgacccactccggactttggaggacatgttgtctcgagggaaatttcaagggcctctgtaaacagatcgaccacttcccagaagatgctgactacgaggcagataccgcagagtatttcttgagagccgtgcgcgcctcgagcatctttcctatcctttccgttatcctgctcttcatggggggcctttgcatcgcagcttcggaattctacaagacgcgccataacatcatactctctgcaggcattttctttgtcagtgcgggactctctaacatcatcggaataatagtgtacatcagcgccaatgccggagacccctccaaaagcgacagcaagaagaatagttactcttacggctggagcttctatttcggggccctttcttttatcattgcggaaatggtgggggttctcgctgtacatatgttcatcgatcgccataagcagctgcgcgcaactgctcgcgctacggactatcttcaggccagcgccataaccagaattccttcctatcgctatagataccagcgtcggagtagatcaagttcccggagcacagagccatcccacagcagggatgccagcccagtgggcataaagggctttaatactctccctagtacagagatatccatgtatacacttagtcgagatcctttgaaggcagccacgacgcctaccgccacgtataattccgacagagacaatagctttctgcaggtgcacaactgtatccaaaaagaaaataaggattcgttgcacagcaatacagcaaaccggcggacaacccccgtttag

SEQ ID NO: 110405 - DNA, 948 bp, Artificial Sequence
  Description of Artificial Sequence: Synthetic coding sequence
atgcggatgtgcgacaggggaatccagatgctcatcactaccgtgggtgcctttgctgccttctctctaatgacaatagccgtgggcacagactattggctttacagccgcggggtgtgtcgtaccaagagtacatctgacaatgagacatcgagaaagaatgaggaggtcatgacacactcaggactttggagaacatgttgcctggagggcgcctttcggggtgtgtgcaaaaaaattgaccacttccccgaagacgccgattatgagcaagatactgctgaatatctcctgagagctgtgagagccagctcagtcttccctatcttgagcgtgacactcctcttttttggtggcctgtgcgtggcagcaagtgaattccaccgaagtaggcacaacgtcattctctcagccggcattttcttcgtgtcggcaggactaagcaacatcataggcattatcgtgtatatttccgccaacgcaggtgatcctggacaaagggattccaagaagtcctactcatacgggtggtcattttacttcggggccttcagttttatcattgctgaaattgttggcgtggtggccgtgcacatttatattgagaaacaccagcagttaagggcgaagtctcattccgaattcctaaagaagtctaccttcgccagattgcccccgtaccgctacagatttagacgacgaagttcaagtaggtccaccgaacctcggtcacgggacctgtcacccataagcaaggggttccacaccattccttccacggacatctctatgttcaccctgtccagggatccatccaaaataacaatggggaccctcctgaacagtgaccgggaccacgcttttctccaattccacaatagcacaccaaaggagtttaaggagagtctgcataacaaccccgccaatagacggacaactccagtctag

SEQ ID NO: 110406 - DNA, 891 bp, Artificial Sequence
  Description of Artificial Sequence: Synthetic coding sequence
atgtctgcctgcgggcggaaggcacttaccctgctgtcaagcgtatttgcagtgtgcggcctgggcctacttggtatcgccgtgagcaccgactactggctgtacctggaggagggcgtgatcgtgccgcagaatcagtcaaccgagatcaagatgagtctacacagcggactctggagggtttgctttctcgctggagaggaacgggggaggtgcttcaccattgaatatgttatgccgatgaacactcagcttacatccgagtccaccgtgaacgtgctgaagatgatacgctccgcaacaccattcccactggtctccctgtttttcatgtttattgggtttatcctgaataacatcggtcacatcagacctcaccgcaccatcctcgcatttgtctccggtatcttctttattttgagcggtctgtcccttgtggtgggactggtgttgtacatttcatctataaacgacgaaatgcttaacaggaccaaagatgccgaaacctacttcaattataagtatggctggagctttgctttcgctgcaattagtttccttctgaccgaagtcaagcccgtgacactgagcatggatagactcggcctcggaacagctcccttatctcgaggcgagtggggatggggcagacgcgacatacctcaacctttttggacccctgaccaccctctgtattttccctcctcttctcaaaatgtaagcttgagctatctgtccggcagtcctccagcccgtatgagccccggtccatgttcttgccctcacgtgcactttcccccccactctagctgcgtcctttgtaggcctcagccacgggagatgagacaagctccagctgcaagtcccagcagcgccgttttctcgctgtag

SEQ ID NO: 110407 - DNA, 828 bp, Artificial Sequence
  Description of Artificial Sequence: Synthetic coding sequence
atgagcgcttgcggcaggaaagccttgacattgctttcttctgtgttcgccgtgtgcgggcttggcctgctggggatcgctgtgtccactgattactggctttacctagaggagggggtgattgtgccacagaatcaatcaactgagatcaagatgagtctccattcaggactctggcgcgtatgttttctggcgggtgaggaaagggggcgctgtttcacaatcgagtatgtgatgccaatgaacactcaactgacctccgagtcgaccgtaaacgtcctgaagatgatacggtctgctactccatttccactagtgtcactgtttttcatgttcattggtttcatcctgaacaacattggccacatccgaccacataggactatactcgccttcgtgagcgggatcttctttatactgtcaggactgtctctggtggtgggtttggtgctctatatctctagcatcaatgatgaaatgttaaatcggaccaaggatgcagagacatacttcaactataaatatggatggtccttcgccttcgccgcgattagcttcctcctcactgagtccgctggagtcatgtccgtatacctgtttatgaaacggtataccgccgaggatatgtataggccacatcccggtttctaccggccccggctgagcaactgcagcgattactctggacaatttctgcatcctgacgcatgggttaggggccggtcgccatccgatattagttcagaggcgagcctgcagatgaactcaaattatcccgccctgttgaaatgtccagactatgaccaaatgtcttcgtccccctgttag

SEQ ID NO: 110408 - DNA, 828 bp, Artificial Sequence
  Description of Artificial Sequence: Synthetic coding sequence
atgagtgcttgcgggcggaaggccctgaccctcctttcatctgtcttcgctgtgtgtgggcttggattgctgggaattgccgtgagcaccgactattggctctacctggaggaaggcgtcatcgtcccacagaatcagtcgacagaaatcaagatgtcgcttcactccggcctttggcgggtgtgtttcctggcaggcgaggaaagaggaaggtgcttcacaattgagtacgttatgccgatgaatacccaactaacatccgagtccacggttaatgttttaaagatgatcaggagcgcaacgccgtttcccctcgtgagcctattttttatgtttatcggattcatcctcaataacatcggccacatcagaccgcataggaccatcttggccttcgtgagcgggatttttttcatcttgtccggtctgtctctcgtggtagggctggtgctgtacatatccagtattaatgatgaaatgctgaaccggacaaaagacgctgagacgtattttaactacaagtatgggtggtctttcgcctttgcagcaatctcattccttctcacagaatccgccggtgtgatgtccgtgtatctgtttatgaagcggtacaccgccgaagacatgtatcgaccacatccgggcttttaccgtccccgcctgtctaactgttccgactattcaggtcaattcctacaccctgacgcctgggtgcggggcagatcaccttccgacattagcagcgaggccagcttgcagatgaactctaactatcccgcgctgctcaagtgtcccgactacgaccagatgtcttccagcccttgctag

SEQ ID NO: 110409 - DNA, 783 bp, Artificial Sequence
  Description of Artificial Sequence: Synthetic coding sequence
atgatgtggagtaactttttcctgcaggaggagaatagacggcggggcgccgcgggtcgccgccgagctcatgggcagggccgaagcggtctgactccagagagagagggaaaggtgaaactcgcgctgctgctggcagcggtcggcgctacactcgctgtccttagtgtgggaactgagttttgggtggagctgaacacttacaaggccaatgggtccgccgtgtgcgaggccgctcatcttggtctctggaaagcatgtaccaaacgtctttggcaggctgacgtcccagtggaccgagacacatgtggccccgcggagttacccggtgaagccaactgtacttatttcaagtttttcaccacaggagaaaatgcgcgcatttttcagaggacaacaaagaaggaagttaaccttgccgctgcagtcatcgccgtattggggttggcagtcatggctctggggtgtctctgtatcattatggtcttgtccaaaggggccgaattcctgttgagagtaggtgctgtatgttttggcctgtctggtctgctgctactggtaagtctcgaggtgtttcggcactccgtcagggcactcctgcagcgagtgagtcccgaaccaccacctgccccgcgcctcacatacgaatactcatggagtctcggctgcggggtcggtgcgggcctcattttgttactgggcgctggctgcttcctcctccttacactcccctcttggccctgggggagcctgtgtcccaaacgtggacaccgcgcaacctag

SEQ ID NO: 110410 - DNA, 645 bp, Artificial Sequence
  Description of Artificial Sequence: Synthetic coding sequence
atgatgtggtctaacttctttctgcaggaagagaacaggcggcggggcgccgcaggccgcagacgggcacacggccagggcaggagcggtctgacaccagagagggagggcaaagtgaaacttgctctcctcttggctgcagttggcgctacgctggctgtgctgagtgttggcaccgaattctgggtcgaactgaacacgtacaaggcaaacggctccgcagtgtgtgaggctgcccacctgggactctggaaagcatgcactaagcgcctgtggcaggccgacgttcctgttgacagagatacatgtggcccagccgaattgccaggcgaagccaactgcacctatttcaagttttttaccactggagaaaatgcgcggatttttcagcgcactaccaagaaggggttactcctgttggtgagtctggaggtgttcaggcactctgttagagcactccttcaacgcgtgtcaccagaaccacctcctgccccccgccttacgtacgaatactcctggagcctaggctgtggggtaggggccggactgatcctcctattgggtgccggctgttttttattactgacactgccttcctggccttggggctcactctgcccaaagagaggtcacagagccacttag

SEQ ID NO: 110411 - DNA, 570 bp, Artificial Sequence
  Description of Artificial Sequence: Synthetic coding sequence
atgatgtggtccaatttcttcctgcaagaggaaaataggcggagaggcgctgcgggcaggcgaagagcacatgggcagggtcgatcaggactgacccctgagagagagggcaaggtcaagctcgccttactcctcgctgcggtaggggcaaccctcgcggttctgtccgtaggcaccgagttttgggtggaactgaatacatacaaagccaatggctccgcagtgtgtgaagcagcccacttaggactgtggaaggcgtgtaccaagagattgtggcaggccgatgtaccagtggaccgggatacatgcggtccagccgaacttccaggcgggttgctcctgctggtgagccttgaggtgttcagacattcagtcagagctctgctgcagcgcgtttcacctgagccaccaccagcccctcgtctaacctacgagtactcctggtcgctgggctgcggcgtcggcgccgggcttattctgctgttaggcgcaggttgctttctgctgctgaccctgcccagctggccttggggaagcctttgcccaaagagaggtcaccgcgctacgtag

SEQ ID NO: 110412 - DNA, 321 bp, Artificial Sequence
  Description of Artificial Sequence: Synthetic coding sequence
atgagtacgaataacatgtccgacccccgcagacccaacaaagtgttacggtacaagcccccccctagtgaatgcaacccagcccttgacgacccgactccggactacatgaacctgctcggaatgattttttcaatgtgtggactgatgctcaagctgaaatggtgtgcctgggttgccgtgtattgttcattcatttcttttgctaactccagatcatcggaagacaccaagcagatgatgtcttcttttatgctgtcaattagcgccgtggttatgagttaccttcagaatccgcagcctatgacacccccatggtag

SEQ ID NO: 110413 - DNA, 828 bp, Artificial Sequence
  Description of Artificial Sequence: Synthetic coding sequence
atgagccattgcagcagtagggctctcacactgctgtcctccgtattcggcgcgtgtgggcttctgctcgtaggaattgcagtgtccaccgattactggctctacatggaagaaggaaccgtgcttccccagaatcagaccactgaagtgaaaatggccttacatgcaggactttggagagtatgttttttcgccggccgcgagaagggccggtgtgtcgcaagtgagtattttctagagcccgagattaacctagtgactgagaatactgagaatattctgaaaacagtcaggaccgcgactcccttcccaatggtgagcctgttccttgtttttaccgccttcgtcatctcaaatattggccatatcaggccccagaggacaatcctcgcattcgtctcagggatctttttcatactgagcggcctgtctctggtggtaggtttagttctctatatcagtagtattaatgatgaagtcatgaatcgaccgagtagcagcgagcagtattttcactacaggtatggatggagttttgcttttgcggcatccagtttcctcctcaaggagggcgcgggtgtcatgtcagtctacttgttcaccaaaaggtatgccgaggaagagatgtatcggccgcatcctgctttttacagacctaggctctccgactgctctgactactccggccagttcctccagcccgaggcttggaggcggggtcggtctcccagtgacatttcctccgatgtttccattcaaatgacccagaactatccacccgctatcaaatatcccgaccacctgcacatttctaccagcccttgctag

SEQ ID NO: 110414 - DNA, 1278 bp, Artificial Sequence
  Description of Artificial Sequence: Synthetic coding sequence
cttgagtcacttaaacgatggaacgaagagaggggcctgtggtgtgagaaaggcgtccaggtgctcttgacaacggttggagcattcgctgcgttcgggctgatgacaatcgcaatctccaccgattactggctgtacacacgggcactaatctgcaacacgaccaacctaaccgcaggaggggacgatggcaccccccaccgcggaggcggcggcgcttccgagaagaaggaccctggcggtctcacgcacagcggattatggcgaatttgttgtttagaaggcctaaaacgtggagtctgtgtcaaaatcaatcatttccccgaggatacagattacgatcatgatagtgcggagtatctccttagggtggtgagagccagctcaatctttccgattctgtccgccatactgctcctcctgggcggtgtgtgtgtcgctgcatctcgcgtgtataaatcaaaacgtaatatcattcttggggctggcatcctattcgtggccgccggtttatcaaatataattggcgtcattgtgtatatatcagccaatgctggggaacccggtcccaagcgagacgaggagaagaagaaccactactcctatggttggagcttctactttggcggtcttagttttatcttggccgaggtgatcggtgtcttggcagtgaacatttatattgaacgcagtagagaggctcactgtcagagccgctccgacctgctgaaggccgggggcggagccggtgggagcggtgggtctgggccctcagctatcctccgactgccaagctatcgattccggtatcgtaggagaagccggagttcttcccggtcttcagagccatctcccagtagggatgcttccccaggcgggcctggaggtccagggtttgccagtacggacattagcatgtacaccctttcaagggacccaagcaaaggatctgtggcggcaggcctggctggggcaggaggcggtggaggcggcgctgtgggagccttcggaggtgcagctggtggcgctggcggagggggtggcggcggggggggggccggcgcagagagagaccggggcggcgcttcagggtttctaaccttacacaatgctttccccaaagaggctgggggcggggtaaccgttacagtgacaggtccgcctgctcctcccgctccagcgccccctgccccgtctgccccagctccagggaccctggctaaagaggcagcagcctctaacacgaatacgttaaatcgcaagactacgccggtgtag

SEQ ID NO: 110415 - DNA, 6540 bp, Artificial Sequence
  Description of Artificial Sequence: Synthetic coding sequence
atggtgaatgaaaatacaagaatgtatattccagaagagaaccaccagggctccaactatggatccccacgtccagcacacgctaacatgaatgccaacgcagcggcaggcctggcccccgagcatattccgacaccgggagccgcactaagttggcaagccgctatagacgctgcccgtcaggccaagcttatgggttccgcaggaaacgccacaatttctactgtgagttccacacagagaaaacggcaacagtacgggaagcccaagaagcagggaagcactacggccaccagacccccacgagccctgctgtgtctgacgctgaagaacccgatacggagggcttgtatcagcatcgtcgaatggaaacctttcgaaattatcatactactcacaatcttcgcgaattgcgttgctctggccatttatatccctttccccgaagacgacagtaacgccaccaactcaaatctggaacgggtggaatacctgttcctaatcattttcacagtggaagcgtttctaaaagtgatcgcttatggcttgctgttccatcctaacgcttacctccgcaacggctggaatctgctggacttcatcatcgtcgttgtcggacttttctcggcaattctcgaacaggccaccaaagccgatggagcaaatgcgctgggtgggaaaggtgccggcttcgatgtgaaagcattgagggcatttagagtgcttcgaccgctcaggcttgtgtctggggtgccgtctcttcaagttgtgctcaactccatcattaaggccatggtccctcttctccacatagcactcctggtcctctttgtgattattatctacgccatcatcggcctggaattgttcatgggcaagatgcataaaacctgctacaaccaggaagggatcgccgacgtccctgctgaggatgaccctagtccgtgcgccctggagaccggccacgggagacaatgccagaacggaacggtatgcaagcctggctgggacggcccaaagcatggcatcacgaacttcgacaacttcgcctttgcaatgctcactgtttttcagtgtattaccatggaagggtggaccgatgtgctgtactgggtgaacgatgctgtgggacgagattggccttggatttactttgtgacgcttataattataggaagcttttttgttctgaatctcgtgttgggagtgctgagcggagagttcagtaaagagcgggagaaggcaaaggctcgtggggattttcagaagctacgagagaaacagcagctcgaagaagatctgaagggctatctggattggattactcaagcggaggatatagatccggagaatgaggatgagggcatggacgaggaaaagccccgaaacatgtctatgcccacaagtgagactgaaagtgttaataccgagaacgtggcaggcggcgacatcgaaggggagaactgcggggccaggctggcccatagaatttctaagtccaagttctcccgttattggagaaggtggaatagattctgccgccgaaagtgcagagctgctgtcaaatccaacgtgttctattggctagtgatttttctggttttcctgaataccttgactatcgctagcgagcattataaccagcccaactggctgacagaagtccaggatactgccaacaaggctcttctagctctgttcactgccgagatgctgctgaagatgtacagccttgggctacaggcctactttgtgtcactcttcaatagatttgattgttttgtcgtgtgtggggggattctcgagacaatcctagtggagacgaaaatcatgagtcccctgggcatctctgtgctgagatgcgtgcggctgctgcgcatttttaaaataaccaggtattggaacagccttagtaacctggtagcttctctgctgaatagcgtgcggtccattgcaagtctgctgttgttgctgtttttatttattattatattttctctacttgggatgcaacttttcggcggaaagttcaattttgacgaaatgcagacgaggaggtcgacctttgataatttcccacagtcgctcctgaccgttttccagatactgaccggggaggattggaactcagtcatgtacgatgggattatggcctacgggggtccttccttcccaggcatgctcgtgtgtatctacttcattattctgtttatctgcggaaattatatccttctaaacgtgttcctcgcaatcgctgtcgacaatctcgcagacgctgagagcctgaccagcgcccagaaagaagaagaagaggaaaaagaacgcaagaaactcgcgagaactgcctctcctgagaaaaagcaagaacttgtggaaaagccagccgttggggagtctaaggaagaaaagatcgaactgaagtccatcaccgccgatggtgaatcccctcccgctactaagattaatatggacgatctgcaacctaacgaaaatgaagataaaagcccgtatccaaatccggaaaccactggagaggaagatgaggaagagcctgagatgcctgtcgggccaagaccaagaccgctgtcagagctacaccttaaggaaaaagccgtcccaatgcccgaagcgagcgctttcttcatcttctcctccaacaacaggttccgtttacaatgccatagaattgtgaacgacactatcttcactaacttgatcctatttttcatcctgctgtcgagcatctctctggcggcagaggatccagtgcagcatactagcttccgaaatcacatcctattttattttgatattgtgtttacaacaattttcaccatcgagatcgcacttaaaatgactgcctacggagcttttcttcataaaggaagcttttgcaggaattacttcaatatactggatctcctggttgtttcggtatcactgatttcgttcggcattcagtcttcagcgatcaacgttgttaaaatcctgagagttctgagggtgctgcgccctttgagagctattaacagagcaaagggcctgaagcacgttgttcagtgtgttttcgtggctatccgtaccattggcaacattgtcatagtcacaacactgctgcaattcatgtttgcatgtataggagtgcagttgtttaaagggaaactgtatacgtgtagcgactcttcaaagcaaacggaggccgagtgtaaagggaattacatcacttataaggatggtgaagtcgatcaccccatcatccagccgcgatcgtgggaaaattctaaattcgattttgataacgtccttgccgctatgatggcactgttcactgtcagtaccttcgagggctggcccgagttgctgtatcgctctattgacagtcatacagaagataaagggcctatttacaattaccgagtggagatatcaatcttctttatcatatatatcattatcatagctttctttatgatgaacatctttgtagggttcgtcattgtcacgttccaggaacagggggagcaggaatacaagaattgtgaactggacaagaaccaacgacagtgtgtcgagtacgccttaaaagctcgtcctctgcgtcgttatattccgaagaatcagcaccagtacaaagtatggtacgtggttaattcaacctattttgaatacctgatgttcgtgctcatcctcttgaataccatttgtttggcgatgcagcactacggacagtcttgcctgttcaaaatcgcaatgaacatacttaatatgttatttactggcctgtttaccgtcgaaatgatattaaagttaattgcctttaaaccgaagcattatttttgcgatgcctggaataccttcgatgcccttatcgtggtcggctcaatcgttgacattgctatcaccgaagtcaatccagctgaacacacacagtgctcaccaagtatggggccgtcatgcagccacccacctctagcggttctcacagcccctcctgtcgccgacggatttcagaatgctgaagagaatagcaggatctcaatcacattttttagactgttcagagtaatgcgacttgtgaaattgctcagccgcggggaaggcattaggacactcctctggaccttcattaaatcattccaagcactcccttatgtggctctgctgattgtgatgcttttttttatctacgcagtgattggaatgcaggtctttgggaaaatcgctctcaacgacaccactgaaattaatcggaataacaactttcaaactttcccacaagccgtgctcctgctgttcagatgcgctacgggggaggcttggcaagacattatgttggcttgtatgccagggaagaaatgtgctccggagagcgagccctcaaactctaccgaaggagagacaccttgtgggagtagcttcgccgtcttttatttcataagtttttatatgctctgtgcctttttgatcatcaatctttttgttgcggttatcatggataatttcgattacctgacaagggactggtctatcctcggaccccatcacctggatgaatttaagaggatttgggccgaatacgatcccgaggcaaagggccggatcaagcatctggatgtggtgaccctcctgaggcggatacagcctcccctgggattcgggaagttgtgcccacacagagtggcatgcaaacgtctggtgtccatgaatatgcctctgaatagtgacggaaccgtcatgttcaacgcaacactgttcgcactagttagaacagccttgaggatcaaaacggaggaagggccttctccctcagaggcccatcagggggctgaagacccctttcgccctgcggggaatctggagcaggcaaacgaggaattaagggccattattaagaagatctggaaaaggacttcaatgaagttgctggaccaagtggtgccccctgccggagacgatgaagtgacggtcggaaaattttacgcgacattccttattcaggagtacttccgcaagttcaagaagagaaaagagcagggcctcgtgggtaaacctagtcagcggaatgccctgagtctacaggctgggttgaggacccttcacgatattggtcccgagataaggcgggctatatccggagatctaacagctgaggaggaactggataaggcaatgaaagaggctgtgagtgcggcttcagaggacgatatattccggcgggccggggggctgttcgggaatcacgtgtcctattatcagtccgatggccggtcagcatttccacagacctttaccacgcagaggccactgcacattaataaggccgggtcctcccagggcgataccgagagccccagccacgagaagctggtggattccacattcaccccttcttcttacagtagtacaggcagcaacgcgaacataaataatgcaaacaacactgcactgggtaggctcccccggcccgcagggtacccttccaccgttagtaccgtcgaaggccatgggccccccctctcacctgccatacgtgtccaggaagtagcttggaaactgtcaagcaatcgatgtcattcaagggaatctcaggccgcaatggctggacaagaggagactagtcaggatgaaacgtacgaggtcaagatgaaccatgacactgaagcatgttctgagcctagcctcctcagtactgagatgctgtcctaccaggatgatgagaatagacagcttacccttcctgaggaagacaagagagatatcagacagtctcctaaacgcggcttcttgaggagcgctagtcttgggaggcgcgcctcatttcatcttgagtgtttgaaaagacagaaagatcgcggcggagacatctcacagaagacagtactgcccctgcatctggtccaccaccaggcactcgctgtagccgggctgtctcctctgttgcagcgctcacacagccccgcttccttccctagaccctttgctacccctcccgccacgccgggcagtaggggatggccccctcaaccggtgcccactctacgactagagggagtggaatcttctgaaaagttaaactccagcttcccctccatccattgcggttcttgggccgagaccactccagggggggggggaagcagtgccgccagacgcgtgcgaccggtgtccctgatggtccccagccaggccggggcaccaggacggcagtttcacgggtctgctagctcgctggtcgaagccgtcctgatttcagaaggtcttggccagttcgcccaagacccaaagttcatcgaagtcaccacccaagagctggctgatgcgtgcgatatgaccatcgaggagatggagtctgctgcagataacattctttcaggcggcgcgccacagtctccaaatggagccctgctgccttttgtgaactgtagagatgctggtcaggaccgagctgggggcgaagaagacgccggctgcgtgcgcgcccggggccgcccttctgaggaagagctgcaggactctcgagtttatgtaagctcactttag

SEQ ID NO: 110416 - DNA, 6561 bp, Artificial Sequence
  Description of Artificial Sequence: Synthetic coding sequence
atggtcaacgagaacacacgcatgtatattcccgaggagaaccaccaaggttctaactatgggtcacccaggccagctcatgcaaacatgaatgccaacgccgcggcggggctggccccggaacatatccctacccctggggccgccttgtcctggcaggcagcaatcgacgctgcccgccaggccaaactgatgggcagcgcgggaaacgcaactattagcacagtgagcagcacccagcgcaagcggcagcaatatgggaagcctaagaagcagggatccacaaccgccactaggcctccccgcgcgttgctgtgcctaaccctgaagaatcccatccgacgggcctgtataagtattgtggaatggaaaccttttgaaattattattttactaacaatcttcgcaaactgtgtggctcttgctatctatattcccttccccgaggatgattccaacgccaccaattcgaatttagagcgggtcgagtatttattcctgattattttcaccgttgaagcctttctcaaagtcattgcatacgggctcctgttccaccctaatgcctatctgaggaacggttggaacctcttggatttcataattgtggtggtggggctgttcagcgccattctggaacaggccactaaagctgacggcgccaacgcactggggggaaaaggtgcgggctttgacgtaaaggccctgcgggccttcagggtacttaggccattgcgccttgtcagtggagtgccatcactccaggttgtgttgaactccataattaaggcaatggtgccactcctgcatatagcgttgcttgtcctgtttgtaattattatctacgctataatcggactggagttattcatgggaaaaatgcataagacgtgttacaatcaggaaggaatcgccgatgtaccagccgaagacgacccttccccttgcgcgcttgagaccggccatgggcggcagtgtcagaatggaacggtctgcaagcccggctgggacgggcccaaacacggtattacaaacttcgataatttcgcttttgccatgttgactgtattccagtgtatcacgatggaaggttggaccgatgtcttatactgggttaacgacgctgtgggacgcgactggccctggatctacttcgttacgctcatcataatcggttctttttttgttctgaaccttgtcctcggtgttttgtccggtgagttctcaaaagagagagaaaaagcaaaggcccggggggacttccagaagctacgggaaaaacaacagctcgaagaagacctgaaagggtacctagattggatcacccaggccgaggacatcgaccccgaaaacgaagatgaaggcatggacgaggagaaaccacgtaatatgagcatgcccaccagtgagacagaatcggtgaacaccgaaaacgtcgccggcggcgatatcgagggtgaaaattgcggagcccgtcttgctcatcgcataagcaagtctaagttttcacggtactggcgtcgctggaaccgtttctgccgacgcaaatgtcgagcggctgtcaaatcaaatgtgttctactggctcgtaatctttctcgtgttcctcaacaccctcaccatagcctcagaacattacaatcagccaaattggctcacggaagttcaggacactgctaacaaggcgttgctagcattgttcaccgctgagatgctactgaaaatgtatagtctagggctacaggcttatttcgtatctctgtttaacagattcgattgctttgttgtttgcggagggatcttggagactatcctggtcgaaactaaaattatgtcccctttaggaatatccgtcctaagatgtgtgcgactcctgcgtattttcaagatcacccggtactggaatagtttgagcaacctggtggctagcctcctaaattcggtgcgcagtatcgcctctctcctactcttgctgtttctcttcataattatatttagcttactgggtatgcagctgtttggcgggaaatttaatttcgatgaaatgcagacacgccggagtaccttcgataattttccacagtccctgctcacagttttccaaatccttacaggcgaagattggaactccgtgatgtacgatggcattatggcgtatggtgggccctcgttccctggcatgttagtttgtatctactttattattttgtttatatgtgggaactacatcctcttgaatgtgttcctcgctatcgccgttgacaacctggccgacgcagagagtttgacgtccgctcagaaagaggaagaagaagaaaaagagcgcaagaaacttgcaagaaccgcctctcctgaaaaaaagcaggagctcgtcgagaaacctgcagtgggcgagtctaaggaagagaagattgaactcaagtccataaccgccgatggcgaatctccccccgccaccaagatcaatatggacgacctccaacccaatgaaaatgaggataagtccccgtatcccaaccccgagaccaccggagaggaggacgaggaggagccagagatgcccgtgggaccccgaccgaggcccctatctgaattacatttgaaggaaaaggccgtacccatgcctgaggcgagcgcattctttatcttcagctccaataatcgcttccggctccagtgccacaggatcgttaatgacactatctttaccaatttgattcttttctttattctcctgagtagtatcagtttagccgcagaggaccctgtgcagcatacctctttcaggaatcacatacttttctattttgacattgtctttaccactatttttacaatcgagattgcactgaagattctgggaaacgcagattatgtctttacttctattttcaccttggaaatcattctgaagatgaccgcctatggcgcgtttttacataaaggctccttctgtagaaactatttcaatatcctggatctcctggtcgtttccgtctcattgatctctttcggaattcagagctccgctattaacgttgttaagatcctcagagttctaagggtgcttcggcctctcagagccatcaatcgggctaagggtctgaagcacgtggtgcagtgcgtgttcgtagctatccggacaatcgggaacatcgtgatcgtgactaccctactccaatttatgttcgcatgtataggcgtccagcttttcaagggcaagctgtacacttgctcagattctagtaaacaaactgaagccgagtgcaaaggaaattatatcacctataaagatggcgaagtggatcatcccataatccagccaagatcttgggagaacagcaagttcgatttcgacaatgtcttggcagcgatgatggccctgttcacagtcagtacattcgaaggttggcccgagctgctttatagatccatcgactctcatacagaggataaaggcccaatctacaactacagagtggaaatcagcatcttttttataatatatattatcataattgccttttttatgatgaatattttcgtcggatttgtgattgtaacattccaagaacaaggcgaacaggaatacaaaaattgcgagctggataagaaccagaggcagtgcgtggagtatgctctgaaagcacgtcccctgcgtagatacattccaaaaaaccagcaccagtataaggtgtggtacgttgtgaactctacgtacttcgagtatctcatgtttgttcttatccttctgaatactatttgcttggccatgcagcattatggccagtcctgtttgttcaaaatagcaatgaacattctgaacatgctctttaccggcctgtttactgtggagatgatcctcaaactcatcgcattcaaacccaaagggtactttagcgacccatggaacgttttcgactttttaattgtgatcggctcaatcatagacgtgatcctgtctgagacaaaccattacttttgtgacgcgtggaacaccttcgatgcactcattgtcgtcggatcaatagttgacatcgcaattaccgaggtgaatcctgctgagcacacccagtgcagcccttcaatgaacgctgaagagaactctcgcattagcattaccttctttcggctttttcgcgttatgcgactggttaagctcctgtctcgtggcgaggggatcaggactctgctgtggaccttcataaaatcctttcaggccctgccctacgtggccttactgattgtaatgctgttcttcatctatgcggtcataggaatgcaggtgttcgggaagattgccctgaatgataccaccgagattaaccgcaataacaatttccagacatttccacaggcagttctcctgctgttccggtgcgctaccggtgaggcttggcaggacattatgctagcgtgtatgccaggtaagaagtgcgcgccagaatccgaaccatccaattcgacagagggcgaaactccgtgtggctcctccttcgccgttttctactttatcagcttttacatgctttgtgcctttctgattattaatttgtttgttgccgtgatcatggacaacttcgactacctgactcgggactggtccattctgggcccacatcatctggatgaattcaaaaggatctgggctgagtacgacccagaagcaaagggtcgaattaagcacctggatgttgtaactcttttgcggcggatccaacctcccttaggttttggaaagctgtgcccgcatcgggtcgcctgcaagcgccttgtaagcatgaacatgccactgaattcagacggaaccgttatgtttaacgccacactctttgcactcgttagaacagctctcagaatcaagaccgagggcaacctggagcaggcaaacgaggaattacgtgcaatcatcaagaagatttggaagcgcacatctatgaaacttctcgatcaggtggttccgccggctggggacgatgaagttacggttggcaagttctacgcaaccttcctcatccaagaatactttcgcaagtttaaaaagaggaaggagcagggtttggttggtaaaccgtcacagcgcaatgctcttagcttgcaagctgggctccgcactcttcatgatattgggccagaaattcggagggccatttcaggcgatctgaccgccgaggaggaattggataaagcaatgaaggaggccgtgagcgccgcgagcgaagatgatattttcaggcgggctgggggcttattcgggaatcatgtgagctattatcagtcggacggccgctcagccttccctcagacattcactacccagcgccctctacacattaacaaagccggatcgtcccagggcgacaccgagtcacctagccacgagaaattggtcgattccaccttcacacccagcagttactcttcgacaggaagtaatgctaatatcaataatgccaacaataccgccctgggcagattacctcgccctgccgggtaccccagcacggtgtccaccgtggagggacacgggccccctctttctcccgccatcagagtccaagaggtcgcctggaagctcagctctaataggtgccactccagagagtcccaggctgccatggccggtcaagaggagacgtctcaggatgaaacatatgaggtaaagatgaaccatgatactgaagcatgttccgagcccagccttctcagcaccgaaatgttgagctatcaggatgatgagaataggcagctgactctgccggaagaagataaacgcgatattcggcagtctcccaagcgaggctttctacgatctgccagccttggcagaagagcctctttccacctggagtgtttgaaaagacagaaagaccggggaggggacatttcccagaaaaccgttctgccactgcatcttgttcatcaccaggccctggcggtcgccggactttctccgttactccagcgatcccattcaccagcatcgttcccccgtcccttcgcgacaccccccgctactccgggctctcgggggtggcccccgcagccggtacccacactgagactcgaaggggtggaaagcagcgagaagcttaactcgagcttccccagcattcactgtgggtcatgggccgagaccacaccgggaggcggaggcagtagcgctgcacggcgggtcaggcctgtgtccctgatggtcccatctcaggctggagcgccgggccggcagtttcacggtagtgcatcgtctctggtggaagcagtgctcatctcggagggcttaggacagttcgcgcaggatcccaaattcatcgaagtcactacccaggagctggcagacgcttgcgatatgacaatcgaggagatggaaagtgctgcggacaatattctgagtgggggcgccccccagagccccaacggcgcattgctgccgttcgtgaattgtagagacgctggacaagatagagctggcggggaagaagacgctggatgtgtccgcgccaggggtcgcccttccgaagaggaattgcaggatagtcgcgtttatgttagctccctatag

SEQ ID NO: 110417 - DNA, 6441 bp, Artificial Sequence
  Description of Artificial Sequence: Synthetic coding sequence
atggtgaacgaaaacactcggatgtatatccccgaagagaaccatcaaggctctaactatggttcaccaagaccggctcacgccaatatgaacgccaacgccgcagcagggctcgcaccagaacacataccgacccccggtgccgccttgagttggcaggccgctatcgatgctgcaaggcaggcgaaactgatgggatccgcaggaaatgccacaatttctaccgtctctagcacacagcggaagcgccagcaatacggcaagcctaagaagcagggctcaactacagcgactcgtcctccaagggcccttctgtgtctgacactgaaaaatccaatacgccgcgcttgcatttcaatcgttgagtggaaaccatttgaaattatcatactgctgacaatcttcgcgaactgcgtcgctctcgctatctatataccatttcctgaggatgattccaatgccacgaattctaatctcgagcgcgtagaatatctcttcctcatcatttttactgtagaggccttcctgaaggtgattgcctacgggctgttgttccacccaaatgcttatttgcggaacggctggaatctcttagattttattatcgtcgtggtggggctcttcagcgctattctggagcaggcaacaaaggccgatggcgcaaacgctctgggtggcaaaggagctggcttcgatgtcaaagcacttagagccttcagggtgctacggccgctgcgcctcgtctctggggtgccttccctacaggtggtgctgaacagcatcattaaggccatggtccctctacttcacatcgcactgctggtcttattcgtgattataatatacgctatcatcggtctggaactgtttatgggcaagatgcacaagacgtgttacaatcaagaaggcattgcagacgtgcctgcagaagacgatccaagcccctgcgctctggaaaccggccacggaagacagtgtcagaacggaacagtgtgcaagcctggatgggatgggcctaagcatggcattacgaattttgataatttcgctttcgccatgctgaccgtattccaatgtatcaccatggaaggctggactgatgtcttgtattgggtgaacgatgcagtaggacgtgactggccttggatttacttcgtgaccttaatcataattgggtcattctttgtgctgaacctcgtcctgggcgtgctcagcggcgagtttagcaaggaacgggagaaggccaaggctcggggagactttcagaagttgagggagaagcaacagctggaagaggatcttaaaggatacctggattggatcactcaggctgaagacatcgaccctgagaacgaggatgaggggatggatgaggagaagccccgcaatatgagcatgcctacgtccgagaccgagtctgtgaacactgagaatgtggccggcggggacatagagggggagaattgcggcgctagacttgcacaccgaatctccaaaagcaagtttagccgatactggagaaggtggaatcgattctgcagaaggaagtgccgggccgctgtaaagtcaaacgtattttactggttggtcatttttctggtcttcctaaataccttgacaatagcctcagaacactacaatcagcccaattggctaactgaagtgcaggataccgccaataaagcactacttgccttgttcaccgcagaaatgctcttgaaaatgtactctcttgggctacaggcttacttcgtgtccctttttaatcgcttcgactgttttgtcgtctgtggagggatcttagagacaatattagtggagacgaagataatgtctcccctgggcatcagtgtgctccgatgcgtgcggctactgaggatcttcaaaattaccaggtactggaactccctcagcaacttggtggcgagcctgctgaacagtgtgcgcagcatagcgagcctcctgctgttgctgttcctgtttattatcattttttctctcttggggatgcagctcttcggcggcaagtttaacttcgacgagatgcagactcggaggtctactttcgataatttcccacagagcctgctgaccgtcttccaaattctgaccggcgaggactggaacagtgttatgtacgatggaattatggcctacggaggcccatccttccctggcatgctggtttgcatctacttcattattctttttatctgtgggaactacatactgcttaacgtgttcttggccatcgcagtggataatctggctgatgctgaaagcctgacctctgcgcagaaggaggaagaggaagaaaaggagcggaagaagctggctcggacagccagtcccgagaagaaacaggagctcgtagaaaaacctgcggttggagagtctaaggaagaaaagatcgagctgaaatcaattactgccgacggcgaatctccgcctgctactaaaatcaacatggacgacttgcagcctaatgagaatgaagacaagtccccgtacccaaaccctgagacgacaggagaggaggacgaggaggagcccgagatgcctgtgggaccgagaccgagaccgctgtcagagctccacctgaaggagaaggccgttcccatgcctgaggcctcggccttctttatcttctcatccaataacagatttaggctccagtgccataggatcgtcaacgatactatcttcactaacctcatcctgttcttcatcctgttgagtagcatttcactcgccgctgaggatccagtccagcacacctctttcagaaaccatatccttgggaacgccgactatgtgttcacgagcatctttacccttgagatcattctaaagatgactgcgtacggcgcctttctacataaagggagcttttgccgcaactatttcaacattttggatctgctggtcgtgtctgtaagcttgatcagcttcgggatccagagttccgctattaatgtggtgaagattttacgcgtcttgcgcgttctcagaccactgcgcgccattaatagggctaaggggctcaagcatgttgtgcagtgtgtctttgtggcgattcgaacaattggaaacattgtgatagtgaccactctcctgcagtttatgttcgcatgcatcggggttcagctgtttaaaggcaagctctatacctgttcggattcaagtaagcagactgaggcagaatgcaaaggcaattacatcacctataaagacggagaggtagatcacccaattatacagccaaggtcgtgggaaaactcaaagtttgatttcgataacgtgttggctgcaatgatggccttgtttaccgttagcacattcgagggctggccggagctactgtaccgtagcatcgattcccatactgaggacaagggacccatctacaattacagagttgaaatctccattttctttattatttatattatcatcatcgcgttttttatgatgaacatttttgtgggcttcgtcatcgtcacttttcaggaacagggagagcaggagtataaaaactgcgaacttgataaaaaccaacgccagtgcgtggaatatgccctgaaggcacgacccctgcggaggtacattccgaagaaccagcaccaatacaaggtttggtatgttgtgaactctacatattttgaatatctaatgtttgtcctgatactcttaaataccatttgtctcgctatgcaacactacggccaatcgtgcctgttcaagatagctatgaacatcttgaacatgctgttcactggcctctttaccgttgagatgatcctgaaactgatagcattcaaacctaagcactatttttgcgacgcctggaataccttcgacgcattaattgtggtgggatctatagtggacatcgcaatcacagaggtaaacaatgcagaggagaattccagaatctccattacatttttccgacttttcagggtcatgagacttgttaagctcctgagccgaggtgaggggatcaggactctgctgtggacattcattaagagctttcaagctctcccttatgtggcactgcttatagttatgctgttctttatttatgccgtgatcggcatgcaggtcttcgggaagatagctttgaatgatactacggagataaatagaaacaacaacttccagacgttccctcaggcggtcctcctactgttcaggtgcgccactggcgaggcctggcaggacattatgttagcttgtatgccaggcaaaaagtgcgcccccgagagcgaaccaagcaacagcaccgaaggcgagactccttgtggcagcagcttcgctgtgttttacttcatctcattctacatgctgtgcgcttttcttattatcaacctctttgtggcagtaattatggacaactttgactacctcacacgggactggagcatactggggcctcaccacttggatgagttcaaacgaatttgggctgagtacgatcctgaggctaagggacggatcaaacatctggatgttgtcaccctcctgcgccggatccaacctcctctgggcttcggaaagctgtgtccccaccgggtagcctgcaagcggttggtttccatgaatatgccactaaactctgacgggaccgtcatgttcaatgcaactctatttgcactggtgagaaccgctctccggatcaaaaccgaggagggccccagtccttccgaggcacaccagggagctgaggaccccttccgccccgctggcaacctggagcaggccaacgaagaactcagggctattattaagaaaatatggaagcgaaccagtatgaaacttctggaccaggtcgtccctccagccggcgatgacgaggtcacggtgggaaagttttatgccacctttcttatccaggagtactttcgcaagttcaagaagaggaaagagcagggactggtgggcaaacccagccagagaaatgccctgtcattacaggctggcctccggacactccatgacataggacctgaaatccgtcgtgctatttctggcgatctgacggcagaggaagagcttgacaaagctatgaaggaggcggtgtctgccgcatctgaggatgacatcttccgccgggccggtggtctgtttggaaaccatgtgagctactaccagtccgacggtaggtccgcgttcccccagacatttactacacaacggccccttcacattaataaggcaggttcgagccagggggataccgaatcaccttcccacgagaaactcgtcgattccacatttacgcccagcagttactcttcaaccgggtcgaacgcaaatataaataacgctaacaacacggcattggggcgtctgccccggccggctggatacccatctaccgtgtccaccgtcgaaggccacggaccccctctctccccagcgatccgtgtgcaggaggtcgcttggaagctgagctccaaccgctgccatagtcgtgagagtcaggcggcaatggctggacaggaagagaccagtcaggatgagacctatgaggtcaaaatgaaccatgatacagaggcctgtagcgaaccctctctgctctccaccgagatgctgagctaccaggatgatgagaacaggcaactgacgttgccagaggaggataagagagatatccggcagagccccaagagagggttcctgagaagtgcttccttgggccgtagagcatcctttcacttggagtgtttgaagaggcagaaggataggggcggagacatctcccagaaaactgtgttacctctacacttagtgcaccatcaggcactcgcagttgcaggactgtcacctctcctccagcgctcccatagcccagcatccttccctagacctttcgccacaccgcctgcaaccccgggcagccgcggctggcccccccaacctgtgcccacactacgccttgaaggcgtggaatcctcagaaaagctcaattcctcatttccaagtatccactgtggatcttgggccgaaacgactcctggtgggggcgggagctcagctgccaggcgggttcggcctgtgagcctcatggtaccatcacaggccggcgctcctggccgacagtttcacggctcagcaagttcattagttgaggcggtcctgatcagtgaggggctgggacagttcgcccaagacccaaagtttattgaagtcactactcaagagttggctgacgcttgtgacatgaccatagaggagatggagtctgctgccgacaacatacttagcggcggcgctccacagagcccaaacggagctctgcttccattcgtgaactgcagggatgcgggtcaggatcgcgccggaggggaagaggatgccggctgtgttcgcgcgcgaggtcgaccttccgaggaggaactgcaggactccagggtttacgtatcgagcctgtag

SEQ ID NO: 110418 - DNA, 6441 bp, Artificial Sequence
  Description of Artificial Sequence: Synthetic coding sequence
atggttaatgagaatacacgcatgtacattcccgaagagaatcatcagggaagcaattacgggagcccgcgcccggctcacgctaatatgaatgcaaatgccgccgcaggcctggcgcccgaacatattccaactccaggcgctgctctctcttggcaggccgccattgatgctgctcgccaggccaaactgatgggcagtgcagggaacgcaactatctctactgtgagttcaacccagaggaagcgacagcagtatggcaagccaaaaaagcaaggctcaaccaccgctactcggccaccacgcgcgctgttgtgcctcacactaaagaatcccatacgccgagcttgcatatccatagtcgagtggaaaccgttcgaaatcatcatcctcctcacaatatttgccaactgtgtggcgttggctatctacataccctttccagaggacgacagcaatgccaccaattcgaatctcgagcgcgtggagtatctgttcctgatcatctttaccgttgaagcgttccttaaagtcatcgcatatggccttctcttccaccccaacgcctacttgcggaacggatggaatctgctggactttattatagtagtggtgggcctctttagcgccatcttggagcaggcaacaaaagccgatggggctaacgcacttggcggcaaaggggctgggtttgacgtgaaggccctgcgagcctttagagtgcttaggccacttagactggtcagcggggtgccctcattacaggtggtactgaattccatcattaaggcgatggttcctctgcttcacattgctctgctggtcctttttgtgatcatcatctatgccattattggccttgagctctttatgggaaagatgcataagacctgttataatcaggagggaatcgcagacgtgcccgctgaggatgatccgtccccatgtgctctagaaaccgggcacggtagacagtgccagaacgggacggtgtgcaagccgggttgggacggcccgaaacacgggattacgaatttcgataatttcgctttcgcaatgctaaccgtattccagtgcatcactatggagggctggactgacgtgctatactgggtgaacgatgctgtgggccgcgactggccctggatctactttgtaaccctcattatcatcggatccttcttcgtgctgaacctcgtactcggcgtgttgtccggggagttttctaaggagcgtgagaaagcgaaagccaggggcgacttccaaaaactccgagagaagcaacagctcgaggaagatttgaaaggatatctcgactggatcactcaggccgaggacatagaccccgagaacgaggacgaggggatggacgaagagaaaccgcgcaacatgagcatgcccacgtcggagactgaatcagtgaacaccgagaatgttgccggtggggatatagagggagaaaactgcggcgcacgtctcgcacacagaattagcaagagcaaattctcaaggtactggcgcaggtggaacaggttctgtcgcaggaagtgccgggcagccgtaaagtccaatgtgttttactggctagtcatcttcctggtgtttcttaacaccctcacaatcgctagcgagcattataaccagccaaactggctgactgaagttcaggatactgccaataaagctctgctcgctctattcactgcggaaatgctgctgaagatgtattcccttggccttcaggcctactttgtatcactgtttaaccggtttgactgcttcgtcgtttgcggaggtatcctggaaactatactggtggagactaaaatcatgtctcccttgggaatttctgtcctgagatgcgtcaggctgctgcgtatctttaagataacaagatattggaactcactctctaacctggtggccagcctgcttaattcggtacggagcatcgcctcattgctcttgctgctcttcttatttataatcatcttctcactccttggtatgcagctctttgggggcaagtttaacttcgacgaaatgcagacccggcgctctaccttcgataatttcccacagtcactgcttaccgttttccagatcctgaccggtgaggactggaatagcgtcatgtatgacggtattatggcctatggcggcccttcctttcccgggatgctggtatgcatctacttcataatcctattcatttgcggaaattacattcttctgaacgtttttctagcaatcgctgttgacaacttggcagacgccgagtcactgaccagcgcccaaaaggaggaggaggaggagaaagaacgaaagaaactagcgagaaccgccagccctgaaaagaagcaggagttggtcgagaaacctgcagtcggcgaatccaaagaagaaaaaattgagctgaagagcattacagccgatggggagtcaccccctgccaccaaaataaatatggacgacctgcaacctaacgagaacgaggataagtccccttaccccaatcccgagaccaccggcgaggaagatgaagaagagcccgaaatgcccgtgggtccccgccccagacccctctccgagctgcacctcaaggaaaaagctgtgcctatgcccgaagcctccgccttctttatcttcagctcaaataacagattccggttgcaatgtcatcgcattgtgaatgacactatttttaccaatctgattctgttttttattctcctttcttccatttctctcgctgccgaagaccccgtccagcatacctcctttagaaaccatatactgttctacttcgatatcgtttttaccaccatatttactattgaaatcgctctgaagatgaccgcttacggcgcctttctccacaagggttccttctgtcgaaattatttcaacattttggacctgctggtcgtttccgtcagtctgatttcgttcggtattcagtcttcggccatcaatgtggtaaaaatcctgcgagttttacgggtgctacggccccttcgcgctattaacagggcaaaggggctgaagcatgtagtgcaatgtgttttcgtcgctattcgcacaatcggcaacatcgtgatcgttacaaccctgctccaattcatgtttgcctgcattggcgtgcagctgtttaaagggaaactttacacgtgtagtgatagttccaagcagacagaagctgaatgcaagggtaactacattacttacaaggacggagaagtggatcacccaataattcaacctcgcagctgggagaatagtaagttcgacttcgataatgtgctggctgctatgatggcgttgtttactgtgagcacctttgaaggctggccggaactcctttaccgatcgatagattcccacaccgaagataaaggccccatctacaattatagggtcgaaatttcaatcttctttatcatttatattatcatcattgccttctttatgatgaatatctttgtgggcttcgtgattgtgaccttccaggagcagggcgagcaggagtacaaaaactgcgagctggacaagaaccagagacagtgcgtggaatatgcattaaaggctcgaccactgcgaagatacatacctaagaatcagcaccagtacaaggtttggtacgtcgttaacagcacctattttgagtatcttatgtttgttctcatactgctcaacacaatctgtttggctatgcagcattacggccaatcatgtctcttcaaaattgcaatgaacatcctgaatatgctgttcaccggcctgtttactgtcgagatgatattgaaactgatcgcatttaagcctaaacactacttctgcgatgcctggaataccttcgatgccctaattgtggtgggcagtatcgtcgacattgctatcaccgaagttaataacgccgaggaaaactcgaggatttccatcacgttcttcagactctttagggtgatgcggctggtaaagctcttgtcgaggggagaggggataagaaccctgttgtggacatttattaaaagcttccaggcccttccctacgtggcactgctaatcgtgatgttgttcttcatctatgctgtgattggaatgcaggtatttggaaagatcgcactaaatgacactactgagatcaacaggaataacaattttcagacattcccgcaagccgtgctactgctatttcgttgcgctaccggtgaggcctggcaggacatcatgctggcctgcatgcctggcaagaaatgcgctcccgagtcagagcctagcaatagcaccgagggcgaaacaccatgcggaagttcctttgccgtgttttattttatttccttctacatgctgtgcgcttttctgatcataaacctgttcgtcgccgtgattatggataactttgattatctgactcgggactggagcatcttaggacctcatcatttggatgaattcaagcgcatttgggcagagtacgacccagaagccaaaggacggatcaaacacttggacgtggtcaccttgctgcgaaggattcagccacccctggggtttgggaaattatgtccgcaccgagtggcttgtaaacggctcgtcagtatgaacatgccgttaaacagcgacggaactgttatgttcaatgctaccctctttgccctagttaggaccgccctcagaattaaaacagaggaaggcccgagccccagtgaagcgcaccagggtgcagaggatcctttccgaccagcagggaacctggagcaggctaatgaagagctgcgcgccataattaaaaagatatggaaacggacatctatgaagctcctggaccaggtcgtgccacctgcaggggatgatgaggtgactgtcgggaaattctacgctaccttcttaatccaggagtatttcaggaaattcaagaagcggaaagaacagggactcgtaggtaagccttcccagagaaatgcactgagtctgcaggccggcctgaggaccttacatgatattggcccagaaattaggcgggctatttcgggagatctgactgcggaggaagaacttgataaagccatgaaagaagctgtctcagcagcgagcgaggatgatatttttaggagagccggggggcttttcggaaatcacgttagttattatcaatctgatggccgctctgcctttccacagactttcacaacacagcgtcctctgcacatcaataaggcaggcagttcccagggtgatactgagtccccgtcacacgaaaagcttgttgactctacctttacacctagcagttattcaagcactggttcaaatgctaatattaataatgctaacaacactgcgttgggtcggctgccaaggcccgcaggttatccatccacagtctcgaccgtagaaggtcatggtcctcccctgtcacctgctataagggttcaggaggtcgcatggaaactctcatctaaccggtgccactctcgggagagtcaagccgcaatggccgggcaggaggaaacctctcaggacgagacctatgaagtaaagatgaatcacgacacggaagcttgcagcgagcctagcctcctgagcaccgagatgctgagctaccaagacgacgagaacagacagctgacattgcccgaggaagacaaaagagacatccgtcaatcacccaagagaggttttctcagaagcgcgtcactgggcaggcgcgccagctttcatctggagtgcttgaaacgccagaaagatagagggggcgatataagccagaaaaccgtcctaccgttgcacctggtacatcaccaagccctggccgtggctgggctgtcacccttacttcagcgaagccatagcccagcctcttttcccagacctttcgcgacaccaccagcgacacctgggagcagaggatggcctcctcagcctgtgcctacactccgactagagggagtggagtcaagcgaaaaactgaatagctcctttccttccattcattgtggctcgtgggctgaaacgaccccaggcgggggagggtccagtgccgcaagaagggtcagaccagtgtcactgatggtcccaagtcaggccggagctccgggaagacaattccacggcagtgcttcttcgttagttgaggccgttctgatctccgaggggctcggccaattcgctcaggacccaaagttcattgaggttacaactcaggagcttgctgacgcctgcgatatgactattgaagaaatggagagcgccgccgacaacatcctctcgggcggggcgcctcagtctccaaatggcgcattgctcccattcgttaactgtcgcgacgccggccaagaccgcgccggaggcgaggaggatgccggatgcgttcgtgcccgcggccggccatccgaggaagaactgcaggattcacgggtgtatgtcagcagtctgtag

SEQ ID NO: 110419 - DNA, 6417 bp, Artificial Sequence
  Description of Artificial Sequence: Synthetic coding sequence
atggttaacgagaacaccaggatgtatatacctgaggaaaatcatcagggttcaaattatggctcacccaggcccgcacacgcgaacatgaatgcaaacgctgcagcaggtttagcaccggagcatatacccacacctggggccgctctgtcctggcaagcagccatagatgccgcacgccaggctaaactaatgggtagcgccggaaacgcaacaatttcaacagtgtctagcactcagcgcaagagacagcagtatggaaaacctaaaaagcaggggagcacgaccgctaccaggccaccccgggctcttctctgcctaacactgaaaaatcccatccggcgcgcatgcattagcattgtggagtggaaaccatttgagattatcatcctgctgacaatcttcgctaattgcgtcgccctcgcaatctacatcccgtttccagaagatgattccaacgctactaactccaacttggaacgcgttgaatacctttttctcataatattcaccgtcgaagctttcttaaaggtcatagcatacggtctgctgttccacccaaacgcctatctgcggaacggctggaacctgttggacttcataatcgttgtggtgggtctctttagcgccattcttgagcaggcaaccaaagccgacggcgcgaatgcactgggcggcaaaggggcagggtttgatgttaaggcactccgggcctttcgagttctgaggcctctgcgtttagtgtccggcgtgccatcactgcaggtggtgctgaattcaatcattaaggccatggtgccactccttcacatcgccctgcttgtgctgttcgttattatcatttacgccatcatcgggctagaactgttcatgggaaaaatgcacaaaacatgttacaatcaagaagggatagcagatgtgcctgccgaggacgatccatcaccctgtgccctggaaacagggcatggtagacagtgtcagaatggcactgtttgcaagcctggctgggacgggccgaaacatggcattacgaactttgataacttcgcgttcgccatgctgacagtcttccagtgcatcaccatggagggttggactgatgtgttgtactgggtcaacgatgcagtgggtagagactggccttggatatatttcgtgactctgatcataattgggtctttcttcgtgctgaacttggtgctgggggtcctgagcggagaattcagcaaagagagagaaaaggccaaggcgcgaggtgacttccagaagctgagagaaaagcagcagctggaggaggatctgaagggctaccttgactggataactcaggctgaggacattgatcctgagaacgaagatgagggcatggacgaagaaaaaccccgcaatatgagtatgcccacctcagagactgaatctgtgaatactgagaatgtcgcgggaggggatatcgagggcgagaactgtggggctcgcctggcccacagaatctccaaatcaaaattttcacggtattggcgccggtggaacaggttttgcaggagaaagtgcagagccgccgtcaagtcaaacgtgttttactggttagtgattttccttgtgtttcttaacaccttgacaatcgcaagcgagcactataatcagccgaactggttgaccgaggtgcaggataccgccaataaggcactattggcactgttcaccgccgaaatgctgctcaaaatgtactccttgggacttcaggcgtattttgtatccctgtttaatagatttgactgctttgtcgtatgcggcggaatacttgaaactatcctggtggaaaccaagatcatgtcgccactgggcatcagcgtactgcggtgcgtgaggctgttgcgcattttcaaaattacacgctactggaacagcctgtctaacctagtggcttccctcctgaattcagtgaggagtattgcttccttgctactcctcctgttcttgttcattattattttcagcctgctaggcatgcagctcttcgggggaaaatttaacttcgacgaaatgcagaccaggcgcagtacttttgataactttccccagtccctcttaaccgtgttccagatccttaccggcgaagattggaactccgtgatgtatgacggtatcatggcatatgggggcccatctttccctggcatgctggtgtgtatctacttcatcatactttttatttgtgggaactacatcttgctaaacgtgtttttggccatcgctgtcgataacctggccgatgccgaatcattgacgtcagcacagaaagaagaggaagaggagaaggagcgaaagaaactggcccgaacggccagtcccgagaagaagcaggagctggtggagaaacctgccgtgggggagtcaaaggaggagaaaattgagctgaagtccataacggcagatggcgagtccccaccagccacgaagatcaacatggatgacttacagccaaacgagaacgaagacaaatccccctatcctaatcccgaaaccaccggggaggaagacgaagaagaacccgaaatgcctgtcggacctaggccccggccattgagcgagttacacctaaaggagaaagcagtcccaatgccagaggcaagtgcgttttttatcttcagtagtaacaaccgattccggctgcaatgtcatcgaatcgtcaatgacactattttcactaacctgatcctgttcttcatattactaagcagtatttcacttgcagccgaagatcctgtccagcacactagctttcgcaaccacatcctgttctattttgatatcgttttcacaacaatcttcacaatcgaaatcgcactgaaaatgacggcttacggggcctttctgcataaagggtccttctgtagaaattatttcaacatcctggatctgctggtcgtgtccgtgtccttgatttccttcgggattcaatcctcagccattaacgtagtaaaaatcctgcgggtgctacgcgtgcttcgcccgttacgagcaattaaccgggctaaggggctgaagcacgtggtgcaatgcgtgttcgtagcaatcagaacaattggaaatattgtgattgtgaccactcttcttcagtttatgtttgcctgtattggcgtccagttgtttaagggcaagttgtacacatgcagtgactccagcaagcagacagaggctgagtgcaagggaaattatatcacatataaggatggtgaagtggaccaccccatcatccagcccaggtcttgggagaatagtaaatttgatttcgataatgttttagctgcaatgatggccctcttcacggtgagcaccttcgagggctggcctgaattactgtaccgaagcattgacagtcacaccgaggacaaaggacccatctataactatagggtagaaattagcatattttttatcatctatatcattatcattgcgtttttcatgatgaacattttcgtaggatttgttatcgtgactttccaggagcagggtgagcaggagtataaaaactgcgagcttgataaaaaccagaggcaatgcgtggaatacgccctcaaggctcgtccgctccgcaggtacattcccaaaaatcagcatcagtacaaagtatggtatgtagtgaacagcacctactttgaatatctaatgttcgtgctgatcttgctcaacaccatttgtttggccatgcagcactacggacagtcttgtctcttcaagattgcaatgaatatcctaaacatgcttttcactggcctcttcactgtagagatgatcctcaaactgatcgcattcaaaccgaaaggatacttcagcgatccatggaatgtgttcgatttcctgatagttatcggatccattattgacgtgatcctgtctgaaaccaaccctgcagagcacacccaatgcagcccgagcatgaacgcggaggagaatagcaggatctccattacttttttcaggctgtttagagtgatgagattggtgaagttgttatcaagaggtgagggcattagaaccctactctggacttttataaaatcctttcaagccttgccatacgtggctctgttgatcgtaatgctgttttttatctatgctgtcatcgggatgcaggtctttggcaaaatcgctctgaacgacacaactgagatcaatagaaataataacttccagacttttcctcaagccgtgctgcttctattccgatgtgctaccggggaagcatggcaggacataatgctagcctgtatgcctggtaagaagtgcgctcctgaatcagagccgtccaattccacggaaggcgagaccccatgcgggagtagtttcgcagtgttctactttatctcattctacatgttgtgtgcatttctgatcatcaatctgttcgtcgctgtcatcatggacaacttcgactatcttacccgcgattggagtatcctaggaccacatcaccttgacgaattcaagaggatctgggccgaatacgatcccgaagctaaaggcaggatcaaacaccttgacgttgtcacgcttttaaggcgaattcagccaccactgggatttggaaaactttgcccgcacagggtagcatgcaagcggttagttagcatgaacatgcctcttaactctgatggcactgtgatgtttaatgccaccttgttcgcacttgtcagaaccgccctgagaatcaaaacagaggggaatcttgaacaagcaaacgaggaactgcgagccattattaagaaaatttggaaacggactagtatgaagctgctggaccaggtggttccgcctgctggcgacgacgaagttacggtggggaaattctatgctacatttctgattcaagagtactttaggaaattcaagaaacgtaaagagcaagggctggtggggaagccaagtcagcgtaacgcgttgagcctgcaggccggcctgcggacactgcatgatattggacccgagatccggcgtgctattagtggggacttgaccgcagaggaggaactggacaaagcaatgaaggaagccgtttctgcagcgtccgaggatgacattttcaggcgggcaggtggactgtttgggaaccacgtgtcatactatcagagtgacgggaggtccgcttttccacagacgtttaccacacaaaggcctctgcatattaataaagccggttcctcacaaggcgatacggaaagcccaagccacgagaaattggtggacagcacatttactccatcgtcgtatagcagtactggctctaacgccaatatcaacaacgccaataatacagctctcggccggctcccacgcccggctggctatccctcaaccgtgagtacagtggaggggcacgggccacccttgtctcctgcaatcagggtgcaggaggtggcctggaaacttagcagcaatcgttgtcatagtcgggagagtcaggccgccatggcaggtcaggaggagacatctcaggatgagacctatgaagttaagatgaatcacgatactgaggcgtgcagtgagccaagtctgctcagtacagagatgctatcctatcaggacgatgagaatcggcagctcaccctgccagaagaagataagagagatattcgccagtccccaaagagggggttccttcggagtgcttctctcggccgtagagcctcatttcatttggaatgtctcaaacgtcagaaagaccggggaggtgatatatctcaaaaaactgtgctgcctctccatctggtgcaccatcaggccctggcagtcgccggcttgtcaccgctgctgcagcgctctcattcacctgctagctttcctcggccattcgcaacccccccggccacccccggctcacggggttggcccccccaacctgttccaacactgcggttagaaggcgtggagtcttctgagaagctgaatagcagctttccttcaatccattgtggatcatgggccgagaccaccccgggcgggggtggctctagcgcagccagacgggtgcgtccggtatctctgatggtcccgtctcaggcaggggctccaggacgccaatttcacggatccgcatcaagccttgtggaggccgtactgatttcagaagggctaggacagtttgcccaggatcccaagttcatcgaggtgaccacccaagaactagccgacgcctgcgatatgacaattgaagagatggagtccgctgctgataacatcttgtctggcggagcaccccagagtcctaatggtgctctgctgccattcgtgaattgtagggatgctggccaagatagagcaggcggtgaggaggacgcagggtgtgtgcgggctaggggacgcccctctgaggaagagttgcaggacagtcgcgtctatgtatcctccttgtag

SEQ ID NO: 110420 - DNA, 6417 bp, Artificial Sequence
  Description of Artificial Sequence: Synthetic coding sequence
atggtcaacgagaataccaggatgtatatacccgaggagaatcaccaaggctccaactacggttcacctaggcctgctcacgcgaatatgaacgcaaacgccgccgccggactggctcccgagcacatcccaacacccggcgccgctctatcgtggcaggccgctatagacgctgcccggcaagccaaactaatgggctccgcaggaaacgcaactatctcaacagtgagtagtactcaaagaaaaagacagcaatatggcaagcctaagaaacagggatccaccactgccactcgaccgccccgagccttactatgcctgaccttgaagaaccccataaggagggcttgtatctcaattgtggaatggaagccattcgagatcattatcttgttgaccatcttcgcaaactgtgtggctttggctatctacataccatttcctgaggacgacagcaacgcgacgaactcgaatctggagcgagtcgaatatctgtttctgatcatcttcactgtggaggcctttctgaaagttattgcttacgggttgctgttccatccaaacgcatatttacgcaacgggtggaatcttctggactttattatagtggtggtgggcctgttctccgccatactcgagcaggctacaaaagcagatggcgcaaatgctcttggtggtaaaggcgcggggttcgatgttaaggcgttaagggcatttagagtcctgcgtccattgcgcctggtgtccggagtgccaagtctgcaagtggtccttaacagtatcatcaaagccatggtcccattgctgcatattgctctgctggtgctcttcgttatcattatttatgcgattattggcctggaactgttcatgggcaagatgcacaaaacatgctacaaccaggagggcatcgctgatgtcccagcagaagacgatccatccccttgcgctctggagaccggtcacgggagacagtgccagaatgggacagtgtgtaagccaggctgggatggaccgaaacatggaattactaacttcgataatttcgccttcgctatgctgaccgtcttccagtgtattaccatggagggatggacagacgtgctttactgggtgaatgatgccgtgggaagagactggccttggatctatttcgtgacactgattatcataggcagctttttcgtgttgaaccttgttttgggtgtgctctctggcgaattctccaaggagcgggagaaagcaaaggctagaggagacttccagaagcttcgggagaaacagcagctagaggaagacttgaaagggtaccttgactggatcacacaggccgaagatattgacccggagaacgaagatgagggcatggacgaagagaagcctcggaatatgagtatgcctactagtgaaaccgagtccgtaaacacagagaacgtggcgggaggcgatattgaaggtgaaaactgtggggctaggctggcccaccgcatttcaaagagtaagttttctaggtattggagacgctggaatagattttgccgtagaaaatgtcgcgccgccgtgaaatctaacgtgttttactggctagtcatttttttggtcttcctcaatacccttactatcgcatcagaacactacaaccaacctaattggttgacagaagtgcaggatactgccaataaggcacttcttgccctattcacagccgagatgctacttaaaatgtactctctgggcctgcaagcctacttcgtctcactgttcaacaggtttgattgctttgtggtctgtgggggtattcttgagacgattttggtggagactaagataatgagcccattgggcattagcgtgcttcgctgcgtacgattactcaggatattcaagattacacgatactggaacagtctgtccaacctggtggcctcactgctaaattctgtgaggagtatcgcaagtctgctgctgctgttatttctgttcattatcatcttctcgctattaggtatgcagctgttcggtggcaagtttaactttgacgagatgcagactcggagatcaactttcgataacttccctcagtccctgctgacggtctttcagattttgacaggtgaagactggaatagtgtgatgtacgatggtattatggcctacgggggaccttctttccccggaatgcttgtgtgcatttactttattatcttattcatttgcggaaattacatcttgcttaacgtcttcttggctatagccgtggacaatctagcggacgctgagtctctaacttctgctcagaaagaagaggaggaggagaaggaaagaaagaaattagctaggacagcaagccccgagaaaaaacaagagctagtggaaaagccagcagtgggcgaatccaaagaagagaagatcgagctgaagagtattactgctgatggcgagagtcctccagctaccaagatcaacatggatgatctgcagcccaatgaaaatgaggacaagagtccataccctaaccctgaaaccaccggcgaggaggacgaggaggaacccgagatgccagtgggacctaggcctaggccgttgtctgaactgcacctcaaggaaaaggcagtgccgatgccagaagcctccgctttcttcatcttttcctctaacaatcggttccgtctgcaatgccatcgaatcgttaacgatacgatttttacgaacctcatcctgtttttcatcttgttatcatcaatttctcttgccgcggaggacccggtccagcatacttctttcaggaaccatattctgggcaatgccgattacgtgtttacatcaatcttcaccttagagataattctcaagatgacagcctacggagcgttcctgcacaagggatcattctgccggaactactttaacatcttagacctgctagtggtgagtgtttcactcattagttttggcattcagtcttcagcgataaacgtggtcaagatcctgcgtgtccttcgggtgctgcggcctctccgggctattaaccgggctaaagggcttaaacatgttgttcaatgtgtttttgtggccatccgaactattgggaacattgtcatcgtgaccaccctcctccagttcatgttcgcttgtatcggtgtgcaactattcaaagggaaactgtacacttgtagcgactcttcaaagcagaccgaagccgagtgcaaaggtaattatatcacctacaaagacggcgaggtggatcaccctattatacagcccaggtcatgggagaactcgaagttcgactttgacaacgtgctggctgcgatgatggcactatttactgtgtccacctttgaaggttggccagaactcttgtatcggtctatcgatagtcataccgaagacaaagggcccatttataattacagagttgaaatctctatcttttttattatctatattataataattgccttctttatgatgaacatttttgtcgggttcgtgattgttacatttcaggagcagggcgagcaagaatacaagaactgtgagctcgataaaaatcagagacagtgtgtcgagtacgcactgaaagcgcgacctcttagaagatacattcctaagaatcaacaccagtataaggtgtggtacgtcgtgaacagcacctacttcgagtatttgatgtttgtactcatactgctcaacactatttgtcttgcaatgcagcactatggccagtcttgcctgtttaaaatcgcgatgaacattctcaacatgctgtttacaggtctttttaccgtagaaatgatcctgaaattgatcgcatttaagcctaagcattacttctgtgacgcgtggaatacattcgacgccctgattgtagtggggagcatcgtggatattgccatcaccgaggttaacccagcggagcacacccagtgctccccctcgatgaatgccgaggaaaacagtagaatctctataacgtttttccggttgttccgcgtaatgagactagttaaactcctcagtaggggcgagggaatcagaactctgttatggaccttcataaagagctttcaggctctgccttacgttgctctgcttattgtgatgctgtttttcatttatgcggtaatcggtatgcaggtatttgggaaaattgcactgaatgatacaactgagattaaccgcaacaacaatttccaaactttcccccaggccgtgctcttgctgttcagatgcgctactggagaggcgtggcaggatataatgctggcctgcatgcctggcaagaagtgcgcacctgaatcagaacctagcaattctactgagggtgagaccccttgcggtagtagtttcgcagtgttttattttatttctttctatatgttgtgcgcctttttaattattaaccttttcgtagccgtcattatggataattttgactatctgacccgtgattggtccatcctgggcccccaccacctggacgaattcaaaaggatttgggccgagtatgaccctgaagccaaaggtcggataaaacatctggatgtggtaacattgctaagacgtatccaaccacccctcggctttggaaaactgtgtccccaccgtgtcgcgtgtaaacgtcttgttagcatgaacatgcccttgaattccgacgggaccgtgatgtttaacgctaccctctttgcactcgttcgtacagcactgagaatcaaaaccgaggggaatctcgagcaggccaacgaagaactgcgcgccattataaaaaagatctggaaaaggacctccatgaagcttctggaccaggtagtcccaccggctggcgacgatgaggtaacagtgggaaaattttacgcaacctttctgatccaggaatactttaggaagtttaaaaaacgaaaggaacagggactcgtgggcaagccttcccagcgtaatgctctcagcctgcaggcggggctgcgtaccttacacgacattggccctgaaatcaggcgtgcgatcagcggagatttaaccgccgaagaggagctcgacaaggcaatgaaggaggcggtctccgccgcatctgaagacgacatctttagaagggctggggggctttttggcaaccacgtgagctattaccaatcagacgggcgatctgctttcccccagactttcaccacccagagacctctccatataaataaagctgggtcatcacagggagataccgaatctccttctcacgagaagctggtggattccacatttactccttccagctacagttccacaggatcaaacgcaaatatcaacaatgcaaataacaccgccctcggacgactcccacgcccggccggttatccctccactgtgagtaccgtggaaggacatggcccacctctgtctcctgctattcgagtccaggaggtcgcatggaagttatcttctaataggtgtcactcaagggagtcacaggcagcgatggcaggtcaggaggagaccagtcaggacgagacttatgaggtcaaaatgaaccatgataccgaggcgtgcagcgagccctctctactgtccacagaaatgttgtcttaccaagacgacgagaatcggcaactcacactacccgaggaagataagagagatatacgacaaagccctaagcggggattcttgcggagcgcctctttgggacgccgggccagttttcacctggagtgcctaaagcgtcagaaggatcgagggggtgatatttcacaaaagacagtcttacctctgcatctagtccaccaccaagctcttgccgttgctggcttgtcaccgctcctgcaaagaagtcacagccctgccagtttcccccggccctttgctacacccccagcaactccgggctcccgcgggtggcctccacagcctgtgcccaccctcagactggagggtgttgagtcttctgaaaagctgaatagtagtttcccttctatacattgcggaagctgggccgagactacacccggaggcgggggctcttccgcagcccggcgtgtccgacccgtgagtctgatggtgcctagccaagccggagcccctggacgccagtttcatggatctgcatcctcactggtggaggccgtgttaattagcgagggacttgggcagttcgcccaggatcctaaatttatagaggtgacaacacaggaactcgccgacgcctgcgatatgaccattgaagaaatggagagtgctgctgataatatcttgagcgggggcgcaccacagtcccctaatggggccctgctcccctttgtcaattgtcgtgacgctggccaggatagggccgggggcgaggaagatgccggctgcgtgcgcgccagagggcgtccctccgaggaggaattgcaggactctagagtctatgttagttctctgtag

SEQ ID NO: 110421 - DNA, 6417 bp, Artificial Sequence
  Description of Artificial Sequence: Synthetic coding sequence
atggtgaatgaaaatacacggatgtacataccggaagaaaatcaccagggcagcaactacgggtctccaagacctgctcatgccaatatgaacgcaaacgccgccgcagggttagctcctgagcatatacccacgcctggtgcagcactgtcttggcaggccgctattgacgccgcccgccaagctaaactgatgggtagtgccggaaatgccacaatctccacagtcagttccacacaacggaagcggcaacagtatggcaaaccaaagaagcaggggtcaaccaccgctacacgccctccccgcgcccttctctgtctcacacttaagaatccaatcagacgggcctgtatttccattgtagaatggaagccctttgagattatcatcttactaactatcttcgccaactgcgtggccctagcaatctacattccttttccagaggacgattctaatgcaacaaactccaacctcgaacgggtagagtacctttttctgatcatcttcaccgtcgaggctttcctgaaagtgattgcatacggactgctctttcatccaaacgcttatcttagaaatggatggaacctattggatttcatcattgttgtggtagggttgttctccgcgatcttggaacaggccacaaaggcagatggggctaacgctcttgggggaaagggcgctggattcgatgtgaaagctttgagagccttccgcgtattgagacccctccggctggtaagtggggtgccttcactgcaggtggtactgaatagtatcattaaggccatggttccacttctccatatcgcactgcttgtactgttcgtgattatcatttacgcaatcatcggccttgagctcttcatgggtaaaatgcacaaaacatgttacaatcaggaaggaattgcagacgtgcctgcagaggacgatcccagtccttgcgctctggaaacgggccatggcaggcagtgccaaaacgggacggtatgtaagcctggctgggacgggccaaaacatggtattactaactttgacaacttcgcttttgctatgctgactgtgtttcagtgtattacaatggagggatggaccgacgtactgtattggatgcaggacgccatggggtatgaactaccctgggtctactttgtttcactcgtcatctttggaagctttttcgttctcaatctggttctcggagtgttgtcaggcgagttcagtaaagagagagagaaggccaaggcacgtggcgattttcagaaactcagagaaaagcagcagcttgaagaagacttaaaggggtatctagattggataactcaggccgaggatatcgatccagagaacgaagacgaagggatggatgaagaaaaaccaagaaacatgagtatgccaacttcggagacagagagcgtcaacacagagaacgtggcaggcggggatatcgaaggcgagaactgtggcgcccgactggctcatcggattagtaaaagcaagttcagtagatattggcggaggtggaaccgtttttgcagacggaagtgtcgcgctgctgtgaaatccaatgtgttctattggttggtcatcttcctcgtcttcctgaacaccttgaccatcgccagtgagcattacaaccagccaaactggctgacagaagtgcaggatactgcgaataaggcgctcttggccttgtttaccgcggagatgctgttgaagatgtatagtctcggtcttcaggcatacttcgtgtcactgtttaatcggttcgattgcttcgttgtctgtggaggcatactcgaaacaatcttggtcgagactaaaatcatgtccccacttgggatctccgtgctgaggtgtgttcgcttacttcgtatcttcaagattaccaggtactggaattctctctcaaatctcgtggcctcccttttgaattcagtgagatctatcgcctctctactactcctgctctttctttttattatcatttttagccttctggggatgcagttgtttggggggaaatttaactttgacgagatgcagaccaggcggtccactttcgataacttcccccagtcattgctgactgtctttcaaatcctaaccggggaggattggaacagtgtaatgtacgatggcatcatggcgtacgggggaccttcttttcccggaatgcttgtgtgcatttactttattatcctgtttatttgtgggaactatatcctgttaaatgtgttcctggctattgccgttgacaacctagccgatgctgagtctttgacgtctgcacagaaggaggaggaggaagaaaaagagaggaagaaactagcgcggacagcctccccggaaaagaaacaggaactcgtggagaagccagccgtgggggagtcgaaagaggaaaagatagaactgaaatcaatcacagctgatggtgaatcccccccagccaccaagatcaacatggatgacctacaacctaacgagaacgaggataagtccccttaccctaaccccgaaacaaccggggaagaggatgaagaagagccagaaatgcccgtgggtccacgaccacggcctctaagcgagctgcacttgaaggaaaaggccgttccaatgcccgaggccagcgctttcttcatcttttcttcaaataataggtttagactgcagtgccataggatcgtgaatgatacaatattcactaacctgattctgttttttattcttctcagcagtatctctctggcggctgaggatcccgtccagcataccagcttccggaatcacatcctgttttacttcgacatagtttttacaaccatattcactatcgaaatcgctcttaagatgacggcctacggagcctttctgcacaaggggtccttttgtcggaattactttaacatcttggacctactcgttgtgtctgtttcattaattagctttgggattcaatcgtccgcgatcaacgtcgtgaaaatcttacgggtgttaagagtgctgcgtccgttacgagccataaatcgggcgaagggtttaaagcatgtggtgcaatgtgtttttgttgcaatccgaacaatcggaaatattgtgatcgtgacaactctcctgcagtttatgttcgcatgcattggggtccaactcttcaagggcaagctgtacacttgctccgacagctccaaacaaaccgaggcagaatgtaagggtaactatattacatacaaagacggggaggtggaccaccctattatacagccacggagctgggagaattcaaagttcgattttgacaatgttcttgctgctatgatggccctgttcacagtcagcaccttcgaaggttggcctgaactattgtatcgtagcatcgactctcacacagaggacaagggaccaatctataactatcgggttgagatttcaatcttcttcatcatctatatcattattatcgctttttttatgatgaacatttttgtgggcttcgtaattgtcaccttccaggagcagggagagcaggagtataaaaactgtgagctggacaagaaccagagacagtgcgtggagtacgccctgaaggcaagaccgctgcgacggtacattcccaaaaaccaacaccagtacaaggtgtggtatgtggtgaatagcacctactttgaatacctcatgttcgtccttatcttgttgaatactatctgtttagccatgcagcattatggtcagtcctgccttttcaaaatagctatgaacatcttgaatatgctgttcactggactcttcactgtggagatgatcctgaagcttatcgcgtttaaacctaagggttacttctctgacccctggaacgtgttcgattttctgatcgtgatcggatcgatcatcgatgtcatcctcagcgaaactaatcccgcagaacacacgcagtgctctccaagcatgaacgccgaagaaaattccaggatctctattactttttttcgactgttccgggtaatgaggctggtgaaactcctgtcccgtggggaaggcatccgaactttactttggacctttatcaagagttttcaggctctgccgtacgtggctttgctgatcgtcatgttgttctttatctacgctgtgattggtatgcaagtttttggaaagattgccctgaacgacaccaccgagattaatcgcaacaataactttcaaacgttcccccaggcagtgctattactcttccgatgcgccaccggagaggcatggcaagacatcatgctcgcctgtatgccaggcaagaagtgtgccccggaatccgaaccatctaactcaaccgagggagagacaccatgcggatcatctttcgcagtcttttacttcattagcttctacatgttgtgcgcatttctgataataaacctgttcgtggccgttataatggataacttcgactacctcactcgcgactggtcaatcttgggcccacaccacctggacgaatttaaacgaatctgggccgagtatgacccggaggcgaagggccgcatcaaacacttggatgtggtaactttactgcgcaggattcagcctcccctcggattcgggaagctgtgtccccaccgggtggcatgcaagaggctagtatcaatgaacatgcctctcaatagcgacgggacagtgatgttcaatgccaccctgtttgcccttgtccgcactgccctgaggataaaaacagaaggcaatcttgaacaggcaaacgaggagctccgtgcgatcattaaaaaaatctggaagaggacaagcatgaaactgttggaccaagtggtgccaccagcaggggatgatgaggttacagtggggaagttctacgcaaccttcctcatccaagagtacttccgcaaattcaaaaaaaggaaagaacagggattggttggtaaaccatcccaacggaacgcactttctttgcaggcagggctgaggactctgcacgacatcggccccgagattagacgcgccatttcaggcgatcttacagctgaggaggagctcgataaagcgatgaaagaagctgtgtctgccgcctcagaggacgatatttttcgtagagctggcggcctgtttggtaaccatgtatcgtattaccaatccgatggacggtccgctttcccccagacattcactacccagagacctctccatatcaacaaggctggttcgagccagggtgacacagagtctccgtcacacgagaaactggtggacagtaccttcacacctagttcctactcatccacaggcagtaacgccaacattaataacgcgaacaatactgctctgggacgtttaccacgaccagccggttatccgtccaccgtgtccaccgtggaaggacacggcccacctctctcacccgccattagggtccaggaagtggcatggaagctcagtagtaatagatgccactcgcgtgagagccaggcagcaatggcaggccaggaagagacttcgcaagacgaaacctacgaggtgaagatgaatcacgataccgaggcatgtagcgaacccagcctcttgagcacagagatgttgtcttaccaggacgacgagaatcgtcagctgactttgcctgaggaagataagagggatatccgacaatccccaaagcgtggttttttgcgatctgccagcctcggacgccgggcctcttttcacctggaatgcttgaagagacaaaaggaccgcgggggcgatatcagccagaaaaccgtcttgcccctacatctggtgcatcatcaagctctggccgtggcaggactcagtccgctgttacaaagatcgcacagtccagcatcgtttcctaggccatttgctacacctcccgctacgcccggcagccgcggctggccaccacagccagtccccactctaaggctggagggggtagagtcatccgagaaactgaacagcagtttcccgtccatccactgtggatcatgggccgagacgacacctggaggcggcggcagcagcgcagctcggagggtcagacccgtgtccctaatggtgccttctcaggcaggggcccccgggcgacaatttcatggcagtgcctcctctctcgtagaagctgtgctgattagcgaagggctgggacaatttgctcaagatcctaagtttatcgaggtaacaactcaggagctggctgatgcttgcgatatgacaatcgaagagatggaatccgcagcagataacattctcagcggcggagccccccagagccccaatggcgcacttctcccatttgtgaattgtcgagacgccgggcaggatagggcgggcggggaggaggacgccgggtgcgtgcgcgctaggggcaggccctcagaggaggaactgcaggatagcagggtatacgtgtctagtctgtag

SEQ ID NO: 110422 - DNA, 6477 bp, Artificial Sequence
  Description of Artificial Sequence: Synthetic coding sequence
atggttaacgaaaatacccgtatgtatatacccgaggagaaccatcagggatctaactatgggtctcctcgcccagctcatgccaatatgaacgccaacgccgctgccgggctcgctcccgaacatatccctaccccaggagctgcgctcagttggcaggccgccattgatgccgcacgccaggcgaaactcatggggagcgcaggaaacgctacgatctcgacggtgtcgtctacccaaaggaagcgccagcaatacggcaagcccaaaaagcaaggctcaaccacagcaacgcggccgccccgcgccctgctgtgcctgaccttaaagaacccgatccgccgggcctgtatcagcatagttgaatggaaacccttcgaaattatcatcctgctgactatttttgctaattgtgtggctctcgccatctacatcccgttcccagaggatgattcgaatgccacaaattctaatctggagagggtcgaatacctctttctgatcatcttcaccgtcgaggcgttcttgaaagtgatcgcctatggccttctgtttcaccctaacgcatatttaaggaacggctggaacctcctggacttcatcatcgtggtggtaggcctcttctctgcaatattagagcaagctaccaaagccgacggagccaacgctctcggaggtaaaggtgccgggttcgacgttaaggcactgcgcgccttccgtgtactccggccactgcggctcgtgtcaggcgtgccttcgttacaagtagtcctcaactctattatcaaagccatggtccctctcctccacattgctctcttagtccttttcgtgatcatcatctacgcaataattgggcttgagctcttcatgggtaagatgcacaagacatgctacaaccaggagggtatagccgacgtgcccgccgaggacgacccctccccctgcgcactagagacgggccatggacgtcaatgtcaaaacgggaccgtgtgcaaaccgggctgggacgggcccaagcacggaatcaccaatttcgataatttcgcattcgcaatgttaacagtgttccagtgcattactatggagggatggacagatgtcctgtactgggttaacgatgccgttggacgagactggccctggatttattttgtcacgctaattatcatcgggtcctttttcgtcctgaatcttgtgttgggcgtcttgtctggggagttctcaaaggaacgggagaaggccaaggcaaggggagatttccagaaactgcgggagaaacagcagcttgaggaggacctgaaaggttacctcgactggattacccaggcagaggacattgacccagagaacgaggatgaggggatggacgaagagaaacctaggaatatgagcatgccgacgtcggaaactgagagcgtaaacaccgaaaatgtcgcagggggtgacatagaaggcgagaactgcggcgcacgactcgcacaccggatatctaaaagcaagttctcacgctactggcgccgatggaacaggttttgccggcggaaatgccgtgccgccgtcaagtcaaacgtgttttactggctcgtcatctttctcgtgtttcttaacacactgaccatcgcaagcgagcattacaaccagcctaattggctgaccgaggtccaggatactgcgaataaagcgctgcttgccctgttcacagccgagatgttgctgaaaatgtactctcttgggctgcaggcctattttgtatcacttttcaatagattcgactgtttcgtcgtgtgtggcgggatcctcgaaactattctcgtcgagacaaagattatgagccccctgggaatcagcgtcctgaggtgtgtcaggctgctgcgtattttcaaaataacccgctactggaacagcctgtctaacctcgttgcgagcttgttaaattctgtgaggtctatcgcttctcttctgctgctgctgttcttgttcataatcattttttctctactgggaatgcagctgtttgggggaaaattcaattttgatgagatgcagacccgacggagcacttttgataattttccacaaagcctgctcacagtttttcagatcctgaccggagaagattggaatagcgtaatgtacgacggtattatggcttatggaggcccaagctttccgggcatgctggtgtgcatctactttattattctgttcatctgcggtaattacattcttcttaatgtgttcctcgcgatagccgtggacaacctggccgacgctgagagcctcacatctgctcagaaagaagaggaagaggagaaggaacgcaaaaaacttgccagaacagcatctcccgagaagaaacaagaattggttgagaagcccgcagtcggagagtctaaagaagaaaaaattgagcttaagagcataactgccgatggtgagtcgccccccgccacaaaaataaacatggatgacttgcagcctaatgaaaatgaagataaatccccctacccaaatcctgagacgactggggaagaagacgaggaggagcccgagatgcctgtggggccacgtccacgacccctgagtgaattgcatcttaaagagaaggcagtcccaatgcccgaggcctcagcattcttcatcttctcatctaataaccgttttcgactgcagtgccatcggatcgttaacgatacaatctttacaaatctcattttgtttttcattctcctgagttcaatttcattggcagccgaggaccctgttcaacacacttccttccgaaatcatatcttgttttacttcgacatagtgttcactacaatcttcacaatcgagatcgctctaaagatcctgggcaacgccgattacgtgtttacatccatctttaccctcgaaattatcttgaagatgacagcctatggagctttcctccataaaggatctttttgtcgcaactattttaatatcctggatctactcgtggtgagcgtgtcattaatcagttttgggatacagtctagcgcaatcaacgtcgttaagattctaagagtgctgcgagtactccgcccacttagggcaatcaatagggcgaaaggcctgaagcacgtggtgcagtgtgtatttgtggctatccgcaccatcggcaatatcgttatcgtgacgacactgttacagtttatgtttgcgtgcattggcgtccagctattcaaaggtaagctgtacacatgttctgatagctccaagcagacagaggcggaatgcaaggggaattatattacatataaggacggagaggtagatcatcctatcatccaaccacgctcatgggagaactctaagttcgacttcgataacgttttggcagccatgatggcactgttcaccgtgtccacgttcgagggatggcccgaactgctgtaccgctcgatcgatagccatactgaggacaaaggaccaatttacaattacagagtcgagatcagcatcttcttcatcatatacatcatcatcatcgccttcttcatgatgaatattttcgtgggcttcgttatcgtaacatttcaggagcagggagagcaggagtacaaaaactgtgaactggataaaaaccaacggcagtgtgtcgaatacgcgctcaaagcacggcctcttagacggtatatccccaagaatcagcaccaatataaggtctggtacgtggtcaattcaacgtatttcgagtacctgatgttcgtactcatcttgctgaacacaatttgtctggccatgcaacactacggccagagttgtctgttcaagatcgccatgaacatcctgaatatgctgttcaccggactctttactgtggaaatgattttaaagttgatcgcgtttaaacccaaacactatttttgtgacgcctggaacacgtttgatgccttgatagttgtgggatcgatcgtggacattgcaatcacggaggtgaaccctgctgagcacacccaatgtagtccctccatgaacgcagaagagaactctagaattagcatcacattctttcgtctgttcagggtgatgaggctggtgaagctactttctcggggtgaagggattcggaccctgctgtggacatttatcaaatcttttcaggccttgccctatgtggctttgctgatagtgatgctgttctttatctacgccgtgataggaatgcaggtattcggtaagattgcccttaatgacactactgaaatcaaccgtaacaataattttcagacctttccacaagccgttttgttactgtttcggtgtgctactggcgaggcttggcaagacataatgcttgcttgtatgcccggaaaaaagtgtgccccagagtctgagccctccaattcaacggaaggtgagacgccctgcggttctagctttgctgtcttttacttcatcagtttctacatgctgtgcgcattccttataattaacctgttcgtagctgtgatcatggacaactttgattacctgacaagggactggagtatcctgggccctcaccatctggacgagttcaaaagaatctgggccgaatacgatccagaggcaaaaggccgtatcaagcatttggatgtggtgacactgctgagaagaattcagcctcctcttggcttcggaaaactgtgcccgcaccgggttgcatgcaagagattggtgtccatgaatatgccactcaatagtgacgggactgtgatgtttaatgccaccttgtttgcgttggtcagaacggctctgagaatcaaaacggagggcaacctcgagcaggctaacgaggagctgcgtgccatcatcaagaaaatctggaaacgaactagtatgaagctgttagaccaagtggtgcctccagcaggggacgatgaggtgactgtgggtaaattttacgcaacctttttgatccaggagtacttcaggaagttcaaaaaaaggaaggagcagggactggtgggtaagccatcccagcgtaacgcactttctttgcaagcagggctcagaaccctgcatgatatcgggcccgagatcaggagggcaatatccggcgacctgaccgccgaagaagagttggataaggcaatgaaggaggcagtaagcgcagcctcggaagacgacatctttcgaagggcaggcgggctcttcgggaaccacgtatcctattatcagtccgacggtcgcagcgccttcccccagacattcacgacacagcggccacttcacatcaataaagccggtagctcacagggtgataccgaatcaccttcacatgagaagctggtggactccacttttacgccaagcagctattcttccactggatccaacgctaatattaacaacgccaacaatacagcgctcgggagactgcctcggccggccgggtatccaagcactgtcagcactgtcgaaggacacggaccccccctatctccggcaatccgtgtgcaggaagtggcatggaaattaagcagtaatcgttgtcactctcgggagagtcaagccgctatggctggccaagaagagacctcacaagatgagacctacgaggtaaagatgaatcacgatactgaagcctgctctgaaccctcactcctgagcaccgagatgctctcatatcaggacgatgaaaatcgccagctcactctccctgaggaggacaaacgggacataaggcagtcgccgaaaagggggttcctcagatctgcctctctcggtcggagagcctctttccatttggaatgcctaaagcgtcagaaggaccgcggaggcgacatctcccaaaaaacagttcttccattgcatctggtgcaccaccaggctctcgccgtggccgggctgtcaccactcttacagagatcccactcccccgcaagcttcccccgccctttcgctacaccccccgcaacacccggctcaaggggatggcctcctcagcctgtgcccactttgcgtcttgaaggcgtggagtcttccgagaaactcaatagttcattcccttccattcactgcggatcctgggctgagactacaccaggcggagggggcagttccgcagccaggagagtgcgccctgtatctctgatggtgcccagccaggctggggcgccgggacgccagtttcacggaagtgcctcttccttagtggaagctgtgttgatctcggaggggttgggccagtttgcccaggaccccaaatttatagaagtcaccactcaggagctcgccgacgcctgtgatatgactattgaggagatggagtcagccgctgataatattctgtcaggcggcgctccacagagtccaaatggagccctactcccctttgttaactgtcgcgatgccggacaagatcgggccggcggtgaagaggatgcgggctgcgtgagagccagaggtaggcccagtgaggaggaattgcaggattcacgcgtgtacgtatcatctctgtag

SEQ ID NO: 110423 - DNA, 6522 bp, Artificial Sequence
  Description of Artificial Sequence: Synthetic coding sequence
atggtgaacgagaataccaggatgtacattccagaagaaaaccaccaaggcagcaactatggttccccccgccctgcccacgccaacatgaacgcaaacgccgctgccggactggcccctgagcacatccctactcctggagctgctttgagctggcaggcagcaatagacgccgccagacaggccaaactcatgggaagtgccggcaacgctacgatctccactgtatccagtacacagaggaaacgtcagcagtatgggaagccaaaaaagcaggggtccaccactgctactcggccaccaagagccctgctctgtctaacgctaaaaaatcccatccggagagcatgcatttcgatcgtggagtggaagccttttgaaatcatcatccttcttactattttcgccaattgcgtagcgttggctatctacattcctttccctgaggatgattctaatgcgaccaattccaacctggaaagggtggaatacctgtttctaatcatttttacagtggaggcctttctgaaagtgatagcatatggtttacttttccaccccaatgcttacctcagaaatggctggaacctcctggactttattattgtagtggtcggcctcttttcggctattttggagcaggccactaaggccgatggcgctaatgccctcggcggtaagggggctggcttcgacgtgaaggcgctcagagccttcagggtgttgcgtcccttgcggctcgtgagtggcgtcccttcactccaggtggtgctcaacagcattataaaggccatggtcccacttctacacatcgcgctgctggtgctcttcgttatcatcatatatgctatcatcggactggagctgtttatgggaaagatgcacaagacatgttataaccaagagggcatcgccgacgtgccagccgaagacgacccgtcaccctgcgctctcgagaccggacatggccgacaatgccaaaacgggacagtctgcaagcccggatgggacgggcctaagcatggcattaccaattttgataattttgcctttgcgatgctgacagttttccagtgtattacaatggaaggttggaccgacgtgctgtactggatgcaggatgcaatgggatacgaactaccttgggtgtacttcgtgtccctggtgatttttggcagtttttttgtactcaatctggtgctcggcgtcttaagcggggaattcagcaaggaacgagaaaaggcaaaggcaaggggggatttccaaaagttgagggaaaagcagcagttagaggaggacttgaagggctatcttgactggattactcaggccgaggacatcgatcctgagaacgaggacgaagggatggatgaagaaaaaccccgcaatatgtccatgcccacaagtgaaaccgagtccgtaaacaccgagaatgtggctgggggagatatagaaggggaaaactgtggtgcaagattggcacacaggatttccaagagcaagttctcccgttactggcgacggtggaacagattctgcagaagaaaatgccgggccgcagtgaagtcaaacgtcttctattggctggtgatcttccttgtgtttcttaacacacttactatcgcttcagagcactacaaccagcctaactggctgactgaggtgcaggatacggcaaataaggccctgcttgccctgtttaccgcagaaatgcttttaaagatgtactcactcggtctgcaggcctattttgtgtcactctttaatcggtttgactgctttgtcgtctgtggtgggattttagagaccatcctcgtggagaccaagatcatgagtcctctaggaatttcggtgcttcgctgcgtcagacttctccgtatttttaagatcacacggtattggaattcactgtccaacttggtagcctcgctgctgaactcagtgaggtctatagcttccctgttactgctactgtttctgtttatcatcatatttagccttcttggaatgcagctgtttggaggtaagttcaactttgacgagatgcagaccagacggtctaccttcgataatttcccacagagcctgttaaccgtctttcagattctcaccggagaggactggaactccgtgatgtatgacggtatcatggcttacggaggcccaagcttccctggaatgctggtgtgcatttattttattatactcttcatctgtggaaattacattctactgaatgttttcttagcaattgccgtggataacctagctgacgcagaaagcctcacctcagcacagaaggaagaggaagaagagaaagagcggaagaagcttgctagaactgcaagtcctgagaaaaagcaggagctggtggaaaagcctgccgtgggcgagagcaaagaggaaaagatcgaactgaagtcaattaccgccgacggcgagtcccctcccgccactaagataaacatggacgaccttcagccaaacgagaatgaggataagtctccgtatcccaatcccgaaaccacaggagaagaagatgaagaagagcccgaaatgcctgtcggccctaggccgagacccctctccgaactgcacctgaaagagaaagcagtgcctatgccagaagcctccgcatttttcattttcagctccaataatcggttcagacttcagtgtcaccggattgtgaacgacaccattttcaccaatctgattctgttctttatattactctcctctatatctcttgctgccgaggatcccgtgcagcacacttcatttcgtaaccacatcctcttctacttcgacattgtgttcactacaatcttcaccatcgagatcgccctcaagatgaccgcctatggtgctttcctgcataagggttccttctgcagaaactacttcaacatactcgatctgttagttgtgtcagtttcactgatttcttttggcatccagagctcagctataaacgtcgtcaaaatactgcgggtgttgcgagtgctccgccccttgcgtgccatcaaccgcgccaagggcttgaaacacgtcgtgcagtgtgtgttcgtggccatcaggacgattggaaacattgtcatagtgactacgctgttgcagttcatgtttgcctgtataggggtccagctattcaagggaaagttatacacgtgcagcgactcatccaagcaaaccgaagctgagtgtaaaggaaactacattacatataaggacggggaagtggatcacccaatcatccagccccggtcttgggagaatagcaaattcgactttgataatgtactggctgcaatgatggctctcttcaccgtgtcgacttttgaaggttggcccgagctgctgtacagaagtatcgattcccacaccgaagacaaggggcccatttacaattaccgtgtcgaaattagcatcttctttattatttatataataatcatagctttctttatgatgaatattttcgtgggtttcgttattgtaaccttccaggagcagggggagcaggagtataagaattgtgagctcgacaagaaccagaggcagtgtgtggagtacgccctgaaggcccgacccttaagaaggtatatcccaaagaatcaacaccagtataaggtgtggtatgtggtcaatagtacgtactttgagtacctgatgtttgtccttatactgttgaataccatctgtctggccatgcagcactatggccagtcctgtctgtttaagatcgcgatgaatattctgaacatgctgttcaccggactattcaccgtagagatgatcttgaaattgatcgccttcaagccaaaggggtacttttcagatccctggaacgtgtttgatttcttaatagtgataggctcaatcatcgatgtcattttaagtgagaccaacccggccgagcacacccaatgcagcccctctatgaacgccgaggaaaattcgagaattagcattaccttcttccggctattccgggtgatgcgattagtaaagctcctctcacgtggcgaaggaatcaggactctcctctggactttcatcaaatcgtttcaggccctgccatacgtcgccctgctcattgtgatgctcttcttcatctatgctgtgatcggcatgcaggtgtttggtaagatcgccttaaatgacacgactgagatcaacagaaacaataattttcagaccttcccacaggctgttttactcctgttcagatgcgccactggcgaagcgtggcaggatataatgttggcctgcatgccaggaaagaaatgtgcaccagagtcagaacctagcaattctaccgaaggtgagaccccctgcggctccagcttcgccgtgttttactttatcagcttctatatgctgtgcgccttcctcatcattaatctcttcgtggctgtgatcatggataattttgattacctgacacgagattggtccattttagggccccatcatctggacgaatttaagcgtatctgggccgagtacgacccagaggctaaagggcgaataaagcacttggatgtcgtgacacttttacgacgcattcagcccccgctcggatttgggaagctgtgccctcatagagtggcttgcaagcgactggtgagtatgaacatgcctctgaattcagacggaaccgtaatgtttaacgccaccctgttcgctttggtccgtaccgccctgcgtatcaaaactgaggggaacctggaacaggctaatgaggagcttcgggccattattaaaaagatctggaagagaacctcgatgaagcttctcgatcaggtggtgccgcctgctggcgatgatgaggtgaccgtcggcaagttttatgccacatttttgatccaggaatatttccggaagtttaagaaaaggaaagagcaggggctggtggggaagccttcccagcggaacgccctgtctttgcaagccgggctgcggactttgcacgatattggcccagaaattagacgtgcaatcagcggagacctgacggctgaggaggagcttgataaagccatgaaggaggctgtctccgcagcttctgaggacgacatttttcggagagccggtggcttgtttggtaatcacgtctcgtactaccagagcgacggacgaagcgcttttccccaaacctttactactcagcgtcccctgcacattaataaggccggtagcagtcagggcgacactgagtccccctcacacgaaaagttagtcgacagcacgttcacccctagcagttattcaagcacgggctccaacgccaacattaataacgcaaataacaccgctctcgggcggctgcctaggcccgctgggtacccttctacagtgagcacagtggagggccacggacctcctctgtcacctgctattcgcgttcaggaagtcgcttggaagttatcatccaatcgcgagcggcatgtgcccatgtgcgaagacctcgagcttagaagggatagcgggtctgcaggaacacaggcccactgtttacttctgaggaaagcaaatccttctaggtgtcactcacgcgagagccaggccgccatggctggacaggaggagacttctcaggacgagacctacgaggtcaaaatgaaccacgatacggaggcctgctctgaaccctcgctattatctactgagatgctgagttaccaggatgatgaaaaccgacagctgaccctgcccgaagaggacaaacgcgacatcaggcagagccctaagcgtggctttctaaggtcggccagcctggggaggagagccagtttccatctggagtgcctgaaacggcagaaggatcgcggaggagacatctctcagaaaacagtattacctttacacctggttcaccatcaggccctggccgttgctggtctctcgccgcttctgcaaagaagtcacagcccagcctcgttcccaagaccattcgctacccctccagccactccaggcagcagagggtggccaccacagcccgtgcccacactccgccttgaaggcgtggaatcctctgagaagctcaactcctccttcccatcaatacactgcgggagctgggccgaaacaacccctggtggaggcggcagtagcgcagcaagacgagtgcggcccgtgtcactaatggtgccctcccaggccggggcgccagggagacaatttcacggatcagcttcttcgctcgtagaggcagtgctgattagcgaggggttgggacaattcgcgcaggatccaaagtttatcgaagtcacaacgcaagagctcgccgacgcctgtgatatgaccatcgaggagatggaatccgccgcggataacattcttagcggcggagctccacagagcccgaacggagccctgctaccctttgtgaattgtcgggatgctgggcaggaccgagccggcggcgaggaggatgccggttgtgtgcgggctagagggagaccctccgaagaggagctgcaagattctcgcgtgtacgtgtcatccctgtag

SEQ ID NO: 110424 - DNA, 6474 bp, Artificial Sequence
  Description of Artificial Sequence: Synthetic coding sequence
atggttaatgagaacactagaatgtacataccagaagaaaaccatcaaggtagtaattatggatccccaagacctgcccacgcgaacatgaatgcgaatgccgcggcaggtcttgctccagaacatatcccaactccgggcgctgccctgagctggcaggcagcgattgacgccgctcgccaagctaagctaatgggatctgccggtaatgcgacgatttctactgtgagtagcacgcagcggaaacggcaacagtatgggaagccaaagaagcagggttcaacaactgcaacaaggccgccacgcgcccttctatgccttacactgaaaaatccaatccgccgggcttgcatcagtatcgtcgagtggaagccattcgagattatcattctgctcactatttttgcaaactgtgtggcgctggccatttatataccgttccccgaggacgacagtaatgctaccaactcaaacttggagcgggttgagtacctattcctgattattttcactgtcgaggcgttcctaaaagtgattgcgtacggtttgcttttccacccaaatgcctacctccggaatggctggaatcttctggacttcattatcgtagtagttgggttgttcagtgccatccttgaacaggcgacaaaggctgacggagctaatgcattggggggcaaaggtgccggatttgatgttaaggcactgcgagcgtttcgcgtacttcgtcctctccggttggtgagcggagtgccctcactgcaggtggttctcaattccataattaaggccatggtgcctcttctgcacattgctctgctggtccttttcgtcatcatcatctacgctattatcgggttggaactgttcatggggaaaatgcataaaacttgttacaaccaggagggcattgccgatgttcccgccgaggacgatccatccccgtgcgcattggagacaggccatggaaggcagtgtcagaacggcaccgtgtgcaagccaggctgggatgggcctaaacacggaattactaactttgacaatttcgcctttgctatgctgactgtgttccagtgtatcactatggagggttggacggacgttctctattgggtgaatgatgcagtgggaagagactggccgtggatctatttcgtgacactgatcattatcggctctttcttcgtgttgaaccttgtgctgggggtgctgagtggcgaattcagtaaggaacgggagaaggctaaggctagaggcgacttccagaaattacgggaaaagcagcaactagaagaagacctgaaaggttacttggactggatcactcaggccgaagatattgaccctgaaaacgaagacgaagggatggacgaagaaaaacccagaaatatgtccatgcctacctccgagacagagtcagttaacaccgagaatgtggctggcggtgacatagagggggagaattgtggagccagactggcccaccggatctcgaagtccaagtttagtaggtactggcgccgctggaatcgcttttgccgtcgtaaatgccgtgcggctgtgaagagcaatgtattctattggcttgtcatcttcctggtgttcctgaacactctgaccatcgccagtgaacattacaaccagcctaattggcttactgaagtccaggatacagccaataaagccctgctggccctattcacggccgaaatgctgctcaagatgtattctttgggtctgcaggcctactttgtgtcactgttcaaccgcttcgactgcttcgtggtctgtggggggatcttggagaccatactggttgaaacaaaaataatgtccccgctcggaattagtgtcttgcggtgcgtccgtttgctacggatcttcaagattaccagatattggaattcactgagtaatcttgtggcttctctcctgaactcggtgcgatcaattgctagtctcctgcttttgttgtttctgttcatcataatcttctccctgctcggaatgcagctgttcggcggcaaattcaatttcgacgaaatgcagacacgcagatcaacgttcgataattttccacagtccctgctgacggtgtttcagattctcacaggagaagattggaactccgtgatgtatgatgggattatggcatatgggggacctagcttcccgggaatgttggtgtgcatctatttcattatactctttatttgcggaaactacatcctactgaacgttttcctggcgattgcggtggacaatcttgcggatgctgagtcactaacgtcagcacaaaaggaagaggaagaggagaaggagagaaagaagctggcccgaaccgcatctcctgagaagaagcaggagctggtagagaagcccgcagtcggggagtccaaagaggaaaagattgaactgaagagcattacagccgatggtgaaagccctcctgccactaaaatcaatatggacgacttgcagccaaatgaaaacgaagacaaaagcccataccccaacccagaaacaactggagaggaggatgaggaggagccggaaatgcctgtcgggccacgtcccagacctctgagtgaattgcatctcaaggaaaaagcggttcctatgcctgaggcttcagccttttttattttctccagcaacaaccgattccggttgcaatgccatcggattgtgaatgacacaattttcacgaacctcatactatttttcattttactctcctccatcagcctcgccgctgaggatccggtccagcacacctcctttcgcaaccacatactgttttatttcgatatcgtctttaccacaatcttcacaatagagatagccctgaaaatgactgcctacggggcttttctccacaaagggtcgttctgtcggaactactttaatatcctcgacctccttgtggtgagcgtctctctcatctcgtttggcatccaatcctccgctatcaatgtggtcaagatcttgcgcgtgttgcgtgttctgcggcctctccgggcgatcaaccgagccaaaggactgaagcacgttgttcagtgcgtgtttgtggccattagaactataggcaacatcgtgatcgtgaccacccttctgcagttcatgttcgcgtgcattggagtccagctttttaagggcaagctgtacacctgctccgattctagtaaacagaccgaggcagaatgtaaaggtaactacattacgtataaggacggagaggtcgaccaccctatcatacagccccggtcttgggagaattcaaaatttgacttcgataacgtcctggctgctatgatggcactgtttaccgtgtcaacgttcgagggctggcccgagcttctgtataggagcattgatagccataccgaagacaagggacccatctacaactaccgagttgagatatccatatttttcatcatttatattatcattatagccttcttcatgatgaatattttcgtgggatttgtgattgtgaccttccaggaacagggggaacaagaatataaaaactgtgaactggataaaaatcaacgccagtgtgtggagtatgctctcaaggcgcgcccactgaggcggtatattcctaaaaatcagcaccagtacaaagtgtggtatgtcgttaactcaacgtatttcgaatacttgatgttcgtgctgattctgctgaatacaatttgtctggcaatgcagcactacggtcaatcgtgcctgttcaagatcgctatgaatatcttaaacatgctgtttacgggcctattcaccgttgagatgattctcaagctcatagccttcaaacctaagcattacttctgcgacgcgtggaatacattcgacgcactgattgtggtggggtctatcgttgacatcgctatcacagaagtcaacccagcggagcatacacagtgttccccttctatgaatgccgaggagaactccaggatctccatcacttttttccggttgttcagagtgatgagactggttaaacttttgagccgcggagagggaatcagaacactactctggacctttatcaaaagttttcaggccctgccgtatgtggccctgttgattgtgatgttattctttatttatgctgtcatcgggatgcaggtgtttgggaaaatcgccctgaatgacacaacagagatcaaccgcaacaataatttccaaactttcccacaggcggtcctcctgttgttccgttgcgcaacgggcgaggcctggcaggatatcatgctcgcgtgcatgcccggtaagaagtgcgcccctgaatctgagccaagcaacagtacggagggagagaccccctgtggctcgtcttttgctgtgttctattttatctctttttatatgctgtgcgcctttttgatcattaacctgtttgtggctgtgatcatggataatttcgattacctcaccagagattggagcatcttgggtccccatcacttagacgagttcaaacgcatctgggccgaatatgacccggaggcgaaaggtaggatcaaacacctggacgtggtgacattgctgcggaggatccagcccccactggggtttgggaagctctgcccccacagggttgcctgtaagaggctagtcagtatgaacatgcccctgaacagtgatgggaccgtcatgtttaatgccacattgtttgccctggtgcggaccgccttgcgcataaaaaccgaggagggacctagcccaagcgaggcacaccaaggtgctgaagaccctttcaggcccgccggcaacttggagcaggccaatgaggagttacgggcaattatcaagaagatatggaagagaacatcgatgaaactgttggatcaggtcgttcctcctgctggagatgacgaagtaactgtgggtaagttctacgctacatttctcatccaggagtacttccgaaagttcaaaaagaggaaagaacaaggactcgttgggaaaccatctcagaggaacgccctcagtctgcaggccggattgcgtacactccatgatatcgggccggagattcgcagggccattagtggcgacctgactgccgaggaagagttagacaaggctatgaaagaagcggtgtccgccgcgagcgaagatgacatctttaggagagctggtggtttgtttgggaatcacgtgtcctactaccaatcggacggccggtctgcatttccccagacctttacaactcaaaggcctttacacataaataaggccggatcctcccaaggcgatactgaaagcccaagccatgaaaagcttgtggactccacctttacaccaagctcctatagctcaaccggttcaaatgcaaatatcaacaatgccaacaacacagcccttggcaggttgcccaggccagcggggtaccccagtacggtgagcactgttgaaggccatggaccgcctttgagtcccgccatccgggtgcaggaggttgcctggaagctgtcttccaatcggtgtcattcaagagaatcccaggctgcaatggccggacaggaggagaccagccaggatgaaacttatgaggttaaaatgaaccacgatactgaagcatgttcagagcccagcctgttgagcaccgaaatgctctcataccaggacgatgagaataggcagcttacgctgcccgaggaggataagagggacatccgacagtcgccaaagcgggggttcctaagatcagcctctctggggcggagagcatcattccatctggagtgtctgaaaagacaaaaggacaggggaggagatatttcccagaagacagtcctgcctctgcacctggtccaccaccaggctttggcagtggcaggactgtctccattattacagcgttcccattccccagcgagctttccccggcctttcgccaccccccccgcaactccaggttccagaggttggcctccgcagcctgttcccacattgaggctcgagggagtggagtccagcgagaagctcaattctagtttcccctccattcattgcggctcctgggctgaaactacccccggagggggaggcagttccgcagcccgacgagtccggcccgtctctctgatggttccctcccaagcaggggcgcctgggcgacaatttcacggctcagcaagttcacttgtggaagccgtcctgattagtgagggattaggccagttcgcccaggatcctaagtttattgaggtgactacgcaagaactcgctgatgcatgcgatatgaccatcgaggagatggaatccgccgccgataacatcttgtctggaggggcccctcaatcacctaatggagccctgctcccatttgtgaactgtcgcgacgcaggccaggacagagccggcggagaagaggacgccggttgtgtcagggcaagaggtaggccttcagaggaggaactgcaggactctagggtgtacgtctcctcgctgtag

SEQ ID NO: 110425 - DNA, 6468 bp, Artificial Sequence
  Description of Artificial Sequence: Synthetic coding sequence
atggttaatgaaaataccaggatgtatatccctgaggaaaaccaccagggatccaactacggtagcccccgcccggctcacgccaatatgaacgcaaacgccgcagccgggctcgccccggagcacattcctactcccggggcggctttgtcttggcaggcagctatagatgctgcacggcaggccaaattaatgggaagcgctggtaatgcgacaattagcaccgtgtccagtacccagcgcaaacggcaacaatacggcaagcccaaaaagcagggaagtactacagccacacgtccccccagagccttgctctgcctaactctgaaaaaccccatccgacgggcctgcatctcaattgtagagtggaagcccttcgagattataatccttctgaccatattcgccaactgtgtggctctggccatatacattcccttcccggaggatgactctaacgcaacaaatagcaatctggaaagagtcgagtacctcttcctgattatctttaccgtcgaggctttcctgaaagtgatcgcatacggactccttttccatcctaacgcctatctgagaaacggctggaacttgcttgacttcataatcgttgtggttgggttattctcagcaatcttggagcaagccaccaaggcggacggagcaaacgcactgggcgggaaaggcgccggctttgatgtgaaagctctaagggcttttagagtcttgagaccgctaaggctggtaagcggagtgccaagccttcaggtagtgcttaactccatcattaaagctatggtgcctctgctccacattgctctgctggtgctttttgttatcatcatttatgcgattattgggcttgagctgttcatggggaaaatgcacaagacatgctataatcaggaggggattgctgacgtgcctgctgaagatgatccatctccatgtgcactcgagaccggacacggacggcaatgtcaaaatggcacagtctgcaagcccgggtgggacggccctaagcacggaatcactaattttgataacttcgcttttgctatgctgactgttttccaatgtatcacaatggagggctggacagacgtgctttattgggtcaatgacgccgtcggccgtgattggccctggatttatttcgtcacactaatcatcatcggatccttttttgtactaaatctggtgctgggtgtgctgtcgggggagttctccaaggagagagaaaaagcgaaggcccgcggggacttccaaaagctgcgtgagaaacagcagctcgaggaggacctcaagggctacctggactggatcactcaggccgaagacattgatccagaaaacgaagatgagggtatggatgaggaaaaacctcgcaacatgtctatgccgacctcggaaaccgaatcagttaatacagagaacgtcgccggaggggacatcgagggcgaaaactgtggcgcaagattggctcatcgaatatcaaaaagcaaattcagtagatactggaggcgctggaaccgtttttgtcgtcgcaagtgtagagccgccgtcaaaagcaatgtgttttactggcttgtgatctttctggtattcctgaacaccctgaccatcgccagtgagcactacaaccaacctaactggttaaccgaggttcaggacactgctaacaaggcactgctcgctctatttaccgctgaaatgctgttaaagatgtattccctcggccttcaagcctactttgtgtccctgtttaatcggttcgactgcttcgtggtgtgtgggggaatcctcgagacaatcctggtcgagactaagattatgtccccactcggtatctccgtgttgcgttgcgtgagactgctcaggatattcaagattacccgctactggaactctctgagcaatctggttgcgagcttgctgaacagcgtgaggagtatcgcctcccttctcttgttgctctttctcttcattatcatattctctctgctggggatgcaactgttcggagggaaattcaacttcgacgagatgcagacgcgccggtccaccttcgacaattttccgcagtctctgcttaccgtgttccagatactcaccggcgaagattggaactctgtcatgtatgacggaattatggcttacggcggacctagctttcccggcatgctggtttgtatttatttcatcatacttttcatctgtggtaactatatcttgctgaatgttttcttagccattgcagtcgataacctggccgacgcagaaagcttgacgtccgcccagaaggaggaggaggaggagaaagaaagaaagaaacttgcaagaacggcgtcaccagagaagaaacaagagcttgtcgaaaaaccagctgtgggagaaagtaaagaagaaaagatagaactcaagtcaatcaccgccgacggggagagcccccctgccactaagatcaatatggatgatctccagcccaacgagaacgaggacaagagcccctaccctaatccagagaccacgggcgaagaggacgaagaggaaccagaaatgcctgtgggcccgaggcccaggcccctgtccgaattgcatctcaaagagaaagctgtccccatgccagaggcatcagcattttttatcttcagcagcaacaatagattccggctgcaatgccatcggattgtgaatgacaccatctttactaacctaatcttgttctttattctcctgtcctctatctctttggccgcagaggatcctgtgcaacatactagtttccgcaaccacatcttaggcaacgctgactacgtgtttacgagtatctttactcttgagattatcctgaaaatgacggcttatggcgccttcttgcataagggatctttctgtagaaattacttcaatattcttgacttattagtggtgtccgtgtccctgatctcattcggaattcaaagctctgccattaacgtcgtaaagatcctacgagtgcttagggtacttagaccactaagggctatcaacagagccaaaggtctaaagcacgttgtgcagtgtgtgtttgtggcaattagaactatcggaaacatcgtcatcgtgactaccctgttgcagttcatgtttgcctgcatcggcgtccaattgttcaagggcaaactatacacctgctccgattcatcaaaacaaaccgaagccgaatgcaaagggaattatattacttataaagacggcgaggttgatcaccctataattcagccgcgcagctgggaaaacagcaaatttgactttgataacgttttggctgccatgatggcactttttacagtcagcactttcgagggctggccagagttgctgtatcgctcaatcgattcacacactgaagacaagggtccaatctacaattacagagtggagataagtatcttttttattatctacattatcattatcgcttttttcatgatgaacatcttcgtcgggttcgttattgtgacattccaggaacaaggtgagcaggaatacaaaaactgcgagctggacaagaatcagagacagtgcgttgagtatgctctaaaggcccgccccctcaggagatatatcccaaaaaaccagcaccagtataaggtgtggtatgtcgttaacagtacatatttcgagtacttgatgttcgttttaattctgttaaacacaatatgtctcgcaatgcagcattatgggcagtcttgcctttttaagatagcaatgaatatactcaatatgttgtttacaggactatttaccgtggaaatgatcttgaagctgatcgcttttaagcctaaggggtacttttcagatccatggaatgtgttcgatttcctcattgtgatagggtccataatagacgtcattctgagcgagaccaaccactacttctgcgatgcctggaatacttttgatgcccttatcgtggtgggatctattgtggatatcgccattactgaggtgaataacgccgaggagaatagtagaatttcaatcacatttttccgactatttagagtgatgaggctggtcaagctactctcccgcggagaagggatcaggacccttttgtggacttttatcaaatcctttcaagcactgccatatgtggcccttctcattgtaatgctattcttcatttacgccgtgataggcatgcaggtcttcggcaagatcgcactcaacgacaccaccgagatcaatcgaaataacaacttccaaaccttcccgcaagcggtgctcctcctgtttcggtgtgccactggtgaggcttggcaggatataatgttagcctgcatgcccgggaagaaatgcgcacccgagagcgagccgagcaattccaccgaaggcgaaacaccctgtggatccagcttcgccgtattctattttatctccttttacatgttgtgcgccttcttaattatcaatctgttcgttgccgttattatggacaactttgactacctcaccagggactggtccatcctgggcccccaccatctggatgaatttaagcgcatctgggctgagtacgaccccgaggcaaagggccgcataaagcatctcgacgtggttacactgcttcggaggattcaaccccccctcggcttcggcaaattatgcccgcatcgggttgcatgcaagcgattggtgtcaatgaacatgcctctgaactctgacgggactgtaatgtttaatgcaacacttttcgccctggtccgaactgccctgcggatcaaaaccgaggggaacctcgaacaggctaatgaggagctgagggcaattataaagaagatctggaaacgtacctccatgaaacttctggatcaagtcgtccctcctgctggcgacgatgaggtgactgttggtaagttctacgccacatttcttattcaggagtacttccgtaagtttaaaaagaggaaagaacaagggttggtaggcaagccatcccagaggaacgcgctgtcgttgcaggccggcctcaggacccttcacgacattggtcctgagataagacgcgcaattagcggcgacctgaccgccgaggaagaactcgacaaggccatgaaggaggccgttagcgctgcctcagaggatgatattttccgtagagccggcggtctgttcggcaaccacgtgtcttactatcagagtgacggccggtcggcctttcctcagacatttactactcaacgcccactgcacattaacaaggctgggagcagccaaggagacacagagtcgcccagtcacgagaaactggtggatagtaccttcacacccagctcctactccagtaccggcagtaacgcaaacattaataacgccaataataccgcccttggtagactgccacggcccgctggctatccctctactgtgagcaccgtggaggggcatgggccccctctctcgcctgctatccgtgttcaagaggtggcttggaaactatcttcaaatcggtgccacagccgcgaatcccaggcagctatggcagggcaggaagagacatcacaagacgaaacctacgaagtgaagatgaaccacgacacagaggcctgttcagagccctcactcctgagcaccgagatgctaagctaccaagatgatgaaaacaggcaactcacattgccggaggaggacaagcgtgatatacgccaatccccaaaaaggggctttttgcggtctgcctccctggggaggagggccagcttccatctggagtgcctgaaaaggcaaaaagaccggggcggcgacatctcacagaaaacagtactgcccctacatctggtacatcatcaagccttggccgtggcaggattgagtccgcttttgcaaaggagtcacagccctgcctcatttcctcggccctttgcaaccccacccgccacgcccggatccagagggtggccgcctcagccagtgcctacgcttaggttagagggcgtcgaatcttccgagaaactcaactcgtctttcccatccattcattgcggctcctgggccgaaaccacccctggtggtggcggatcaagtgcagctcgccgggtacgacctgtgagtctgatggtgccatcacaagccggagcccccggcagacagtttcatggctcagctagtagcttagtagaggctgtgctgatcagtgaaggactggggcaatttgcgcaggatcccaagttcattgaagttaccactcaggaacttgccgacgcttgcgatatgaccattgaagagatggaaagcgccgcggacaatatcctgagcggtggcgctccccagtcccccaacggcgccctgctgcctttcgtaaattgccgcgacgccggacaggaccgcgctggaggtgaggaggatgccggttgcgtgagggctcgggggaggccatcagaggaggagctgcaagacagccgggtgtatgttagttctctgtag

SEQ ID NO: 110426 - DNA, 6630 bp, Artificial Sequence
  Description of Artificial Sequence: Synthetic coding sequence
atggttaatgagaacacgcggatgtatatcccagaggaaaaccaccagggaagcaactacggcagtccccgccctgcacacgccaatatgaacgcaaacgcagctgccggtttggcgccagagcatataccgacacctggggccgcactcagctggcaggccgccatagacgcagccagacaggcgaagcttatggggagtgcgggaaatgcaacgatatccacagtcagttcaactcagaggaaacgccagcagtacggaaagcctaagaagcagggctcgactaccgccactagacctcccagagccctgttatgtctaactctgaagaaccctattaggcgtgcttgcatatcaatcgtcgagtggaaaccatttgaaatcattatcctactgaccatctttgctaattgtgtggctctggcaatttatattcccttcccagaggacgattcaaatgccacgaactctaacctagaacgggtggaatatctgtttttaatcatcttcaccgtcgaggctttcctgaaggtaatagcctatggtctcctgtttcatcccaatgcgtacctgcgaaatggctggaacctgcttgacttcataatcgtcgtggtgggcctctttagcgccatcctggaacaagccacaaaagctgacggagccaatgctttaggagggaagggggcaggtttcgatgtgaaagctctacgggccttcagagtgctgcgtcccctaagactggtgtctggagtcccttccctgcaggttgttctgaattcaataatcaaagccatggtccccctcctgcatatcgctctactggtcttattcgtgataataatatatgccattatcggcttggagctgttcatgggcaaaatgcacaagacctgttataatcaggaaggaatcgccgatgtacctgcggaagatgacccgtctccctgcgccctcgagaccgggcatggcagacagtgtcagaacggcaccgtctgtaaaccgggctgggacggacccaaacacggcatcacgaattttgataactttgctttcgcaatgttgactgtgttccaatgtatcacaatggaaggatggactgacgttctgtactggatgcaggacgccatgggctatgaactgccgtgggtctattttgttagtctggtgatcttcggctcctttttcgtgttaaaccttgttctaggggttctttctggcgagttcagcaaggagagagaaaaagccaaggctagaggggatttccagaagttgagagagaagcagcaactggaagaggacctgaagggttatctggattggatcactcaggctgaggacatcgatccagaaaatgaggatgaagggatggacgaggagaaaccccggaatatgtccatgcccaccagcgaaacagaatccgtgaacaccgagaacgtagcgggcggtgatatagagggggaaaactgtggagcccggctcgctcacagaatctctaaaagtaaattctcccggtactggcgtcgctggaatcgattttgccgccgtaagtgtagggctgcagtcaagtccaatgttttttactggctggtgatcttcctggtcttcctgaacacgttgacaatcgcgagcgagcactataatcagccgaattggttgactgaggttcaggacaccgccaataaggccctgttggccttattcacagctgaaatgctgctcaagatgtattccttaggactacaggcctacttcgtgtctctgtttaacagattcgactgcttcgtcgtttgcgggggcatactcgaaactatattggtagagacgaagataatgtcccccctcggaatcagcgtgctaaggtgcgtgcgattgcttcgcatcttcaagatcacaagatattggaattctttgagcaacctggtggcctctttgctgaacagcgtcaggtcaatagcctcgttgctgctgctgctgtttctatttatcattattttcagtctgctgggcatgcagttattcggaggtaaattcaatttcgacgaaatgcagacccgtaggtcaacatttgacaattttccacaatccctgttgacagtcttccagatactgaccggcgaagactggaattcagtaatgtatgatgggatcatggcctacggcggaccctcttttccagggatgctggtgtgcatctactttattattctcttcatctgtggtaactatatcctgctgaatgtgttcttagctatcgccgtggataatttagctgatgcagagtctctcactagcgcccagaaggaggaagaggaggaaaaggagcggaagaagctcgccagaacagctagcccagagaagaagcaagaactagtagagaagccagccgtgggcgaaagcaaggaagagaagattgagctcaagtctattacagccgatggagagtctccccctgccacaaaaattaacatggacgacctgcagcccaatgagaacgaagacaagagcccatatcctaatcctgaaacgacaggcgaagaggatgaggaagaacccgagatgcccgtggggccacggccccggccgctctcggagctccacctgaaagaaaaagccgtacccatgcccgaagccagtgccttttttatattttctagtaataatcgattccgactccagtgtcaccgtatcgtcaatgatactatttttacaaaccttattctcttttttatactcctcagttccatctcgcttgctgccgaggatccggtgcaacacacgtcttttagaaatcacatcctcttttacttcgatattgtgttcacgaccattttcacgatcgagatcgccctgaagatgaccgcttatggggcgtttctgcacaaaggtagcttttgcaggaattacttcaatatcctggacctgctagtggtgtcagtaagtctaatatcgtttgggatacagtcatcggctatcaacgtcgtgaagattctccgagtgctccgtgtcctgaggccccttcgggcaatcaatagagcgaagggactcaagcatgtagtacagtgtgttttcgtggccatccggacaatcggaaatatcgtcattgtaactacactcctccagtttatgttcgcatgcatcggggtgcagctgttcaaaggaaagttatatacatgttccgattcttctaaacaaactgaggccgagtgtaagggcaattatattacctacaaggacggtgaagtggatcatcccattatccaaccacggagctgggagaatagcaagttcgacttcgacaatgtgcttgctgcaatgatggctctgttcactgtcagtactttcgaaggctggcccgagctgttgtaccggtcaatcgattctcatacagaggacaaaggaccgatctataactatcgtgtggagattagcattttctttatcatctatatcataatcattgctttcttcatgatgaatattttcgtggggttcgtgattgtcacgttccaggagcagggtgaacaggagtataagaactgcgagctcgataaaaatcagcgccagtgcgtcgagtacgcgctgaaagcccgaccactgcgccgttacatccccaaaaatcaacaccagtacaaggtttggtatgtagtgaactctacatacttcgaatacctgatgtttgtgttaatcctgttgaacacaatttgcctcgccatgcaacactatggacagtcctgcctgtttaaaatcgcaatgaacatccttaatatgcttttcactggactctttacagttgagatgatcctcaagctaattgctttcaagccaaaacactatttctgcgacgcttggaacacgttcgatgcactgatcgtggtgggctcgattgttgacatcgcaatcacagaggtcaatcctgctgagcatactcagtgttctccatctatgaatgcagaggaaaactctcgtatcagcattactttttttagacttttccgggtgatgcgcttggtcaagcttctgtcacggggtgaggggattcgcacattgctttggacatttattaaatcgtttcaagccctgccttacgtggccttactgatcgtgatgttgttcttcatatatgccgtgatcggcatgcaggtgttcggtaaaatcgcactgaatgatactacagagattaaccgaaataataactttcaaacgttcccacaggccgtgttgttgctattccggtgtgccaccggtgaagcctggcaggacatcatgcttgcctgtatgcccgggaaaaaatgtgcccctgaatccgagccgagcaatagcactgaaggagaaaccccttgtgggagcagtttcgctgtgttctacttcataagcttttatatgttatgtgcgttccttattattaacctgttcgtagctgtgattatggacaacttcgattacttaacacgtgactggagcatcttagggcctcatcatttggacgaatttaaacgaatttgggctgagtatgaccctgaagcgaaaggtcggattaaacatctggacgtggtgactctgctgaggagaatacaaccccccctcggcttcgggaagctgtgcccccacagagtggcctgcaagagattggtttccatgaatatgcctctcaattcagacggcaccgtgatgttcaatgctacactgtttgctcttgttagaacagcactcagaattaagaccgaaggtaacctggagcaggccaatgaagaacttcgagcaattataaaaaagatctggaagcgcacgagtatgaaacttctggaccaagtggtgccacctgctggtgacgacgaagtaacagtggggaaattttacgcaacttttctgattcaagagtattttcggaagttcaaaaaacgtaaggagcaaggcctcgtgggcaagccatctcaaagaaacgctctctctctgcaggccgggctcagaacactccatgatatcgggcctgagatacgccgggcaatctccggcgatctgacggcagaggaagaacttgataaagctatgaaggaagctgtgtccgccgcaagtgaggatgatatttttagacgagccggcggcctcttcggcaaccacgttagttactaccagagcgatggtcgtagcgccttccctcaaaccttcacaacccagaggccactccacatcaacaaggccggtagtagtcagggagacacagaaagcccaagtcacgagaaactagtggacagcacattcactccaagctcctacagcagtacggggtccaacgctaacattaataacgctaataatactgccctgggtaggttacctcgcccggcgggatatcccagtaccgtctccacggtggagggtcacggtccacccctgtccccagcaatccgggtgcaggaggtcgcttggaagctcagctcaaatagaatgcactgttgcgatatgcttgatgggggtactttccctccagccctcggacccaggcgggccccaccctgtctgcaccagcaacttcaaggcagcttagctggcctacgtgaagatacaccctgcatcgtcccaggccacgcctccctttgctgttcctcacgggtgggagaatggcttccagccgggtgcacagcccctcagcatgctagatgccatagccgggaatctcaggccgctatggcagggcaggaagaaacatcacaagacgaaacttatgaggtcaaaatgaatcatgacacagaagcttgttctgagccgagcctgttatcaaccgagatgttgtcttaccaggatgatgaaaaccgccagctcactctgccagaagaagacaaacgcgatatcaggcaatctcccaagcgaggcttcctgaggagcgctagtcttggacgccgagcatcattccacttggaatgcctaaagagacagaaagaccggggaggagacatcagccaaaagaccgttctgccgctgcacctggtccaccaccaggcactcgcggtggcaggtctttctccactactgcagcgcagccattctcctgcctctttcccccggccctttgctaccccccctgcgacaccaggatctcggggctggcctcctcagcctgtgccgactctgaggctggaaggagtggagagctcagagaagctcaactcctctttcccatccatccactgcggatcttgggctgagaccaccccgggaggcggcggaagttccgctgcacgacgcgttaggcccgtgagcctgatggtgccgtcccaagctggcgcccctggacgtcaatttcatggttccgccagcagtctggtcgaggccgtgttgatcagtgagggacttgggcagttcgcccaagatcccaagttcattgaggtgacaacacaggaacttgccgatgcctgtgatatgactatagaagagatggagagcgcagctgacaatatcctgtctggcggtgctcctcagtctccaaatggcgctttgcttcccttcgtcaattgtagagatgccgggcaggaccgcgctggcggcgaggaagacgcggggtgcgtgcgcgccagaggcagacctagcgaggaggagttgcaggactcaagagtgtacgtctccagcctttag

SEQ ID NO: 110427 - DNA, 6474 bp, Artificial Sequence
  Description of Artificial Sequence: Synthetic coding sequence
atggtgaatgagaacactcggatgtacattcctgaggagaaccaccagggttcaaattatggaagcccacgcccagcacacgctaatatgaacgctaatgctgcggctggcttagccccagaacatatacctacccccggggcagcgctgtcttggcaggctgctattgacgctgctaggcaagccaagctcatggggagcgcaggcaatgctacaattagcactgtgagcagtacacaacggaagagacagcagtacgggaagcccaaaaaacagggctctacaacagctaccagaccacctagggctctgctatgcctcacacttaagaaccctatccggcgtgcttgtatttccattgtggagtggaagcctttcgagataatcatactgcttactattttcgcgaactgtgtggccttggccatttatatcccctttccagaggatgatagcaatgccactaatagcaacctggaaagggtggagtatctatttctgatcatttttacggttgaggcgttcttgaaggtgattgcttacggcctgctgtttcatcctaatgcttacctgcgtaatggatggaatctcctggactttatcatcgtggttgtggggctgttctctgctatactggaacaagccacgaaagccgatggagcgaatgcactaggtggcaaaggcgcaggttttgacgtcaaagcactccgggccttccgtgttctgcggcccttgcggctggtctccggcgtgcccagcctgcaagtcgtactcaatagcattattaaagctatggtgcccctgctgcacatagctctgttggtgctgttcgtgattatcatttacgctattataggactggaactgtttatgggaaaaatgcataagacctgttataaccaggaagggatcgcagatgtccctgccgaggatgatcctagcccttgcgccctggaaactgggcacggccgccagtgccaaaatggaacggtgtgtaaacctggttgggacggcccgaagcacgggatcacaaactttgacaatttcgcctttgctatgctgacggtgtttcagtgcattacgatggaaggatggaccgacgttctttattgggtcaacgatgcagtcggccgtgactggccatggatttactttgtgaccctgatcatcatcggtagcttctttgtcttgaacctggtgctaggggtgctgtccggcgagttttccaaggagcgtgagaaggccaaagcacgtggggattttcagaaactacgagagaagcaacagctggaagaggatctgaagggctacctggactggattactcaagctgaagatatcgacccggaaaacgaagatgaagggatggatgaggagaagccaagaaatatgtctatgcccacttccgagactgaatcagttaatacggaaaacgtcgccggcggcgacatcgagggagagaactgtggcgcccgcctcgcacaccggatctctaagtcaaagttctccaggtattggagacgatggaaccggttctgcaggcgcaaatgcagggccgccgttaaatcgaatgtgttttactggctggtgatcttcttagtgtttctgaacactctgacgattgcaagcgaacactacaatcagcccaattggctcactgaggtgcaggacaccgccaataaagcactccttgccctgttcactgctgagatgctcctgaagatgtacagtctggggttacaagcctacttcgtatcattgtttaacagatttgactgcttcgtggtgtgtgggggtatactggaaactattctggtcgagaccaaaattatgagtcctttaggcatttcagtacttcgttgcgtccgcctgctgcgcattttcaagataactcggtactggaactccctgagcaatttagtcgcgagcctcttgaattccgttaggtctatcgccagtctgttgctgcttctgttcttattcataatcattttctccttgctgggaatgcagctgtttgggggcaagttcaatttcgacgaaatgcagaccaggagaagcacctttgacaatttcccccagagcctcctcaccgtgttccagatcctgaccggagaggactggaactcggtgatgtatgatggaattatggcctacggcggcccaagttttcccggtatgcttgtgtgtatctattttattatcctcttcatatgcggtaattacatcctactgaacgtgtttctggccattgccgttgacaacctggctgatgctgaatcactcacatctgctcaaaaagaggaggaagaagaaaaggaacgtaaaaagctggcgagaaccgcctcgcctgagaaaaaacaggaattagtggaaaagcccgcagtgggggagagcaaggaggaaaagattgagctgaagtcaataactgccgatggcgagtcccctcctgcgactaagatcaatatggacgatcttcagccgaacgagaatgaagataagagcccttatcccaaccctgagaccaccggagaagaagatgaggaagagcccgaaatgcccgtcggtccaaggccacgacctttgtccgaattgcacctgaaggaaaaggctgtgccaatgcccgaagctagtgcgtttttcatcttctcatccaataaccggttcaggctacagtgccacagaatcgtgaacgacactatctttactaatcttatcctctttttcattctgctatctagcatctccctggccgccgaagatcccgtacaacacacttctttccgcaatcacatcttagggaacgctgactacgtctttaccagcatcttcaccctggaaatcatactgaagatgacggcttatggcgcatttttgcacaaggggtccttctgccgcaactattttaacatcctggatctgcttgtcgtttcagtatccctcatctccttcgggatacagagctctgccattaacgtggtcaaaattctaagagtgctccgggttttaaggcctctgagggcgataaatagggcgaaaggcctgaaacatgtggtgcagtgtgtttttgttgccatcaggacaattggcaacattgtgatcgttactaccctccttcagtttatgttcgcttgcattggagtccagctgttcaaaggtaaactgtacacatgcagtgactctagcaaacagactgaggcagaatgcaaaggaaattatatcacttataaagatggggaagtagaccaccctattatccagcctaggtcatgggaaaatagcaagttcgactttgataatgtgttagctgcgatgatggccctcttcactgtttcaaccttcgaagggtggccagagctgctgtaccggtctattgacagtcacacagaagacaaagggccaatctataactacagggttgagataagcatcttttttatcatttacattatcataattgctttttttatgatgaatatctttgtaggcttcgtgattgtaacgtttcaagaacagggggaacaagagtacaaaaactgtgagctcgacaagaaccaaaggcagtgtgtggaatacgctttgaaggcacgtcctcttcgcagatacatccctaagaaccaacatcagtataaggtctggtatgttgttaactctacgtacttcgaatacctgatgttcgtattaattctccttaataccatatgcctcgccatgcagcactatggccagtcttgtctttttaaaatagccatgaatattctgaatatgttattcacagggttattcacggtggagatgatcttgaagctgattgctttcaagcccaaacactatttttgtgatgcctggaatacattcgacgctcttatagtggtggggtcaattgtcgatattgccatcacagaagttaaccctgccgagcacacacagtgctcgccaagcatgaacgctgaagagaacagccggatctccataaccttcttcaggctgttcagggttatgagactggtgaaactgttgagccggggtgaggggattcggacgctgctgtggacatttatcaaatcattccaagcgctcccttacgttgcactcctgattgtcatgctcttctttatctacgcagtgattgggatgcaggtctttggaaagatcgcccttaacgatactacagaaattaatagaaataacaatttccaaaccttccctcaggccgtgttgcttctctttaggtgtgccacgggagaagcctggcaggacattatgctcgcatgcatgcccggtaagaaatgcgcacccgagagcgagccctctaactccacagagggagagaccccttgtggtagctcctttgccgttttctactttattagtttctacatgctctgcgccttccttataataaatctcttcgtcgccgtaataatggacaatttcgactatctgacccgcgattggtctattctagggcctcaccacctcgatgagtttaagcgtatctgggcagaatatgatcctgaggcgaaaggtcgcattaagcaccttgacgtagtgaccttgctgaggagaatccagccgcctctcgggtttgggaaactctgtccgcaccgggttgcatgtaagcgactagtctcaatgaacatgcctttgaatagtgatggcaccgtgatgtttaacgcaaccctgttcgcgctagtgcgcactgcgctcaggattaagacagaggaagggccctctccttcagaagcacatcaaggcgcggaagatcccttcaggccagctggcaacttagaacaggcgaacgaagagttaagagccattatcaaaaagatttggaaacgaacctctatgaaactgctagatcaggtcgtgcccccggccggcgatgatgaagtgaccgttggtaaattttatgccacttttctgatccaggaatacttccgaaagtttaagaagcgcaaggagcagggcttggtcggcaaacctagccagagaaatgccctttctctgcaggctgggctgagaacactgcacgatattggtccagagatcaggcgtgcgatctccggcgatcttacggccgaggaggaattagataaagctatgaaagaagcggtgtcagccgcctctgaagatgacatattccgacgagccggtgggttgttcggaaaccatgtcagttactaccaaagcgatgggcgcagtgcgtttccccaaacctttaccacacaaaggcctctgcacatcaataaggctggttcatctcagggggacaccgagtcacccagtcacgagaaattggttgattccacgttcacgccatcttcctatagctcaactggatcgaacgcaaatatcaacaacgcaaacaacacagcccttggaaggctccctcgacctgccgggtatccctccaccgtgtccacagtcgagggccatggccctccactgagccccgctattagagtacaagaagtggcgtggaagttaagctcaaacagatgccatagtcgggagtctcaagccgccatggccggacaggaggaaacctcccaagatgaaacctacgaagtcaaaatgaatcatgacaccgaagcttgttctgagccatcactgttgagtacggagatgttgtcatatcaggatgacgagaaccggcagctaaccctccctgaagaggataagcgggacattcgccaaagtcctaagagggggtttcttaggtctgctagtctgggcagacgcgccagcttccacttagagtgccttaagcggcagaaagacaggggaggcgatatctcacagaagacggtgttgcccctccacttggtgcatcatcaggcccttgctgtggcaggactgagccccttactacagagaagtcattccccggcctctttcccaagaccctttgctaccccacctgctacacccgggagtagaggctggccccctcagcccgtgcccactttgcgcctcgaaggggtagaaagtagcgaaaagctgaattccagctttccatccatacactgtggaagttgggccgagacaactccagggggtggcggcagttccgcagctcgccgcgtgaggccggtgtcattgatggttccctctcaggccggggccccaggccgccagttccacggatctgctagcagcttagtggaagccgtcttgatcagcgaggggcttggccagtttgcacaagaccccaagtttatcgaagttactacacaggagctggcagatgcttgcgacatgacgatcgaggagatggagagtgctgccgacaatatcctaagcggtggcgccccacagagccctaacggcgccctactgccatttgtgaattgcagggacgcaggccaggatagagccggaggagaggaagacgctggttgtgttagggccagggggcggccaagcgaggaggaactgcaggacagtagggtgtacgtttccagcctatag

SEQ ID NO: 110428 - DNA, 6501 bp, Artificial Sequence
  Description of Artificial Sequence: Synthetic coding sequence
atggttaacgaaaatacacgaatgtacatccccgaagaaaatcaccaagggagtaactatggttcaccacgacctgcacacgctaatatgaatgccaacgcagccgccggtctggcacccgagcacatccctactcccggcgctgccttatcctggcaggccgctatcgacgctgctagacaggccaaactgatggggtccgctgggaatgctacaatcagtaccgtttcttccacacagaggaagcgccagcagtacggaaagccaaagaagcaagggtccaccacagcaactcggcctccccgagccctcctgtgcctcactttgaagaaccccatacgccgcgcttgtatatctatcgtggaatggaagccttttgagattattattctgttaactatttttgccaactgtgtggcactcgctatctacattccgttcccggaggatgatagcaacgcgaccaacagtaatcttgagagagtggagtacttattcctcattatctttacagttgaagcattcctgaaggtgatcgcgtatgggttactgttccacccgaacgcctacctaaggaatggatggaatctcctggatttcatcatcgtagtggtcggattgttctctgccatcctcgaacaggcaacaaaagctgatggcgctaacgctctgggaggcaaaggagctgggttcgatgtaaaagcccttcgggctttccgcgtgctgcggcctttaaggcttgtttccggcgttccatctctacaagtggtactgaatagcattataaaggctatggtacctctgctgcacattgcgctgttggtacttttcgtcataatcatatatgcaatcatcggactcgaactgttcatggggaagatgcataagacatgctacaaccaagaaggcatcgccgatgtacctgccgaggacgatcctagcccttgtgcactcgaaaccggacacggcaggcaatgccagaacggaacagtgtgcaaacccgggtgggacggcccaaagcatggtattacgaacttcgacaattttgcctttgcaatgctgacagtcttccagtgcattactatggagggatggaccgacgtactttactgggtcaatgacgcagtcggcagggattggccatggatctatttcgttactctcattattattggttcctttttcgtgttaaacctggttcttggcgttctcagtggcgagttttcaaaggagagagagaaggcaaaggccagaggtgactttcagaagttgcgggaaaaacagcagctggaagaggacctgaaaggatatttggattggatcacacaagccgaagatattgatccagaaaatgaggacgaagggatggacgaggagaagccacgcaatatgtccatgcctacatccgagacggagtctgtcaatacagagaatgtcgccggcggcgacatagaaggcgagaactgtggtgccaggctggctcacagaatcagcaagtccaagttcagtagatattggaggagatggaaccgtttttgccgcaggaagtgtcgggcagctgtgaagtcaaatgtcttctattggctggtgatatttctggtttttctcaatactctgacaatcgcttctgagcattacaaccaaccaaattggttgaccgaggtgcaggacacagcaaataaggccctgcttgccctgttcacggcagaaatgctgctgaaaatgtacagtctcggcctgcaggcgtactttgtctcactgttcaaccggttcgactgcttcgttgtttgtgggggcatcttggaaacaattctcgtagagactaaaattatgtcacccctgggtatctcggtgctgaggtgcgtgcggttgctgcgaatattcaagatcaccaggtattggaattccctcagcaatttggtcgccagtctccttaactctgtacgcagtatcgcgtcgttattgctattgctgtttctgttcatcataattttctcactccttggcatgcaactgttcggaggcaaatttaatttcgatgaaatgcagaccaggcgcagcacctttgataatttcccgcagtctttgcttactgtttttcagattctgaccggggaagattggaattcagttatgtatgatgggatcatggcatacggaggccccagctttcctggcatgctggtgtgtatttactttataattctgttcatatgcggcaattacattctcctcaacgtattcttggccatcgccgtcgataacctagccgatgctgagagcttaacgagcgcccaaaaagaggaggaggaagagaaggaacggaagaagttggctcggacagcatcacctgagaaaaaacaggagcttgtggagaaacctgccgtgggggagagcaaggaggagaaaattgagctgaagtccatcaccgctgatggagaaagccctcccgcaactaaaattaatatggatgatctgcaacccaatgaaaacgaggataagagcccctacccaaaccctgaaactactggcgaggaagatgaggaagaacccgaaatgccagtaggaccacgtccaaggcccttgtctgagctccacctgaaggaaaaagccgttcccatgccggaggcaagcgcattttttatcttctccagtaacaatagatttagactgcagtgtcacaggatcgtgaatgatactatcttcaccaacttaatcctgttttttatcctactctcaagtatctccctggccgccgaagatccagtgcagcatacttcgttccgtaaccacatcctgttttacttcgacattgtcttcacaaccatctttacgattgagattgctctgaagatgaccgcctatggggcattcctgcataaaggatctttctgccgcaattattttaacatcctggatttgctcgtggtcagcgtgtctctaattagtttcgggatccaaagctctgccattaatgttgttaaaatccttagggtgttacgggttctaagaccactacgagcgataaatcgggccaaaggcctgaagcatgtggtccagtgtgtgtttgtcgccattcggacaattggcaacatcgtaatagtcacgactctgctgcagttcatgtttgcttgcatcggagtgcagctattcaagggcaaattgtacacctgttcggactccagtaagcagactgaagccgagtgtaagggcaattacattacgtacaaggacggtgaggtcgatcatcctatcatccaacccagaagttgggagaattccaagttcgattttgacaacgtcttagcagctatgatggctcttttcacagtctccacttttgagggctggcccgagctcttgtacaggtctatcgattctcacaccgaagataaaggacccatctacaattaccgcgtcgagatttctattttctttattatctacatcatcatcattgcgttctttatgatgaacatatttgtcggctttgtgatagtcacattccaggagcagggagagcaggagtacaaaaattgcgaactggacaagaatcaaaggcaatgtgttgaatatgccctaaaagcccgacctctccgacgctacattccaaaaaatcaacatcagtacaaagtctggtacgtggtgaactcgacctacttcgagtaccttatgtttgtgttgattctcctgaacactatatgcttggcaatgcaacattacggccagagctgtctgtttaaaattgcaatgaacatcctaaatatgttgttcactgggttattcacggtggagatgattctgaaattaattgcgttcaagcctaagggttatttctccgatccatggaatgtgttcgacttcttgattgtcattggctctatcatagacgtgatattatccgaaaccaaccactatttctgcgacgcttggaacacattcgatgctctgatagttgtagggtctattgtggacatcgcaattacagaagtaaaccccgcagaacacacccagtgtagtccgagcatgaacgccgaagagaactctaggatttcaattactttttttagactcttccgcgttatgaggttggtgaaattgcttagccggggcgagggaatccgcactctgctttggacgtttatcaaatccttccaggctctcccgtatgtcgctctcctgatagtgatgctgttcttcatatatgctgtgattgggatgcaggtgtttggtaagatagcactgaatgatactactgagattaacagaaacaataacttccagacgtttccccaggcagtgcttttgctgtttcggtgtgcaactggtgaggcatggcaggacattatgctagcgtgtatgcctggcaagaaatgtgccccagaatccgaaccctcaaactccaccgaaggagagacgccctgtggttcctctttcgcggtgttttatttcattagcttctacatgttatgcgccttcctaataattaatctcttcgtcgcagtgatcatggacaactttgattacctcactcgagattggagtatcctgggcccacatcacttagatgagttcaaacgaatatgggcagagtacgaccctgaggctaaagggagaataaagcatctggatgtcgtcacactgttgcgacgcattcagccccccctcggtttcggaaaactttgtccccaccgggtggcgtgcaagagactggtgtccatgaatatgccccttaattcagatggaaccgtgatgttcaacgctaccctgttcgctctcgtgaggactgcattgcgcattaaaactgaaggcaatctcgagcaagctaacgaagagctcagagccatcattaagaaaatctggaaacgtacgtccatgaaattacttgatcaggtggtgccgccagctggagacgacgaagttacagtgggcaaattctatgctacgtttctgatacaggagtacttccgcaagtttaagaaacggaaggaacagggtctggtaggtaagcccagccagagaaatgcactgtcccttcaggcaggattgcggacactgcacgacataggcccagagatcaggcgggcgatttcaggtgatctgactgcagaggaggaactcgacaaagctatgaaggaagctgtgagcgccgccagcgaggacgatatcttcagacgggccggaggcctcttcggtaatcatgtgagttattatcaaagtgatggacggtctgcttttcctcagactttcaccactcaacgcccactacacatcaataaggccgggagttctcagggagacactgaatctccttcgcatgaaaaactggttgacagcacctttactcctagctcttactcctcaactggcagcaacgccaacattaataatgccaacaatactgccctcggtagattgcctcgaccagcaggctatccttctactgtctctactgtggaaggccatggccctcctctctcaccggctatccgtgtccaggaggttgcctggaagctttcctcaaacagatgccactcccgcgaatctcaggctgctatggccggtcaggaagaaacctcccaagatgaaacatacgaagtcaagatgaaccacgacaccgaggcttgtagcgagccttctctgctgtctaccgagatgctcagctaccaggatgacgaaaacagacagctgacattgcccgaggaggacaaacgagatattcgacaatcacctaaacgtggttttcttcgaagtgcatcactgggtcggagagcctcttttcatctagaatgcctgaaaaggcagaaggacagaggtggcgatataagccagaagacagttttacccctacacttagtgcaccatcaggcactggctgtagccgggttgtcacctctgctccagcgatcccattcacccgcttcttttcctagaccgttcgcaaccccacctgcaaccccggggagtagaggatggccacctcagccagtgccgacccttcgccttgagggagtagaatcatcagagaagctgaattcaagcttcccttccatccattgcggcagctgggcggaaaccaccccaggaggcggggggagcagcgccgcgaggagggtaaggcccgtaagcttaatggttccgagccaggcgggagcacctggacgacagtttcatggttcagcctctagtttggtcgaagctgttttgatttctgaaggcttgggccagttcgctcaagaccctaagtttattgaggtgactacacaggaattggcggacgcctgcgatatgacaatcgaggagatggaatctgccgctgacaacattctcagtggaggcgccccacagtcccccaacggcgctcttctcccatttgtgaattgtcgagacgccgggcaggacagggcaggcggtgaggaagacgctggttgcgttagagctcgagggcggccatctgaagaagagctccaggactcacgggtttatgtgtcttcactgtag

SEQ ID NO: 110429 - DNA, 6417 bp, Artificial Sequence
  Description of Artificial Sequence: Synthetic coding sequence
atggtaaacgagaatacccgtatgtatattcccgaggaaaaccatcaaggctctaactacgggtcgccacgcccagctcatgcaaacatgaacgctaacgccgccgcaggcctggcccctgaacacatcccaacccccggtgcggctctcagctggcaggccgccatagatgccgcccgccaggctaagctgatgggttccgcaggcaacgccacaattagcaccgtgtcaagcacacaacggaagcgccagcagtacggcaagccaaaaaaacagggatccaccactgccacccgaccgccacgtgccctactgtgcctcactttgaagaatcctatccgaagagcctgtatcagcattgtggaatggaagccgtttgaaatcatcattcttctcacaatatttgctaactgcgttgctcttgcaatctatattcctttccccgaggatgactctaatgccactaactccaacctagagagggtagaatatctgtttttgatcatctttaccgtcgaggctttcctgaaggtgatcgcctatgggctactgttccatcccaacgcgtatctcagaaacggctggaatcttctggattttattatcgtggtcgtggggctattcagtgctattctcgagcaggctaccaaggcagacggagcaaacgctctggggggcaaaggagctggattcgacgtaaaggccctacgcgccttccgcgtgctacggccgctccggctggtgtccggggtcccctcgctccaagtggttctgaattccattatcaaggcaatggttccgctcctgcacatcgcactgctggtgctgttcgtgatcatcatatatgcaatcattggtctggaactcttcatgggtaagatgcataagacctgttacaaccaagaaggaattgccgacgtgccggcggaagacgatccctcaccatgcgccttggaaacgggccacggacgacagtgtcagaacggtactgtgtgcaagcccggatgggacgggccaaagcacggcattacaaactttgacaacttcgcctttgctatgttaaccgtgttccagtgtattactatggagggttggactgacgtgctttattggatgcaagacgctatgggatacgagttaccgtgggtatattttgtctcactcgtcattttcggctccttttttgttctcaacttagtcttgggggtgttgtccggggagttttcaaaagaacgcgagaaagctaaggcccggggcgattttcagaagttaagagaaaaacagcagctggaggaagacctgaaaggatatttagattggatcactcaggccgaggacatcgatcccgagaacgaggacgagggcatggacgaagaaaaaccccgcaacatgtcgatgcctacctctgagactgaaagcgtgaacaccgagaatgttgccgggggggacatcgaaggcgagaactgcggcgcaaggctggctcacaggatatcaaagtccaagttctccagatactggaggaggtggaatcggttctgtagaaggaagtgcagagcagccgttaaatctaatgttttttattggctggtcatctttctcgtattcctgaacaccttaacaattgctagtgaacactacaatcaacctaactggctgaccgaagtgcaggatactgccaataaagcactgctggccctttttaccgcggagatgctcctgaaaatgtatagcttgggccttcaggcctattttgtgtcactctttaatcgcttcgactgctttgtcgtctgtggcgggatcctggaaactatcctggttgaaaccaagataatgagccctttgggcatcagtgtgttgaggtgtgtgcgattactacgcatctttaagataacacgctattggaactctctaagtaacctggtggctagcctcctgaattctgtgagatcaattgcatccttgctgctactactgttcctctttattattatattctccctcctggggatgcagctcttcggcggaaaatttaactttgacgagatgcaaacacgaagatccacattcgataactttcctcaaagtttactgactgtgtttcagattcttactggcgaggattggaatagcgtgatgtacgatggtattatggcctatgggggcccatctttccctggcatgttggtgtgcatttacttcatcatcctatttatttgcgggaactacatcttgcttaacgtgtttctggccattgctgtggacaatcttgccgatgccgagagtttgacatcagcgcagaaagaggaggaggaggagaaggaacggaaaaagctggcgagaacagcatcccccgagaagaaacaggaattggtggaaaaacccgcagttggggagtctaaggaggaaaagatcgaactcaagagcatcaccgcagacggggaatctccacctgctactaaaataaacatggatgatcttcagccaaacgagaatgaagacaaatcgccttacccgaatcccgagactactggcgaagaggatgaagaagaacccgagatgccagttgggccccgcccccgacctctgtcagaactacatctcaaagagaaagccgttcctatgcccgaggcatcagcattcttcattttttccagcaacaacagattccggcttcaatgtcacaggatcgtgaacgatacaatcttcacaaacctgatcttgttcttcattctcctaagtagtatttccttggcggccgaggatcccgttcagcacacttccttccgaaaccacattttgggcaatgcagactatgtgttcaccagtatttttacgctcgaaatcatcctcaaaatgactgcttacggtgcatttcttcataaaggtagcttttgtagaaattatttcaacattctggatttgcttgttgtgtccgttagccttatttccttcggaatccagtcatcagcaattaatgttgtcaagatcctgagggtcctcagagtcctgagacctctgagagccatcaaccgggctaagggcttgaaacacgtggtgcagtgcgtgttcgtagctatcaggaccattggtaacatagtcatcgtgaccacactgttgcaattcatgtttgcctgcatcggagttcagctatttaagggcaagctttacacttgttccgattctagtaagcagactgaagcggaatgcaagggaaactacatcacttacaaggatggggaagtcgaccacccgataatacagcctaggtcttgggaaaacagcaaattcgatttcgacaacgtactggcggctatgatggccctgtttacagtgtccacgtttgaaggttggccggaattattgtaccgcagcatcgactcccacacagaggataaaggtccaatctataattacagggttgaaatatctatcttcttcatcatttacatcatcatcattgcattctttatgatgaatatctttgtggggtttgttatcgtcactttccaggagcagggagagcaggagtacaaaaactgcgagctcgacaagaaccagagacagtgtgttgagtacgccctcaaggcccgtcctctcaggaggtacattccaaagaaccagcaccaatacaaagtgtggtatgtcgtcaactcaacttattttgagtatctgatgttcgtgcttatcctgctgaatacaatctgcctggcaatgcagcattatgggcagagttgcttgtttaagatcgccatgaacatattgaacatgctgttcacaggtctgtttaccgtggagatgatcctgaagttaattgcattcaagccaaagcactacttttgcgacgcctggaatactttcgatgccctgatagttgtggggtccatcgtcgatattgccattactgaggttaaccctgccgaacacacccagtgttcaccttccatgaatgctgaagagaattcaagaatctcaatcactttctttcgcctgttcagagtgatgagactggtcaagctcctatccaggggcgaggggattcgtaccttgctttggacctttatcaaaagcttccaggccctcccttatgttgccctgcttatcgtcatgctattcttcatctacgctgtcattgggatgcaggtgtttggcaagatagctttgaacgatacaactgaaatcaatcggaacaacaacttccaaactttcccgcaagctgttctcttgttatttcgctgtgctaccggcgaagcttggcaagatattatgctggcctgcatgcctggaaagaagtgcgctcccgagtctgaaccctccaactctactgagggggagacaccctgcggctctagctttgctgtcttttatttcatctctttctacatgttatgtgctttcttaatcattaacctgtttgtggccgtcattatggataacttcgactaccttactagggactggtccatcttggggcctcaccatctggacgagttcaagcgcatttgggcagagtacgatccagaggccaaaggtcgcatcaaacatctcgatgtggtgacgctgctgcgccgcattcaaccaccgctcggattcggcaaactttgccctcatcgagtggcttgcaagaggctcgtgagtatgaacatgcccctaaattctgacggcaccgtgatgttcaacgctacacttttcgccctggtcaggacagcactccgcattaaaacggaaggtaatcttgaacaggcaaatgaagaactacgggctatcattaaaaagatctggaagagaacctccatgaaactgttagatcaggtagtcccccccgctggcgacgacgaagtcacagtgggcaaattctatgctacgttcctgattcaagaatactttaggaagtttaagaagcggaaggagcaaggactggtgggaaaaccctctcaacgcaatgccctctcactgcaagccggcctccggaccttgcacgacataggtcctgagatccggagggccatctctggagatttaaccgccgaggaagaattggacaaggcaatgaaagaggcggtctccgcagcatccgaggatgatatcttcagaagagctgggggcctctttggcaatcacgtcagctactaccaatccgatggaagaagtgcttttcctcagaccttcactacacaacggcccttgcatataaacaaggcagggtctagccagggcgatactgagtccccgtctcatgagaagctggtcgacagtaccttcactcctagctcttattcctcaactggaagcaatgcgaatataaataacgccaacaataccgccctgggcagactcccaagacctgcgggatatccaagcactgtgtcaacagtggagggacatgggccccccttgtccccagcaattcgagtccaggaggtggcctggaaactctcttctaatcgctgtcactctcgcgagtcacaggcagccatggcagggcaagaggagacgtctcaggacgagacctatgaggtcaagatgaaccatgacacagaggcgtgctctgaacccagcctgttgtccacggagatgctctcttaccaggacgacgaaaaccgccagttaaccctgcctgaggaggacaaacgtgacataaggcagtctccaaaacgcggatttctgcggagcgcatccctgggcaggcgcgcttcgtttcatttggagtgcctgaagagacagaaggataggggtggtgatatatcgcagaaaaccgttctgccactccacttagtgcaccatcaggcgctggctgtggccgggctgtcacctctgctgcagcggtcccactcccccgcctccttcccccgccccttcgccacaccacccgctacacccggttcacgcgggtggcctccgcaacctgttcccaccctgcggctcgagggtgtggagagttccgaaaaactgaactctagcttcccgtccatacactgcggatcttgggccgaaaccacacctgggggcggcggttccagtgctgccaggagagtgcgtcccgtctctctgatggtgccgtctcaggccggggcccctggtcggcaattccatggttccgcatctagtctggtcgaggcggttctaatctcagagggcctcggccaattcgcacaagaccccaagttcattgaggtaaccacccaagaactggcagacgcatgtgatatgaccattgaggagatggagtcggccgccgataacatcctgagcgggggagccccccaatccccaaatggagcactgctgcccttcgtcaattgtcgagacgcaggccaggatcgagcagggggtgaggaagacgcaggatgcgtgcgggcccgtggcaggcccagcgaggaggagctacaagattccagagtttacgtttcttccttgtag

SEQ ID NO: 110430 - DNA, 6417 bp, Artificial Sequence
  Description of Artificial Sequence: Synthetic coding sequence
atggtcaatgagaatacaagaatgtatatcccagaggagaatcaccagggatccaattatggttccccccgccctgcgcacgccaatatgaatgcgaacgcagccgccggactggctccggaacatatacccactccaggcgctgcgctgtcttggcaggcggccatagacgcggcgcggcaggccaagctcatggggagcgcggggaacgctacaatctccacagtcagctctactcagcgcaagaggcagcagtatggaaagcctaaaaagcagggctcaactaccgccaccaggccccctcgcgcactcctttgcctgacactgaaaaatcccatcaggagagcctgtatctctatagtggagtggaaacccttcgagatcattatactcctgaccatcttcgccaattgtgtggccctggccatctacatccctttccctgaggacgactctaatgctaccaactcaaatctggagcgggtggaatacctgtttcttattatcttcaccgttgaggcgttcctgaaagttatagcatatgggctattgtttcaccccaacgcctatctcagaaatggttggaatctactagacttcattatcgttgtggtggggctcttttccgcaatcctcgagcaggccacaaaggccgacggagccaacgcactgggcggaaagggtgcaggattcgatgtaaaggcactccgcgccttcagggtgctccgccccttacgcttagtatcaggcgttccttcactgcaggtggtgttgaattccatcatcaaggctatggtccctttgcttcacatcgcattgctggtgttatttgttatcatcatctacgccattatagggcttgaactattcatgggtaagatgcataagacttgctataaccaagaggggatcgccgatgtccctgctgaggacgatccatctccgtgcgctctggaaactggacatgggaggcagtgtcagaatggtaccgtttgcaaaccagggtgggacgggcccaagcacggcatcacaaacttcgacaattttgcattcgctatgcttacagtctttcagtgtatcactatggagggctggactgatgtcctttattgggtgaatgatgctgtgggaagagactggccatggatttactttgtcactttaatcatcattggatctttctttgtgctgaatctcgtgctcggagtgctttccggggagttcagcaaagagcgagagaaggccaaggccagaggagacttccagaagctgagagaaaagcagcagctggaagaggacttgaagggatatctggattggattacccaagccgaagatatcgaccccgagaatgaggacgaaggtatggacgaggagaagccacgaaatatgagtatgcctacttctgagactgagagtgtgaacaccgaaaacgtcgccggcggagatatcgagggggagaattgtggagcccgcctggcgcatagaatcagcaagtccaagttcagccggtactggcgcagatggaataggttttgtcgccgcaaatgtagagctgctgttaagtctaacgtgttctactggctagtgatcttcttagttttcctaaacacccttacgatagcctccgagcactacaatcagccaaactggctcactgaagtccaagacactgccaataaagccctcctggcactgtttactgccgagatgctgcttaagatgtactcgcttgggctacaggcttactttgtcagcctttttaaccggtttgattgttttgtggtgtgcggcggcattttggagacaattctggtcgaaacaaaaatcatgtcgcctctcggtatttccgtgcttcggtgtgtgaggctcttacggattttcaagatcacccgatactggaacagtctgtccaacttagtagccagcctactcaactccgtcagatctatagcatcgttgctgctgcttctatttctcttcataatcattttctccctcctcggaatgcaactgtttggaggaaagtttaatttcgatgagatgcagacgcgcaggtctacctttgacaatttcccacaatctctgctcaccgtcttccagatcctgaccggggaagattggaacagtgttatgtatgatgggataatggcatatggaggtccaagctttccagggatgctggtgtgcatctattttattattctgtttatctgtggaaactacatcttacttaatgtgttcctagctattgcggtcgataacctggccgacgcagaatccctcacctcagctcaaaaggaggaggaggaagaaaaagagaggaaaaaattagcgcgaacggcgtctcccgagaaaaaacaggaactcgtggagaaaccagcagtcggcgagtccaaggaagagaaaattgagctgaagagcatcacggcggacggtgagtctcctccagcgaccaagattaacatggatgacttgcagcctaacgaaaacgaagacaagagtccatatcccaatccggagacaacaggcgaggaggatgaggaagagccagagatgcccgtgggtcccagaccccggcctctcagcgagctgcaccttaaggaaaaagccgtgcctatgcccgaggcctcagccttctttattttctcaagtaataatcgctttagactacaatgccatcgtatagtcaacgatacaatcttcactaacctgattctttttttcatattactatctagtatctccctggctgccgaggacccagtccaacatacctcattcaggaaccacatactggggaacgctgattatgtttttacctccatcttcaccctcgaaattattctcaagatgactgcttacggcgcttttctgcacaaaggctccttttgccgaaactatttcaatatactcgacctcctggtggtgagtgtctccctgatttcgtttggcatacagtccagcgcgattaatgtagtaaagatcctgcgcgtcttgcgggtccttagacccctcagggccataaacagagctaagggcctgaagcacgtggtgcagtgcgttttcgtggcaataagaactatcggtaatatcgttatcgtcaccacactacttcagtttatgttcgcgtgcattggagtgcagcttttcaagggaaaattatacacctgctcggactcctccaaacagacggaggcagagtgtaaggggaactatatcacgtacaaggacggtgaggtcgaccatcccattatacagcccaggtcgtgggagaatagtaaattcgattttgataatgtgcttgcagctatgatggctctattcacggtgtctacctttgagggatggcccgaactgctttacaggtccattgacagtcacacagaggacaaaggccccatttacaattatagggtcgagatctcaatcttcttcatcatctatattatcataattgcttttttcatgatgaatatcttcgtcggattcgtgatcgttacctttcaagagcagggcgagcaggagtataaaaattgtgaactggataaaaaccagaggcagtgcgtggagtatgctctaaaagccaggccattaaggagatatatccccaagaaccagcaccagtacaaggtgtggtacgttgtcaatagcacttatttcgaatacttaatgttcgtgctgatccttcttaatacaatctgcttggccatgcagcactacggacagtcgtgtcttttcaaaatcgccatgaacattctcaacatgctctttacaggcctgtttacggtcgaaatgattttgaagctgatcgcattcaagcccaagggctacttctctgacccttggaacgtatttgattttttgattgtcataggaagcattatcgatgtgatccttagcgagacgaaccccgccgagcacacccagtgtagtccctccatgaatgctgaggagaatagtcgaatttcaataacattttttcgcttgtttagggttatgaggcttgtcaaactgctttcccggggggagggtatcaggactctcctctggactttcatcaaatcctttcaggccctgccgtacgtggctctgttgatcgttatgcttttctttatttatgcagtaatcggtatgcaggtgtttggtaaaatcgcccttaatgatacaactgagatcaatcgaaacaataattttcagaccttcccacaggcagtcctcttgctgtttcggtgcgctaccggcgaggcatggcaggatatcatgctggcatgtatgcccggaaagaaatgtgcccccgagagcgagcctagtaattccaccgagggcgaaacaccctgcggatcttctttcgccgttttctactttatcagtttctatatgctctgtgccttcttgattattaacctgttcgtggcagtgatcatggacaactttgattaccttacaagagactggtcaatcctgggccctcaccatttggacgagtttaaacgcatctgggcagagtacgaccccgaggccaaaggcagaataaagcacttggatgtggtgaccctcttgcgccgaattcagccacctctcggattcggaaagctgtgtccccacagggtcgcctgcaagcgcttggtaagtatgaacatgccactcaatagcgacgggaccgtaatgtttaatgcaacccttttcgctctagttcgaactgccttaagaatcaagaccgaaggcaatctggagcaggccaacgaagagttaagggctataatcaaaaaaatctggaagagaaccagcatgaagctgctcgatcaggtcgtgcccccagccggtgatgatgaggtgaccgtcgggaagttctacgctacgttcttgatccaggaatattttagaaagttcaagaaacggaaggagcaggggctcgtagggaaaccaagccaacgcaatgcactttccctccaggctggcctgaggaccctgcacgatatcgggcccgaaatcaggagagcaatttccggagatttgacagctgaggaggaactcgataaggccatgaaagaggccgtttctgccgctagcgaagacgacatattccgccgggctggcgggcttttcggaaatcacgtatcttactaccaatctgacggccgatctgcctttccccagacatttactacccagcgcccactccatataaataaagctggaagctcccagggcgacacagaatcaccatcccatgaaaagctagtggactccacatttaccccatcttcatattcatcgacaggctctaatgccaatataaacaatgctaacaacaccgctctcggacggctacctcgccccgccggctaccccagcactgtctctaccgttgaaggtcatgggcccccgctaagcccagccatcagggttcaggaagtggcgtggaaattatcatcaaaccgctgccacagccgagaaagccaggctgctatggcaggccaggaagaaacaagccaggatgagacctatgaggtgaaaatgaatcacgacactgaagcatgctccgagccctccttgctttcaaccgagatgttaagttatcaggatgacgaaaatagacaactcacactccctgaagaggacaaacgagacattcggcagtctccaaagcgagggtttttgagatccgcttctctgggtcgtcgagcatccttccacctggagtgtctgaaaaggcaaaaagatcgaggtggcgatatatctcagaagactgtcctgcctttgcacttagtgcaccaccaagcgctcgctgtggcaggcctgtcgcccctcctgcaacggtcccatagtcctgcatccttccctagaccattcgccacccctcccgccactcctgggtctcggggatggcccccacaaccagtgcctacactgcgcctggaaggggtggagagctcagagaagctgaattcatcttttcccagtattcattgtgggagctgggccgaaacaacgcccgggggaggcggctcttctgccgcccgccgtgtgcgccccgtcagtcttatggtgccatcgcaagccggagcacccggacgacagtttcacggtagcgccagctctctggttgaagccgtacttatcagtgaagggctgggacagtttgcgcaggacccaaagttcatcgaggtaactactcaagaactcgctgacgcatgtgacatgacaattgaagaaatggaaagcgccgccgacaacatcctgagcggaggcgccccccagtcacctaatggtgccctcctaccttttgttaattgccgggacgccggccaagaccgcgccggaggcgaagaagacgctggatgcgtccgcgcgagagggcgcccatccgaggaggagcttcaggacagcagggtttatgtgagctctctttag

SEQ ID NO: 110431 - DNA, 6435 bp, Artificial Sequence
  Description of Artificial Sequence: Synthetic coding sequence
atggtcaatgaaaacacccgaatgtatatccctgaagagaatcatcaaggcagtaactatggttctcctcgaccagcccacgccaacatgaatgccaatgcagccgctgggcttgctcctgagcacatccccacccccggcgcagcgctctcctggcaggctgccattgacgcagcccgtcaggccaagctcatgggcagcgccgggaacgccaccatctctaccgtgtcatccacacaacggaaacggcagcagtacggcaagcccaaaaagcagggatcaactaccgctacgagaccccctcgcgccctactgtgtctgacgctgaagaaccctattaggagagcttgcattagcattgtcgagtggaagccttttgaaattattattctcctcactattttcgccaattgtgtcgccttagcgatctacattcctttcccagaggacgactccaatgccacaaatagcaacttagagcgggtcgagtacctctttttaatcattttcacagtcgaggcatttctgaaagttatcgcctacggtctgctgtttcacccaaatgcctacctccggaacgggtggaaccttctggactttattattgtcgttgtcgggctgttctcagctattcttgaacaggctacaaaggccgatggggccaatgcactggggggcaaaggagctgggttcgacgtcaaagccttgcgggctttcagggttcttaggcctcttagactcgtgtctggtgtaccgtcccttcaggtggtgctgaacagtatcataaaagctatggtgccccttcttcatatagccctgctggtcctgttcgtgatcattatttatgccattattgggttagaactcttcatgggcaaaatgcataagacatgttacaatcaggaagggattgctgacgtcccggctgaggatgatcctagtccttgtgctctcgagaccggtcacgggaggcagtgccaaaacggcactgtgtgcaagcccgggtgggacggccccaagcatggaattactaattttgataatttcgcttttgccatgcttacggttttccagtgtataaccatggaaggatggactgacgtgctttactgggtgaatgatgctgtgggtagagactggccgtggatttactttgtcactcttattatcattggtagctttttcgtcttaaatctggtgctgggagtgctgtccggggagtttagcaaagagcgcgaaaaggctaaggctcgcggagactttcagaagttgcgggaaaaacagcaactggaggaggatctcaaaggctatctggattggataacccaggccgaagatattgaccctgaaaacgaagatgagggcatggatgaggagaagccacgcaacatgtccatgcctactagtgagaccgagagtgtgaacaccgaaaatgtggccggcggagacattgagggcgagaattgcggtgcaagattagctcaccgaattagcaagtcaaagttctcaagatattggaggcgctggaacaggttttgtagacgtaagtgccgggcagccgtgaagtctaacgtgttctactggctggtaatctttctagtttttctgaacacgctcactattgcatctgagcactacaatcagccgaactggctgacagaagtgcaagacactgctaacaaggccctactggctctgtttacggccgagatgcttctcaaaatgtattccttaggcctgcaggcctattttgtgagcctcttcaatcgctttgactgctttgtcgtctgcgggggtatcctggagactatccttgtcgagaccaaaatcatgtctccgctcggtatttccgtgctgagatgcgtgcgcctgctcaggattttcaagattacacgctattggaacagtttatccaaccttgtggcttccttgctcaactcggtaagaagcattgccagtctcctgctcctcttgttcttgttcattataattttttccctgctgggcatgcagctgttcggaggcaagttcaatttcgacgaaatgcaaacacgacgctccacgtttgataatttcccacagtctctgctgaccgtgtttcaaatcctcactggagaggactggaactcagtgatgtatgacgggattatggcctacggcggcccatcatttccagggatgctggtgtgtatttattttatcattctgtttatttgtggaaattatattctgctcaatgtttttctggccattgctgtcgacaacctggcagacgcggaatcccttacatcggcacaaaaggaggaagaagaagaaaaggaaagaaagaaattagccaggaccgcttcaccggagaagaaacaggaacttgtcgagaagcccgctgttggggagtcgaaagaggaaaagattgaactgaagtccatcactgcagacggggagtctccccccgctacaaaaattaacatggacgatttacagcccaacgagaatgaggataaaagcccgtacccgaacccagagactacaggggaggaggatgaggaagagccagagatgcccgtcgggccccggcccaggcccttgtcggagcttcatcttaaagagaaagccgtgcccatgccggaggcctcggccttctttatattctcaagcaataaccggttcaggttgcagtgtcatagaatagttaatgataccatcttcaccaatttaatactcttcttcatactgctcagctccatcagtttggccgccgaagatcctgtgcagcacactagtttcaggaaccatatactgttctacttcgacatagtcttcacaactatctttactattgagattgcattgaaaatgactgcatacggcgcttttttgcacaaaggatccttctgcaggaattacttcaatattctagacctacttgttgtgtccgtgtccttgatttcgtttggcatccagtcatctgctattaacgtggtgaagatcctgagagtcctcagagttttacgccccctgcgcgccataaacagggccaaggggctgaaacacgtggtgcaatgcgtgtttgtggcaatccggactattggcaatattgtgatcgtaaccaccctcctacagttcatgttcgcttgtataggcgtccagctctttaaaggaaaactgtacacctgtagcgactcttcaaaacagaccgaagccgaatgcaaaggcaactatattacctataaggacggtgaagtggaccaccccatcatccagcccaggtcctgggaaaatagtaagttcgacttcgataacgtattggctgcaatgatggccctattcactgtctccactttcgagggctggcctgagctcctttatcgtagcattgactcccacaccgaggacaagggacccatatacaactatagagtggaaatttccatcttcttcatcatctacatcatcatcatcgccttcttcatgatgaatatcttcgtcggtttcgttattgtaacgttccaggaacagggagagcaggaatataagaactgtgaactcgataaaaaccaacggcagtgcgtggaatacgcccttaaggcccgccccctcagacgctatattccgaaaaatcagcaccaatacaaggtgtggtatgttgttaatagtacttactttgaatacctgatgttcgtattgatcctgctcaatacgatctgcctggcgatgcagcactacggccagagctgtctctttaagattgccatgaacattctgaacatgctattcacaggactctttactgtggagatgatactgaaacttattgcttttaaacccaagcactatttctgtgacgcatggaacacctttgatgctctgatcgtggtgggttccattgttgatattgccatcacggagaacgcagaggagaacagccggatttccattaccttctttcgccttttcagggtgatgcgcctggtgaaactgttaagtcgcggagagggaatccgtacactactatggacctttatcaagtctttccaggccttgccctatgtggccctgcttattgtgatgctcttttttatatacgcagtaatcgggatgcaggtgtttggcaagatcgctcttaatgacacgactgagataaaccgcaataacaacttccaaacctttccacaggcagtcctgttgctcttccgctgtgctactggggaggcctggcaggacatcatgctcgcatgcatgcccggtaagaagtgtgctccagaaagcgaaccgagtaatagtacggagggtgagaccccttgcggcagctcgtttgccgtattctactttattagcttctacatgctgtgtgccttcctgataatcaatctcttcgtcgcagtcataatggacaacttcgattatctaacccgggattggagtattctcgggcctcatcacctagatgagtttaaacgtatttgggccgagtatgatccagaagccaaaggtcgcataaaacacctcgacgtggtcactttgctccgtcggatacagcctcccctgggctttggaaagctgtgtccccaccgggtagcctgtaagcggctagtttccatgaatatgcctttgaattctgacggcacagtgatgttcaatgccactttatttgctcttgttcgaaccgctctccggatcaaaacggaggaggggcctagtccgtcagaggcccaccaaggcgcggaggaccctttccgccctgcaggtaatctggagcaggctaatgaggagctaagagccatcatcaagaagatttggaagcgaaccagtatgaaactgttggaccaggtggtgccgccggccggcgacgatgaagtcacagtaggcaagttctatgccaccttcctgatccaagagtacttccgaaaatttaagaaaaggaaggagcagggcctggtagggaaaccatctcagaggaatgcactttctctacaggctggcctgaggaccctccatgatatcggtcccgaaattcgaagggctatatcaggagatcttaccgctgaagaagagttggataaagccatgaaggaggccgtgtcagccgccagcgaagatgacatcttcagaagagcaggtggcctttttggtaatcatgtctcatactaccagtcagacggacgctccgcgtttccccagacttttacaacgcagcgcccactgcacatcaacaaagccggctcaagccagggtgacacagaatcaccttcacatgaaaagcttgtggatagcactttcaccccatccagctattcaagtaccgggtctaacgccaacatcaataatgccaataacacagccctcggtcgcctccccagaccagccggctacccatcaactgtgtccaccgttgagggccatggtccccctttgtcccctgccattagggtgcaagaggtagcttggaagctgagcagcaacaggtgccacagccgggaatcccaggcagcgatggcaggacaggaagaaacaagtcaggacgagacctacgaagttaagatgaaccatgatactgaggcttgtagtgaaccctctctgctgtctaccgagatgctgagttaccaggatgacgaaaacagacagttgaccttgcctgaggaggacaaacgcgatatccgccagagccctaaacgcgggttcctccgcagcgcctcgcttggtcggagagcgtcatttcatttggaatgccttaagcgtcagaaggatcggggcggcgatatctcgcagaagaccgtacttcctttacacctcgttcatcatcaagcccttgctgttgctggattgtccccactcctgcagaggtctcattcccccgcctcatttccccgcccttttgcaactccgccagccacgcccgggagcaggggatggccgcctcaacctgtgcccacactcagattggaaggtgtggagtcatccgaaaaattgaatagtagttttccgagtatccactgcggctcgtgggcagagacaaccccaggtgggggaggctcaagcgctgctaggagagttagacccgtaagtctcatggtcccaagtcaggcaggtgcacccggtcggcaattccacgggagcgcgtctagtctggtcgaggcagtcttgatttctgaaggcctgggccagtttgcccaggaccccaaattcatcgaagtaactactcaagaactggccgatgcctgtgatatgactatcgaggaaatggaaagtgctgcagataatattttgtctggcggagcaccacagtcgccaaacggcgcgctgttgccctttgtcaattgcagggacgctggacaggacagagccggaggagaagaggatgctggatgcgtgcgggcacggggccgcccatccgaggaggagttacaagactctagggtctacgtgagttccctgtag

SEQ ID NO: 110432 - DNA, 6417 bp, Artificial Sequence
  Description of Artificial Sequence: Synthetic coding sequence
atggtcaacgagaacactcgtatgtacatccctgaggaaaatcaccaggggagtaactatggctctccccggcccgctcacgcaaacatgaacgcgaatgccgcagccgggttagctcctgaacacattcctacacccggagccgccttgtcctggcaggctgccattgacgccgccagacaggcaaagttaatgggctccgccgggaacgccaccatcagtacagtgtcctcgactcagcgcaaacgccagcagtatgggaaaccaaaaaaacaggggagcacaacagcaacccggccacctcgggcactgctttgtttaactctgaagaaccctattagaagagcctgtatttcaatcgttgagtggaaaccattcgaaattattatactgcttaccatatttgctaactgtgtggctctcgccatttatattcccttccccgaggatgatagtaatgcgacaaactccaacctcgagagagtggaatacctgtttctcattatatttacagtggaagcttttctcaaagttattgcctatggactcttgtttcaccctaacgcataccttcggaatggctggaatctgcttgatttcattatcgtagtcgtggggctgttttcagcaatcctcgaacaagcaacaaaagcggatggagctaatgcgttaggcgggaagggcgctgggttcgacgtaaaggcattgagggcattcagagtcttacgcccactccgtctggttagcggagtcccttcactccaggtcgtgctgaattcaatcattaaagctatggttccactgctccacattgcccttctggtcttatttgtgattataatttacgcaattatcggactggagctgtttatgggtaagatgcacaagacttgttacaaccaggagggcatagccgacgtgccagccgaagatgacccgtccccttgtgctttagagactggacacggacgtcagtgccagaacggtacagtatgtaaacccggttgggacggccccaaacacgggatcacaaacttcgacaacttcgcatttgctatgctgactgtattccaatgtataacgatggagggctggacggatgtgctttactgggtgaacgacgcagttggtagggactggccatggatctacttcgttaccttgattattatcgggtccttctttgtactaaatctggtcctgggcgtgctgagcggtgagttttcaaaggagcgcgagaaagccaaggcccgcggcgattttcagaaactgcgcgagaaacagcagctggaggaagatctcaaaggctatctcgattggatcacacaggctgaagatattgaccccgagaacgaagacgaaggaatggatgaggagaaaccgagaaacatgtctatgccaacgagcgaaacagagtccgtcaacacagaaaacgtggctggcggtgacatagagggggagaattgcggagccaggctggcacaccgcattagcaaaagcaaattttctagatattggcggcgatggaaccgcttttgtagacggaaatgtagagctgccgttaaatccaacgtgttctactggctggttattttcctggtctttctgaatacactcaccatagcaagtgaacactacaaccaaccaaactggctgactgaggtgcaggacacagccaacaaggctctcttggctctgttcactgcggagatgctcctcaagatgtactctctgggtctccaagcctacttcgtctccctgttcaatcgatttgactgttttgtggtgtgtggaggcattctcgaaactatactcgtggaaacaaaaataatgtcccctctggggatctctgtgcttcgctgtgtgagacttctgcgcatattcaagattactcggtactggaattccctcagcaatcttgtggcgtccctgctcaatagcgtgcggagtatcgccagcctactgctgctactattcctctttatcattattttttcactgctcggaatgcagttgttcggcgggaaattcaattttgatgaaatgcagacccgtcggtctacctttgataactttcctcaaagcctgttaactgtgttccagatcctaactggagaggattggaactccgtcatgtatgatggaatcatggcatacggtggtccatccttccccggaatgttggtgtgcatctacttcatcatcctctttatctgtggcaactatattctgcttaacgtgtttcttgcaattgccgtagataacctggcagatgctgagtcgctgacttccgctcagaaggaagaggaagaggagaaggagagaaaaaagctcgctcgcacggcatctcccgagaaaaagcaggaacttgtcgagaagccagccgtcggcgaatctaaggaagaaaaaattgaactaaaatctatcactgcagatggtgagtcacctccagctaccaagatcaatatggatgacctccagcctaacgaaaacgaagataaaagcccttatcccaatcccgagacgactggagaagaagatgaggaggagcccgagatgcctgtgggcccccgtccgagacctctgtctgaattacatcttaaggagaaggcagtacctatgccagaggcaagtgcttttttcattttctctagcaataatcgcttccgcttgcaatgccataggattgtaaacgacaccatttttactaacctgatacttttttttatactcctttcctctattagcctggccgcagaagaccctgtccagcacacctcttttaggaaccatatacttttttatttcgacatagtcttcacaacaatatttacaatcgagatcgccctgaagatgaccgcttacggggcgtttctccacaaaggctccttctgcagaaattactttaacatcctggatcttctggtggtctctgtgagcctgatctcttttggtattcagtcctcggcaatcaacgtggtcaagatcctgcgtgtactgcgggttctaagaccgctgagagccattaaccgagctaaaggtctgaagcacgtggtccaatgcgtgtttgtggccatacgcaccatcggcaatattgtgatagtgaccacattgttacaattcatgtttgcctgtatcggggttcagcttttcaagggtaagttgtatacttgcagtgatagcagtaagcagaccgaggctgagtgcaagggcaactacattacctataaggacggggaggtagaccacccaattattcagccgagaagctgggagaatagcaagttcgactttgataacgtcctggccgccatgatggccctgttcaccgtatctaccttcgaggggtggcccgagttactatacagatcaattgatagtcacaccgaggataagggaccaatctataattaccgcgtagagatctccatctttttcattatctacattataataattgcattctttatgatgaatatttttgtcgggtttgtgatcgtgactttccaggagcagggtgaacaggagtacaagaattgcgaactagataagaaccaaaggcaatgcgtagagtacgcgttgaaagcccggcctctgcggaggtacatacccaagaaccaacatcagtataaggtgtggtatgtcgtcaattcaacatatttcgagtaccttatgtttgtgttaatcttgctgaacacgatatgcctcgccatgcagcattacggccaatcttgtttgtttaagattgctatgaacatcctgaacatgttatttaccggactgttcactgttgagatgattctgaaacttatagctttcaaacccaaacattacttttgcgatgcatggaacacattcgatgccctgattgtcgttgggtctattgttgatatcgcaattacagaagtgaatccagcggagcatacgcaatgctctccctctatgaacgcggaggagaattcgagaattagcatcacctttttccgattattccgcgtcatgaggctggtcaagctgctgtcgcggggagagggcatccggacactgctctggacttttatcaagtcattccaggccctgccatatgttgccttactgattgttatgttgttcttcatttatgccgttattggaatgcaagtattcggtaaaatagctcttaatgatacaacagaaattaacagaaacaacaacttccagactttccctcaggccgtcttgctcctatttcggtgcgcaacaggagaggcttggcaggacatcatgctggcttgtatgccaggtaaaaagtgcgcacctgagtccgaaccaagcaactctaccgagggggaaactccctgcggctcgagctttgccgtgttctacttcatctctttttatatgctgtgcgcatttcttatcattaatctcttcgtcgctgtcataatggacaactttgattatcttaccagagactggtccatactgggtcctcatcatttggacgagtttaaaagaatctgggccgagtacgaccctgaagccaaaggtagaataaagcacctggatgtcgtcacgctcctcaggcggatacagcccccactggggttcggaaagctttgccctcacagagtcgcatgcaagaggctggtgagcatgaatatgccactgaacagcgacgggacagtcatgttcaacgctaccctattcgccttagtaagaacagccctgcggataaagacagaaggtaatctcgaacaagccaatgaggagttgagggcaataatcaagaaaatctggaagcggactagcatgaagctgctcgaccaggttgtgccaccggcaggcgacgatgaggtcacggtggggaagttctatgcaacatttctgatccaggagtacttccgcaaatttaagaagaggaaagagcaagggctcgtggggaaaccatcacagaggaacgccctgagcctccaggctggattaagaacgcttcatgatatcggccccgaaataaggagggctatatcaggcgacctcacggctgaggaagagttggacaaagcaatgaaggaggccgtgagcgccgctagtgaagacgacatcttccggcgggctggcggtctcttcggaaaccacgtgagctattaccagtcggatggtcgatcagcctttccccagaccttcacaacacagcgaccgctgcacataaacaaggcaggatccagccagggagatacagagagtccctcccacgaaaaactggttgattctacctttacaccatcatcatacagcagcactgggagcaatgcaaacatcaacaacgccaacaatactgccctaggcagactcccgagacccgccggctatccctccacagtttccaccgtggaggggcacgggccccccctctcgccagcgattagagtccaggaagtcgcttggaagctgagtagtaacagatgccatagcagagagtcccaggcagccatggccggtcaggaggagactagccaagacgaaacgtacgaagtaaaaatgaaccacgatacagaagcctgctcggaaccgtctctgctgtctaccgaaatgctgagttatcaagatgacgagaatagacagctcacactgccagaggaggataagagggacatccggcagtctcccaaacgcggctttctgagatccgcctccttagggcgcagggctagtttccacctcgagtgcctcaagcggcagaaagatcgcgggggagatatcagtcaaaagaccgtacttcctctacatctggtacaccatcaggctctcgccgtggctggactgtcacctctgcttcaacgcagccattcccctgccagcttccctcgaccctttgccactcccccagcaaccccaggtagccgcggctggcctccccagcccgtccctaccctccgactggaaggcgtcgagtcctctgagaaattgaattccagttttcccagtattcattgtgggtcctgggcggagaccacccctggcggcggcggatcgagcgctgctagacgagtcagaccagttagcctgatggtcccttcccaagcaggtgctcctggacgacaatttcacggcagtgcaagttctctggtagaagctgtactgattagcgagggcctggggcaattcgcgcaagaccccaaattcattgaggttactactcaggagttggctgacgcttgcgatatgactattgaggagatggaatcggctgctgacaacatcttgtcgggtggagctccacagagcccaaacggggctctgctgccctttgtgaattgccgagatgctggtcaggaccgggcaggaggcgaggaggatgccggctgtgtgcgcgcgagggggcggccttccgaagaggagcttcaggatagtagagtgtatgtgagcagtctctag

SEQ ID NO: 110433 - DNA, 6474 bp, Artificial Sequence
  Description of Artificial Sequence: Synthetic coding sequence
atggtgaacgagaacacccgcatgtacattccggaagaaaatcaccagggcagtaactatggttcgccccgaccagcacacgccaatatgaacgcaaacgcggcggccggcttggctccagaacacatacccactccgggggcggccctgtcctggcaggctgctatcgatgctgcacggcaggcgaagcttatgggtagtgcagggaacgccacaataagcaccgtgtcatctactcagaggaagaggcaacaatacggcaagccgaagaaacaagggtcaacaactgccacccgccctccccgtgctctgctgtgtctgacactcaagaatcccatccgccgcgcctgcatttcgatcgtggagtggaaaccctttgagatcataatcctgttgactatattcgcgaattgtgttgcactcgccatttacataccgttcccggaggacgattctaacgcaactaactctaatctggaacgcgtggaatatctatttctgattatctttacagttgaagctttcctcaaggttatagcctacggacttctgttccaccctaatgcatatctgcgcaatggttggaacctgttggattttatcatcgtcgtcgtgggtcttttttcggcgatcctggagcaagcaaccaaggctgacggggccaacgctcttggcggcaaaggcgctgggttcgacgtcaaagctttgcgggcattcagggttctcaggccattacggctggtttcaggagtgccttcactgcaggtcgtgctaaactctattatcaaggctatggtgcccctactgcacattgccctcctagtcctgtttgtaattataatatacgctatcattggactggagttatttatgggcaaaatgcataaaacctgttacaaccaagagggtatcgccgacgtgcctgccgaggatgacccatcgccctgtgccctcgagacaggacacggcaggcagtgccagaatggcaccgtgtgcaagcccggctgggatggtcccaaacatggaattacgaatttcgacaatttcgctttcgcgatgctcacagtgtttcagtgtattaccatggagggctggaccgatgtactttattgggtcaacgatgccgtcggccgggattggccctggatctacttcgtgacattgatcattatcggaagcttcttcgtgctgaacctggtcctgggcgtgctatcgggggagttctccaaggaaagggagaaagcgaaagccagaggagattttcaaaagctgcgggagaaacaacagttggaagaggatctgaaaggctatctagattggataacccaagctgaagacattgatcctgagaatgaagacgagggcatggatgaagagaaacctagaaatatgtcaatgccaacgtcagagacggaaagcgtgaacacagaaaatgtggcggggggcgacatagagggcgagaattgtggcgcacgtctggcccatcggatctccaaatccaagttcagtaggtattggcgaagatggaacaggttttgccgaagaaaatgtcgcgctgcggtgaaatcaaacgtcttctactggctggtcatcttcctggtgttccttaatactttgaccatagccagtgaacattacaatcagcctaattggttgacagaagtgcaggatactgccaataaggccctgctggctttgtttaccgccgaaatgctgttgaagatgtactccctgggcctgcaggcttactttgtgagcctctttaacagatttgactgtttcgttgtctgtggaggaattctggagacaatcctggtggagactaagatcatgagcccactcgggatttccgtcctgcgatgcgtccgtttgctgcggatcttcaagattactcgatattggaactctttatccaacctcgtcgcaagtctgttgaattctgttcgctcaattgcctccttgctgctgctgttgtttctgtttatcattattttctcactcctaggcatgcagctctttggaggtaaatttaactttgacgagatgcagactcggaggtccacctttgataacttcccccaatctctactgaccgtgtttcagattttaacaggagaagattggaattctgtaatgtacgacggaattatggcatacggaggcccctcatttcccgggatgctggtctgtatctacttcatcatacttttcatatgtggaaactacattttacttaatgtgttcctcgctatcgctgtcgataacctcgccgacgctgaatccctcaccagtgcccagaaggaggaagaggaggaaaaagaaagaaagaagttggctcggaccgcttcgcctgagaagaagcaggagctcgttgaaaagcctgcagtgggcgaaagcaaggaggaaaagatagaattgaagtccatcaccgccgacggggagtcgccacccgctaccaaaatcaatatggacgatctacagccaaacgaaaatgaggacaaatctccataccccaatccagaaacaacgggcgaggaagacgaagaggaacccgaaatgcccgtgggcccgcgaccgcggccactttctgaacttcacctgaaagaaaaagccgtccctatgcctgaagcctctgcctttttcatcttctcctccaacaacaggttccggttacagtgccaccgaatagttaatgatacaattttcacaaatcttatcttattttttatcctcctctcttctatttcactggccgcagaggaccctgtacaacatacgtcttttcgaaatcacatcctgttttactttgatatcgtgtttaccacgatttttaccattgagattgcattgaagatgaccgcctacggggccttcctgcataagggcagcttttgtaggaactactttaatatcctggacttactggtggtgtcagtatctctcatctcctttgggatccagtccagtgcaatcaatgtggtcaagatccttcgcgtgcttagagttcttagacctctcagagccatcaacagggccaagggactgaagcatgtcgtccagtgcgtcttcgttgccatacggacaattggtaatatcgtcatcgtaacaacactcctgcaattcatgtttgcctgcatcggggtccagctcttcaagggaaaactgtacacctgtagcgattcctcaaagcagaccgaagcagaatgtaaggggaactacatcacttacaaggacggagaagtggatcacccgattatccagccccggagctgggaaaactcaaaattcgacttcgacaacgtgctggccgcaatgatggctctctttacggtgagtaccttcgaagggtggcctgaactcctgtatcggagcattgattcacacaccgaagataagggtcctatatataattaccgggtggagatttccatctttttcattatctatattatcatcatcgccttcttcatgatgaatatcttcgtgggttttgtaattgtgacgttccaggaacagggcgagcaagagtacaaaaattgtgagctcgataagaaccagaggcaatgcgtcgaatacgccctgaaggctcgaccgttacgccggtatataccaaagaaccaacatcagtacaaggtgtggtatgtggtgaattctacctactttgagtaccttatgttcgtgctgattctgctcaacaccatatgcctggcaatgcaacattacggccagagctgcctctttaaaatcgcgatgaacattttgaatatgttgtttaccggattgtttacagtcgagatgattttgaaactgattgcttttaaacccaaggggtacttctccgatccctggaacgtgttcgattttttgatcgtcatcggtagcattatcgatgtgatactaagtgagactaaccccgcagaacacactcagtgttcccctagcatgaacgccgaggagaacagcaggatctcgattacattcttcaggctcttcagggtgatgaggctcgtgaaattactatccaggggcgagggtatccggaccttgctatggacatttataaagagcttccaggccttgccttacgtcgctctgcttatcgtgatgctgtttttcatatatgctgttatcggaatgcaggtcttcggaaaaattgcgctgaacgacacaaccgagatcaacagaaataacaacttccagacctttcctcaggccgtcctgttgctattcaggtgtgccacaggggaggcctggcaggacattatgcttgcctgcatgcccggcaagaagtgcgcccctgagagcgaaccctctaactccactgagggcgaaactccctgtgggtccagcttcgctgtgttttacttcatatccttttacatgctctgtgcattcttgatcatcaacctgttcgtggctgtcataatggacaacttcgattatcttacccgcgactggtcgattctagggcctcatcatctggatgagttcaaacgtatatgggctgaatatgatccagaagcaaaaggccgcatcaagcacttggacgtcgtgactctgttgcgccgaattcagcctcccctcgggtttgggaaattatgcccccaccgggttgcctgcaaacgactcgttagcatgaatatgcccctcaacagcgacggaaccgtcatgttcaacgccacattattcgccctcgtgagaaccgcactgcggatcaagaccgaagaggggccttctccttcagaggcccaccagggagcagaggacccattccgccctgctgggaacctagaacaggctaatgaagagctcagggccatcatcaagaagatctggaaacggacctcgatgaaactgctggaccaggtggtcccaccagcaggagatgatgaagtgacagtggggaagttctatgccaccttcctgattcaggagtacttccggaagtttaagaaacggaaagaacagggactagttgggaagcccagtcagagaaatgccttatctttgcaggcgggactgcgaaccttgcatgatattgggccagagatacggcgggcgatttccggcgacctgacagctgaggaagaactcgacaaggctatgaaggaagctgtgtccgccgcttcagaagacgatatattcagacgggcagggggcttgttcggaaaccacgtgagttactatcagtctgatggcaggtcagcattcccacagacctttacaacgcagcgccctctccacatcaataaggcgggtagttcccagggcgatacggaatctccctctcatgagaagctagtcgattcgacttttaccccttcctcatactctagcacaggtagcaacgccaacatcaacaatgccaacaacacagcacttgggcggttaccacggcccgccggataccccagcactgtgagtacggttgaaggacatggcccgccactttcaccagcaattcgcgtacaagaagttgcatggaagctgagctccaaccgctgtcacagccgggaatcgcaggcagcaatggctggccaggaggagacaagtcaggatgaaacatatgaagttaagatgaatcacgacacagaggcctgtagcgaaccttctcttctgagcactgaaatgctcagttaccaggatgatgaaaaccggcaactgacccttccggaagaagataagagggatatcaggcagagccccaaacgggggtttttgcgcagtgcttcgctaggacgacgagcttcatttcatcttgaatgtttaaagcgccaaaaggatcgaggaggcgatatttcgcagaaaactgttctccccctccacctcgtccatcaccaggctttggcagtggccggcctgagccccctcttacagaggagtcatagtcctgcaagctttccacgccctttcgctacccctcccgccacacctggctccaggggttggccaccacagcccgtaccaactctgagactggagggcgtggaaagttctgagaagctgaattcatcctttccttctatacactgtggaagttgggccgaaactacgcctggcggaggtggctcttccgccgctaggagagttcgcccagttagcctgatggttccttctcaagctggcgcccctggtcgtcagttccatggaagcgcttcttctctcgttgaggctgtgctgatttccgaaggtttggggcaatttgcccaagatccaaagttcattgaagtgaccactcaggagctcgcggatgcctgcgacatgacaatcgaggagatggaatcagccgccgacaacatcctaagcggaggcgccccccaaagtcctaacggggccctgctgccatttgtgaactgcagggatgccggtcaggacagggcagggggtgaagaggacgccggatgcgtgcgggcacgagggagaccctcagaagaagagctgcaagattccagagtgtacgtcagctcactgtag

SEQ ID NO: 110434 - DNA, 6630 bp, Artificial Sequence
  Description of Artificial Sequence: Synthetic coding sequence
atggtcaacgaaaacacccgaatgtacattcctgaagagaatcatcagggatcaaattacggaagccctagacctgcgcatgccaacatgaatgccaatgctgcagctggccttgcacccgaacacattcccacacccggagccgctttgtcctggcaggcggccatcgacgcggcccgccaggcgaagctgatgggcagcgctggcaatgctaccatctctaccgtgtcatcaactcaacgtaagcgtcagcagtatggcaaaccaaagaagcagggtagcactactgccacgcgcccacctagggctcttctatgcttaacgttaaagaacccaattcgcagggcgtgcatttctattgtcgagtggaagccatttgagattatcatactcctcacaatcttcgctaattgcgtagcgcttgcgatttacattccttttccagaagacgattccaacgctaccaattcaaacctagagagggtcgagtacttatttctgataatttttacagtggaagcatttttgaaagtgattgcgtatggactgctattccatccgaatgcctacctgcgtaacggctggaacctcctggactttatcatagtcgttgtcggactgttcagtgccattttggaacaggctaccaaggccgacggggccaatgcacttggcggtaagggagccggctttgatgtgaaggcattgagggccttcagggtgctgagaccactgcgcttggtgagtggagttccttctttacaagtcgtcctcaattccatcattaaggctatggttccgctgcttcacattgctcttctggttctgtttgtcatcatcatttatgctatcatcgggcttgagctgtttatgggaaagatgcataagacatgctataatcaagaaggcattgctgatgtcccagctgaggatgaccccagcccttgcgcacttgagacaggccacggaaggcagtgtcagaacggcaccgtctgtaagccgggttgggatggacccaagcacggaatcacaaacttcgataattttgcatttgcaatgctgaccgtcttccagtgtatcacaatggaagggtggacagacgtgttatactggatgcaggatgcaatggggtacgaactgccatgggtgtacttcgtatcccttgtcatctttgggagctttttcgtactgaacctggtgttgggagtcttgtccggggaattttcgaaagaacgggaaaaggcaaaggcccgaggagatttccaaaagctcagagaaaagcagcagcttgaagaggacctaaagggttacctggactggatcacccaggcagaggatattgaccccgaaaatgaggatgagggcatggacgaggagaaaccaaggaatatgtctatgcctactagcgagaccgagagcgtgaacactgagaacgtggccggcggcgatattgaaggagaaaattgtggcgccaggctggctcaccggatttccaagtccaagtttagtcgctactggaggcggtggaatcggttctgccgcaggaaatgcagagccgcagttaagtcaaacgtgttttattggttagtcatttttcttgtgtttctgaacacactcacgatcgcatctgagcattataatcaaccaaactggctgacagaggtccaagacaccgcaaataaggccctgctagctctgtttactgccgagatgctgctgaaaatgtacagcctcggtcttcaggcctatttcgtgtctctgttcaaccggtttgactgcttcgtggtatgtggtggcattctggagaccattctggtggaaacaaaaattatgagtcccctaggcattagcgtgttaagatgtgttagactgttgaggatcttcaagattacccgctattggaattcgctgagtaatcttgtggcctctctgctcaactcggtgagatcaatcgcgtccctcctgcttctcctgtttctcttcataatcatcttcagcctccttgggatgcagctattcggcggaaagttcaactttgatgaaatgcagacccggcgctccacgttcgataatttccctcagagtttgttaaccgtgttccaaatcctgacaggagaggactggaacagcgtgatgtatgatggaatcatggcatacggcggcccatcttttccaggtatgctggtgtgcatctacttcatcatactgtttatttgtggaaactacatactacttaacgttttcctggctattgccgtcgacaatcttgctgatgcggaatccctgacatctgcccagaaggaagaagaggaggagaaagagagaaagaaactagcccggactgctagcccagaaaaaaagcaggaactagtcgaaaaaccagcagtcggagaatctaaggaggaaaaaatcgaactcaagtcaattaccgcagatggggaaagtccccctgctacaaaaatcaacatggatgacctgcagcccaacgaaaacgaggataagtctccataccccaatccagaaactactggtgaggaggatgaggaagaaccggaaatgccggtgggtcctagaccaaggcccctctcggaactccatctcaaggaaaaagccgtgcccatgcccgaagcatcggccttcttcatctttagcagtaataaccgatttcggctccagtgccatagaatagtgaacgatacgattttcactaacctaattcttttctttatcttgctgtcttccatctctctagccgccgaagaccctgtccagcacacctcatttcggaatcatattctgttttatttcgatatcgtgtttaccacaattttcaccatcgagatcgccctgaagatgactgcatatggcgcattcctacacaaagggagtttttgccggaattacttcaacatcctggaccttctcgtagttagtgtgagtttgatatcctttggcatccagagctctgctattaacgtggtgaaaattctcagggtgctccgcgtgctgcggcctcttagggctattaacagagcgaagggccttaagcatgtggttcagtgcgtttttgttgcgatccgcacaatcggtaacatcgttatcgtaacaaccctactacagtttatgtttgcttgcataggcgttcagctgttcaagggcaagctttacacatgcagtgacagcagcaagcaaacggaggcagagtgcaagggcaattatatcacatacaaagacggcgaggtggaccatcctattatccagcctaggtcctgggagaatagtaaattcgacttcgataatgtcctggccgctatgatggcccttttcacagtaagtacatttgaaggctggcccgaactgctgtatcgttccatcgactcccatactgaagataagggcccaatttacaactatagagtcgaaatttccatcttcttcatcatttacatcatcatcatcgccttctttatgatgaacatctttgtcggctttgtaattgtgacatttcaggaacagggtgagcaggagtacaagaattgcgagctcgataagaatcagcgccagtgcgtagagtacgcattgaaggccaggcccctaagacgatacatacctaagaaccagcatcagtataaggtctggtacgtggtgaattcaacttacttcgagtacctgatgtttgtgctcatactgcttaacaccatttgcctggctatgcaacactatggccagagctgcctgttcaagattgctatgaacattctgaatatgctgtttacaggtctgtttactgtggaaatgattttgaagcttatcgcatttaaacccaagggctatttctccgatccgtggaatgtgttcgatttcctcatcgtaatcggctccattattgacgtgatcttgtccgagaccaacccagccgagcatactcagtgctcccctagcatgaacgctgaggaaaattctcgtatttctattactttctttcgcttgttccgagtaatgagattggtcaaacttttgtcgaggggtgagggaattcggacactgctgtggactttcatcaagtcctttcaagccctgccatatgttgccctgctcatcgtgatgctattttttatttacgcagtgattggtatgcaggtgtttggaaagatcgctcttaatgataccacagagattaaccggaataataactttcagacctttccgcaggccgtattactgctgtttcggtgcgcgactggcgaggcttggcaggacattatgctcgcatgcatgcctggaaaaaaatgcgcccctgaatccgaaccttctaactcgactgagggcgaaaccccctgcgggtcatctttcgccgtgttttactttatatcgttttatatgctatgcgcgtttctcatcatcaacctgttcgttgcagtcataatggataacttcgactatctcaccagagattggtctatcctaggccctcatcatttggacgagtttaagaggatctgggcagaatacgaccctgaggcaaaaggacgcattaagcacctggatgttgttaccctactgcgacgaatccagcctccccttggctttggcaaactgtgtccccacagggttgcttgcaagcgtctggtgtcaatgaatatgcccttgaacagtgacggtacagtgatgtttaatgcaacgctgtttgctctcgtaagaactgccctccggattaaaaccgaaggtaacctggaacaggcaaatgaggaactccgggccataattaagaaaatctggaagcgcacctcaatgaaacttttggatcaggttgtgccacctgcgggtgacgacgaggtaaccgtggggaaattttacgccaccttcttgattcaggaatacttccgcaaatttaagaagcgcaaagagcagggtctggtgggcaagccatcccagcgcaacgcgctgagcctgcaggcagggcttcggacactccatgatattggaccagaaatcagacgcgcaatcagcggggacctgactgccgaagaggaactggataaggctatgaaagaagctgtgtccgcagcttctgaggatgacatatttagacgggccggtgggttgtttggcaatcatgtgtcctattatcagagtgatggccgctcagccttcccacagacatttactacgcagagacccctccatatcaacaaggcgggcagctcccaaggcgacaccgagagtccctctcacgaaaagctggtggatagtactttcactccttcatcctactcgagcacagggagcaatgcaaacataaataatgctaataacaccgcccttggtcgccttcccaggcccgctggataccccagcaccgtatccacagtagaggggcacggtcctcctttaagtccggctatccgtgtacaggaagtggcctggaagctttcgtccaacagaatgcattgctgcgatatgctggatggcgggacctttcctccagccctgggcccccgcagagcacccccctgcttacaccagcagttgcagggatcattagctggcctgcgcgaagataccccatgcatcgtccccgggcacgcaagtctgtgttgctcatctcgggtgggggagtggctgcctgcaggatgcactgctcctcagcacgcaaggtgtcacagtcgcgagagccaggccgctatggcaggtcaggaggagacaagccaggacgaaacctacgaagtgaagatgaatcacgatacagaggcttgttccgaaccatctcttttgagcacagagatgttgtcctatcaggacgatgaaaataggcagctcaccctgccagaggaggacaagagggacatccgccagagcccaaagcgcggctttctgaggagcgcttccctgggcaggcgcgccagctttcacctagaatgccttaaacgccagaaagaccggggcggcgatattagccaaaaaactgtcctgcctctccatctagttcatcatcaggctctggctgtagctggactgagtcccctgctccagcgcagtcactctccagcctcctttccccgtccttttgccacgcccccggcgaccccaggttcccgtggctggcctccccagcctgtgcctacattgcgcctggagggcgtggagtcttcggagaagctgaacagcagcttcccctctatccattgcggctcatgggctgagacaacaccgggggggggaggctcctcagctgctcggagagttcggccagtgagtctgatggtcccgagtcaggccggtgcacctggccgccagttccacggatccgcttcatctctggtggaggcagtgctgattagcgagggcttaggtcagttcgctcaagatccgaagttcattgaagttaccacgcaggaactcgccgacgcttgcgacatgaccattgaagagatggagagtgctgccgacaacattcttagtggaggcgctcctcagtcgcccaacggagcactgctgcccttcgtgaattgtagagacgcagggcaagatagagcaggcggcgaagaggacgcaggatgtgtgcgagctcgcggacgaccctctgaagaagagctccaggactctcgagtgtacgtgtcctccctttag

SEQ ID NO: 110435 - DNA, 3840 bp, Artificial Sequence
  Description of Artificial Sequence: Synthetic coding sequence
atggtcaatgagaatactaggatgtacattccggaggagaaccaccagggcagcaattacggttcaccccgcccagctcatgccaatatgaacgcgaatgccgcggccggactggcccctgagcatatccctacgcctggagcagctctctcttggcaggcagctattgatgctgctaggcaggccaaactgatggggtctgcaggaaatgcgaccatctctaccgtgtcttccacacagcggaagcggcagcagtatggcaagcccaaaaagcagggaagtactacagccaccagaccacccagagcacttctctgccttaccttgaagaaccctataaggagggcttgcatcagcatagtggagtggaaaccgttcgaaatcatcattcttctgacaattttcgccaactgtgtggcgctggccatttacatccccttcccagaagacgacagcaatgccaccaatagtaacttggagcgtgtcgaatatttgttcttaatcatctttaccgtggaggcctttcttaaggtcatcgcgtacgggctcctgtttcacccaaacgcatacctgcggaacggatggaatctactggacttcattatcgtcgtcgtgggactgttcagtgccatattagaacaggccactaaggctgatggtgctaacgctctcggcgggaagggtgccggattcgacgtaaaagccctcagagccttccgcgtgctaaggccactgaggctagtttctggtgtgccctcccttcaggtggttttaaacagtatcattaaggctatggtaccattgctccacatagcactcctggtcctgtttgtcattatcatttatgccataattggcttagagctgttcatgggaaaaatgcacaagacatgctacaatcaggagggaatcgcagacgtgcctgctgaggatgacccatctccctgtgccttggaaacaggacacggtagacaatgccaaaacggaacagtctgtaagccagggtgggacggccccaaacatggtattacgaactttgacaacttcgccttcgccatgctgaccgttttccagtgcattacaatggaagggtggaccgacgtcctttactgggtgaacgacgcagtgggcagagattggccatggatctacttcgttactctgattattataggatccttcttcgtgctcaacttagtgttaggggtcctctctggtgaatttagtaaggaacgggagaaggctaaggctcgcggcgattttcaaaaactgcgggaaaagcagcagcttgaagaggacctgaagggatatctagattggattactcaagcggaagatattgacccggaaaacgaggacgagggcatggacgaggagaaacctcgcaatatgtccatgccgacgtctgaaaccgaatctgtgaatacagagaatgtagccggcggcgacatcgagggcgagaactgcggggcaagactggctcacagaattagtaagtccaagttttccagatactggcgacgttggaaccgattttgcagaaggaagtgtcgggcagccgtaaaatctaatgtgttctattggctggtgatctttctggtgttcctaaatactcttaccatcgcctctgaacattacaatcagcccaattggctgactgaggtccaggacacggctaacaaagccctgctcgccctttttacggccgaaatgctgcttaaaatgtattcactagggcttcaggcctacttcgtgagtctgttcaatcgatttgactgcttcgtggtgtgcgggggcatcctcgaaaccatactggtggagacgaagatcatgagcccactaggtatctctgtgctccgctgtgttcgccttctacgcattttcaaaattacccggtattggaactccctcagcaatcttgtagccagtcttctgaattcagtgcggagcatcgccagcctactcttacttttgttcctgtttattatcatttttagtctgctgggaatgcaactgttcggtggtaagttcaactttgacgagatgcaaacccgacggagcaccttcgacaactttccccagtcactcctgaccgtgtttcagatacttaccggcgaagattggaatagcgtaatgtatgacggtataatggcctacggagggcctagcttcccgggaatgctggtttgtatttactttattatcctgttcatatgtggaaactatatccttttgaacgtctttttagccattgcagtggacaacctcgcagacgccgagagtctcacaagcgcccaaaaggaagaggaagaggaaaaagaaaggaagaaactcgcccgtacagcctctccagaaaagaaacaggagctggttgaaaagcccgctgtcggagagtcaaaggaggaaaagatcgaactgaagtctatcaccgccgacggggaatcacccccagctaccaagattaatatggatgaccttcaaccaaacgaaaatgaggataagtctccatatcctaatccagagaccacgggcgaagaagacgaggaagagccggaaatgcctgtcggacctcgtccgcggccgctgagcgagttgcacctgaaagaaaaggctgtgccaatgccagaagctagcgcgttctttatttttagtagcaacaatcgattccgactccaatgtcatcggatcgtgaatgacaccatttttaccaatctcattttgtttttcatcctcctgtcgtcaatctccttggctgcggaggatcccgtgcagcatacctcatttcgaaaccacattctggggaacgctgactatgtttttaccagcatcttcaccctggaaattatcctcaaaatgacggcgtacggagctttcttgcataagggctccttctgccggaactattttaatattctagacctgcttgtggtgtcagttagcttgattagttttggaatccaatcctccgctataaacgtcgtaaagattctgcgggtcctgcgggtcctgcgtcccctgcgggctattaatagggcaaagggattgaagcacgtggttcagtgtgtcttcgtggcaattaggacaataggcaacatcgttatcgttacaacgctgctgcaattcatgttcgcttgtataggtgttcagttgtttaagggtaagctgtacacctgttctgacagctccaaacaaactgaagctgaatgtaaaggcaattacattacatataaggacggcgaagtggaccatccgatcatacaacccaggagctgggagaattcaaaattcgactttgacaatgtgctcgccgccatgatggccctgttcactgtcagcacattcgaaggatggcctgaactgttatacagaagcatagacagccataccgaggataaggggcccatctacaattaccgggtggaaatctcgatctttttcataatatacattatcatcatcgccttttttatgatgaacatctttgtaggtttcgttattgttaccttccaggagcagggggagcaggaatacaagaattgtgaactcgacaagaatcagcgacagtgcgtggagtatgccctcaaggctagacccctgcgcagatatattccaaaaaatcagcaccagtacaaagtatggtatgtggtgaatagcacctactttgagtatcttatgtttgtgcttattttgctcaacacaatatgcctcgcgatgcaacattacggccagagctgtctatttaaaatcgccatgaacattctgaacatgctgttcaccggcctattcactgttgagatgattctgaagctgatcgcctttaagcccaaagtaggactatag

SEQ ID NO: 110436 - DNA, 6546 bp, Artificial Sequence
  Description of Artificial Sequence: Synthetic coding sequence
atgatgatgatgatgatgatgaagaaaatgcaacaccaacgacagcagcaggcagaccacgccaacgaggccaattacgctaggggaactcggctccccttatcgggtgaaggtcctacctctcagccaaattccagcaagcagactgtgctctcctggcaagctgccattgacgcggctcgacaggctaaggcagctcagactatgtctacctctgctccaccacctgttggttccctctctcagaggaaaagacagcagtatgctaaaagcaaaaagcagggcaatagttcaaattccaggccagccagagctcttttttgtctttctctgaataatcccattcgcagagcctgcatatccatcgtggaatggaagccctttgacatattcattctgctagcaatctttgccaattgcgtcgctctcgctatctatatccctttcccagaggacgactccaactccaccaaccacaatctggaaaaggtcgaatatgcctttctcataatttttactgttgaaactttcttgaagattatagcctacggactattactgcaccctaacgcctacgtgaggaatggatggaacctgctcgattttgtgatagttatcgtgggattgttttccgtgatcctggagcaattgaccaaggagaccgaagggggtaatcacagcagtgggaagtcaggggggtttgatgtaaaggccctaagagcatttcgcgtcttgaggcccctgcggttagtgagcggggtgccctcactgcaagtcgtgcttaatagtataattaaagccatggtcccacttctgcacatagcccttcttgtgctcttcgtgataattatctatgcaatcatagggctggagttattcattggcaagatgcacaagacttgcttctttgctgactcagacattgtcgcagaggaagatccagccccctgcgcctttagtggcaatggcaggcagtgtacagccaatggtaccgaatgccgaagcgggtgggtggggccaaacggcgggattacaaacttcgacaattttgcctttgccatgctgactgtttttcagtgtatcaccatggagggatggactgatgtgctttactgggttaatgacgctatcgggtgggagtggccgtgggtgtactttgtcagccttattatcctcggaagcttttttgttcttaatttagtgctgggagtgctgtctggcgagttcagcaaggagcgcgaaaaagcgaaagccaggggggattttcagaagttgcgggaaaagcagcagctggaggaagacctcaaaggctatttagactggatcacacaagctgaggacattgatccagaaaacgaggaagagggtggcgaggaggggaaaaggaacaccagtatgcccacatctgagacggaaagtgtcaacacggagaatgtatccggtgagggtgagaaccgcgggtgttgtggatccctctggtgttggtggaggaggcgtggagccgcaaaggccggcccaagtggttgccgccgatggggccaagccatcagcaaatctaaacttagtcggcggtggcggaggtggaatcgctttaatagacgtagatgtcgggcagctgtcaagtctgttaccttctattggctcgtgatcgtgttggttttcctcaacactttgacaatttcctcagaacattataaccagcccgactggctgacacaaatccaggacatcgcaaataaagtactgctcgcgctgttcacatgtgagatgctggtcaaaatgtattcactggggctgcaagcatatttcgtgtccttgttcaaccggttcgattgcttcgtggtgtgcggcgggataacagagactatcttagtagagctcgaaattatgagcccactgggtatctccgtgtttcgatgcgtgaggctcctgagaatctttaaggtaacaagacattggacgtcactgtccaacctcgtggcctctctgctgaattccatgaaaagcatagcatctttactgttgctactgttcctgttcattatcatcttcagcttgctaggtatgcaactctttggcggcaaatttaattttgacgaaacacagacgaagcgatccaccttcgacaacttcccgcaagctctgctcaccgtattccaaattctaaccggcgaggattggaacgcagtgatgtacgatggaattatggcctatggaggcccctcgagctctggcatgattgtgtgtatctacttcatcattctgtttatttgtgggaactacatactgctgaatgtattcctggctattgccgtcgataacctggcggacgcggaatctctcaataccgctcagaaggaagaagccgaggagaaggagaggaagaaaattgccagaaaggaatcgctcgagaataagaagaacaataaacccgaggtaaaccagattgccaactctgacaataaagtgaccattgacgattacagagaagaggatgaagacaaggatccttatcccccttgcgacgtacccgtcggcgaagaggaagaggaagaagaggaagacgagcccgaagtgcccgccgggccccgtcctcggagaatttctgagctcaacatgaaggagaagattgctccaatacccgagggatctgccttcttcatcctgagcaaaacaaaccctattagagtcgggtgtcataaactcatcaaccatcatatttttacgaatctcatcctcgtgtttattatgcttagttctgctgctctggccgctgaggatccgatccgaagccacagtttcaggaacaccattttggggtactttgactacgcttttaccgccatctttacagtcgagattctgcttaaaatgactacctttggggccttcctgcacaagggagcattttgtcgtaactacttcaacctgttggatatgctggttgtgggtgttagtctagtatctttcggcattcagagtagcgccattagtgtggtgaagattcttagggtactgcgcgtcctacggcccctgagagctataaatagggccaagggcttgaaacatgtggtacaatgtgtttttgtcgcaattaggaccatcggtaacattatgatcgtgactacactcctacagttcatgttcgcttgcattggagtgcagttgtttaaaggcaaattctataggtgtacggatgaagccaagagcaacccagaggagtgccgcggcctgttcattctttataaagatggggacgtggactcccccgttgttcgggaaaggatctggcaaaactcagacttcaatttcgacaatgtgctcagcgccatgatggcactgttcaccgtgtctacatttgaaggttggccggcgctgctctataaggccattgactctaatggtgagaacatcgggcccatctacaaccaccgcgtggaaatctcaattttctttattatctatatcatcatcgtagctttcttcatgatgaatatctttgttggtttcgtgatcgtcacctttcaggagcagggtgagaaggagtataagaattgcgagctggacaagaatcagcggcagtgtgtggagtacgctctgaaagctcgccctctgaggcggtatattcccaaaaacccatatcagtacaagttttggtacgtggtgaattcatctccctttgagtatatgatgtttgtgctcatcatgctgaacacgttgtgcttagcaatgcagcactacgaacaatccaaaatgttcaacgatgcaatggatatcttaaatatggtctttaccggggtgttcacagttgagatggtgcttaaggtcattgcctttaaaccaaaaggatattttagtgacgcttggaacactttcgattcactgatcgttatcggatcaatcatcgatgtggcattaagtgaagcagatcccactgaatcggagaatgtgccggtgccaaccgcaacaccaggaaacagtgaggagtccaatagaatctcaattacattcttcagattgttccgtgtcatgagacttgtgaagctgctgagccggggagaaggcatccgaactctcctctggacatttattaagagctttcaggccctcccctatgtcgctctgctgatagcaatgctgttcttcatttatgctgtgatcggtatgcagatgttcggcaaggtggctatgcgcgacaacaatcagatcaaccggaacaataattttcagacatttcctcaggccgtcttgctgcttttcagatgcgcgaccggagaggcctggcaggagattatgctggcgtgccttccagggaaactgtgtgacccagaatccgactataaccccggcgaagagtatacctgcggtagcaacttcgcaattgtgtacttcataagcttctacatgctctgcgccttcctgataatcaacctttttgtcgcggtgattatggataacttcgactacctgacacgcgactggagtatcctgggtcctcatcatctggacgaatttaagagaatatggtccgagtacgaccccgaggccaagggacgaattaagcatctggatgtggtgactttgctgcgccgaattcagccccccttggggtttgggaaactgtgccctcaccgagtcgcctgtaaaaggctcgtggcgatgaatatgcctctaaattccgatgggacagtcatgtttaatgcaacactttttgcacttgtacgcactgctctcaagattaagacagagggcaatttagaacaggccaacgaagaactgagggctgtgattaagaaaatatggaaaaaaaccagcatgaaactcctcgaccaagtggttcctccagctggtgacgatgaagtgacagtgggtaagttttatgccaccttcctgatccaggactactttcggaagtttaagaagcggaaagagcagggattggtcggaaaatacccggccaagaataccacaattgccctgcaggctggcctgaggaccctgcatgacatcggcccggagatacgccgagctatcagttgtgatctccaggacgacgaacccgaagagacgaagcgtgaggaagaagatgatgtctttaagaggaacggggccttgctcggtaatcacgtaaaccacgtgaacagtgatagaagagatagtctgcagcagacgaacacaacccacagacccctgcatgtccagaggccaagtatccctcctgcatcagacactgaaaagccactttttccccctgccggcaacagcgtgtgccacaatcaccacaaccataacagtatcggtaaacaggtgcctaccagtacaaatgccaacctcaataacgctaacatgtctaaggccgctcatgggaagcggccaagtatcggaaatttggagcacgtatctgaaaacggacaccacagttcacacaaacacgacagggaaccccaacggagatcttctgtgaagagaactcgctactacgagacctatattcgtagtgactcaggagacgagcagctgccaacaatctgccgggaggacccagagattcacgggtattttcgagatccacactgcctcggggaacaggagtatttttcaagtgaagaatgttatgaagacgattcctcaccaacgtggtcaagacaaaactacgggtactactccagatacccaggcaggaacatcgactctgagcgacctcgcgggtaccaccatccgcaggggttcctggaagacgatgatagccccgtgtgctatgacagtagacggagcccccggcgcagactgctgcccccaactcctgctagccaccgtcggtcatccttcaatttcgagtgcctgcgcaggcaatctagccaggaggaagttccttcgagccctatcttccctcaccgaactgcattacctttacacttaatgcagcaacagatcatggcagttgccggcctggattcatcaaaggctcagaagtacagcccttcacacagtactcggagctgggctacacctccagccacacctccttaccgggattggacaccgtgctacactcctctcatccaggtggagcagtccgaggccctcgaccaggtcaacgggagcttaccaagcctgcatcgatcatcctggtatactgacgagccagacatctcctaccgcacctttacccccgccagtctgactgtacctagctccttccggaataaaaatagcgacaaacagaggtccgcagattccctggtggaagctgttctgatctctgaagggcttggacgctatgcccgcgatcctaaattcgtttccgctaccaaacacgagatcgctgatgcctgcgatctgactattgacgagatggagagcgctgcttctactctgctaaatggaaacgtgcggccccgtgcgaatggcgacgtgggccccctgagccatcgccaagattacgagcttcaggatttcggaccaggctactccgacgaggagccagatccagggcgtgacgaggaagacctggctgatgagatgatatgcatcacaacactgtag

SEQ ID NO: 110437 - DNA, 6486 bp, Artificial Sequence
  Description of Artificial Sequence: Synthetic coding sequence
atgatgatgatgatgatgatgaagaaaatgcagcatcagcgccaacagcaggccgatcacgccaatgaagccaattacgctagaggcacacgccttcccctcagcggggaggggccaaccagccaacctaacagctccaagcagaccgtgctgagctggcaggcggccatagatgcagctagacaggctaaagccgcacagaccatgtcaacctccgctcctcctccggttgggagccttagccagcggaagagacagcagtacgccaaaagtaagaagcaaggaaattcttctaattccagacctgctcgagccttgttttgtctctcacttaacaatcctattaggcgggcttgcatctccattgtagaatggaagcccttcgacatcttcatcctcctcgccatctttgcgaattgcgtagccctcgccatttacataccgtttcctgaagatgattctaactccactaaccataatttggagaaggtggaatacgcattcttgatcatctttacagtcgaaaccttcctcaagatcattgcgtacggcttactgctgcacccgaacgcatacgtgcggaacggatggaatctcctggattttgtgatcgtgattgtgggcctcttctctgtgattttagagcaattgaccaaagagactgaaggaggcaaccatagcagcgggaaatcaggcgggttcgacgtaaaggcattgcgagccttcagagtgctgcggccactgaggctggtgtctggcgttccctctttacaggtggtcctgaactcaatcattaaggcaatggttcctctgctgcacattgcactgttagtgctgtttgtaattattatttatgccattatcggcctggaactcttcattggtaagatgcacaagacctgtttcttcgcagattcagatatagtagcagaagaagatccggccccctgtgccttctcaggtaacgggcggcagtgcaccgccaatgggaccgaatgccggagcggttgggtcgggcctaacggcggcatcactaactttgataactttgctttcgctatgctgaccgtgttccaatgtattacaatggagggctggacagatgtcctgtactggatgaacgatgccatgggatttgaacttccgtgggtgtatttcgtgagccttgtgatattcggatccttttttgtgctgaatctcgtgctgggggttcttagcggcgagttctctaaggagagggagaaggccaaggcccgaggagattttcaaaagctgcgggagaaacagcagctggaagaggaccttaagggatatcttgactggattacacaagccgaggatattgaccctgagaatgaggaggaaggcggtgaagaagggaagcgcaacacttcaatgccaacgtccgagaccgaatctgtgaacacagagaacgttagcggagagggggaaaaccggggctgttgtggttcactgtgtcaggctatatccaaatctaagctgtcccgacggtggaggcggtggaacaggttcaaccgaaggcgctgtcgggccgccgttaagtctgtcaccttctattggcttgtgatcgttctcgtgtttctgaacaccctgacaattagcagtgagcactacaatcagccagactggctgacacagattcaggatatcgcgaacaaggtattgctcgcccttttcacttgcgaaatgcttgttaagatgtactctctcgggctgcaagcttacttcgtcagtttgtttaatcggtttgactgcttcgtcgtgtgtggagggataactgaaactatacttgtcgagctggaaattatgagccccctggggatctcagttttccgctgcgtgcgcctgctgcgaatctttaaggtgaccaggcactggacatcacttagtaatctggtcgcttcattacttaattctatgaagagtatcgcaagcctcctgctgctgctgttcttgtttatcattattttctctttgctgggtatgcagctgttcggcgggaagttcaacttcgacgaaacgcagacaaagcgatcaacattcgataacttcccacaggcgttgctgacagtgttccagatcctcacaggcgaggattggaacgccgtaatgtacgacgggattatggcatatggagggccttccagtagcgggatgatagtctgtatttattttattatcctgttcatttgtggcaactatatcctcctcaatgtgtttctcgccatagccgtggataatctggctgacgctgagagccttaataccgcgcagaaggaggaagcagaggaaaaagagcgcaagaagattgcccgcaaggagagcctggagaataaaaaaaataataagcccgaagtgaatcagatcgccaattcagacaacaaggtgactatcgacgattaccgggaagaggacgaagacaaagatccgtaccctccgtgtgacgtgcccgtgggagaagaagaggaagaagaggaggaagacgagcctgaagtgcctgcgggcccgagacccagaagaatcagtgagctgaacatgaaagagaagattgcccccattcccgagggcagtgcctttttcatcctgagcaagactaaccccattagggtagggtgtcataagttaatcaaccatcacattttcacgaacctgattctcgtgtttatcatgctcagcagcgctgctctggctgccgaggaccctatccgctctcatagtttccggaacaccattttagggtactttgattacgcttttactgcaattttcactgtggagatcctgctaaagatgacgacttttggcgccttccttcacaagggggcgttttgccgtaattacttcaacttattggacatgctggtcgtgggcgtgagcctggtctccttcgggatacaatcgtctgcaatctcagtggtcaaaatactccgggtgctacgcgtgctgcgccctctacgggctatcaacagagcaaagggactcaagcacgtagtccagtgcgtcttcgtcgcaatccgaacaattggcaatattatgatagtaaccacgctccttcagttcatgttcgcgtgcatcggcgttcagctattcaagggaaaattctacaggtgcacggacgaggccaaaagcaatccagaggaatgccgtggactgtttattctgtacaaggacggcgacgttgatagtcctgttgtgagggagcgaatatggcagaattccgatttcaattttgataacgtcctctcagcaatgatggcactgttcactgtgagcactttcgagggatggcccgctctgctctataaagctatcgattcaaacggcgaaaacatcggcccgatctataaccatcgggtcgagattagtatattcttcattatttacatcattatagtcgcctttttcatgatgaatatatttgttgggtttgtaatcgttactttccaggagcagggagagaaggaatataagaactgtgaactcgataagaatcagcgccaatgcgttgagtacgcattaaaagcccggcccctccgccgttacatccccaaaaatccctatcagtacaagttctggtacgtcgttaactccagcccattcgagtatatgatgttcgtactgattatgctcaacactctttgtcttgcaatgcaacactatgaacagtcgaagatgttcaatgacgctatggatattctgaatatggtatttactggggtctttacagtggagatggttcttaaagtgatagcatttaaacccaaaggctacttcagcgacgcatggaatacctttgactcccttatagtgattggatccatcatcgatgtagccctgtctgaagctgaccccaccgagagcgaaaacgttcccgttccgaccgcgacgccgggaaattctgaggaaagcaatcggatcagtatcaccttcttccgcctctttagagtaatgcgcctggtcaaacttctttcaaggggggaaggcattcgcactctgttatggacctttataaaaagctttcaagcattgccatatgttgccctcctgatcgccatgctattttttatttacgcagtaatcggaatgcagatgtttgggaaggttgccatgagggacaacaatcagattaataggaataataattttcagacattcccgcaggctgtgctgctcctgtttagatgtgccactggcgaagcctggcaagaaatcatgctggcttgcctgccaggtaaactctgcgatcccgaatctgattacaacccaggcgaggagtacacatgcggctcgaactttgctattgtgtacttcattagcttttacatgctgtgtgctttcctaatcatcaacctcttcgtagctgtgatcatggacaatttcgactatctcaccagagattggtctattctggggccccaccacttggacgaatttaaacgtatctggtccgagtatgaccccgaggctaagggcaggataaagcacctggatgttgtgacgctgctgcggcgcatccagccaccgttaggattcggcaagctttgtccgcatagggtggcttgtaaaagacttgtcgcaatgaacatgccattaaactcagacggaacagtgatgtttaatgccacattgtttgccctggtgagaactgcgctcaagattaagaccgaaggcaatctggaacaagccaatgaagaactgagggctgtaatcaaaaagatctggaagaagactagcatgaaactgttggaccaggtggttccacctgccggagatgacgaagtcacagtggggaagttttatgccacttttttgatccaggattacttccggaaattcaagaagaggaaagagcaaggcctcgtcggaaagtaccctgctaaaaataccactatcgctttgcaagccggccttcgtactctgcacgacattgggcctgagatacggcgcgccatcagctgcgatctgcaagacgacgaaccagaggagaccaagcgcgaggaagaggatgatgtctttaaacgaaacggggctttgctgggtaaccatgttaatcacgtcaattctgacagacgggattccctgcagcagacgaacactacccaccggcccctgcacgttcaaaggccatccatcccacccgcctccgatactgagaagcccttattcccccctgctgggaattccgtgtgtcataaccatcataatcacaattctatcggaaagcaagtgcccactagcaccaacgccaatctcaacaacgccaatatgtcaaaagccgctcacgggaagaggccctctattggtaacctggagcacgtgagcgagaacggccatcattcaagccacaagcacgaccgtgaaccccagcggcggtcaagcgttaaaaggacgcgatattatgaaacgtacataaggagcgattctggcgacgagcagctccctaccatatgtcgtgaagacccagagattcatggttacttccgcgacccccactgcctcggggaacaagaatactttagctcagaggagtgctacgaagacgacagcagccccacatggtcccgccagaactacggatactactccaggtaccccggccggaatattgactcagagcgacctcgtgggtaccaccatcctcagggcttcctggaagatgacgatagccccgtttgttacgactctagacggagcccaaggcgacggctgcttccccctacgccggcctcgcaccggcgctcctcgtttaactttgaatgcctgcggcgacagagctcccaggaggaagtcccctcaagcccaatcttccctcacaggacggcgcttcctctgcacctgatgcagcagcagatcatggccgtggctggcctagactcctctaaggcccagaagtatagccccagtcattccacccgatcttgggcaaccccgccggccacccctccctatcgggactggacgccatgttacacccccctaattcaggtggagcaatctgaagccctcgaccaggtgaacggctccctgccttccctccaccgttcttcctggtacacagatgaacctgatattagctaccggactttcacaccagcttctctgacggttcctagctcttttaggaacaaaaactctgataagcagagatccgccgattcactggtggaggcggttttgattagcgaggggctcggcaggtatgccagggatccgaagttcgttagcgcgactaagcatgagattgctgatgcttgtgacctgaccatcgatgagatggagtctgccgcaagcaccctgctgaacggaaatgttcgtccacgcgctaatggagatgtcggacctctctcgcatagacaggattatgaattgcaagacttcggccctgggtatagcgacgaagaacctgatcccggcagagacgaggaagacctggcagatgagatgatttgtatcactacactgtag

SEQ ID NO: 110438 - DNA, 6414 bp, Artificial Sequence
  Description of Artificial Sequence: Synthetic coding sequence
atgatgatgatgatgatgatgaagaagatgcagcaccaacgacagcaacaggccgatcacgctaacgaggctaattacgccagagggactaggctgcccctcagcggtgaaggcccaacttcacaacccaattcttccaaacaaactgtgttgagttggcaggcagccatagatgcagcaagacaggcaaaagccgctcagaccatgtccaccagcgctcctccgcccgtagggtctcttagtcagcgcaaacgccagcagtatgctaagtcaaagaaacagggtaacagtagtaattctagaccagcccgggcgcttttttgcctttcgctcaacaatcccatcaggagagcgtgcatcagcatcgttgagtggaagcctttcgacatcttcatactgctggcaattttcgccaactgtgttgcgcttgcaatctacatcccttttcccgaagatgacagcaattcaaccaatcataacctagagaaggtggagtatgcatttctgatcattttcaccgttgagacctttctcaagatcattgcatatggcctccttttacaccctaacgcatacgttcgaaatggttggaatcttctagacttcgtgatcgtcatcgtcggtttattctcagtgatactcgaacagctgactaaggaaacagagggcgggaaccatagcagcggaaagtcaggtggcttcgacgtcaaagctctgagagcgtttagggttctgcgccccctgcgtttggtgagcggggttccctccttgcaggttgtgcttaactctattatcaaagccatggtgccattgctccacattgcactgctagtgctgttcgtcatcattatatacgccatcatcggcttagagctgtttataggcaagatgcacaagacctgcttttttgccgatagcgacattgtagccgaagaggatccagccccatgtgctttcagcggtaatggtaggcagtgcacagccaacggaacggagtgtaggtcaggctgggtagggcctaatggtggtattaccaatttcgacaactttgcgtttgctatgctcaccgtcttccagtgtatcactatggagggatggaccgacgttctgtactggatgaacgacgccatgggattcgagctcccttgggtttatttcgtctctctggtgatctttgggtcattctttgtcttaaacctggtgctcggggtgctaagcggggagttcagtaaagagagagaaaaggctaaggcccggggggacttccagaagcttagggagaagcagcagctggaagaggatttaaaggggtatctcgactggatcacacaggccgaagacattgaccccgagaatgaagaagaggggggggaggagggcaaacggaacacttccatgcccacctctgagaccgagagcgtgaacactgaaaatgtgagtggggaaggcgagaaccgcggttgctgcggatccctgtgtcaagcgatctctaagagcaaactttcaaggcgctggagacgatggaatcggttcaataggaggcgctgtagagccgccgttaaaagtgttactttttattggctggtgatcgtgctcgtgtttttgaacacactgaccataagctccgagcactacaaccagcctgattggctgactcagatccaggatatcgcaaataaggttctcctggcactctttacgtgcgagatgctggttaagatgtacagcttgggcttacaggcttattttgtgtctttattcaacaggttcgactgttttgtggtctgtgggggcatcacagagacaattttagtggagcttgaaatcatgtccccactgggaatcagcgtgtttcgatgtgtaagactcttgcgaatttttaaagtgactcgccactggacgtccctgtccaatctcgttgcaagtctactgaattcaatgaagagcattgcttcactgttgctcctcctgttcctgtttattatcatattctccttgctcgggatgcaactgtttggaggtaagtttaacttcgatgagacccagaccaagcgctccacatttgacaattttccgcaggctctgcttacagtattccaaattttgacaggggaagattggaacgccgtgatgtacgatggcataatggcatacggcggcccaagctctagcggcatgattgtctgtatctactttatcattttgttcatctgcggcaattatatactgctcaacgtgttcctggctatagccgtggacaatttggccgatgcggaaagcttaaataccgcccaaaaagaggaagccgaagagaaggagcgcaagaaaatcgctaggaaagaatcactggagaacaagaagaacaataagcccgaagtgaaccagattgctaactctgacaataaggtgaccatcgacgactacagggaagaggacgaggacaaagacccttatccgccttgcgatgtcccggttggtgaggaggaggaagaggaagaggaagacgagccagaagtgccagccgggccacggccacggaggatcagtgaactcaatatgaaagagaagatcgctcctatccctgaggggtcagcgttcttcatcctgtctaagacgaaccctatcagagtggggtgtcacaagctcattaaccaccatatcttcaccaatttgatccttgtgttcatcatgctgtcatctgcagccttggccgccgaggacccaatccggagccattcttttcgcaataccattctgggctatttcgactatgcttttacagccatcttcacagttgagatcctcctcaagatgactactttcggtgcattcttgcataagggagcattttgcaggaattactttaatctcttagacatgctagtcgtcggggtctcactagttagctttggcattcagtcctctgcaatttctgtagtgaaaattctgcgcgtcctccgggtcctgagaccgctgcgcgccattaatcgggccaagggcctgaagcacgtggtccagtgcgtcttcgttgccattcgcacgattggaaacataatgatagtgaccaccctcttgcagtttatgttcgcatgcattggggtgcagctctttaaaggtaagttttatagatgcacagatgaagctaagtccaacccggaagagtgcagaggactcttcattctgtataaggacggcgatgtggacagccctgttgtgcgagagcgaatctggcagaacagcgattttaactttgacaacgtcctgtctgcaatgatggccctgttcaccgtttcgacttttgagggctggccagcgttattgtataaggccatcgactctaacggcgagaatatcgggccgatctacaaccatcgggttgagatctccatctttttcattatctatattatcatcgtggccttcttcatgatgaacatcttcgtcggttttgttatcgtgacattccaggaacagggagaaaaggaatataagaattgtgaactggataaaaatcaacgacaatgcgtggaatacgctttgaaggcccggccactacggcgttatatacccaagaacccatatcaatacaagttttggtatgtggtgaactcgtccccctttgagtacatgatgtttgtgttaattatgctcaacactctatgcctggcaatgcagcactacgagcagtctaagatgttcaatgatgcaatggatatcttgaatatggtgttcactggcgtgtttactgttgagatggttctaaaagtaatcgcctttaaaccaaagggctacttctctgatgcctggaacacctttgacagcctgatcgtcatcggaagcattatagacgtggccctgtcagaggccgacaatagcgaggagagcaataggatatcaattacttttttcagactgttccgggtcatgcgcctggtgaaactcctgagccggggagagggcattcggaccctgctgtggacctttatcaaatctttccaggccttgccatacgtggcccttctgatcgctatgctctttttcatatacgctgtgattggtatgcagatgttcggaaaggtcgccatgcgagacaacaaccagatcaacagaaacaacaatttccagacatttccacaggctgtgttattgttgtttaggtgtgccaccggggaagcatggcaagaaatcatgctggcttgcctgcctggcaaattgtgcgatcccgaatccgattacaatccaggcgaggaatacacctgcggtagcaactttgccatcgtctactttatttctttttatatgctctgtgccttcttaataattaatctctttgtagccgttatcatggataatttcgactacctgacgagagactggtcaatcctcgggccccaccatcttgatgagttcaaacgcatttggtccgagtatgacccagaggctaaagggagaattaagcatctcgatgtggtgactctgctgcgcagaattcagcctcctctgggctttgggaaactgtgcccccatcgcgttgcatgtaagagactggtcgccatgaatatgcctctcaacagcgatggaacagtcatgtttaacgcaacactgtttgccctagttcgcacagccctcaagattaagacagaaggcaacctggagcaggcaaacgaggagttgcgggccgtgatcaaaaagatctggaaaaagacatctatgaagctgctcgaccaagtcgtaccccctgctggggatgacgaagtgactgttggcaagttctatgccacctttctgattcaagactactttcgaaagttcaagaaacgtaaggaacagggtctcgtggggaagtatcctgcaaaaaacacgaccatcgctctgcaagctgggctacgaactctgcacgatattgggcccgaaatcagaagggcgattagctgcgatcttcaggatgatgaaccagaggagaccaaacgtgaggaggaagatgacgtatttaagcggaacggcgcgctcctgggcaatcatgtcaaccacgtcaatagcgatagaagggactctctgcagcaaacaaacactacacacagacctctgcatgtgcagaggccttccatcccacctgcctcagatactgagaaacctcttttccctccagctggtaatagtgtctgtcataaccatcataaccacaatagtatcggcaagcaagtgccaacatcaacaaatgccaacctgaataacgccaacatgtctaaagcagcccatgggaaacggccctcaatcggcaacctggaacacgtgtccgagaatggtcatcattcctcgcataagcatgatagggagcctcagaggcgctcttccgtgaaaaggagcgattcaggggacgaacagttgcctacaatttgtcgcgaggatccggagatacacggctacttccgtgaccctcactgtctgggcgagcaggaatatttcagttccgaagaatgttacgaggatgattcaagcccaacctggagcagacaaaactacggttactactcgaggtatcccggaaggaatattgacagtgaacggccacggggctaccatcacccccaaggatttctggaagacgacgactcaccagtgtgctacgattctcgtagatcaccccgaagaagattgctgcccccaaccccagccagccacagaagaagcagcttcaacttcgagtgtctcagaagacaaagcagccaggaggaggttccgagtagtcctatcttccctcaccgcaccgctctcccccttcatcttatgcagcagcaaattatggctgtcgctggtctggatagtagtaaagcgcagaaatatagcccatctcattcaactagatcttgggccactccgccagccaccccaccctatcgggattggacgccatgctatacccccttaattcaagtggagcagagcgaagcactcgaccaggtcaatggctccctgccctctttgcacaggtcaagctggtatactgatgaaccagacatctcctatagaacctttactccggcctccctcactgtcccgagcagctttcgcaacaaaaatagcgacaagcagcgcagtgctgatagtctggtggaagctgtgctcattagcgaaggactgggaagatacgcacgggacccaaagttcgtgtctgccactaagcacgaaatcgcagatgcctgcgatctaaccatcgacgagatggaatctgccgcaagcactctgttgaacggaaacgtgaggccccgcgccaatggggacgtgggtcctctctcacacagacaggattacgaattacaggactttggacctggctactccgatgaagaaccagacccaggtagggacgaggaggatctggcggatgagatgatctgcatcactactctttag

SEQ ID NO: 110439 - DNA, 5565 bp, Artificial Sequence
  Description of Artificial Sequence: Synthetic coding sequence
gctaatgggacagagtgtcgctcaggttgggtgggcccaaatggcgggatcacgaatttcgataactttgcattcgccatgttgactgtatttcagtgtataaccatggaagggtggactgatgtgctgtactggatgaacgatgcaatgggctttgagctcccttgggtctacttcgtgtcactcgttatctttgggagcttcttcgtgctcaacttggtgcttggcgtacttagcggcgaattctctaaagaaagggagaaggcgaaagctcgtggcgacttccagaagttacgagagaaacagcagttggaggaggacctgaagggttatctcgattggattactcaggccgaagacattgaccccgaaaatgaagaagaggggggcgaagagggtaagcgtaacacaagtatgcctacgtccgaaaccgagagcgtgaataccgagaacgttagtggagagggggagaatagaggatgctgcggatctctgtggtgctggtggaggcggcgcggcgctgcaaaggctggtccttcgggatgtcgcagatggggacaagcaattagtaagtccaaactgagccgaagatggcggcgctggaatcgcttcaatcgacggaggtgccgagcagccgtcaagagtgtaaccttctactggctcgttatcgtactggtgtttctgaatactctcaccatatcttctgagcactacaatcaacccgattggttgacacagatccaagacatcgcaaacaaggttctattggctctatttacttgcgagatgctggtcaagatgtattctttaggcctccaggcctattttgtatcattattcaaccgctttgattgcttcgtggtatgtggaggcatcaccgaaaccatattagtggaactagagattatgtcacctctgggaattagtgtctttcgctgcgtccgtctgctccggatatttaaagtgacccggcattggactagcttaagtaacctggtcgcatcccttctaaattcaatgaagagcatagcctcacttcttctcctgttattcctgttcatcatcatcttttctctgttgggtatgcagttatttggaggaaaatttaactttgacgaaactcagacaaaacggtccacctttgacaatttccctcaagccctgctgactgtcttccagattttgacgggagaggactggaacgctgtcatgtacgatgggataatggcctacggcggcccatctagtagcgggatgattgtgtgtatctattttatcatcctgttcatctgcgggaactacatcctcctgaatgtttttctcgccatcgctgtagataacctggcagatgcagaaagcctgaacaccgctcagaaggaggaggcagaagagaaggagaggaagaagattgcacgcaaagagtctttggaaaacaagaaaaataacaaaccagaggtgaaccagattgccaactctgacaataaggtgactattgacgactaccgggaagaagatgaggataaggatccctatcccccatgcgatgtgcctgtgggggaagaggaggaggaagaagaggaagacgaacccgaggtgcccgctggtccacggcccaggcgaattagcgagctcaatatgaaggagaagatagctcccatccccgagggcagcgccttttttattttgtccaaaaccaacccaattcgagtcggctgccataagcttattaatcatcacatctttacgaacctgatcctggtatttatcatgctgtcttcagctgcactggcggccgaggatcccatcagatctcacagctttcgtaataccattctgggctactttgattacgcctttacagcaattttcaccgtcgaaatcctactcaagatgaccacctttggcgcatttttacacaagggcgcattctgcaggaactattttaatctactagatatgctcgtggtgggtgtgtcgttggtaagttttgggatccagtcttccgcaatatctgtggtcaaaatcctgcgagtcctgagggtcttaagacccctacgggccatcaaccgagccaagggcctgaaacacgttgtccagtgcgtcttcgtggcaatccgtacgattggaaacatcatgatcgtgacgacactgctgcagttcatgttcgcctgtataggcgttcagctttttaaaggcaagttttacaggtgcacagacgaagctaagtcaaatccggaagagtgtagggggctgtttatcttgtacaaggacggcgatgtcgatagcccagttgttagagaacgaatatggcagaatagtgactttaacttcgacaacgttctgtccgccatgatggccctctttacagtctctacattcgaggggtggccagcgctgctgtataaggctatcgacagcaatggtgagaatattgggcccatctacaaccatagggtggagatctctatcttctttatcatctacatcattatcgtggccttttttatgatgaatatcttcgtaggattcgtcattgtaacatttcaggaacagggagagaaagagtataagaactgcgagcttgacaagaaccaacgccagtgcgtcgaatacgccttaaaggctcgcccactgcgtaggtacatccccaagaacccataccagtataagttttggtacgtggtaaattctagcccgttcgagtatatgatgttcgttttaataatgctcaacacactttgtctggctatgcagcattatgaacaaagcaagatgtttaacgatgccatggacatccttaacatggtttttacaggggtgtttacagtcgaaatggtcctgaaagtcatcgcttttaaacccaaacattattttacagacgcatggaatacctttgatgcactgatcgtagtgggctccgtagtggatatcgcaatcacagaggtgaacccaaccgagtccgaaaacgtccctgtgccaactgccacccccggcaattccgaggagagtaaccgcatttccatcaccttttttaggttatttcgagtcatgcgacttgtcaagctcctcagcagaggggagggaattcggacccttctttggaccttcatcaaatccttccaggcactgccatatgtggcgctattgatagcaatgttgtttttcatctatgcagtgatcggaatgcagatgttcggcaaagttgctatgcgcgataataaccagatcaaccggaataataatttccagaccttcccacaagccgtgctgctcctgtttagatgtgctaccggggaggcctggcaggagattatgctcgcatgcctcccgggcaaactgtgcgatcccgaatccgattacaatcccggcgaggagtatacatgtggctcaaatttcgcaattgtgtattttatttccttttatatgctatgtgcatttttgataatcaacttattcgttgctgttattatggacaattttgactatctgaccagggactggtcaatcctgggacctcaccacctcgacgaattcaaacggatatggagcgagtacgatccagaggccaaagggcggattaagcacttggacgttgttacactactgcgcaggattcagcctcccttgggatttggtaagctgtgtccacatcgtgtggcatgcaagcgcctggtcgcgatgaatatgcccttgaactcagacgggacagttatgttcaatgcgaccttgtttgccctggtgaggaccgcattgaagatcaaaacagaagggaacctcgagcaagccaacgaggaattacgggccgtgattaagaagatttggaagaaaacttcaatgaaactgctcgaccaggtggtgcctccagcaggagatgatgaggtcacggttggtaaattttatgctacgttcttgatccaggactattttcgaaaattcaaaaaaagaaaggaacagggactcgtgggaaagtaccctgcgaaaaacacaacgattgcacttcaggcaggacttcggaccctgcacgacatcggtcctgagatccgccgagccattagctgtgatctgcaggatgacgagccggaggagactaagcgagaagaggaggatgacgtctttaaacggaacggagccttgttaggaaatcacgtgaatcacgttaatagtgatagaagagactccctgcaacaaaccaacactacacaccgcccactgcacgtgcaaaggccatcaatacccccggccagtgacacagagaagcccctgttcccaccagcagggaattctgtttgccacaaccaccacaaccacaatagcattgggaagcaggtgccaaccagcacgaatgcgaatttgaacaacgccaacatgagcaaggccgctcatggcaagaggccctctattggtaacctggagcatgtgtctgaaaatggccatcacagctcgcataaacacgatagggaaccacagagaagaagctctgtgaagaggacccgttactacgagacgtacattcgctccgatagcggggatgaacaacttcccacaatttgtagagaagacccagaaattcacggctactttagggatccccattgtctgggcgagcaggaatatttctctagtgaggaatgttacgaggacgacagctcccctacctggtctaggcaaaactatggctactattcgagatatccaggaaggaatattgacagtgagagaccccggggatatcatcatccccagggcttcctagaggatgacgattcacctgtgtgctatgactctagacgaagtccacgcagaaggctgctgccacctacccccgctagtcacagaaggagctctttcaattttgaatgtctgcgtaggcaaagttcccaggaggaggtccccagcagtcctatttttccacacagaacagcactgcccttacatctgatgcagcaacagatcatggcggtggccgggctggatagtagcaaggctcagaaatatagcccgagccacagcaccagatcatgggccaccccgccggcgactccaccataccgagactggaccccatgttacacaccccttatccaggtggagcaatccgaggcccttgaccaggtcaacggctcgctgccttccctccatagaagctcttggtatactgacgaaccagacattagctatcgtacgttcacacccgcgagtcttaccgtaccatccagttttagaaacaagaattctgataagcagcggtctgccgattccctggtggaggccgtcctgattagtgagggcctgggtagatacgccagggatcctaagtttgtcagtgctaccaaacacgaaatcgccgacgcttgcgaccttactatagatgaaatggaaagtgccgcaagtactttgctgaacggcaatgttcgacccagggccaacggtgatgtaggacctctgtcccatagacaggactacgagttacaggacttcggccccggctacagcgacgaggaaccagatcctggacgggatgaggaggatctagccgatgaaatgatctgtataacgacgctgtag

SEQ ID NO: 110440 - DNA, 1620 bp, Artificial Sequence
  Description of Artificial Sequence: Synthetic coding sequence
atgggagagacatggttgtgtccagccgccctgggactgctatacaaggccatcgatagtaacggcgaaaatatagggccgatttacaaccatcgggtggaaatctccatcttctttattatctatattattattgtcgccttctttatgatgaacatttttgttggctttgtaattgtgactttccaggagcagggtgaaaaagagtacaagaactgcgagttagataagaatcaacgtcagtgcgtagagtatgcactgaaggccagacccctacgccgttatatacctaagaacccttatcagtacaaattttggtatgtcgtgaacagcagtcctttcgaatatatgatgttcgtgctgatcatgcttaacactctctgcctagccatgcaacactatgagcagtcaaagatgttcaatgacgcaatggatatcctgaacatggtgttcactggagtatttactgtggaaatggtgctcaaggtgattgcctttaaacccaaaggctattttagcgatgcttggaatacatttgacagcctgatagtgatcgggtctatcatcgatgtggctctgtcggaagccgataactcggaagagtccaaccgtatctccatcacgttctttagactgttccgagtaatgagactagtgaagctactctccagaggggagggaatccgaacccttctttggacgtttatcaaaagtttccaggcactgccctatgtggccctgctgattgcaatgctgttctttatttacgcagtcattgggatgcagatgtttggtaaggtggccatgcgcgacaataaccaaatcaaccgtaataataatttccagacatttccacaggccgtgcttctcctgtttaggtgcgctaccggcgaggcgtggcaagagattatgctcgcctgtctgccagggaagctctgcgatcccgaatcagattacaacccaggcgaagaatacacctgcggctccaactttgctatcgtgtactttatctccttctacatgctgtgcgcttttctgattataaatctcttcgttgcggtgatcatggacaattttgactaccttacccgggactggtcaatactaggtcctcaccacctggacgagttcaagcgaatctggtcagagtacgaccccgaagccaaaggccgtattaagcacctggatgtcgtgacattactgaggagaatacagccccccttaggttttgggaagctttgtccgcaccgggttgcttgtaaaaggctggtggccatgaacatgcctcttaatagtgacgggaccgtgatgtttaacgcaacactgtttgccctggtgagaacagcattaaagatcaaaacagaagggaatttggagcaggccaatgaggaattacgcgctgtcattaagaagatctggaagaagacatcgatgaagctcctggatcaagtagtccctccagctggcgatgacgaagtgaccgtcggcaaattctatgcaaccttcctcatccaagattattttcgtaagttcaagaaaaggaaagagcaaggcttggttggcaagtaccctgccaagaataccacaatcgccttgcagatgctagagaggatgctttag

SEQ ID NO: 110441 - DNA, 1056 bp, Artificial Sequence
  Description of Artificial Sequence: Synthetic coding sequence
atgaacgggctggctcaatctcgcttggagacttgtattagttaccttcactgctacagcgctgggctgaggaccttgcacgatatcggccctgaaatccgtcgagccatctcttgcgacctgcaagatgacgaaccggaagagaccaagagagaggaggaagatgacgtatttaaacgcaacggagcacttctgggtaaccacgtcaatcacgtgaattctgacagacgtgactctctgcaacaaaccaataccacccaccggcccctccatgttcagaggccctctatcccccccgccagcgacacagagaaaccattgttcccacctgctggaaattcagtctgtcacaatcaccacaatcacaattccatcggaaagcaggtccccacgtccactaatgccaatctgaataacgcgaacatgtctaaggccgcccacggtaagcgaccctcaattgggaatctggagcacgtttcagagaatggacatcactcgagtcataaacacgacagggaaccacagaggaggagtagcgtgaagaggactagatactacgaaacctacattcgctcagattctggcgacgaacagttaccaacaatttgcagagaggatccagagattcatggctactttagggatccccattgtctaggggagcaagaatacttttcctccgaagagtgttatgaagacgactcaagtcctacatggtctagacagaattacggatattacagtagatatccgggccgcaatatcgatagcgaacgtccaagaggatatcaccatccccaaggcttccttgaagatgacgacagccccgtctgttacgactcgaggcggagcccccgtagacggctgctgcctccaacgccggcctcacatagacggtccagctttaattttgagtgccttcgtaggcaatctagtcaagaggaggttccatcaagcccaatttttccccacaggacggccttgcctctccaccttatgcaacagcagagcccattgtcctcagatcatggttcctgtaggcccaggttcaaatag

SEQ ID NO: 110442 - DNA, 5901 bp, Artificial Sequence
  Description of Artificial Sequence: Synthetic coding sequence
atgtctgagtccgagggcggaaaggatacgaccccagagccgagtccggcaaatggggccggacctggacccgaatggggcctttgccccggacctccagcagtcgaaggagagagctcaggcgctagcggcctgggcactcctaaacggagaaaccagcactctaaacataagacggttgctgtggcatcagcccaacggagccctcgggcccttttctgtttgaccctggcaaatccgctcagaagaagctgtatttcgattgtggaatggaaaccattcgacattctgatcctcctgaccatcttcgctaactgtgttgccctaggtgtgtatattccgttccctgaagatgactccaacacggcgaaccataacctagagcaggtggagtacgtcttcttagttatctttacagtagagactgtcctgaagattgtggcctacggcctggtgctgcacccgtccgcttatattaggaatggctggaatttgctggactttattatcgtggtcgttggccttttctctgtgctcctggaacagggaccggggagacctggggacgcacctcatacgggtggaaaacccggcggattcgatgtcaaggccttacgggcattccgcgtgctacgtccattgcggctggtgtccggcgttccttcactgcatatagtgctaaactccatcatgaaggccctggtcccattactgcacatcgctttgttggtgctcttcgttataataatctacgccatcatcggactggagctgttcttgggccggatgcataagacctgttacttcctggggagtgatatggaagcagaggaggatcctagcccctgtgcttcaagcggatccggccgagcatgcacacttaaccagactgaatgcaggggcaggtggccaggcccgaatggagggattaccaattttgacaacttcttcttcgccatgttaacggtcttccaatgtgtaacaatggaggggtggactgacgtgctgtactggatgcaagacgctatgggatacgagcttccgtgggtttactttgtatccctcgtcatcttcggtagctttttcgtgcttaatctggttctgggcgtgctgagcggagagttctccaaggagcgtgagaaggccaaggcaagaggcgattttcaaaaacaaagagagaagcagcagatggaagaagatctaaggggctatctggattggattactcaagctgaggagcttgacatggaagatccaagcgctgacgacaacctcggccctcagctggctgaactgactaatagaaggcgagggcgcctgagatggttctcacactcgaccagatcaacccacagcactagctcccatgcctcgctgcccgctagcgataccggctctatgaccgagactcagggagacgaagacgaggaagaaggagcgctggcgagttgtactcgctgtctgaataaaattatgaagacgagagtctgtagacgcctccggagagctaacagggtgctcagggcgcgatgcaggagagccgtgaagtctaacgcctgctactgggcagtccttttgctcgtgtttcttaacaccctgacgatcgcaagcgagcatcatgggcagcctgtctggctcactcaaattcaggaatacgccaataaggtactgctttgtctgttcactgtagagatgttactcaagctttatgggttgggcccctctgcctatgtgtcctccttttttaacaggtttgactgttttgtcgtttgtgggggcatcctggaaacaactctggtagaagtaggcgccatgcagcccctgggaatatccgtgcttagatgcgttcggctattgcgtatttttaaagttactcggcattgggctagcctgtcgaatcttgtggccagtctgctgaactctatgaaatctatcgcctcactactgttacttctctttctttttattatcatattttctcttctgggcatgcaactttttgggggaaagtttaacttcgaccaaactcataccaaaaggtccacctttgacacattcccccaagcactgctgactgtatttcagattctcacaggggaagattggaacgtggttatgtatgatggaattatggcctacggcggcccgttctttcctggcatgcttgtctgcatttacttcataatcctgtttatatgtgggaactatatcctgttaaacgtgtttctcgccattgccgtggacaacctggcttccggggacgcaggaacagccaaagacaagggcggcgagaagtccaatgaaaaagacctgccgcaagaaaatgaagggctggtgcctggcgtcgagaaggaagaggaggaaggcgcaaggagagagggcgctgacatggaagaggaggaagaagaggaagaggaagaagaagaagaggaggaggaggaaggagctggtggagtagagcttcttcaggaggtggtcccaaaagaaaaggtcgttccgataccagaggggagtgccttcttctgtctgagccagactaatccactcagaaagggatgccataccctcatccaccaccatgtcttcaccaatcttatcctagtttttataatcctttctagcgtgtcccttgccgcagaggatcctatacgggctcatagctttcggaaccatattttaggatacttcgattacgcttttactagtattttcaccgtggagattctccttaagatgactgtcttcggcgctttcttgcaccggggctctttttgtcggagttggttcaacatgctagatctgctcgttgtgtctgtatctctgatctcatttggtatccatagcagtgccattagcgtggtgaagattttgcgtgtgttaagggtgctccgtccgctgcgagccataaatcgtgccaaggggttgaagcatgtcgtgcaatgcgtgtttgtggccatccggactattgggaacattatgatcgtgacaaccttgctccaattcatgttcgcttgtatcggtgttcagctgttcaagggaaagttttacacctgtactgacgaggcaaagcacacccctcaggagtgtaagggaagttttctggtataccctgacggtgatgtaagtcggcccctggtccgtgaaaggctgtgggtaaatagcgactttaactttgacaatgtcctgtcagctatgatggcgttatttactgtgtctacgttcgagggatggccagcgctcctctataaggccatcgacgcctatgccgaagaccatgggcccatctacaattaccgtgtggaaatatcagtgtttttcatcgtttatatcattatcatagcctttttcatgatgaatatttttgtgggattcgtgattatcacttttcgcgcacagggcgaacaagaataccagaactgcgaattggataagaaccagagacagtgcgtcgagtatgccctcaaggctcagcccctacggcggtatatacccaagaatccccaccagtaccgcgtctgggctacagttaattctgctgcctttgaatacctgatgttcctgttaatcctcctaaacacggttgccctcgccatgcagcactatgaacagaccgctccattcaactacgcaatggacatactgaacatggtgtttacgggcctgttcacaatagagatggttctgaagattatagcgttcaagccaaagcactacttcaccgacgcatggaacactttcgacgccctgatcgttgtcgggtctatcgttgacattgcagtgaccgaggtcaataatggaggtcacctgggcgaatcttcggaggactcttccagaatctcaattacgttcttcaggctttttcgggtgatgagactggtaaaactgcttagtaaaggcgaagggatcagaactttgctttggactttcatcaaatcattccaggcactaccatacgtggcactgctgatcgcaatgattttcttcatctatgccgtaatcgggatgcagatgttcggaaaggtggccctgcaggacggaacccaaataaacaggaacaacaatttccaaactttcccgcaggccgtactgctactgttcaggtgcgcaactggtgaagcttggcaggaaataatgctcgcaagcttgcctggcaatagatgcgacccggaatccgattttggcccaggggaagagttcacatgcggctctaatttcgccattgcatacttcatctcatttttcatgctctgcgctttccttatcattaatctgttcgttgcagtgatcatggataattttgattacctgactagagattggtcgatcttgggccctcaccaccttgacgagttcaaacggatatggtctgaatacgatcctggagctaagggtcgcatcaagcacctggacgtggtggcactcctccgaaggattcagcccccattagggtttggcaagctgtgtccccatagagtggcttgtaagaggttagtcgcaatgaacatgcctctcaactcagacggaacagtaacttttaacgcaactctctttgctctggtacgcacatccctgaaaataaagacggaaggcaacctcgagcaggcaaaccaggaactacgaatcgtgattaagaagatatggaaacggatgaagcaaaagctcctggacgaggtcattcctccacctgatgaagaggaggtgaccgttggcaagttttatgcaactttcctgattcaggactatttcaggaaattccgacggcgcaaggagaagggactgctgggcaacgatgcggctccatcaacctcgtcggccctgcaggcgggactgaggtcccttcaggatttaggtccagaaatgcggcaggcactcacatgtgatactgaggaggaagaagaagaaggacaagagggggtagaggaagaggatgaaaaggacctggagactaataaagcaacaatggtttcacagccttccgcccgccgcgggtccgggataagcgtgtccttgccagtgggagaccggctgcccgactctttgtcatttggccccagcgatgacgacagaggcactccaaccagtagccagccgagcgtcccccaggctggctcaaacacgcatcgccgcggatccggagcgctgatcttcacaatccccgaagagggaaacagtcaacccaaaggcaccaagggccagaacaagcaggatgaggacgaggaagtgcccgacaggctgtcgtacctggatgaacaggcaggcaccccaccttgtagcgtcctcctcccgccccaccgcgcacagagatacatggacggtcacctcgttcctcgccggcgacttttgcctcccacacctgctggccgcaagccatcattcacaatccagtgtctacagcgccagggaagctgtgaggatttgccgatcccggggacctaccaccggggaagaaactctgggcctaaccgggcccagggtagttgggccacgccacctcaacgaggccgcctcctgtatgccccactgcttctggtcgaagagggggctgccggagaaggatacctgggtagatccagtggcccactcagaacctttacttgtcttcatgtgcctggcacccacagtgacccgagccatggaaaaaggggctcggccgattcactcgtggaggcagtcctgatcagcgaaggacttggcctgtttgcacgcgacccgcgctttgtcgctcttgcaaagcaggagattgcggacgcatgtagattaaccctggatgagatggacaatgctgcatccgacctactcgcccaaggcactagttcactgtactcagatgaggaatccattttgtctaggttcgatgaagaggaccttggagatgagatggcgtgcgttcacgccttatag

SEQ ID NO: 110443 - DNA, 5739 bp, Artificial Sequence
  Description of Artificial Sequence: Synthetic coding sequence
atgtcagagagtgagggtggtaaaggagagcggatccttccaagcctgcagaccctcggcgcgtccatagtcgagtggaaaccctttgacatcctgatccttcttactatttttgcaaactgcgtggctctgggagtttacatccctttcccagaagatgattcaaacactgccaatcataatcttgagcaggttgagtacgtattcctggtgattttcacggtcgagacggtgttgaaaatagtggcatacggcctcgttctccacccttctgcttacatccggaatggatggaacctgcttgattttatcatagtcgtggtgggcctcttttccgtactgttagaacaggggccagggaggcccggcgatgcacctcacacgggtggtaagcccggcggtttcgatgttaaagctctcagagctttccgggtcctgcgaccactgaggctggtctcaggcgtgcctagccttcacatagtcttgaactcaatcatgaaagccctcgtgccattgctgcacatcgcgctcttggtgcttttcgttatcattatctacgccatcataggcttggaactgttcctgggacggatgcataagacctgttatttcctgggaagcgacatggaggcagaggaggaccccagcccctgcgcgtccagcggtagcgggcgcgcttgtacattgaaccagaccgagtgtcggggaagatggcccggccctaatggaggaatcaccaattttgataactttttttttgccatgctgacagtgttccagtgtgtcaccatggagggctggacagatgtcttgtactggatgcaggatgcaatgggatatgagctcccttgggtctactttgtctcactggtgatcttcggttccttttttgtactgaacttggtcttgggagttctgtctggcgagttctccaaggagcgcgagaaggccaaagctcgaggggatttccagaaacagcgggaaaagcagcaaatggaggaggacttaagagggtatttagattggattacccaggccgaggaattagatatggaggatccatccgctgacgacaaccttggaagtatggcggaggaggggagggcaggtcacaggccccaattggccgagttgaccaaccgaaggcgagggcgtctacggtggtttagccactcgacaaggtccactcacagtacgtcttctcacgcaagtctgcccgccagtgacacggggtcaatgacagaaactcagggggatgaggacgaggaggaaggggcgcttgcatcatgcactcggtgtctgaataaaattatgaagaccagggtttgtcgcagacttcggagggccaatcgggttctccgcgctcgatgcagaagagcagtaaagagtaacgcgtgctactgggccgtcctgttgctcgtttttctaaatactctgacaattgccagtgaacatcacgggcagcccgtgtggttgactcaaattcaggagtacgctaataaggtattactgtgcctgtttacagtcgaaatgctcctgaagctgtacggactgggaccttctgcatacgtaagcagtttctttaatcgatttgattgtttcgtggtgtgcggcgggatcctagagacaaccctcgttgaagtaggagccatgcagcccctcgggatttctgtccttagatgcgtcaggttgctgcgcatttttaaagtgacaagacactgggcctctttatcaaatctggttgcaagtttgctaaattcgatgaaatctattgccagtctgctcctcttgctgttccttttcattataatcttctctttacttggtatgcagctgtttggagggaagtttaacttcgaccaaactcacaccaaacgctctactttcgatacatttcctcaggcgcttctgacagtgtttcagatcctgactggggaagactggaacgttgtgatgtacgatggcattatggcttacggaggtcccttttttccgggcatgttggtctgtatatatttcatcatactgttcatatgtggaaattacattctactgaacgttttcctggctattgccgttgacaacttggcatccggcgacgcaggaactgcgaaggataaaggtggagaaaaatccaacgagaaggatctgccccaagaaaacgaaggcctggtccccggggtggaaaaggaagaggaggagggcgcccgccgggagggcgcggacatggaagaagaggaagaagaggaggaggaggaggaagaagaggaggaggaggagggcgccgggggcgtggagctcctgcaggaggtggttcccaaagaaaaggtggtgcccatccctgaaggctctgcctttttttgcttgagccagactaacccacttagaaagggttgtcacaccctgattcatcaccacgtgtttacgaatttgattcttgtcttcatcatattgtctagcgtctccctagcagccgaggatcctatccgcgcgcactctttccgtaaccatatcttgggatactttgactatgcctttacatcgattttcactgtggaaatcttgctcaagatgaccgttttcggtgccttcctacacaggggctcattctgtcgatcatggttcaacatgctagatctgctcgtcgtgtcagtatctcttatatcctttggcattcactcttcagctatctctgttgttaagattctccgagtgctacgtgtcctgagacctctgcgggcaattaaccgggctaagggcctgaagcatgttgttcagtgtgtatttgtggcaattcgaacaattggtaacattatgattgtgactactttacttcagtttatgtttgcatgcattggtgtccagctctttaagggaaaattctatacctgtaccgacgaggcaaagcacaccccccaagaatgtaagggctcctttctggtgtatcccgacggagatgtgagccggccactggtgagggaacgactgtgggtgaattcagacttcaactttgataatgtgctgtccgccatgatggcactcttcaccgttagcacattcgaagggtggcccgccctgttgtataaggcaattgatgcttatgctgaggatcacggaccgatctataattatcgggttgaaatatcggttttctttatcgtgtacatcatcattatagccttctttatgatgaacatcttcgtgggcttcgttatcatcacctttcgggcccagggtgagcaggaatatcaaaactgtgagttggacaagaaccagcgtcaatgcgtcgagtacgcactgaaggctcagccgttacggagatacatcccgaagaacccacatcaataccgagtgtgggctacggtcaatagcgcagcttttgagtacctcatgtttcttcttattcttctgaataccgttgccctggccatgcagcactacgaacagacagcccctttcaattatgccatggatattcttaatatggtgtttacaggcctgttcaccattgagatggttctgaagatcatcgcttttaaacctaaacactattttaccgatgcctggaatacattcgacgcactgattgtagttggctcaatagttgacattgcagtaactgaggtgaataacggcgggcacctgggagaatccagtgaagacagttccagaataagcatcactttcttccgtctgtttagggttatgcgtctggtgaaactgctcagtaaaggggagggcattagaactctgttgtggacattcattaagagctttcaagcccttccttatgttgccctcctgatcgccatgatctttttcatctacgcagtgataggaatgcagatgttcggtaaagtggcgctccaggacgggacacagattaaccgtaataacaactttcagacgttcccccaggctgtcctgctactgtttagatgcgctacgggggaagcctggcaggagatcatgctggccagcctaccaggcaacagatgcgatcctgagtctgattttggacctggtgaagagttcacatgcggaagcaatttcgccatcgcgtactttatcagtttttttatgctgtgtgccttccttatcatcaacctttttgtagctgttatcatggacaacttcgactatcttacccgagactggagtatcctcggccctcaccatttggatgagtttaaaagaatatggtccgaatacgatcccggcgctaaaggacgcattaagcatctagacgtcgtagctcttctccgccgaatacaacctccactaggctttggcaagctatgcccgcatcgggtcgcgtgtaagaggcttgtggccatgaacatgccactgaacagcgatggaactgttacttttaacgcaactctgtttgctcttgtgcggacttctctgaagatcaaaacggaaggtaacctggaacaagcaaatcaagagctgagaatagtgattaagaagatttggaagaggatgaagcaaaagctgctggacgaagttattcctccccctgacgaagaggaggtaacagtagggaagttctatgctacctttctcattcaggattactttcggaagtttcgcagaaggaaggaaaaaggccttctgggaaacgacgccgcgccttccacgtccagcgccctccaggctgggctgcgtagcctacaggaccttggtcccgaaatgaggcaggccttgacatgcgacacagaggaggaagaagaggaaggccaggagggcgtcgaagaggaagatgagaaagatctggagacaaacaaggcaactatggtaagccaaccatccgcaagaagaggaagtggtataagcgtctctttgccggtcggcgacagactaccggattcactgtcttttgggccatcagacgacgatcggggtaccccgaccagttcccagccttctgtgccccaggctggttccaatacacaccgaaggggaagtggcgccctgattttcaccatcccggaagagggcaactcacagcccaaagggaccaaaggccagaacaagcaggatgaagacgaagaggtgcctgatagattgtcctacctcgacgagcaggcaggcacccctccatgcagtgtcctgctgcctccccatagagcccagagatatatggatggacatctggttccccggaggcggctgctccccccaaccccagctggtcggaaaccttcctttacgatccaatgcctccagcggcagggcagttgtgaggacctcccaatccccgggacataccaccgcggccgaaattccggaccgaatagggcacaggggtcctgggctacacccccgcaacggggtaggttgttatatgcacctctgctgctcgtggaggagggcgcagcaggcgagggctacttgggccgcagcagcggcccactccgcacattcacttgtctgcatgtaccaggcacacacagtgacccatcccacgggaaaagaggaagcgctgacagcctggtagaagctgtgctgatctctgaggggttgggactgttcgcgagagatccccggttcgtggcccttgccaagcaggaaatcgctgatgcgtgcagactgactctggacgagatggacaacgccgcctctgatctattggcccaaggcacatcatccttatactcagatgaggagtcaatcctttctcggttcgacgaggaggatcttggggacgagatggcctgcgtacacgccctgtag

SEQ ID NO: 110444 - DNA, 5934 bp, Artificial Sequence
  Description of Artificial Sequence: Synthetic coding sequence
atgtctgaatcagagggcgggaaagataccacacctgaacccagccccgctaacggcgctggccccggaccagagtggggcctatgccccggcccccccgcagtggaaggagaaagcagcggggcttccggattaggaacacctaaacgaaggaaccagcattccaagcacaagacagttgcggtggcctccgctcagagaagtcctcgagccctgttctgcctcactctcgcaaatccactgagacggtcatgtatttctatcgttgaatggaagccctttgacattctaattctgctgactatcttcgcaaactgtgttgcacttggcgtgtacatccccttcccagaggatgacagtaataccgcgaatcacaacctagaacaagtggagtatgtatttctcgttatattcactgttgagacggtcctcaaaatcgtagcttacggcttggtgttacatcccagtgcatacatcagaaacggctggaatctattagattttattattgtcgtggtcggactgttctccgtcttgctggagcaagggcctgggaggcccggagatgctccccacaccggtgggaaacctggtggcttcgatgtgaaagctttacgtgcgttcagggtgctgcgacctctgcgactcgttagtggcgtgcctagcctccatatcgtgctgaacagcatcatgaaggcgctggttcccctgctgcacatcgcgctgctggtcctctttgtgataattatctatgctataatcggactcgaactcttcctgggcaggatgcacaagacctgctatttcctaggcagcgatatggaggctgaagaggatcctagcccttgtgcgagtagtggcagtggacgggcatgtaccctgaaccaaacagaatgtcgggggagatggccagggcctaacggaggaataaccaacttcgacaacttcttcttcgctatgctcacagtgttccaatgcgtgaccatggaaggttggacggacgtgctgtactggatgcaggacgcgatgggatatgagcttccttgggtgtattttgtgagtctggtcattttcggctcttttttcgtgctgaacctcgtgctcggggtgttgtccggggagttctctaaagaacgcgagaaagcaaaggcccggggcgatttccagaagcagagggaaaagcagcagatggaggaagacctacggggctatctcgactggataactcaagctgaagaactagacatggaggacccctccgccgatgacaatctggggagtatggcggaggaaggaagggccgggcatcgcccccagctcgccgagctcaccaacagacgcaggggaaggttgcgatggttctcacattcgactcgtagtacacatagtacaagtagccacgcgtcactgcccgcatctgacacaggcagcatgaccgagacacagggcgacgaggacgaggaggaaggcgcgctggccagctgcacaagatgcctgaataagatcatgaagactagggtgtgccgtcgtctgagacgggctaaccgggtgctacgcgcccggtgtcgcagggccgtgaagagtaatgcttgttactgggcagtgctgctccttgtattcctcaacaccttgactatcgcatcagagcaccacggccagccggtctggctaacccagatacaggagtatgccaataaagtgctcctttgcttgttcacagtagaaatgctgctgaagttgtacgggctagggccctctgcatatgtgagctccttcttcaatcggttcgactgctttgttgtgtgcggcgggatcctggagacaacactcgtagaagtcggggctatgcagccattgggcatttccgtattacgatgtgtgaggctgctgcggatctttaaagtaacacgtcactgggctagcctgtcaaacttagtggccagcctgctgaatagtatgaaatccatagcctccctcctcttgctcttgtttttgttcatcattattttcagtttactcgggatgcaactgtttggggggaaattcaactttgatcaaacacacactaaacgaagtacatttgataccttccctcaggcactgctcaccgtgtttcagattttgactggagaggactggaatgtggtcatgtacgatggaattatggcatacggcgggccgttttttccgggtatgctggtgtgcatctatttcattatactatttatatgtgggaactacattcttcttaacgttttcttggctatagccgttgataatctcgctagcggggatgcgggcaccgctaaagataaaggaggtgaaaaaagcaatgagaaggacttgcctcaggaaaatgaaggcctcgtcccgggtgtggagaaggaagaagaagagggggctaggcgggaaggggcggacatggaggaggaggaagaggaggaggaggaggaagaggaagaggaagaggaggagggagccgggggggtcgaactgttgcaggaagtcgttccaaaagagaaggttgtacccattcctgaagggagtgcttttttctgtctgagccagaccaatccactgcggaagggctgtcataccttaattcaccaccacgtgttcaccaacctcattctggtgtttataatactgtccagcgtgtctctcgctgcagaagaccccataagggctcatagcttccgcaatcacatccttggttactttgattacgcctttacctcaatcttcacggtcgagatccttctgaagatgactgtgttcggggcctttctgcacagaggatccttttgcagaagctggttcaacatgttggacttattagtggtcagtgtctcgctaataagctttgggatccactcctcagctatttctgtagtgaaaatcctgcgcgttttgcgggtgctgagacctcttcgcgccatcaatcgcgccaagggccttaagcacgtggtgcagtgcgtattcgtcgccattaggacaatcggtaacataatgattgttacaacactgctgcagtttatgtttgcttgtatcggtgtgcagctgttcaagggaaagttctatacttgtaccgacgaagcgaagcatactccccaagaatgcaaaggcagcttcctcgtataccccgacggcgacgtcagtcggcccctggtgagggagaggctctgggtgaactccgacttcaacttcgacaatgtcctaagcgcaatgatggccctttttaccgtgtccacatttgagggctggcctgctctcctatataaggcaattgacgcgtacgccgaggatcatgggccaatatacaattaccgtgtagaaatcagtgtgtttttcattgtttacatcataattatcgcattctttatgatgaacatctttgttggatttgtgatcattacctttcgggcccaaggggagcaggaatatcagaattgtgagctggataagaaccagcggcagtgtgttgagtatgcgttgaaagctcagccattgcgccggtatattcctaagaatccccatcagtacagagtgtgggctacagtcaactcagcggctttcgaatatctgatgttcctgctgattctgttgaatacagttgccctagcgatgcaacattacgaacagacagcaccgttcaattacgccatggatatcctcaacatggttttcaccggactattcacaatagagatggtgctgaaaatcattgcctttaagcctaagcactacttcacagacgcttggaacacttttgacgcactcattgtggtgggatcgatcgtcgatattgcggtgaccgaggtgaacaacggcggccatcttggcgaaagcagtgaagatagcagtcggatttctataacattttttcgcctctttagagtgatgaggctggtgaagcttttgagcaaaggggaagggatccgtacactgctctggactttcattaagtctttccaagctttgccctacgtcgcattactgatcgctatgatcttcttcatctatgcggtgataggaatgcaaatgttcggaaaagttgcccttcaggacggaacccagatcaaccggaacaacaattttcagacatttccgcaggccgttctactgctgttccgttgtgcgaccggtgaagcatggcaagagatcatgctcgcctccctccctggaaacagatgcgaccctgagtctgactttgggcctggagaagagtttacctgtggttcaaactttgccattgcctactttattagcttttttatgctttgcgccttccttattattaatctttttgtcgccgttattatggataacttcgactacttgacacgggactggagcatcctcggacctcaccacttagatgaattcaaacgaatatggtccgagtatgatcccggcgctaagggacgcattaagcacctcgacgtggttgctctgttaaggcggatccagccacccctgggattcggaaagttgtgcccacaccgcgtagcctgtaaacgcctggttgcaatgaacatgcccctgaatagtgacgggaccgtgacctttaacgccactctgtttgcattggtccggactagtctgaaaataaaaacggaggggaaccttgagcaggccaatcaggagttgcgcatagtcattaagaagatttggaagcgcatgaaacaaaagctgttagacgaggtgattcccccgccagatgaggaggaagttacggtgggaaaattttacgctacttttctcattcaggactattttaggaaattccggcgccggaaggagaagggactcctaggtaacgatgctgccccctcaacatcaagcgctctgcaggcaggtcttcgcagcctgcaggatctggggcctgaaatgaggcaggcactcacgtgcgacacagaggaggaagaagaggagggacaggagggcgtggaggaagaagacgaaaaagatcttgaaactaataaggcaactatggtgtctcagccctctgccagacgcggcagcggtattagcgtgtccctacccgtcggagatagactgcctgactcactgagcttcggtccttctgacgatgaccgcggcacccctacaagtagccagccgagtgtccctcaagctggctccaacactcaccgcagagggagcggagccctcatcttcactattccagaggaggggaacagccaaccaaaagggactaagggacagaataagcaggatgaggatgaggaagtaccagataggctaagttacctggatgaacaggcaggcacacccccctgctctgtgctcctcccaccccatcgcgctcagaggtatatggacggacacctggtaccgagacggaggctattaccccctactccggcaggacgcaaaccatcctttaccatccagtgcctgcagcgacaggggtcatgtgaagatctgcctatccctggaacgtaccataggggccggaacagtgggccgaatcgggcccagggttcttgggccacccccccacagcgcgggcgcctgctctacgcaccgctgctgctcgtcgaggagggagccgccggagaggggtaccttggtcgaagcagcgggcccctacggacattcacttgcctccacgtgccaggcactcactcagatccttctcacgggaagaggggaagcgccgactccctagtggaggctgttctcattagtgagggcctggggctttttgcaagagaccctaggtttgtagccctggctaagcaggaaatcgccgacgcctgtcgccttaccctggacgagatggataacgctgccagtgatctgctggcccagggcactagctcactgtattcagacgaggagtccatcttaagtaggttcgacgaggaagatctcggagatgaaatggcttgtgtgcacgccctgtag

SEQ ID NO: 110445 - DNA, 5622 bp, Artificial Sequence
  Description of Artificial Sequence: Synthetic coding sequence
atggagccctcctcccctcaggacgagggactcaggaagaagcagcctaagaagcctgtgccagaaatcctgccccggccaccacgggctcttttctgtctcacattggagaaccccctgagaaaagcctgtatcagcattgttgagtggaagccgttcgagaccattatattattgactatttttgcaaactgtgtagctctagcagtgtaccttcctatgccggaagatgacaacaatagtctgaaccttggtctggaaaagctggagtacttcttcctgattgtcttctccatagaggcagcaatgaagatcattgcatatggattcctgtttcaccaggacgcttatctcagatctggttggaatgtgttggatttcacgatagtgtttctcggcgtgttcaccgttatcctggagcaggtcaatgtgatccagtctcacactgctcctatgtctagtaaaggagccgggttagacgtgaaagccctgagggcctttagggtgcttcgtcccctccggcttgtgagtggcgtcccgagccttcaggtcgtgttgaattccatctttaaagcgatgttgcctctgtttcacattgcccttctggtactcttcatggttattatttacgcaattatcgggttggagttatttaaagggaaaatgcataaaacctgctatttcattgggacagatatcgtcgcgaccgtcgagaatgaggagccctccccgtgcgcccgcactgggtccggccgtagatgtacaataaacggaagcgagtgtcggggcggctggccgggacccaaccacggaatcacacatttcgataactttggattttccatgctgaccgtgtatcagtgtattacgatggagggctggaccgatgtgctttactgggtgaacgatgcgatcggcaatgaatggccttggatttattttgtcaccctaatacttcttggcagtttctttatcctcaacctcgtgctgggcgtcctttcaggtgaatttaccaaggaacgagaaaaggcaaaatctagggggacttttcagaagctgcgggaaaagcaacagctagacgaggacctgaggggatacatgagttggatcacacagggtgaggtgatggacgtagaggacttccgggagggaaaactgagcttagacgaggggggatcagatacggaatctctttacgagatcgcaggcctgaataagatcattcagtttattcgacattggagacagtggaatcgaatatttcggtggaaatgccatgacattgtcaaaagtaaggttttttactggctcgtgatcttgattgttgcactgaatacgcttagtatcgcctccgagcaccacaatcagcccttgtggcttacacgcctccaggatatagcaaaccgcgtgttactcagcttgtttacgacagagatgctcatgaagatgtacggtttgggactgagacagtactttatgtctattttcaataggttcgactgcttcgtggtgtgtagcggtatcctcgaaattctcctggtagagtctggagcgatgactccgcttggaatctccgtgctgcgatgcatcaggctcctgcgcatctttaagatcactaaatactggacttcactgtccaacctcgtggcctccctcttgaactccattagatctattgcctctctgcttctgctgctgtttttattcatcgtgatcttcgccctgcttggaatgcagctttttggcggccggtacgattttgaggacaccgaggttcgacgaagtaacttcgacaacttcccacaggctctcatatccgtgttccaggtcctcacaggagaagattggacatctatgatgtataacggtatcatggcctatggtggtccatcttaccctggtatgcttgtgtgtatttattttatcatcctctttgtttgcggcaattatatactcctgaatgtcttcctcgccattgctgtagacaatttggccgaggccgaaagtctgacctctgcacaaaaggcaaaggctgaggaaaaaaaacgaagaaagatgtctaaggggctcccggataaatcagaagaagaaaaatctactatggcgaaaaaactggaacagaagcccaaaggggaaggcatccccacgactgccaaacttaagattgacgagttcgaatccaatgtgaacgaagtaaaggacccttacccgtccgctgattttccaggggatgacgaagaggatgagcctgagattcccctctctcctcgaccaaggccacttgctgagctccagctcaaggaaaaggcagtgcctatccccgaagcctcgtctttttttatattcagtcccaccaacaaaattagggtgctctgtcacaggattgtaaacgccacctggttcactaacttcatactgttatttattcttctctcttccgctgctttggccgctgaagatcctatcagagccgactccatgagaaatcagattctaaagcatttcgatatcggattcaccagtgtatttactgtagagattgtcttaaagatgaccacatacggagcattcttgcacaagggcagtttctgcagaaactactttaatatgctcgacttgctggtggtggccgtttccctcatctctatgggcctggagtcctctgcgatcagcgttgtaaaaatcctgcgagtgcttcgtgtcctgcgcccattacgcgccataaacagagctaagggactcaagcacgtggttcagtgcatgttcgtggccatttcgacaatcgggaacatcgtcctcgttaccactcttttacaattcatgttcgcctgtatcggagtgcagctatttaagggaaagttctttaggtgtacggatctaagcaagatgactgaggaagaatgcagagggtactactacgtttacaaagatggggatcctatgcaaatcgaactgcgccacagagaatgggtgcactcagatttccacttcgacaatgtgctctccgccatgatgagcctgtttaccgttagcacatttgaagggtggcctcagcttctctataaagccatagatagcaatgccgaggacgttggcccaatctacaacaaccgcgtcgagatggcaatattttttataatctacatcatcttgattgcctttttcatgatgaacatttttgtcggatttgtgatcgtcactttccaagagcagggcgaaactgagtacaagaactgtgaactcgacaaaaatcagaggcagtgtgtccagtatgccctcaaagcacgtcctttgagatgttatatccctaagaacccctaccagtatcaggtctggtatattgtgaccagttcgtatttcgaatatctgatgtttgccttaataatgctgaacacaatttgtctgggaatgcagcattacaaccagtccgagcagatgaatcatatcagcgacatactgaatgtggcctttacaattattttcacactcgaaatgatcttgaagttgatggctttcaaagcgcggggctattttggtgatccgtggaatgttttcgactttctgattgtcatcggaagcataatcgatgtaatcctgtcagagattgatacgtttctcgcaagctcaggcggtttatactgtctcggcggaggttgcgggaacgtggatcctgacgaaagcgcccgcattagcagtgcgttcttcagactcttccgagtgatgcgactgattaaactgctgtcccgcgccgaaggtgtcagaacactgctctggactttcatcaagagcttccaggcattaccatacgttgccctgctgatagtcatgctgttctttatatatgctgtcattggaatgcagatgttcggcaaaatcgccttagtggacggcactcagatcaatagaaataacaacttccaaacctttccgcaggcagttctcttactgtttagatgtgctacaggggaggcctggcaggaaattctgctggcatgtagctatgggaaactatgtgaccccgaatccgactatgctcccggggaggaatacacgtgtggcaccaacttcgcctactattacttcatttccttttacatgttatgtgcgtttttggtaatcaatttgttcgtggccgtgatcatggataactttgattacctgaccagggattggagtatcttgggccctcaccacttagacgaatttaaggccatatgggcagagtacgatcctgaggccaagggcaggataaagcacttagatgtggtaacactactccgacggattcagcctccactaggcttcggaaagttttgtccgcaccgcgtcgcatgcaaaaggctcgtgggaatgaatatgcccttaaattcagatggcaccgtaacgttcaatgcaactctgttcgctcttgttcggaccgcactcaaaatcaaaaccgaggggaattttgaacaagccaacgaggagctgagagctatcattaagaagatctggaagcgaacgtctatgaagctcctggaccaggttatccctccaataggggacgacgaggttacagtcggcaaattttatgccacgttcctgattcaggagcactttaggaaattcatgaaaagacaggaagaatactacggatacaggcccaaaaaagatatcgtgcagatccaagctggcctgaggactattgaggaagaagccgctccggagatttgtcgaactgtcagcggagacttggcagccgaagaagaattggaacgggccatggttgaggccgcaatggaggaaggaatctttcgtcgtacaggggggctgtttggacaggtggataacttcctcgaacggacgaactcactgccacctgtgatggcaaatcagcgcccgcttcagtttgctgaaatcgagatggaggaaatggagtcccccgttttcttggaagatttcccgcaagatccccgcacaaacccacttgcgcgtgcaaacacaaataacgcaaatgctaatgttgcttacggtaatagcaatcactccaactcccacgtattcagctccgtgcattacgagcgggaattccctgaggagaccgaaacacccgccaccaggggtcgggccttgggtcagccatgtagggttctgggtccacacagtaaaccctgcgtggagatgctcaagggtttgctcacacaaagggcaatgcccagaggccaggcccctccagcaccgtgtcaatgtccccgggtggaatctagcatgcccgaagatcgcaaaagcagcacccctggttctctgcatgaggagactccacactccagatctacgagagaaaacacgtctcggtgtagcgcccccgccaccgctctcctgatccagaaagcgctagtccggggagggctcggcactctggctgctgacgctaatttcattatggctaccggacaggccctggctgacgcctgccagatggaaccagaagaagtcgagataatggctaccgagcttcttaagggcagagaggccccggagggaatggcaagcagcttgggatgcctgaatctggggtcttctttgggttccctggatcagcaccagggttctcaggagaccctcatcccccctagactgtag

SEQ ID NO: 110446 - DNA, 5565 bp, Artificial Sequence
  Description of Artificial Sequence: Synthetic coding sequence
atggagccatctagcccccaggacgagggcctccgaaagaagcaacccaaaaaaccagtgccagaaattttacctcggcctcctagagcactgttctgtctgaccctcgaaaaccccctgagaaaggcctgcatctctatcgtcgagtggaagcccttcgaaactatcatactactgactatttttgcaaattgcgtcgcgctagcagtgtatctccccatgcctgaagatgataacaattcactgaaccttgggcttgagaagcttgaatacttcttcctgatcgtcttctctatcgaggccgccatgaagattatcgcatacggctttcttttccaccaagacgcatacctgcgctccggctggaatgtcctcgactttaccatagtgtttctcggcgtgttcaccgtcatcctggaacaggtgaatgtgattcagtctcataccgctcccatgtcgtctaaaggggccggtttggacgtgaaagcgctgcgcgctttccgggtccttcgcccattaaggttggtgtcgggcgtgccttccttgcaggttgtacttaattctatctttaaagccatgctacccctgttccacatcgcgcttttggtgctgtttatggtgattatttacgctatcattggactcgagctgttcaaaggcaaaatgcataaaacttgttattttatcggtacagatatcgtcgcaacagtcgagaatgaagagccatctccatgcgcccgtaccggttctggccgacgatgtaccatcaatgggtctgagtgcagagggggatggccggggccaaatcacggtatcacacacttcgataatttcgggttttctatgcttaccgtatatcagtgtattacaatggaaggttggactgatgtattgtactgggtgaacgatgcaatcggcaatgaatggccttggatttacttcgtgaccctgatcctgctgggatccttctttattttgaatcttgtgctgggagtgctttcaggcgaattcaccaaagaacgtgagaaagcaaagtcccgaggcacattccaaaagttgagggagaagcagcaactcgacgaggatttaaggggctacatgtcctggatcacccaaggcgaggtaatggacgtcgaagacttccgagagggaaagttgagcctggatgagggcggttccgataccgaatccctgtatgagatcgccggtcttaataaaatcatccagttcatacggcactggaggcagtggaatagaattttcaggtggaagtgccacgatattgtgaagagtaaagtgttttattggttggttatccttatcgtcgctctgaatacactcagtattgcttctgagcaccacaatcagccattatggctgactagactgcaagatatcgcaaatcgggttctgctgtctctgttcactaccgagatgctgatgaaaatgtacggcctgggtctgcggcagtacttcatgtccatcttcaatcgtttcgactgctttgtcgtgtgcagtgggatcctggaaatcctgctagtcgagtcgggggccatgacccctttggggatcagtgtcttacgttgtataaggctgctcagaatcttcaagataacaaaatattggacctctctatcgaatctcgtggcctccctccttaacagtattcggtccatcgcttcactcttacttctgctgtttctcttcatcgtcatatttgcactgctgggaatgcagctgttcggaggcaggtatgacttcgaggatacggaggtccggaggagcaactttgataatttccctcaggccctgatctctgtcttccaggtgttaacaggtgaggactggacatcgatgatgtacaacgggataatggcatacggcggaccctcctatcccggcatgcttgtttgtatctatttcatcattctgtttgtatgcggaaattacattttgttaaacgtctttttggctatcgcagtggataatttggctgaggcggagagtttgacatcagcgcagaaagccaaggccgaggaaaaaaagcggcgtaagatgagcaagggcttgcctgacaaatctgaagaagagaagagtaccatggccaagaagcttgaacaaaagcccaaaggagagggaatcccaactacagcaaaactgaaaatcgacgagtttgagtctaacgtgaatgaagttaaggacccttatccttccgccgatttccccggtgacgacgaggaggatgaacccgagatcccactttctccccgacctcgaccattggcagagctccagttgaaggaaaaggccgtgcctatccctgaggctagtagctttttcatcttttcaccaacaaataagatccgggtcttatgccatagaattgtcaatgctacttggttcacaaactttatcttactctttatactgctgtcctccgccgccttagccgccgaagatcccattagagcagactctatgcgcaatcaaatcctgaagcatttcgacattggcttcaccagcgtcttcactgttgagattgtgctgaagatgactacctacggggcttttctacataagggttctttctgtcgaaactattttaatatgctggacctccttgtagtggcagtgagcttgatcagcatgggattggagtctagtgctatctcagtggttaagattttacgcgttcttagggtactgcggcctctccgggcaattaaccgcgccaagggactgaaacatgtggttcaatgcatgtttgttgcgattagtacaatcgggaacattgtactggttacaacacttctccagtttatgtttgcatgcataggtgtccaactgtttaagggcaaattcttcagatgtactgacttgagcaagatgactgaagaggaatgtcgtggctattattacgtgtataaggatggagacccaatgcagatcgagctgagacaccgtgagtgggtacactcagactttcacttcgacaatgtgctgtcggccatgatgtccctgtttacagtttccactttcgaagggtggccccagcttttatataaagccattgactccaacgctgaggacgtgggacctatttataataatagagttgaaatggccatcttctttatcatttacattattcttatcgctttttttatgatgaacattttcgttggattcgtgatcgtcacgttccaggaacagggcgaaacagagtacaaaaactgcgaattggacaagaaccaaagacagtgcgtgcaatacgccttgaaagctcgtcccttgcgctgttacatacccaaaaatccctaccagtatcaagtatggtatatagtaaccagcagttatttcgagtatctgatgttcgcgctgatcatgctcaatactatctgtctgggtatgcagcactataatcagagcgaacagatgaaccatattagtgatatattaaatgtggcgttcactatcatattcacattggaaatgattctgaagctgatggcctttaaggctagaggctacttcggagacccctggaacgtgttcgatttcctaatcgtcatcggcagcattatcgacgtgatcctctcagaaattgacgaccctgatgagtccgccaggatttcttctgcatttttcaggctatttcgggtgatgagattgattaagttgctgtcacgggctgaaggggtgaggaccttgctctggacttttatcaaaagctttcaggctttaccgtacgtcgctcttttgattgtcatgctatttttcatatacgccgttattggtatgcaaatgttcgggaagattgctctagtggacggcacgcagattaataggaataacaacttccaaacatttccacaagctgtcctacttttgtttcggtgtgcgaccggcgaagcttggcaggagatactgctggcctgcagctacggaaaactctgcgatcctgagtctgattatgcccccggggaagaatacacgtgtggcactaatttcgcctactactatttcatttcattctatatgctctgtgcctttttagtcataaacttgtttgtcgctgtgataatggataatttcgactacctgacaagggactggtccattctggggccccaccaccttgacgaatttaaagccatatgggctgaatatgacccagaagccaagggtcgcataaagcatctggatgtcgtcaccctgctgcggcgcattcagccccctcttggattcggcaagttttgccctcaccgagtggcttgtaaaaggcttgtcggcatgaacatgcccctcaattccgacgggactgtgacctttaatgctacattgttcgctctggttagaacggcacttaagatcaagacagaaggcaatttcgaacaggctaacgaggaactcagggccatcattaagaagatctggaagcgcacctccatgaagctcctcgatcaagtgattccacctatcggagacgatgaggtgacagtcggcaaattctacgccacattcctgattcaggagcacttccgaaagtttatgaagcgccaagaggaatactatgggtacagacccaagaaagacatcgtgcaaatccaggccggtcttcgcaccatagaagaggaagcggctccggagatatgcaggaccgtctcaggcgatctcgcagctgaagaagagctagaaagggctatggtggaggccgccatggaagaagggatctttcgcagaacaggcgggcttttcggacaggttgataattttctcgaacgcaccaattctctccccccagtgatggccaatcagaggccacttcagttcgccgagatagagatggaggagatggagtcacccgtcttccttgaagattttccccaggacccgagaactaatccactagcccgggctaatacaaataatgctaatgctaatgtggcctacggaaacagcaaccactcaaatagccacgttttttcatccgtccactacgagcgcgaattcccagaagagacagagacacccgcaactcggggcagggctctgggacagccttgtagagtgttggggccgcactccaagccctgcgtggaaatgttgaaagggcttctcacccaacgagcaatgccccgaggacaggcccccccagccccttgtcagtgccctcgggtcgaatcctctatgccagaggaccgcaaatctagtactcctgggtccctgcacgaggagactccacactcacggtccacgagagaaaatacctcccgctgctctgccccagcaaccgcactcctcatccagaaggctcttgtcagaggtggtctaggcacacttgcagccgacgctaatttcattatggctaccggccaggctctcgccgacgcttgccagatggagcctgaagaagtcgagattatggccacagaactcttaaagggcagggaagcccccgaaggaatggcctcctccctggggtgcctgaaccttgggtctagcctggggtcactggaccagcaccaggggtctcaagagacgctcatccctcctcgactgtag

SEQ ID NO: 110447 - DNA, 4602 bp, Artificial Sequence
  Description of Artificial Sequence: Synthetic coding sequence
atgaaaacacacctggataggccacttgtggtggagttagggcgagatggggcccgaggtcccgtagggggcaaggcccggcctgaggccgcggaggccccggaaggagttgatccacccagacgacatcaccgtcacagggataaagataagacccccgcggctggggaccaggatcgcgccgaagctcccaaagctgaatccggcgagcccggagcaagggaagagaggccacggcctcacaggtcccatagtaaagaggccgctggacccccagaggcacgctccgaaagaggtcgcggacctggacccgaaggtgggagaaggcatcatcgccgaggatcccctgaggaggctgccgaacgcgaaccccgccgtcatagagcacacaggcaccaggatccctcaaaggagtgcgcgggggcaaagggagaaaggcgggcgcggcaccgcggggggccacgggctggaccaagagaagcggagtccggggaagaaccagctcggaggcaccgggcccgacacaaggctcagcctgcacatgaggctgtcgagaaggagaccactgaaaaggaggcaactgaaaaagaggctgaaatagtcgaggccgacaaggagaaggagttgcgtaatcaccagccacgtgaaccgcattgtgatcttgaaacttctggaaccgtgacagttgggcctatgcacacactgccatctacatgcctccagaaggtcgaagaacaaccagaagatgccgataaccagcgcaatgttacccggatgggctcccagcccccagatccgaacacaatcgtccacatacccgtcatgttaactgggcctctcggggaggccacggtggtcccaagcgggaacgtcgacctcgagtcccaagcagaaggtaaaaaagaggtggaggccgacgatgtcatgaggtctggaccccgccccatcgtcccgtactcctctatgttctgtctgagcccaacaaatctgctgagacgcttttgtcactatatcgtgaccatgcgatacttcgaggttgtgatacttgtggtcatcgccctgtccagcattgccctcgctgcagaagacccagttcgcacagactctccaagaaataacgctttgaaatacctggattatatattcactggcgttttcacttttgagatggtcataaagatgattgacctgggactcttactgcaccccggtgcttatttccgcgatctgtggaacatcttggacttcatcgtggtgtccggcgcactcgtcgcttttgcgttctcctcattcgtaggaggttccaaaggtaaggatatcaacacgataaaatctcttagggtgctccgcgtgcttcgccctctgaagactattaaacgcctgccaaaattgaaggcagtctttgactgcgtggtgaacagcctgaagaatgtgctcaacattctgattgtctacatgctattcatgttcatctttgctgtaattgccgttcagttgtttaaaggcaagtttttctactgcactgatgagtccaaggagcttgaacgtgattgccgcgggcagtatcttgactacgaaaaggaggaggttgaagcgcagcctcggcagtggaagaagtatgacttccactacgacaatgttctatgggcccttttaacactgtttacggtgtctaccggtgagggctggcctatggttctgaagcactccgtggatgctacatatgaggagcagggcccctcacctggataccgcatggagttaagtattttctacgtggtttacttcgttgtatttccgtttttctttgtaaacatcttcgtggctctcataattattacattccaggagcagggtgataaagtgatgagcgaatgttccctcgaaaaaaatgagagggcctgtatcgactttgccatctctgccaaacccctcacaagatatatgccccagaaccggcagagtttccagtacaagacatggacatttgtcgtatctccccccttcgagtatttcatcatggcaatgatagcattgaataccgtcgtccttatgatgaaattctacgatgccccctatgaatacgagctcatgctgaaatgtctgaacatagtgttcacctctatgttttcaatggagtgcgtcctcaaaatcatagcattcggggtgctgaattattttcgggacgcctggaacgtctttgatttcgtgacagtcttaggcagtatcaccgatattctggttacagaaatcgccaataattttataaacctgtcctttctccgcctgtttagagcagcccggctgattaaactgctaaggcaaggatacactatcagaattctgctatggacctttgtccagtctttcaaagctctaccctatgtgtgtcttttaatcgcaatgctgttttttatttacgcaataatcggtatgcaggtcttcgggaatatagccctcgatgatgacaccagcatcaatcgacataataacttcaggactttcctgcaggcactgatgcttctgtttcgaagtgcaacaggtgaggcctggcatgaaattatgctgagctgcctcagtaatcaggcctgcgacgagcaagcaaatgccacagaatgcggctcggatttcgcctatttctatttcgtctcctttattttcctctgtagtttcttaatgttgaatctttttgttgcagtcataatggataacttcgaatatctgacccgggacagttctatcctggggccccaccatctagacgaattcatccgcgtctgggctgagtatgaccctgcagcttgcggacggatttcctataatgacatgttcgaaatgttaaaacacatgagcccccctttggggttgggcaaaaaatgtcctgcccgggtggcttacaaaagactggtgaggatgaacatgcctatatccaacgaagacatgacagtacactttacaagcacattgatggcactcatcaggaccgcgctggagattaagctggctcctgctgggacaaaacagcaccagtgtgacgcggaactgcgcaaggagatctctgtcgtgtgggccaatctgcctcagaagacgctagaccttctcgtcccccctcataaaccggatgagatgacagtgggcaaggtctatgccgccctgatgatctttgatttctataagcagaataagactacaagggaccagatgcagcaggcccccggaggcctgtcccagatgggccctgtgtccctgtttcatccgcttaaggctaccttggaacagacccagcctgcagtacttagaggagctagggtgttcctgcgtcagaagagttccacctcactgagtaatggcggggctatacagaaccaagagagcggcatcaaggaaagcgtgtcatgggggacacagagaacgcaagacgccccccatgaggccaggccccctttagaacgaggacactcaactgagattccagttgggaggagcggtgcgctggccgtggacgtgcagatgcagtccatcacaaggcgaggcccggacggcgagccacagcctggtctggagtcccaaggaagggcagcctccatgccccggctggcggcagagacgcagccagtaaccgacgcttctccgatgaagcggtccatctctactctggcccagaggcctcgaggcactcatctctgtagcacaactcctgatagaccaccaccaagtcaagcaagcagccatcatcaccaccatcgttgccatcgtcgacgtgatcggaaacagcggtctttggaaaagggtccctctctgtccgctgacatggacggcgcaccatcttcagcagtagggcccggattgcctccgggggagggtcctactggatgccgcagagaacgtgagagacggcaggagcgcggtaggtctcaggaaaggcgccagccatcatcaagctcctcagagaagcagcgattctactcatgcgaccggttcggaggccgtgagcctcccaagcccaagccatctcttagctcgcacccaacctctcctacggcgggccaggagccagggcctcacccacagggaagtgggtctgtaaatggctctcccctgctatccacgagcggggcatccaccccgggcagaggcggacgacggcaactcccccaaaccccactcacacccaggccctctattacttacaagactgctaattcatcacccattcatttcgcgggagcacagacatcccttcctgccttcagtcctggtcggctttcacgtgggctctcagagcacaatgccctgctccaaagagatcccctcagtcaacctctggccccagggtcaaggatcggcagcgatccttacctgggtcagagactcgactcagaggctagtgtgcacgctttgccagaggacacattgacctttgaagaggctgtagccaccaactctggacggtcctctcggacttcatatgtgagttcgctgacaagccagtctcaccccctgaggagggtgccaaacggctatcactgcactctggggttaagttccgggggcagagctaggcacagttatcatcatccagaccaggatcactggtgttag

SEQ ID NO: 110448 - DNA, 306 bp, Artificial Sequence
  Description of Artificial Sequence: Synthetic coding sequence
gataacctggccaacgcgcaggagctgacaaaagacgaggaagaaatggaggaagctgcaaaccagaaactcgctctccagaaggccaaagaagtggccgaggtgtccccaatgagcgctgctaacatttctatcgcggcttttgtgaaacaggcccgaggtacagtgtctaggagcagctcagttagcagtgtgaactccccacggcagcagaactcagccaaagcccgatccgtttgggagcagcgggcttcccagttaagattacagaatcttagggcatcatgcgaagctctctattcttag

SEQ ID NO: 110449 - DNA, 6714 bp, Artificial Sequence
  Description of Artificial Sequence: Synthetic coding sequence
atggttcggttcggagacgagctcggcggacgctacgggggccccgggggtggagagcgcgcccgtggcggcggcgccgggggggccggaggccctgggcctggcggtctgcagcccgggcagagggtattgtataaacagtccattgctcagagggccagaaccatggccttgtataaccctatccctgtcaagcagaattgttttacagtgaaccgaagtctctttgtgttttccgaggataacgtagtcaggaagtacgccaagaggataactgagtggcctccatttgaatacatgatcctcgccactatcatagctaactgcattgtgctagcactggagcagcacttgccagatggggataagacacctatgagcgaacgattggacgacaccgagccctacttcattggcatcttctgctttgaggccgggatcaagatcatcgcgctgggcttcgtgtttcataaaggaagctacttgaggaatggctggaatgtgatggactttgtggtggtacttacaggaatcctagcaacagccgggaccgacttcgatctgagaaccctcagagccgttagagttctccggcctctgaaactggtatccggcatccctagcctgcaggttgtgctgaaaagcatcatgaaggctatggtgccactcctccaaataggacttctcctgttcttcgcaatcttgatgttcgccataattgggctggaattctatatgggtaagttccataaagcttgttttccgaattcaactgatgctgaacccgttggcgattttccttgcgggaaagaagcacccgccagactgtgtgagggtgatactgagtgccgtgaatactggcctggaccaaattttggaataaccaactttgataacatactgtttgccatcctcacagtgttccagtgtataacaatggagggctggacagatattctctataatacaaatgacgctgcggggaacacttggaattggctctattttattccactgattatcataggtagcttctttatgctgaatcttgtactcggagttctgagtggagagttcgctaaggaacgcgagagagtagaaaaccgtcgggctttcctcaaattgcgacgccaacagcagatcgagcgggaactgaatggctatcttgagtggatatttaaggcggaggaagtaatgctcgcagaagaagatcgtaacgccgaggaaaagtctccactggacgtactgaaaagagcggctacaaagaaatctaggaacgacctgatacacgcggaagaaggagaggaccgtttcgccgacttgtgcgctgtgggctctccattcgccagagcaagcctcaaaagcggcaagacagaaagttcatcctactttagacgtaaggagaaaatgttcagattctttattcgtcggatggtcaaggctcagtctttttattgggtagtactatgtgttgtggcactgaatactctatgtgtcgccatggtgcactacaaccagcctcgccgtctgacgaccaccctctattttgcagagttcgtatttctcggcttattcctcacagaaatgagcctcaagatgtatggcctcgggcctagaagctactttcgcagtagcttcaattgcttcgacttcggcgtgattgtaggaagcgtttttgaggtcgtgtgggctgctatcaagccagggtcttcgtttggaatttcagtactgcgggccctgagattgcttcgcatcttcaaggtcactaaatattggtccagcctgagaaatctagtagtatcactgctgaatagcatgaaatccataatcagccttttatttctgttgttcctattcattgtggtattcgccttgctcggcatgcagttattcggcggccagtttaactttcaggatgaaacccccacgactaatttcgatactttcccagcagccatcttgactgtcttccagatcctgacaggcgaagattggaatgctgtcatgtatcacggtatcgagtcgcaggggggggtgagcaaaggcatgttttccagtttttacttcatcgtcctgacactgtttgggaactataccctgctgaacgtttttcttgctatagccgtcgataacttagccaatgcacaggagctgaccaaggatgaagaggagatggaagaggccgccaatcagaaactcgcactgcaaaaggctaaagaggtggctgaagtttcccccatgagcgccgccaacattagtattgctgctagacagcaaaattcagctaaagcgaggagtgtctgggagcaacgcgcctcacagttacgtctccagaacctgagagccagctgcgaggccctttattctgaaatggaccccgaagagcgcctgcgcttcgcaacaacacgacacctgcgcccggatatgaaaactcatctcgacaggccactggtcgttgaactgggtagggacggcgccagaggacctgtgggaggaaaggcacgtcccgaggccgccgaagctcccgaaggcgtggatccaccccgaagacaccataggcacagggacaaggataagacaccagccgcgggcgatcaggacagagcagaagctcctaaggctgagtcgggggagccaggcgcccgagaagagcgacctcgcccacataggtctcacagcaaggaagcagcaggccctccggaggcccgttccgagcgcggccggggacctggacctgaaggggggagaaggcaccaccggagggggagtccggaggaggccgcggaaagggagcctcgccgtcaccgcgcgcaccggcaccaggacccctccaaggagtgtgccggtgccaagggtgagaggcgcgccagacacagaggtggtccgcgtgcagggcctagggaagccgagtcaggcgaggagcccgcccgacgccaccgggcgagacacaaagcacagcccgctcatgaggccgtcgagaaagagacaaccgagaaggaagcaacagagaaggaggcggagattgtcgaggcagataaggagaaggaactgagaaatcatcaacccagggaaccccattgtgatctggaaacaagcggaactgtcactgtaggacctatgcatacgctaccttctacttgtcttcaaaaggtcgaggaacaacccgaagacgctgataatcagaggaacgttactcgaatgggttcgcagcctcccgatcctaataccatcgtacatatccccgtcatgctcactgggcctctgggggaggctacggtcgtgccttctgggaacgtggacctggagagtcaagccgagggtaagaaggaagtcgaggctgacgacgtaatgcgtagtggtccgaggcccatcgtgccctactcctctatgttttgcctctcacccaccaacctcctgcgtcgattctgccattatattgtgacgatgcgctacttcgaagtcgtgatccttgtggtgatcgctctgagttccatagccttagccgccgaggaccccgttcgaaccgacagtcccaggaataatgccctaaaataccttgattacattttcactggcgtgtttaccttcgagatggtcatcaaaatgatagacttaggactgctgttgcatccgggtgcatattttcgcgacctgtggaatattctagactttattgtggtcagtggcgctcttgttgccttcgcgtttagcggatctaagggaaaggatattaatactatcaaatcccttcgggtactgcgcgtacttaggccgctgaagaccataaagaggctgcccaagctcaaggctgtatttgactgcgttgtaaatagcctcaagaatgtactgaacatcttgatcgtatacatgcttttcatgtttattttcgctgtgattgcagtacagttgttcaagggcaagtttttttattgcaccgatgagagtaaagagctagagcgcgactgccgggggcagtatctggattacgagaaggaagaggtcgaagcccagcctaggcagtggaagaagtacgatttccattacgataacgtgctttgggctctgctaactttatttaccgtatccaccggcgaaggctggccaatggtcctgaagcactcagtagacgccacatatgaggagcagggaccaagtccaggttatagaatggagctgagcatcttctatgtggtatactttgtagtgtttcctttttttttcgtgaacatcttcgtggccctcatcattatcacttttcaggagcagggtgacaaagtgatgtctgagtgctcccttgaaaagaatgagagggcctgcatcgacttcgcaatctctgccaagcctctcacacgctacatgccccagaatcggcagagcttccagtataagacgtggacattcgttgttagtcccccctttgaatacttcatcatggcgatgattgcactgaacacagttgtcctcatgatgaaattctacgacgctccatacgaatacgagctcatgttaaagtgcctgaacatcgtgtttacatctatgttctccatggagtgtgtcctcaagataattgctttcggggtactgaactatttcagggatgcttggaacgtgtttgactttgtgacagtgctgggatccatcaccgatattcttgtcacagagatcgcagaaacaaacaatttcatcaatttgagcttcttgcggctttttcgcgcggcccgcctcatcaagcttcttaggcagggatacacgatcagaatacttctgtggactttcgtccagtctttcaaggccctcccgtacgtttgccttcttatagctatgctgtttttcatttatgccattatcggaatgcaggtgtttggaaatatcgcactcgatgatgacacatcaatcaacaggcataataattttcggacctttttgcaagctctgatgcttctctttagatcggcaactggcgaggcctggcacgaaatcatgcttagctgtctgtccaaccaagcttgtgacgagcaggcgaacgctactgagtgtgggagcgacttcgcttatttctatttcgtgtcgttcatctttctgtgttcattcctcatgttgaatttatttgtagcagtgattatggataactttgagtaccttacacgcgattcatctattttggggccacaccatctggatgaattcatccgcgtctgggcagagtacgacccggcggcatgcggccgtatctcttataatgacatgttcgaaatgctgaagcatatgtcgcctcccctgggactgggtaagaaatgccctgctagggtggcatacaagagactggtgcggatgaacatgccgatctcgaacgaggacatgaccgttcatttcacctcgaccctgatggctttaattcgcacagcacttgagattaagctcgctcctgcggggaccaagcagcaccagtgcgacgcagagctgcgcaaggagatctctgtggtatgggccaatctgccacaaaaaacccttgacctgcttgtgcctccccacaaacctgacgagatgaccgtcggtaaagtgtacgcagccctcatgatcttcgatttctataagcagaataagaccaccagagatcaaatgcaacaggctcccggaggtttatcccagatgggtccagtgtctctgttccacccactgaaagccacgctcgagcagacacagccagccgtactgagaggagctagggtttttctccgacaaaaatcttccacatccctgtctaatgggggagcgattcaaaaccaggagagcggaatcaaagagtcagtgagttgggggacgcagcggactcaggatgctccacacgaggctcgtccgccccttgagcgaggccatagtactgagatccccgtcggacgttcgggagctttagccgtcgatgtacaaatgcagtccatcacgagacggggtcctgacggagaaccacaacccgggctcgagtcacaagggcgcgccgcctccatgccacggcttgccgcagagacacagccggttactgatgcgagcccaatgaaacggagtatttctaccctcgcacagagaccccggggaactcacctgtgcagcaccactccagacagacccccacccagtcaggcaagctcacaccaccaccatcataggtgccacaggcgacgggacagaaaacaaagatcgctggagaaaggccccagtctgagtgcagatatggacggggctccttcatccgctgtgggtccgggtctgccccccggagagggcccgactgggtgccgccgcgagcgagagcgtcggcaagaacgcgggagaagccaggagaggagacagccttcctctagttcgtccgaaaaacaaagattttattcttgcgataggtttggcggacgagaaccaccaaagccaaagccctcgctgtcgagccacccaaccagcccaaccgccggacaggaaccaggtccacaccctcaagccgggagcgccgtcgggttcccgaataccaccccttgctgtcgggagacgccatctgcaagtccctggcccctggctcttgaactcgcactcaccttgacttggggaagtgtctggactgtgcggcccctgtccacgccttgtttgcggaccctaagtttgagccgccgactttggccacctacaagagccgcccctcccggtttaccaacctgccctccatag

SEQ ID NO: 110450 - DNA, 7023 bp, Artificial Sequence
  Description of Artificial Sequence: Synthetic coding sequence
atggtccgattcggtgacgagttgggtgggcgctatggaggacccggaggcggcgagcgggcccgcggtggcggcgctggcggggcagggggtccagggccaggcggattacaaccgggccagcgggtgctgtacaagcaatccattgcacagcgagccagaactatggccctctataatccaattccagtgaagcagaattgctttactgtcaatagatccttattcgtgtttagcgaagacaacgttgtgcgcaaatacgccaaaaggatcacggagtggccacccttcgagtacatgatccttgcgaccataattgccaattgcattgtccttgctcttgaacagcacctccctgacggagacaagactcccatgtccgagaggctcgacgacaccgaaccatattttataggaatcttctgtttcgaagccgggattaaaattattgcgttggggtttgtttttcacaaagggtcttacttacgaaacggatggaacgtgatggatttcgtggtcgtcctcacaggcatcctagccacagctgggaccgatttcgacctgcgaactctccgcgctgtaagggtgttgcgccccctcaagctggtgagcggcataccaagtttgcaggtcgtgttgaaaagcatcatgaaggctatggtcccacttctgcagatcgggctgcttcttttttttgcgattttgatgttcgccatcataggccttgagttttacatgggtaaatttcacaaggcatgtttccctaacagcacggacgcagaacctgtcggagatttcccatgcggcaaggaggcaccagcacgcctctgtgaaggggataccgagtgtcgagaatattggccaggccccaacttcggcatcacgaattttgataacattctgtttgctatcctgacagtattccagtgcattaccatggaggggtggactgacatcctgtataacaccaacgatgctgctggaaatacctggaactggctttatttcatcccattaataattatcggtagctttttcatgctcaatctggtcttaggggtccttagcggtgaattcgctaaggagagggaaagagtagagaatcgcagggcctttcttaagctaagacggcagcagcagatcgaaagggagctgaatgggtatttggagtggatcttcaaggccgaagaggtcatgctggccgaggaggacaggaacgcagaggagaaatcaccgcttgacgctgtgcttaagagagccgccacaaagaaatcgcgaaacgatctcatccacgctgaggaaggagaggaccgtttcgcggacctgtgcgcagtgggaagtcctttcgctcgcgccagcctgaaatccgggaagaccgaaagttcatcctactttagaaggaaagaaaaaatgttcaggtttttcatccgtcggatggtcaaagcccaatcattctactgggtggtgctatgtgtggtggcgctcaatactctctgcgtcgctatggtgcactataatcagccgcggcgacttaccacgaccctgtattttgctgagttcgtgttcttgggattgttcctgacagaaatgagtctgaagatgtatggcttaggaccaaggtcgtattttaggagcagcttcaactgctttgacttcggtgtgatcgtgggcagcgttttcgaagtagtttgggctgccatcaagcccggttcttcatttggcatttccgtgctccgggcacttagattgcttcggatctttaaggttaccaaatactggtcttcactcagaaatctggtcgtaagcttactcaacagcatgaagtccatcatatctctcttgttcctgctttttctgttcattgttgttttcgcattgttgggaatgcagctgtttggcggacagttcaatttccaagatgagacccctaccaccaactttgacacattccctgcagctattttgaccgtgttccagattctgacaggcgaagattggaacgccgttatgtaccacggaatcgagagccagggcggagtttccaagggaatgtttagctctttttatttcatcgtcctcactctgttcggcaattataccctgctgaacgtttttctggcgattgccgtggacaacctagcaaatgctcaggagcttacaaaggacgaggaggaaatggaggaggcggccaaccagaagctggcactgcaaaaggccaaggaagtggccgaggtatctcctatgagcgcagccaacatcagcatagctgctagacagcagaactcagccaaagcccgtagcgtgtgggagcagagggcaagtcaactgagactgcagaatttgcgtgcctcatgcgaagcattgtacagcgagatggatccagaggaaagattgcgtttcgccaccactaggcatctgaggcctgacatgaaaacacacctggaccggccattggtcgtcgagcttggccgcgacggagctagggggcctgtgggaggcaaggcaagaccggaggccgctgaggcaccagagggagtggacccacctcgaagacatcacaggcacagagataaagataagacgcctgctgccggagaccaggaccgggccgaggccccaaaggccgaaagtggcgaacctggggccagggaggagcggccccgccctcatcggtcacatagcaaagaggctgctggaccccccgaagccagaagcgagcgcggtcggggaccaggtcctgagggaggacggcgacaccataggcgcggtagtcccgaagaagccgccgagcgcgaaccgcggcgtcatcgcgctcacagacatcaagatcctagcaaggagtgcgctggagcaaaaggggagaggcgggcacggcaccggggtggacccagagcaggcccaagagaagcagagtcaggcgaagaacctgcccggaggcacagagcgcggcacaaggctcaacctgcccacgaagcggtggagaaggaaaccaccgaaaaggaggctaccgaaaaggaggccgaaattgtggaagctgacaaagaaaaggaactacggaaccaccagcccagggagccacattgtgatcttgaaaccagcggcactgttactgttggccccatgcacacattgccatctacatgcctgcagaaggtcgaggaacagcctgaggatgccgacaaccagaggaatgtgaccagaatgggctcccaacccccggaccccaacacaattgtgcatattcccgtgatgcttaccggacccctgggcgaagctactgtggtgccctctgggaatgtggatctagagagccaggctgagggtaagaaggaagtagaggccgatgacgtcatgcgctccgggccaagaccaattgttccctacagcagtatgttctgtctgtccccgacaaacctcctcagacgcttctgccattacattgtgactatgagatacttcgaggtggttattctggtggttattgctctttcttccattgctttggccgccgaggatcccgtgcggactgactcccctcgtaataatgctctcaagtatctagattacatattcacaggcgtcttcacattcgagatggttatcaaaatgatcgacctggggctgttgttgcaccccggcgcatatttccgggacctttggaacattctggattttatcgtggtatcaggggctctggtagcattcgcattctccgggtctaaggggaaagacatcaacaccattaagagcttgcgggtgttgcgcgtcttgagaccattaaagaccattaagaggctccctaaactcaaggcagtttttgactgcgtagtgaattccctcaagaacgttctgaacattttaattgtgtatatgctgtttatgttcatcttcgctgtcatagctgttcagctcttcaaaggcaagtttttttactgcactgatgagagtaaagaactggagcgggattgtcgtggacaatacctagattatgagaaagaagaggtcgaggcccagccaagacagtggaagaagtatgacttccactacgacaacgtgctgtgggcgcttcttaccctcttcactgtctctacaggggaggggtggcccatggtgctgaaacattccgtagacgccacctatgaggaacagggaccctccccaggttacagaatggaactttccattttctatgtggtgtactttgttgtattccccttcttcttcgtcaacatcttcgtggccctaataattattacttttcaagaacagggcgacaaggtaatgagtgaatgcagtctggagaagaacgaacgcgcctgtatcgatttcgccatcagtgcgaagcctctcacccgctatatgccccagaacagacagtctttccagtataagacatggacgttcgttgtcagccctccctttgagtatttcattatggcgatgatcgccttgaatacagtagtgctgatgatgaagttctatgatgcaccatatgaatacgaactcatgcttaaatgcctgaacattgtttttacatccatgtttagtatggagtgcgtcctgaaaatcattgcattcggcgtcctaaattactttcgcgatgcttggaatgtgttcgacttcgtgactgtactgggatccattaccgatattcttgttacggaaatagccgagaccaataatttcatcaacctatcattcttgagattgttcagggcggcccggctgatcaagctcctgagacagggctatactatccgtattttactatggacattcgtgcagtctttcaaagccttgccctacgtgtgtctcctgattgctatgttattcttcatatatgcgataatcggcatgcaggtgttcgggaatattgctttagacgatgacactagcattaataggcataacaacttccgtacctttctgcaggcgctcatgttgctgtttcgcagcgcaaccggtgaagcatggcacgagattatgctgagctgcctgagtaatcaagcatgcgacgagcaggctaacgccaccgaatgcggatctgactttgcttacttttacttcgtcagctttatcttcctctgctcatttttaatgctgaaccttttcgttgcagtaataatggacaacttcgaatatttgacccgggatagtagtatcttgggtcctcaccatttggatgaattcatccgtgtgtgggcggagtacgatccagctgcatgcggtcgcatttcttacaatgatatgttcgagatgttaaaacacatgagcccccctctggggcttggcaaaaagtgccccgcacgagtggcctataagaggttagtacggatgaatatgcctatcagtaacgaagacatgacagtgcatttcacatctactctgatggctttgatacggactgccctcgagattaagcttgcacccgctggcacaaaacagcaccagtgtgatgccgaattgcgtaaggagatctctgtggtgtgggccaacctcccccagaaaactctggaccttctggtgccaccgcataaacctgacgagatgacagtaggcaaggtttacgcggctctcatgatctttgatttctataaacaaaacaagacaacaagggaccagatgcagcaagctccagggggactgtcgcagatgggcccggtatccctgttccacccactgaaggccactttggaacagacccaaccggccgtgcttaggggggctcgggttttcctcagacagaaaagttcgacttctctatctaatggcggagcaatccagaaccaggagtcaggtattaaggagtccgttagctgggggacccaacgcacgcaagacgcccctcatgaggcccggccacccctggagagaggtcacagcacagagatcccagtaggcaggtcaggggcgctggcagttgatgtgcaaatgcagtccatcacccggagaggacccgacggcgaaccgcagcccgggctggaaagccaagggcgggcagcatcaatgccaaggctcgctgccgagactcaaccagtcacagatgcaagtcctatgaagaggagtatctcgaccctcgcccagaggcctcgcggcacacacctgtgtagtactactcccgaccgcccccccccaagtcaagcatcttcccaccaccatcaccaccgctgtcaccggcggcgagatcgcaaacagcggtctctagagaagggtccctccctgtcggcagacatggacggagctccaagtagtgccgtgggcccaggactgccccccggcgaagggcctactgggtgccggcgcgagcgtgaacggaggcaggaacgcggaagaagccaggaacgacgccagccgagctccagttcaagcgagaagcagagattctattcttgtgacagatttggtgggcgcgaacctcctaagcctaagccatcacttagttcccatccaaccagccctacagcaggtcaagagcccggaccccacccacagggaagcggctctgtgaacggctctccactattatccacatctggcgcctccactcccggtagaggtggccgacgacagcttcctcaaactcccctgacccctcggccatccatcacctataaaaccgcaaatagcagccccattcacttcgcaggagctcagacaagtctgcctgccttcagcccaggacgactctcacggggcctctcagagcacaatgccttgcttcagcgggatcctctatcccagccacttgcccctggaagccggatcgggtcagacccgtatctggggcagagactcgatagtgaggcctccgtacatgctctaccggaggacaccctgacatttgaagaggccgttgcgaccaattcaggacgatctagcaggacgagttatgtgtcctctctgaccagccaatcccatcccctgcggcgggtccccaatggataccattgtaccttgggactctcttccggcggcagggcaaggcacagttaccaccatcccgatcaagatcattggtgctag

SEQ ID NO: 110451 - DNA, 7017 bp, Artificial Sequence
  Description of Artificial Sequence: Synthetic coding sequence
atggtccggttcggagatgaactaggcgggcggtatggtggtcccggaggaggagagagagcacgcggagggggagctgggggggcaggggggccagggcccggaggtctgcagccgggtcagcgggtgctctacaaacagtccattgcgcaaagagcacgtactatggccctctacaacccaatccccgtgaaacagaattgcttcaccgtcaacagatcactgtttgtattctcagaggacaatgttgtcaggaaatacgcaaagcggattacggagtggccaccttttgaatacatgatccttgcaactattattgccaattgtatcgttttagcacttgagcaacacttgcctgacggagataagacaccaatgtctgaaagactggatgacactgagccctattttatcggcatcttctgtttcgaggccggaatcaaaattatagccctaggatttgtgttccataaaggctcgtacctgcgaaatggatggaacgtgatggacttcgtagtggtgctgaccgggatcttagccacagcgggtacagactttgatttacgaacactcagagcggtgcgtgtgctgagaccactgaaactggtttccgggatcccatccctccaagtggtgctgaagtccatcatgaaagccatggtacctctcctgcagattggcctgctccttttctttgcaatactaatgtttgctatcataggcctggagttctatatgggcaagttccataaggcgtgcttccctaacagtaccgatgcagaaccagtcggtgactttccatgcggtaaagaagctcccgctcgactgtgtgaaggcgacactgagtgtcgcgagtattggcccggccctaattttgggattacaaacttcgacaacatcctttttgccatcctcacagtgttccagtgcatcacaatggagggatggactgatatcctgtataatactaatgatgccgctgggaacacgtggaactggctgtacttcatacccttgattattatcgggtcattcttcatgttaaatctggtattgggggtcttatctggcgaatttgcaaaagagcgcgagcgtgtcgagaaccggagggcctttctgaaactcaggcgccagcagcagatcgagcgagaacttaacggatatctggaatggatctttaaggctgaagaagtaatgctcgcagaggaggaccgcaatgccgaagagaagtctccactcgacgctgtattgaagcgagcggctaccaagaaatcacggaatgacctgattcacgccgaggagggagaggacaggtttgccgacctctgtgccgtgggatcaccatttgctcgagcctcactgaagtcaggaaaaacggagtctagcagctacttccgtcgaaaagaaaagatgtttcggttttttattcggagaatggtgaaggctcagagcttctactgggtggtactttgtgttgtcgcgctgaacactctttgcgttgctatggtccactacaaccagccacggcgcctgacaaccacactgtattttgctgagtttgtttttctgggactgtttctaacagagatgagcctcaagatgtatgggctggggcccaggtcgtacttcaggtccagttttaactgcttcgacttcggggtgatcgtgggaagcgtgtttgaagtggtgtgggcagccatcaaacccggaagtagtttcggaatctccgtcctgcgagcgctgcggctgctgcgtattttcaaagtgactaagtactggagttcattgcgcaacctcgtggtgtccctcctaaactctatgaaatcaatcatatccctgctttttttgctatttctgtttatcgtcgtgttcgctctcctgggaatgcagctatttggcgggcagtttaattttcaagatgaaacacctactactaattttgacacatttccggctgccatcttaaccgtgttccagatactgactggagaggattggaatgctgttatgtatcatggcattgaaagtcaaggcggagtgagcaaaggcatgttcagcagcttttatttcatagtcttgactctgtttggaaactacacgttattgaatgtgtttctcgccatagctgtggacaatctggccaacgcccaagagctcacaaaggacgaggaagagatggaggaagcagccaaccagaagctggcccttcaaaaggcaaaggaggtggcagaagtaagccccatgagcgctgctaatattagcatcgccgcgaggcagcagaacagcgcgaaggctcggagcgtttgggagcagagagcctctcagttacggcttcagaatctccgcgccagttgcgaggctctgtactctgaaatggatcccgaggagagactgaggttcgctacaacacggcatctgcgccctgacatgaaaacccacctcgaccggcctctcgtggttgagctcggcagagatggggcgcgaggaccagtcggaggcaaggcacgcccagaagctgccgaagctcccgagggtgtggacccaccccggcgccaccatagacatcgggataaagataagacccctgctgcgggggaccaagatagggctgaggcacctaaggctgagtctggtgaacctggcgcccgggaggaaagaccccggcctcaccgtagtcactccaaagaagccgctggcccacctgaggctaggagtgaacgcggcagaggtccagggccagagggcggtcgaaggcaccaccgaaggggatctcccgaagaggccgctgaacgcgaaccacggcgacacagggcccaccgccatcaggatccttctaaagagtgtgcaggggccaaaggcgaacgccgtgcccgccacaggggcggccctagagccggcccccgtgaagctgaatctggagaagaacccgcacgtagacaccgtgcccgacacaaggcgcagccggcccatgaagctgtagagaaggaaacaaccgagaaggaggccaccgaaaaagaagccgaaattgtggaggcagacaaagaaaaagaacttaggaatcaccaacctagagagccacattgtgatctcgagacgtctggtacagttacagtggggccaatgcacacacttccaagtacctgccttcagaaagttgaggaacagcccgaggacgcagataatcagagaaacgttaccagaatgggctctcagccacccgatcccaatacgattgttcacatccctgtgatgttaaccggaccactcggcgaggctactgtggtgccttcaggtaatgtggaccttgagtcacaagccgaaggtaagaaggaagtggaggcagacgacgtgatgaggtcaggcccccgacctatcgtcccatactcatcaatgttctgcctgtcccctactaacctgctcagacgcttctgtcactacatcgtgacaatgcgatactttgaggtagtgatactggtggtcatcgcattgtcctcaatcgccttagccgctgaagatcctgttcgtacggattcacccagaaacaacgccctcaagtacctggactacatctttacaggggtgttcacatttgaaatggtgataaaaatgatcgatctgggcttgctgctccatcctggggcctactttagggacttgtggaacatcctagatttcattgtggttagcggtgcactggtggcttttgcgttttcaggaagtaagggcaaggatataaacacaatcaagagcctccgagtgctaagagttcttcggccactgaagaccattaagcgcctgcccaagcttaaggcagtttttgactgcgtggtgaatagcctcaaaaatgtgctcaatattctaatagtctatatgctgttcatgtttatcttcgctgtcatcgcggttcaactcttcaagggtaaatttttttactgcacagatgagagtaaggagttggagagagattgtagggggcaataccttgattatgagaaagaggaggtcgaggctcaaccacgccagtggaagaagtacgactttcactacgataacgtcctttgggctctgctaactctattcactgtcagtaccggggaggggtggccaatggtgttgaaacattctgttgatgctacatatgaggaacagggaccaagcccagggtaccgcatggaactatctattttctatgtggtttactttgttgtcttccctttcttttttgtgaacatttttgtggcgctgatcatcattaccttccaggagcagggagataaagtgatgagtgagtgctcgcttgagaagaacgagagagcttgcatcgacttcgccattagtgcgaagcccctgacgcgctacatgcctcaaaacaggcagagctttcagtacaagacctggacctttgtggtttcccccccctttgaatactttattatggccatgatcgccctgaataccgtggtgttgatgatgaaattctatgacgcaccttacgaatacgaactgatgctaaagtgccttaacattgtcttcacttctatgtttagcatggagtgcgtgttgaaaataatcgcatttggtgtgctgaactactttcgcgatgcatggaacgtctttgacttcgtgaccgtcctcgggtcaattaccgacatcctagtcaccgaaatagctaacaacttcattaacctgagctttctaagactgtttcgagccgcaaggctgattaaactcctgagacagggctatactatcagaatcttgttgtggacatttgtccagtcattcaaagccctgccctatgtttgcttactgatcgcaatgctcttcttcatttacgccattatcgggatgcaggtgtttggcaacattgcactggacgatgacactagtatcaatagacataacaattttcgcacattcctccaagcactgatgctgcttttccgctccgccacaggggaggcttggcatgagatcatgttgagctgcctttctaaccaggcctgcgatgagcaagctaacgccactgaatgcggcagtgatttcgcgtacttctacttcgtgagttttatctttctttgtagcttcttaatgctgaatttgttcgtggcggtgatcatggataactttgagtacctgaccagggactcaagtattctcggacctcaccacctcgacgagttcatccgcgtatgggcagaatatgatccagccgcctgtggtcgcatatcttacaatgatatgtttgagatgctcaaacacatgtcacccccactgggcttaggaaagaaatgcccagcccgtgtcgcctataaacgactggtgcggatgaacatgcccatatcaaatgaggacatgactgtacatttcacttcaacgcttatggcactcatccgtaccgccctggagatcaaactcgcccctgccggcaccaagcagcatcaatgcgacgccgagctgagaaaagagatttccgtggtgtgggcaaatcttcctcaaaagacccttgatctgctggtgcctccacacaagccagacgagatgactgtcggcaaggtgtacgcagctctcatgatcttcgacttttataaacagaacaaaactactcgggaccaaatgcagcaggcacccggtggtctgtctcagatgggtcccgtatccctgttccatccccttaaagctacacttgagcagacacagccagccgtgctgagaggtgctcgcgtttttctgcggcagaaatcaagtacctctctgtcgaacgggggggcaattcaaaatcaggaatcaggcatcaaagagtctgtatcgtggggaacccagcgcacccaggatgccccacatgaggctcgccctcccctggagcgaggacactcaactgagatacccgtcgggcggtcaggagccctcgctgtcgacgtgcagatgcaaagcataaccagacgcggacccgatggggaaccccagccaggactggagtcacagggcagagctgcaagtatgccacggttggccgctgagacacagccagtcacagatgcaagccccatgaaacgatctatttccacgctcgcacagcgtcctcgggggactcatctgtgtagcacaacgccggaccggccacccccttctcaggcttcatctcaccaccatcaccacagatgtcataggagacgtgatcgaaagcagagatcactagaaaaaggaccctcactgtccgctgatatggacggtgctccttcgagcgcagtgggccctgggctcccaccaggagaaggccctacgggatgccgtcgcgagagggagcgcagacaggagaggggaaggagccaggagaggcggcagcctagctcgtcaagttcagagaagcagcgcttctacagctgtgacaggttcggggggagggagccccccaaacctaaaccatcactgtcaagtcaccccacgtcacccactgccggccaggaacctgggccgcatccccagggtagcggatctgtgaatggatccccgctgttaagtacctccggcgcttcaacaccgggccgcggcggtagacggcagctgccccaaacccccctcaccccccgtccatctatcacgtataaaaccgccaactcttcaccaatccattttgctggcgcccaaacatctctgcctgcattttccccgggacggctgagtaggggactctctgagcacaacgctctgttgcagcgagatccattatcgcagcccctggcacctgggagccgcattggatctgatccttatctcgggcagaggctagactccgaggcgagtgtgcatgccctcccggaggatacacttacttttgaagaggcagtggccactaattccggaaggagcagccggaccagttatgtgtctagccttacaagtcagtcacatccattgagacgcgttcctaacggataccactgcacacttggattgtcctcagggggtagggctcggcatagttaccatcatccagatcaggatcactggtgctag

SEQ ID NO: 110452 - DNA, 7014 bp, Artificial Sequence
  Description of Artificial Sequence: Synthetic coding sequence
atggtccggttcggggatgagttgggcgggagatatggtggtccaggaggcggcgagagagccaggggcggcggggctgggggagccggcggaccaggcccaggcgggctgcagcctggacaacgggttctctacaaacagtcaatcgcgcagcgcgctagaaccatggcactctacaatcccatccctgttaagcagaattgttttactgttaatcggtctttgttcgtcttctcggaggataacgtggtgcgtaaatacgccaaaaggattactgagtggccccccttcgagtacatgattttggctaccatcatagcgaattgcattgtgctggctctggaacaacacctgccggacggagataagacgccaatgagtgagcgcctggacgacactgagccatacttcataggtatcttctgcttcgaggcaggcatcaaaattattgcccttgggttcgtgtttcacaagggttcataccttcgaaacgggtggaacgtgatggatttcgtggtggtcttgacgggtatcctggccaccgctggtacggacttcgacctccggaccctgagagctgttagagttcttcgccccctgaagctggtgtcaggtatccccagtctgcaggtggtgctgaaaagtattatgaaagctatggtgcccctgctgcaaatcggcctgcttctgttttttgctattttaatgtttgctattatagggttagaattttacatgggaaaatttcataaggcctgtttcccaaacagcactgacgcagaaccagtaggcgattttccatgtggtaaagaggcacctgcaaggttgtgcgaaggagatactgagtgcagagaatactggcccggtccgaattttgggattacgaattttgacaatattctattcgctatcctcactgtgtttcagtgtatcacaatggagggctggacagacatcctttataatacaaatgatgcagcaggcaatacgtggaactggctgtacttcatcccactcattattataggctctttcttcatgttaaatcttgtactgggcgtcctttccggcgaattcgcgaaggaaagggagagggtggagaatcgacgcgcgttcctgaagctccgtcgccagcagcagattgaacgggagctgaatgggtacctcgagtggattttcaaggcagaggaggtaatgctggcagaagaggaccgcaacgcagaggagaagtctcctctcgatgttctcaaaagagcagccacgaagaaatcccgcaatgatctgatccacgccgaggaaggggaggataggttcgccgacctctgtgctgttggatcacctttcgcccgagcatcgctaaagagtggtaagacagaatcatcatcttactttaggcggaaagagaagatgttccggtttttcatacgaaggatggtcaaggcccaaagcttttactgggttgtcctgtgtgtcgtagcacttaatacactttgtgtggcaatggttcactataatcaaccccgtaggttaaccacaacactgtactttgccgagttcgtgtttctgggcctgttcctcacagagatgtctttgaagatgtacgggctggggccaaggagctacttcagatcgagcttcaattgctttgattttggcgtgatcgttggaagtgtgttcgaagtggtctgggccgccattaagccaggctccagctttggcatctctgttctgagagcactacgcctgctccgcatcttcaaggtgacaaaatattggtcctcactgcggaatcttgtggttagtctcctgaacagcatgaagagcattatttcgctgctgtttctgctctttttattcattgttgtatttgcacttctgggtatgcagctgttcggcggacagttcaactttcaggatgaaacccctaccactaacttcgacaccttccctgctgctattctgacagtgttccagatcctaacaggagaagactggaacgccgtgatgtaccacggaatagagagtcagggcggtgtttctaaaggaatgttttcgagtttttatttcatcgtgcttactctcttcggcaattataccttgctcaacgtgtttctggccattgccgtggacaatttagccaatgcacaggagctgacgaaagacgaagaggaaatggaggaagccgcaaatcagaaactggcactgcaaaaagcaaaggaagtggcagaggtctcgccgatgtcagccgctaatatttctatagctgctcggcagcagaatagcgcaaaagccagatcagtgtgggaacagcgagcatcccagctgcgcctgcagaacctccgcgcctcttgtgaggcgctctatagcgaaatggatcctgaggagcggctgaggttcgcaactactcggcatttaaggccggatatgaaaactcatctcgatagacctctggtggttgagctgggcagagacggggcacgcggacccgtgggcggtaaggcccggcccgaggcagcggaggcgccagagggcgtggatccccccagacgccaccataggcacagggacaaagacaagacacctgcagcaggcgaccaggaccgggctgaagcccctaaagcagagagcggcgagcccggagcccgggaagagcggcccaggccgcacagatcccactccaaagaggctgcgggcccacccgaggcaagaagtgaacggggacggggtcctggacccgagggcgggcgaaggcaccacagacgtggttccccagaagaagccgcagagagagagcccagaaggcacagagcccaccggcaccaggaccctagcaaagagtgtgcaggagcgaaaggtgaacggagggctagacaccggggcggtccacgtgccggccctagggaagcagaatctggagaggagcccgctaggaggcatcgggcccgacacaaggctcaacccgctcacgaggccgtggagaaggagaccactgaaaaggaggctaccgaaaaggaggccgagattgttgaagctgacaaagagaaagaactgcgcaatcaccagcctcgggaaccacactgcgacctggaaacttctgggacagttactgttggccctatgcacaccttgccctccacttgcctccaaaaggtcgaggaacaacctgaggacgcagacaaccaacggaacgtgacccgcatgggcagccagccgcctgatcccaacacaattgtgcacatcccagtgatgctcacaggaccattgggcgaggccactgtggtcccctcgggcaatgtggatctcgaatcccaggccgaaggcaagaaggaagtggaagccgatgatgtgatgcgaagcgggccaaggcctatcgtgccctactccagcatgttttgtctgtcgccaactaaccttctgaggcgcttttgtcactacatcgtaaccatgaggtactttgaggtggtgatcttggtagtgattgctttatcatccattgctctggctgctgaggaccctgtgagaacagattcacccagaaataacgcgttaaaatatctggattacatcttcacgggagtctttactttcgaaatggtcatcaagatgattgatctggggttactgcttcatccaggcgcctactttagggacctatggaacattctggatttcatagttgtgtccggcgctctcgtggcatttgctttcagcgggagcaagggcaaggacattaacacaattaagtcccttcgcgtgttacgcgtactgcggcctctgaaaacgattaagcgcttgcctaagctgaaagccgtttttgactgcgtcgtgaatagtttgaaaaatgtgttaaacatattaatcgtatatatgttatttatgttcatttttgcagtaatcgccgtgcaactgttcaagggcaagtttttttactgtaccgatgaatcgaaagagctcgaacgggattgcaggggacagtacctcgattacgagaaggaggaagtagaagctcagccgcgacagtggaagaaatacgattttcactatgataacgtactctgggcactcctgacacttttcacggtgtccactggagaaggatggcctatggttctgaagcatagcgtcgatgccacctatgaggaacaggggccatcccctgggtataggatggaattgagtatcttctacgtggtatatttcgtggtgttcccttttttctttgtcaacatcttcgttgctctcatcattataacgttccaggagcaaggtgataaggtaatgtccgagtgctcactcgagaagaacgagagagcatgtatagacttcgccatctctgcaaaacctctgacccgctacatgcctcagaatcgacagtcattccagtataagacctggacctttgtggtttctccaccttttgagtattttattatggccatgatagccctgaacaccgtagtcctgatgatgaagttctatgacgctccttatgaatacgagttgatgctgaaatgtctaaacattgtgttcacatccatgttcagcatggaatgcgttctaaaaatcatcgctttcggagtgcttaattacttccgtgacgcgtggaacgtgtttgattttgtaacggttctcggctctataaccgacattttggttaccgaaatcgctaacaatttcatcaacctgtcatttctgcgcttgtttagagcggccaggctgatcaagctactacgccaggggtataccattcggatcctgctgtggacattcgtgcagagcttcaaggccctcccttatgtgtgcctgcttattgcaatgctcttcttcatctacgcgataatcggaatgcaagtgtttggtaatatagcgttagacgacgacaccagcatcaatagacacaacaacttccgcactttcctgcaagcccttatgctcctcttccgatctgcaaccggcgaggcctggcatgaaatcatgttgagctgtctgtcaaaccaggcctgtgacgaacaggcaaacgcaacagagtgcggtagcgactttgcttacttctatttcgtctcttttatcttcttgtgttctttccttatgctgaatctgttcgttgccgtcattatggataactttgagtatcttactagagactcctctattctggggccgcaccatctggacgagtttattcgggtgtgggccgagtacgaccccgcagcatgcggcaggatttcatataatgacatgtttgaaatgctgaagcacatgtccccccccctcggtttgggcaagaagtgtcccgcaagggtggcctacaagagactcgtgcgtatgaacatgcctatttcgaatgaggatatgaccgtgcattttaccagcaccctcatggcccttattcggacagccctcgaaatcaagctagcccccgcaggtaccaagcagcaccagtgcgacgcggagctgcggaaggagattagcgtcgtatgggccaatttgccccagaaaactcttgatttacttgtgcctccgcacaaacctgacgagatgaccgtggggaaggtgtatgccgccttaatgatcttcgacttctacaaacaaaataaaacaacaagggatcagatgcagcaggcgcccggaggcctatctcagatgggacccgtctctctgtttcaccctctaaaggcgactcttgagcagacgcagccagccgtgctccgcggggccagagtctttctgagacaaaaatcttctacctccctgtccaatggaggggcaatacagaatcaggagagcggaatcaaggagtcggtcagttgggggacacagagaacgcaggacgcccctcatgaagccagacccccactggaacggggacactcaacagaaattcccgttggaaggtctggcgctctcgcggtcgacgtgcagatgcaaagcattacaaggaggggccctgacggggaaccgcagcccggcctggagtctcaagggcgggctgccagtatgcccagattggccgctgagacccaacccgtcactgacgcaagccctatgaagcggagcatatctaccctggctcaaaggccgcgtgggacccacctgtgttcaacaacgccagaccggcctccaccaagccaggctagcagtcatcatcaccaccatagatgccataggcgacgagatagaaagcaacgaagcttggaaaaaggcccttctttaagcgcagacatggacggtgccccgtctagcgctgttgggcctggtctccctccgggtgaaggcccaaccgggtgcaggagagaaagagagcgtaggcaggaaagaggtcgcagccaggaacgacggcaaccttcaagtagctcctcagagaaacaacgtttttacagttgcgacaggttcggaggaagggagccccccaagcccaaaccgtcactgtcaagtcatcccacaagccctacagcaggccaggagccagggccacacccccaaggcagcggctcggtgaacggaagccccctgctatccacctccggggcttccaccccaggtaggggcggccgccgccaactaccacagaccccactgacgccccgtccatctatcacctataagacagctaactcttcccccattcattttgcaggggcccagacttcgctgccagctttttctcctgggagactgtctcgaggattatccgagcacaatgccttgcttcagcgcgatccactgagccagcctttggccccaggatccagaatcgggtctgatccatacctgggccagagactagattcagaagccagtgttcacgcactacccgaagatacattgacattcgaggaagcggtggcgactaacagcggtcgctcgagcagaacttcttacgtgtctagcctaactagccagtcccatccactaagacgcgtgcctaacggatatcattgcacgctgggattaagcagtggcggaagggctcgccactcctaccatcatcctgaccaagatcactggtgttag

SEQ ID NO: 110453 - DNA, 495 bp, Artificial Sequence
  Description of Artificial Sequence: Synthetic coding sequence
aatttcagaacattcttgcaggcactgatgctgcttttcaggtcagctactggggaagcctggcacgaaatcatgcttagttgcctgtccaatcaggcttgtgatgagcaggccaatgcaactgaatgcggcagcgattttgcttatttttattttgtgtcttttatatttctgtgttcctttcttatgttgaatctgttcgttgctgtgattatggataactttgagtacctaactcgagatagcagtatccttggtccccaccatcttgatgagtttattagggtttgggccgaatacgaccccgctgcatgctgccggatccactacaaggatatgtactctctgctccggtgtatagctcctcccgtgggcctcggaaagaattgccctcgcagactagcctacaagaggttagttcggatgaatatgccgattagcaatgaagacatgaccgtgcattttacaagcacgctcatggctctgatcaggtag

SEQ ID NO: 110454 - DNA, 327 bp, Artificial Sequence
  Description of Artificial Sequence: Synthetic coding sequence
ctgagaaatcatcagccccgtgaaccccattgtgatctggagacgtccggaacggtcacggtagggccaatgcacaccttacctagtacatgcctgcagaaagtggaggagcagcctgaggatgcagataatcaacgcaacgtgacgcgcatgggctcgcagccacctgatccaaataccatcgtgcacatcccggtcatgttaacaggtcccttaggagaagcaacagtggtcccaaccttggaaaagaatgtgtgcctattccttttaacaagtatggtgtcggacgagaaaagtacggtgattagaatagttttcttcttatag

SEQ ID NO: 110455 - DNA, 7020 bp, Artificial Sequence
  Description of Artificial Sequence: Synthetic coding sequence
atggtccggttcggggacgaactcggaggacggtacggcgggccggggggtggcgagcgcgcgcgagggggtggcgccggcggagcaggaggaccagggcccggagggctgcaacccggccaacgggtcttgtacaaacagtcgatcgctcagagagcgcgcactatggctctatataaccctatacccgttaaacagaattgcttcactgttaaccgatctctgtttgtgttcagcgaagataatgtggtgcggaagtatgctaagcgcattaccgagtggccaccattcgagtatatgatcttggcaactatcattgccaactgcatcgttcttgccctcgaacagcatctccctgatggcgataagacccccatgtcggaacggctggatgatacagagccatatttcattgggatcttctgttttgaagccggcattaagattatcgcgttgggtttcgtgtttcataaggggagctatctgagaaatggctggaacgtcatggatttcgttgtggtcctgacgggaatattggccaccgcgggaaccgattttgatctgcgcacacttagggctgtgagggtacttcgcccactgaagctggtttcaggcatcccaagcctgcaggtggtgctcaagtccatcatgaaggccatggttccactcctgcagatcggtttgcttctgttcttcgctatcttgatgtttgcaataatcgggttagaattttatatggggaaattccacaaggcttgtttcccaaacagtacagatgcagagcctgttggcgactttccatgtggcaaggaagcccctgcccgcttatgcgagggagataccgagtgtagagaatattggcccggtccaaatttcggtatcacgaatttcgataatatcctctttgccatcctgaccgtgttccagtgcatcaccatggaggggtggacagacatactatacaacacgaacgacgcagccgggaatacctggaactggctctactttatccctcttattatcattgggtccttcttcatgttaaatctggtccttggcgtgttgtccggagagtttgccaaagagcgggaacgggtggaaaacagaagagcttttctgaagctccggaggcagcagcaaatagaaagggaattaaacggctacctagaatggatattcaaagccgaagaagtaatgctggcagaagaggaccgaaacgcagaggagaagtcacctctggacgtgcttaaaagagcagcgacaaagaaatctcggaatgaccttatccacgcagaggagggagaggatcgcttcgcagatctgtgtgctgttggaagtccgtttgcccgagccagcttaaaaagcggtaagaccgaatcctcctcctatttccgtcgcaaggagaagatgttcaggttctttatcaggcgcatggttaaagctcagagtttctattgggttgtgctgtgcgtggtggctcttaatactctctgcgtggcaatggtccactacaatcagcctcgtaggctgacaaccaccctgtatttcgccgaatttgtatttctcggcctcttcctgaccgagatgagccttaaaatgtacggtttgggcccccgaagctacttccgatctagtttcaattgtttcgactttggagtgattgtggggagtgtttttgaagtagtttgggccgctatcaagcccggctcatctttcggcatctcagtattgagggcactaagactgctgcggatctttaaagttactaaatactggtctagtctaaggaacctggtggtgagtctcttaaacagtatgaagagcatcatatccttattgtttttactgtttctgttcatcgttgtattcgctttattaggcatgcagcttttcggtggccaatttaactttcaggatgagacgccaaccacaaattttgatacctttccggcggcgattttgacagtattccagatcctcaccggcgaggactggaacgccgtgatgtaccatggtatcgagtcccagggaggagtgtctaaaggaatgttctccagcttttattttattgtgctgaccctgttcgggaattatactttgctgaatgtgttcctggccattgcagtcgataatcttgcgaatgcacaggaacttacaaaggacgaggaagaaatggaagaagccgcaaatcaaaagctagcgctgcagaaggcaaaagaggtggctgaggtttcgcctatgtccgccgccaatatctccattgcagcccggcagcaaaacagcgctaaagcgagatccgtgtgggagcagagggccagtcagctccgcctgcagaatctgcgcgcttcttgcgaagccctctactcagaaatggatcctgaagagcggctgcgattcgccacaacacgccacctgagaccggacatgaaaacccatctcgatcggcctttggtggtcgagcttgggcgggatggtgcgcgcggcccagtgggtggcaaagctaggcctgaagccgctgaggctcctgaaggtgtggaccctccacgcagacaccaccgccatagagacaaagataaaactccagccgcgggggaccaggaccgcgcggaggctcccaaggcagaaagtggagagccgggcgctcgtgaagaaagacccaggccgcatcgttctcactcgaaagaggcagccggtccgcccgaagctcgaagtgagcgcggcagaggccctggtcctgaaggcgggagacgacaccaccgccgggggtccccggaggaagcggcggagcgggagcctaggcgtcatcgggctcatcgccaccaggacccctccaaagagtgcgcgggagccaaaggcgagcgccgcgctcggcatcgcggaggtccgcgggctggcccgagagaggctgagagcggcgaggagcctgcccgccgccatagagctaggcacaaggcacagccagcccatgaagcggtggagaaagaaactaccgagaaagaagctacagagaaggaggccgagatagtagaagccgacaaagagaaagagttgcgcaaccatcagcctagggagccgcactgtgatctcgagacaagcgggactgtgacggtgggcccgatgcatactctcccttctacttgtctgcagaaagtggaggagcagcccgaagatgccgacaatcagcggaacgttacacgtatgggtagccagccacccgacccaaatactatcgtgcatatcccagtcatgctcaccggtccattaggtgaggccactgtcgttccgagcggaaacgtggatctggagtcacaagctgaaggaaaaaaagaagtcgaggcagacgatgtgatgagatcaggaccccgcccaattgtgccatattcttctatgttctgcttgtcccccactaacctgctgagacgcttctgccactacatcgttacaatgagatactttgaagtggtcattttagtcgtcatcgcactgtcctctattgctctggcagccgaggacccagtcagaaccgattcaccccgcaataacgccttgaagtatctggattatattttcaccggcgttttcacattcgagatggtgattaagatgattgatctgggcctgcttttgcaccctggagcttatttcagagatctgtggaatatactggatttcatcgtggtgtcaggagccttggttgcgtttgccttttccggcagtaaaggtaaagacattaacaccataaagagcctccgagttctaagggtcttgcggccacttaagaccattaaaaggctacctaaacttaaggccgttttcgactgcgtcgtcaattctcttaagaacgttctgaatatactcatcgtgtatatgctgttcatgtttatcttcgctgtgatagccgtacaattgtttaagggcaagttcttttactgcacagatgagagtaaagaactggagcgtgactgtcgcgggcagtatctggattacgagaaggaggaagtggaagcacagcccaggcagtggaagaagtatgacttccattacgacaacgtcctctgggctctgcttacactgtttacagtatcaactggcgaaggctggccaatggttctcaagcactccgtggatgccacatatgaggagcagggacccagcccaggatacagaatggagctgtccattttctacgtggtgtatttcgtggtttttcctttcttcttcgtcaatattttcgttgcattaatcattattacctttcaggagcagggcgacaaggtcatgagcgagtgctcactggagaaaaacgagcgggcctgcatcgactttgccatcagtgctaagccgctaacacgctacatgccgcagaaccgccaatcttttcagtataaaacgtggacctttgttgtttctcccccatttgagtattttatcatggcaatgatcgctctgaacaccgtggtgctcatgatgaagttttacgatgctccatacgaatacgagctgatgctcaagtgtctgaacatagtctttacatcaatgtttagcatggaatgtgttcttaagataatcgcgtttggggtgttaaactatttccgtgatgcctggaatgtgtttgatttcgttaccgttttgggctctatcaccgacattttagttacagaaatcgcagagaccaacaactttatcaatctaagcttcctgcgactctttagggccgcgcggctaatcaagctcctccgccaagggtacaccatcaggattctgttgtggacatttgttcagtcttttaaggccctgccatatgtttgcttgctcatcgcgatgctgtttttcatttacgctatcatcgggatgcaggtgtttggcaacatcgcgctcgacgatgatacctccattaaccggcacaacaacttcagaacttttctccaggccctcatgcttctatttagatctgctactggagaagcctggcatgagatcatgctgtcttgtttaagcaaccaagcatgcgacgaacaggccaatgccaccgagtgtggctcagactttgcttacttctattttgtgtcctttatattcctgtgcagctttttgatgctcaatctctttgtcgcagtgataatggataattttgagtatcttaccagggactcaagtatcctcggaccacaccatctggacgaattcataagggtgtgggctgagtacgatcccgctgcctgtgggagaataagctataacgacatgtttgaaatgctgaagcatatgtctccccccctaggtttaggcaaaaaatgtcccgccagagttgcctataagaggttggtcaggatgaatatgcctatctctaatgaggacatgaccgtgcactttaccagcacactcatggctctgatccggactgctcttgagatcaaactggctcctgcaggaacaaagcagcaccaatgcgacgctgagctgagaaaggaaatttcagtggtgtgggcaaatctccctcaaaaaaccttggacctgttagtgcctccgcataagcccgacgaaatgacagtggggaaggtgtacgctgctttaatgattttcgatttctacaaacaaaataaaacaactagagaccaaatgcagcaggctcctggtggtctcagtcagatgggtcccgtctctctgtttcatcctttaaaagcaaccctcgagcagacccagccggccgtgctcaggggcgcccgtgtctttctacggcaaaaatcctctacttccctgagcaacggtggggcaatccagaatcaggaatcagggatcaaggaatctgtttcatggggcactcagcggacacaggacgccccccatgaagcgcgccccccactggagcggggacacagtacggaaattccagtaggccgctcaggagctctggccgttgacgttcagatgcagtctatcactcgccgcggccccgacggtgagccgcagcccggcttggagagtcagggtagggccgcaagcatgccacgtctggccgccgaaacacagcctgtgacagacgcctcacctatgaaacggtccataagcaccctggcccaaaggccccgcggcacacatctgtgctccactacccccgacaggcccccgccaagccaggcatctagtcatcaccatcaccacagatgccaccgaagacgcgatcggaagcaacggagtctagaaaagggcccaagtctgagcgccgatatggacggcgcaccaagcagcgcagtgggaccaggattgccgcctggcgaagggccgaccgggtgtcgacgggaacgcgagaggcggcaggagagagggcgctcacaggagcgacgtcagccatcctcctcttcctctgaaaaacagcgcttttatagttgcgataggttcggcggcagagaacctcctaagcccaagccctcgctgtcatctcaccctactagccccacagccggacaggaaccggggccacatcctcagggatcaggctccgtgaatggctcgcccctgctaagcacaagcggcgcgagtacacctgggcgcggagggaggcgtcagttacctcagaccccattgaccccacggccaagcatcacatacaaaaccgcaaacagtagccctatccacttcgccggggcccagacctccctgcccgcattttcacctggccggctctcacgtggtctttccgaacacaacgccttacttcaaagagacccactgtctcagcccctagcaccgggatcaaggatcggatcagacccttacctgggccaaagactggacagcgaggccagcgtgcatgctctcccagaagacactttaacattcgaagaggcagtggccacaaatagcggccgctcgagtcggacttcttatgtgtcctccctgacgagccagtcccatcccctgcgccgtgtgcctaatggatatcattgcacactaggcctctcctctggcggtcgcgccagacactcctaccatcacccagaccaggaccactggtgttag

SEQ ID NO: 110456 - DNA, 498 bp, Artificial Sequence
  Description of Artificial Sequence: Synthetic coding sequence
tgaaactttcgtacctttctgcaggcgctcatgctgctcttccgcagcgccacgggcgaggcgtggcacgagatcatgctctcctgcctcagcaatcaggcgtgcgatgagcaggcaaatgcaacagagtgcggttctgacttcgcctatttctacttcgtgtcgtttattttcctatgtagcttcttaatgctgaatctcttcgtcgctgtaatcatggacaacttcgaatatctcaccagggatagtagtatcctgggcccccaccacctggatgagtttatccgggtgtgggctgagtacgatcctgctgcttgttgccggatccactataaggacatgtactcactgctgagatgtatagcccccccggtgggactcgggaaaaattgcccgcgtagacttgcttacaagcggttagtgcggatgaatatgcctatctcaaatgaagacatgacggtgcatttcacttcaaccctgatggcactgatccgttag

SEQ ID NO: 110457 - DNA, 564 bp, Artificial Sequence
  Description of Artificial Sequence: Synthetic coding sequence
ctaagaaatcaccagcccagagagccccactgcgatcttgagacgagtgggacggttaccgttggtcctatgcacacactgcccagcacctgtctgcagaaagttgaggaacagccggaggacgcagacaaccaaaggaacgtcacccgaatgggtagtcagcctcccgatccaaatactatagtccacatcccagtaatgctgaccggacctctgggagaggctactgttgtgcctagcccaacaattggcagactgcaggcggaagagcagggagagccggccagagttagtaagttgaatttagaatccgatgtccggggacaggaagcttcctcaacaggcgaacgatatagattgggcggcgggaacgtggacttggaatctcaggccgaaggaaagaaagaagtcgaagcagacgacgtgatgcggtccggccctcgcccaatcgttccatactctagcatgttttgtttaagccccaccaacctgctgcgccgtttctgccactacatcgtgacaatgcgttactttgaagttgtaatcctggttgtaatagcatag

SEQ ID NO: 110458 - DNA, 6786 bp, Artificial Sequence
  Description of Artificial Sequence: Synthetic coding sequence
atggcacgctttggggatgagatgcctgcgcgttatggcggtgggggaagcggcgcggccgctggggtggtcgttgggtctggcggaggcaggggggccggagggtccagacagggggggcagcctggggcccagcggatgtataagcagtccatggcgcagagggccagaacaatggcgctgtataaccctataccagtcaggcagaactgtctgaccgtcaacagatcgcttttcttgttctctgaagataacgtggtccggaagtacgcaaaaaagatcaccgagtggcctccttttgagtacatgatattggcaaccataatcgcaaattgcattgtgcttgccttagaacagcacctgccagacgacgacaagaccccaatgtccgagcgcctcgacgataccgagccctattttatcggtatcttctgctttgaggctggtatcaaaatcatagccctggggttcgctttccacaaaggtagctatcttcgaaacggttggaatgttatggatttcgtggtggtgctaacaggcatactcgcgacggtagggacagagtttgacttgcgcaccctacgcgccgtgcgggtgttacgtccacttaagctggtgagtggcattccttccctccaggtcgttctgaagagcatcatgaaagccatgatcccactgctgcagattggcttgcttttatttttcgccatattgatcttcgctatcatcggcctggagttttacatgggcaagtttcacacaacatgctttgaagaaggaactgacgatattcagggggaaagtcctgcaccatgtggaacagaagagcctgcgcgcacatgtccgaatggtactaaatgccaaccatactgggaaggtcccaataacggtatcacccagtttgacaatatactgtttgccgttcttactgtctttcagtgtatcactatggagggatggactgatcttttatacaactccaacgatgcgtccggcaatacttggaactggctctactttattcccctgataataatcggatcctttttcatgctgaatctggtcctcggggttctctctggcgaattcgctaaagaaagagaacgtgtcgaaaacaggagagccttccttaagttaagaaggcagcagcagatcgagagagaacttaatggttacatggagtggatctctaaagcagaagaggtgatcctggcagaggatgagacggatggtgagcaaaggcaccctttcgatggagctcttagaaggacgacgatcaaaaagagcaaaacggacctgttaaaccccgaggaggccgaagaccagttagccgacatcgcctctgtgggatcccccttcgctcgcgccagtatcaagagtgctaagcttgagaattctacattttttcataaaaaagaaagacggatgcggttttacataaggaggatggtaaagacacaggctttttactggaccgttttgtcactcgtcgctcttaatacactgtgtgtcgctatagttcactataaccagccagaatggctgtcagatttcctgtactacgccgagttcatctttctggggttattcatgtcagaaatgttcatcaaaatgtatggcttgggtacaaggccttacttccactctagtttcaattgctttgactgcggcgtcatcatcggctctatctttgaagtgatttgggcggtgatcaagcccgggacttctttcggcataagcgtgctgcgggccctcagactgctccgtatctttaaagtgacaaagtattgggcatctcttcgcaatttggtggtgagcctgttgaattctatgaagtccattatttcattgttgttcctcttgtttctcttcattgtcgtgttcgcactgttgggcatgcagctttttggcggacagttcaactttgacgaaggtacaccccctaccaacttcgatacattccccgccgctattatgacagtgtttcagatcttaaccggtgaagactggaatgaggtcatgtatgacggcatcaagtcccaggggggagtgcagggaggaatggtattcagcatttacttcattgtattgactcttttcggtaactacactctcctaaatgtgttcctcgcaatagcagttgataatctcgctaatgcccaggagctgacaaaagatgagcaggaagaggaagaagccgctaaccaaaaattggctctccaaaaggccaaagaagtagcggaagtcagcccactgtccgctgccaacatgtctatcgcggttaaagagcagcagaagaaccagaagccagcgaaatcggtctgggagcagagaactagtgaaatgcgcaagcagaacctgctcgcatcaagagaagcgctgtacaatgaaatggatccagacgagaggtggaaagcagcctatacacggcacctgcgcccagatatgaagactcacctcgatcgaccacttgttgtggatccgcaagaaaatcggaacaataataccaacaaatcccgggctgcggaaccaactgtcgatcagaggctgggacagcaacgggctgaagacttcttgaggaagcaggccaggtaccacgatagagcccgggatcccagcgggtcagcaggcctggatgcaaggagaccttgggctgggtctcaagaagctgagttgtcgcgcgagggtccatacggcagggaaagtgatcaccacgcacgagaaggctcgttagaacaacccggcttttgggagggtgaagccgaacgcggtaaggcgggtgacccacaccggcgccatgtgcatagacagggcggcagtcgagagtctcgcagtggctcacctcgcaccggcgccgatggggaacacaggagacatagggcgcatagacgtccgggcgaggaggggcctgaagataaagcagaacgccgggcgcgtcatcgcgaggggtcaaggcccgcaagaggaggtgagggcgagggtgagggccctgatggtggagagagacgtcgccggcatcggcatggtgctcccgcaacatacgagggggacgcacggcgcgaggacaaggaacgacgtcacagacgacgaaaggagaatcagggatccggagttccagtgagtgggccaaacctttctaccacgcgtccgatccagcaggacctcggcagacaggacccacctctggctgaggacattgacaacatgaaaaataataaactggccactgctgagagcgcagctcctcacggctccctcggacatgccggccttccccagtcccccgctaaaatgggcaattcaaccgaccccggccctatgctcgctatccccgcaatggccacaaacccacaaaatgccgcttcacgacgcacaccaaacaaccccggaaacccttctaatcccggacctccaaagacgccagagaactcactcatcgtcacaaacccatccggtactcaaactaacagcgcgaagacggccaggaaaccggatcacacaacggttgatatcccacccgcctgccctccacccctaaatcacacagttgtgcaagtgaacaaaaacgcgaacccggatccactccctaaaaaagaagaagagaaaaaagaggaggaagaggacgatcgcggtgaagacggacctaagcctatgccaccctattcatccatgtttatactatcaacaactaaccctctccggaggctgtgtcactatatcctgaatcttcgctattttgagatgtgcattctgatggtcatcgccatgtcttccatcgctcttgccgccgaggaccccgtccagccaaatgctcctagaaataatgtgctgagatattttgactacgtgttcacaggtgtattcacatttgagatggttattaaaatgatcgatctgggcctggtcttgcaccagggagcctatttccgcgatttgtggaacatcctcgatttcatcgtggtgagcggagcactggtggctttcgcatttacgggcaatagcaaaggaaaggacataaacacaatcaagagcttgagggtcctgagggttctgcgcccactcaaaactatcaaacggctcccaaaactgaaggctgtgttcgattgcgtcgtgaattcactgaaaaacgtcttcaatatcctaattgtctatatgctcttcatgtttatcttcgctgtggttgcggtgcagctgtttaagggcaaatttttccattgcaccgacgagagtaaagaattcgaaaaggactgtagaggcaagtatctcctgtacgagaagaacgaagttaaagctcgggaccgggaatggaaaaaatacgaattccattacgataacgtgctgtgggccctgctgacgctctttaccgtctctaccggggagggctggccccaggtgctgaagcactcagtcgacgctacttttgaaaaccagggaccgagtcctggctaccgcatggagatgagtatcttctatgttgtgtatttcgtggtttttcccttcttctttgttaacattttcgtggctcttatcataatcacatttcaggagcaaggcgacaagatgatggaagaatattctctggagaagaacgaacgcgcgtgtatcgactttgctatttccgctaagccgctcacccggcacatgcctcagaacaaacagtccttccagtatcgaatgtggcagttcgtggtgagtccccctttcgaatacaccatcatggcaatgattgcactaaatacaatcgtgctgatgatgaagttttacggcgccagtgtggcctatgaaaacgccctgagagtcttcaacatcgtctttacctccctgttttccttagaatgcgtgctcaaggtgatggcgttcggcatccttaactactttcgcgacgcctggaatattttcgactttgtgaccgttctcggctccattactgacatcctggtgactgaattcgggaacaactttattaacctaagcttcttaagactgtttcgtgccgcgaggcttataaagctgctccggcagggatataccattaggattctactttggacttttgtgcagtcctttaaagcgctcccgtatgtgtgcctactgatcgccatgctcttttttatttacgccatcatcggcatgcaagtgtttggcaacattggcattgacgtggaggacgaggatagtgacgaggatgaattccagattacggagcacaataacttcagaaccttcttccaggcactaatgctcctctttcgtagtgcaaccggagaggcctggcacaatatcatgttgagctgcctgagcgggaagccctgtgataagaattcaggcatccttacccgggagtgcggtaatgagtttgcatatttttactttgtgtcctttatttttctttgcagcttcttgatgctgaacctgttcgttgctgtgatcatggacaatttcgaataccttacaagagactcaagcattctggggccacaccacctggatgaatacgtgagggtctgggcagaatacgacccagcggcttgtgggagaattcactacaaagatatgtattctttgctaagagtgataagtccccccctgggtctgggaaagaagtgcccgcatagggttgcctgtaaaagactgctgcgtatggatctccctgtagctgacgacaatacagtgcactttaattcaacacttatggctttgattcggaccgcactggatatcaagattgccaaggggggggcggataaacaacaaatggacgctgaactccggaaagaaatgatggcaatctggcccaacctgtcccaaaagacactggacctcctggtgacaccccacaaatcaactgacctcaccgtcgggaaaatttatgcagcaatgatgattatggaatattatcgacaatccaaagctaaaaaactccaggccatgcgggaagagcaagaccgcacacccttgatgtttcagaggatggaacctccaagccccacacaagaagggggcccgggacagaatgctttgcccagcacacagttggacccagggggggcccttatggcccacgaaagcggactgaaggaaagtccatcctgggttacccagagagcacaagagatgtttcagaaaaccgggacgtggagccccgagcaggggcctcccaccgacatgcccaactcccaacccaattctcaaagcgttgaaatgagagaaatgggacgcgacggctacagtgattcagagcactatcttcctatggaggggcaggggcgcgctgcctcaatgccacgcctgccagctgaaaaccagaggcgaagaggtcgacctagagggaacaacctctccactatcagcgataccagccccatgaagaggtccgccagcgtcctaggacccaaggccagacgcctggacgattattctctggagagggtcccccctgaggagaaccaaagacaccatcagcggcgccgagaccgatcgcatcgggcttccgagagatcgttgggccgctacaccgacgtagacaccgggctgggtacggatctttccatgacgacccaaagtggcgatctacctagtaaagaacgtgaccaagaacgggggcgcccaaaggatagaaaacataggcaacatcaccaccaccatcatcaccatcatcatccaccaccaccagataaagacaggtacgctcaggagcggccagaccatggtcgggcccgcgctcgagatcagagatggtcccgctccccctccgagggccgagagcacatggcccaccgccaatag

SEQ ID NO: 110459 - DNA, 7488 bp, Artificial Sequence
  Description of Artificial Sequence: Synthetic coding sequence
atggcaaggtttggagacgagatgcccgctagatatggaggtggcggttccggcgccgcagccggggtagtggtggggtcaggaggcggcagaggcgcagggggatctcgtcagggagggcaacccggagcccaaagaatgtacaagcaatcaatggcccagcgagcccgtactatggccctgtacaatcccatccccgtgcgccagaactgcctgaccgtgaacagaagcctgtttctgttttccgaggataacgtggttcgaaaatatgctaagaagattaccgagtggccccctttcgagtatatgattttagcaaccattatagcaaactgtattgttctggccctcgagcagcacttacctgatgatgataaaacccctatgtccgagaggctggatgacacggagccttatttcatcggaattttttgctttgaagccgggataaagattattgcccttgggttcgccttccacaaagggtcttatctgcgcaacggctggaatgtcatggattttgtggtcgtgctgaccggaattctggcaacagtcggcaccgagttcgacctgagaactttgagagcggtcagggtactgaggcctctgaaactggtaagcggtataccttcactgcaggtcgttctgaaatcgatcatgaaggccatgattccgctgcttcagatcggccttcttctcttcttcgctatcttaatctttgctatcattggactggagttttacatgggtaagtttcataccacctgtttcgaagaagggaccgatgatattcagggcgagtctccagccccctgtggcaccgaggagcccgctagaacttgccctaatggaacgaagtgtcagccttactgggaggggcccaataacgggatcactcagttcgacaatatcctctttgcagtcctgacagttttccaatgcattactatggagggctggacagacttactgtacaattccaacgatgcctccggcaatacatggaattggctgtactttattccccttatcatcattggaagcttctttatgctgaatttagtcctgggcgtgttatccggagagtttgctaaggagagggagcgtgtcgagaacaggcgtgcctttcttaaattgcgcaggcagcagcagattgaacgagaactcaatggctatatggagtggattagcaaggccgaagaggtgatcctggcagaggacgagactgatggagagcagcggcaccccttcgatggggccctcaggcgcacaaccattaagaaatctaaaacagatctgctgaatccagaggaagccgaggatcagctcgcagacattgcatccgtggggtctccgtttgcacgcgcgtctatcaagagcgcaaaactggagaattctaccttttttcataaaaaagagagaaggatgcggttttacatacggagaatggttaaaacccaagcgttttactggacagttctaagtttggtcgcactgaacaccctctgcgtggctatcgttcattataatcaacccgaatggctatctgacttcttgtactacgcggagttcatttttcttggtctgttcatgagtgagatgttcatcaaaatgtacgggctgggcacaagaccctacttccacagctcatttaactgcttcgattgtggagtgatcatcggctctattttcgaagtcatttgggccgtaatcaaacccgggacatccttcggtatatcagttctacgagccctacggctgctccggattttcaaagtgaccaagtactgggcctccttgcgaaatttagtggtatccttgctgaacagcatgaaatctataatatctctgctattcctcctgttcttgtttattgtcgtgtttgccttactcggtatgcagttgtttggcggacagttcaactttgacgaaggaacgccccctacaaacttcgacacctttccagctgctattatgaccgtgtttcagattttgactggcgaggattggaatgaggtgatgtatgacggcattaagtctcagggcggagtacagggaggaatggtgtttagcatctactttattgtccttaccttgttcgggaactacaccctgctgaatgtttttctggccattgcagtcgacaaccttgctaacgcccaggaacttacaaaggacgagcaagaggaagaagaagcagccaaccagaagttggcgctccagaaggcaaaggaggtggccgaggtgagtccactgtcagcagccaacatgtctatcgctgttaaagaacaacagaagaaccaaaagcctgcgaagagcgtgtgggagcagcgcacaagtgaaatgcggaagcagaatctgctggcaagtagagaggctctttacaatgagatggatccagacgagaggtggaaggccgcgtacaccagacacctcaggccggatatgaaaactcatctggaccggcctctcgtggtggacccacaggaaaatagaaacaataacacaaacaagtcacgcgctgcggagccgactgtggaccagcggctcggccagcagcgcgccgaagatttccttagaaaacaggcccggtatcacgacagagcgcgcgatccatccggcagcgccggactcgacgcacggcggccttgggctggcagccaggaggctgaattgagtagagagggcccttatgggcgggagtctgaccatcacgcgcgtgaaggaagcctggaacagcctgggttttgggaaggggaagctgaacgcggcaaggccggtgaccctcatagacgccacgtacatcggcaaggcggatccagagagtcccggtctggtagccccaggacgggagccgacggtgagcacaggcgacatcgggcccaccgcaggcctggcgaagaaggtcctgaagataaagccgagcgccgcgctcgccaccgcgagggcagtcgacccgcccgggggggtgaaggggaaggcgagggccctgacgggggcgaacggagacgcagacaccgccacggagctccggccacctatgaaggggacgctaggcgagaagataaagagcgacgtcacagaaggcggaaagagaatcaagggagcggcgttccagtatccggcccaaacctttccacaacaagaccaatccagcaggacctaggaaggcaggatccgccgctggcagaggacattgataatatgaaaaataacaagctggctacagctgaatccgcagcgccccatggctcactcgggcatgcgggccttcctcagagtcccgccaagatgggcaacagcacggaccccgggcctatgctagcaattccggcaatggctaccaatccacagaacgccgcttcaagacgcacgccgaataaccccggcaatccctctaaccctggcccccccaaaactcccgaaaactccctgatagttacaaacccctctggtacacaaacaaattccgccaaaaccgctagaaagcccgaccatacgaccgtggatatcccccccgcttgtcctccacccctcaaccacaccgtggtgcaagtaaataaaaacgccaacccggaccccctgcctaaaaaggaagaagaaaagaaggaagaagaggaagatgacaggggagaagacggacccaagcctatgccaccttatagcagcatgttcatcctgtctaccactaaccctctgcggcggttgtgccactacatactgaatcttagatactttgagatgtgcatcctcatggtgattgcgatgtcttccatcgcactggccgccgaggatcccgtgcagccaaacgccccccggaacaatgtgctccggtattttgactatgttttcactggtgtgtttacattcgaaatggtaatcaagatgattgacctggggctggttctgcatcaaggggcctacttccgggacctgtggaatatcttagatttcatcgtcgtcagcggggcactggtggcttttgctttcaccgggaattctaaaggaaaggatattaacacaattaaaagtctgagagtgctgagagtcctgcgcccacttaagactatcaagagattgcctaagctgaaggcagtgtttgactgcgtagtcaactctctgaagaacgtctttaacattttaatagtatacatgcttttcatgtttatttttgcagttgtggccgtgcaattgtttaaaggtaaattctttcattgtaccgatgaatccaaggagttcgagaaggattgtagaggtaagtatctgctgtatgaaaagaatgaggttaaggctagagatagggaatggaagaaatacgaattccactatgataatgtgctgtgggccctgcttaccctgtttactgtaagtactggggagggatggcctcaggtgctgaaacatagtgtggatgccacgttcgagaaccaaggaccttcccccggatatagaatggaaatgtcgatcttctatgtagtgtatttcgtggtgttccccttcttcttcgtgaacatttttgtagcactgatcatcatcactttccaggaacaaggagacaagatgatggaggaatactctctggaaaagaacgaacgcgcctgtattgattttgctatatccgccaaacctctcacccgacacatgccacagaacaagcaatcatttcagtaccgcatgtggcagtttgtggtctccccgccgttcgagtacaccatcatggccatgattgcgctgaacactattgtgctaatgatgaagttttacggggcctcagtcgcttatgagaacgcccttcgagtatttaatatcgtgtttactagtttgttttctctggaatgcgtgctgaaggtaatggccttcgggatcttaaactattttcgtgatgcatggaatatttttgattttgtgactgtactggggtcaatcaccgacatacttgtcacagagttcgggaataacttcataaacttgagcttcctgcggctgttccgcgcagcaagactcatcaaattgcttcgtcagggctacaccatccggattcttctgtggacgtttgttcagagttttaaagccctcccctatgtgtgtctgctgatcgccatgctcttctttatttatgcgataatcggaatgcaagtgtttggcaacatcggcatcgatgttgaggacgaggattccgacgaagacgagtttcaaattaccgagcataacaacttccggacatttttccaggccctcatgttactgttccggagtgccactggtgaggcttggcataacatcatgctcagttgcctgtccggaaaaccatgcgacaaaaacagcgggatcctgacacgagaatgcgggaatgagtttgcctacttttatttcgtctctttcatctttctctgttccttcctaatgctcaacttgttcgtcgccgttatcatggataactttgaatacctcacccgcgactcaagcatacttggacctcaccatctggacgagtacgtccgggtgtgggccgagtacgacccggccgcctggggacgcatgccatacctggacatgtaccagatgctcagacatatgtccccccccctgggtctgggaaagaaatgccctgcccgagtcgcatataaacgtctgctgcggatggacctccctgttgccgacgacaacacagttcacttcaactctacattaatggctctgatcagaacagcactggacataaagattgcaaagggtggcgccgacaagcaacaaatggacgccgagcttagaaaagaaatgatggccatctggcctaacctctcacaaaaaacgctggatctactggtcacccctcataaaagcacagacctcacggtaggcaagatctatgccgctatgatgattatggaatactacagacagtccaaagctaagaagctgcaggccatgagagaggagcaggataggacgcctctcatgttccaaaggatggagccccccagccccactcaagaaggcggcccaggtcagaatgcacttccctccactcagttggacccggggggggcactcatggctcacgaaagtggtcttaaggagagcccttcttgggtcactcagagggcacaggaaatgtttcaaaaaaccgggacctggtcacccgagcagggtcctcctaccgatatgcctaactctcagcctaactcacagtctgtcgaaatgcgcgagatgggcagggacggttatagcgattctgagcattacctgccaatggaaggccaagggagggctgcttcgatgcccagactgcctgccgaaaaccaaactatctcggacacgagcccaatgaaacgatcggctagcgtacttggccccaaagcaaggcggttggatgactactctctggagagagttcctccagaggaaaaccagagacatcaccaaagaagacgggataggtctcatagggcctctgagcgctcactagggaggtatactgacgtggacactgggttgggtacagacctttccatgacgacccagagtggggatctaccatctaaagaaagggaccaggagcgtggccggcctaaggatcgaaaacacaggcagcatcatcatcatcatcatcatcaccaccacccccctcccccggacaaagataggtatgcacaggagaggcccgaccacgggcgcgccagggctcgcgatcaacgatggtcccgcagcccttccgagggtcgggagcacatggctcatcgtcagggctcatcaagtgtgagtggcagccctgcaccctcaacgagtggaacctcaactccaagaagggggcgccggcagcttcctcaaaccccgagtacaccacggccccacgtgagctattctccagtgatccggaaagccgggggttctggaccccctcagcaacagcagcagcagcagcagcagcagcagcagcaggctgtggccaggccagggagagccgctactagcggtccacggcgttaccccggccctactgctgaacccctcgccggagacaggccaccgacgggcggacattcttccgggcgatcacctagaatggagcggcgcgtgccaggccctgcaaggtctgaaagccccagggcctgccgacacgggggggcccgatggccagcttcaggacctcatgtcagtgagggtcctccagggccaaggcatcacggttactatcgcgggagtgactacgatgaggccgacggacctggttccggtggcggtgaagaggccatggctggagcatacgatgctccccctcctgtcagacatgcctcctccggcgccactgggcgctctccccgcacaccacgtgcgagcgggccggcatgcgcttcccccagtcgacatggtaggaggctgcccaatggctactaccccgctcatgggttggcacgcccacgcggccctggcagtcggaagggactgcacgaaccctacagcgagtccgatgacgactggtgctag

SEQ ID NO: 110460 - DNA, 7521 bp, Artificial Sequence
  Description of Artificial Sequence: Synthetic coding sequence
atggcgagattcggtgatgagatgcctgccagatacggcgggggcggttccggcgctgctgccggagttgtagtgggatcagggggaggccggggcgcaggtggcagccggcaaggcgggcagcccggcgcacagagaatgtataagcagtccatggcacagagagctaggactatggccctgtacaaccctatacccgtgcgacaaaattgtctcacggtcaacagatccctctttttgttctctgaggataacgttgttagaaaatatgctaagaaaattacggagtggcccccattcgagtatatgatcctggcgaccatcatagccaactgtatcgtactggccttggagcaacatcttcctgatgacgataaaacccccatgtcggaaagactggatgatacagagccttactttatcggtattttttgcttcgaggctggaatcaaaatcatagccttagggtttgccttccacaaaggttcttaccttcggaatgggtggaacgtgatggatttcgtagtggtcctcacagggatattggctacagtcgggaccgagttcgacttacgcacactgcgggcagtgcgcgtgctccggccgctgaagctggtctcgggcataccctcactgcaggtggttctcaagtcaattatgaaggctatgataccactgcttcagatcgggctgttgctgttcttcgcaatcctgattttcgctattatcgggcttgagttttacatgggaaagtttcacacaacttgttttgaggagggtacagacgatatccagggggaatcgccggcaccctgtggaaccgaggaaccagcccgtacatgtcccaacgggaccaaatgtcagccttactgggagggtccaaataacggaatcacacaattcgataacattctctttgcagtgctcaccgtcttccagtgtatcactatggaaggttggacggacctgctgtacaattccaacgatgcctctgggaatacatggaattggctctacttcatcccactgattatcatcggctcctttttcatgttgaatttagtcctcggggtcttgagcggggagttcgctaaagagagggagcgcgtggaaaacaggagagcttttctcaaactcagaaggcagcaacagattgagagggagctgaatggttacatggagtggatttcaaaggccgaggaagttatccttgctgaggacgaaacagacggcgaacagagacaccccttcgatgccctgcggcgcaccactattaaaaagtcaaagaccgaccttttgaacccggaagaggcggaggatcaactggcagacatcgccagcgtgggatccccttttgcaagggcctctatcaagtcagcaaagctggagaattctacgttctttcacaagaaggaaaggaggatgcgattctacattagacgcatggtcaagactcaggctttctactggactgtgctgtccctggtggctttgaatacgctgtgtgtcgctatcgtgcattacaaccaacccgagtggctctccgacttcctgtactatgccgagtttatctttctgggtttattcatgtcagaaatgtttatcaagatgtatgggctgggcactcgtccctactttcactccagcttcaactgtttcgattgcggggttatcatcggttctatcttcgaggtgatttgggcagttatcaagccaggcacaagttttggcatctcagtcctccgggcgctgagactgctgcgaatcttcaaagtcacgaagtattgggcttcgctgaggaacctggttgtctccctgcttaacagtatgaaatccatcatatctctgttattcttgctctttctgtttatcgtggtgttcgccctgctgggcatgcagctctttggaggtcagttcaatttcgacgaaggcacccctcccactaatttcgacacctttcccgcggccatcatgacagtcttccagatcctgaccggcgaggattggaatgaagtgatgtatgacgggatcaaaagtcaggggggtgtacagggcggcatggtgttctcaatttattttatcgtgctaaccctgtttggtaattacactctgctaaacgtgtttttggcaattgccgtggataacctcgcaaatgcacaagagctgacaaaagatgagcaagaggaggaagaggcagctaaccagaagttagctttgcagaaagctaaagaagttgccgaagtctcacctctgtcggccgcgaatatgtcaatcgccgtcaaagagcagcagaagaatcagaagccagccaagtccgtgtgggaacaacggactagcgaaatgcggaagcagaacctcctggcatccagagaggccctgtacaacgagatggatcctgatgaaagatggaaggctgcctacacccgacatctacgtccggatatgaagacacatctcgatcgtcccctggttgtggatccacaagagaatcgcaataacaacaccaataagagccgcgcagcagagccaaccgtggatcagagactgggccagcagcgggctgaggattttctcaggaaacaagcacggtaccacgaccgtgctcgggatccgtctggaagtgccggtctcgatgctcgtcgtccttgggccggaagccaggaggctgagctgagcagggaaggtccctatgggcgggagtcagaccaccacgccagggaaggcagtctcgagcagcccggtttctgggagggtgaagcagaaagaggcaaggccggagatccacataggcgccacgttcatagacaggggggtagcagggaaagcaggtccgggagcccccgaacaggcgcagacggcgaacacaggagacacagggcccatcgacgacctggtgaggaagggcccgaagataaagccgagaggcgtgctaggcatcgcgaaggaagcagacctgcaagagggggcgaaggggagggtgagggacctgacggcggtgaaaggcggcgaaggcaccgacacggtgctcctgccacttatgagggtgacgcaaggagggaggataaggaacggagacatagacggcggaaggagaatcagggctcaggggtgccggtgtcaggcccaaacctctcaaccacacgccccatccaacaggacctaggacgccaagacccgccactcgccgaagatatcgacaacatgaagaacaataagctagcaactgccgagtctgctgcccctcacggaagccttgggcatgctggcctgccacagtcgcccgcaaaaatggggaattccacagacccgggccctatgctagccattccggccatggccacaaatccgcagaacgccgccagccggcggacccctaacaatcccggtaatccaagcaatcctggtcctcccaagacacccgaaaattcactgatcgtaacaaatccctctggtacacagacaaactccgccaagacagccagaaagcctgatcacaccacagtggatattcctcctgcctgccccccccccctgaaccacactgtagtgcaggttaacaaaaatgctaatccagatcccctgcctaaaaaggaggaggaaaaaaaggaggaggaggaggacgaccgcggcgaagacggaccgaaacctatgcccccttacagctctatgtttattctgagcactactaatccgctgcgcagactgtgtcactatatactcaacttgcgctacttcgagatgtgcatccttatggtgatcgccatgagctctatcgccctagccgcagaagatcccgtccagcccaacgccccccggaacaacgtcctgcggtacttcgactacgtctttaccggcgtgtttaccttcgaaatggtaattaaaatgatcgacctagggctggtgttgcaccaaggcgcttactttcgagatctatggaatatcctcgacttcatcgtggtttctggcgccctcgttgcattcgcatttacgggaaattctaagggaaaagatatcaacacaattaaatctcttcgggtgcttagggtgctacggccactgaaaaccatcaaaagacttccaaagctgaaagctgtgtttgattgcgttgtgaactctctgaaaaatgtgtttaatatccttattgtgtacatgttgtttatgttcatttttgcagtggttgccgtacagctgttcaagggaaaattttttcattgtactgatgaaagcaaggaattcgagaaggattgtagaggaaagtacttgctgtacgagaaaaatgaggtgaaggcccgagatagagagtggaagaagtacgaattccactacgataatgtgctctgggccctcttgaccctcttcaccgtgtcaacaggagaagggtggccacaagtgctgaagcactccgttgacgctacattcgaaaaccaaggaccttctccaggctaccgtatggagatgtctatcttttacgtggtgtatttcgtggtcttcccattcttttttgtgaacattttcgtagccctcatcattatcacgttccaggagcaaggcgataagatgatggaggagtattcattggagaagaacgaaagggcttgcatcgactttgcgatcagtgccaaaccgctaactcgacatatgcctcagaataagcagagttttcagtacaggatgtggcagttcgtcgtatctcctccgttcgaatacactatcatggctatgattgcattgaatacgatagtgctgatgatgaagttctatggtgccagcgttgcttacgagaatgcgttacgtgtgttcaacatcgtgttcaccagcctttttagccttgaatgcgtgctaaaagtgatggcctttggcattctcaactactttagggacgcatggaacatatttgactttgtgacagtgcttggctcaattacagacatcctcgtcaccgagttcggcaataatttcattaatctgtcctttttacgactctttcgggccgcccgtcttattaagctgctgaggcaggggtacaccatcaggattctcctgtggactttcgttcagtctttcaaggccctgccgtacgtgtgtctgctaatcgcgatgctttttttcatctacgctatcatcggaatgcaggtctttgggaatataggaattgatgtggaagacgaggattccgatgaggatgaatttcagataaccgagcacaataactttagaacattcttccaagcactgatgctcctgtttcggtctgccacgggagaggcgtggcacaacatcatgctctcatgcctgtcagggaaaccctgcgataagaattccggaatactcacgagggaatgcggaaatgaattcgcttacttctatttcgtgtccttcattttcctctgcagttttctcatgctgaacctttttgtggccgttattatggataactttgaatacctaactcgcgactccagtatattggggccccaccacctggacgagtacgtgagggtatgggcagagtacgacccagccgcttggggtcggatgccatacttggatatgtatcagatgctgcgccacatgtctccgcccctgggcctgggaaagaagtgcccggcgcgtgtcgcatacaagaggcttctgcgcatggacttgcctgtagcggatgacaacacagtccatttcaatagtacactgatggccctcatacgcaccgccctcgatattaagattgccaagggcggcgccgataaacagcagatggatgccgagctccggaaagagatgatggctatttggccaaatctgtcgcagaaaaccctggatctcctggtgactccacataagtccactgacttgacagtaggcaaaatctatgccgcaatgatgataatggaatattaccggcagtccaaggcaaaaaaacttcaagccatgcgcgaggagcaggatcgcaccccacttatgtttcagcggatggaacccccctcccctacacaggaggggggtcccggccagaacgccctgccttctacccagctcgacccagggggggcgctgatggctcacgaatccggcctgaaagaatctccttcttgggttacccagcgcgctcaagagatgttccagaagactggaacctggagccccgaacaggggccacctactgacatgcctaacagtcagccaaattcccagtcggtggagatgcgggagatgggccgggatgggtacagtgacagcgaacactacctgcccatggaaggacagggaagagccgcctcaatgcctcgcctgcctgcagaaaatcagcgtagacggggaaggcctagggggaacaacctctccacaatttcagatacatctccaatgaagcgcagcgctagcgtgctggggcctaaggcacgccgcctggacgattattctctcgagagggttccccccgaggagaatcaaaggcaccaccagaggcggagggatagatcgcatcgggcatctgagcggagcttaggacgatatacggatgttgatacgggcttgggaacagatctgagtatgaccacccaaagcggtgaccttccctctaaggaaagagaccaggagcggggccggccgaaagaccggaaacaccggcagcatcatcaccaccaccaccatcaccatcatccgcctcctcccgataaagatagatacgcccaggaacgcccggatcatggccgcgcacgcgcacgagatcagagatggtctaggagtccatccgaaggccgggagcacatggcgcatcgtcagggcagttcgagtgtctcgggctcgcctgcaccctctacttccggtacctccacaccaagacgcggcagaagacagctcccccagacaccctcaaccccccgccctcacgtttcatactcgcctgtgattcgaaaggccggcgggagtggaccccctcaacagcagcagcagcaacagcagcagcagcagcaacaagcggtggcaagaccaggcagagcagcgacaagtggccccaggagatatccaggacctaccgcagagccgctcgcaggcgatcgccctcccaccggcggtcacagcagtgggaggtcccctagaatggaaagacgagtacccggacctgcacggagcgagtctcctagggcctgtaggcatgggggagctaggtggcccgcctctgggccccatgtgtcagagggacctccaggcccccgtcaccatgggtactaccgggggagtgattacgacgaggccgacggtccgggttctggtggaggggaggaagcgatggcaggggcttatgatgccccacctccagtacgccacgctagctcaggagccaccggacggtcgccccggacacccagagcatcgggtcccgcctgtgcctccccctccaggcacggtaggaggcttccaaacggctattacccggcccatggactagctcgacccaggggcccaggctctcgcaaaggtctacacgaaccttatagtgagtctgatgatgactggtgctag

SEQ ID NO: 110461 - DNA, 7539 bp, Artificial Sequence
  Description of Artificial Sequence: Synthetic coding sequence
atggctagattcggagacgagatgcccgcacgttatggaggtggaggttccggggccgcagctggcgtggtagtggggtctggcggcggacgcggggccggcggttccagacaaggagggcagcccggggcccagcgcatgtataagcagtcaatggcccagcgcgccaggactatggctctctacaatcctatacctgtgcgacaaaactgcctgactgtcaaccgctcactgttcctgttctccgaggacaacgtggtacgcaagtatgccaagaagatcactgagtggcccccgttcgaatatatgatcctggcgaccatcatagctaattgcattgtgctggccctggagcagcacctccctgacgatgacaaaactccgatgagcgaacggctggatgacaccgaaccgtactttatcggcattttctgcttcgaagctggtataaaaatcattgctcttggatttgcttttcataaggggtcctatcttaggaacggatggaacgtgatggatttcgttgtggttctgacgggcatattagccacagtgggcactgagttcgacttgcgcacactgcgagccgtcagagtccttcgaccattgaagctcgtgtctggcataccgtcgcttcaggtagtcctcaagtcgattatgaaggcaatgatcccactgctgcagatcggcttgttgctcttttttgctatactcatcttcgcaatcattggtcttgagttctatatgggaaagttccacacgacgtgcttcgaggagggtaccgatgacattcaaggggaatctcccgccccatgcggaacagaagagccagctagaacttgcccgaacgggaccaagtgccagccttactgggaagggcccaacaacggcataactcagtttgataatatcctgtttgccgttctgacagtcttccaatgcataacgatggagggctggactgacctcctgtataatagcaacgacgcctccggaaacacctggaattggttgtatttcatcccacttatcataatagggtccttttttatgctgaatctagtgctaggcgttctatccggcgagtttgcaaaagagcgggagagagtcgagaaccggcgggcgtttctcaaactccgccggcagcagcaaatagagcgagagctgaatggatatatggaatggatcagtaaggccgaggaggtgattctggctgaagatgagaccgacggcgaacagaggcatccattcgacggtgctcttaggcgcaccacaatcaaaaagtccaagaccgacctccttaaccctgaggaggcggaagatcagttagccgatatagcctccgtcggcagcccatttgcgcgcgccagcatcaaaagcgccaaactcgagaactctaccttcttccacaaaaaggagcggcgcatgcgcttctacattcgacgcatggtgaagacacaggctttttactggacggtcctctctctggtcgctctgaatacactctgcgtcgccatcgtgcactacaatcaacccgagtggctgagcgatttcctatactacgctgaatttatctttttgggcttattcatgagcgagatgttcatcaaaatgtacgggctgggcactcgaccttacttccactccagcttcaactgtttcgattgtggcgtgatcatcggtagtattttcgaggtgatttgggccgtgatcaagccaggcacctctttcggcatttccgtgttgcgcgctctgcgactgctgcgcatatttaaggtcaccaaatactgggccagcctgcgtaatcttgtggttagtctgttgaactctatgaagagcataatctccctccttttcctgctgttcctgtttatagtcgtgttcgctctattgggtatgcagttgtttggcggtcagttcaatttcgatgagggcaccccccctactaacttcgacacatttccagccgcaattatgactgtctttcagatactgaccggagaggactggaacgaagtcatgtacgacggcattaagtctcagggaggagttcagggcggaatggtcttcagtatctactttattgttctgaccttattcggtaactacacacttctcaacgtttttctggcaattgccgtggataacttggccaacgcccaggaactgacaaaggtggaagcagacgaacaagaagaagaggaggcagccaatcagaagctggcgttgcagaaagctaaagaggttgctgaggtttctcctctgagtgcagctaacatgagtatcgcagtcaaagaacagcagaagaaccagaagcccgctaaatcagtttgggagcagaggacttccgagatgcgcaaacagaatctgctggcatcacgggaagctttatataacgagatggacccagacgagcggtggaaggccgcctacactagacatctgaggccagacatgaagacccatctcgaccgtccactcgtcgtcgaccctcaggagaacaggaataacaacactaataaaagccgagccgccgagccaaccgtggatcaacgactgggacaacagcgcgctgaggatttcctgcgtaagcaggccagatatcacgatagagctcgggatccaagtgggtccgccggtctcgacgcacgcagaccttgggccggcagtcaagaagccgagctgtcaagggaggggccgtatggccgggaatcagatcaccacgccagggaagggtccttagaacagcccggcttctgggagggcgaagcagagaggggtaaggctggcgacccgcacaggcgccacgttcaccgacagggaggaagtagagagagcagatccggatcccctagaaccggagcagatggggaacacagaaggcatagggcccaccgcagaccaggggaggagggcccagaggacaaggccgaaaggcgagcaaggcatagagagggctcgcgcccagccaggggaggtgagggcgaaggggaagggcccgacggcggagaaaggagacgaagacatcgccacggtgcccctgccacatacgaaggggacgcgagacgagaagataaagaaaggcgccataggaggcgcaaggagaaccaggggagtggtgtgccagtctctggtcctaatctttctaccacacgaccgatccagcaggacctgggccgccaggatccccccttggcagaagatattgataacatgaagaataataaattggcgaccgccgagagtgcagcacctcacggcagtcttggtcatgcaggtctaccccagagccccgcgaaaatgggaaacagtaccgaccctgggcccatgcttgctatcccggccatggccaccaacccacagaacgccgcgagtcggcgcacccccaacaaccctggtaacccctcaaatccagggcccccgaaaacaccagagaactccctgatcgtcaccaatcccagcggcactcaaaccaatagcgcaaagacggccagaaagcctgaccacaccactgttgacatacctcctgcttgccccccaccgttgaaccacaccgtcgtgcaggttaacaaaaacgccaaccctgatcccctccccaagaaggaggaggaaaaaaaggaggaagaggaagacgacaggggcgaagacgggcctaaacctatgcctccgtattctagtatgttcatccttagcacaaccaatccgctgcgaaggctgtgccattacatcctgaacctacgctattttgagatgtgcatattgatggtgattgccatgagctccattgccctagcagcagaagatcctgtgcagcctaatgcccctagaaataacgtgcttcggtacttcgattacgtctttaccggggtgttcacatttgaaatggtaataaagatgattgacctcggccttgtcctgcatcagggcgcatactttcgcgatttgtggaatattcttgattttatcgtggttagcggtgccctagtggcttttgcatttaccgggaacagtaaagggaaagacatcaacactatcaaatcactaagagttttgcgtgtgctaagacccctgaagaccatcaagaggctccccaaacttaaggcagtctttgactgcgtggtcaatagcctcaagaatgtgttcaatatcctcatagtctacatgctgtttatgttcatctttgccgtggtagccgtgcagttattcaagggcaaattctttcactgcacggacgaatcaaaagagttcgaaaaggactgccgcgggaaatacctgctgtatgaaaaaaacgaagtgaaagcccgtgatagggagtggaagaaatatgagttccattatgacaacgtgctctgggcccttctaactctctttacagtctcaaccggagaaggctggccacaggttctcaagcacagcgtggacgctactttcgaaaaccaggggccatcacccggatacagaatggagatgtccattttttatgtggtttactttgtcgtcttcccctttttctttgtaaatatctttgtcgcgctgatcatcatcacttttcaagagcagggggacaaaatgatggaggagtactctttggagaagaacgaacgtgcttgcattgattttgcaatcagcgcaaagccactaacaagacatatgccacaaaacaaacagtcatttcagtaccgaatgtggcagtttgttgtgagccccccctttgagtacactatcatggctatgattgcattaaacactattgtattgatgatgaagttttatggtgctagtgtcgcatatgaaaacgccttgcgggtgtttaacatcgtctttacatcattattcagcttggagtgcgtcctgaaggttatggcgtttggcatactaaactatttcagggatgcctggaatatttttgattttgttaccgtgcttggctccatcacagacatcctggtgactgaattcgggaaccccaataatttcatcaatttgagttttcttcgcttgtttcgagcggcacggcttattaagctgctgcgtcaggggtatactattcgaatcctgctgtggacctttgttcagagtttcaaagccctgccttacgtctgcttgctgatcgctatgctgtttttcatctacgcaattatcggaatgcaggtcttcggcaacattggaattgacgtcgaagacgaggactccgacgaagacgaatttcaaatcaccgaacacaataatttccggaccttcttccaggctctgatgctgttgtttcgtagcgccacgggcgaggcatggcacaatataatgctgtcatgtctgagtgggaagccgtgcgacaaaaattcgggaatcctgacaagagaatgcggtaatgagtttgcctatttctacttcgtatccttcatctttttgtgctctttcctaatgctcaacctattcgtggctgtgatcatggataattttgaataccttactcgtgattctagtatcctcggaccacaccatctcgacgagtatgtgagagtatgggccgagtatgacccggcagcatggggacgtatgccgtacttggacatgtaccaaatgcttcggcatatgagtcccccactggggctgggtaagaagtgcccggccagggtggcctacaagagactactgcggatggaccttcctgtggcggatgataacacagtgcattttaacagtactcttatggcactcatacgtaccgctcttgatatcaagatcgctaaaggaggcgccgataagcaacagatggatgctgaactccgaaaagagatgatggccatctggccaaacctgagtcagaagacacttgacctcctggttacaccccataagtctaccgacctgacggtgggcaagatctacgcagctatgatgattatggaatactacaggcaatcaaaggccaagaaactccaggcaatgcgagaggaacaggaccggaccccgctgatgttccagagaatggagcctccaagccccacccaggaaggaggacctgggcagaatgctctccccagcactcagcttgatccaggaggcgcactcatggcccacgagtctgggctgaaagagtctccgagctgggtgacccagcgggcacaagaaatgttccagaagaccggcacatggagtccggaacaaggcccaccaaccgatatgcccaactcccaacccaacagtcagtctgtggaaatgagggaaatggggcgagacggctattccgatagtgaacattatctgcctatggagggccaggggcgcgcagcttcaatgcctcgcctccccgccgaaaatcagcggcggcggggacgtccgcgtggaaataatctcagcaccatttcagatacctccccaatgaagaggtcagccagcgtgctcggtcccaaagcacgccggttagacgactacagcctcgagcgcgttcccccggaggagaatcaacgccatcatcagcgacgcagagaccgtagtcacagagcatcagaacgatccctagggcggtacacggatgtggatactgggcttgggactgatctttccatgaccactcagtccggtgacctaccatcaaaagagcgagatcaggaacgaggacgaccaaaagaccggaagcatcgccaacaccaccatcatcatcaccaccatcatcacccaccaccacccgataaagatcggtacgctcaagagagaccagaccatgggcgggcccgggcacgtgatcagcggtggtctcgttctcctagcgaaggtagggaacacatggcccacagacaaggctcttcctcagtttctggctcacccgcccctagcacttcaggaacatcaacacctcggcgaggcaggcgccagctccctcagactccgtccaccccgcggccgcacgtcagctattccccagtaattcgtaaagcaggtggaagcggcccccctcagcaacagcagcagcagcagcaacaacaacagcaacaggctgtcgccagacccggcagagccgcaacttccggacccagacggtatcctggccccacagccgagccactcgctggcgaccgacccccaactggcgggcacagttctgggaggagtccaaggatggagcgccgggtaccaggccctgcccgatcagagtccccccgcgcatgcagacatggaggggcccgttggccagcaagtggaccgcacgtatcagagggccctccagggccgcggcaccatgggtactatcgaggttctgactacgacgaggctgatgggcccgggtcaggcggtggcgaagaggcaatggcgggtgcttacgacgctccccctcccgtgcggcacgcctcttccggagcaaccggtcgatccccacgcacccccagagcttccggacctgcatgcgcctcaccaagtagacatgggagaaggttaccaaacggatactacccagctcatggcctagcccggccccgcggccctgggtccaggaagggtctccacgagccgtactccgaatctgacgacgattggtgttag

SEQ ID NO: 110462 - DNA, 804 bp, Artificial Sequence
  Description of Artificial Sequence: Synthetic coding sequence
atgttatttatgtttatctttgccgtggttgcggtccagctgttcaagggtaaattttttcactgtaccgatgagagtaaggagtttgagaaggactgcagagggaagtatttgctgtacgagaaaaacgaggtgaaagccagggacagggaatggaaaaaatacgaattccattacgataatgtgctctgggctctgcttacactgttcactgtttccacgggcgaggggtggccacaagttcttaagcactcggtggacgctacgtttgaaaaccagggccccagccctggttacagaatggagatgtctatcttttacgtcgtttatttcgtcgtatttcccttttttttcgtaaatatctttgtggccttgatcataattacatttcaagaacagggagataaaatgatggaagagtattcactggagaagaatgagagggcctgcatagactttgcaataagcgctaaacccctgacaagacacatgccgcaaaacaagcagtcctttcagtatagaatgtggcagtttgtggtgtcccccccttttgaatatactatcatggctatgatagcattgaatacgatcgtgctgatgatgaagttttatggtgcatctgttgcttacgagaacgcactgcgcgttttcaacattgtgtttacctctcttttcagcctggaatgcgttcttaaggtcatggcattcggcattttgaattattttagggatgcctggaacatatttgactttgtgactgttctggggtcaataaccgacatcttagtgaccgagtttggttag

SEQ ID NO: 110463 - DNA, 6795 bp, Artificial Sequence
  Description of Artificial Sequence: Synthetic coding sequence
atggctctgtataaccccatacctgtgcggcagaattgctttaccgtgaacaggtcactttttatctttggcgaagataatatcgtgcggaagtatgccaagaagcttattgattggcctcccttcgaatacatgatcttggctacaatcatcgcaaattgcatcgtgctggcacttgaacagcacttgcccgaggacgataagactccaatgagcaggcgactggagaaaacagagccctattttataggtattttttgctttgaggcaggcattaagattgtagctctggggtttatcttccataaggggagctaccttagaaacgggtggaatgtgatggattttatcgtcgtcctgtccggaatcctcgctaccgccggaacacacttcaacacccacgttgatctccgcactctgcgagccgtgagggtgcttcggccccttaaacttgtgagcggcatcccctctctgcaaatcgtgctgaagtcaatcatgaaagctatggtgccactgttacagatcgggctgctcctgttctttgccatacttatgtttgcgataataggtctagagttttattcaggcaaacttcacagagcctgttttatgaacaactcaggcatattggaaggttttgatccaccccacccttgtggggtgcagggttgcccagcaggctacgaatgtaaggattggataggccccaatgacggcattactcagttcgataatatattattcgctgtcctgaccgtatttcagtgtattactatggagggctggacgacggtgctgtataacacgaatgacgctctcggcgccacttggaactggctctacttcattccgcttattattattggcagctttttcgtgctcaacctcgtgctcggcgtcctgtcaggggagttcgccaaggaacgggaaagggtggaaaatagacgggcctttatgaagttaagacggcaacaacaaatcgagagggaactgaatgggtacagagcctggatcgataaagcggaggaggtgatgctcgccgaagagaataaaaatgcaggcacgtcggctctggaggttcttcggcgcgcaaccatcaagagatcaagaacagaggcaatgacccgggattcgagcgacgaacactgtgtggacatttcttcagtgggcactccactcgctcgggcttctattaaaagcgccaaagtcgatggcgtaagttactttaggcacaaagaacggctgctgcgtatttctataaggcatatggttaagtctcaagtcttttattggattgtgttgagcctggtcgccctgaacacagcctgtgtagctattgtgcatcataaccagccccagtggttaacccatcttttgtactatgctgaattcctatttctgggactgttcctgctcgaaatgtctctaaaaatgtacggcatgggtcccagattatacttccactccagttttaattgcttcgactttggggtcaccgtaggatcaatttttgaggtcgtgtgggcaatctttcgtcctgggacatcgttcggcatttcagtgttaagggcgttgagattgcttaggatcttcaagattaccaagtattgggcctcacttcgcaacctggttgtctcattgatgtccagtatgaagtctatcatttcccttctcttcctactgtttctgtttatcgtggtcttcgctctcctcggaatgcagctgttcgggggaagattcaacttcaatgatggaaccccctcagcaaactttgacacatttcccgccgctattatgaccgtgtttcaaatactgaccggcgaggactggaacgaggtgatgtacaacgggattcgtagccagggcggcgtgagctcaggtatgtggtcggcaatctatttcatcgttctgaccctgttcggaaactacaccttactgaacgtgttcctcgcgattgccgttgacaatcttgcaaacgcccaggagctgactaaggatgaacaggaggaggaagaagcgtttaaccagaaacacgcattgcagaaggcaaaagaggtatcccccatgtcagctccaaacatgccgtctatcgaacgcgacaggcgaaggcggcatcacatgtctatgtgggaaccaagatcttcccatctgcgcgaaagaagaagacgacaccacatgtctgtttgggaacagaggactagtcagctgagaaagcacatgcagatgagctctcaggaggctcttaacagggaggaagcgccaaccatgaacccactcaaccccctcaatccactctctagcctaaacccgttgaatgcgcacccttccctgtaccgccgtccaagggccattgagggcctggccctcggcctcgcactcgagaagttcgaagaggagaggatctcgaggggcgggagtttgaaaggcgacggtggagatcgatcctctgctctggacaaccaacgtacccctctctcactgggccagcgcgaacccccctggttggcccgaccctgtcatgggaactgcgaccccacacaacaagaagcgggggggggggaagccgtggtgaccttcgaagatcgcgctcggcatcgtcaatcacagagacgcagtagacatagaagggtgcgcaccgagggcaaagagtccagcagcgcctccagaagcagaagtgccagccaggagcgttccctggacgaagccatgccgactgagggtgagaaggatcatgaactgcgaggaaaccatggggctaaggagccgacaattcaggaggagagagcgcaggaccttaggcgcacgaacagcctgatggtgagcagaggctctggcctcgcaggagggctcgacgaggctgataccccactggtgcttccgcatccagaattggaggtcggcaaacatgtggtgctaaccgagcaggagccagagggatcgagtgaacaggccttgcttggaaatgtgcagcttgatatgggtagggtgatatctcagtcagagcccgatctgtcctgtattactgcgaacaccgataaagctaccactgaaagcaccagcgtaaccgtggccatccctgatgtcgatccgctggtcgactcaacagttgtccacatctcaaacaagactgacggagaagcctcccccctcaaggaggccgagatcagggaagatgaggaagaagtcgagaagaagaaacagaagaaggaaaagcgggaaactgggaaagccatggtgccacatagttccatgttcatatttagtaccactaacccgatcagacgtgcctgccattacatcgtcaatttgcgttatttcgagatgtgtatcctcctggtcattgctgcttcttcaatcgcgttggcggcagaggacccagtgctcacgaactctgagagaaacaaagtgcttcgatacttcgattacgtctttacaggggtgtttaccttcgagatggtaataaaaatgattgaccagggactgattctccaggatgggtcttactttcgggacctctggaatatcctggacttcgtcgtcgtggtcggcgctcttgttgccttcgcgctagccaacagcatgaagacaaacaaggggcgcgacataaaaacaatcaagtctctcagagtgctgagagtgttgcgacccttgaaaaccatcaaaagactgccaaaactgaaggccgtttttgattgtgtggtcacgagtctgaaaaatgtgttcaacattcttatcgtctataagttgtttatgtttatcttcgccgtgattgccgtccaactctttaagggtaaattcttttattgcaccgattcctccaaggacacagaaaaggagtgtatcgggaactatgtagatcatgagaagaataaaatggaggtcaaggggcgagaatggaagcgacacgagttccactacgataacatcatctgggcgcttctgactctatttaccgtctcaactggcgagggctggccccaagttctgcagcacagcgtggacgtgactgaggaggatagaggaccctcacgtagtaacaggatggagatgtctattttttacgtggtgtactttgtggtgtttccctttttctttgtgaacatatttgttgcgttgattatcattacctttcaggagcagggagacaagatgatggaggagtgtagtttagagaagaatgagcgcgcttgcattgacttcgccatctccgccaaacccttgacccgatatatgcctcagaaccggcatacctttcagtatagggtctggcactttgtggtgagcccttctttcgagtacactatcatggcaatgatcgccctgaatactgtggttttaatgatgaagtattatagcgcaccttgcacctatgagctggccctgaagtatctcaatatcgcctttactatggtgttttcccttgagtgcgtgctaaaggtgatcgcattcggcttcctgaattattttcgtgacacctggaacatttttgatttcattaccgtgattggctctataacagagatcattctgacggacagtaagctggtgaacacttctggcttcaatatgtccttcctgaaactctttagggcagcccggctcatcaagctgctgaggcagggatacacaattcggatccttctctggaccttcgtgcagagttttaaggctctcccctacgtgtgtttattgattgccatgttgttcttcatttacgccatcatcgggatgcaggttttcggtaacataaaactagatgaggaaagccacattaatcgacataacaatttccggtcatttttcggctctctgatgttactcttccgaagcgctacaggggaggcatggcaggaaatcatgctttcatgcctgggcgaaaaaggctgtgagcctgacaccaccgccccttctggccagaatgagaatgaaaggtgcggcacagacttggcttacgtttactttgtcagtttcatctttttttgttcatttcttatgctcaacttgtttgtggcagtgataatggacaacttcgagtatctgaccagggacagcagcattctcggtccacatcacctggatgagtttgtcagggtttgggcagaatacgacagagctgcttgtggacgaattcattataccgagatgtacgaaatgttgaccctaatgagtccacctctgggcctaggaaagcggtgtccgagtaaagtggcttataaacgcctcgtgctgatgaacatgccagtagccgaggatatgacagtacattttacttcaaccttgatggccttaattcggactgccctggatatcaagatagcaaaggggggcgccgaccgtcagcaactggatagtgagctacagaaagagactcttgctatttggccccacctcagccagaagatgttagacctactggtcccaatgccaaaagctagtgacctaaccgtcggaaaaatatacgccgccatgatgattatggattactataaacagagcaaagtcaaaaaacaacggcagcagctcgaagagcaaaaaaacgcccccatgttccagcgcatggaaccatcctctctcccacaggagataatcgctaacgccaaggccctaccgtatctccagcaagatcctgtgagcggtctgtctggcaggtccggctacccatctatgtcacccctgtcccctcaagacattttccagttggcctgtatggatcctgccgatgatggccaatttcaggaacgccagtctctagaacctgaagtgagcgagctgaaaagcgtgcagccctccaaccacggcatttacctgccaagcgatacacaggagcacgctggctcaggcagagcatcctccatgccaaggcttactgtcgatccccaagtcgtcacagacccctcatccatgcgcagaagcttctccaccatcagggataagcggagtaacagttcctggttggaagaattctcgatggaaagatcttctgaaaatacctacaaatcgagacgtagaagttaccactcctctctgcgcctgtccgctcatcggcttaactctgattctggtcacaagagcgatacacacaggagtggaggaagggaacggggccgtagcaaagagaggaagcatctgctctcccctgatgtgagcaggtgcaactctgaagaacgtgggacccaggctgactgggaatctcctgagcgtcgccagagcaggtcaccatccgagggccggtcccagacaccaaaccggcaaggcaccggcagcttaagcgagagctctattccctctgtaagtgacacatcaacgcccagacggtctcgccgccagttgccccctgtgcccccgaagccgcggcccctcctttcctatagcagtctgataagacacgccggctctatatctccccccgctgacggctctgaagagggatcacccctgacatcacaggccctggaatccaacaacgcctgtttgacagagagcagcaatagtccccaccctcagcagtcacagcacgcctctccccaaagatacatcagtgagccttacctcgcccttcacgaggactcgcacgcctcggactgcggggaggaagagacgttaacatttgaagcagccgttgcaacatccctcggaagatctaacactatcggttctgccccacccctgcgccatagctggcaaatgcccaacggacattaccggaggcggagaaggggcggaccaggcccaggaatgatgtgtggcgcagtcaataatttgctgtcagacaccgaagaggatgacaaatgctag

SEQ ID NO: 110464 - DNA, 6609 bp, Artificial Sequence
  Description of Artificial Sequence: Synthetic coding sequence
atggcactgtacaatcctataccagttcgccagaattgtttcaccgtgaaccggtccctgtttatcttcggcgaggataatatagtaaggaaatacgcaaaaaagctcatcgattggcctcctttcgaatatatgattttggctactataatagctaattgtatcgtgctggcactcgaacagcatctacccgaggacgataagacacctatgagcagaaggctggaaaagaccgaaccttattttatcgggattttttgctttgaggccggcattaagatcgtggccctcgggtttattttccacaaggggtcctacctccggaacgggtggaacgtaatggactttatagtggtgctgagcgggatcctcgccaccgctggaactcactttaatacccacgttgacctgcggacactgagggccgtcagggttctaagacctctgaagctggtttccggcatcccaagcctccagatcgtgttaaaatccatcatgaaagcaatggtccctctgctgcagattggactgctgctgttcttcgccattttgatgttcgctattattggccttgagttctactccggcaagctgcaccgtgcgtgttttatgaataatagtgggatcttggaaggcttcgacccaccccacccatgcggagtccaaggttgccctgctggatatgagtgcaaggactggattggacctaacgacggcatcacacagttcgataacattctgttcgctgttttaactgtgtttcagtgcatcacaatggagggttggaccacagtgctctacaacactaacgatgcactgggcgctacatggaactggctttactttattcccctaattataattggttctttctttgttctcaacctggtattgggagtcctcagtggggaattcgccaaggagagggagagggtcgagaacagacgagctttcatgaagttgcgaagacagcaacagattgaacgcgagctgaacggctaccgggcatggatcgataaggcagaggaagttatgctggccgaggagaataaaaatgccggcacttcggcactggaagtactccgcagggccaccattaaacggagccgaacggaagccatgacccgcgattcctccgatgagcactgcgtggatatctcttccgttggtactccactcgctcgtgcctccatcaaatcagctaaagttgatggggtgtcatacttccggcataaagaacgcctcttgcgcatctccatacgtcatatggtgaaatctcaggtcttctattggatcgtcttgagtctagtggcactgaacaccgcttgtgtagctattgtgcaccacaatcagccgcagtggctcacacacctgttgtattacgcagagtttttgttcctgggactgtttctgcttgagatgtcacttaaaatgtatggtatgggacctaggctgtacttccatagctcatttaattgctttgactttggggtaaccgtcggatcaatatttgaggtggtgtgggctatatttcggccaggcacttcattcgggatcagcgtgctccgggccctccgcttattaaggattttcaaaatcaccaaatactgggcttctctcaggaacctggtagtctctctgatgtccagtatgaagtctattattagcttgctttttttgctgtttttgtttatcgtggtcttcgcccttctgggcatgcaattgtttgggggcaggttcaattttaacgatggaacaccctccgccaattttgacactttccccgccgctatcatgacagtgtttcagatactaacaggtgaagactggaatgaggtcatgtataatgggatccgctcacaggggggtgtgagctctggcatgtggtctgccatatatttcatcgtcttgaccctttttggcaactacacccttttaaacgtttttctcgctattgcggttgacaatctggccaacgcgcaagagctgacgaaggatgaacaggaggaggaggaagctttcaaccaaaaacacgcccttcagaaggccaaagaggtatcccctatgagtgcacccaatatgccatctatcgagagagaaaggaggagacggcaccatatgtctgtttgggagcagcgaacttcccagctgcgaaagcatatgcagatgagcagtcaggaggcactgaaccgagaggaggcgcccactatgaatcccctgaatcccctcaacccattgagctctctgaatcccctcaatgctcaccccagtctgtacaggagaccaagagctatcgaaggactggccctgggtctggccctggaaaagttcgaggaggagcggatcagcaggggaggatcacttaagggtgacggtggggatagatcttccgcgctcgacaatcaacgcacccccttgagcctcggtcagagggagcctccgtggctggcacgcccttgtcatggtaactgtgacccaacccagcaagaagctggcggcggcgaggcagtcgtcacattcgaggaccgcgcaagacatcgtcagtcacagcgtaggtctagacatcgcagagtgagaacagagggcaaggagtctagttcagcttcccggtccagatccgctagtcaggagcgctcccttgatgaagcgatgcctacagagggcgaaaaggaccacgagctcagaggcaaccacggagctaaagaacctaccattcaggaagagcgagcccaggacctgcgcagaaccaatagccttatggtgtcccgcggaagtggtcttgccggagggttggacgaagctgatacgccattggtcctaccgcacccagaattggaggtgggaaaacacgtggtgttaacagaacaggagcccgaagggtcctcagagcaagccttgctaggcaatgtccaactggacatgggccgtgttatatcccagtccgagccagatctgtcgtgcattacagcaaataccgacaaagccactacagaatcgacatccgtgaccgtcgctatccccgacgtggaccccttggtcgacagcacagtcgtgcacataagcaacaagactgatggagaagcaagtcccctgaaggaagcggagatccgcgaggacgaagaagaagtagagaagaagaaacagaagaaagaaaaacgcgaaactggaaaagccatggtcccccacagttccatgttcatcttctccactaccaatccaatccggcgggcgtgccactacatcgtgaatctgcgatatttcgaaatgtgcatcctgctcgtgattgctgccagtagcatcgcattggcggccgaggacccggtgctcactaattcggagcgcaacaaggtcctgcgctatttcgactacgtgttcacgggcgtgtttactttcgagatggttatcaagatgatcgatcagggcctgattctgcaggacggtagctacttcagggacctgtggaacatcctcgattttgtggtggttgtgggcgccctggtcgcctttgccctcgccaactctatgaagactaataaagggagagatatcaagaccataaaatcgctccgcgtcctgcgagttttgagacctttgaagaccatcaaaagactcccaaaactcaaagcagtattcgattgcgttgtaacctccctcaagaacgtctttaatatcctgatcgtctacaaactctttatgtttattttcgcagtgattgccgtccagctcttcaagggaaagtttttttattgtactgatagcagcaaggacacagaaaaagagtgcattggtaactatgttgatcatgagaaaaacaagatggaggtgaagggccgtgaatggaagcgccacgaattccactacgacaacattatatgggctttactgactctgtttactgtgtccactggggagggatggccccaggtacttcagcattccgttgatgtaaccgaagaggatcgtggtccaagtcgctccaatcgtatggagatgagcatcttttacgttgtatacttcgtggtctttccattcttcttcgtcaatatatttgtcgctctgattatcattacttttcaggaacagggagataagatgatggaggagtgctcactcgagaaaaacgaacgggcgtgcattgactttgcaatatccgctaagcccctgacgcgttatatgccccagaatagacacacgttccagtatcgggtgtggcacttcgtcgtttccccaagttttgagtatactataatggcaatgattgcactgaacactgttgtactcatgatgaaatactactcggccccatgcacctacgagctggcgctgaaatacttgaacattgcctttactatggtcttcagcttagaatgcgtgcttaaggtgatcgcctttggcttcttgaactactttagggatacatggaacatctttgacttcattacagtgattggctctatcaccgagattatcctgactgattctaagttggtaaatacctctggcttcaatatgtcgtttctaaagctgtttcgcgccgccaggctcatcaagctccttcgtcagggctataccataagaattctcctgtggacatttgtccaatcctttaaggcattgccgtacgtgtgcctgttgattgccatgctgttcttcatctacgcaatcatcggcatgcaggtatttggtaacattaagctggacgaggaatcccatataaacagacataacaacttccggtcattcttcggaagcctgatgcttttgttccgcagcgccaccggtgaggcctggcaggaaattatgctctcatgtttgggcgagaagggctgtgagcccgacacgacggccccttctggtcagaatgaaaacgagagatgcggtacggatcttgcttatgtgtattttgtttcctttatattcttttgctcatttcttatgctgaatctgttcgtggctgtcattatggacaactttgaatacctgaccagagatagctccatcctgggaccccaccacctcgacgagtttgtgcgagtgtgggccgagtacgatcgagctgcttgtgggcgaatcccatacaaggacatgtacaaactggtcagggtgatcagtcctcccctgggcctaggggaaaactgcccatatcgcgtcgcttgtaaaaggcttgtcttaatgaacatgcccgtggccgaagacatgacagtacactttacatctacactcatggctctgatccggacagcgctggacatcaaaattgccaaggggggagccgacaggcaacagcttgactccgagctgcagaaagaaacattggcgatttggcctcacttatctcagaaaatgcttgacctgttagtccctatgcctaaggccagcgatctgaccgtcggcaaaatatacgctgccatgatgatcatggactactacaagcagtcgaaggttaaaaagcagcggcaacagttggaagagcagaaaaatgcacccatgttccaacgaatggagcccagcagtctacctcaggaaataattgctaatgcaaaagcacttccgtacttgcaacaggaccccgtgtctggactgagtggccggtcgggctacccgagcatgtccccactatctccacaggacatctttcagttggcttgcatggaccctgccgacgatggtcaattccaggaaaggcaaagcttggtggtcacagatccctcctccatgcgccggagcttctccactatcagagacaagcgctcgaattcatcatggctagaagagttctctatggagcgaagtagcgaaaatacatacaaatcgcgtcgcagatcctaccactcctccctccgcctatcagcccacagactgaattctgactcaggccacaaatctgatacccaccgcagcgggggacgggaaagaggtaggtccaaggagaggaaacatctgctcagtccagacgtgtccaggtgtaacagcgaggagagagggacacaggctgactgggagtctccggagaggcggcagtctagaagtccgtctgaaggcagaagccagacgccgaaccgtcagggaactggaagcctgtccgaaagctctattcccagtgtcagtgacaccagcaccccacggcggagcagacggcagcttccccccgttccccccaaaccccgcccgctcctgtcttacagctctctgatccggcatgcgggctccatctcccctcccgcggatggctctgaggaaggtagtccactgacgtcacaggctctcgaatctaacaacgcgtgtctgactgaaagctcaaactccccacatccccagcagtcacagcatgcctctccgcagagatatatttcggaaccgtatcttgctctgcacgaggatagccacgcatctgattgtggggaagaagaaacccttacgtttgaggcagccgtggcgacctccctgggtcggagcaataccattggtagtgcccctccgttgaggcattcatggcaaatgccgaatgggcactacaggagaagaaggagaggcggcccaggacctgggatgatgtgcggggccgtgaataacctgctctccgacacagaagaggatgataaatgttag

SEQ ID NO: 110465 - DNA, 6885 bp, Artificial Sequence
  Description of Artificial Sequence: Synthetic coding sequence
atggctcgctttggagaagcagtggtggcccggccaggttctggagacggggactccgaccaatctcgaaacaggcaggggacccccgtccccgccagcggccaggcagcggcatacaagcagactaaagcccagagagctcggacgatggccctgtataaccccatccccgtgcgacagaactgcttcacagtcaaccgtagtctctttatctttggggaggacaatattgtgagaaaatatgccaaaaagctgattgattggccacccttcgaatatatgatacttgcgactataattgccaactgcatagtgctggctctcgaacagcacctaccagaggacgacaagacccccatgtcacgccggctggagaagacagagccgtacttcattggcattttctgtttcgaggctggaataaaaattgtcgctctcgggttcatattccataaaggcagctatctccgaaacggctggaacgttatggactttatcgtggttcttagcggaatactggcgacagcagggactcattttaatacccatgtagacctgaggactctgcgagccgtgcgagttctgcggccacttaagctggtctctggcataccatctcttcaaattgtgctgaaatctatcatgaaagcaatggtgcctttgctccagattggccttctgttgttcttcgccatactcatgtttgccatcattggactcgaattttactctggtaaactacacagggcctgttttatgaacaattccggtatcctggaaggctttgatcctccccatccttgcggtgtccagggctgcccagccggctatgagtgcaaagactggattggccccaacgacggcattacacagttcgataacatcttattcgccgttttgacggttttccagtgcattacgatggagggctggaccaccgtcctttacaacacaaatgacgcactgggcgccacatggaattggctttactttattccactaattattatcggttcgttttttgtgctgaacctggtgctcggtgtactgtccggagagtttgcgaaggaaagagagagggttgaaaataggcgcgcttttatgaagcttcgcagacagcagcagatagaaagggaactaaacggctatcgggcttggatcgacaaggctgaggaggtcatgctcgccgaagaaaataagaacgccgggacatccgctctggaggtcctgagaagggcgacaatcaaacgaagtcgaaccgaggccatgactagagactcaagcgacgaacactgcgtggacatcagctccgtcgggactccgctcgcgcgcgcgtctattaagtccgccaaggttgatggtgtaagctacttcagacacaaggagcgtttgcttaggatttctatcaggcacatggttaaatcccaggtcttctactggattgtgctgagtctggttgccctgaacacagcttgcgtggccatcgttcatcacaaccaaccccagtggctgactcatctcctgtactatgccgagttcctcttcctagggctgttcctcctggagatgagcctgaaaatgtacggcatggggccaagattgtacttccatagctctttcaattgctttgacttcggagttaccgtgggtagtatcttcgaggtcgtgtgggcaatctttcgacccggaacttccttcggaatcagtgttctgagggccttgcggcttttacggatctttaagattacgaaatactgggcttcactgcgcaatttggtagtgtctctcatgagctcgatgaagagcattatctccctgctgtttctcctgtttctgtttattgtggtttttgctctgctggggatgcagttgtttggagggcgattcaacttcaatgatggcacaccatcggcaaacttcgacacctttccagccgcaatcatgactgtcttccagatcttgacaggggaggattggaacgaagtgatgtataacggtatccggtctcaggggggagtctcctccgggatgtggtccgccatctactttatagtgttaacactctttggaaactacaccctcttgaacgtgttcttggccatcgcagtggataacctggctaacgcgcaggaactaaccaaggacgaacaagaagaagaggaggcgttcaatcagaagcatgccttgcagaaagcaaaggaggtttctccaatgtccgctcccaacatgcccagtatcgagcgggagcggcggcgccgccaccatatgagcgtgtgggaacagaggaccagccagctgagaaagcacatgcagatgtcttctcaggaggcactgaacagggaggaggcccctaccatgaacccactgaacccccttaatccgctgtctagcctgaatccactcaatgctcatccaagcctttaccgccggccacgcgcgatcgaaggtctggcactcggcttggccctggagaaattcgaggaggaacgaatttcccggggagggagcttgaaaggtgatggaggcgatcggtcctctgcactggacaatcagcggacacccctgagcctcggccagcgcgagccgccttggctagcgagaccatgtcacgggaattgtgaccctacccagcaggaagccgggggaggcgaggccgtcgtaacattcgaagaccgggcacgccataggcagtcacagagacgatcacgacataggcgggtgaggacggagggaaaggaatcatcttccgcgtcacgctcaagaagtgcaagtcaggagcgctcactggacgaggccatgccaacggagggggagaaggatcacgagctacgtgggaaccacggagcaaaggagccgacaatacaagaggagagagcacaagatctgcgccgcactaattcacttatggtttcacgcgggagcggcctggccggtgggctcgacgaggccgataccccactggtcctgccacaccctgaactggaagttggcaagcacgtggtgctgaccgaacaggagccagaaggttccagcgaacaggccctgctcgggaatgtccagctggatatgggtagagtaatctctcagagtgagcccgatctgagttgcataacagctaataccgataaggctaccacagaaagcacttctgtgaccgtcgctatacctgatgtcgatccccttgtagacagcactgtggtgcatatcagtaacaagacggacggagaagccagtccactgaaagaggccgaaatcagagaggacgaagaggaagtggagaaaaagaagcagaagaaggaaaagagagaaaccgggaaggccatggtgccacactcttccatgttcatcttcagcaccaccaaccccattcggcgtgcctgccactacatcgtgaacctgagatattttgaaatgtgcatccttctggtcatcgctgcatccagcattgcattggcggccgaggatcccgtgctgaccaatagtgagagaaacaaggtgctgcgctatttcgattatgtgttcacaggggtgtttacattcgaaatggtcatcaagatgattgaccagggcctgatcctgcaggacgggtcatatttcagggacctctggaacatcctggacttcgtggtagtggtgggagcactcgtcgcctttgcactggccaacgccctgggaactaacaaaggacgcgacataaagactatcaaatctctacgggtcctgcgcgtgctgcggccgctaaagaccattaagcggttaccaaaattgaaggccgtttttgattgcgtggtgacttctctgaaaaatgtgtttaatatccttatcgtttacaaactctttatgtttatctttgctgtcattgcggttcagctgttcaagggcaagttcttttactgcactgactcctctaaagacacagagaaggaatgcatcggcaactatgtcgatcatgagaaaaataaaatggaggtgaagggacgagagtggaagcgccatgaatttcactacgacaacattatctgggctctacttaccctattcacggtgtccaccggcgagggttggccccaagttctccagcattctgttgacgttacggaagaggatcggggccctagccggtccaaccgcatggagatgagcattttctacgttgtctattttgtggttttcccttttttcttcgtgaacatatttgtcgcactgattatcataacattccaggagcagggggacaaaatgatggaagagtgcagtctcgaaaaaaacgagagggcttgcattgactttgctatctccgccaaacctctcacgagatacatgccacagaatcgccatacatttcagtacagggtctggcattttgtggttagcccatcattcgaatataccatcatggcaatgattgcccttaacaccgtggtattgatgatgaagtactattccgccccgtgcacatacgagctggcactgaaatacctgaatatagctttcacgatggtgttctccctggagtgtgtactcaaggtcatcgccttcggcttcctgaactatttccgagatacgtggaatatttttgatttcattaccgtaatcggaagtatcactgaaatcatacttacggacagtaagctggtaaacacctcaggattcaatatgtctttcctcaaactgttccgagccgctagactgattaagttacttcggcagggttacaccattagaatcttgctgtggacctttgtgcagagctttaaggccctcccatacgtttgtttacttatagctatgctgttttttatttacgcaatcatcggtatgcaggtgtttggaaatataaagctggacgaggagtcacatatcaatcggcacaataattttcgctcattttttgggagtctgatgctgttgtttcgcagcgccaccggcgaggcctggcaggaaattatgttaagctgccttggggaaaaaggctgcgaacctgatacgaccgccccctctggtcagaatgagaatgagcgctgcgggacagacctggcctatgtctacttcgtgtcctttatatttttctgcagcttccttatgttgaacctgtttgtagccgtgattatggacaatttcgaatacctgactcgggactctagcatcctggggccccatcacctggatgaattcgtccgcgtttgggccgagtatgatcgtgcggcctgcggccgcattcactacaccgagatgtatgaaatgctcaccttgatgtccccccctctgggactcggtaagcgctgtcccagcaaggtggcgtacaaacgccttgttctgatgaacatgccagtggctgaggacatgacggtgcattttaccagcactttgatggccctcatcagaacagctctggacatcaaaattgccaaagggggcgcagaccgtcagcaactggattctgagctgcagaaggaaactctggcaatctggccccacctctctcagaaaatgctagatctgttagtccctatgccaaaggcctctgacctgacagtggggaagatttacgcggccatgatgattatggattattacaaacagtccaaggttaagaagcagagacagcaactcgaggaacagaaaaatgcccctatgttccagaggatggaaccctcttccctacctcaggagatcatcgccaatgccaaggccctcccctatttacagcaagaccccgtgtctggactgtcaggccgtagcgggtacccttccatgtctccactctcgccacaggatatctttcagttggcctgtatggaccccgcagacgacggccagtttcaggaacggcaaagccttgagcctgaggtgtctgagttgaagtcagtgcaaccttccaatcacggcatctatcttccgtccgacacacaagagcatgccggctcgggtcgagcctcctccatgccgaggctaaccgtggatccgcaggtcgtgaccgatccgagctcaatgaggagaagctttagcaccatccgggacaagcggagcaattcctcatggctagaagaattctctatggaacggtcaagcgagaatacctacaaaagcagaaggcgcagttatcactcttctttgcgtctctccgctcatcgtttgaatagtgacagcggccacaaatccgacactcaccgatctggtgggagggagcgtggacgcagcaaagagaggaagcacttgctgtcacctgatgtgagtcgatgcaattccgaagaacgcggtactcaggctgactgggagagcccagagcggcggcagagccggtctcccagcgagggtcgcagtcagacacccaaccgtcagggaacaggaagcctctccgaatcctcaattcctagtgtttccgataccagtaccccacgccggtcccgtcggcagttgccgccagttccaccgaaaccaaggcctcttctgtcttatagcagcctgattcgacacgcaggctctataagtccgcccgccgacggctccgaagaaggctctccgctgacatctcaggctctggagtcgaacaacgcctgtcttacagaatcctctaactccccacacccacagcaatcccagcacgcaagcccccagcgctatattagcgaaccatacctcgcactgcacgaagatagccatgcatcggactgtggtgaggaagagacactgacctttgaggctgccgtggccacatcactgggtcgcagcaacacaattggctccgcaccacctctgcgacatagctggcagatgccaaacgggcattacaggaggaggcgacgcggcgggccaggcccaggcatgatgtgtggcgccgtgaataaccttctgtccgacactgaagaggatgataagtgttag

SEQ ID NO: 110466 - DNA, 5634 bp, Artificial Sequence
  Description of Artificial Sequence: Synthetic coding sequence
atgctcgctgaggagaataaaaacgcaggtactagcgcattagaggtcctgagacgcgctactataaagagatctcgcaccgaagctatgacccgagattcctctgatgaacactgtgtggacattagttcagtcgggacacccctggctcgggcgtctattaagagcgctaaggtagatggtgtgtcctacttcaggcataaggagcgtctactgcgcataagcatacgccatatggtcaagtcccaggtgttctattggatagtactgagcctggtggcgctcaataccgcctgtgtcgctatcgtccatcataaccagccacaatggcttacacatctcctgtactatgccgagttcctgttcctcggattgtttctactggagatgagcctaaaaatgtatgggatgggtcctcggctgtacttccattcaagctttaattgcttcgacttcggcgtcactgtaggatccatcttcgaggttgtgtgggctatattccggcccggtacatctttcgggattagtgtcttaagggctctgcggctgttgcggatctttaagattaccaagtactgggcctcactgcgaaatcttgtcgtcagtcttatgagttccatgaaaagcatcatctccttgttatttctgctgttcctgttcatcgtggttttcgcgctactgggaatgcagttgttcgggggtaggttcaacttcaatgatggcactccctctgccaatttcgacacctttccagctgccatcatgacggtctttcagattttaaccggagaagactggaacgaagtcatgtacaatggaattagaagccaggggggcgtgtctagcggtatgtggtccgctatctacttcatcgtactcacactgttcggtaactatacacttttgaacgtgttcctggctatcgcagtcgataatctggccaacgcacaggagcttacgaaggatgaacaggaagaagaggaggctttcaaccagaaacacgctttgcagaaggccaaagaggtctcaccaatgtccgctccaaacatgcccagcatcgagcgcgaccgacgtaggaggcatcacatgagtatgtgggagccccgatcctcccatttacgcgagcgaaggcggcgccatcatatgagcgtctgggagcagaggacttcccaactgagaaagcatatgcagatgtcctcccaggaagctctcaatcgcgaagaagctccgacaatgaaccctctcaaccccctcaaccctctctccagcttgaatcctctcaacgcacaccctagcctctataggagaccgagagccatcgaagggcttgccctgggcctcgcactcgaaaagtttgaagaagaacgtatttcaagaggaggatctctgaagggagacggcggggatcgttcctccgctctggataatcagcgaacacccctgtcgctggggcagagagaaccaccctggttggctcggccctgccatggtaactgtgaccccacacagcaggaggcggggggcggcgaggccgtagtaacgttcgaggaccgggcacgacaccgccagtctcagcgaaggagccggcatcgccgggtgaggaccgaaggtaaggagtcatcaagcgcatctcgatcccggtctgccagccaagaaaggagtttggacgaggctatgccgaccgagggggaaaaggaccatgagcttcgcggtaatcatggggctaaggagccaacaattcaagaggaacgcgctcaagacctgcgtaggacaaattccttaatggtgagccggggatcgggtctcgctggggggcttgacgaagccgatactcctctggtactccctcatccagaactggaggtaggcaagcacgttgttctaactgagcaagaacctgagggcagctctgagcaggcacttttagggaacgtccaactggacatgggaagagtgatttcgcagagcgaaccagacctgtcatgcatcaccgctaataccgataaggccactactgaatcgacctcagtcactgtggctatccctgatgtcgacccattggttgattctaccgtagtccacatttcaaataagaccgatggagaagccagccccctgaaggaggccgaaatacgcgaagacgaggaggaggtggagaagaagaaacaaaaaaaggaaaaacgggagacggggaaggccatggttccccacagctctatgtttattttcagcaccacaaaccctatcagacgggcgtgtcactacatcgttaacctgcgctactttgagatgtgtatactgcttgtgatcgccgccagctctatcgcattggctgctgaggaccccgtcctcactaactccgagcggaacaaagtcctacgatatttcgactacgtgtttaccggagtgttcacctttgaaatggtaatcaagatgatcgatcaaggtctcatattgcaagatggcagttacttcagagatctgtggaatatcctagattttgttgtggtcgttggcgcccttgtcgccttcgcgctggctatgtctctggagaccaataaaggcagggacatcaagaccataaaatcactgagagtgctgcgtgtcttaagacccctgaaaaccattaagagacttcccaagctaaaggctgtgttcgactgcgttgtcacatccctcaaaaacgtgtttaacattttaattgtgtacaagctctttatgtttatattcgctgtgattgcagtgcagctgtttaagggcaagtttttttactgcaccgactcttctaaagataccgaaaaagaatgcatagggaattatgttgaccacgagaaaaacaagatggaggtaaagggaagagaatggaagaggcatgaatttcactatgataacattatttgggctctcttaacactcttcactgtctccactggtgagggttggccacaggtgctgcaacactccgtagacgtaactgaagaggaccgggggccgtctcgctcaaaccggatggaaatgtctattttttatgtagtgtactttgtggtgttccctttctttttcgtaaacatctttgtcgccctcatcatcattacgtttcaggagcaaggcgacaagatgatggaagagtgctctctggaaaaaaacgagagggcctgcattgattttgccatctcagctaagcccttgacccggtatatgccacaaaacagacatacctttcagtaccgtgtgtggcacttcgtagtgtcgccaagttttgagtataccatcatggcaatgattgccctcaataccgtggtcttgatgatgaagtactattctgctccttgcacttacgaactggctctcaagtacttaaatatagcctttacaatggttttttcactagagtgcgttttaaaagtgatcgccttcggattcctcaattatttccgtgatacttggaatatttttgactttatcaccgtaatcggcagcattacagagataatcctgacggatagcaagctggtaaatacatcaggcttcaacatgagttttctaaaactcttccgtgccgcacgcctgatcaagttgctgcgccagggctataccatccgcatattgctgtggactttcgttcagagtttcaaggcccttccctatgtctgcctgttaatcgcaatgctattcttcatatacgctattatagggatgcaggttttcgggaacattaaactagatgaagagagtcatattaaccgccacaacaatttcagatcttttttcgggagcctgatgctcttgttccgaagtgcgactggcgaagcttggcaggagatcatgctgtcatgcctgggcgaaaagggttgcgaacctgacaccaccgcaccctctggacaaaatgagaacgagcggtgcggtaccgatttagcttatgtgtacttcgtctccttcatcttcttctgctccttcctgatgctgaacctgtttgtagccgtgattatggataactttgaatacctaactagagacagcagtatcctgggtccccatcatctcgatgagtttgtccgagtttgggccgagtacgacagagccgcatgcggtcgaatccactatactgaaatgtatgagatgctgaccttgatgtcccccccccttggcctcgggaagcggtgcccgtctaaggtggcctacaaaaggctggtcctgatgaacatgcccgtggcggaggatatgacagtgcatttcactagcacactgatggcactaattaggaccgctttagatattaaaatcgccaagggaggcgcagacaggcagcaactggacagcgagttgcagaaagagaccctggccatctggcctcatctctctcagaaaatgttggacctgctagtccctatgccaaaagcgtctgatctgaccgtgggcaagatctacgctgccatgatgatcatggactattacaaacagtccaaagttaagaaacagagacaacagctggaagagcagaagaatgcccccatgttccaaaggatggagccgtcctctctgccccaagaaattattgcaaatgccaaagcactgccatacctccagcaagatcccgtctctggcctttccgggcgttccggatatccttcaatgtcccctcttagccctcaagatatctttcagctcgcctgcatggatcccgctgacgacggacagttccaggaaaggcaatctctggtcgtgacagatccaagttcaatgagacgtagcttctctaccattagggacaagagatcgaatagtagctggctggaagagttttccatggagcgcagctcagagaacacttacaaatctcgccggagatcatatcactccagtctcaggctgtccgctcatagactcaacagcgatagcggccacaaatcggacacacaccggagcggaggcagagaacgggggaggtccaaggagaggaaacatctgctgtctcccgatgtcagccggtgtaattcagaggagcgggggactcaggccgactgggagtcccctgaaagacgccaatcccgctccccatccgagggacggtctcaaacacccaatcgccaggggactgggagtttgtcagagtcttcgatcccaagcgtgtccgatacttcaacaccgcggcggagccgccgtcagcttcctcccgtgcctccgaagccaaggccactgttgtcatactcatcgttaatccgccacgcaggcagcatctcgccacccgccgatggatccgaagagggaagtcccctcacgagtcaagccctggaatctaataacgcctgcctgacggaatcgtccaacagtccccatccccaacaatcccagcacgcctcgccacagagatacatctccgagccatatctcgcgctacatgaggatagccacgccagtgactgcggggaagaagagactctgacgttcgaggctgccgtggctacctccttaggaaggagcaacactatagggagcgcccctccacttaggcattcatggcaaatgcctaatggtcactataggcgcaggcgtcggggcggcccgggccccggaatgatgtgcggtgctgtgaataacctcctcagcgacacagaggaggacgataagtgttag

SEQ ID NO: 110467 - DNA, 6813 bp, Artificial Sequence
  Description of Artificial Sequence: Synthetic coding sequence
atggcacgattcggggaggccgtcgtggcgaggccaggcagtggagatggagacagcgatcagtctcgcaaccgacaggggaccccagttccggccagcggacaagccgctgcatataagcagaccaaagctcagagagccagaacaatggccctttataaccccattcccgtcagacaaaattgcttcacggtcaaccggtctctcttcatattcggcgaggacaatatcgtgagaaaatacgcaaaaaagctgatcgactggccccctttcgagtatatgatcctggcaacaatcatagccaactgcatcgtcctggccttggaacagcatctgcccgaggatgacaaaaccccaatgagccggcggctggagaaaaccgaaccctatttcatcggcattttctgcttcgaggccggaattaaaatagtagcactgggatttatctttcataagggcagctacctgcgtaacggttggaacgtaatggactttatcgtggtgttaagcggaatactcgcaaccgctggtacacacttcaacacgcatgtagatctgaggactctgcgcgcagtgcgggtcttgagaccactgaagctcgtcagcggcatcccttctcttcagatcgtccttaaaagtatcatgaaagctatggtgccgctgctccagatcggtctgctactgttctttgccatattgatgttcgccattataggattggaattctactccggtaaactacaccgggcttgtttcatgaacaattcgggcatcctggagggatttgaccctccacatccatgcggagtacaggggtgtcccgcaggttacgagtgtaaggattggatcgggccaaatgacggtattactcagtttgacaatatcctctttgcagtccttactgtgtttcagtgtattaccatggaaggctggacaacagtactgtataacaccaacgacgcgcttggagcgacatggaattggctttactttatacccctgatcatcattgggtctttctttgtcctgaaccttgtgctgggtgtgttgtccggagaatttgctaaagagagggaacgcgtggagaatcggcgcgcctttatgaagctgagacggcagcagcagatagaacgggaactcaacggttaccgggcatggatagataaagcagaggaggtaatgcttgccgaagaaaataagaatgctggcacatccgctctcgaagtccttcggagagctactattaaacgatcacggaccgaagcaatgacacgagacagcagcgatgagcattgtgttgacatatcctccgttgggacacctcttgcacgagctagcataaaatccgcaaaagtggatggcgtttcttactttcgccacaaggaacgcctcttgcgcatcagcattagacatatggtcaagtcccaggtgttttattggatcgtgctgtcgctggtggcgctcaatacggcatgcgtcgccattgtacaccacaatcagccgcaatggctgacacacctgctgtattatgccgaattcctgtttcttggtctgtttctactggagatgtcgctgaaaatgtatggaatggggcctagactgtattttcatagtagctttaactgtttcgattttggggtgactgtcggctctatttttgaagtcgtttgggctatctttcgccccggcacctcctttggtattagcgtgctgagagctctgcgactcttgaggatctttaaaatcacgaagtattgggcatccctgcgcaatctagtggtgtccctgatgagcagtatgaaatccattataagcctgctgttcctattgttcctgttcatagtggtgttcgcacttcttggcatgcaattgttcggtggacgtttcaacttcaatgatggtaccccttccgcgaatttcgatacattcccggcagccattatgactgtatttcagatcctaacgggcgaagattggaacgaggtcatgtataatggcatcagatctcaaggaggcgttagcagtggcatgtggtccgccatctattttatcgtccttaccctctttggtaactatactttacttaatgtattcctggcaatcgccgtagacaatctggctaacgcacaggagttgacaaaggacgagcaggaggaagaagaggctttcaaccagaaacacgccctgcagaaggcaaaggaggtttcccctatgtctgcacctaatatgccttcaattgaaagggaccgacggcggagacatcacatgagtatgtgggaaccccggtcctcccacctcagagaaagacgtagacgccatcatatgagtgtctgggagcagagaacatctcagcttagaaagcatatgcagatgagttcacaagaggctttaaacagagaagaagcaccaacaatgaaccccctcaaccccctgaaccccttaagcagtctcaaccccctgaacgctcatccatccctttatcgaaggccgagggctatcgagggactcgccctgggcctagcactggagaaattcgaggaggagcgaatctcgcgtgggggctctctgaaaggcgacggcggagatcgatcatctgccttggacaaccagcgtacgccattgtccctcggacagagggagcccccatggcttgcacggccctgccatggcaactgtgacccaacacagcaggaggccgggggtggcgaagctgtagtgacttttgaggatagggccagacaccgccagagtcaaagaagatcgcgtcacagacgggtgcgcacggagggtaaagagtcatcatccgccagccggtcacgtagtgcgagccaggaaaggagcctggacgaggctatgcctacagagggggagaaagaccacgaactgagaggaaatcacggtgccaaagagccaacaatccaggaagagcgtgcccaggatctgcggagaactaattctttgatggtgtctcgaggatccgggctggccgggggattagacgaggccgacaccccgctcgtgctgccacaccctgagcttgaagtcggcaaacatgtagtgctgacagaacaggagcctgagggcagttctgagcaagccctcctgggcaacgtccagttggatatgggcagagtgattagccagtcagagcccgatctgtcatgtatcacggccaataccgacaaggccactaccgagtcaacttcagtcaccgttgccattcccgacgtggatcccctggtggactctactgtggttcacatctcgaacaaaacagacggagaggcgtcaccactcaaggaagctgaaattcgcgaggatgaggaggaggtggagaagaagaagcagaaaaaggaaaaaagagagacaggtaaagctatggtaccccactcatctatgttcattttttctactaccaatccaatcagacgggcctgtcattatatagtcaacttacgttatttcgagatgtgcattctgctcgtgattgctgctagcagtatcgccttggctgctgaggatccagtgctgactaactccgaacggaataaggtgttgaggtacttcgactatgtgtttaccggggtctttacctttgagatggttataaagatgattgatcaggggctcattttacaggatggaagctatttccgggatttatggaacattttggatttcgtggtggtcgtgggagctctggtcgcattcgctctggccaacgcgctaggaaccaacaaagggcgcgatattaaaactataaaatccttaagagtcctgcgcgtactgcgtccattgaaaacaattaaaaggcttccaaagctgaaggcagtatttgattgtgtggtcacttccctgaagaatgtattcaatattctgattgtatacaagctatttatgtttatctttgctgtcatagccgtacaacttttcaaaggcaagttcttctactgtaccgactcctcaaaagatactgaaaaggagtgcattgggaattacgtggaccatgagaagaacaaaatggaggtcaagggaagggagtggaaaaggcatgaattccattacgataatataatatgggcgctgttgactttgtttacggtctcaacaggggaagggtggccacaggtgttacagcacagcgttgacgtgaccgaggaggatagaggtccatcccgaagcaaccggatggagatgtctattttttacgtggtgtatttcgtggtttttccatttttttttgtgaacatctttgtggcgctgatcataatcacctttcaggagcagggcgataagatgatggaggagtgcagtctcgagaagaatgagagggcttgcatcgactttgccatctccgccaagcccctgactcgttacatgcctcagaaccggcacacgtttcagtaccgcgtgtggcactttgtcgtaagtccctcattcgaatacaccattatggccatgatcgccttgaataccgtggtactcatgatgaaatactacagtgccccctgtacttacgagctggccctgaagtacttgaacatcgcatttaccatggttttttcactagagtgtgttctgaaagtgatcgctttcggattcctcaactactttagggacacttggaatatctttgacttcattacagttataggatctataacagagattattctgacagatagcaagttggtaaacaccagcgggttcaacatgtctttcctcaagctatttcgggctgcgcgcctcatcaagttactgagacagggttatacaatcaggattttgctgtggacattcgtccagtccttcaaagcactcccctacgtatgtctgctgattgcaatgctgttctttatctatgctattatcggaatgcaggtcttcggaaacataaagcttgacgaggaaagtcacattaaccggcacaataattttcgtagttttttcgggagcctgatgttactttttcgctccgcaactggggaagcctggcaggaaattatgttaagttgtctgggcgagaaaggctgcgagccagacacaaccgctcccagtggccagaacgaaaacgaacgttgcggcacagatttagcatacgtgtacttcgtgtcttttatctttttttgtagtttcctcatgctgaatcttttcgtcgctgtgattatggataatttcgaatacttgactagagatagtagtatcctcggaccgcaccaccttgatgagtttgtgcgcgtgtgggccgagtacgatagggcagcttgtggcaggattcactatacggaaatgtacgagatgcttacgttgatgagcccaccgttggggctgggaaagaggtgccccagtaaagtggcttacaagcgcttagtcctgatgaatatgcctgtagcggaggatatgacagttcattttacttcgaccctgatggctctgatcaggaccgcgctcgacattaagatcgccaaagggggcgctgacaggcagcagctagatagtgagctgcagaaggagacactcgccatttggccccacctgtcccagaagatgctagatctgctcgtccctatgccgaaagcttctgacttaactgtgggtaagatctatgccgcaatgatgataatggactactataagcagtccaaagtcaaaaaacagcggcagcagctggaggagcagaaaaatgccccgatgtttcagcgcatggagccttctagcctaccacaagaaattattgctaacgccaaggccttgccctacttacagcaggaccccgtgagtggcctgagcggcaggtcaggttacccgagcatgtcccccctgtccccacaggatatcttccaactggcctgcatggatccagccgacgacgggcaatttcaggagcggcaaagtctggtcgtcacggatccttcctcaatgcgaagatccttttccaccattagagacaaacgaagcaactcgtcttggctggaggagttctcaatggaaagatcttctgaaaacacgtacaagagccgacggcgcagctaccattcctctctcagactgagtgctcatcggcttaactccgattccggccataaatccgacacacaccgcagtggcggcagggagaggggtagatcgaaggaaagaaagcatctcctcagcccagacgtttcacgctgtaactcagaagagcgcggaacccaggccgactgggaaagccctgagcgaaggcagtccagaagtccatcagaggggcgttcgcagacaccaaatcgccagggaaccgggagtttgagtgagagcagcatcccctctgtgagcgacaccagcacaccgcgcagaagtaggcggcaattacctcccgtccctcctaaacctcggccactattatcctattcaagcctcatcagacatgcaggaagtatttcaccaccggctgatggttccgaggagggcagtcctctgactagccaggccttggaatctaacaacgcctgtctgaccgagtcaagcaattctccccacccgcagcagtctcagcacgccagcccccagcggtatatttccgaaccctacttggcccttcacgaggactcacacgctagtgattgtggcgaggaagaaacgctgactttcgaggcagccgtcgcaacttctctggggaggtctaataccatcggctccgcaccgcccttgaggcattcttggcagatgccaaacggtcactatcgcaggcgccgccgcggtggcccaggtccgggcatgatgtgcggcgccgtgaataacctgttatcagacactgaagaggatgacaaatgctag

SEQ ID NO: 110468 - DNA, 6942 bp, Artificial Sequence
  Description of Artificial Sequence: Synthetic coding sequence
atggcaagattcggggaggctgttgtggcccggcccggcagcggggacggggattcagaccagagccgcaatcggcagggcacgccagtgcccgctagcgggcaggccgccgcgtacaagcaaacaaaggcgcaacgggcccgaaccatggctctgtataatcctattccggtgcggcagaactgcttcacagtgaataggagtctgtttatcttcggcgaagacaatatcgtgaggaaatacgccaagaagctcatcgactggccacctttcgagtatatgatattggctacgattattgccaactgcatcgttctagctctggaacagcacttgcccgaagacgataagactccaatgtctcggaggttggagaagactgaaccctatttcatcggaattttctgctttgaggccggaatcaaaatagtggcgcttggatttatatttcacaagggttcttatcttaggaatggctggaacgttatggattttattgtggtgttaagtggcattctggccaccgcgggtacccactttaacacccatgtcgacctgaggacgttaagggctgttcgtgtgttaaggccattaaagttggtctctgggatcccaagtctacaaatcgtgctgaagtcgataatgaaagcgatggtgccgctcctgcagataggtctactcctattcttcgcgattctgatgttcgccatcatagggcttgagttttattccggcaagttgcaccgagcctgcttcatgaacaattcaggtattttggaaggttttgatccgcctcacccctgtggggttcaaggttgccccgctggatacgagtgcaaggattggatcggacctaacgacgggattacacagttcgacaacatcctgttcgccgtgctgactgtatttcagtgcattaccatggagggttggaccactgttctgtataacaccaatgacgcactgggagccacgtggaactggctatacttcattccactgattatcattggcagcttctttgtcctgaatttggtcctgggagtcctatccggagaattcgcgaaagagagagagcgcgtcgagaacagacgggcattcatgaagctgagacgtcaacagcagatcgaaagggagctgaatgggtaccgcgcctggatagataaggcagaagaggtgatgctggctgaggagaataaaaatgcaggaactagcgctttggaggtgctcaggcgtgcaaccataaagcgcagtcgtacagaggcaatgacaagagatagttccgatgaacactgtgtggacatctcctccgtgggcacccctttagcacgggcgtctataaagtcagctaaggtcgacggggtgtcttactttcgccataaagagagactcttgcgcatcagcatccgacatatggtcaaatctcaggtgttctattggattgtgctgagtctggtcgcactgaataccgcctgcgttgctattgtgcaccacaatcaaccccagtggctgacccacctgctctattacgcagagttcctcttcctgggcctgttcctattggagatgagtctaaagatgtatggaatggggcctcgactctatttccattcctcctttaactgcttcgatttcggggttaccgtcgggtctatctttgaagtggtgtgggctatctttcgacccgggacctctttcggcatttccgtcctccgcgcactccgcttactgagaatctttaagataactaagtactgggcgtccctgaggaacctagtagtgtcccttatgagctcaatgaaaagcataatatcactgctgttccttttatttctgttcatcgtggtgttcgcgctgcttggcatgcagttattcggaggccggtttaacttcaacgatggcacaccctccgcgaatttcgatacctttccagctgctatcatgactgtgtttcagatccttacaggtgaagactggaacgaggtgatgtataacggcattagaagccaaggcggcgtcagtagcggaatgtggagcgctatctacttcatagttttgactttattcgggaattataccctgcttaatgtctttttggccattgccgtcgataaccttgcgaacgcccaggaactgacaaaggacgaacaggaagaggaagaggcttttaaccagaaacatgcactacagaaggccaaggaggtctccccaatgtcagcccccaacatgccttctatcgaaagggataggcgccggcgccatcacatgtccatgtgggagcctaggagctctcatctccgtgagcggaggcgcaggcatcacatgtcggtctgggagcagcggacatcccaacttcggaagcatatgcaaatgtctagccaagaggctctgaatcgggaggaggctccaacaatgaaccccctgaaccccctgaaccccctttctagtctgaacccactgaacgctcacccatccctgtatcggagacctagggcaatcgaagggcttgccctgggactggctcttgagaaatttgaggaagaacggatcagtcgcgggggtagcctcaaaggcgatggcggcgatagatcttccgcactggacaaccagagaactcctctgagcctcgggcagagggagcccccctggctggctcgtccttgccacggcaactgtgaccctacccaacaagaggctggcggaggcgaggcggtggtgacctttgaagacagagcccgtcatcgacagtcacagcgcaggtctcggcaccgccgcgtgcgcaccgaggggaaggaaagcagctccgctagcaggagtcgctctgctagtcaagaacggtccttggacgaggcaatgcccaccgagggagaaaaggatcatgagctgcgagggaatcatggcgctaaagaacccaccatccaggaggaaagggcccaagatttgaggcgcaccaactccctcatggttagccgaggcagtggattagcagggggcctagatgaagcagacacccctctggtgcttccgcacccagaattggaggtggggaagcatgtcgtgcttacagagcaagagcccgaaggctcctctgagcaggcactgctgggaaacgtacagctggatatgggcagggtgatttctcagagcgagccagatctaagctgtatcacagcaaacacggacaaggcaactacagaaagcactagcgtgactgtagccatcccagacgtggatccgctcgtagactcaaccgtcgtgcacatctccaacaagactgacggggaggcgtctccgctaaaggaagccgaaataagggaagatgaggaggaagtcgagaaaaagaagcagaagaaggaaaagagagaaaccggtaaagctatggtccctcatagctccatgttcatcttttcgactacgaaccccatccgccgagcctgccattatatcgttaacctgcgttacttcgagatgtgcatccttctggtaattgccgcttcatctatcgcactggccgctgaggaccccgtgctcaccaattctgaacggaacaaagtgctgagatactttgattatgtgtttaccggcgtgtttacctttgaaatggtgatcaagatgatagatcagggactgatattgcaggacggatcctatttccgcgacctgtggaatattcttgacttcgtggtggtcgtgggggcccttgttgcctttgcactcgctaacgcccttggcactaacaagggtagggacatcaagactatcaagtcccttcgagtgcttcgtgtattgcggccattaaagaccattaaacgcctcccaaagctgaaggcggtcttcgattgcgtcgtaacctcgctgaagaatgtgtttaacattctgattgtctacaagctctttatgttcatctttgctgttatagctgtacaattgtttaaaggaaaattcttttattgtacggacagttcgaaggacactgagaaggagtgcattggaaattacgtggatcacgagaaaaacaagatggaagtgaaaggcagagaatggaagagacatgaattccactacgataacatcatctgggcccttttgaccctgttcaccgtgtccactggagaggggtggcctcaggtgctccagcattccgtggacgtaacagaagaagatcgagggccctcgagatccaaccgaatggagatgagcattttctatgtcgtgtattttgtcgtcttcccgttttttttcgttaacatatttgtggcacttatcattatcacctttcaggagcaaggcgataaaatgatggaggaatgctccctggagaaaaatgaaagggcctgcatcgatttcgccatctctgccaagcctctgaccaggtatatgccccagaacagacacacctttcagtatagggtatggcattttgtggttagcccaagcttcgagtataccattatggccatgatagccctgaataccgtggtgctgatgatgaaatattatagcgcgccatgtacatatgagctggccttgaagtacctcaacatcgcatttacaatggtgttttcattggaatgtgtgctcaaggtaatcgcttttgggttcctaaactattttagagatacttggaatatcttcgattttatcaccgtgattggttccattacagaaatcattttgactgactcaaagttggtgaatacttctggattcaatatgagctttttgaaactgttccgagcagcgcgactcataaagctgttgcggcaggggtacacaatccggatcctcctgtggacattcgtgcagagcttcaaggcactgccttacgtgtgtctactgatcgccatgctgttctttatttacgctattattggcatgcaggtgttcggtaatataaagctggacgaagagtcacacatcaatcgacacaataacttcagaagtttcttcggatccctcatgcttctcttccgcagcgcaactggcgaagcctggcaggagattatgttgagctgcttgggtgagaagggttgtgagcccgacaccaccgccccgagtggccagaatgagaacgagcggtgcggtacagatcttgcatacgtttattttgtgagcttcatttttttctgcagtttcttgatgttgaacctgttcgtcgcagttatcatggataacttcgagtatctgaccagggattctagtatcctgggcccacaccacctggacgagttcgtgcgggtttgggccgaatacgaccgggccgcctgtgggcgcattcactacactgagatgtatgaaatgcttaccctaatgtcgccccccctagggctgggcaaacgctgtccaagtaaggtggcttacaaacggctcgtcctcatgaacatgccagtggccgaagatatgaccgtacactttacatccacgttaatggctctgatccgaactgcattggacatcaagattgcgaagggtggggcggatcgccagcagctggattcagagttgcagaaggagaccttggcaatatggccccatctgagtcagaagatgttggaccttctcgtgcccatgccgaaggccagcgatctcactgtggggaaaatctacgcagctatgatgatcatggattattataagcaaagcaaggttaaaaagcagaggcagcagctagaagagcagaaaaatgctccgatgtttcagcgcatggagcctagttctttgccgcaggaaattatagccaatgcaaaggccctgccctatctacagcaggatccggtgtctgggctgtccggcaggtcaggctacccaagcatgagtccactctctccccaggacatcttccagctagcttgtatggacccagctgacgatggacaatttcaggaaagacagagtctggagccagaggtctctgagctcaagtccgtccagcctagcaaccatggaatttacctgccgagtgatacacaggaacatgctgggagtggaagggccagttcaatgccgcggctgacagtagacccccaggtcgtcactgacccaagcagcatgcgccgcagtttctccactatcagagacaaaaggtcaaactctagttggctggaggaattcagtatggagcgctcttccgagaacacgtataaaagccgacggagaagctatcacagctcccttcgcctgtctgcccataggttgaactccgattcagggcacaaatccgacactcatcgcagtgggggaagagagagggggcgtagcaaggaacgcaaacacctgctgtcacccgatgtgagtcgttgtaacagcgaagaacgtggcacgcaggccgattgggaatcacctgaacggcgtcagtcgagaagtccaagcgaaggccgctcccaaactcccaataggcaaggaacaggatccttgtctgagtcttcgattccttccgttagcgacacctctactcccaggcgctctcggagacagttacctcccgtccctccaaagcctcggccgctgctatcctattcaagcctgattcgtcacgcagggagtatttcccccccagcagatggaagcgaggaggggagcccactcactagccaagcacttgaaagcaacaatgcatgtttgaccgagtcttcaaactccccacaccctcagcagagccagcacgcctccccacaacgctacatttctgagccatatctggcccttcatgaggactcgcatgccagtgattgcggagaagaggaaaccctgaccttcgaggcagctgtggccacctctctcggtcgctccaatactataggctctgctcctccactgagacacagctggcagatgcctaacggacactaccgccggagacgtcgcggcgggccaggccctggcatgatgtgtggcgcagttaacaacttgttaagcgataccgaggaagacgataagtgttag

SEQ ID NO: 110469 - DNA, 1317 bp, Artificial Sequence
  Description of Artificial Sequence: Synthetic coding sequence
atggcccggtttggggaagcagtagtggcccgtcccggcagtggggacggcgattcagatcagtcccgaaatagacagggcactccagtgcccgctagcgggcaggcagctgcatacaagcagaccaaagcccagagggccagaactatggctctctataatcctattccagtgagacagaattgctttactgttaacagatctctcttcattttcggcgaggataatatcgttcgtaaatatgctaaaaagctcatcgattggccaccttttgagtatatgattctcgctacaattattgctaactgcattgtgctagcactagagcagcacttgcctgaagacgataaaaccccgatgagccgacgacttgagaagactgagccctattttatcggaattttctgtttcgaggcaggaatcaaaattgtggcgctcggcttcatcttccacaaagggagttatttgaggaatggctggaacgtgatggacttcatcgttgttctgagcgggatcctagcgactgctggcacccacttcaatacacatgtagacttgcggacactgagagccgtgagagttctgcggcccctgaagctcgtgtcaggcattccgagtctgcagatagtgctgaaatcaattatgaaggccatggtccctctcctgcagattgggttactgttgttcttcgccattctcatgttcgcaataatcggtctggagttctactccgggaaattgcaccgggcctgctttatgaacaactctggtattcttgagggcttcgaccctccacatccctgcggagtgcaaggatgcccagctgggtacgaatgcaaggactggattggccccaatgatgggattacccagtttgacaacattctgttcgccgtgcttaccgtgttccaatgcattacaatggaaggatggaccacagtgctgtataatactaacgacgcgctgggtgccacttggaattggctgtacttcattccccttattataattggttccttttttgttctgaacctggtgctcggtgtgctaagcggcgaatttgccaaagaacgagagcgggtcgagaaccgtcgcgcctttatgaagctacgcagacaacaacagattgaacgagaactcaatggctatagggcttggatcgacaaggctgaagaggtcatgctcgccgaagaaaacaaaaacgctggtacgagtgccctcgaagtcctgcgcagggccactatcaaacgcagtaggacggaggccatgacccgtgacagttcagacgagcactgcgttgacatctcctccgtgtag

SEQ ID NO: 110470 - DNA, 6756 bp, Artificial Sequence
  Description of Artificial Sequence: Synthetic coding sequence
atggctaggttcggcgaggcggtggtggcacggccagggtccggagatggagactctgaccagtctaggaatcgacagggcaccccggtgcccgctagtggccaggctgctgcctacaagcagactaaggcccaacgcgctaggacaatggctctatataaccctattcccgtgagacagaactgtttcaccgtgaacagaagtcttttcatttttggagaagataacattgtgcgcaaatacgctaagaagttaattgactggcctccgtttgagtacatgatcctggccacaattatagccaactgtatagtgttagctcttgagcagcaccttccagaagacgacaaaaccccaatgtctagacggctggaaaagactgagccctattttatagggatattctgttttgaggcaggcatcaagattgttgcgcttggttttattttccataagggcagttatctgcgtaatggttggaatgtcatggacttcatagtggtgcttagcggcatcctggcaacagcgggtacacactttaacacccacgttgatcttaggacccttcgtgcagtacgggtccttagacctctgaaattggtaagcggtatcccaagcctccagattgtcctcaaaagcattatgaaggccatggttcctttgttacagatcggtctcctcctttttttcgccatcctgatgttcgctataatcggcctcgagttttatagcgggaaattacacagggcatgttttatgaataatagcggcatacttgaaggttttgatccacctcacccttgcggtgtgcagggatgtccggccgggtacgaatgcaaggactggatcggccctaatgacggtataacccagttcgacaatatactgttcgctgttctgactgtattccagtgtataactatggagggatggaccaccgtgttgtacaacactaatgatgccctgggcgctacctggaactggctctactttattccgcttattattattggatcattcttcgtgctcaaccttgtcctgggcgtcctctcaggggaatttgcaaaggagcgcgagagagtcgagaaccgcagggccttcatgaaacttagaaggcagcagcagattgaacgcgaactcaatggctatagagcatggatcgataaagcagaggaggtaatgctggctgaggagaataaaaacgccgggacctccgcgctggaggtgttgaggagagcgaccattaagcggtctcgcaccgaagcgatgaccagggattcgtctgatgaacattgcgtggacatctcctccgtgggaacacccctggctcgcgcatccatcaaatccgccaaggtggacggagtgtcttactttagacacaaggaacggctgcttcggataagcattaggcatatggtgaagtctcaggtgttttattggatcgttctgagcttggtggccctgaacaccgcttgcgtagctattgtacaccacaatcagccgcagtggttaacccacttattgtactatgccgagtttctttttctcgggctttttctgctggaaatgagcttaaagatgtatggcatggggccgagactgtacttccattcatcatttaattgcttcgatttcggcgtgacggttggctccatatttgaggtggtgtgggctatcttcagaccaggcaccagcttcggaatcagtgttctgcgggctcttcggctactcaggatttttaagatcactaagtactgggcatccctgaggaacctcgtggtgtccctgatgtcatcaatgaaatcgatcatcagcctgttgttcctgttgtttctcttcatcgttgtgttcgctctgctgggaatgcagctcttcggaggaaggtttaatttcaacgacggtacgccaagtgctaacttcgacacctttcccgcagcaataatgaccgtgtttcagatattaaccggcgaggactggaacgaggtgatgtacaacgggattaggtctcagggtggagtatcatccggaatgtggtctgccatatacttcattgtactgaccctcttcggaaactacacactgctgaacgtttttctcgccatcgctgtggacaatctggcaaatgcgcaggagcttactaaagacgagcaagaggaagaggaagcttttaaccagaaacatgcactccaaaaggcgaaggaagtttctcccatgtcagccccgaacatgccttccattgaacgcgagcgaagaagaaggcaccacatgagcgtgtgggaacaaaggacatctcagcttcggaaacacatgcaaatgtcttcccaggaagcactgaaccgggaggaagctcctacaatgaatccactcaaccctctcaaccccttatccagcctgaatccccttaacgcccatccatctctctaccgccggcctcgagccattgagggcctggccttgggattggcgctggaaaagttcgaagaagaacgaattagcaggggtgggagccttaaaggagacggtggcgaccggagcagcgctctagacaaccaacggacacctctgtcactcgggcagcgggagcccccctggctcgcccgaccctgccatggcaactgcgatccaactcagcaggaggctggcggcggcgaagccgtggtgacatttgaagaccgtgctcgccatcgccaatcacagcgtcgaagccggcacagaagagtgcggaccgagggcaaggaatcttcgtccgctagtaggtctcggagtgcaagccaagagcgctcattggacgaggccatgcctacagagggggagaaagatcacgagctgagaggcaaccacggcgctaaggaacccaccatccaggaggaacgcgcccaggacctgcggcggacgaattctttaatggtgtcccggggcagcgggctggccggaggcctagatgaagccgacacccccttggttttaccccatcctgagttggaggttggcaagcacgtcgtgttgaccgagcaggagcctgagggttcgagcgaacaggctcttcttggcaatgtgcagcttgacatgggacgggtgatcagtcaatccgagcctgacctatcttgtatcactgctaacaccgacaaagccaccactgaatcgacctctgtgactgtcgcaatccctgacgtggaccccctcgttgatagcaccgtggtgcatatatccaacaagacagatggggaagcaagtcccctgaaggaagccgagattcgggaagacgaagaggaagtggagaagaagaaacagaaaaaagaaaaaagagaaaccggcaaggctatggtgccgcactcgtccatgttcatcttctccacaactaaccccattcgaagggcgtgtcactatattgtcaatctccgatatttcgaaatgtgcattctactggtcatcgccgcctcctccattgcgcttgctgccgaagacccggtgctgaccaacagcgagaggaacaaagtattacgttatttcgattacgtgttcaccggcgtcttcacgtttgaaatggtaataaaaatgattgatcaaggccttattctgcaggacggaagctactttagggacctttggaacattctggattttgtggtggttgtgggcgccctggtggcattcgccctggctaacgccctcggtacaaataaaggccgggacatcaaaaccattaagagtctccgtgtcttgcgcgtgctccgccccctgaagactattaagcgactccctaagctcaaggccgtatttgactgcgtggtgacatccctgaaaaacgtgtttaacatactcatagtatataagctgttcatgttcatcttcgctgtaattgccgtgcagctgttcaagggcaaattcttttattgcactgattcatctaaagacacagaaaaggagtgcattgggaattatgtagaccatgagaagaataaaatggaggtcaagggtcgagaatggaaacggcacgagtttcactatgacaatattatatgggcactgttgacgcttttcactgtgagcacgggcgagggatggccacaggtgcttcagcactccgtagatgtgactgaagaggatagaggaccgagcaggtcaaatcgaatggaaatgtccattttttacgtggtgtacttcgtggtgtttccattctttttcgtgaatatttttgtcgccctcatcattattacttttcaggaacagggtgacaagatgatggaggaatgttctctggagaagaacgagcgagcctgtatcgactttgctatctccgctaaacccctgacacgctatatgccacagaacaggcacaccttccaataccgggtttggcactttgttgtctccccctcctttgagtatactatcatggcaatgattgctttgaacaccgtggtccttatgatgaaatactacagtgcaccttgtacttacgagctcgcactgaaatatctcaacatagctttcactatggtcttttctttagaatgtgttcttaaagtgattgcctttgggttcctgaactattttagagatacatggaatattttcgactttattacggtgatagggagtattactgagattatcctaacggattccaaactggtaaacacttcgggattcaatatgtcatttctgaaactctttcgcgcagcccggcttatcaaactgctgcgtcagggatacactattagaatcctgctatggaccttcgtccaatcatttaaagcactgccctatgtgtgcctgctcattgcgatgctgttctttatctatgcgatcatcggcatgcaggtcttcggcaatatcaagctcgacgaagaatcgcacatcaatcggcacaacaatttcagatcattcttcggatctctgatgcttttattccgctctgctaccggggaagcatggcaggagattatgctaagctgcctgggggagaaaggttgcgagcctgacacaactgcaccgagcggacaaaacgagaatgagaggtgcggaacagacctggcctatgtgtactttgtgtccttcattttcttctgctcgtttcttatgctcaatctattcgtagccgtaatcatggataatttcgaatacctgaccagagattcatcgattcttggtccacatcaccttgatgagtttgtccgagtgtgggccgaatacgatcgggctgcctgcggaagaattcattatacagagatgtacgaaatgctcacactgatgtcccccccactaggccttggaaaacgctgtcctagcaaagtggcatacaaacgcttggtactgatgaatatgcccgtggctgaggatatgactgtccactttacgtcaaccctgatggccctaatccgcactgctctggatattaagatagccaagggtggagctgatcgccagcagttggacagcgagctacaaaaggagaccctggccatttggccccacctgagtcagaagatgctggacctcttagtcccaatgcccaaggcttcggatctcaccgtgggcaaaatttacgccgccatgatgattatggattactataagcagtccaaagtgaagaaacagaggcagcagctggaggagcagaagaacgcccctatgtttcagaggatggagccttcctctcttccccaagagataattgcgaatgccaaggcgctgccatacctgcagcaagaccctgtcagcgggcttagtgggcgcagcggctatccgtccatgagccctctttcacctcaggatattttccaactggcctgcatggatccggcagatgatggtcaattccaggagaggcagtcattagttgtcaccgatcccagttccatgaggcgatctttcagtacgatcagagataaacgttctaattccagctggctggaggaattctctatggagcggagttctgaaaacacatataaaagccgaagacggtcctaccacagttcgcttaggctctccgcgcacaggctaaactctgacagcggccataagtccgacacacatcggtccggaggtcgtgaaagaggacggtctaaggagcggaaacatctgttatctccagacgtcagccgctgcaattccgaagagagggggacccaggctgattgggaatcccctgaaagacggcagtccagaagtccgtccgaagggaggtcacagacaccaaacagacaagggacgggctccctgtctgagtcttctattccaagcgtgtccgacactagtacaccacgccgaagcaggagacagcttccgcctgtgccaccaaagccacgcccattgctgagctacagcagcctgatacgccatgcaggctcaataagcccaccagctgacgggtccgaagaaggctctccattaacatctcaggcactggagtccaacaacgcttgtctgaccgagagtagcaacagcccccacccccagcagtcccagcacgctagtccccaacgttatatctctgaaccttatctggccttacatgaggactcacacgccagtgactgcggtgaggaggagaccctgacctttgaggccgctgttgccacctctctggggcgctccaacacaatcggctcagcacctccattgaggcacagttggcaaatgccgaacggccactacaggcggcgtcggcgagggggcccgggtcccggaatgatgtgtggtgcggttaacaacctcttatcagatactgaagaggatgacaaatgctag

SEQ ID NO: 110471 - DNA, 7062 bp, Artificial Sequence
  Description of Artificial Sequence: Synthetic coding sequence
atgaccgagggcgccagggccgctgatgaagtccgtgttcccttaggcgcaccaccgcccggacctgccgccctggtgggagcatctcccgaaagccccggtgccccaggcagagaggctgagagaggcagtgagctcggggtcagtccgagtgagagtcccgcagctgaaaggggagctgaactgggtgccgatgaagaacagcgggtgccctatccagcattggctgctaccgtatttttctgtctcggccagacaactcgaccccggtcatggtgcctacggcttgtgtgcaacccttggttcgagcatgtatctatgctggtgatcatgctcaactgcgtgaccttaggcatgttcaggccttgtgaggatgttgaatgcggcagcgagcggtgtaacatcctggaagcattcgacgctttcatttttgcgttctttgctgtggaaatggtgattaagatggtcgcccttggtttgttcggccagaagtgctatctcggtgatacctggaatagattagatttctttattgtggtagccgggatgatggaatatagcttagacgggcacaatgtatccctgagtgctatcagaacagtgcgcgttctgagacctctgagggccatcaatcgggtcccgtctatgcggattctggtaacacttctgttggacaccttgccaatgctgggtaatgttctactgctctgcttttttgtgttctttatctttgggatcgtgggagtgcagctctgggctggactgctgaggaatagatgctttctagatagcgctttcgtcagaaataacaaccttactttcctccgcccatactaccagacagaggagggggaggaaaatccatttatttgttccagtcggagggataatggtatgcaaaagtgtagccatatcccaggtcgaagggaactccggatgccatgtactctgggctgggaggcttacacacagcctcaggcggaaggggtcggtgctgctagaaatgcctgtataaactggaaccagtattacaatgtttgccggtctggggattctaatcctcacaatggcgcaatcaattttgataacattgggtacgcctggatagccattttccaggttatcactctcgaagggtgggtagacatcatgtactacgttatggacgcacactccttctacaattttatctatttcattcttctgatcattgttgggtcgtttttcatgatcaacttgtgcctggtagtaatagcaactcagttttccgagactaagcaacgcgaatcccagctgatgcgggagcagcgtgccagacacttgagcaacgattctactcttgcctccttttccgagcccggctcatgttacgaagaactgctcaaatatgtgggacacatctttaggaaggttaagcggcggtcgctgcgcctgtatgcaaggtggcagtctcggtggaggaagaaagtggaccccagtgcagttcagggacaggggcccggccacaggcagagacgcgcggggcgccacaccgcatcagtgcaccatctggtataccatcatcaccatcaccaccatcaccattaccattttagccacggaagcccgcgcagacctggaccagagcccggcgcatgcgacacaaggcttgtgcgtgccggagcgcctccctcccctccttcccccggacgcgggccacctgacgcagaatctgtgcattcaatctaccacgcggattgtcacatcgaggggccacaggaaagagccagagtggctcacgctgcagccaccgcagcagcctcccttagattggcaactggcctgggcactatgaactaccctaccatactcccttcgggggttgggtccgggaaaggcagtaccagcccaggccctaaaggcaagtgggccggtggcccgcctggtacaggcgggcacggacctctttcgcttaactctccggatccctatgagaaaattccccacgtggtcggagagcacgggctaggccaagcccctgggcacctgtcgggtctaagtgtgccatgcccactgcccagccctccagcaggtactttaacatgcgaattaaaatcttgtccttactgtacgcgtgcgcttgaggaccccgagggggaactgtccggatccgagtccggcgactcggatgggcggggcgtgtacgagttcactcaggacgttaggcatggtgatcggtgggaccctacccggccaccgagagccaccgacaccccgggtcccggccctgggtcacctcagaggagggctcaacagagagcggctcctggcgaacctggatggatgggtcgcttgtgggttaccttcagtggcaaactgagaaggatagtggactctaagtacttctctcgggggatcatgatggcgatccttgtcaacacactgtctatgggggtagagtaccacgagcagcctgaggaacttacaaatgccctcgaaataagtaacattgtttttacctctatgttcgctcttgagatgttattaaaactcctggcctgtggccctctgggctacatacgtaacccctataacatttttgacgggataatcgtagtcatcagcgtatgggaaattgtcggccaggcagacggcggtctgtctgtccttcgcacttttaggctgcttagggtgcttaagcttgtccgctttctgcccgccttacgacgccagctggtggtgctagtgaagaccatggacaatgtcgctacattctgcacacttctgatgctgttcatcttcatcttttcaattctgggcatgcatctatttggctgtaaattttctctcaagacagatacaggcgacactgttcccgacaggaagaatttcgattcacttctgtgggctatcgtaactgtattccaaatcctgacccaggaagattggaacgtggtgctgtataatggcatggcaagtacgtcaagctgggcagccctctatttcgtagccctcatgaccttcgggaattatgtgttatttaatctgctggtggcaatcctcgtggaaggattccaggcagagggggacgccaaccgctctgacacagacgaagataaaacaagtgttcattttgaggaagattttcataagctgagggaactgcaaacaactgagttgaagatgtgtagccttgccgtcactcccaatggccaccttgagggcagagggtccctgagtcctcctttaattatgtgcaccgccgccacccctatgcctacgccaaagtccagcccgttcttggacgccgccccttccctgcccgacagcagacgagggtcgagtagcagtggcgatccacccctgggggatcagaaaccacccgcttctctgcgctcttccccctgtgccccctggggcccctctggagcatggagctcccgtcgcagcagctggtcatccctgggaagggcgccttccttgaaaagaagaggccagtgcggggaacgggaatctttactgtccggggagggaaaaggatcaactgacgacgaggccgaagacggcagagccgctcccggccccagggccaccccactgcgcagagccgaatccctggacccacggccccttcgacctgcggcgctgccccctacaaagtgcagggacagggacggccaagtggtggccctgcctagcgacttttttctgaggatcgatagtcatcgagaggatgctgcagagctcgatgatgactctgaggatagctgctgcctcaggctccataaagtcctcgagccttataaaccccagtggtgtcggtcgcgggaggcctgggccctctacctgttttcgccccagaacaggttccgcgtctcatgtcaaaaggtgattacccacaaaatgtttgaccatgtcgtgttggtgtttatctttctgaattgtgttacaatcgcactcgaacgcccagacatcgaccccggctccaccgaacgagtatttctctccgtgtccaattatatttttactgccatttttgtggctgagatgatggtcaaggtcgttgctttaggactgttgtccggcgagcacgcttatctgcaatcatcctggaacttgctcgacggactgcttgtactggtcagcctggtggacattgtcgtggccatggcatctgctgggggagcaaaaatacttggcgtgttgcgggtattgcgattgctcaggacattgcgacccctgagagtcattagtcgggcccccggcttgaagcttgtggtggagaccctgatctctagcttgcggcctatcgggaatattgtcttgatctgctgtgccttttttatcatctttggaatactgggagtacagctgtttaaaggtaaattttattattgcgaaggaccagacactaggaatatatctactaaggcacagtgcagagcagcccattatcggtgggtgagaagaaaatacaactttgacaacctcggtcaagccctgatgagtctgttcgttctaagttctaaggatggctgggtgaacatcatgtatgatggcttggatgccgtcggcgttgaccagcagccagtacaaaatcacaacccgtggatgctgctgtatttcataagctttttgctgatagtctcattttttgtgcttaacatgtttgttggcgttgtggtggagaatttccacaagtgccggcaacaccaggaggccgaggaggccagacggcgggaggagaaacgtctgaggcgtctggaaaggcggagacgaagcaccttcccaagtccggaagcccagaggaggccctattacgcggactattcccctaccaggcgcagtatacattcactgtgcactagccactatctggacctctttatcactttcataatttgtgtgaacgtgattacaatgtccatggagcattacaaccagcctaaatccctggacgaggcccttaagtattgcaactatgtctttacaatcgtgtttgtttttgaggccgcactgaagttggttgcattcggattccgcaggtttttcaaggatcgatggaatcagctcgacctggcaatcgtgctcctgagcttgatgggcatcaccctggaggagatcgaaatgtctgccgctctgcctatcaaccccactataatccgaatcatgagagtcctgcggatcgctcgcgtcctgaaactgctgaagatggcaacaggaatgagggccctcctggacacagtggtgcaggcgttacctcaggtaggcaacctgggcttgctgttcatgctgctcttcttcatttacgctgctctaggagtggagctgttcggaagattagagtgctctgaagataacccctgtgaaggtctttctcgccacgcaaccttttctaactttggaatggccttcctgacacttttcagggtctcgactggagacaactggaatggcattatgaaggacacgctacgagaatgctccagagaagacaaacactgtctctcttatctgcctgccctctcgccggtgtactttgtgacattcgtgctggttgctcaattcgtgctggtgaatgtggtcgtggcggtcttaatgaaacacctcgaagagtcaaacaaggaagcgagggaggacgctgaactcgacgcagagatcgaactagagatggcccagggtccagggagcgcaagacgggtagatgccgatcgaccccctctcccgcaggaatctccgggggcgcgcgatgctcctaatcttgtggcgcgtaaagtgagcgtttctaggatgctgtctctgcccaatgattcatacatgtttagacccgtcgtgcctgctagcgcccctcatccaagacctttgcaggaagtggaaatggagacttatggtgcaggcactccactaggatcggtggcatctgtgcatagcccccccgccgaatcatgtgctagcctgcaaattcccctggccgtatctagtccggctagaagcggcgagccgctgcatgccctgtcccccagggggactgctcgaagccccagtctatcccggttgctgtgtagacaggaggctgtgcacacagactcattggaggggaagattgatagccccagagacaccctagaccccgctgaaccgggcgagaagacgcctgtaagaccggtaacccagggcgggtctttacagagtccaccccgaagcccccgccccgcttccgtccgcaccagaaagcatacttttggacagcgctgcgtttccagccgtcccgctgcacccggtggcgaagaggctgaggcttctgatccagctgacgaggaggtctctcatattacctcgtctgcttgcccctggcagcctacggccgagccgcacggtcccgaggcatcaccggttgccggcggagaaagggatcttagacggctttatagcgttgacgcccaaggtttcctggataagcccggccgggccgatgaacaatggaggcccagtgcggagttaggcagtggggagccgggagaagccaaagcgtgggggcccgaggcagaaccagctctgggagcgcgccgtaaaaaaaagatgagtccaccctgtataagcgtggaacccccagccgaagacgaaggatccgcacggccttcagctgccgagggaggctcaactacgctcagacgcaggacgccttcgtgtgaagcaactcctcacagagattccctcgagcctaccgagggtagtggcgctggcggtgaccctgccgccaagggtgaacgttggggacaggcctcctgcagggctgagcacctgaccgtcccctcatttgcatttgaacccttggatctcggcgtgcccagcggcgatccattcctcgatggcagccattctgtcacccccgagtcacgcgcaagctccagtggagccatcgtgccactggaaccccccgagagcgagcctcccatgcctgtaggtgatcctccagagaagaggagagggctttacctcaccgtccctcaatgcccgcttgagaaaccaggcagccctagcgccacaccagctccgggtggcggagctgacgacccggtgtag

SEQ ID NO: 110472 - DNA, 7044 bp, Artificial Sequence
  Description of Artificial Sequence: Synthetic coding sequence
atgactgagggagctagagctgcagacgaggtccgggtcccccttggcgcccccccacccgggcccgcagccttagtcggggcctcccctgagtctccaggcgctccggggcgagaagctgaaagaggctctgagcttggagtgtcacctagtgaaagccctgccgctgagagaggcgctgagttgggtgccgatgaggagcagcgggtcccctatccagccctcgccgcaaccgtgttcttttgcctagggcaaaccactaggcccaggtcgtggtgcctacgattggtgtgcaatccttggtttgagcacgtaagtatgctggtaatcatgttgaactgcgtgactttagggatgttcaggccctgcgaagatgtcgagtgcggttccgagcgttgcaacatactggaggcctttgacgccttcatctttgcctttttcgccgttgagatggtcattaagatggtagccctggggttgttcggacagaagtgttacctgggcgacacgtggaataggttagatttttttattgttgtggccggcatgatggagtattccctcgatggccataatgtttcactgtccgccatccgaacagtgcgtgtgctgaggcctctccgggccataaaccgggttccatccatgaggatcctagttacactgttgctggacactcttccaatgctaggaaacgtgttactcctttgtttttttgtgtttttcattttcggcattgtaggagtgcaactttgggcggggctgctccgaaaccggtgtttcctagattctgcgtttgttcggaataataacctaacatttttgcgcccatactatcagacagaggagggggaagaaaacccctttatttgctcatccagacgcgacaacggcatgcagaagtgctcccacatcccaggacggcgagagttgcggatgccctgcacactcggctgggaggcatatacccagccgcaggccgagggtgtgggtgcggcccggaatgcctgcatcaattggaaccagtactacaatgtgtgccggtccggcgactctaaccctcataacggcgcgattaactttgacaatattggatacgcatggatagctattttccaggtgattactcttgagggatgggttgacattatgtactacgttatggacgctcacagcttttataatttcatctactttattttgctcatcattgttggctctttctttatgataaatctctgtttggtagtgatcgcgacccagtttagcgaaactaagcagagggagtcccaactgatgagggagcagcgcgcccgccacttgtccaacgattcgacgctagcatccttcagcgaacccggatcgtgttacgaggagctgctgaagtacgtcgggcacatcttccgcaaggtaaagagacgcagcctccgtctgtacgctagatggcagtcccgatggcggaaaaaagttgacccctcagccgtccagggccaaggccctgggcataggcaacggagggcaggccgacatactgcctccgtgcaccacttggtgtaccatcaccatcaccatcaccatcatcactaccacttcagtcacgggtcccctcgaagacccggcccagaacccggcgcgtgcgacactagactcgttcgggcaggcgcaccaccctctcccccctcccctggcagaggaccacccgacgctgaatccgtccactccatttatcatgctgattgccacatcgaaggccctcaggaacgagcacgggtcgcacatgctgcggctactgctgccgcctctttgaggctggccactggccttggcaccatgaattatcctactatcctgccctcaggtgtggggtccggtaagggttctactagcccagggcctaaggggaaatgggcagggggccctccaggcaccggtggccatggaccactcagcctgaacagccccgacccatatgagaagatccctcatgttgtaggcgaacacggcctggggcaggcccccgggcacctgagcggcctaagtgtgccttgtccacttccatccccgccggctggcacgctcacgtgcgaacttaaaagctgcccatactgtaccagagcactggaggatcctgagggagagctcagtggcagcgagtccggagacagcgatggcagaggggtctacgagttcacccaggatgtaaggcatggagaccggtgggatcccacccgcccacctagagcgacagatacccccggtccggggcctggatcccctcaacggcgcgcccagcagagggcggccccaggcgaacctggatggatgggtcgtctgtgggtcacttttagcggaaagctgaggcgcatcgtcgactctaagtatttctcccgcggaattatgatggcaattttggttaacacgctctccatgggcgtcgagtaccatgaacagcctgaagagctcaccaacgccctcgaaatctctaacattgtattcaccagtatgtttgctctagagatgttgttgaagctgctcgcatgcgggcccctggggtatatccgcaacccctacaatatcttcgacgggattatagtagtgatttcggtgtgggaaattgttgggcaggctgatggcggcttgagtgtactgcgaacctttaggctcttgcgagttctgaagctggtgaggttcctgccagcactgcgcaggcagctagttgtgctggttaagaccatggataatgtagccaccttctgcactttgttgatgctctttatattcatatttagtatcctcgggatgcacctcttcgggtgtaaattctccctaaagactgacacaggagataccgtccccgacagaaaaaactttgatagtctgctgtgggctatcgtgactgtcttccaaatcctcacgcaagaggattggaatgttgttctgtacaatggaatggcatctacgtcctcttgggccgcattatattttgttgcactcatgacttttggaaactacgtgctatttaacctcctggttgcgattctggtcgaaggctttcaggctgagggtgatgccaaccgcagtgataccgatgaagacaagacaagcgttcacttcgaagaggatttccataaactccgggaacttcagacaacagaactgaagatgtgttccctagcagttactcccaacgggcatctggaaggccgtggcagcttaagtcctccactgatcatgtgtactgcggctaccccgatgccaactcctaagtcaagcccctttctggatgctgccccaagccttcctgactcaaggagaggcagcagctcttccggggacccacccctcggtgaccagaaaccacccgcctcgcttaggtcctctccctgtgccccttggggccctagcggggcatggtcctcaaggcggagctcctggagctctcttgggcgggccccatcccttaaacgccgcggtcaatgcggggagagagaatctttgctgtctggagaaggaaagggctccacagacgacgaggccgaggatggtcgggcggcgcctggcccacgagcaacccctctgaggagggcggagagcctggacccacgtcctcttcgtcccgcggcactgccacctaccaagtgtcgcgatagggacggtcaggtggttgcactcccgtccgatttttttctacgcattgattcccatcgtgaggacgctgctgagctggacgacgattccgaggactcctgctgtttaaggctccacaaggtgcttgaaccctacaaaccacaatggtgcagatcgagggaagcttgggcactttacctctttagtccccaaaacaggtttcgtgtatcttgtcaaaaggtgattacgcataagatgtttgatcacgtggttctcgtcttcatctttttgaactgcgtcactatagcgcttgagcgacccgatattgatccgggatctaccgaaagagttttcctgtcggtgagtaactatatcttcacagccatctttgtggctgaaatgatggtcaaggtcgtggctcttggtctcctgtctggggaacatgcctacctgcagagcagctggaacttactggacggactgctggtgcttgtgtctctcgttgacatagtggtcgctatggcatctgctggaggagcgaagatacttggtgtgttacgggtgctccgactactgcggactctgcgaccgctgagagtaatcagccgagcacctggattgaagctggtcgtcgagacccttataagcagtctacgccctattggcaatatcgtgctcatctgctgcgccttttttattatcttcggcatcctcggcgtgcagttgtttaaaggaaagttttactactgtgagggcccagatactagaaatatctccacaaaggcacagtgtcgcgcggcccattatagatgggtgcgaagaaaatataactttgacaatctgggacaggctctgatgtctctgtttgtcctgtcttccaaggatggatgggtcaacatcatgtatgacggccttgacgccgtcggtgtagaccaacagccagtgcaaaatcacaacccctggatgttactctattttattagcttcctgctgattgtgtctttcttcgtcctcaacatgtttgtaggggtggtggtagagaattttcacaaatgtaggcagcatcaagaagccgaagaggcccgtagaagggaggaaaaacgtctccgaaggctggagcggcgcagaagaaaggcccagagacgtccatattatgcagattacagccccactaggagatccattcactctctgtgcactagccactacctcgatctcttcataacctttatcatctgcgtcaatgttatcactatgtcaatggagcattacaaccagcccaaatctttggacgaggccctaaagtactgtaactacgtttttaccattgtattcgttttcgaggctgcactcaaactcgtggccttcggcttccggcgcttcttcaaagacagatggaaccaactcgacctagccatcgttctcctttctctgatggggattactctggaagagatcgagatgtccgccgccctccctatcaaccccacaatcattaggataatgagagtgctaaggattgcacgggttctgaagctgctgaagatggccaccggcatgagggcgcttctagataccgtagtgcaggcactgccacaggtaggcaatttgggtttactgtttatgttgctcttctttatttatgcagccctaggggtggagctcttcggacgactggagtgcagcgaagacaacccttgcgaaggattatcccgacatgctaccttttctaattttggcatggccttccttaccctttttcgggtttctaccggagacaactggaatggcattatgaaggatacgctgcgggagtgctctcgtgaggacaaacattgtctgtcatatctgccagccctgtcgcctgtatatttcgtgacctttgtcctggtggctcagttcgttttggtaaatgtggtcgtcgcagtgctaatgaagcacttagaggaatctaacaaggaagcacgggaagacgcagagttggatgccgagatcgagctagagatggcacagggaccaggctcagccaggcgtgtggatgccgacaggccccccttgccacaggagtctcccggagcgagagacgctcccaacttggttgcacggaaagtcagcgtatcgagaatgctgagcctcccaaatgattcttatatgttcagaccggtggtaccggcttccgcaccacatccccgtcctttacaggaagtagagatggaaacctatggggcagggacccctctcggcagcgttgcctccgtgcatagtccgcctgctgagagttgcgcgtccttgcaaatccctttagccgtgtcaagcccagcccggtcaggggaacctttgcacgcactgagcccacgaggtaccgcccgatccccttcactgtcacgtctattatgccggcaggaggccgtccatacggactctctcgaaggtaaaattgatagcccgcgcgacacacttgatccggcagagcctggtgagaaaacccctgtgcgcccggtgacccagggaggctctctgcagtccccaccccgaagccctcgaccagcatcagttcgaacgaggaaacacacttttggacagaggtgtgtgtccagccgccccgctgcccccggaggagaggaggcggaagcttccgacccagccgacgaagaagtctctcacatcacaagctcggcctgtccttggcaacctactgctgagccccatgggcccgaagcaagtccagtggctgggggagaacgtgacctaaggcgtctctattccgttgatgcacagggattcttggacaagccgggcagggccgacgagcaatggcggccctccgccgagctcggctctggcgagcccggggaggccaaagcatggggacccgaggcagagcccgcactgggcgctcgccggaaaaaaaagatgtctcctccctgcatttctgtcgagccccctgccgaggatgaaggaagcgctcgaccgagtgcagctgaaggaggctctactactctccggcgtagaacgcccagctgcgaggcgaccccccaccgtgattctctcgaacctaccgagggttcaggtgctgggggagatcctgcagccaagggggagcgctgggggcaagctagttgccgggccgagcatttgacagttccgtcttttgctttcgaacccctcgatctgggcgttccatctggagacccattcctcgacggttcccacagcgttaccccggaatctcgggcgagcagtagtggcgccatcgtgccattagagccacccgaaagcgagccacctatgcccgtcggcgaccctccagagaagcgtagaggcctgtacttgacagtgccgcagtgcccgctggagaaaccaggcagcccctcagcaactcccgcaccaggaggcggagccgacgacccagtgtag

SEQ ID NO: 110473 - DNA, 6690 bp, Artificial Sequence
  Description of Artificial Sequence: Synthetic coding sequence
atggcagagtcagctagcccacccagctcttccgccgcggccccagctgcggagccaggggtcaccacagaacagcctggtcctcgctctccaccatcctcaccacccggcctagaggaacccctagacggcgccgatccccacgtgccacaccctgatctggcacctatcgcatttttctgcttgcgccagaccacctctccacgtaattggtgtatcaagatggccactggcccttggtggtggtgtctgtgcatgctggtgatcctgctgaactgtgttactctcgggatgtatcaaccctgcgacgatatggattgtttatccgaccggtgcaaaattctgcaggtgtttgacgacttcatcttcatcttcttcgctatggagatggtcctgaagatggttgctctcggtatcttcggaaagaaatgctatctcggggatacatggaacagactggactttttcattgtaatggctggcatggtggagtattctctggatttgcagaacatcaatctctctgccatccggactgtgcgggtgctgagaccactcaaggcgatcaatcgggtgcctagcatgaggatcttagtgaatttgctactagacacgctcccaatgctgggaaacgtgctgttgttgtgcttcttcgtcttttttattttcggaattataggagtgcagctgtgggctggcctgctccgcaaccgatgttttttggaggagaactttacaatacagggagacgtggccctgccgccatattaccagcccgaagaggacgacgaaatgccattcatttgttcactctctggcgacaacggtataatgggatgccacgaaatacccccactgaaagagcagggcagggagtgctgtctcagcaaggacgacgtgtatgacttcggagcaggacggcaagacctgaatgcctctgggctgtgtgtaaattggaataggtactacaatgtctgccgaaccggaagtgcaaatcctcataaaggggccattaattttgataatatcgggtacgcatggattgtgatcttccaagtgattaccctggagggttgggtagagatcatgtactatgtgatggacgctcactccttctacaactttatttactttatcctactcatcatagtcgggagcttcttcatgataaatctttgcctcgtcgtcatcgccactcagtttagtgagaccaaacagcgggaacaccgattaatgcttgaacaacgccagcggtatctgtcttccagcacagtcgcctcttacgcagagcccggtgattgctacgaagagatttttcagtatgtgtgccatattcttaggaaagcaaaaagaagggctctcggcctgtatcaggccctgcagtctcggaggcaagcgctaggccccgaagctccagcccctgccaagcctggccctcatgctaaggagccccgtcactatcacggaaagaccaagggccagggtgatgagggccgccacctggggagtcgacattgtcagactttgcacgggcccgcctcaccgggaaatgaccattccggccggggaaaaccaggacccagagagctgtgtcctcaacatagccccctggacgccacaccccacaccctggttcaaccaataccagcgactctggcttcagatccggcttcatgcccgtgctgtcaacacgaggacgggcgcagacctagtggccttgggtccaccgatagcggacaggaagggtccggatccggaagtagtgcaggcggcgaggacgaggcggatggcgatggggcccgcagtagcgaggatggcgccagtagcgagctgggtaaagaagaggaagaggaggaacaagccgatggtgccgtgtggctgtgtggcgatgtgtggagagagaccagagcaaagctccggggtattgtggattccaaatatttcaacagagggattatgatggccattctggtcaatacggtctccatgggaatcgaacatcatgagcaagccaatgaattgactaatatcctcgagatctgcaatgtggtcttcaccagcatgtttgcacttgaaatgatcctaaagctggcagcctttggtttgttcgactatctacgtaacccatataatatcttcgacagcataattgtcattatttcaatctgggagatcgtgggtcaggccgatggcggactgagcgtactaagaacatttcgactcctccgggttctaaagttggttcgtttcatgccagccctgagacgccagctggttgttttaatgaagacaatggacaacgttgccacattttgtatgctgcttatgctattcatctttattttttctatcctcgggatgcatattttcggatgcaagttcagtctgcggaccgacacgggggatactgtacccgaccggaaaaattttgattcgttgctttgggctatcgtgacagtgttccagatcctgacccaagaggattggaacgtggtcttgtataacggtatggcaagtacttccccctgggcttctctgtacttcgtggcccttatgaccttcggaaactacgtgcttttcaatctgcttgtcgcaattttagtcgagggattccaggctgagggcgacgctaatcggtcctacagtgacgaggaccaatcgtctagtaacatcgaggagtttgacaagctgcaggagggccttgattcgagcggggacccaaagttatgccccattccaatgactcccaatggccatttggatccgtcgctgccgctcggcggccatttaggacccgccggcgctgctggacccgcccctagactgtcgctgcaacctgacccgatgctggtggcactgggctcccggaaatcctctgtgatgagcctgggtaggatgtcctacgatcagagatcgctgtcctcttctagatcgtcctactatggcccctggggcagatccgcagcctgggcgtctcgcaggtcctcctggaatagtcttaagcacaagccaccaagtgccgagcacgagtctcttctgtcagccgaaagaggagggggggcccgagtatgcgaagtggctgcagatgaggggccgcccagggccgcccctctgcacactccacatgcgcaccatattcaccacggcccacacctcgctcaccgacatcgtcaccatcgacggactctttcactggacaaccgcgactccgtagatctcgctgaacttgtgcccgccgtgggggcacaccctcgagccgcatggagagcagctgggccggctcccggccacgaggactgcaacggacgcatgcctagcatagctaaagacgtgttcactaagatgggcgacaggggagaccgcggcgaggatgaagaggaaatagactacacgttgtgtttccgcgtgaggaaaatgatcgatgtttacaaaccagactggtgtgaggtgagggaggattggtctgtgtacctgttttcccccgaaaaccgatttcgtgtgctgtgccagactatcattgcccacaagctcttcgattatgttgtactagcctttattttcctaaactgtattacgatagcgctggaacgaccgcagatcgaggccggcagcaccgaaagaatcttcctgaccgtcagtaactatattttcacagcaatcttcgttggcgagatgacgctgaaagtggtcagtctgggcctgtatttcggcgaacaggcctacctgagatcttcatggaacgtgctcgatggctttcttgtgtttgtttctattatcgatattgtcgttagcctggcctccgctggtggggcaaagatcctgggggtgctgcgggttctgcgcctcctccggactctgagacctcttcgggtgatcagccgtgctccagggctgaaacttgtggtcgagacgttgatcagttcactgaaaccaataggaaacatagtgcttatctgttgtgctttctttatcatttttggcatcctgggagtgcaactgttcaagggaaagttctaccattgtttgggggttgacactaggaacatcacgaaccgctcggattgtatggccgctaattaccgctgggtgcatcacaagtacaatttcgacaatttgggacaggccctgatgagcttgtttgtgctggcctccaaagatggctgggtgaacattatgtataacgggctggacgccgtggcagttgaccagcagccggtaaccaaccacaacccttggatgttgctctatttcatatccttcctgctaatagtaagctttttcgttctaaacatgtttgtgggagttgtggttgaaaacttccacaaatgcaggcagcaccaggaagctgaggaggcgcggcgtcgcgaagagaaaagactgcggcgcctggaaaagaagagacgcaaggctcagaggctcccctactatgccacctactgccacacccgtctgctcatccatagtatgtgtacatctcattatctggatattttcattacgtttatcatctgtctgaatgtggtgaccatgtcactcgagcattacaaccagccgactagccttgagactgccctgaagtattgtaattacatgtttactaccgtcttcgtgttggaggcagtcttgaagctggtggcgttcggattacgccgtttttttaaggaccgctggaaccagctggatctcgcaatcgtgctcctgagcgtgatgggcatcactctggaagagattgaaataaacgctgctttgcctattaatccaaccatcatccgcattatgcgggtgcttagaatcgcacgtgtgctgaaactgctgaagatggctaccggcatgcgggcattactggataccgtcgtgcaggcgcttccccaggtgggaaacctgggcctgctgtttatgctcctctttttcatctacgcagccctgggcgtggagctcttcggaaagttggtctgtaatgacgagaatccttgtgaaggcatgagccggcacgcaacttttgagaactttgggatggctttcctgaccttgtttcaggtctccacaggggataactggaatgggatcatgaaagatactctgcgggactgtacccacgacgaaagaagctgtttatctagcctgcaatttgtgtccccgctttactttgtcagctttgtattgaccgcacagttcgtgctaatcaacgtggttgttgccgtactgatgaagcacctcgacgattccaacaaggaggcccaagaggacgccgagatggacgcagaactggagctcgagatggctcacgggcttgggcccggtcccagactgccaacggggtctccaggtgcaccgggacgtggaccgggaggcgccggcgggggcggagatactgaaggtgggctgtgccggaggtgctattcgcccgctcaagagaatctttggttggatagtgtatccctaattatcaaggattcattagagggcgaactcacaataatcgacaatctgagcgggtccatcttccaccattattctagccccgctggatgcaaaaagtgccaccacgacaagcaggaagtgcagttagccgagaccgaagctttctcgctgaacagcgaccggagcagctcaatactccttggggacgacctaagtcttgaagatcccacagcttgcccaccaggccggaaagatagtaagggggaactcgaccccccagagcccatgagggtcggtgaccttggcgagtgtttcttccccttgagtagcaccgccgtttctcccgacccggagaatttcctctgcgagatggaagagatacccttcaatcccgttcgatcatggctgaaacatgactcatcacaggctccccccagccctttcagccctgacgcctcatcccctctgctccctatgcccgcggaatttttccacccagcagtctctgcttcccaaaaagggcctgagaaaggtacaggcactgggacacttcctaagatcgccctgcaggggtcttgggcttcacttagatctccccgggtgaattgtaccttattacgacaagctacagggtcagatacaagcctagatgcttctccctcgtcgtcagccggatccctgcagacgacactggaagattcgctaacgttatcagactcaccaagacgcgctctcggccctcccgctccggctcctgggcccagagctgggctgtctccagccgcaagaagacgattaagcttgcgaggcaggggcttgttttccctccgtggactcagggctcatcagcggagccatagcagcggagggtcaacttcaccgggctgcacccatcacgactccatggacccatctgatgaagaaggcagaggaggcgccggcgggggcggggcagggagcgagcacagtgaaacactgtcttccctgagcctcacttccctgttctgtccaccgcctcctccgccggcaccaggattgacccccgcaagaaagtttagttccaccagcagcctggctgcccccggtaggccccatgccgcagccctcgcccacggacttgcccgtagccccagctgggcagccgatcggtcaaaggaccctcctggacgcgctccactgcctatgggtctcggcccccttgccccccctcctcagcctctgcctggtgagctggagcccggcgatgctgcctccaaacgaaagagatag

SEQ ID NO: 110474 - DNA, 6567 bp, Artificial Sequence
  Description of Artificial Sequence: Synthetic coding sequence
atggctgagtccgctagtcccccttcgtcttctgccgcagccccagccgctgaacctggggttaccacagaacagcctggcccacggtccccacctagttcccctccgggacttgaggaaccactggatggtgccgaccctcacgtgcctcatcccgatcttgcacccattgcattcttctgcctgcgacagacaacatctccccgcaactggtgtataaagatggcaacgggaccatggtggtggtgcttatgcatgttggtgattttgctgaattgcgtgaccttagggatgtaccagccatgcgatgatatggattgcctcagcgatagatgtaaaattctgcaagttttcgacgactttatttttatcttctttgctatggagatggtccttaagatggtcgctttagggatcttcggaaaaaaatgctatctgggagacacatggaatcgtctcgacttctttatcgtgatggctggaatggtggaatattcacttgatctccagaacattaatctgagcgcaatacggactgtgcgcgttctgagacccttaaaagcaataaatagggtgccctccatgaggatattggtgaatctattgctcgacacactccccatgctgggaaatgtcctattgctgtgcttctttgtgttcttcatttttggaatcattggagtgcaattatgggccggtctgctgagaaataggtgctttctcgaggaaaatttcactattcaaggcgacgtcgccttacctccttactaccaacccgaggaagatgacgaaatgccattcatctgtagtctaagcggggacaatgggattatgggatgtcatgagataccccctctcaaggaacagggcagggagtgctgtctgtctaaggacgatgtgtacgacttcggagccggacgccaagatctgaacgcttccggactctgcgtgaattggaacaggtattacaacgtttgtcggacggggtccgccaacccccacaaaggggcaatcaatttcgataatattgggtatgcctggatcgtgatcttccaggtaatcacccttgaggggtgggttgaaattatgtactacgttatggacgcccacagtttctataacttcatctatttcatcctgctgatcatcgtggggtcgttctttatgattaacctctgtttggtagtgattgcgacacaatttagcgagaccaaacagcgggaacaccgcttaatgctggaacagaggcagagatacctctctagttcaacagtggcatcttatgccgagcccggcgactgttacgaagagatcttccaatatgtgtgccatatcctgcggaaagcgaagcggcgtgcactcggtctgtaccaggcactgcagagccgcaggcaagccctgggacccgaagcccctgcccccgcaaagcctggaccccatgccaaggagccacggcactaccagctctgtccacagcactcgcctctcgatgcgaccccacacacactggtgcagccgattcccgccacgctggcttctgacccggcatcttgtccatgctgccagcacgaggatggtcggagaccatctgggctgggaagtaccgacagtgggcaggaaggttccggctcgggcagcagcgctgggggtgaagatgaggcagacggagacggagcacggtcctcagaggatggcgcctcttctgaacttggtaaggaggaagaggaagaggagcaggccgacggagccgtgtggctgtgtggcgacgtttggagggagactagggctaagttgagaggcattgtagactcaaagtacttcaaccgcggcataatgatggccattctggtgaacacagttagtatgggtatagagcaccacgagcaggctacagagctaaccaacatcctagaaatctgtaatgtggttttcacgtcaatgttcgccctggagatgattttaaagctggccgccttcggtctcttcgactatctgagaaatccatacaacatcttcgactctattattgttatcatttctatttgggaaatcgtgggacaagcagatggcggtctgtctgtgctccggacattcagattgctgagggtcctgaaactagtgcggtttatgcccgccctgcgacgccagcttgtggtgctgatgaaaaccatggacaatgtcgctaccttttgcatgctgctgatgctattcatcttcattttcagtatattggggatgcacatttttggctgtaaattctcattaaggactgacacgggagatacggtccctgaccggaagaactttgatagtttactttgggcaatcgtaactgtgtttcaaatcctgacccaagaagattggaatgtagtgctttataatggcatggctagtactagcccctgggccagtctctatttcgtggcccttatgacatttggcaactacgttctcttcaatctcctagtggcaatcctggtggaagggttccaggccgagggagacgctaacaggtcttacagcgacgaagaccagagctctagcaatatagaagaatttgacaagctgcaagaaggactcgacagctcaggggaccctaagctgtgcccaattcccatgacacctaacgggcacctggacccaagtctccctctgggaggacatctgggacctgcgggtgccgcgggcccagctcctcgactatcgttgcagccagatcctatgctggtggctttaggtagccggaagtcatcggtcatgtctctgggccgaatgtcctacgaccagcgtagcctaagctcttcccggtcctcttactacggtccctggggtagatccgcagcatgggccagcagacggtcctcttggaactccctcaaacacaagcctccttctgccgagcatgaatcactgctgtccgctgaaaggggcggtggcgcaagagtatgtgaggtagcagctgatgagggcccaccccgggctgctcctctgcacaccccacacgcgcaccatattcatcatggaccgcacttagctcatcggcaccgacatcaccgccgcaccctgagccttgacaacagggatagcgtcgacctggcagaattggttccggccgtaggagcccacccacgggcagcatggagagccgccggtcctgctccgggacacgaggattgtaatggacggatgccctccatcgccaaagatgtgttcactaagatgggggatcggggagaccgaggcgaggatgaagaagagatcgattatactttatgcttccgggtgagaaaaatgatcgatgtgtacaaacccgactggtgtgaggtccgagaagattggtccgtgtatctgttcagccctgagaacaggtttagagtcctctgccaaacgatcatagcacataagttatttgattatgttgtcctggccttcatttttttaaactgtattacgattgcactggaacggccccagatcgaagctgggtccacggaaagaatctttctgactgtgagtaattatattttcacagccattttcgtaggggagatgaccctgaaggtcgtgtctctcgggctatacttcggagagcaggcctacctccgatcttcatggaacgtcttggatggcttcctggtattcgttagcatcattgatatcgttgtgtcactggctagcgccggaggagccaaaatactgggagtgctgagagtgcttagactgctaagaactttgaggccgttaagggtgatctcccgggccccaggtctcaaactagtggtggagacactaatttccagtctcaaacccatcggaaatatcgtccttatctgttgcgcatttttcatcatttttggaatcctgggagttcaactattcaaagggaaattttaccactgccttggtgtggatacccgcaacattacaaaccggtctgactgcatggctgccaattatcgctgggtgcatcacaaatataattttgataatcttggccaggccctgatgtcacttttcgtgttggcatccaaggacggatgggttaacatcatgtacaatggcctcgacgccgtcgctgtcgaccaacagcctgtaacaaaccataatccgtggatgctcttatattttatcagcttccttctgattgtctctttcttcgtattaaatatgttcgtgggagtcgtggttgaaaatttccacaaatgcaggcagcaccaggaagccgaagaggcaagacgcagagaggaaaagcgcttgcggcgcctggagaagaagagaaggaaggcccagcgactgccatactatgccacatattgtcatacccgactgctgatacacagtatgtgcacgagccactacctggacatcttcatcacgttcataatttgtttaaatgtggtaactatgagcctggagcactataaccaacctactagtctagagacagccttgaaatactgtaactacatgttcaccaccgtgttcgtactggaggctgtactcaagctggtggccttcggcctgaggcgtttctttaaggaccgctggaatcaactagacctggctatcgtccttcttagcgtcatgggcatcacactggaggaaattgagattaacgcagccttaccaattaaccctacaatcatacgtatcatgagggtactcaggattgctagagtcttgaagctgttgaagatggcaacagggatgcgggcactgctagacaccgtcgttcaggccctcccgcaggtgggtaaccttggactactctttatgctgttgttcttcatttacgctgcattaggcgtggaactctttggcaagctggtttgtaacgacgaaaacccctgcgaaggcatgagccggcacgccacattcgagaactttggcatggccttcctgactctgtttcaggtgagcaccggagacaattggaatggcataatgaaggacaccctgcgcgattgcacacacgatgaaaggagttgcttgtccagcttgcagttcgtgagtccgctgtactttgtgtcctttgtcctcactgcccagtttgtactgattaacgttgtggttgccgtcctgatgaagcatttggacgacagcaataaagaggcccaagaggatgccgagatggatgcagaactcgagttagagatggctcatgggctcgggcctgggccacggctgcccacaggaagtcctggcgctccgggacgcggaccagggggcgcaggcggcggaggcgatacagaggggggtctgtgtaggcgatgctacagcccagcacaggagaatctgtggctcgattctgtgtcacttatcattaaggattctcttgaaggcgaattgacgattatcgataaccttagtggatccattttccatcattactctagcccagccggctgcaagaaatgtcaccatgataagcaggaagtgcagctggctgagacagaggccttctcactgaactctgaccggtcttcctcaattctgttgggggacgatctcagcctggaggatcccacagcttgtcccccgggtcggaaagattccaaaggcgaactagatcccccagaaccgatgcgtgtgggggacctcggcgaatgtttttttcccctaagtagcaccgccgtcagccctgatcctgaaaactttctgtgtgagatggaagagattccgttcaacccggtcagaagctggctgaagcatgactcctcccaggccccaccaagtccctttagccccgatgcaagctctccactgctgccaatgcctgctgagttctttcacccagctgtatctgcaagccagaagggaccagagaaaggcactgggaccggaacccttccaaagattgccttacagggcagttgggccagtctccgctcgccacgcgtgaactgtactctactgcggcaggctacggggtccgacacttccctggacgcttctccaagttccagtgctggctcactccagactaccctggaagacagcctgacccttagcgattcaccacggcgtgcgttgggcccaccggcacctgcccccggccctagagctggcctgtctccagcagcacggcgtcggttatccttgagggggcgcggcctgttctccctgagaggtctgcgcgcccatcagagatcccactcatccggcgggtcaacctctcccggttgtacccatcatgactctatggatccttccgatgaagagggaagagggggcgctggtggcggtggggctgggtctgaacatagcgagactttgtcaagtctctctctgacctctctcttctgcccaccaccaccccctcccgccccgggcttaacccctgcacgcaaatttagcagtacgtctagcttagcagcgcctgggcggccgcacgccgcagctctcgctcatggtctcgctagatctccaagctgggcagccgatcggagcaaggacccccctggacgggccccgctccccatgggcctagggcctctcgccccaccacctcagcctctccctggagagctcgagcccggcgatgcagcatcaaaacgcaaacggtag

SEQ ID NO: 110475 - DNA, 6051 bp, Artificial Sequence
  Description of Artificial Sequence: Synthetic coding sequence
atggccgaaagcgctagtcctcctagtagctcagccgctgccccagctgcagaacctggcgttacaacagaacagcctggtcctcggtcccccccctccagcccccccggtctggaagagcctctggacggagctgatccccatgtcccacatccagacctagcccccatcgcgtttttttgtcttagacagactactagccccaggaattggtgtatcaagatggtctgcaatccctggttcgagtgcgtctcgatgctggtcatcctcctgaattgtgtgacactgggcatgtatcaaccgtgtgacgacatggattgtttgagcgaccgctgcaagatcttgcaagtcttcgatgactttatatttatctttttcgccatggaaatggtgttgaagatggtcgcgctcggcatctttggcaagaaatgttatctgggagacacctggaaccggttagatttttttatcgttatggcggggatggttgaatactcgcttgatttacagaatatcaatctgtccgcaatcaggacagtgcgtgtattgcgcccactgaaggccatcaatcgggtgccaagcatgcgcatcctcgtcaacctgctgttggacactttacccatgctcggaaacgttctgctactttgcttctttgtctttttcatttttggcatcattggagtgcagctgtgggcgggcctgttgcggaataggtgcttcctcgaggagaactttactatccagggggatgtggcattacccccctattaccagccagaagaggacgatgagatgccatttatctgctcattgagcggcgataacgggattatgggctgccacgaaattccccctctcaaggagcaggggagggagtgttgtctctctaaagacgatgtttacgacttcggcgccggacgccaggatttaaatgcgagtggtctgtgcgtaaattggaaccgctactataacgtgtgccgaactgggagcgcaaatccacacaagggggctatcaatttcgacaatattgggtacgcctggatcgtcatctttcaagtgatcacgctcgaaggctgggtggaaataatgtactacgtaatggacgcccacagtttctacaacttcatctacttcatcctcttaattattgttggttcattttttatgattaacctgtgcctagttgtgattgcgacccagttttccgaaaccaagcaaagggagcaccggctcatgttagaacaaagacagcgatacttatcctccagtactgtcgcatcctatgcagaacctggcgactgctacgaagagatctttcagtatgtctgccatattctgcggaaagcaaaacgccgcgctctcggcttgtatcaggcgctacagagccgaaggcaggccttaggccctgaggctcccgctccggcgaaacccgggccgcacgccaaggagccgcgtcactaccacggtaagacaaagggacaaggcgacgaggggcggcatctggggtcgaggcactgtcagactctacacggtcctgctagtcctggcaatgaccactcaggccgggagctttgcccccagcactcccctctcgacgcaacgccgcacacgttagttcaaccaatccccgctactctcgccagcgacccagctagctgcccgtgctgccagcacgaagacggtcgccggccaagtggcctcggcagcactgatagtggacaggagggcagcggaagcggcagcagtgctggtggcgaagacgaggcggatggagatggcgccaggagtagcgaggacggcgctagcagtgagcttgggaaagaggaggaggaggaagaacaggccgacggtgccgtgtggttatgcggtgacgtatggagggagacacgggccaagctgcgaggaatagtcgactccaagtatttcaatagaggaattatgatggccattcttgtcaatactgttagcatgggcatcgaacaccacgagcaacccgaagaactgaccaatatccttgaaatttgcaatgtcgtttttaccagcatgttcgcactagagatgattctcaaacttgccgcttttggtctgttcgactacttaagaaacccctacaacattttcgactccatcatcgtcattatctccatctgggagattgtgggccaggctgatggcggactatctgtgttgagaacttttaggctcctgcgagtcctcaaactagtaagattcatgccagcgctgaggcgccagctcgttgtactgatgaaaactatggataacgtggccactttctgcatgctgctgatgctgttcatattcattttcagtattctgggaatgcacattttcggatgcaagtttagcttgcgcactgacacaggagatactgtgccagatcggaaaaacttcgatagtcttctttgggctattgtgacagttttccagattctcacccaggaggactggaatgtggtcctgtacaacggaatggcaagtacctctccctgggcgagtctttattttgtggccttgatgacctttgggaattacgtgcttttcaacctcctggtggccattctcgtagaaggttttcaggccgagggagacgctaacaggtcctacagtgatgaggaccaaagtagtagcaatatcgaagagtttgacaaacttcaggaggggctcgattcttcaggggatccaaagttgtgtcctatccccatgacgcccaatggacacttggacccttctttacccctcggaggacatctggggcccgccggggctgcgggaccagccccaaggctgagcctgcagcctgaccctatgctcgtggccctcggatccagaaaatcatcggtcatgtctttgggccgaatgagctacgaccaaagaagcctgagttcaagccgatcgagttattacggtccttggggcagatctgccgcctgggcatcaaggcgcagcagctggaactctcttaagcataaacccccctctgccgaacatgaatccctgctcagcgcagagaggggcggtggcgcaagagtttgcgaagtcgcggccgacgagggaccgcctcgagccgccccgttacacacgcctcacgcccatcatatccatcacggacctcacttagcacatcgacataggcaccatagacggacactgtccctcgataaccgagactcagtggatcttgccgagctggtccccgctgttggagcccatcccagagcagcatggcgcgcagccggccccgcccccgggcatgaagattgcaacggacgtatgccatcaatagccaaggatgtcttcactaaaatgggagaccgaggagatagaggagaagacgaagaagaaatcgattacacactttgtttccgggttcgaaagatgattgacgtttacaaacccgactggtgtgaagtgagggaagattggtcagtgtatcttttctcaccagagaacagattccgggtcctgtgccagactattatagcccacaagctgttcgattatgtggtgctagcttttatttttctgaactgcattacgatcgccttagagcgccctcagattgaggctgggtccactgagcgcatatttctgactgtcagtaattacatttttactgccatcttcgtgggagagatgacccttaaggtggtgtccctcggtctttacttcggggagcaggcctacctgagatcttcatggaatgtgctcgacggattcctggtgttcgtgagtatcatcgatattgtcgtgagccttgcatccgcaggcggcgccaagatcctcggggtgctgcgggttctgcggctgcttcgcacgctgcgtcctttgagagtgatttcaagggcccctggtctgaagttggtggtggagaccttaatcagctcccttaagcccattggtaacatagtgctgatatgttgcgcctttttcattatcttcggcattctcggcgtgcagttatttaagggcaaattctatcattgcctcggagttgacacccgtaatatcacaaatcggagtgattgtatggctgctaattatcgctgggtgcaccataagtacaacttcgacaacctgggtcaggctcttatgtccctgttcgtgctggcctccaaggacgggtgggttaacatcatgtacaatgggctcgacgccgtggccgtggaccagcagcctgttacaaaccacaacccctggatgttgctatacttcatttcgtttctcctcatagtgtcttttttcgtgttgaatatgttcgtaggcgtggttgtagaaaacttccataaatgtcggcagcaccaagaagccgaagaggcccggcgcagggaggagaaacggcttaggcgactagaaaaaaagagacgtaaagcccagaggctgccctactacgccacctattgtcacactcgcctcctgattcacagcatgtgcaccagccactacttagatatattcattactttcatcatttgcctgaatgtggtgactatgagcctcgaacactataatcagcccactagcttggagaccgccctcaagtattgtaattatatgtttactacagtgttcgtgctggaagccgtgcttaagctagtagcttttgggcttcggaggttttttaaggacagatggaaccagttggacctcgctattgtgctgctctccgttatggggatcacactcgaagaaatcgagatcaatgctgccctgcccattaatccaacaatcataagaatcatgagagtgttgcggatagcacgcgtcctcaagctgctcaagatggccaccgggatgagagccctgctggacactgtggttcaagcgcttccccaggtcggcaacctgggtctgctgttcatgttgttattcttcatctacgccgccctaggagtggagttattcggaaagttggtttgcaatgacgaaaacccgtgcgaaggtatgagtcgacacgccaccttcgaaaatttcgggatggcatttttgaccctgtttcaggtctccaccggcgacaattggaatggcatcatgaaggacactctccgggattgtacccacgatgaaaggtcctgtctgtcgtcgttgcagtttgtatctccgttgtacttcgtgagctttgtgctgacagcacagtttgttctcattaacgtcgtggtcgccgtgttgatgaagcatctcgacgattcaaacaaagaggcccaggaagacgcagagatggacgctgaactggagctggagatggcgcacggacttgggccgggacctcgactgccaactgggtcacccggggcgccagggcgtggacctgggggagcaggaggcgggggcgatactgaaggcggcctgtgcagaagatgctatagtcccgcccaagaaaatctttggctggactccgtatctctgatcattaaagacagtctcgagggggagcttactatcattgacaatctgtccggtagcattttccatcattattcttcccccgcaggctgtaaaaaatgccatcacgacaagcaggaagtccagctcgcagaaacagaagccttctcactcaactcggatcgtagctccagcatcctgctcggagatgatttgtcactggaggaccctaccgcctgccctcccggacgaaaggactccaaaggcgaactggatcctcccgagcctatgcgcgtcggagacctgggcgagtgctttttcccactgagtagcacggcggtttccccagatcccgagaactttctctgtgagatggaagaaattccctttaatccagtgcgctcctggctgaaacacgacagcagtcaggcgcctccttcacctttcagcccagatgcttccagcccacttcttcctatgcctgctgagttctttcaccccgccgttagcgcatcgcaaaagggacctgaaaaaggcacagggaccgggaccttacccaagatcgcactccaggggtcctgggcatctctgcgcagtcctagggtcaattgtaccctcctgagacaggtgccaactcctcctcggccctag

SEQ ID NO: 110476 - DNA, 6672 bp, Artificial Sequence
  Description of Artificial Sequence: Synthetic coding sequence
atggcagagagcgctagccctccctctagctccgctgcggctccggccgcagagccgggcgtcacaaccgagcagccagggccgagaagcccaccatccagtcctcccggcctcgaagaacccttggatggagccgatccccatgtaccgcatccggacctggccccgattgctttcttctgcctgcgacaaacaaccagtccccgcaactggtgtatcaaaatggtttgcaatccctggtttgagtgtgtaagcatgctggtaatcctcctcaactgtgtaaccctgggcatgtatcagccttgcgatgacatggattgcctctcagaccgctgcaagattctgcaggttttcgatgactttatctttatattctttgccatggaaatggtgctaaagatggtggccttagggatattcggcaaaaagtgctatctaggcgacacctggaacaggctcgacttctttatcgtaatggccggcatggttgaatactccctggacttgcagaacatcaacctgagcgcgatccggactgtgcgggtgcttaggcccctcaaggctattaatcgtgtccctagtatgcgaatattggtaaatctgctgcttgacacgttgcccatgttggggaacgtcctgctcttatgcttctttgttttctttatattcggaattataggggttcaattgtgggccggcttgctgaggaaccgctgctttctcgaagagaattttactatccaaggagatgtggcgctgccgccttattatcaaccagaggaggacgacgaaatgccatttatttgcagcttgagcggcgacaacggaataatgggttgtcacgaaatccccccgctgaaagagcagggcagagaatgttgcctgagtaaagatgacgtctatgacttcggggctggcaggcaggaccttaatgcgtctggcctctgcgttaattggaatcgatattacaacgtctgccgcactggaagtgctaatcctcataaaggggccataaacttcgacaatatagggtatgcctggattgtgatttttcaagtgatcactctcgaggggtgggtagaaataatgtactatgtcatggatgcacatagcttttacaatttcatctatttcatcctccttatcatcgtcggctcgttcttcatgataaacctgtgccttgtcgtcattgcgactcagttctcagagactaaacagcgcgagcaccgtctcatgcttgaacaaagacagcgttatcttagcagttcgactgtagccagctatgctgagccaggggattgttatgaagagatcttccagtacgtctgccacatcctacgaaaagctaagcgaagggctctgggtctgtaccaagcccttcagtcaagacggcaggctttgggcccagaggcacccgcgccagccaaacccgggccacacgctaaagagccacggcactaccacggaaaaaccaaggggcagggggatgaagggcgccatctggggagcagacattgtcagactttacatgggcccgcttcacccggcaatgatcatagcgggcgtgaactttgcccacaacacagccctctcgatgctaccccacacaccctcgtgcaaccaatccccgccaccctcgcctccgacccagcatcatgcccttgctgccaacacgaggacggcagacggccttcaggcttaggatcaacagactccgggcaggaagggtctggcagtggtagctctgcagggggagaggacgaagccgatggagatggtgcacggagcagcgaagacggcgcttcctctgagctgggcaaggaagaggaagaagaggaacaggccgacggggcagtctggttgtgcggggatgtatggcgggaaacccgagctaagcttcgaggcatcgtggactcaaaatactttaacagaggcattatgatggcaatccttgtgaatacagtgagcatggggatcgaacaccacgagcagcccgaagaactgacaaatattctagagatatgcaacgtggtctttacatcgatgtttgctctcgagatgatcttaaagctcgctgccttcggtctgtttgattacctgcggaacccttacaacattttcgatagcatcatcgtcatcatctcaatctgggagatcgttgggcaagcagatggaggactttctgtgctgcgcacgttcagactcctccgcgtactcaagctggtgcgctttatgccagcccttagaagacagctcgttgtgttgatgaagacgatggataacgtcgctaccttttgcatgctgttaatgctgttcatcttcatcttcagtattctgggtatgcatatttttggctgcaagttctccctccggaccgatacaggggataccgtgcctgacagaaagaacttcgattccctgctgtgggcgatagtgactgtgtttcagatcctaacccaggaggactggaatgtagtattatacaatggcatggcctcgacttccccctgggcttccctttattttgtcgccctaatgacctttgggaattatgtcctgtttaatctcttggtggcgattctagtggaagggtttcaggctgagggagatgctaatagatcctacagcgacgaggaccagtccagctcaaatatagaggagttcgacaagctgcaggaaggattggatagctcaggcgatcccaaactgtgtccaatcccaatgacccccaatgggcatctcgacccctctctgcccttgggtgggcatctgggtcctgcaggcgctgccggccccgcacctagattgtccctgcaacctgatcccatgctggtggcgttaggaagtaggaaatcgagcgtcatgagcctggggcgcatgtcatacgaccagcgcagcctaagctcctccaggtcctcctattacggcccctggggtcgaagcgccgcttgggcctcgcggagatcatcttggaactcacttaaacacaagccaccctcggccgagcacgagtcccttctgagcgccgagaggggcggaggagcacgcgtctgcgaagtggccgcagacgagggtcctccccgagccgcaccgctccataccccacacgcacaccatattcatcatggcccccaccttgcccaccggcatcgacaccatagacgaaccctttcactggataaccgagactctgtggatttagcggagcttgttccagctgtgggtgcacacccaagggccgcatggcgcgcagcagggcccgcccccggccacgaggactgtaacgggagaatgccaagtattgcaaaggatgtctttaccaaaatgggagatagaggagatagaggagaggatgaggaggaaatcgattacactctgtgtttcagggttcggaagatgattgatgtatacaagccagattggtgtgaggtgagagaggactggagtgtttacctgttcagcccggagaatcgatttagagtgctgtgtcaaacaataatcgcccataaactgttcgactacgttgttctggctttcatctttcttaactgtatcactatcgctctggagagaccccaaatcgaggccggatccacagagaggatcttcctcacagtgagcaactatatctttacggccatctttgttggtgagatgacgctgaaggtggtgagtttgggtctgtattttggcgaacaggcgtacctcaggagcagttggaatgtgttagacggcttcttagttttcgtgtccattatcgacattgtggtatctctggcctccgccggaggggcaaaaatactcggagtattgcgagtgctgcggcttcttcgcacactccggcctctgagagtaatcagccgcgcacccggactcaaattagtcgtcgagactcttatctccagcctgaagcccataggtaatatcgtactgatttgctgtgcattctttataatatttgggattctcggcgtccagctgtttaagggcaaattctatcattgcctgggcgtggatactcgcaatatcactaatcggtctgactgtatggcagctaattaccggtgggtgcatcataagtataacttcgataacttaggccaagcacttatgtcactcttcgttcttgcctccaaggatgggtgggttaatattatgtataatggactcgatgcggttgcagtcgaccagcagccagttactaaccataacccctggatgctgctgtacttcatctcttttttgctgattgtaagcttctttgtgttaaacatgtttgtgggagtggtggtagaaaactttcacaaatgtcggcaacatcaggaagctgaggaggcacggcgccgcgaggagaagcgactaaggaggctggaaaagaagaggcgtaaagcccaaaggcttccctattatgcgacatactgccacacccgcctccttattcattcaatgtgcaccagccactacttagatatcttcataactttcataatttgtttaaatgtagtcaccatgtctctggaacactacaaccagccaactagcctagaaactgccctcaagtactgtaactacatgttcacaacggtattcgtgctggaagccgtgctaaagctagtcgcttttggactgaggcgcttctttaaggatcgctggaatcagctggaccttgccatagtcttgctttcagtgatgggaatcactctcgaagaaatcgagataaatgccgctttgccaataaatcccacgatcatccgcatcatgagagtcctgcgtatcgcccgagtgttgaaattgctcaaaatggccaccgggatgcgggcactacttgacacggtcgtgcaggcactaccacaggttggcaatctaggcttgctctttatgctgctcttctttatttacgcagcattaggtgtggaacttttcggcaaacttgtctgtaatgatgaaaacccttgcgagggcatgtctagacacgcaacttttgagaacttcgggatggccttcctgaccttgttccaggtatcaacaggcgacaattggaacggaataatgaaagacaccttgagggattgtacacatgacgaacggtcgtgcctctcgtcgctacagtttgtttcccctctgtactttgtttccttcgtactgactgcccagttcgtgctgatcaatgtggtcgtggctgttcttatgaaacacttggatgactccaataaggaggctcaagaggatgccgaaatggacgctgaactagagctggagatggcccacggactaggacctggtcctcggctcccaacagggagcccgggagcacctggcaggggcccaggaggggcggggggcggcggtgacactgaaggcggactctgcaggcggtgttatagtcctgcacaggagaatctgtggctcgacagcgtctcgctgatcatcaaagactccctggagggggaattgactataattgacaacctcagcggctccatttttcaccattactccagtcccgctggttgcaagaagtgtcaccacgataaacaagaggtccagctagccgaaaccgaagcttttagtctgaattctgacagatcaagtagcatcctcttgggggacgatttgagcctagaggacccaactgcctgtccccccggtcgcaaggatagcaagggtgagttggatcctcctgaacctatgagggttggcgatctgggcgagtgctttttccccctgtccagcaccgccgtgtcacctgatcctgagaacttcctgtgcgagatggaggaaatacccttcaacccagtgcggtcctggctgaaacatgactcgtcccaggccccccccagcccattcagcccagacgcatcatccccactcctcccaatgccggcggagttttttcaccctgcagtctctgctagccagaagggaccagaaaagggaaccggcactgggacccttcctaagatcgccctgcaaggcagttgggcaagcctgcggtctcctcgggtaaattgcacgttattgagacaagccacaggctcagacacatccttggacgcttcaccttctagctctgctggttcactgcagacaactttggaggacagcttgaccctgtctgacagtcctagacgagccctgggccctccggcccctgccccaggcccacgcgctgggctctcaccggcagctcgtcggaggctatctctgagggggagagggctctttagcctgcgcgggcttcgtgcccatcagaggagtcactcgagcggaggctccacctcaccaggttgcacccaccacgactcaatggatccatccgatgaggaagggcgcgggggagcaggagggggtggagcggggtcagagcactcagaaaccttatcgtctctcagcctcacctcgctgttttgtccaccacccccacccccggctccaggccttactcccgctaggaagttctcaagcacatcatccctggccgcgccaggacgcccacacgccgcagccttggcccacgggctggctagaagccctagctgggccgccgaccgaagtaaagatcccccaggccgcgcccctctccccatgggactgggtccactggcccccccccctcagcccctaccaggcgagctggaacccggagacgcagcttctaaacgcaagaggtag

SEQ ID NO: 110477 - DNA, 6567 bp, Artificial Sequence
  Description of Artificial Sequence: Synthetic coding sequence
atggctgaatcagctagccctccctcttcttcagccgctgccccggccgcagagcccggcgttaccacggaacaacccggtccacggtcacctcctagcagcccgccaggtctggaagaacccttggatggggccgatccgcatgttccacatccagatctcgctcccattgcctttttctgtctccgacagacaaccagccctcgaaactggtgtattaaaatggtttgcaatccttggttcgaatgtgtaagcatgctcgtgattctgctgaactgtgtgacgctgggaatgtaccagccgtgcgatgatatggattgtcttagcgatagatgtaagatccttcaagtttttgatgattttatttttatattctttgccatggagatggtactcaaaatggtagcattaggcattttcggcaaaaaatgctatctcggtgatacatggaacaggctggatttctttatcgtcatggccggaatggtggagtatagtctggacctacagaatataaacctctccgccatcagaaccgtcagggtgctgagacccctgaaggccataaaccgagttccttcgatgagaatactggtaaacctgctgcttgacaccttgcccatgcttggtaacgtgctgctactttgtttcttcgtgttcttcatctttggcattatcggggtgcaactttgggcgggcctcctccgcaatagatgcttcttggaggagaatttcactatacagggagatgtggctctccctccctactatcagcccgaagaggacgatgaaatgccatttatatgtagtctttcaggggataacgggattatggggtgtcatgagataccacctctgaaagaacaagggcgcgagtgctgtctgtcaaaagatgatgtctatgatttcggagccggtaggcaggacctgaatgcatcagggctctgcgtaaactggaaccggtactataatgtgtgtcgtactggttccgccaatccgcacaagggagccattaatttcgataatattgggtacgcctggatcgtcatattccaggtgataaccttagagggctgggtggaaattatgtattacgtcatggatgctcactcattttacaactttatctactttattctgttgattattgtcgggtccttcttcatgattaatctgtgccttgtggtcatcgcaacacagttctcagagacgaaacagagagaacaccggttgatgcttgagcagaggcagagatatttatcatcatccactgtggccagctacgccgagcccggggactgctatgaggagattttccagtacgtgtgccacatcttgcggaaagcgaaaaggagagccttgggtctttatcaggcattacagagcaggcggcaagccttaggtcctgaggctccggccccagccaaacccggccctcatgccaaagaacccagacactatcagctctgccctcaacactctccacttgacgcaacgccccacacgctggtgcagccaatccctgccaccctggcaagtgatccggcgagttgcccatgctgtcagcatgaagacggtaggaggcccagtggcctcgggtcaacagactctggacaggaggggtctggaagcggatcctccgctgggggcgaggatgaggcagacggggatggtgcacgatcctccgaagatggggccagttcggagcttggcaaggaggaggaggaggaagagcaggccgacggggccgtgtggctatgtggagatgtatggagagaaacacgagctaagctgaggggaattgtcgactcaaaatatttcaaccggggcatcatgatggccatcctggtgaacaccgtgtcgatgggaatcgaacatcacgaacagcctgaagagttgaccaacatactcgaaatctgcaatgtggtcttcacatccatgttcgccctggaaatgatcctaaaactggctgcgttcggactttttgattatctgcgaaacccttataacattttcgattcaattatcgtgataatctcgatttgggaaatagtggggcaagctgacggtggtctgtccgtgctgcgtacttttcgcttacttagggtgctgaaactcgtgagatttatgcccgctctgagaagacaactggttgtgctgatgaagacaatggacaatgttgccacattctgcatgctacttatgctgttcattttcatcttcagcattctcgggatgcatattttcgggtgtaagttttcactgcgaacggataccggcgacactgtgcctgaccgaaagaattttgactctcttctgtgggcaattgtcacagtgttccaaatccttacccaggaggattggaatgtggtgctgtacaatggcatggctagcacctcaccttgggcgagcctatacttcgtggccttaatgacttttggtaattatgtcctgtttaatctactggtagcaattctggtggagggattccaggcagagggagacgccaaccgcagttacagcgatgaggatcagtcgtccagtaatatagaagagtttgacaagctgcaggaaggcctggactccagcggagatccaaagctgtgtccaatacccatgactcctaatggccacctggacccttctttacccctgggtggccacttggggcccgcgggcgccgcaggacccgcacccaggctgtccctgcagcccgatcccatgctggtcgcgctcggttccagaaagtcatccgtgatgtccctgggtcgcatgagttacgatcaacggagcctgtcttcgagccggagctcgtattacggaccctggggaagaagcgctgcctgggctagcaggaggtccagttggaatagcctgaagcacaagccaccctccgccgagcacgagagcctactgtctgctgagaggggagggggcgcccgcgtgtgtgaggtagccgctgatgaggggcctccaagagccgcccccctacatactccacacgcgcatcacatccatcacgggccacatctggcacaccgacataggcatcacaggcgcactctgagcctggataatcgcgactccgtagatttggcagagttagtgccggccgtgggcgcccacccacgggctgcttggagagctgcgggccccgccccaggtcacgaggattgcaatggccgaatgccttccattgctaaagatgtgttcactaagatgggggacagaggcgatagaggggaggacgaggaggaaatagactacactttatgctttagagtgcgcaagatgatcgacgtttacaaaccagattggtgcgaagttagggaagattggtccgtttacctgttttcaccagagaatcgatttcgagttctgtgccagactatcattgctcataaactattcgactacgtagtattggcgttcatctttcttaactgtatcactatcgccctggagcgaccccagatcgaagctggtagcacagagcggatattcctgacagtgtcaaattatatcttcacagccatctttgtcggagagatgacactgaaagtggttagcctaggtctttactttggcgaacaagcttacttacggtcaagctggaacgtactggacgggtttctcgtttttgtcagcatcatagacattgttgtgagcctcgcctccgccggtggcgccaagattcttggagttctgagggtgctgcggctgctcaggaccttaaggccactgcgtgttatctccagggccccaggactcaaactagtggttgagactctgatctcttccctaaaacctattggaaacattgttctgatctgttgtgcctttttcattatcttcggaatcttgggcgtccagctatttaaaggtaagttctatcattgtctcggtgtggatacacgtaatatcacgaatagatctgactgcatggcagccaattaccggtgggtgcatcataagtacaacttcgacaaccttggacaggctctgatgtcgcttttcgttctagcatccaaagatggttgggtgaacatcatgtacaacggcttagacgcggtggccgtggatcaacagcctgtaaccaatcacaacccctggatgctactgtacttcattagctttctgctgattgtcagcttcttcgtgttgaatatgttcgtgggggtggttgttgagaacttccacaagtgtcgccaacatcaggaagctgaggaagctcgaaggcgggaggagaaacggctccggagattggagaaaaagcgccgcaaggcacagcgtctgccttattatgcaacctactgccacaccagacttctaatccatagtatgtgcacgtctcattacctcgacatattcattacgttcattatctgtcttaacgtagtaacaatgtccctggaacactacaaccaacctacgagcctagagaccgcgctgaaatattgtaattacatgttcactaccgtattcgtgctcgaagcagtgctgaagctagtggccttcgggctgaggcggtttttcaaagacagatggaatcagctcgacctggctatcgtgctcctgtccgtgatgggaattactttagaggagattgaaatcaacgcagccctccctatcaatcctactattatccgaattatgagggttctacggatagcccgggtcttaaaactgctcaagatggcgacaggcatgagagctttgttagatacggtggttcaggccctgcctcaggtgggcaatctggggctgctgttcatgttattgtttttcatctacgcagcattaggcgtagaactgtttggcaagctggtgtgtaatgatgaaaacccttgtgaaggcatgagcagacatgccacatttgaaaatttcggaatggcatttctgactctctttcaggtttctaccggcgataactggaatgggattatgaaagacacactgcgagactgcacccatgacgagcgcagttgtctgtcatcactgcagtttgtgtcccccctgtatttcgtttcattcgtcctcacagcccagttcgtcttgatcaatgttgtggttgcagttctgatgaagcacttggacgattcaaacaaggaggctcaggaagatgcagagatggatgcagagctcgaactggaaatggctcacggactcggtcctggcccacgcctgccgactgggtccccaggagctcctggacgcggccctgggggggcaggcggcggcggagacaccgagggcggattgtgtcgtcgatgttactctcctgcccaggagaacctctggctggattctgtatccctgatcattaaagattcactggagggcgagcttaccatcatcgacaacctgtccggctctatttttcatcactatagctctccagcaggttgcaagaagtgtcatcacgataaacaagaggtgcaacttgccgaaactgaggccttttccttgaattctgacaggagtagttctatcctcctgggcgacgacctttctctcgaagaccctaccgcctgcccccctggtcgaaaggactctaagggagagctggaccctcccgagcccatgagagtaggagaccttggcgagtgtttttttcctctcagctcaacagccgtgtctcctgatcctgaaaactttctatgcgagatggaggaaattccttttaacccagttaggtcatggctgaaacatgacagctctcaggctccccccagcccattctccccagacgcaagtagtccgttgctgcccatgccggctgagttcttccaccctgcagtttctgcctcacagaaaggacccgaaaaagggaccggcacaggcacactgcccaaaattgctctgcagggctcttgggctagcttgagatcaccaagggtgaattgtacattgttaagacaagcaacaggatccgacacttctctggatgccagtccatcctcatctgctggctctttgcagaccactctggaggactccctgacactcagcgatagcccgcgccgagccttaggaccgcccgctccagccccaggaccacgagccggcctgagccccgcagccagaaggaggctcagcctgaggggaaggggtctgttttcactacgcgggctcagggcccatcagagatcacattcatctggcggatccactagtccaggttgtacacatcatgacagcatggacccaagcgatgaggaaggtaggggtggcgccggcgggggtggagcagggtccgagcacagcgaaaccctgtcttccctatccttgacttcacttttctgtccccctcctcctccccccgcccctggcttaactcccgccagaaaatttagcagcacttcaagcctggctgctccaggccgtccacacgcagcagcactggcccatgggctcgcacgctctccgtcctgggctgccgataggtcaaaagacccacctggacgcgccccactgcctatggggctgggtcctctggcacccccccctcagcctctccctggcgagcttgagcctggtgacgccgccagcaaacggaagaggtag

SEQ ID NO: 110478 - DNA, 5946 bp, Artificial Sequence
  Description of Artificial Sequence: Synthetic coding sequence
atggctgagtctgcttcaccccctagttcttctgccgctgccccagctgccgagcctggtgtgaccacagaacagcctgggccaaggtcgccaccttcctcaccaccaggactcgaggagccactggacggcgcagaccctcatgtgccacaccctgacctggcacccattgctttcttctgcttgagacaaacaacatctcccaggaattggtgcatcaaaatggtgtgcaacccttggtttgagtgcgtatcaatgctggttatcctgttgaattgcgttacacttggcatgtatcaaccctgtgatgatatggattgtttaagcgatcgctgtaaaatccttcaggtgttcgacgatttcatctttatcttcttcgcgatggagatggtgctgaaaatggtcgccttaggaatctttggaaaaaagtgttacctgggggacacttggaaccggttagatttctttattgtaatggccggaatggtggagtactctttagatctccagaacatcaatctcagtgcgatccgaaccgtacgggttctgagacctctgaaggctatcaatcgcgtccctagtatgcgaattctagttaacttattgctggacactctacctatgttaggtaatgtgctactcctgtgcttcttcgttttcttcatattcggtattattggagtgcagctgtgggctggtctcctccggaatcgctgctttttagaagaaaactttaccatccagggggatgtggctctccctccttactaccagccagaggaagatgacgagatgccctttatctgctctctctctggcgacaatggcatcatgggttgccacgaaattcctccacttaaggagcaaggtcgggagtgctgtctgtcgaaggatgacgtgtatgattttggcgccgggagacaagatctcaacgcgtcgggtctgtgtgtcaactggaaccgctactacaatgtgtgccgcaccggatcagccaacccccacaaaggcgccattaatttcgataacatcggttatgcctggatagtgatcttccaggtgatcactttagagggatgggtagaaattatgtattacgtcatggacgcccattctttttataattttatttactttattcttctaattatcgtcggctccttctttatgattaatctgtgtctggtagtgattgcgacccaattctccgagactaagcaaagggaacaccggcttatgctggaacagagacaaagatacttgagctccagcactgttgcgagttatgccgagccaggagattgttacgaggagattttccaatatgtgtgtcatatcctccgcaaggccaagcgccgggcgctcgggctgtaccaggctcttcaatcccgtcgacaagccctcgggccggaagcacccgctcccgctaagccgggcccccacgctaaggagccacgccattatcagctctgtcctcagcattccccactagacgccaccccacatacactggtccagccaatccccgcaaccctagccagtgaccctgcgtcctgtccctgttgccagcatgaggacggtcggaggccttctgggttgggttctactgattctggacaggagggatccggctcgggcagtagtgcagggggcgaagacgaggcagacggcgacggtgcccgatcctccgaagatggagccagctctgagctgggcaaggaagaggaagaggaagaacaggccgatggcgctgtgtggctgtgcggggacgtgtggagagaaacccgcgccaagctccgaggcatcgtagacagcaaatatttcaatagaggaataatgatggccattctggtgaacacagtatccatgggtatcgaacatcacgaacagcccgaggagctgaccaatattttggagatatgcaacgtcgtttttacctccatgtttgctctcgagatgattctgaagctcgccgctttcggtctttttgattacctacggaacccctataacatttttgattccataatcgtcatcatttcaatctgggaaatcgtgggccaggctgatggtgggctcagcgtattgagaacatttaggctgctacgggtcctcaaactggtgcggttcatgccggccttacgcaggcagctagttgtgctgatgaaaacaatggataatgtcgcaaccttctgtatgctgctaatgttgtttattttcatcttctcaatcctagggatgcacatattcggctgtaagttcagtctgcggaccgacaccggggacactgtccctgataggaagaattttgactcccttttgtgggctatcgtgacagtctttcagattctgacccaggaggactggaacgtggtcctgtataatggaatggccagtacctccccctgggcctcactgtacttcgtagcgctgatgaccttcggcaactatgtgctctttaacctgctggtcgccatcctggtagaggggtttcaggcagaaggggacgcaaatagaagctatagcgatgaagaccagtcatcctctaatatcgaggagttcgacaagctgcaggaagggctggattcaagtggcgaccctaagctctgccctattccgatgacgcccaatgggcacctggaccctagtttgcctctgggaggccatcttggtccggcaggagctgccggacccgcccccaggcttagtcttcaacctgatcccatgctggttgcactcggcagccggaagtcatcagtaatgagcctgggtcgcatgtcctacgatcagagaagtttaagctccagccgcagcagttattatggcccatggggccgctcagccgcctgggcaagtcgacggagctcctggaacagcctgaagcacaagccaccttcagccgagcacgaatccctcttgtccgccgagagaggtggaggtgccagggtttgcgaagtagccgccgacgaaggaccaccacgagccgccccgttacatacaccccacgcacaccatatccatcatgggcctcacttggcacacagacaccgtcatcaccgcagaaccctgagcctagacaaccgggacagcgtggatctggccgagctagtgcccgctgtcggggctcatccccgcgcagcatggcgggctgccggccccgcccccgggcacgaggactgcaatggtcgcatgccttctatagccaaggacgtcttcaccaaaatgggcgatcgcggcgaccgaggtgaggacgaggaagagatagattacaccttgtgtttccgggtgagaaagatgatcgacgtgtataagccagactggtgtgaagttcgggaggactggagcgtgtacctctttagtcctgagaatagatttagagtgctctgtcagactatcatcgcccacaaactgttcgattatgtggtgcttgcttttattttcctcaattgcattacaatcgcactggagcggccgcaaattgaagcgggcagcactgaaaggatcttcctgactgtgtcaaattacatattcactgcaattttcgtgggagagatgactctcaaggtggtgagcctgggcctgtacttcggtgaacaggcataccttagaagctcttggaatgtgcttgacggttttttggtgttcgtgagtataattgacatcgtcgtttcgctcgccagtgctgggggggccaagatcttaggggttctccgtgtgttacgcctcttaagaaccctgcgtcctctcagggtgattagcagggcgccaggcttgaagcttgtggtggagactctcattagtagtttaaaacccatcgggaatatcgtgctgatatgctgtgcctttttcattatctttggcatcttgggcgtccaactctttaaaggcaagttctaccactgtcttggggtggacactcggaacattaccaatagatctgactgcatggctgcaaattatcgctgggtccaccacaaatataactttgacaatcttggtcaggccttaatgtctctgttcgtgctagcaagtaaggacggatgggtgaatattatgtacaatgggctggacgcagtggccgtggaccagcaaccagtcaccaatcataacccctggatgctgctctacttcatttctttcctgctgatagtaagctttttcgtgctgaacatgttcgtaggggttgtggtggagaactttcacaaatgccgtcaacaccaggaggctgaagaggcccgaagacgcgaggagaaaagactccgacgcctagagaaaaagaggcggaaggctcagcgacttccttactatgctacctactgccacacccgtctcctgatccatagtatgtgcacaagccactatctcgacatttttattaccttcatcatctgccttaacgtggtgacaatgagtctggaacactacaaccaaccgacctcccttgaaacagccctgaaatactgcaattatatgtttaccaccgtctttgttctcgaggcagtcctgaagctggtggctttcggactgcggagatttttcaaagaccgctggaaccaactcgatctggcaatcgtgttattgagcgtgatggggatcacgctggaagaaatcgagatcaacgccgcccttcctatcaaccccaccatcatccgcataatgagagtcctcagaattgctcgcgtcctgaagctccttaaaatggctactgggatgagagccctcttggataccgtggttcaggccttaccccaggttggcaacctgggcttgttatttatgctgttgttttttatttatgctgctctgggcgttgaacttttcggaaaactggtgtgcaatgacgaaaatccatgtgaaggtatgtccagacatgccacattcgaaaattttgggatggccttcctaacactgttccaggtgtctacaggcgacaactggaatggcatcatgaaggacactctgcgggactgtacacacgacgaaagaagttgcttgtcttccctacaatttgtatcaccactgtattttgtgtccttcgtgctcacagcccagttcgttctcatcaatgtggttgtggccgtattgatgaagcacctggatgacagtaacaaggaggcacaggaggatgccgagatggatgcggagttggaattagaaatggcccacgggctcggccccggtcccagactgcctaccggctcgcccggcgcaccaggtcgtggccctggcggggcaggaggaggcggtgataccgagggtggcctctgcaggcggtgttatagcccagcacaggagaatctgtggctcgacagcgtctctcttatcattaaagattcactggaaggcgaactgaccataattgataacctctccggcagcatattccatcattattccagtccagcaggctgcaaaaaatgtcaccatgataaacaggaagtccagctggcagagactgaagccttctcccttaatagcgatcgatcttccagcatcctcctgggagatgatctgagccttgaagatcctacagcctgtccgccgggtcgaaaagattcaaaaggggagctggaccccccagaaccgatgcgagtaggagatcttggagagtgttttttccccctcagtagtaccgccgtgtcaccagaccccgagaacttcctatgcgaaatggaggaaatccccttcaatcccgtccgaagctggcttaagcacgactcatcccaggctccgccctcccccttctctcccgacgcatcttccccgctcttacccatgccagcggagttctttcaccctgcagtatctgcctcccaaaaggggcccgagaaaggaacagggaccggtaccctgccaaagatcgcccttcaagggagttgggccagcctccggagccctcgggtgaactgcaccctgctcagacaagtacctaccccccctcgtccttag

SEQ ID NO: 110479 - DNA, 1041 bp, Artificial Sequence
  Description of Artificial Sequence: Synthetic coding sequence
atgatggataaattccggatgattttccaattcctccagtccaatcaagagtccttcatgaacgggatatgtggcatcatggcactggcgtcagcacagatgtactcggcattcgactttaattgcccctgcctgccggggtataacgcagcctattctgcgggcatcctattagcccctcctctggttctgttcctgctgggcctggtcatgaataacaacgtctctatgctcgccgaggaatggaaaaggccacttggccgcagggctaaagatcctgccgtgctacggtacatgttctgctccatggcacagcgcgcattgattgcccctgtcgtctgggtggcggtaacacttctcgatggcaaatgtttcctgtgcgctttctgcaccgcagtccccgtgagcgcccttgggaacggatccttggcccctggcttgcccgctcctgaattggctcgcctgctggctagagtgccatgtcctgaaatttacgatggcgactggctgctggccagggaggtggccgtacggtatttgagatgtatctcacaggctcttggttggtctttcgtcttactcactactttactggccttcgtggtacgttcagtgcgaccatgctttacccaagctgctttcctcaaatctaaatattggagtcactacatcgacatcgaacgaaagctgttcgacgaaacctgcactgaacacgctaaggccttcgctaaggtctgtatccagcagttttttgaagctatgaaccacgacctggagttaggccatactcatggaaccttggccactgctccggcttccgcagcagcaccaactacccccgacggggcggaagaagagcgggaaaagttgcgtgggataactgaccagggcactatgaataggctgctgacgagctggcacaaatgcaaacctcccctacggttgggacaggaggaaccgcctcttatggggaatgggtgggcgggtggtggaccacggcctcctaggaaagaggtcgcaacgtacttcagtaaggtgtag

SEQ ID NO: 110480 - DNA, 972 bp, Artificial Sequence
  Description of Artificial Sequence: Synthetic coding sequence
atggccgcgttgatcgctgaaaatttcaggttcctgtcactattttttaaatctaaggatgtgatgattttcaatgggttggtggccttggggacagtaggctctcaggagctgttttcagtggtagctttccactgcccttgttcccctgcacggaactacctatatggactggcagccattggagtgcccgcactggtactgtttattattggaattatcctgaataaccacacgtggaatctggtcgctgaatgtcagcatcggcggacaaagaattgctccgccgccccaacattcttgctcctcagtagcatcctcggcagggccgctgtcgccccagtcacctggagcgtcatatctctgctaagaggtgaggcctatgtgtgcgctctgtctgagttcgtagacccgtcctcgcttaccgccagggaagaacattttccgtctgctcacgcgaccgagattcttgcccgcttcccgtgtaaagaaaaccccgacaacctgtccgactttagagaggaggtcagtagaaggctgcgctacgagagccagctgtttggatggctcctgataggcgttgtggcaatactggtattccttacgaaatgtctcaaacactactgtagccccttatcctaccggcaagaagcgtattgggcacagtatagggccaatgaagaccagctattccagcgcacagccgaggtgcattcccgagttctggctgcaaataacgtccgccgtttcttcggtttcgtcgctctgaacaaagatgatgaagaactcattgccaacttcccagtcgagggaactcaaccaaggcctcagtggaacgctattaccggagtgtatctatatagagaaaatcaaggacttcccttgtattcccgacttcacaaatgggcgcagggtctcgccggaaatggcgccgctccggataatgttgaaatggccctgttgccaagctag

SEQ ID NO: 110481 - DNA, 972 bp, Artificial Sequence
  Description of Artificial Sequence: Synthetic coding sequence
atggccgctttgattgccgaaaatttcaggtttctatccctattttttaagtccaaagacgtgatgatcttcaatggtttagtcgctctcgggaccgttgggtcacaggaactcttttccgtggtggcattccattgcccctgtagtcccgctagaaactacctgtatgggttggcagccatcggagtgcctgccttggtgctcttcatcatcgggataatcctcaataaccatacgtggaatttggtggccgagtgccagcatagacgcaccaagaattgctcagccgctcctactttccttctgttgagcagtatactgggcagagcagccgtcgctccagtcacatggagtgtcatttctctcctaaggggagaagcttacgtgtgtgccctgtctgaatttgtggaccccagttcactgactgccagagaggagcacttccctagtgcccatgccaccgagatactagctaggttcccctgcaaagaaaacccggacaacctctctgatttcagggaggaggtgagccggcggctacgctacgaatctcaattgtttggctggctgctcataggcgtcgtagcaattcttgtgtttctgaccaaatgtctgaagcactactgtagcccactgtcatatagacaggaggcctattgggcccagtatagagcgaacgaggaccagcttttccaacggactgctgaagttcacagccgtgtcttagctgcgaacaacgtgaggcgtttctttggctttgtcgcattaaacaaggacgatgaagagctcatagccaactttccggtcgagggcacacagcccagaccgcagtggaacgcgatcactggcgtttacctgtaccgcgagaatcaggggctgcctctctatagccggctacataaatgggcgcaggggctggctggtaacggggccgcaccggacaatgtcgaaatggccctgctgccatcttag

SEQ ID NO: 110482 - DNA, 657 bp, Artificial Sequence
  Description of Artificial Sequence: Synthetic coding sequence
atggcggcactgatagctgagaactttagatttctgtccctgtttttcaaatccaaggacgttatgatctttaacggcctcgtggccctgggaactgtggggagtcaagaactgttcagtgtggtcgcgttccactgtccttgttcacctgcacgaaattacctgtatggtcttgccgccataggtgttcctgctttggtgttattcataattggaatcattctgaacaaccacacctggaacctcgtggcagagtgtcagcatagaagaacgaagaactgcagcgcagcgccaacctttttgctgctgtcaagcatcttgggacgcgccgctgtggcccccgttacctggtctgtgataagccttctcaggggcgaagcctacgtttgtgcactgtccgagttcgtcgacccctcctcactgaccgcccgggaggaacatttccccagcgcgcacgctactgagattctggctcggtttccttgtaaggaaaatcccgacaatttgagcgactttcgtgaagaggtctccaggaggctaagatacgagtcccaggttcgaagctgtgccaaaggatcatccagcagtctcgtggtggccggtgaaaggtcgggagacggacttgtcctgaagctgggcctagtcctgaggggctag

SEQ ID NO: 110483 - DNA, 891 bp, Artificial Sequence
  Description of Artificial Sequence: Synthetic coding sequence
atggaatctatggctgtggccacagacggcggtgagcggccgggggtccccgctggctctggcctgtccgctagccaaagacgagctgagctgaggcgcaggaagttgctcatgaattccgaacagagaataaatcggattatgggctttcaccgccctgggtcgggggcggaagaagaatctcagacaaagagcaagcagcaagattccgacaagctgaattctctgtcggtaccaagtgtgagcaagcgggtcgtcctaggcgacagcgtctccactggcacaacagaccagcagggaggcgtggccgaggtgaaaggcactcaattgggcgacaaactagattcctttattaaaccgcccgagtgctccagtgacgtgaacctcgaattgcggcagcgcaatcggggggatttgactgccgattccgtacagagaggcagtcgccacggactggagcaatacctaagtaggttcgaagaggctatgaaactcaggaagcagctgatctcagagaagccctctcaggaagatgggaatactacagaagaatttgattctttccggatcttccggttggtgggttgtgctctccttgcactaggggttagggccttcgtttgtaagtaccttagtatattcgctccgtttctgaccctccagctggcttatatggggctgtataagtattttccaaagtctgagaaaaagatcaagacaactgtccttacagccgcactcttactgagtggcatccccgccgaagttatcaatcggtcgatggacacctactccaagatgggcgaggtcttcactgacctttgtgtctacttcttcacctttatattctgtcacgagctgcttgattattggggttccgaagtgccttag

SEQ ID NO: 110484 - DNA, 1113 bp, Artificial Sequence
  Description of Artificial Sequence: Synthetic coding sequence
atgcttggggctgtggagggcccgcgatggaagcaggccgaggacatccgcgacatctacgatttccgtgatgtgctgggtaccggtgcctttagcgaagtcatactggcagaagataagaggactcagaagctggtggcaatcaagtgcatcgcgaaagaagcattagagggcaaggagggaagtatggagaacgagatcgctgtgctccacaaaattaagcatccaaatattgttgcgctggatgatatctacgaaagcggcggtcatctgtaccttatcatgcagctagtatctgggggagaactctttgaccggattgtggagaagggattttacaccgagagagacgccagtcggttgatttttcaagtgttagatgcagttaaataccttcacgacctcggcatagtccatcgagacctgaagcccgagaaccttctttactattcattagacgaggatagtaaaatcatgatctccgacttcggtttgtccaagatggaagatccgggctctgtgttaagcacggcttgtgggacaccaggctacgtcgctcccgaggtgttggctcagaaaccgtacagcaaggcggtggactgttggtccattggcgtgatcgcatacatattgctgtgtggttatcccccattttacgacgaaaatgatgcgaagttgttcgaacagatcttgaaggccgagtatgagttcgactccccctactgggacgatatctccgatagcgccaaagattttatcagacacttgatggaaaaagaccctgaaaagagatttacatgtgagcaggccctgcagcacccgtggattgctggagataccgcactggacaaaaatatccaccagagcgtgtcagagcaaataaagaagaacttcgctaaaagcaagtggaaacaggccttcaacgccaccgctgtggtccggcatatgcggaagcttcagctgggtacgtctcaggagggtcagggccagaccgcctcacatggcgaactgctgactccagttgccggcggacccgccgctggttgttgctgccgagactgttgtgtggagcccggaacggaactgtcccctacactgccccaccagctgtag

SEQ ID NO: 110485 - DNA, 1437 bp, Artificial Sequence
  Description of Artificial Sequence: Synthetic coding sequence
atggccaccattacgtgcacaagattcacagaggaataccagctctttgaagagctgggcaaaggagccttcagcgtcgtgcgaagatgcgtgaaggtcctcgcgggccaggagtacgccgccaagattattaatactaagaagctgtcagctagagatcatcagaagctggagagagaggcacgcatctgcagattgctgaaacaccccaacattgttcggctccacgatagtatatccgaggaaggtcatcactacttgatcttcgaccttgttacaggaggagaactcttcgaggatatagtggccagagagtactatagtgaagccgatgcctcacattgcattcagcagatcctcgaggctgtgctgcactgtcatcagatgggcgtagttcatcgggacctgaaaccggagaacctcttgctggctagcaagctgaagggggctgctgtgaaactggctgatttcggcctggcgattgaagtcgagggcgaacagcaagcttggtttggcttcgccggaactcctggatacttaagtcctgaggttctccgaaaagatccttatggcaagccggtggacctgtgggcatgtggcgtgatcttatatatacttcttgttggctaccctccgttttgggacgaggaccaacaccgtttataccaacagatcaaagccggggcatacgactttccatcccctgaatgggatacagtgacccctgaagcgaaggatctaattaataaaatgttgacaattaacccttccaagagaatcaccgcagctgaagcacttaaacacccttggatctcccaccgctccaccgtggcctcttgtatgcacaggcaggagaccgtcgattgtctgaagaagtttaacgcccgccgaaagctgaaaggtgcaatactcacaacaatgctcgccacccgtaatttcagcggaggcaagagcggggggaataagaaatcggacggcgtaaaggagtcctcggagtccactaacaccaccatcgaagatgaggacacaaaggtgcgcaagcaggagatcatcaaggtgaccgagcaactgattgaggcaatttctaatggagacttcgaatcctataccaagatgtgcgaccccggcatgaccgcgttcgagcccgaagccctgggcaacctggtagagggcttagactttcacagattctactttgagaacctttggtctaggaattccaaaccagttcacaccacgattctcaatccacacatccacctcatgggtgatgagagcgcgtgtatcgcctacatacgcatcacccagtatctcgatgctggcgggatacctcgcacggcccagagcgaagagacacgtgtgtggcacagacgggatggcaaatggcagatcgtccacttccaccgctccggggccccttctgttctgccccattag

SEQ ID NO: 110486 - DNA, 1470 bp, Artificial Sequence
  Description of Artificial Sequence: Synthetic coding sequence
atggcaacaatcacctgcacacggtttaccgaggaataccaattgttcgaggaattgggaaagggcgccttctccgtggtgcggagatgcgtgaaagtgcttgctggacaggaatacgcagcaaaaattatcaacacaaaaaaattgtcagcacgagatcatcagaaattagaaagagaggcccgcatttgcagattgttaaaacaccctaacatcgtccggctgcatgactcaatttccgaagaagggcaccactacctgattttcgacttagttaccggaggcgaacttttcgaagacattgtcgcccgagagtactactcggaggcagatgcaagtcattgcatacagcagatcttggaagcagtccttcactgtcaccagatgggggttgtccacagagatctgaaacctgagaatcttttgttggcgagcaagcttaagggggctgctgtgaagctggcagactttggtttggcgatagaggtggaaggcgagcagcaagcgtggtttgggtttgccggcacgcccggatacctctctcccgaggtcttgagaaaagacccatacggcaagcctgtggatctgtgggcctgcggggtgattttgtatatcttgctggtggggtatccaccattttgggatgaagatcagcaccgcctttaccagcagatcaaggcaggcgcatatgactttccctctccggagtgggataccgtgacacccgaggccaaagatctgatcaataagatgctgaccatcaatccaagcaagcggattaccgccgccgaggctcttaaacatccctggatcagccaccgctccactgtcgcgtcctgtatgcaccggcaggagacagtggactgtctcaagaaatttaatgcacggagaaagcttaaaggcgctattcttactaccatgctagccaccagaaactttagcggaggcaagagcggaggtaacaagaagtctgatggggtaaaaaagagaaaaagcagctccagcgttcagcttatggagtcaagcgagtctaccaacaccactatcgaagatgaggataccaaagttcgcaagcaagagatcataaaggttacagagcagctgatagaagctatcagcaacggcgatttcgaaagctatactaaaatgtgtgaccctggaatgacggcctttgaacccgaggcgctgggtaatctggtggagggcctggatttccataggttttactttgaaaatctgtggagcaggaactcaaaacccgtccatacaacaatattgaatcctcatatccacctcatgggagatgaaagcgcatgcatcgcttatattaggatcacacagtacctggatgccggtggaattccgcggacagcccagtccgaggagacgcgggtgtggcaccgaagagatggcaaatggcagattgtgcactttcaccgctccggagcaccctcagtgctgcctcactag

SEQ ID NO: 110487 - DNA, 276 bp, Artificial Sequence
  Description of Artificial Sequence: Synthetic coding sequence
atggccacaatcacctgtacaaggttcaccgaggagtatcagctgtttgaggaactgggtaagggggcattctcggtcgtcaggagatgtgtgaaggtgctcgccggacaggaatacgcagccaagattatcaataccaagaaactctctgcgcgagatcaccagaaactcgagcgggaagctaggatctgccggctcttaaaacaccctaacatagttcgactccacgacagcatttcagaggagggacaccactaccttatttttgacctgtag

SEQ ID NO: 110488 - DNA, 1554 bp, Artificial Sequence
  Description of Artificial Sequence: Synthetic coding sequence
atggccacgaccgttacatgcacccgatttaccgacgaataccagctctatgaggatattgggaagggcgcgtttagtgttgtacgcaggtgtgtaaagctctgcacgggccacgaatacgcggcaaagatcataaataccaagaagttgtcggcacgagaccatcagaaattggagcgtgaagcaaggatctgtagactgctgaaacactctaatatcgttcgcctccacgactcaataagcgaggagggctttcactacctggtgttcgatctcgtgacagggggcgagctctttgaggatatcgtggccagggagtactacagtgaggctgacgcgtcccattgcatccaacaaatactggaagcagtgttacactgccaccagatgggagtggtacacagagatctaaagcccgagaatctcctgctcgcatctaagtgtaagggcgccgctgtcaagctcgctgacttcggtctggccatcgaagtccagggagatcagcaagcatggtttggcttcgccggtacccctggctatctttctcctgaggtcctcagaaaagaggcgtacggtaagcctgtggacatctgggcctgtggagtgattctgtacattctgttggtcggatacccaccgttctgggacgaagaccagcacaagctgtatcaacagattaaggctggagcctatgatttcccttctcccgagtgggatacagtgactccggaggctaaaaatctgatcaatcagatgctcacaatcaatcctgcaaaaaggattaccgctcacgaggcactgaaacacccgtgggtgtgtcagaggagcacggtcgcctcgatgatgcatagacaggagaccgtggagtgtctgaagaaatttaacgcaaggcggaagttaaagggcgcaatcctgactaccatgttagctacccgcaatttcagcgcgaaaagcttgcttaacaaaaaggctgacggtgttaaacctcagacaaatagcacaaaaaattccgccgcagcgacctctcccaagggaacgctgcctcccgcagctctagagccacagacgaccgtgatacataacccggtggacggcatcaaagagtcttccgatagtgccaacacgaccatcgaagatgaggacgccaaggcacgaaaacaggagataattaagactaccgagcagctcattgaggcagtgaataatggcgattttgaggcctatgcaaagatctgcgatccaggcctcacaagttttgaaccagaggctctgggcaatctcgtggagggaatggacttccaccgtttttactttgagaacttgctggccaagaactccaaaccgatccataccaccatcctcaatccacacgtacacgtcatcggcgaggatgcagcctgcattgcctatatccgtctcacacagtacattgacggccagggcagaccacggacgtcccagtcggaggagactagagtgtggcaccggagagatgggaagtggcagaacgtccatttccattgttccggcgccccggtggcccctcttcagtag

SEQ ID NO: 110489 - DNA, 1350 bp, Artificial Sequence
  Description of Artificial Sequence: Synthetic coding sequence
atggctaccacagtgacgtgtactcgtttcacagatgagtaccagctctacgaagacattggaaaaggagcattctccgtcgttcggagatgcgtgaagctgtgtacagggcacgagtacgccgctaagatcattaacaccaagaaactgagcgcgcgggatcatcagaaactagagcgcgaggcccggatttgtagattgcttaagcattcaaatatcgttaggctccacgactctatttcagaggagggttttcattatctggtttttgacctagtcacaggcggcgagctctttgaggacatcgtggctcgcgaatactactccgaagccgacgcgtctcactgcatccaacaaatactggaggctgtactccactgccaccaaatgggagtggtgcatcgcgacttgaagcctgagaacctcctgctcgcgtcgaaatgtaaaggcgccgctgtgaagctggccgatttcggcctggcaattgaagtccagggagaccaacaggcctggtttggctttgcagggacacctggctatctgtctccagaggtcttgaggaaagaggcctatggcaagccagtcgatatatgggcctgtggtgtgatcttgtacatattgttggttgggtacccccctttctgggatgaagatcagcataaactgtatcagcagatcaaggcaggggcttatgacttcccctcacccgagtgggatactgttacgccggaggccaaaaaccttatcaaccagatgctcaccattaacccagctaaaagaataactgcacacgaagctttgaaacacccatgggtgtgccagagatctaccgtggcatcaatgatgcaccgacaggagacagtcgagtgtctcaagaagttcaatgcacgccggaaactgaagggcgctatacttactaccatgctcgccacgcggaacttcagcgctcgcaagcaggagattattaaaacgactgagcagctcattgaagcagtgaataatggggactttgaagcctacgccaagatctgcgatccagggctgacgtctttcgagcccgaagctctcggtaatctggtggaggggatggactttcacaggttctatttcgaaaatcttctggcaaaaaacagcaagcctatccacaccacgatcctaaacccccacgtgcatgtgataggagaagacgccgcttgtatcgcatatatccgtctgactcagtacattgatggtcagggacgtcctaggaccagccagtccgaagaaacgagggtttggcacaggagagatggtaagtggcaaaatgttcatttccactgctccggggccccagtggcgccgttacagtag

SEQ ID NO: 110490 - DNA, 1479 bp, Artificial Sequence
  Description of Artificial Sequence: Synthetic coding sequence
atggccaccactgtgacctgcacccggtttacggatgagtaccaactctatgaggatatcggcaaaggggcgttcagtgttgtccgacgttgtgtcaagctctgtaccggccacgaatacgccgctaaaattattaataccaagaagttatctgcgagagaccatcagaagctcgagagagaggcgagaatatgtagacttctgaaacattccaatatcgtacgactgcatgattccatttctgaggagggttttcactacctggttttcgacctggtaaccggcggggagcttttcgaggatatcgttgccagagaatactactccgaggccgatgcctctcattgtattcagcagatcctggaggccgtgctgcattgccatcagatgggggttgtgcaccgggacttaaagcctgaaaacctgctgctggccagtaaatgcaaaggggcagccgtgaaacttgcggattttgggctcgccatcgaggtgcaaggtgatcagcaagcatggttcggctttgccggaactcccggctacctctctccagaagtgctgaggaaggaggcttacggcaaacccgtcgacatttgggcctgtggagtgatcctctatattctgctggtaggttatccacctttttgggacgaggaccagcacaaattataccaacaaataaaggccggggcctacgacttcccctcccctgaatgggataccgtgacgcctgaggctaaaaacttaatcaaccaaatgctgacaatcaaccctgccaagaggattacagcccacgaggccttaaaacacccctgggtgtgtcagaggtctacagtggccagcatgatgcaccggcaggagacagtcgagtgcctgaaaaaatttaacgcccgccgaaagcttaagggtgccatccttactaccatgttagccacccgcaactttagcgtcgggagacagactactgctccggccacaatgtctaccgcagcatctggaaccactatgggcttagtggaacaggctaagtctctgctcaataagaaagctgatggcgtcaaagagccccagaccaccgtcatccataacccagttgatggtatcaaagaatcatccgattcggccaatacaacaattgaggacgaagacgccaaagcacggaagcaagagatcatcaagaccacagaacagctgatagaggccgtcaacaacggcgattttgaagcatatgcattctactttgagaacctgttggccaaaaattctaaaccaattcatacgacaatcctcaacccccatgtgcacgtcattggggaggacgcagcatgtatcgcctatattcgactgacccagtacatagatggccagggccgcccccgcacctcacagagtgaagagacacgggtctggcaccgcagagacgggaagtggcagaatgttcactttcattgcagcggtgcacccgtcgctccacttcagtag

SEQ ID NO: 110491 - DNA, 1629 bp, Artificial Sequence
  Description of Artificial Sequence: Synthetic coding sequence
atggctactacagtgacatgtacacgtttcacagacgagtaccagttgtatgaggatattggaaaaggggctttttccgtcgtgcggcgatgtgtgaagttgtgtacaggtcatgagtatgctgccaaaattatcaacacaaaaaagctgtccgccagagaccaccagaagctggagcgcgaagctaggatctgccgcctcctgaagcatagtaacatcgtgcgcctacatgacagcatctctgaagagggctttcattacctcgtattcgatctagtgacaggcggtgagctctttgaggatatagtcgcaagagagtactattcagaagccgatgcttctcattgcatccagcagatccttgaagctgtgcttcattgccaccagatgggtgttgtgcaccgggacctgaagccagagaacttgctgctcgcctccaagtgcaagggagccgcagtaaagctggctgacttcgggttggccattgaagtgcaaggtgaccagcaggcttggttcggcttcgcaggaactcctggctacctctctcccgaggttctgaggaaagaagcatacgggaaaccggtagacatctgggcctgcggagtgatattgtacatactgcttgtgggctatccccccttctgggacgaagaccagcacaaactctaccaacagatcaaagctggagcctacgactttccctcacctgagtgggataccgtaaccccagaagccaagaacctcatcaaccagatgttgactatcaaccccgccaaaagaattaccgcacacgaagctttaaaacatccatgggtgtgccaacgctcaaccgttgccagcatgatgcataggcaggaaactgtggaatgcctcaaaaagttcaacgcgcggcggaagcttaagggagctatcctgaccaccatgctcgccacgcgcaactttagtgtggggcgccaaaccacagctcccgccactatgtctaccgccgcaagtgggaccactatggggctcgttgagcaggccaaatctttgctcaataagaaggccgatggggtgaagccccagaccaactcaacaaagaactctgcggctgccactagcccaaaagggaccctgcctccagctgctcttgagccccagaccacagtgatccacaaccctgtcgatggcatcaaggaaagcagtgactccgccaatactactatcgaagacgaagatgccaaagcccgcaaacaggagatcattaaaactactgaacagctcatcgaggccgtgaataatggtgactttgaggcttacgctaaaatttgcgatcctggcctgacctcgttcgagcccgaagcactcggtaaccttgtggagggcatggacttccatcgtttttacttcgagaatctgctggctaaaaattcaaagcccattcatacgaccatcctgaatccccacgtacacgtgatcggggaagatgccgcctgcatagcctatattcgccttacccagtacatagacgggcaaggaaggccacgcacctcacaatctgaagaaacaagggtttggcaccgccgcgacggcaaatggcagaacgttcattttcactgctccggggcccccgtggcacctctgcagtag

SEQ ID NO: 110492 - DNA, 1440 bp, Artificial Sequence
  Description of Artificial Sequence: Synthetic coding sequence
atggcgactactgtaacctgcacgcgcttcacagatgagtaccagctgtatgaagatatcgggaaaggggcattctctgttgtacgccggtgcgtcaagctctgcacaggacatgagtacgctgcgaagattataaacacaaaaaagctatcagcccgcgaccaccaaaaacttgagagagaggcccgcatttgtaggcttctgaaacactccaatattgtccggctccacgattccatctctgaggaagggtttcactatctcgtgtttgacctcgtgacaggcggcgagctattcgaggacatcgtggcgagggagtactactcggaggccgacgcaagccattgcatccagcagatccttgaggccgtacttcattgtcatcagatgggggtggtgcatcgggatttgaaacctgagaatctcctgctggcatctaagtgcaagggcgctgcggtcaagcttgccgactttggtctggcgattgaggtccagggcgatcagcaggcatggttcggcttcgccggtacccctggatacctttccccagaggtgcttagaaaggaggcttacggcaaacctgtggacatttgggcttgtggagttattctttatatcctacttgtaggatatccacctttttgggacgaagatcagcataagctatatcaacagatcaaggccggtgcttacgattttccctctccagagtgggacaccgtgacaccagaggcaaaaaacctgattaatcagatgctcacgattaatcctgcaaagcgaattaccgcccacgaggccctcaagcatccgtgggtgtgccagcggtctactgttgcttctatgatgcaccgccaggaaacagtggaatgtttaaagaaattcaacgcgagaagaaaactgaagggagccattctgacaaccatgctcgccacgcgaaacttcagtgctgcaaaatcccttctgaacaaaaaggccgacggcgttaaagagagctcagattccgcgaacacaacaatcgaggatgaggacgccaaagctaggaaacaggagattataaaaacaaccgagcagctgatcgaagctgtcaacaacggtgatttcgaggcgtatgcaaagatctgcgatcctggtctgacaagctttgagcccgaggccctcggcaatttggtagaaggcatggactttcacagattctacttcgaaaacctgctggcaaaaaattccaaaccgattcacacaacaatcctcaatcctcatgtgcacgtgataggcgaagacgccgcttgcattgcctatataaggctgacacagtacatcgatgggcaaggccggccaaggacctcgcagtcagaggaaaccagggtttggcacaggagagacggaaaatggcaaaacgtacatttccactgtagcggggctcctgttgcccctctccaatag

SEQ ID NO: 110493 - DNA, 1512 bp, Artificial Sequence
  Description of Artificial Sequence: Synthetic coding sequence
atggccacaactgtcacttgtactcgattcactgatgaatatcaactgtatgaagacattggcaaaggtgctttctccgtggtgcgaagatgcgtgaaattgtgcactggacacgaatatgctgctaaaattattaacacaaaaaagctcagcgcccgagatcaccagaaactggagagagaagcacgcatctgccggttgctgaagcattctaacatagtgaggctgcacgacagcatctccgaagaagggttccactatttggtattcgacttggtcaccggaggagagctgtttgaagatatcgtcgctagggagtactactctgaagcagacgcatcccattgtatccagcaaattttagaggccgtgctgcattgccaccaaatgggagtcgtgcacagagacctgaagccagagaacctgctgctggcttctaaatgtaaaggggctgccgtgaagctagcagacttcgggttggccattgaggttcagggcgaccaacaggcttggttcggctttgctggaacccccggatatctatcccccgaagttctgcggaaggaggcatatggcaaaccagtagatatctgggcttgtggggtaatactgtatatcctgctggtaggctaccccccattctgggacgaggaccagcacaaactctaccaacaaataaaggccggtgcgtatgatttcccaagccctgaatgggatactgtgacccctgaggcgaagaatcttataaatcagatgttgactatcaaccctgctaaaagaataaccgcccacgaggccctcaaacatccctgggtctgtcagaggtcaacagtggcttctatgatgcaccggcaggagaccgttgaatgcctgaaaaagtttaacgccagaagaaaacttaaaggtgcaatactcactacaatgctggccactcggaatttctctgctgcgaaatctttacttaataaaaaggcggatggagtcaaaccacagacaaattctactaaaaatagcgccgcggcgacctcacccaaaggcaccttgccacctgcggcacttgagagtagcgactcagccaatacaactatagaggacgaagacgctaaagcacgaaaacaggagattattaagactacagagcagctgatcgaagccgtgaacaacggcgactttgaggcttatgccaagatctgcgatccgggtctgacctcatttgagcctgaggcgcttggtaacctcgtggaagggatggatttccatagattctacttcgagaaccttctggccaagaattctaaacccattcatactactattctcaaccctcacgtacacgtgataggagaggatgccgcctgtatcgcttacattcgactaacacagtacatcgacgggcaggggcgcccaaggaccagccagagcgaagagacccgcgtatggcaccgccgcgatgggaagtggcagaatgtgcacttccattgttctggcgctcctgtagcaccgctccagtag

SEQ ID NO: 110494 - DNA, 1557 bp, Artificial Sequence
  Description of Artificial Sequence: Synthetic coding sequence
atggcgacgaccgtcacatgcaccaggttcactgacgaataccagttgtatgaagacataggtaagggcgccttttctgtggttagaaggtgcgtgaaactttgtactggtcacgaatacgcagcaaaaataatcaatacgaaaaagttaagtgcccgtgaccatcagaagttagagcgagaggccagaatctgtcgacttctaaagcattccaatatagtacgcctgcatgattcaatctctgaggaaggatttcactacctggtgttcgatttagtcactggaggcgagctgttcgaggatatagtcgcgcgcgagtattacagtgaggccgacgcctcgcattgcattcagcagatccttgaggcagttctgcattgccatcagatgggtgttgtgcacagggatctgaaacccgagaatctcctgctggcctcaaaatgtaagggggctgccgtgaagttggccgactttggactcgctatcgaggtgcagggagatcaacaggcgtggtttggttttgcaggaacgcccgggtatctgtctccagaggtcctgcgcaaggaagcctacggcaaacctgtggatatatgggcctgcggagttatcctgtacattttgctagttgggtacccacctttctgggatgaggaccagcataagctgtatcaacagatcaaggcaggcgcatacgacttcccctcaccagagtgggacacagtcacaccagaagccaaaaacctcatcaaccagatgctcacaatcaaccccgccaagcgcataacagcgcacgaagcccttaagcacccctgggtttgccaaaggtcgacagttgcttcaatgatgcataggcaggagaccgtggaatgtctgaaaaaattcaatgcgcgccggaagttaaagggcgccatcctgactactatgctggctacccgtaactttagcgcggccaagtctctattgaacaagaaggcagacggggtgaaaccacagactaatagcactaagaatagcgcagccgcgacatctcccaaaggcactctgccacctgccgccctggagccgcagactacggtgatacacaatccagtggatggaatcaaggaaagctccgactccgcaaacacgactattgaggatgaagatgctaaagcaagaaagcaggagattattaagactactgaacaactgatagaggccgtcaataatggcgatttcgaagcatatgccaaaatctgcgatcccggactgacatcatttgagcctgaggccctgggaaatctcgtggaggggatggattttcatcgcttctatttcgaaaatctcttggcgaagaacagcaaacccatccatacaacaattttgaacccccacgttcacgtgataggagaagatgcggcctgcatcgcatacattagacttactcaatacatagacggacagggcagacccagaacctcacaatccgaggaaacacgtgtatggcaccggcgcgatggtaaatggcagaatgtgcatttccactgttctggagcaccagtggccccgttgcagtag

SEQ ID NO: 110495 - DNA, 2001 bp, Artificial Sequence
  Description of Artificial Sequence: Synthetic coding sequence
atggcaacaaccgtcacttgcacaaggttcacggacgaataccagctgtacgaagacattggtaagggggcattcagtgtagtgaggcggtgcgtcaagctttgcaccggacatgagtatgctgctaaaatcatcaacactaagaagttgtccgccagagaccatcagaaattagaacgggaagcacgcatctgcaggctcttgaagcacagtaatattgttcgtctccacgacagcatttccgaggagggctttcattatctggtgtttgatctcgtcaccggaggcgagcttttcgaagacattgtcgcccgggagtactatagtgaggctgatgcctcccactgtatccaacagatcctggaggctgtgctccattgccaccagatgggggtcgtccacagagacctgaaacctgaaaatcttctcctggcaagcaagtgtaaaggcgcagccgtcaagttagctgactttggacttgctatcgaagtgcaaggggaccagcaggcctggttcgggttcgccggcactcccggctacttgtccccagaagtgttgcggaaggaggcgtatgggaagccggttgatatctgggcctgcggggtgatcctgtatatcttgttggtcggttatcctcccttctgggatgaagatcagcataaactctaccagcaaatcaaggcgggcgcctacgactttcccagccctgagtgggatacggttaccccggaggcaaagaacctgatcaatcagatgctcaccatcaaccccgcaaagcgcatcactgcacacgaagccttaaagcatccgtgggtctgccagcgcagtacggtcgcatctatgatgcaccgtcaggaaaccgtggagtgtctgaaaaagtttaatgcacgtcgcaaactcaaaggagcaatcctcactacaatgttagcaaccagaaatttctccgtgggacgtcagacgactgcacctgccactatgtcgactgccgcctccggcaccactatgggactcgttgaacaggccaagtctctattgaataaaaaggctgatggtgtgaagcctcagaccaattcgaccaaaaactctgcagccgcaacctctcctaaggggactctgcctcccgccgctctggaacctcagacgacggtcattcacaatcccgtggatggcatcaaagagtctagcgactccgctaatacgaccattgaagatgaagacgcaaaggcgccacgcgtgcccgacatcttgtcatctgtcagacgaggaagcggggcgcccgaagcagaggggcccttgccttgcccttcccccgcccccttttccccgctgcccgcacccagtccgcgcatatcagacatccttaattcagttaggcgcggcagcgggacccccgaggctgagggcccgctgagtgcggggccacccccctgcttgtcccccgccctgctggggcccctgagttcgccatccccccgaattagcgacatcctcaacagtgtcagacgtggaagtgggactccagaggcggaaggacccagccctgtaggaccacctccctgcccaagccccaccatacctggtcctctgcctactccgtctagaaagcaggaaatcatcaagaccaccgagcagcttatcgaagcggtgaataacggggattttgaggcctatgcaaaaatttgcgatcccggtctaacctctttcgagccagaagctctgggcaaccttgtggaggggatggatttccatcgtttctactttgaaaatctgctggcgaagaactctaaacctattcatactacgatacttaacccgcatgtccatgtgatcggcgaagatgctgcttgtattgcctacatccgccttacccagtacatagatgggcagggcagaccaagaacatcccagagcgaagaaacccgcgtttggcacagacgcgatgggaagtggcagaacgtacacttccattgcagtggcgctccagtagctccccttcagtag

SEQ ID NO: 110496 - DNA, 1629 bp, Artificial Sequence
  Description of Artificial Sequence: Synthetic coding sequence
atggccaccactgtgacgtgcactcgattcacggatgagtaccagctgtacgaggacataggcaaaggcgctttcagcgtggttcgcagatgcgtaaaactgtgcacaggccacgaatacgccgctaaaattattaatactaaaaaactgtccgctcgagatcaccaaaaactggagcgagaagcaagaatctgccggctcttaaaacatagcaatatcgtccgccttcacgatagtatatctgaagaaggattccactacctggtgtttgatctagttaccggaggtgagctgttcgaggacattgtcgcccgagagtactactccgaggcagacgcatcacactgtatccaacaaattctggaagcagtgttacactgccaccagatgggcgtggtccatcgcgatctcaagcccgagaatcttctgcttgcctcgaagtgcaaaggggccgcagttaaattggcagatttcgggctagcaattgaagtgcagggcgaccagcaggcctggtttggctttgccgggacacccggatacttaagtccagaagtcctgagaaaggaagcatacggaaagcctgtggacatctgggcctgcggcgtcatcctttacatcctgttagtcggctacccgccattctgggatgaggaccagcataaactgtaccaacaaataaaagcaggtgcatatgactttccaagcccagagtgggataccgttacaccagaggctaagaacttgatcaatcagatgcttactataaaccccgctaaacggattaccgcccatgaggccttgaaacacccctgggtctgtcaaaggtctacggttgcgtctatgatgcatcggcaggagacggtggaatgcctgaagaagttcaatgcacgccgcaaactaaagggcgcaatcctcacgacgatgctggccacaaggaactttagcgtcgggcgacagactactgctccagctactatgagcaccgccgcatcggggacgaccatgggacttgtagaacaggctaaatctctactgaataaaaaagccgatggcgtcaagcctcagactaactccactaaaaatagcgctgcagctacatccccgaagggcacattacccccagctgctcttgaaccccagactactgtgatccacaaccctgtggatgggataaaggagtctagtgattcggctaataccacgatcgaagatgaagacgcaaaagcccggaagcaggagattatcaagaccacagagcagctaatcgaggccgtcaacaatggcgattttgaggcttatgccaagatttgtgatcctgggctaacatctttcgagccagaggcactgggaaatctggtcgagggaatggacttccatcgcttctactttgaaaatctgctcgcaaaaaattcgaaacccattcatactacgattctgaacccccacgtgcacgtcataggtgaggatgccgcgtgcatcgcctatattaggctcacacagtacatcgacgggcaaggaaggccccgtactagccagtccgaggagacacgagtttggcatcgcagggatggcaaatggcagaatgttcacttccactgtagcggcgcacctgtggcccctctgcagtag

SEQ ID NO: 110497 - DNA, 1557 bp, Artificial Sequence
  Description of Artificial Sequence: Synthetic coding sequence
atggctactacagttacctgtacaaggtttacggatgaatatcagctatacgaggatattggtaagggcgcctttagtgttgtgcggaggtgtgtcaagctctgtacaggacacgagtatgccgccaaaatcatcaacaccaagaaactgtcagcccgtgaccaccaaaagctggagagggaggctcgaatctgtagattgctgaaacactcaaacattgtccgtctacacgattcaatctcagaggagggctttcactacctcgtttttgacttggtcaccggcggagagctttttgaagacattgtcgctcgggagtactacagtgaagccgacgccagccattgcattcagcagattctcgaggcagtacttcactgccatcagatgggcgttgtgcacagagacctgaaaccagagaatcttcttctggcgagtaaatgcaaaggggcagcggtgaagctggccgatttcggactggcaattgaggtgcagggcgaccagcaggcatggttcgggtttgctggaacccctggatatttatccccagaggttctgcgaaaggaggcctacggcaaacccgtagatatttgggcctgtggcgttatcctatatatattgctggttggctaccctccattttgggatgaggaccagcacaagttgtatcagcagatcaaagccggcgcctatgacttcccctctcccgaatgggatacagtcactccggaagccaagaatctgatcaaccagatgttaaccatcaatccggctaagcgaattaccgcacatgaagcgttgaagcacccttgggtttgccagcgtagcaccgtcgcatcaatgatgcaccggcaggagacagtggagtgcctgaagaagttcaatgcccgccggaaactgaaaggagccatactcaccaccatgctggcaaccagaaattttagtgcggccaaatccttactgaacaaaaaagcagatggcgtgaaaccgcagaccaatagcacaaagaatagcgcagccgcgacatcgcctaaaggcaccttgccacccgctgccctggaaccacagactacagtcatccacaaccccgtggacgggatcaaggagagcagcgattctgctaatacaaccatcgaggatgaagatgcaaaggcccgaaaacaggaaatcataaaaacaacagaacagctcattgaggccgtcaacaatggcgatttcgaagcatacgcaaagatctgcgatccagggctcacgtcttttgagccagaagctctcggcaacctggtggaaggaatggattttcaccggttttattttgaaaacctcctggcaaaaaattcaaagcctatccacaccaccatcctcaacccccatgtgcacgtcattggtgaagacgccgcctgtatcgcctatatccggctcactcagtacattgacggacaggggagaccaaggacatcccaaagcgaggaaacccgtgtctggcacagacgcgacgggaaatggcaaaacgttcactttcactgctctggcgcaccagtggctccactgcagtag

SEQ ID NO: 110498 - DNA, 918 bp, Artificial Sequence
  Description of Artificial Sequence: Synthetic coding sequence
atgggcgtcgtgcacagggacttgaagcccgaaaatctcttgctcgcctccaaatgtaaaggagccgccgtcaaactcgcggattttggtctggccatcgaggtccaaggagatcagcaagcttggttcggcttcgccgggacaccgggttacctctctcccgaagtcctgcgcaaggaggcttacggaaagcctgtggatatctgggcttgtggagttatcctgtatattttactggtcgggtatccacccttctgggatgaggatcagcacaaactttaccagcagattaaggccggcgcttatgactttccgtccccagagtgggataccgttacacctgaagccaagaatctgatcaaccagatgctaaccataaatccagccaaacggatcaccgcacatgaggccctcaaacatccctgggtgtgccagcgttccactgtagcatccatgatgcacaggcaggagacagtggagtgtctgaaaaagtttaatgctagaaggaaactcaaaggcgcgatactgactacaatgctggccaccagaaacttctccgtaggccgacagaccacagccccggccacaatgagcaccgccgcctcaggtaccaccatgggcttggtggaacaagcgaaaagtctgctgaataaaaaggccgacggcgtgaaaccacaaaccaacagcaccaaaaactccgccgccgctacctcacccaaggggacactcccacccgccgctctcgagccccaaactacagtgatccacaaccccgtcgatggaattaaggagagtagcgattccgcaaataccactatcgaggacgaggatgcaaaagcccggaaacaggaaataattaagactactgagcaactgattgaggcggtcaacaacggcgactttgaggcctatgcctag

SEQ ID NO: 110499 - DNA, 1437 bp, Artificial Sequence
  Description of Artificial Sequence: Synthetic coding sequence
atggcgtctacaactacctgcacgcgctttactgatgagtatcaattgttcgaggaattgggtaagggagcattctcagtggttcgccgatgcatgaagatacccactgggcaggaatacgcggctaagattataaatacaaagaagctttctgctagggaccaccagaagctcgagagagaagcccgtatctgtagactgttgaagcatcccaatatcgttagattacatgattctatctcagaagaaggattccattacctagtctttgacctggtcactggcggggagctctttgaggatatcgtggcccgcgagtattacagtgaggccgatgccagccactgtatccagcagatactcgagagcgtcaatcattgtcacctgaacggcatagtgcacagggacctgaaacctgagaatcttttactggcgagtaagagtaagggcgctgctgtcaagcttgctgacttcgggctcgccattgaagtgcaaggagatcagcaggcatggttcggtttcgctggaactccaggatatttatcccctgaggtacttaggaaggacccctacggcaaacctgtggacatgtgggcatgtggcgtgatcctgtacattcttctggtgggttatcccccattttgggacgaggaccagcacaggctgtatcagcagataaaggcaggcgcctacgacttcccaagcccggagtgggacacagttacacctgaggcaaaagatctgataaataaaatgctcaccataaaccccgccaaacgtattaccgcttccgaggccctgaaacacccttggatctgtcagcgcagcacggtcgcctccatgatgcatcgacaggagacagtggactgtctcaaaaaatttaatgcccggcgtaagcttaaaggcgcgatcctcaccacaatgctggccacgcggaatttcagtgccgcaaaatctcttctaaagaaaccagatggcgtcaaggaatctaccgagagtagtaacacaactatcgaagacgaggacgtgaaggctaggaagcaggaaattatcaaggttaccgagcagctgatcgaagccataaacaacggagacttcgaagcttatacgaagatatgcgatccaggacttaccgcatttgagcctgaggctctcggtaatttggtggaagggatggattttcatagattctatttcgagaacgctctcagcaaatctaataaacctatccacaccataatcctcaatccccacgttcacctcgtgggggatgacgccgcctgtatcgcctacatacgtctgacccagtatatggacggaagcgggatgcctaagactatgcagtccgaagaaacaagagtttggcatcgcagagatgggaagtggcagaatgtccatttccatagatctggttctcccacggttcctatcaaatag

SEQ ID NO: 110500 - DNA, 1500 bp, Artificial Sequence
  Description of Artificial Sequence: Synthetic coding sequence
atggctagcaccactacatgtaccaggttcaccgatgagtatcagttatttgaggagcttggtaagggtgccttctccgtggttcggagatgcatgaaaattcctaccggacaggagtatgccgctaaaatcatcaataccaaaaaactgtccgccagggaccaccaaaaactggagcgtgaagcccggatctgccgcctgctgaaacaccccaatatcgtgagactgcacgattctatttccgaggagggctttcactatttagttttcgatctggtcacagggggcgaactgttcgaggacatcgtcgcgagagagtattactctgaagccgacgcatcccattgtatccagcagatcctcgagtcggtgaaccactgccatttaaatggaatcgtccaccgtgacctcaagcctgagaacctgctattagcctccaaatccaaaggggccgccgtcaaactcgccgacttcggactggcaattgaagttcagggagaccagcaggcgtggttcggcttcgcaggtaccccaggctacctgagccctgaggtcctcaggaaggacccctacggaaaaccggtggacatgtgggcctgtggcgtcatactctacatactgctcgttgggtatccgcccttctgggatgaggaccaacatcgcctgtatcaacaaattaaggctggagcttacgattttcccagccctgaatgggacaccgtcacaccagaggctaaggacctcatcaacaaaatgctcactatcaaccctgctaaacgtataactgccagcgaggcactaaaacatccgtggatttgccaacggagcacagtggcttctatgatgcatagacaagaaactgtggattgtctcaagaagttcaacgcccggaggaagctcaaaggggcaatccttacaaccatgctggctaccagaaactttagcgccgctaagagccttctcaagaaaccagacggtgtaaaggaatcaaccgaatcaagcaacacaacaattgaagacgaagatgtaaaggcccgcaaacaggagattatcaaggtgacggagcaactgattgaggcaattaacaacggcgacttcgaagcttataccaagatttgcgaccccggacttactgctttcgagccagaggctttgggcaatctggtggaaggcatggattttcatcgcttctactttgagaatgcgctgtcaaaatctaataagccaattcacactattatattaaatccccacgttcacctcgtgggcgacgatgctgcatgtatcgcctatattagactgacacagtatatggacggctctggaatgccaaaaactatgcagtctgaggagaccagagtgtggcaccggagagacgggaaatggcagaacgtgcatttccatcggagtgggagcccgacggtgccgattaagccaccatgcattcccaacgggaaggagaatttcagcggcggcacctcgctgtggcagaatatatag

SEQ ID NO: 110501 - DNA, 1437 bp, Artificial Sequence
  Description of Artificial Sequence: Synthetic coding sequence
atggcatccacaactacttgcactcgctttaccgacgaataccaactgtttgaggagctgggaaagggagcattttcggtggttaggaggtgtatgaagatacccaccggtcaggaatatgctgccaaaatcatcaacacaaaaaagttgtccgcgcgagaccatcagaaattagagcgcgaggcccggatctgtcgactgcttaagcaccccaatattgtcagactccacgattcaatttcagaagaggggttccactatctggttttcgatttagtgacgggaggcgaactgtttgaggacatcgtggcgcgggagtactacagcgaggcggacgccagccactgtatccagcaaattctagagtccgtgaaccattgccatcttaatggaattgtgcacagggacttgaaacctgaaaatttgttactggcttcaaagagtaagggcgctgccgtgaaactagcagattttggcctcgccattgaggtacagggtgatcaacaggcctggtttgggttcgcgggcacccccggatacttgtcaccagaagttctgaggaaagatccatatggcaaaccagtggacatgtgggcctgtggcgtcattctgtacatcctgctggtaggatacccaccattctgggatgaagatcagcacaggctataccaacaaattaaagcaggagcctacgactttccttctcccgagtgggatacagttactccagaggcgaaggacctgatcaataagatgctgactattaaccctgccaagaggattactgcaagtgaggccctgaagcatccatggatctgccagagatccactgtggccagcatgatgcaccgtcaggaaactgtggactgcctgaagaagttcaacgcccgacggaagttgaagggagctattctgacaaccatgctggccacccgcaatttctcagcagcaaagagtttactgaagaagccagatggagtcaaggagtccacagaatcttctaataccactattgaagacgaagatgtcaaagcccgcaaacaggagataatcaaggtcactgagcagttaatcgaggctattaataacggagacttcgaggcttacacaaaaatctgcgatcccggcctaactgctttcgaacctgaggcgctcggcaacttagttgaaggaatggatttccacaggttttattttgagaatgcactctccaaatccaacaagccgatccatacaatcattttaaacccacatgttcatcttgtaggggacgacgccgcttgtatcgcctacatccggctcacccagtatatggatggttccggaatgccaaaaacaatgcaatccgaggaaacgcgagtgtggcacagacgcgacggtaagtggcagaatgtacactttcatagatctgggagccccacggtgcctatcaagtag

SEQ ID NO: 110502 - DNA, 1479 bp, Artificial Sequence
  Description of Artificial Sequence: Synthetic coding sequence
atggcctctaccaccacttgtacacgcttcaccgatgaataccagttgtttgaggaactcggtaagggagccttcagcgttgtacgtcgctgcatgaagattcccacgggtcaggaatatgccgctaaaatcatcaacaccaagaagctgtctgccagggatcaccagaagctcgaacgggaagcccggatatgtcgtttactgaagcaccctaacatcgtccgactgcatgacagtatctctgaagagggcttccactacttagtttttgacctggttaccggaggagagctttttgaggacatagtcgcgagagagtattacagcgaggctgatgcctcccattgtatccagcagattctggagtccgtgaaccattgccatcttaacggcatagttcaccgggacctaaagcctgaaaacctgcttctggcctccaagagtaagggcgcagcagtgaaactggcagactttgggcttgcaatcgaggttcagggtgatcagcaggcctggtttggtttcgccggtactcccggttacttgagtcccgaagtattaaggaaagatccatatggcaagcccgtggacatgtgggcgtgcggggtgatactgtacatcctgctggttggctatccgccattttgggacgaggaccagcacaggctgtaccagcagatcaaagctggcgcttatgattttccaagcccggaatgggacacggtcacacctgaagctaaagatctgataaacaaaatgcttactatcaacccggcaaaaaggatcactgcctctgaggccttgaagcacccatggatctgccagcgctctactgttgcgtcgatgatgcacaggcaggagacagtggattgcttgaaaaaatttaacgcccgccgaaagttaaagggtgcgattctcaccaccatgctggcaaccagaaacttcagtgctgcaaaaagccttctgaaaaaacccgatggtgtgaaggagcctcaaacgactgtgattcacaaccctgatggcaataaagagtctactgaatcatcaaacaccacaatcgaagatgaggatgtgaaggcaagaaagcaagagattataaaagtcacggagcaactaatcgaagccatcaataacggggattttgaggcctacacgaaaatttgcgatccgggcctgactgcattcgagccagaggccctcggtaatctggtcgagggaatggacttccatcggttttactttgaaaacgcgctgagtaaaagtaataagccaattcacaccattatcttgaatccacacgtccacctcgtgggcgacgacgctgcgtgcatcgcctacattcggctcacacaatacatggatggcagcggaatgcccaagaccatgcagtctgaggagacacgggtatggcataggcgcgatggaaagtggcaaaatgtccacttccacaggtcagggagtcctactgtacccatcaagtag

SEQ ID NO: 110503 - DNA, 1533 bp, Artificial Sequence
  Description of Artificial Sequence: Synthetic coding sequence
atggcctcgacaactacctgtaccagatttacagacgagtaccagctctttgaggagctgggtaagggcgcgttctcggtagtacgtaggtgtatgaagattcccaccggtcaggaatacgccgccaagatcattaatactaagaagctgtcagcaagagatcatcagaaactcgagcgggaagctcgcatctgccgactgttgaagcaccctaatatagtccgcctccatgattcgatcagtgaagaaggcttccattacttggtgttcgacctggtgaccggtggggaattgtttgaggatatcgtcgcacgcgaatactattccgaagctgacgcgtctcactgcatccagcaaattttggaaagcgtaaaccactgtcacctcaatggtattgtccatagggatctgaaacctgaaaacctattgctcgcctctaaatctaagggggcggccgttaagctggccgacttcggtctggcgatcgaagtccagggcgatcagcaggcttggttcgggttcgctggtactcccggatacttgagccccgaggtcctgcgtaaggatccctatgggaagcccgtggacatgtgggcgtgcggtgtgattttgtatattctgctcgttgggtatcctccattctgggatgaagatcagcatcgcctctatcaacagattaaagcgggagcctacgacttccctagccccgagtgggacacggtcactccggaagcgaaggacctgataaacaaaatgctgaccatcaatccggcaaaaaggatcactgccagtgaagcactgaagcacccttggatttgccagcgctccaccgtggcgtctatgatgcatcggcaggaaactgtggactgtcttaagaaatttaacgctaggaggaagctcaagggcgccattctcacaaccatgttggctacccgtaacttttcagcagccaagtccttgctgaagaaacctgatggagtgaaaaaaaggaaatcttccagctcagtccagatgatggaatccaccgagagtagtaatactactatagaagatgaagatgtcaaagcacgcaagcaggagatcattaaagtgaccgaacagcttattgaagccatcaataatggagatttcgaagcctataccaagatctgcgacccaggcttaaccgcctttgagccagaggccctgggcaatctcgtggagggcatggacttccatcgcttctactttgaaaacgcgctctccaagtccaacaaacctatccataccattattttaaaccctcacgtgcacctcgtgggggatgacgctgcctgtattgcgtacatccgactcacacaatatatggacgggtcgggtatgcctaaaactatgcagtccgaggaaacccgggtgtggcaccgacgtgatgggaagtggcagaacgtccacttccatcgctctggctcccccactgtgccgatcaagccaccttgcattccgaacgggaaagaaaattttagcggaggcacaagcttatggcagaacatatag

SEQ ID NO: 110504 - DNA, 1542 bp, Artificial Sequence
  Description of Artificial Sequence: Synthetic coding sequence
atggcttctactaccacctgcacacgtttcactgacgagtaccaactctttgaggagctcgggaagggtgctttcagcgtcgttagaagatgtatgaagattcctactggccaggagtatgccgccaaaatcataaataccaaaaagctatcggctagagatcaccagaaactggaacgcgaggccaggatttgcagattgctaaagcaccccaatatcgttcgcctccatgactccataagcgaggaaggattccattacctggtgtttgatctggtaaccgggggagagctgtttgaggacatcgtcgcacgtgagtattattccgaagcggatgcatcacattgtattcagcaaattttggagtccgtcaaccactgccaccttaatggcattgttcatagggacctaaaaccagaaaatttgttgttggcttccaagtctaagggggcagctgtgaaactggcagattttggtttggctatagaggtgcagggggaccagcaggcctggttcgggtttgccgggaccccgggatacctcagccctgaggtcctgcgaaaagacccttatggtaagcccgtggacatgtgggcctgcggcgttatcctgtacatactgctggtcggctaccctcccttttgggacgaagaccagcatcggctctaccagcaaattaaggctggagcctatgatttcccctccccagagtgggacaccgtcactcctgaagctaaggatctcatcaataagatgctcacgatcaacccggcaaagcggataaccgcctctgaagccctgaaacacccttggatttgccagagatctaccgtggcaagcatgatgcacaggcaagagactgtggattgcctcaagaagtttaacgcccggaggaaactgaagggagccattctgaccaccatgctggcaacccgaaactttagcgccgcaaagtccctgcttaaaaagccagacggcgtaaaggagcctcagaccacagttatccacaatccagacggcaacaaggagagcactgagagtagcaacaccacaattgaggacgaagacgttaaagcccgcaagcaggagatcatcaaggtaaccgaacaactgatcgaggccatcaacaatggagacttcgaggcctacacaaaaatctgcgatcccgggctgacagcttttgaaccagaagccctaggaaacctggtagagggcatggacttccacaggttttatttcgagaatgccctatccaaatccaacaagcctattcatacaataatccttaacccacatgtacatcttgtgggagatgacgccgcctgcatagcttacatccggctgacacagtacatggacggaagcggcatgccgaagactatgcagtctgaggagacccgggtatggcaccgaagggacggcaaatggcaaaatgtccacttccatcgctccggcagccctaccgtgccgatcaagcccccctgtatccctaacggaaaagagaatttctctgggggcaccagcctctggcagaacatttag

SEQ ID NO: 110505 - DNA, 1560 bp, Artificial Sequence
  Description of Artificial Sequence: Synthetic coding sequence
atggcaagcacgactacctgtactcgattcaccgacgagtaccagctcttcgaggagttgggtaagggagccttctctgtggtccgtcgctgcatgaagatccctaccggacaggaatacgctgccaaaataatcaacaccaaaaaactttccgcccgagaccaccagaagttggagagggaagcgaggatctgtcgactcctgaagcaccccaacatcgttcgcctccatgacagtatttcagaagaggggttccattatctggtattcgatttggttacgggcggtgagctgttcgaggatatcgtcgccagggagtactactctgaggccgacgcttcccactgtattcaacaaatcctcgagagcgtgaatcattgccacctgaatggaatcgtgcaccgggacttaaaacccgagaatctactgttggcgtcaaagagtaaaggagccgccgtgaagttggcagattttggactggcaattgaagtccaaggggaccagcaggcttggttcgggttcgccggcacccccggttacctctccccagaagtcttgagaaaggacccgtacggtaagccagtggatatgtgggcatgtggagtgatactgtatatcctgcttgtggggtacccgcctttctgggatgaggaccagcataggctctaccagcagataaaggccggcgcctatgattttccctctcccgagtgggatacagtgacgccggaggctaaggatcttatcaacaagatgctgacaatcaatcccgctaagcggattacagccagcgaggcccttaagcacccctggatttgccagcggtccacagtagcatctatgatgcatcgacaagagaccgtggactgcctgaagaaattcaatgcccggaggaaactcaagggcgctattctcacaaccatgttggctacacgtaactttagtgctgcaaaatcgctcctgaagaaacccgatggcgtgaagataaacaataaggcaaacgtggtgacctcccccaaagagaacatccctacgcctgctctcgaaagcacagagtcctcaaacaccactattgaagatgaggatgtcaaggccagaaagcaagaaatcatcaaagttacagaacagctgattgaggcgattaacaatggtgattttgaggcctataccaagatctgtgaccctgggctgacggcattcgagcccgaggccctggggaacctcgtcgaaggaatggatttccatcgattctactttgaaaatgcattgtctaagagcaataagcccatccacacgatcatcctgaacccccacgtccacctggtgggggacgatgccgcttgtatcgcctacatccggctgacccagtatatggacggcagcggaatgcctaagacgatgcagtcggaggagacacgtgtttggcatcgacgggacgggaaatggcagaacgtacacttccatcgctcggggagtcctacagtgcccatcaaacctccatgtattcctaatggcaaggagaatttctctggaggcacatcactctggcaaaacatctag

SEQ ID NO: 110506 - DNA, 1575 bp, Artificial Sequence
  Description of Artificial Sequence: Synthetic coding sequence
atggccagcacaacaacctgtactaggttcacagatgaatatcaattatttgaagagctgggcaaaggtgctttcagcgttgtcagacgctgtatgaaaataccaacgggccaagagtacgccgccaagatcattaatacgaaaaaactttcagctagagatcaccaaaagttggagcgggaagcgcgaatttgtcgtctcttgaagcatccaaacattgtaaggctgcatgattcaattagcgaagaaggctttcattacctcgtattcgacttagttacaggcggagagctgtttgaggacatcgttgcccgggaatactactctgaagcggatgccagccattgtatccagcaaatcttggagtcggtgaatcactgccacttaaatgggatcgtgcacagagatctcaaaccagagaacctgttgctagcctcaaaatcaaaaggggctgccgtgaagctggcagacttcggcctcgccatcgaggtacagggagaccagcaagcctggtttggctttgccggcacgcccggctacctatcccctgaagtactgcgtaaggacccctacgggaagcctgtggatatgtgggcttgtggagttatcctgtacattttgttggtcggataccctcccttctgggacgaggatcagcatcggctctatcaacagatcaaggctggagcatacgattttccctcacccgagtgggacaccgtgaccccagaagccaaggatctcattaacaaaatgctgactattaatcccgctaaaaggataaccgcctctgaggccctgaagcatccttggatctgtcaacgctccacagttgcctcaatgatgcaccgccaggagactgtggattgcttgaagaagtttaatgcccgccgaaaactcaagggcgccattctgacgactatgttggccacccgtaattttagcgccgcaaaatctctgctgaagaagccggacggagtgaagaagcgtaagtcctcttcctctgtgcagatgatggaaccgcaaaccactgttatccacaaccccgatggaaacaaggagagcacggagagcagcaacactaccatagaggatgaggacgtgaaagcacgtaagcaggaaatcatcaaggtcacagagcaattgatcgaggcaatcaacaacggcgactttgaagcttatacaaaaatatgcgaccccggccttactgcttttgagccagaggctctcggcaaccttgtggaaggcatggacttccacaggttttactttgagaacgcgctctcaaaatcaaataagccgattcacacaattatattgaacccacacgtacacctggttggtgatgacgccgcatgcattgcctacattcgcctaacacagtacatggacggctccgggatgccgaaaaccatgcagtcagaggaaacaagggtctggcacaggagagatggaaaatggcagaatgtgcatttccatcgctcagggtccccgactgtgcctatcaagcctccttgtatccccaatggtaaggagaacttttcgggtggtactagcctgtggcagaacatttag

SEQ ID NO: 110507 - DNA, 1470 bp, Artificial Sequence
  Description of Artificial Sequence: Synthetic coding sequence
atggccagcactacgacctgcactcgtttcactgacgagtatcagttatttgaagagctcgggaagggagccttctctgttgtgcggcgttgtatgaaaatcccaacaggtcaagaatacgccgccaaaatcatcaatactaagaaactctctgccagggatcatcagaagctcgaacgagaagcaagaatctgcaggctgctgaagcatccaaatattgtgagattgcacgactccatcagcgaagagggatttcattatctcgtttttgacttagtcacaggcggggagctattcgaagatatagtagcccgtgagtattactccgaggctgacgccagtcattgtattcagcagatcctcgagagcgtgaatcattgtcatcttaacggaatcgtccaccgcgacctcaaacccgagaatttgctcttggcctccaagtctaagggggccgccgtcaagctggccgatttcggcttggccatcgaggttcagggcgatcaacaggcctggttcggtttcgcagggactcctggttatctaagccccgaagtgttgcgtaaagatccctacggcaaacctgtggacatgtgggcctgtggagtcatcctgtatatcctgctcgtcggatacccaccgttttgggatgaagatcagcatagactttaccagcagataaaggcaggcgcctacgactttccttctcccgagtgggacactgtgacccctgaggctaaagacttgataaacaagatgctgacaattaatcccgcaaaaagaattaccgcgagcgaggctctgaaacatccatggatctgccaacggagcactgtggcaagtatgatgcacagacaggaaaccgtggactgccttaaaaagttcaatgctaggcgcaaacttaagggtgctatcctgactactatgctggccacaagaaactttagtgcggccaaatccctgctcaagaagccagacggcgtcaagaaaagaaaaagctctagcagcgtgcaaatgatggagtccaccgaatcctctaacactacaattgaggacgaggatgtgaaagctagaaagcaggagatcattaaggtgaccgagcagttaatagaagccataaacaacggcgacttcgaagcctatacaaagatatgtgacccggggctgactgcattcgagcctgaggccctgggtaacctcgtcgaaggcatggattttcatcgattctactttgagaatgctctgagtaaatctaataagcccatccacacaattatcctgaaccctcacgtgcacctggtcggggatgatgccgcttgcattgcttacattagactaacccagtatatggatggcagtggcatgccgaaaaccatgcagtcagaagaaacaagggtttggcatcggagggatggtaagtggcaaaacgtccacttccacaggtccgggtcccccaccgttcccatcaaatag

SEQ ID NO: 110508 - DNA, 549 bp, Artificial Sequence
  Description of Artificial Sequence: Synthetic coding sequence
tgacgtaaactgaaaggtgcaatcctcaccacgatgcttgcaacaagaaactttagcgctgctaaatcgctgctcaagaagcccgacggagtgaaggagagtaccgaaagcagtaacactacaatagaagatgaggacgtgaaagctaggaagcaggagatcattaaggtcaccgagcagctaattgaagctataaataacggcgactttgaggcttacaccaagatttgcgatcctgggctgaccgcgtttgagcctgaagctttgggaaacctggtggaaggcatggacttccacagattctactttgagaacgctctgtctaagtccaataaaccaatccacacgataatcctgaacccccacgtccacctggtcggggatgatgccgcctgtatcgcatacatccgcctgacccagtacatggacggctcagggatgccgaagacaatgcagtctgaagaaacacgggtttggcaccgtagggatggcaaatggcaaaatgtgcattttcatagaagcggctcacccaccgtgccaatcaagtag

SEQ ID NO: 110509 - DNA, 1437 bp, Artificial Sequence
  Description of Artificial Sequence: Synthetic coding sequence
atggcctcaaccactacctgcacaagatttacggatgaataccaattgttcgaggagttgggaaaaggcgccttctccgtcgtcagaaggtgtatgaaaatacccacagggcaagaatacgccgctaagataatcaatacaaaaaaattatccgctcgggatcatcaaaagcttgaacgggaggccagaatatgccgcctcctaaaacatccaaacatagttcgtctacacgattctatcagcgaggagggctttcactacctcgtgtttgacctggtgaccggaggcgaattgttcgaggatattgtcgcccgagagtattacagcgaggcagatgcctctcattgcatccagcagatccttgaaagcgtgaaccattgtcatctgaatgggatcgtacaccgggatcttaagcctgagaatttacttctcgcatcaaagtcaaaaggcgcagccgtcaagctggctgactttggcctcgcgatcgaggttcagggagatcagcaggcctggtttggatttgccgggacccctgggtacttaagccccgaggtgttgaggaaggacccttatggaaagccagtggacatgtgggcttgtggcgtcatcctgtacatactgcttgttgggtatccacccttctgggacgaggatcagcatcggctctatcagcagataaaggctggcgcatacgatttcccttccccagaatgggacacggttaccccagaagccaaggacctcataaacaaaatgctgactatcaacccggccaaacgtatcaccgcatccgaggcccttaagcacccatggatttgccagagatccaccgttgcgtcgatgatgcacagacaggaaaccgttgattgtcttaaaaaattcaacgctcgcaggaaactgaagggggctatactgaccacaatgctggccacgcgaaatttctcagctgccaaatccctactgaagaaacccgacggcgtaaaagagagtactgagtccagtaatacaactatagaggacgaagacgtgaaagctcgcaagcaagaaattatcaaggtgacagagcagctgatcgaggcaatcaacaacggcgatttcgaagcctacactaagatctgcgaccccgggctgaccgcattcgagccagaagccttaggaaacttagttgagggcatggatttccaccgtttctatttcgaaaatgccctgagcaaaagcaataaaccgattcatactattattctgaatccacatgtacaccttgtgggcgacgacgctgcctgcatcgcatacattcggctgacacaatatatggacggaagcggcatgccaaagacaatgcagagcgaagagacgcgcgtttggcataggagagacggaaaatggcagaatgtgcatttccataggtcaggctcccccaccgtgcctataaattag

SEQ ID NO: 110510 - DNA, 1590 bp, Artificial Sequence
  Description of Artificial Sequence: Synthetic coding sequence
atggccactacagccacatgtacaagatttactgatgactaccagctgttcgaagaactgggcaagggcgctttttctgttgttcgccgatgcgtcaaaaagacatctacccaagaatatgctgccaagattattaacacgaagaaactctccgctagagaccatcagaagctggagcgcgaggctcggatatgccggctcttgaagcacccaaacattgtacgtctgcacgattctatctccgaagagggatttcattacctggtgttcgacctcgtcacaggcggcgaactcttcgaagatatcgttgctcgggagtattattcagaggcggacgcatcccactgtattcaccagatccttgaatctgtgaaccacatccaccagcacgacattgttcatcgcgatctgaagccagagaacctgctgctagccagtaaatgtaagggcgccgccgtcaaacttgctgacttcggcctggcaatcgaagtgcaaggggagcaacaggcttggttcggcttcgcaggaacaccaggatacttgagtccagaagtgcttcgcaaagacccctatggcaagccagtcgatatatgggcttgcggtgttattctgtacattctgctggtcgggtaccccccattttgggatgaggaccagcacaaactgtaccaacaaatcaaggctggcgcgtatgactttcccagtcctgagtgggacactgtaaccccagaagcgaagaacttaataaaccagatgctgactattaaccccgccaagcggattacggccgaccaggccctgaagcacccatgggtgtgtcagcgaagcacagtcgctagcatgatgcatcggcaagagacagtcgaatgcctacgcaagttcaatgcgcgcaggaagctgaaaggagccatcctgacaacaatgctagttagtagaaacttctctgctgccaagtctttgctgaataaaaaaagtgatggtggagtcaaaaagaggaaatcaagtagttctgttcatctgatgccacagagcaacaataaaaacagcctagtcagccccgcccaggagcctgctcctctgcagactgcaatggaaccacagaccacagtcgtgcacaatgccacggatgggatcaagggaagtacagaatcgtgcaatactactactgaagacgaggatttaaaagttcggaaacaagagattattaagattacggagcaactcatcgaagcaataaataatggagacttcgaggcctatacaaagatctgtgatccaggactgacatcatttgagccagaggctctgggcaatctggtggaggggatggacttccataaattttattttgagaatttattatctaaaaacagtaaacccatccataccacgatcctgaatccccacgttcacgtgatcggtgaggatgctgcttgtattgcctacattaggttgactcaatatatcgacggccaaggaagacccagaacaagccaaagtgaagagacgcgcgtgtggcacaggcgagatgggaaatggcttaacgtgcactaccattgttccggcgctccagccgcacccctgcaatag

SEQ ID NO: 110511 - DNA, 1584 bp, Artificial Sequence
  Description of Artificial Sequence: Synthetic coding sequence
atggctaccactgcaacatgtacgcgcttcactgacgattatcaattattcgaggaattaggaaagggggccttcagtgtggttcggcggtgcgtgaagaagactagcacccaggagtatgcagctaagattattaatacaaagaagctctcggccagagatcaccagaagctggaaagggaggcccgaatatgtcgactgctgaagcacccaaacatagttaggctgcacgacagtatatccgaggagggatttcactacctggtgttcgacctcgtaaccggcggggagctatttgaggacattgtcgctagggaatactattccgaggccgatgctagccactgtattcaccagatcctagagtccgtgaatcatatccaccaacatgacatagtgcatagagacctcaaaccagagaacctgctactggcaagcaagtgcaaaggcgctgctgtgaagctggcagattttgggctggctattgaggtgcagggcgagcagcaggcctggtttggatttgctgggactccaggttatcttagtcccgaggttctgcggaaggacccctacggtaagcccgtggatatttgggcttgcggcgtcatactgtacatcctcttagttggatatcctcccttctgggacgaggaccagcataaactgtaccagcagattaaggctggcgcgtacgatttcccatctccagagtgggacacagttacaccagaggccaagaatctcattaatcagatgctcacaattaatcccgccaagcggatcacagccgatcaagccttgaaacatccctgggtgtgccagaggtcaactgtggcaagcatgatgcatagacaggagactgttgaatgcctccggaaatttaatgcccgcaggaaacttaagggggcaatactgacaacaatgctcgtatccagaaacttctcggtgggacggcaatccagcgctccagccagtcccgcagcttcagccgctgggctggccggacaagctgctaagtccctgttgaacaaaaaaagcgatgggggcgtgaagaaacgcaaaagttcaagctcggtgcacttaatggaacctcaaaccactgtcgtgcataatgccaccgacggcatcaagggatccactgagtcttgcaacacgaccaccgaagatgaagatttaaaagtgagaaaacaggagattataaaaatcacagagcagctcatcgaggcaataaataacggagatttcgaggcttatactaagatctgcgaccccggcttgacaagcttcgagccagaggcactggggaatctcgtggaagggatggacttccataaattttactttgagaacctcttgtccaagaatagtaagcccattcatacgactattttgaacccgcacgtgcacgtgattggggaagacgccgcgtgcatcgcctatattcggctgacccagtatattgacggccaaggacggccaaggactagtcagagcgaggaaacgagagtgtggcacaggagggatggcaagtggctgaatgtccattatcactgttccggagctcccgctgcacctttgcagtag

SEQ ID NO: 110512 - DNA, 1671 bp, Artificial Sequence
  Description of Artificial Sequence: Synthetic coding sequence
atggcaaccaccgccacctgcacacggtttacagacgattaccagctgtttgaagagctaggcaaaggcgctttttccgtggtgcgcaggtgcgtcaagaagacttccacacaggagtatgctgcaaaaatcatcaacactaaaaaactctctgcaagagatcaccagaagctggagagagaggcacggatttgcaggctgctcaaacaccctaacatcgttaggttgcacgatagcatcagcgaggaagggttccactacttggtctttgacctggtcaccggcggtgagctattcgaagatatcgtagcaagggaatattacagcgaagcggatgcatcccattgtatccatcaaatcttggagagtgttaatcacatacatcagcacgacatcgtgcacagagacttgaagccagagaacctcctcctggcctccaaatgtaagggcgctgctgtgaagctggccgacttcggcctagccattgaagttcagggagagcaacaggcttggttcgggtttgcgggaacccccggctacttgagccccgaggtgctcagaaaagacccctacggtaagcccgttgacatttgggcatgcggcgttatcctatatatcctgttggtaggctacccccctttctgggacgaagatcagcacaaactgtatcaacagatcaaggctggcgcctatgacttcccttcgcctgaatgggacactgtgacccctgaagcaaagaatttaatcaatcaaatgctgacaatcaacccagctaagcggatcactgctgatcaggccctgaaacacccatgggtgtgtcagcggtcaacagtggcctctatgatgcaccgccaggagacagtggagtgtctgcgcaaattcaacgcaaggcgcaagcttaaaggagcaattctcaccactatgctagtgtcccgcaacttctcagcggccaagtccttgctgaacaaaaaatctgatggcggtgtcaagccacagtcgaataacaagaatagtctggtgagcccagcccaggagcccgcccccttgcagacggctatggagcctcagacaactgtggtgcataatgcgaccgacggtattaagggttctaccgagagttgcaacactactaccgaagacgaagacctgaaggcggcgcccctgcggacgggaaatggcagcagcgtgcctgagggccgaagttctcgagacagaacagcaccttccgcaggaatgcagcctcaacctagcctgtgtagcagtgcgatgcggaaacaggaaatcattaagattactgagcagctcattgaggccattaataacggagattttgaagcatacaccaagatttgcgaccccggacttacgtcattcgagccagaggctctggggaacctagttgaggggatggattttcacaaattttatttcgaaaacctcctgagtaagaactccaaaccaatccacactacgatcttgaacccccacgtgcatgtgatcggtgaagacgccgcttgcatcgcgtacatccgtttgacccaatatatcgacggccagggacggcccagaacctcgcagtccgaggagacaagagtatggcacaggagggacggcaagtggcttaacgttcattaccactgcagcggagcacccgcagctcctctccagtag

SEQ ID NO: 110513 - DNA, 1488 bp, Artificial Sequence
  Description of Artificial Sequence: Synthetic coding sequence
atggctacgaccgccacgtgcacgcgcttcaccgatgattatcaactctttgaagagcttggtaagggtgctttctctgtcgtgcggaggtgcgtgaagaagacaagtacccaagagtatgcagccaagataatcaatactaaaaaattgagtgcaagagaccaccagaaactggagcgcgaggctaggatttgccgcctgctcaagcacccgaatatcgttcggctgcatgatagcatcagtgaggaagggttccactatctggtgtttgaccttgttactggcggtgagctgttcgaagatattgtcgcacgggagtattactccgaagctgacgcatcgcactgcattcaccagattcttgaaagcgtgaatcatatccatcagcatgacatcgtgcatagggatctaaagcccgaaaacctccttttagcttctaaatgcaagggggccgctgtgaagctggcagacttcggactggctatagaggtgcaaggtgagcaacaagcttggttcggatttgcaggcactcctggctacctgagtccagaggtcctacgcaaagacccctacggtaagccggtggacatctgggcctgcggtgtgatactctacatcctgttggttggctatccccctttttgggatgaggaccagcataagctgtatcagcagatcaaagctggagcttatgatttcccctcccctgagtgggacacggtcactccagaagctaagaatctgatcaaccagatgctgacaattaatccagctaaacgtattactgccgatcaggcactcaaacatccctgggtatgccaacgatcaacagtagcctctatgatgcaccggcaggagactgtcgagtgcttaagaaagttcaatgctaggcggaagctcaaaggcgccatactgacaacaatgctggtatcgcgcaacttcagcgctgctaaatcgctcctgaacaaaaagtcagatggaggcgtgaaagagccccagacaacagtagtacacaacgctactgacggcatcaagggttccaccgaatcttgtaacactacgacagaagatgaagaccttaaagtgcgtaaacaagagattattaaaattacagaacagttaattgaggctatcaataatggagactttgaagcttacactaagatctgtgacccagggctgacatcttttgaaccagaagccctagggaacctcgtggaaggcatggacttccataagttctacttcgaaaacctactgtcaaaaaacagtaagccaatccacaccacgatactgaaccctcatgtacatgtgataggtgaagacgcagcctgcatcgcttacatcagactcacacaatatatagacggccagggccgacctcggacctcccaatctgaagaaactagagtgtggcatcggcgggacggtaaatggttgaatgtgcattatcactgcagtggagcaccagccgccccactgcagtag

SEQ ID NO: 110514 - DNA, 1551 bp, Artificial Sequence
  Description of Artificial Sequence: Synthetic coding sequence
atggcaacaaccgctacctgcacccgctttactgacgactatcaactcttcgaagaactggggaaaggggcctttagcgttgtgagacggtgtgtcaaaaagacatctactcaggagtacgctgcaaagatcataaacactaagaaactttcggcgcgggaccatcaaaagttagagcgtgaggcccgaatctgcagacttcttaagcaccctaacatagtcaggttgcacgactccattagcgaagagggtttccattatctggtgttcgaccttgtcacagggggagaattatttgaggacatcgtggcccgcgaatattactctgaggcagacgccagccactgcatacaccagatcctagagagcgtcaatcatatacatcagcacgacatcgtccatcgcgatctgaaaccagaaaacctcctcctggcttcgaagtgcaagggtgctgccgtcaagttagctgatttcggactagctatcgaggtccagggagagcaacaggcgtggttcggatttgccggaaccccagggtatctgagccccgaagtgcttcgtaaagacccctacgggaaacccgtcgacatttgggcctgtggcgtgatcttgtacatcctcctggttggttatccacctttttgggacgaggatcagcataaactctatcagcagataaaggctggggcttacgacttccctagtcccgaatgggataccgtcactcctgaggccaaaaatctcattaaccaaatgctcacaataaatccagcaaagcggatcactgccgaccaggctcttaagcatccttgggtttgtcaaagaagcacggtggcatctatgatgcaccgccaggaaacggtggagtgcctgcgaaagttcaacgcccgaaggaagctcaaaggcgctatactgactacaatgttggtcagccggaatttctcagtggggaggcaatcatcggccccagccagcccagctgcttccgccgccggtcttgctggccaggctgccaagagtctactgaataagaagtccgatggcggtgtgaaggaaccacagaccacagtggtgcacaatgccaccgacggcattaagggcagcacagagtcttgtaacaccacaaccgaagacgaggacttgaaagtacggaaacaagaaatcattaaaataaccgagcagctcattgaagccataaataatggagattttgaggcttacactaagatttgtgacccgggattgacatcgttcgaacctgaagccctcgggaacctcgttgagggtatggacttccacaaattctactttgaaaacttgctctctaaaaacagtaagcctatccacacaacaatcctgaacccccatgtacacgtaatcggagaggacgccgcctgtattgcctatataaggctgacacaatatattgatgggcagggcaggccacggacctcacaaagcgaggaaacaagagtatggcacaggcgagatggcaagtggcttaacgtgcactatcactgttccggcgcccccgccgccccattgcagtag

SEQ ID NO: 110515 - DNA, 1602 bp, Artificial Sequence
  Description of Artificial Sequence: Synthetic coding sequence
atggccacgacggcaacatgtacacgcttcactgacgactatcagctttttgaagaactaggaaaaggtgcattttctgtggtgcgcagatgtgtgaagaaaacgagtactcaagaatacgcggccaagatcattaatacgaagaagctgtccgcccgggaccatcagaagctggagcgggaggctagaatttgtaggctgctcaaacaccctaacatagtgcgcctacacgatagtattagcgaagagggattccactacctggtttttgacctcgtcaccggcggtgagctgttcgaagacattgtggctcgcgaatattactcagaggcggatgcttcgcattgcatccaccagatcctggaatctgttaaccacatacatcagcacgatattgttcaccgagacctgaaaccggagaacctcctgttggctagcaagtgcaaaggagccgccgttaagctggctgatttcggtttggcaatcgaggtgcagggagagcaacaagcatggtttggattcgccggtactccaggttacctcagtccagaggtgctgcgcaaagacccctacggtaaacccgtggacatttgggcctgcggggtcatcctatacattttactcgtggggtaccctcctttctgggatgaagatcagcataaactgtatcagcagataaaggccggagcctatgactttccatctccagagtgggacaccgttacgccagaagcgaaaaatttgatcaatcagatgctcaccataaatcccgccaagcgaataactgccgatcaggcgttgaagcacccgtgggtatgccagagatcgactgtggcctccatgatgcacagacaggagacggtagagtgcctgagaaaattcaatgccagaaggaagctgaaaggggctattctcaccacaatgctggtgtcccgtaatttctcagcagccaaatcactgctgaataagaagtcagatggcggagttaaagagccgcagaccaccgtggtacataatgccacggatgggattaagggatccacagaaagctgcaacaccactaccgaagacgaagatctaaaggcagcccctctgaggacaggaaacgggtcgagtgtgcccgaaggtaggtcctccagagataggacggcaccctcagcagggatgcagcctcaaccttcattatgcagctctgcgatgaggaaacaggaaataatcaaaatcaccgaacagctgattgaggccattaacaacggcgatttcgaagcttataccaaaatctgcgatcctgggctgacctctttcgagccagaagcgttggggaatcttgtggagggaatggatttccacaagttctatttcgaaaatctcttatctaagaattccaagcccatccacaccaccatcctcaacccacacgtacacgtaattggtgaagatgctgcttgcatagcctatatacggctcacccagtatatcgacggacagggccggcctaggacctctcagagcgaagaaactcgggtgtggcatcgacgagatggcaagtggctgaatgtgcactaccactgctctggtgcgccggccgcacctctgcaatag

SEQ ID NO: 110516 - DNA, 1677 bp, Artificial Sequence
  Description of Artificial Sequence: Synthetic coding sequence
atggccaccacggctacgtgcacaagattcaccgacgattaccaacttttcgaggagctgggaaaaggagccttctcagtggtgaggcgatgcgtgaagaagacatccacacaagagtacgctgctaaaatcatcaacacaaagaaacttagcgcgcgcgaccaccaaaagctcgagcgcgaagcccgaatctgtcgcttattgaagcaccccaatatcgttcggctgcatgactccatttccgaggagggattccactacctggtcttcgacttggtcactggcggcgaactctttgaggatatagttgctagggaatattactctgaagctgatgcgtcacattgtattcatcagatcctcgagtctgtcaaccatatccatcagcacgatattgtgcatcgggatctgaaaccagaaaatctgttgttggcttccaagtgtaagggcgccgcagttaagctggccgatttcgggttggccatagaagtccagggcgagcagcaagcatggttcgggttcgctgggacccctgggtatctcagtcccgaagtgttaagaaaggatccgtatggcaagcccgtagacatctgggcatgcggggtgatcctgtacatactcctcgtgggttatcccccgttctgggatgaggaccagcacaagctttatcagcagattaaggcaggcgcatacgatttcccatcccccgaatgggacacagtaaccccagaggcaaaaaacctgatcaaccaaatgctgacaatcaaccccgccaagagaataacagccgatcaggcccttaaacacccatgggtctgtcagcgaagtactgttgcctcaatgatgcatcggcaagagactgtggaatgcttgcgcaagtttaatgcgcggcgcaaactcaagggtgccatcctgaccacgatgctcgtgtctaggaacttttcggctgctaagtcattgttaaataagaaaagcgacggaggggtgaaaaagcgcaagtctagcagctccgtgcatctgatgccacagagcaacaacaaaaattctcttgttagccctgctcaagaacccgcccctctccagaccgctatggagccccagacaactgtcgtgcacaatgcgactgatgggataaaggggtcaacagaatcatgtaacacgacaaccgaggacgaagacctcaaaggctccgtgcctgagggtcggagctcccgggaccgtaccgcccccagcgcagggatgcagccgcaaccttctttatgtagtagcgcaatgaggaagcaagagatcatcaagattacagagcaactgattgaggcaattaataacggggacttcgaagcctatactaaaatttgcgatccaggtttaacttcttttgaaccagaggcattagggaatcttgtcgaaggaatggactttcacaaattttatttcgagaacctgcttagcaagaactccaagcccatccataccaccatcttgaacccacacgtgcatgttattggagaggacgccgcatgcattgcatatatccgacttacccagtatatcgacggacagggccgaccccggacctctcagtctgaagagacaagagtgtggcacaggcgcgacgggaagtggttgaacgtgcactatcactgttctggtgcaccagccgccccactccagtag

SEQ ID NO: 110517 - DNA, 1767 bp, Artificial Sequence
  Description of Artificial Sequence: Synthetic coding sequence
atggctaccactgcaacatgcactcgatttacagacgattatcagctctttgaagagcttggaaagggcgctttctctgtcgtgagacgatgtgttaaaaagacatccacccaggaatatgccgctaagatcatcaatactaaaaaactatctgcaagggaccaccaaaagctcgaaagagaagcaaggatttgtagattactcaagcacccgaacatagtacggttgcacgactcgatttctgaggaaggctttcactacttagtctttgacttggtgacaggcggggagctgttcgaggatatcgtggcccgcgaatattattccgaagcagacgcttcacattgcatccatcaaatactggagtctgtgaaccacatccatcagcacgacattgtgcacagagaccttaagcctgaaaatttgctgctcgcatctaaatgcaagggagctgctgtgaagttggctgacttcggcctggccatagaagttcagggagaacaacaggcctggtttggatttgctgggacaccgggttacctgtcacccgaagtgctgcggaaagacccttacggaaagccagtggacatatgggcttgcggggttatcttgtacattctgttagttggttacccacccttttgggatgaggaccagcacaagctctatcaacagattaaagctggtgcttatgacttcccttcacctgaatgggacacagttaccccagaggccaagaatctaatcaaccagatgttgacaataaaccctgcaaagcggattactgccgatcaggcgctgaagcacccatgggtgtgccagcggtccaccgtcgcttccatgatgcataggcaagaaactgtggagtgccttcgaaagttcaacgctagacgaaagttgaaaggagcaatccttacaacgatgctggtgtcacgtaacttcagtgtgggaagacagtcctcagctcccgccagtcccgcagcctccgccgctggtcttgctggacaggctgcaaagagtctgctgaataaaaagagcgacggcggggtgaagaagcgcaaatctagcagtagtgtccacctcatgccacagtctaataataagaacagtctggtctccccagcgcaggaacctgccccccttcagacagccatggaacctcagaccacagtggtccataacgccactgacggtattaagggctccacagaatcctgcaacaccaccacggaggatgaggatctaaaggctgcccctctgcggacaggtaatggaagctcagttcccgagggacgctcatctcgagacaggactgctccatccgctggaatgcagccccaaccttccctgtgttcatcggctatgagaaagcaggagataataaagattacagagcagctcatagaggccattaacaatggtgactttgaggcctacacgaaaatatgcgaccccgggttgacaagttttgaaccggaggccctgggtaatcttgtggagggtatggacttccacaagttttatttcgagaatctgctctccaaaaacagtaaacccattcatacgacgatcctgaatccacatgtccatgtgatcggcgaggacgcggcgtgtatcgcctatatcaggttgacacagtacatagatgggcagggcagaccccggacctcccagtctgaagagaccagggtgtggcatagacgcgatgggaaatggctcaacgtgcactaccattgttcaggggccccggcagctccactccagtag

SEQ ID NO: 110518 - DNA, 1362 bp, Artificial Sequence
  Description of Artificial Sequence: Synthetic coding sequence
cgtctcctcaagcaccctaacatcgtcagattgcatgacagtatatccgaggaaggcttccactacttagtgttcgacctggtgacaggcggcgaactttttgaggatatcgtggctagggagtactactcagaggcggatgctagccattgtattcatcagattctcgagagcgtaaatcacattcaccagcatgacatagtgcacagggacctgaaaccagagaacctcctgctcgccagcaagtgtaaaggcgccgcggtaaaactcgctgatttcggattagcgatcgaagtgcaaggcgaacaacaggcttggttcggctttgctggaactccaggctacctaagtccagaggtccttcgcaaggacccatacggtaagcctgtagacatctgggcttgcggcgtcattctctacatccttctcgtcggctacccccctttctgggatgaagaccaacacaagctgtaccagcagatcaaagctggcgcttacgactttcctagccctgaatgggacaccgttaccccggaggcaaagaacctaataaaccaaatgcttacgattaacccggcaaagcggattaccgccgatcaggccctgaaacacccttgggtctgccagcggagtaccgtggctagtatgatgcatcgacaggagacagtcgaatgcctgagaaaattcaacgctcggcggaaattgaagggtgcgattctcaccaccatgttggtgtccagaaacttctcggccgcaaagtccctgcttaataaaaaatcggatgggggggtgaagccccaatccaacaataaaaactctctcgtatcacctgctcaagagccagccccccttcaaactgccatggagccacagacaacagtggtacataacgccactgacggcatcaaaggcagcacagagtcctgcaacacaacaacagaggatgaggacctcaaggtgagaaaacaggagatcatcaagatcacggagcagctgattgaagcgatcaacaatggtgacttcgaggcatacacgaagatctgtgatccaggtctgacaagctttgagccagaggccctaggaaacctggtggaaggtatggatttccataaattttacttcgagaacctcctgtccaagaatagcaagcctattcataccacgattttgaacccgcacgtgcatgtcatcggtgaagatgctgcctgcatcgcatacatccgcctgactcagtatatcgacgggcaggggaggccccgaacgtcccaatcagaagagacccgcgtctggcatcgccgcgacggcaagtggctgaacgtgcactaccattgcagtggtgctccagccgccccactgcagtag

SEQ ID NO: 110519 - DNA, 1008 bp, Artificial Sequence
  Description of Artificial Sequence: Synthetic coding sequence
tagtatcagcagatcaaggctggggcttacgacttcccatccccggagtgggataccgtcaccccagaagccaaaaatctcattaatcagatgttgacaatcaacccagccaaaagaataaccgccgaccaggcgctcaaacacccctgggtctgccagcgttcaaccgttgcatccatgatgcaccggcaagaaactgtggagtgccttcgaaaattcaatgcccgacgcaagctgaagggcgctatcctcaccacaatgttggtcagccggaattttagcgccgcaaagtcactgttgaataagaagtccgacggtggggtaaaacctcaaagcaataacaagaatagtctggtgtccccggctcaggagcccgctccgttacagacggctatggagccacagacgacagtggtgcacaatgctacagacggcatcaaaggcagtaccgagtcttgcaatacaacgaccgaagatgaagatctcaaagccgctccccttagaacagggaatggctcctcagtacccgagggtcgttcctcccgagaccggaccgccccatccgccggaatgcagccacagcccagcctgtgttcctcagccatgaggaagcaagagatcattaagattaccgagcagttgatcgaggctatcaacaatggcgacttcgaagcctacaccaaaatttgtgatcccggcttgaccagctttgagcctgaagccctgggcaacctggtggagggaatggacttccacaagttctactttgaaaatctgcttagtaaaaatagcaagcctatccataccacgatcttgaatccccacgtgcacgtgatcggcgaggatgctgcttgcatagcttatattaggctgacccaatatatcgatggccagggacgaccccgcacgagccagagtgaagaaacacgagtatggcaccggcgagatggaaaatggctgaatgtgcactatcattgctcaggagcccccgcggctcccctgcagtag

SEQ ID NO: 110520 - DNA, 543 bp, Artificial Sequence
  Description of Artificial Sequence: Synthetic coding sequence
atggctactaccgccacatgcaccagattcactgacgactaccaactgttcgaggagctagggaaaggcgccttttccgtcgttcgcagatgcgtgaaaaagactagcactcaggagtacgctgccaagatcataaatactaagaaactgtcagcacgggatcatcagaagctggagcgggaagctcgcatttgcaggctgcttaaacaccccaacatcgcaacgatccacggtggcattcacgatgcaagcagtggcgattgcggggtgtttgcgcaagtccagtgccccgaaaaaactgaggggtgccacccgcacgaccacgcatgcctgcaggagctccttagctgtcagaagcccatagagcaagaggtggggtggcgatgccaggcgactgagcagcagcagaaacagtctcgcaagccaagccctcgcgcccgggctctggctgacggacacggagcgacaaatcattgtgggacccagagatatcgatgggaccagggcctgcatcgagagctccagcatcatcacaggcgctag

SEQ ID NO: 110521 - DNA, 240 bp, Artificial Sequence
  Description of Artificial Sequence: Synthetic coding sequence
atgagcgagatactgccatacagtgaggacaagatggggcgattcggggccgatcccgagggaagcgatctctctttctcatgtcggttgcaggatacaaactcattcttcgccggtaaccaagccaagcgacctccaaagctcggccagattggaagggcaaaaagagtggtgattgaggacgaccgtattgatgacgtgttgaagggcatgggagagaagccaccaagcggtgtgtag

SEQ ID NO: 110522 - DNA, 1422 bp, Artificial Sequence
  Description of Artificial Sequence: Synthetic coding sequence
atgctcaaggtcacagtaccctcctgttccgcatcctcatgtagttcggtgaccgccagtgcggcaccaggcacagccagcttagttccggattactggattgacggctccaaccgggacgcgctctctgacttttttgaagtggagtctgaactgggacggggagccacctccatcgtgtaccgctgcaagcagaaggggacgcagaaaccctacgccctaaaggtcttaaagaagaccgtcgacaaaaagatcgtgcgcactgagatcggcgttttactgaggctctcacacccgaacatcattaaactaaaggagattttcgaaactccgacagagattagccttgtactcgagttggtcacaggtggcgagctctttgacaggatcgtcgagaaaggctattactctgagagggatgccgcagatgcagttaaacagatcctcgaggccgtcgcatacctgcatgaaaatggcattgtccaccgggacctgaaacctgaaaaccttctttatgccaccccggcccccgatgcacccttaaagattgccgatttcggtctgagcaagatcgtggaacaccaagtgctgatgaagactgtctgcggcacgcctggttactgcgcccccgaaatactcagaggatgtgcttatggcccagaagtggacatgtggagcgtgggaattatcacatacattctcctgtgcggcttcgagcctttctacgatgagcgaggcgatcagtttatgtttaggaggattttgaattgcgagtactacttcatctctccttggtgggacgaagtgagcttaaacgcaaaagatctggtgcgcaagcttatcgtcttggatcctaaaaaaaggttgaccacgtttcaggcattgcagcatccctgggtgacagggaaggcggccaacttcgtccacatggatacagcccaaaagaagctgcaggaatttaacgctagacggaaactaaaggctgcagtgaaggccgttgttgccagctctaggcttggctctgcaagcagcagccacggctctattcaggagtctcacaaagctagtagagatccgtcgccgattcaggacggcaacgaagacatgaaagcaatccccgagggtgaaaaaattcagggcgacggggcgcaggccgcagtgaaaggagcacaggcagagctgatgaaagtgcaggctctggaaaaagttaagggcgcagatatcaacgcagaagaggcccctaagatggtgccgaaggccgtcgaagatgggattaaggttgccgatcttgaactagaggaagggctagctgaggaaaaactcaagacagtcgaagaggcagccgcaccccgtgagggccaggggtcttccgctgtcggctttgaagtcccccagcaggatgtaatcctgcctgaatactag

SEQ ID NO: 110523 - DNA, 429 bp, Artificial Sequence
  Description of Artificial Sequence: Synthetic coding sequence
atgttgaaggtaactgtgccaagttgctcggcttcctcatgtagttctgtcacagcatcggccgcccctggtacagcaagcctcgttcccgattattggattgatggatctaacagggacgcacttagcgatttctttgaggtggagagcgaactgggccgtggcgcaacatccattgtctatcgttgcaagcagaaaggcacacagaagccctatgcattaaaagtactcaaaaagaccgtcgacaaaaaaatcgtcagaacagagattggcgtcttgctccgcctgagccacccaaatatcatcaagctgaaggagatctttgagacacccactgagatatcactggtcctggagctcgtgacaggtggggagctgttcgaccgcattgtagaaaaaggttactattctgagcgcgacgccgcgtag

SEQ ID NO: 110524 - DNA, 1422 bp, Artificial Sequence
  Description of Artificial Sequence: Synthetic coding sequence
atgctcaaagtcaccgtcccctcctgcagtgcatctagctgtagctccgtgacggcctccgccgctccagggaccgcctccctcgttccggactattggattgacggatccaatcgggatgctctgtcagacttcttcgaggtagagagcgaactgggtaggggcgcaaccagcattgtgtacaggtgcaaacagaagggtacgcagaagccttatgctctcaaggtgctgaaaaagaccgttgacaaaaagattgtccgcactgagataggagtgttgctgcggctgagtcaccccaatataattaagcttaaagagatctttgaaacacccacggagatctctctagtactggagttggtcaccggaggggagctgttcgaccgcatcgttgagaaaggctactacagtgaaagggacgccgccgacgctgtcaaacaaatcctggaggctgtcgcttatctgcatgaaaatggcattgtgcatagagacctgaaaccagagaatttactttatgccactcctgcccccgatgcccctctcaagatcgctgacttcggacttagcaagatcgtggagcaccaggttctaatgaagaccgtgtgcggaacacccggttattgcgccccagagatcctgcggggctgcgcttacgggcccgaggtggacatgtggtctgttgggatcataacctacatactcctgtgtggattcgagcccttttacgatgagaggggagaccagttcatgtttcggcgcatcctcaattgcgagtactatttcatttccccctggtgggatgaggtgtctctgaacgctaaggacctggttagaaagttaatcgtcctcgacccaaaaaagagactgaccactttccaagcactgcaacatccgtgggtgactgggaaggccgccaatttcgtgcacatggacacagcccagaagaaactacaggaatttaatgcgaggcgcaaactgaaggctgccgtgaaggccgtggtggctagttcaaggctcggaagcgccagctcgtcccacggcagtattcaagaatcacacaaggcttcgagagatccatcccctatccaggacggcaatgaggacatgaaggctatcccggaaggcgaaaagatccagggcgatggtgcccaggccgctgtgaagggagctcaggcagagcttatgaaagtccaagccctggagaaggtgaagggggccgacatcaacgccgaggaggcacctaagatggtacccaaggccgtcgaggatggaatcaaggtggccgacttagaactcgaagaggggttggctgaggaaaaattgaaaaccgtagaggaagcggccgctccacgcgaaggacagggctccagcgctgtgggcttcgaagttccccagcaagatgtgatactgccagagtactag

SEQ ID NO: 110525 - DNA, 2766 bp, Artificial Sequence
  Description of Artificial Sequence: Synthetic coding sequence
atggcagatgacgacgtccttttcgaagacgtgtatgagctgtgtgaagtgatcggtaaagggccattcagcgttgtgcgaaggtgtattaaccgagagacaggacagcagtttgccgttaaaatcgttgacgtcgccaagttcaccagctcccctggtttatcaacggaagacctaaagagggaggcgtcgatttgccatatgctgaagcacccacacatcgttgagctcctggagacttatagtagcgacggtatgctgtatatggtgtttgaatttatggacggagccgatttgtgtttcgaaatcgtgaagcgcgcggatgcgggatttgtgtattcagaggccgtagcaagtcattatatgcggcagattcttgaagcattgagatactgccacgataataacataatccatcgcgatgtcaaaccacactgtgtccttttggcgtctaaagaaaactctgctccggtgaagttgggtggcttcggagtagctatccagctgggagagagtgggctggtggcaggaggccgtgtaggaacaccccatttcatggccccggaggtggtgaagcgagagccatatggcaaaccagtggacgtgtggggctgcggagtcattctctttatcctgctctccggttgcctacctttttatggaaccaaggagaggctgtttgaagggatcatcaaaggcaagtacaagatgaatccgagacagtggtcccatatttccgaaagcgccaaggatctggtacgtagaatgctgatgctcgacccagcggaacgcattaccgtctacgaagccttgaaccacccgtggctcaaagaacgggacagatatgcttataaaattcaccttccagagacagtcgagcagctaagaaaatttaacgctcgccggaagcttaagggtgctgtgcttgcagccgtgagttctcataaattcaatagcttttacggagatccaccagaggaactcccagacttctcagaggatcccacatcttctgttttgttgatagtgtctcgggctgtcagccaggtactcgactccctggaggaaatccatgccctcactgattgttctgagaaagatctcgatttcttgcatagcgtgtttcaagaccagcatcttcacactctcttggatctgtacgacaaaatcaacacaaagagttccccccagatcagaaatcctccatctgacgccgtccagcgcgcaaaggaggtcctggaagagatctcgtgctacccagagaacaacgacgctaaagagttgaaaaggattctcacacagccccactttatggcactgctccaaacccacgacgtggtggcccacgaagtgtatagcgacgaggccctgcgggtcacacctccacccacctctccttatctgaacggggattccccagaatctgccaacggcgatatggatatggaaaacgtcacaagagtgaggctggtacagtttcagaagaataccgatgaacctatgggcattaccctgaagatgaacgagttaaaccattgcattgttgcccgtatcatgcacggcggcatgatccaccgccagggaacactccacgtcggcgatgaaatcagagagatcaacggaatctcggtggccaatcagactgtggagcaactgcagaagatgcttagggagatgcgggggtctattaccttcaaaatcgtgccttcgtaccgtacacaatcatcatcatgtgagagggattcccccagtacatctagacagtctcccgcaaatggacatagctccacaaataactcagtgtccgatctgccctcgacaacccagccaaaaggaaggcagatttacgtgagggcacagtttgaatatgatccagcaaaggacgacctgattccatgcaaggaggctggaataagattcagagtcggggacatcatccaaataattagcaaagacgaccacaactggtggcagggaaaacttgagaactctaaaaatggaactgcaggcttgatccccagccctgaactgcaagagtggagagtagcctgcattgcaatggagaaaaccaagcaggagcaacaggccagctgcacttggtttggcaaaaagaagaagcaatacaaagataaatacctggctaaacacaatgctgacttggtgacatatgaggaggtcgtcaagcttccggcgtttaagcggaagactctggtcctgcttggggcccacggggtcggcagacgtcacatcaaaaatactctcatcacgaaacaccctgaccgcttcgcataccccatccctcacactacccgtcctccaaaaaaggacgaagaaaatggaaagaattactactttgtttcccacgaccagatgatgcaggacatctccaacaatgaatacttggagtatggcagtcacgaagatgcgatgtatggcactaagctggagacaattcgcaagatccacgaacaggggttgatcgcaatcctcgatgtggagccacaggccttgaaggtgctgaggacggcagagttcgccccgtttgttgtgttcatcgcggcccccaccataacccctgggttaaacgaagatgagagcctacaaagactccagaaggagtccgatattcttcagaggacatacgcacactactttgacctcacgatcatcaacaacgaaatcgacgagaccattcgacacctcgaagaagccgtggaattggtgtgcaccgccccacaatgggttccggtgtcttgggtgtattag

SEQ ID NO: 110526 - DNA, 2730 bp, Artificial Sequence
  Description of Artificial Sequence: Synthetic coding sequence
atggccgacgatgacgtcttatttgaagatgtgtatgaattatgtgaggttatcggaaagggaccattctcagtggtgcggcggtgtataaacagagaaacggggcaacagtttgctgtgaaaatcgtggacgtagcaaaattcacaagctcacctgggctcagtactgaggatctgaagcgtgaagctagcatatgtcatatgttaaaacatccgcatatcgttgaacttctggaaacttactcttccgacgggatgctgtacatggtgtttgagttcatggatggtgcggatctctgttttgagatcgtaaaacgcgctgatgccggctttgtgtattccgaagccgtcgctagccactatatgaggcagatcctggaggccctgcggtattgtcacgataataacattattcatcgcgatgtgaaaccccattgtgtcttgctggcctcgaaagaaaactcagcccccgtcaaactgggtggattcggagtcgctatccagcttggggaatcagggctggtcgctggaggaagagtgggaactcctcactttatggcccccgaagtagtaaagagagagccttacggcaagcccgtggacgtgtggggatgcggagtcattctttttatacttctgtccggatgtctgcccttttacggaaccaaggagcggctgtttgagggaatcattaagggcaagtacaagatgaacccacgacagtggagccacatctctgaatccgccaaggacctcgtccgcaggatgttgatgctggaccctgctgagcggatcacagtttatgaggccctaaatcacccctggcttaaagagcgggaccgatacgcatataagattcatctgcctgaaactgtggagcaactgcgcaagtttaacgcacgcaggaagctgaagggagctgtgctcgcagcagtgtctagccacaagttcaactcattttacggggaccccccagaagaacttccggatttcagcgaggatcctacttctagcgtcttgctcatcgtaagtagagccgtttcacaggtgctggatagcttggaggagatccatgcactcaccgattgcagcgagaaggatctagacttcctccactctgttttccaggaccagcacctgcataccctgctggatctgtacgacaaaattaacacaaaaagctctccacagatcagaaatcctccttctgacgctgtgcagagagctaaggaagtcctggaagagatctcatgttatcccgagaacaacgatgccaaagagttaaagcgcattctgacccagcctcatttcatggcactgttacagacccatgacgtcgtggctcacgaagtctatagcgacgaagctctgcgtgtgaccccaccccctaccagtccttaccttaacggggatagtcctgagtcagcaaacggagatatggatatggagaacgtcacaagagtcaggcttgtccaatttcagaagaataccgatgaaccaatgggaatcaccctgaaaatgaatgaactgaaccactgtatagtggctcgcataatgcacgggggaatgattcacagacaaggcaccctgcacgttggagatgagatacgcgagatcaatggtatctccgtggctaatcagaccgtggagcagctgcagaaaatgctgcgggagatgagaggcagcataacattcaaaattgtaccctcctaccgcacccagtcctcctcgtgcgagcgcgatagtcctagcacaagtaggcaaagcccggcaaacggtcacagctccaccaataattccgtctccatctatgtaagagcgcagttcgaatatgaccctgccaaagacgatctgataccttgcaaagaggcaggaattcgcttccgagtgggcgacatcatccaaatcatctccaaagacgatcacaattggtggcagggtaagctggagaactccaaaaacggcacagccgggttgattcctagccctgaattgcaggagtggcgagtagcctgcatcgcgatggaaaagactaaacaggagcagcaagcatcctgcacatggtttgggaagaagaaaaaacaatataaagacaagtacttagccaagcacaatgccgatctggtaacctacgaggaggtggtgaagcttccggcctttaaaagaaagaccctggtgctgctgggtgcacacggcgttgggaggaggcatattaaaaatactcttatcaccaagcacccagatcgtttcgcctatccaatcccacatactacccgcccaccaaaaaaagacgaagagaacggaaagaactattactttgtgtcccacgaccaaatgatgcaggacatcagtaacaacgaatatttggagtacgggagccacgaagacgccatgtacgggacaaaactcgaaactattcgaaaaatacacgaacagggattgatcgccattcttgacgttgaacctcaggcactgaaagtcctgagaacggcagaatttgcacccttcgtcgtctttatcgccgcccctacaataacacctggcctgaatgaagacgaatctctacaacggctgcaaaaggagagcgatatcctgcagagaacttatgcgcactacttcgacctgaccattattaacaatgaaatcgatgagactatccgccatctggaagaagctgtggaactggtttgcactgcccctcagtgggttcccgtctcctgggtctattag

SEQ ID NO: 110527 - DNA, 1773 bp, Artificial Sequence
  Description of Artificial Sequence: Synthetic coding sequence
atggccgacgatgatgtcttatttgaagacgtctatgagctctgcgaagttatcggaaaaggcccattttctgtcgtgcgtcgctgtatcaaccgcgaaacaggtcagcagttcgccgtaaagatagtagacgttgccaagtttaccagttcaccggggttatccactgaggacctgaagcgggaggcaagcatctgccatatgcttaagcaccctcacattgttgaattgctggagacctattcaagcgatggcatgttgtatatggtgtttgagtttatggatggggcggatctgtgcttcgagatagttaaaagagcggacgctggttttgtgtactcagaagcagttgcttcccactatatgagacagatactcgaagctttgcgctactgccatgataacaatataattcatagagacgtgaagccacattgcgtgcttctggcttccaaggagaattccgcacctgtgaagctgggcgggttcggggtagctattcagctcggtgaaagtgggctggtggccggtggccgcgtcgggacaccccacttcatggcgccagaagtagtcaaaagggagccgtatggtaagccagtggacgtgtggggctgtggtgtcattctgtttatactgctcagtgggtgtctcccattctacggcacgaaagagcgcctgtttgaaggaatcatcaaggggaaatacaagatgaacccgaggcaatggagccacatctccgaatcggctaaggatctggtgcgacggatgttgatgctggatccagcggaacgcatcacagtgtacgaggcactgaatcacccatggcttaaggagcgggacagatatgcctataagatccacctcccggagacagtagaacagctccgcaaatttaacgcacgacgcaagttaaagggcgctgtactggccgctgtttcttctcacaagtttaattctttttatggtgacccgccggaagagttacctgatttttccgaagatcccacgtcatcaggactgctcgccgccgagagagccgtctcccaggttttggatagcttggaggagattcacgccctgacggattgcagcgagaaagacctggacttcctgcactctgttttccaagaccagcatctgcacaccctgttggatctgtacgataaaattaacacaaagagcagcccccaaatcagaaacccacccagtgatgctgtgcagcgagctaaagaagtgttggaggaaattagctgctaccccgaaaataatgacgccaaagagcttaagaggatcttgactcaaccacattttatggccctgcttcagacacacgacgtcgtcgctcacgaggtctacagcgatgaagcactccgggtgacaccacccccaacttccccatacctgaatggggacagccccgagtctgctaacggcgatatggatatggaaaacgtgacccgggtcaggctggtacagttccagaagaatacggatgaacctatgggaatcacgctcaagatgaacgaactgaaccactgtattgtcgccaggataatgcacggcgggatgattcatcggcagggcactttgcatgtaggagatgagatccgcgagattaacggaatttccgtcgccaaccagacagttgaacagctccagaaaatgctgcgcgaaatgcgaggctcaattaccttcaaaatcgtcccgtcatatcgcacgcaatccagttcatgcgaagtcatgacccttactaatcatccacacctgttgtag

SEQ ID NO: 110528 - DNA, 2730 bp, Artificial Sequence
  Description of Artificial Sequence: Synthetic coding sequence
atggccgatgacgacgtcctcttcgaagacgtgtacgaactgtgtgaagtcatcggaaagggcccgttctctgttgtgaggcggtgtatcaacagagaaactggccagcaatttgcagtcaaaatcgtagatgtggccaagttcactagctcccccggcttgagcacagaagatctgaagagggaggcctccatctgtcacatgctgaagcatccccatatagtggaattgctggaaacatattcgagcgatggcatgctatatatggtgttcgagttcatggatggggcggacttgtgtttcgagatcgtgaaacgagccgacgccggttttgtgtactctgaagctgttgcctctcactacatgagacagatcctcgaggctcttagatattgccatgataacaacataatccaccgggacgtgaaacctcattgcgtgctgcttgccagcaaggagaattctgctcctgtcaagctaggggggttcggagtggccattcaactgggggagtccgggctagtggctggggggcgagtgggcacaccacatttcatggctcctgaagtggtaaagagggagccctatggcaaacctgtcgatgtttggggttgtggagtgattctattcatactcctcagtggttgtctgcccttctatggcactaaagagcggctcttcgagggcattataaagggaaaatacaaaatgaacccccgccagtggtcgcacatctccgagtcagccaaagatctagtgcggcgaatgctgatgttggaccctgcagagaggatcaccgtctatgaagcgctaaaccatccatggctcaaggagcgggatcggtatgcttacaaaatccacctaccagagaccgttgaacagctccgtaaattcaatgcacgacgcaagttgaagggcgcagtgttggccgctgtttcatcccacaaattcaactcattttatggggaccctcctgaggaactaccggatttctctgaggacccaacatcgagcggtcttttggccgcagagagagccgtgagccaggtgcttgactccctggaagaaatacatgctctgacggactgctctgaaaaggacttggactttctgcatagcgtatttcaggaccaacacctgcacaccctgcttgacctgtacgacaagattaacacaaagtcctctccccagattaggaatcccccctccgatgccgtccaaagggctaaggaggtcttggaagagattagttgttaccctgaaaacaatgacgccaaggaactgaaacgtatactcactcagccccatttcatggccctcctgcaaacccatgacgttgtggcacatgaggtgtatagtgacgaagccctgcgagtcaccccccctcccacgtccccctacctgaacggagattcccctgaatctgccaatggcgatatggatatggagaacgttacgcgggtacgcctggtgcagtttcagaaaaataccgatgaacccatgggcatcacgctaaagatgaatgaactgaaccattgtattgtggctaggataatgcatggcggcatgatacatcgccagggcaccctgcatgtcggagacgagatccgcgagattaatggaatttcggtggcaaaccagacagtggagcagctgcagaagatgcttagagagatgaggggaagcattacgttcaagatcgtcccaagctaccggacgcaatctagcagctgcgaacgcgacagcccaagtacttcaagacagagtcctgcgaacgggcactcttctaccaataactccgtctcaatttacgtcagggcgcagtttgagtacgaccctgccaaggacgacctgatcccatgcaaggaggctggcatcagattcagagttggtgacatcatacagatcattagtaaggatgaccataattggtggcagggtaagttggaaaattccaagaacgggactgcaggcttgattccgtcccccgagctgcaggaatggcgcgtcgcctgcattgccatggagaagactaaacaggagcaacaggctagttgcacttggtttgggaaaaaaaaaaagcaatacaaagacaagtaccttgcaaaacataatgccgacctggtgacgtacgaggaggtagtgaagttacctgcctttaagcgaaaaactctggtgctgctcggtgcccacggcgtaggccgccgccatatcaaaaacactcttatcacaaagcacccagatcgattcgcatacccgatcccacataccacacggcctcctaaaaaggacgaggagaatggcaagaattattatttcgtaagccatgatcaaatgatgcaggatatcagcaataacgagtatcttgagtatggcagccacgaagacgccatgtacgggaccaagctcgaaaccatccggaaaatccacgagcagggcctaattgcaatcttggatgtggaacctcaggcactgaaagtgttgaggaccgctgagttcgcgccttttgttgtgtttattgcagctcctactattacacctgggctcaatgaagacgagtctcttcagcgacttcagaaagagagtgatattttgcaacgaacctacgcacactatttcgacctcacaattataaacaatgagatcgatgagacaattcgccacctagaggaagccgttgagcttgtgtgtacagcacctcaatgggttcccgtgtcatgggtctactag

SEQ ID NO: 110529 - DNA, 2781 bp, Artificial Sequence
  Description of Artificial Sequence: Synthetic coding sequence
atggcagatgacgacgttctattcgaagacgtctacgagctttgtgaggtcatcggaaaaggccctttttcggtggtgagacgctgcattaaccgagaaaccgggcaacagtttgcggtgaaaatcgtggatgtggccaaattcacaagcagccctggattatcgaccgaagacctcaagcgagaggcctcgatctgtcacatgctgaaacacccacacatagtagagctcctcgaaacctattcaagcgacggaatgttgtacatggtgttcgagttcatggacggagccgatctgtgttttgaaatagtcaaaagagccgatgccggcttcgtttattccgaggccgtagcaagccactacatgcggcagatactggaggccttgcgctattgtcatgataataacatcattcacagagacgtcaaaccccactgtgtactgctcgctagtaaagagaattcagcccctgttaagctcggggggtttggggttgccatacaattgggcgagagcggcctcgtagctggcgggcgtgtgggaactccacattttatggctcccgaggtagtgaaacgcgagccttatgggaaacccgtggatgtttggggatgtggtgtcatactgtttatcctgctgagcggctgcctccccttctacggcacgaaggagagactgttcgaaggcattataaaaggaaagtataagatgaatcctagacagtggtcacacatctccgaatcagcgaaggatctggtgcgacgtatgctgatgttggatcctgcggagcgcattactgtctatgaagcacttaaccatccgtggctgaaggagagagacagatatgcttataagatacacttgccagaaacagtggagcaactcagaaagttcaatgcccgacggaagttgaagggcgctgtgctggcagcggtgagcagccataaattcaattccttctatggagatccccctgaagaactccccgatttctcagaagatcccacgtcaagtggccttttagcagccgagagggctgtgtcacaggtgctcgactcactggaggaaatccacgccctgaccgattgttctgagaaggatttggatttcctgcattcagttttccaggatcaacatctgcacactctgctggacctctacgataagatcaatacgaaatcctcgccccagatccggaaccctccgagtgacgctgtgcagagagccaaagaggtgctcgaggaaatatcatgttaccctgagaataacgatgccaaagagctcaaaagaattctcacacagccccattttatggcccttttgcaaacccatgatgtggtcgctcatgaggtgtattccgacgaggcacttagggtgacgcccccacctacatcgccatatctaaacggtgattctcccgagtccgctaatggggacatggatatggaaaacgttacccgagtgcgtctggtgcagttccagaagaacacagacgagcccatgggcataaccttgaagatgaacgaacttaatcactgcatagtggcgcgcattatgcatgggggaatgatccacaggcaagggaccctgcatgttggcgacgagattcgagagatcaacggcatctccgtggctaatcagaccgtggaacagctccagaaaatgctaagagaaatgagaggctctatcacttttaagatcgtgccttcttatagaacacagagttcaagctgtgagagagacagccctagtacaagcagacagagtcccgcaaatggacactcaagcaccaacaattctgtgagtgacctgcccagtacaacccagcctaaagggaggcagatttacgtgagggcgcagtttgagtacgatcctgcaaaagatgatcttatcccgtgcaaggaggccggcattagattcagagtgggtgacattatacagattattagtaaggatgatcacaactggtggcagggaaagttggaaaacagcaagaacggcacggctggtctcattcccagtcctgaactgcaagaatggcgggtagcttgcatagcaatggagaaaacaaaacaagagcagcaggctagttgcacatggtttggcaagaaaaaaaagcagtataaagataagtacctggctaaacacaacgctgttttcgatcagcttgatctggttacatacgaagaagtggtcaagttgcccgcattcaaacgcaagacattggtgctgctcggtgcacatggagtcggacgcaggcatattaaaaataccttgattacgaagcaccccgatcgctttgcatatcctataccccatacgactagaccccctaaaaaggacgaggaaaacggcaagaattactatttcgtgtcccatgaccagatgatgcaggacatcagcaataacgagtatttagagtatggttcccacgaagatgctatgtacggcactaaactggagacaatcaggaaaatccatgaacaggggctgatcgctatactggacgtagagcctcaggcattgaaggttttgcgcacagcagagtttgcgccttttgtcgtgttcattgccgctcctacaatcaccccagggctgaatgaagacgagtcccttcaaaggttacagaaagaatctgacatactgcaacgaacctacgcgcattattttgatctgacaattataaataacgagatcgatgagactattagacacctggaggaagcagtcgagttggtgtgcactgcaccacagtgggtcccggtgtcctgggtgtattag

SEQ ID NO: 110530 - DNA, 2766 bp, Artificial Sequence
  Description of Artificial Sequence: Synthetic coding sequence
atggccgacgacgatgtgctgtttgaagacgtgtacgagctgtgtgaggtgatagggaagggtccattctctgttgtgcggagatgcataaacagggagacaggacagcagtttgcagtcaagatcgtcgatgtagccaaatttacctcctcgcctggcctgagcaccgaggacctaaaacgtgaagcatccatatgccacatgcttaagcatccgcacatcgtggagttgttggagacctactcatctgatggcatgctctatatggtgttcgagtttatggacggcgcagatttatgctttgagattgtgaaacgcgcagatgccggatttgtctacagcgaagcggtcgccagccattacatgcgccagattctcgaggctctgaggtattgtcacgataacaacatcatccaccgcgacgtcaagccacactgtgtcttactagccagcaaagagaactctgctccggtaaagctgggtggtttcggtgtggcaatacagttgggcgagtctggcctggtggctggtggccgcgtgggtacacctcattttatggctccagaggttgtgaagcgcgaaccttacggaaagcctgtggatgtgtgggggtgcggggtcattctattcatcctgctgagtggctgtcttcctttctatgggactaaagagaggttattcgagggtattattaaggggaagtacaaaatgaacccgcggcagtggagccacatctccgagtccgccaaagacctagtccgtagaatgctgatgctcgaccccgccgagcggatcacagtgtacgaagctctgaatcatccatggctcaaggaaagggatcgctacgcctacaagatccacctgcccgaaacagtcgaacagttacgcaaattcaacgcacggcgcaaactgaaaggcgctgtgctggctgctgtctccagccataagtttaactcattttacggcgaccctcctgaggaactgccagatttcagtgaagacccgacctcatccggactgctagctgccgaaagagcagtctcccaggtgctagactcactagaggagatccatgctctgaccgattgcagtgagaaggacctcgattttctgcacagcgtgttccaggatcaacatctgcacacgctcttagacctatacgacaagattaacaccaagtcctcaccacagatcaggaatcccccttccgacgccgtacagcgtgctaaagaagtgctcgaggagatctcatgctacccagagaacaacgacgcaaaggagctgaaaagaatcttaactcaaccccacttcatggcgctgctccagacccacgacgtggtggcacacgaagtgtactcagacgaggccttacgggttacccccccgccgacctctccttatctgaacggcgactcgccggaaagcgccaatggggatatggacatggaaaatgttacaagggttcgtctcgtccagtttcagaaaaataccgacgagcccatggggatcacattgaagatgaatgaacttaaccattgtattgtcgcccggataatgcatggcggcatgatccatagacagggaaccctacacgtgggagatgaaatccgcgagatcaatggaatctctgtggctaatcaaacagtggagcagctgcagaagatgctgcgtgaaatgagagggtccattacctttaaaattgtgccttcataccgcacgcagtcctcgtcttgcgagagagattcaccgtcgacgtcaagacagagccctgccaatggacatagttctacaaataacagtgtcagcgatctccctagcaccacccagccaaagggacggcagatctacgtccgggctcagtttgaatacgatccagcaaaggacgatcttatcccgtgcaaggaggcagggatcagatttcgggtgggggacatcatccagattatttccaaagacgaccacaactggtggcaaggtaagctggaaaactccaaaaacggtaccgctggcttgatcccaagccccgagctgcaggagtggagggtagcctgtatcgccatggagaagaccaaacaggagcagcaggcatcatgcacatggtttgggaaaaagaagaagcaatataaggataaatacttagcaaaacataacgccgacctcgtgacctacgaagaggtggttaagctgccggcattcaaacggaaaaccttagtcctgctaggggcccacggggtcggccgcaggcacattaaaaatactctgatcaccaagcaccccgatcggtttgcttacccaatcccccatacaaccaggccccccaaaaaggatgaagaaaatggcaaaaactattacttcgtgtcccacgaccagatgatgcaagatatttcaaataacgaatatctcgaatatgggtcacacgaagatgcaatgtacggaacaaaactggaaacgatcaggaagatccacgagcaggggctcatcgcgatcttagatgtggagcctcaggcactaaaagtcctacgcacagcagaattcgcccccttcgtggtgtttatagcggcccctacaatcacaccgggtctgaacgaggatgagtctctgcagaggctgcagaaagaatcagacatcctgcagaggacttatgctcattacttcgacttaacgattattaacaatgagattgatgaaactataaggcatctggaagaggccgttgaactggtttgtaccgcccctcaatgggtcccagtgtcttgggtgtactag

SEQ ID NO: 110531 - DNA, 1146 bp, Artificial Sequence
  Description of Artificial Sequence: Synthetic coding sequence
gacgagatccgcgaaattaatgggatctctgttgccaaccagaccgtcgaacaactccagaagatgctgagggaaatgagaggctctattacattcaagattgtgccatcttacagaactcaatcctctagttgtgagcgcgattcacccagtaccagcaggcaaagcccagctaatggtcactccagcaccaacaattctgtgtctatctatgtgcgtgctcagttcgaatacgaccctgcaaaagacgaccttataccttgcaaggaagccggcatcaggtttagagtcggcgacatcatccagatcatctccaaagacgatcacaactggtggcagggcaaactcgagaacagtaaaaacggcacagcaggtctgataccatcccccgagctgcaggaatggcgggtggcgtgtattgctatggaaaaaaccaaacaggagcagcaggcgtcttgtacttggtttgggaaaaaaaagaaacaatacaaagacaagtatcttgcaaaacacaacgctgtgtttgaccagttggatctagtcacgtacgaagaagtcgtcaagctgccagcctttaaaagaaaaactctggtgctgttaggagcacacggggtaggaagaagacacatcaaaaacacgctgatcactaagcatcctgataggttcgcctacccaattccccacactacaagaccgcccaaaaaagacgaagagaacggaaagaattattattttgtgtcccacgatcagatgatgcaggacatctcaaataatgagtatctcgagtacggatctcatgaagacgccatgtatgggaccaagctcgagaccatacggaagatccacgagcaggggttgattgctatcctggacgttgagccacaggcgctgaaagtgttgcgaacagcagagtttgcaccgttcgtggtgtttattgctgcccctaccataacgcctggcctcaatgaagacgaaagcctgcagcggctccagaaagagtcggacatcttacagaggacctacgctcactactttgacctcacaatcattaataacgagattgatgaaacaatccgccatctggaggaagctgttgagcttgtctgtaccgccccccaatgggtacccgttagctgggtgtattag

SEQ ID NO: 110532 - DNA, 1557 bp, Artificial Sequence
  Description of Artificial Sequence: Synthetic coding sequence
ttatacgataaaataaacacgaaatcttccccccagatcaggaatccccccagtgacgctgtgcagcgggccaaggaagtccttgaggagatatcatgctatcctgagaacaacgatgcaaaagagttgaaacgcatcctaacacagccacatttcatggcgctgctccagacacatgacgttgtcgctcatgaggtctattccgacgaggccctgagggtgacgccacctcccacgtctccctatctgaatggagattctccagaaagcgcaaacggggatatggatatggagaatgtaactagggtcagacttgtacagtttcagaaaaataccgacgagccaatgggaattacactgaagatgaatgagctgaatcactgcatcgtagccaggataatgcacggagggatgatccaccgacagggcaccctgcacgtgggagacgagatccgggagattaatggtatctcggttgcgaaccaaaccgtcgaacagctccaaaaaatgctgcgggagatgcggggttcgatcacctttaagatcgtcccaagctaccggacacaatcatcatcctgcgaagatctgccgagtacaacacagccaaaggggcgacagatttatgtgcgcgctcagttcgagtatgaccccgcaaaagatgatctcatcccttgcaaagaagcaggtattcggtttagggtgggggacatcatccaaattatatcaaaggacgatcataattggtggcagggaaagcttgaaaatagtaagaacggcacagctggactgattccatcccccgaactgcaggaatggagagttgcctgtatcgccatggagaagactaaacaggaacagcaggcctcatgtacatggtttggcaaaaagaaaaaacagtacaaggataaatatcttgccaaacacaacgccgtcttcgaccagctcgatctggttacttacgaagaggtagtgaaactgccagctttcaagaggaagacactggtgttgctgggcgcccacggcgtgggtcgacgccacatcaaaaatacactgattaccaagcaccccgacagattcgcctacccaattccccatacaacccgtccaccaaagaaagatgaggagaatggaaaaaactattattttgtcagccatgaccagatgatgcaggatatctctaacaacgagtacctagagtatggctcacacgaagacgcgatgtacgggactaagctagagacaatcaggaagatccacgaacagggtttgatcgctatcctggacgttgagccacaagccctgaaagtcctccggactgcagaattcgcccctttcgtagtctttatcgccgcacctaccattactcccggtctgaatgaagatgaatccttacaaaggctgcaaaaagagtcggacattttacagaggacgtacgcgcactacttcgatcttactatcattaacaatgagattgacgagacaattagacacttagaagaagcggtagagttggtctgcaccgcgcctcagtgggtgcccgtgagttgggtctattag

SEQ ID NO: 110533 - DNA, 2694 bp, Artificial Sequence
  Description of Artificial Sequence: Synthetic coding sequence
atggctgatgacgatgtactcttcgaggatgtttacgagctctgtgaagtgattggtaaaggtccgttcagtgtcgtgcgacgatgtatcaacagggaaacaggtcagcagttcgctgtaaagatcgtggatgtggccaaatttacaagtagtcctggcctgagtaccgaggacctgaaaagggaagcctcaatctgccatatgcttaaacacccccatattgtagaactcctggagacctacagttctgacgggatgctgtacatggtatttgagttcatggacggggcagatctgtgcttcgagatagtaaagcgggccgatgccgggtttgtctacagtgaagccgtggcctcccattacatgcggcagattctcgaagccctcagatactgccacgataacaatattatccatcgcgacgtaaagccccactgcgttctgttggccagcaaagagaacagtgctcctgtgaaattgggaggatttggggtggcgatccagctcggtgaatcagggttggtggctggggggagggttggaacgccccattttatggcccccgaggtggttaaacgagagccctacggcaagccggtcgacgtgtgggggtgcggtgttatcctgttcattcttcttagcgggtgtctgcctttctacgggacaaaggagcggctgttcgaggggattataaaggggaaatataaaatgaacccccgacagtggtcccatattagtgaatctgccaaagacctggtcaggagaatgctgatgctcgaccctgcggagcgaataaccgtgtatgaggccctgaaccatccttggctgaaggaacgggatagatatgcctacaaaatccatctgccagagaccgttgagcagttgagaaagttcaatgcaagaagaaaattgaaaggggccgtgctagccgccgtcagctctcacaaatttaacagcttttatggtgatcctcctgaggaacttccggacttcagcgaggacccgaccagctctggcgccgtgagtcaggttctcgattccctcgaggagatccatgccctgacagattgctcagagaaagatcttgactttttgcacagtgtgttccaggaccagcacttacatacactcctggatctgtacgataagattaataccaagtcttctcctcaaatcaggaacccgccatccgacgccgtccagcgcgccaaagaagtcctggaggagatttcctgctatcccgaaaataatgatgcaaaagaactgaaacggattctgacacagccgcacttcatggcccttttgcagactcatgacgtcgtagcacacgaggtgtactcggatgaagcgctgagggtcacgccgccccccacatcgccttatctgaacggggactcccctgaaagcgccaatggcgacatggacatggaaaatgtaaccagggtgcgcctggtgcaatttcaaaagaatacagatgagcctatgggcatcaccttaaaaatgaatgaactcaatcattgcattgtggccaggatcatgcacggcggaatgattcaccgccagggaacactgcacgtgggtgacgaaattagagagatcaacggcatcagtgtcgcaaaccagacagttgagcagctgcagaagatgctgcgcgagatgagggggtccatcaccttcaaaatcgtgccaagctatcgcacgcagtcctcctcctgcgaagatctgcctagcaccacccagccaaaggggcgccagatttacgtccgtgcacagtttgaatacgatccggccaaggacgatctaatcccgtgcaaagaggcaggcattaggttccgcgtgggggacatcattcagatcatttccaaagatgatcacaattggtggcaggggaaactggagaatagcaagaacgggacggccggcctcattccatcacctgaattgcaagagtggagagtcgcatgcatagcgatggaaaagaccaaacaagagcagcaagccagttgtacgtggttcgggaagaaaaaaaagcaatataaggataagtacctcgccaagcataatgccgtgttcgatcagctggaccttgtgacgtatgaagaggttgtcaagttaccagcatttaaacggaaaaccctagtcctccttggtgcccacggagtggggagacgacatattaagaacactctgatcaccaagcaccctgatcgttttgcttaccccatcccacacacaacaaggcctccgaaaaaagacgaagaaaacggaaaaaactactattttgtgtcacacgaccagatgatgcaggacatatccaacaatgagtatctcgagtacggctctcacgaggacgccatgtacggaacaaaacttgagactataagaaagatccacgagcagggtttgattgccatattggatgtggagccgcaggccctcaaggtgctaagaacagccgagttcgccccttttgtcgttttcatcgcggccccaactataacgccgggactcaatgaggacgagtctcttcagagactgcagaaagaaagtgacatcctgcagagaacatacgctcactatttcgatctcacaatcattaacaacgaaatcgacgagaccatccgacacctggaagaggccgtcgagctcgtttgcaccgcaccgcagtgggtcccagtgagctgggtgtactag

SEQ ID NO: 110534 - DNA, 2697 bp, Artificial Sequence
  Description of Artificial Sequence: Synthetic coding sequence
atggctgacgatgacgtcctgttcgaggacgtgtacgagctgtgtgaagtgattggtaaagggcctttctcagttgttcggcgctgcataaatcgggagactggtcagcagtttgccgtcaaaatcgttgacgtagccaaattcacatcctcgcctggcttgtccacagaagacctgaagagagaggcgagcatttgccacatgctaaagcatcctcacatcgtcgagctattggagacctactcctccgacggtatgctgtatatggtgtttgaatttatggatggggctgatctatgcttcgaaatcgtcaagagggccgacgccgggttcgtttacagcgaagccgttgcatctcactacatgaggcagatcctggaggcccttcggtattgccacgacaataacatcatacatcgagacgtgaagcctcattgtgtcctactggcatccaaggagaactccgctccagtcaagctagggggattcggggtggcaatacagctgggggagtctgggttagttgctggcggcagggtggggactcctcatttcatggcaccggaagtggtgaaacgagagccgtacggcaaacccgtggatgtttggggatgtggcgtgattctcttcatccttctgtcaggttgtctcccattctatggcactaaggagcggcttttcgagggcatcattaagggaaagtacaaaatgaaccctaggcaatggagccatatatcagagtcagctaaagatctggtcaggcggatgctgatgctggaccccgctgagcgcattaccgtgtacgaggcactcaaccacccatggctgaaagagcgggatagatatgcctataagatacacctgccagaaacagtagagcagctgaggaaatttaacgcgcggcgcaaactgaaaggcgcagtcctggcggctgtgagtagccataagtttaattccttctatggcgaccctccagaagagctccccgacttttctgaggatccgacaagcagcggactgctggctgctgaaagagctgtgagtcaggtcctggattccctggaagaaattcatgccctgacagattgttcagaaaaagacctggacttcctccacagcgtcttccaggaccaacatcttcacacgctgttagatttgtatgataaaattaatacaaagagcagcccccaaattcgaaaccctcccagcgacgcagtgcagcgcgcaaaggaggtcctcgaggagatttcttgttaccctgagaataacgatgcaaaagagctgaaaaggatactgacacaacctcatttcatggccctgcttcagacccacgacgtggtagcccacgaggtttactccgacgaggccttaagagttacacctccccctacatccccttacttaaacggtgactcaccagagtccgctaatggggacatggacatggagaatgtaactcgagtcaggctcgttcagttccagaagaacactgatgaacctatgggtattacgttaaaaatgaacgaacttaatcactgcatcgtggccagaatcatgcatgggggaatgatccaccgccaggggaccctgcacgtaggcgacgaaattagagaaataaacggaatcagtgtggctaaccagaccgtggagcagttgcaaaagatgttgagagagatgcgggggagtatcacttttaagatcgtcccttcctaccgcactcagagtagctcttgcgaagatttgccaagcactactcaacctaaggggaggcaaatctacgtgagggctcagtttgagtatgaccctgcgaaggacgatctcatcccttgcaaggaggcggggattcgatttcgggtgggggatatcatacaaataatatcgaaggatgaccataactggtggcagggcaaactggaaaacagcaagaatggaaccgccggacttatcccatcaccagaactgcaggaatggcgcgtggcttgcatcgctatggagaagactaagcaagaacagcaagcttcctgcacttggttcgggaaaaagaaaaaacagtataaggacaaatatctagccaaacacaatgccgatcttgtgacttacgaagaggtggttaaactccccgccttcaagcggaagacactagtgttgctgggtgcgcatggtgttggcagaaggcacattaagaacactctgattaccaagcaccccgaccggttcgcttatccaattccacatacaacccgtcccccaaagaaagacgaggagaatggcaagaattactacttcgtctcccacgatcagatgatgcaggacattagcaacaatgagtacttggagtatgggtcccatgaagacgctatgtacggaacaaagctggaaaccatccggaagattcacgagcagggactgattgctattttagacgtggagcctcaggcactcaaagtgctgaggactgccgagtttgcaccctttgtggttttcattgccgcacctacaattaccccaggcctgaacgaggacgaatcacttcagaggctgcagaaagagagcgacatcctgcaacgcacctacgctcactactttgatctcacaataatcaacaatgaaattgatgagacgatacgacacctggaggaggccgttgaattggtgtgtaccgcaccccagtgggtgcccgtgtcatgggtgtactag

SEQ ID NO: 110535 - DNA, 3237 bp, Artificial Sequence
  Description of Artificial Sequence: Synthetic coding sequence
atggctttttacagttgttgctgggtactgctggcactgacatggcatacgtcagcttacgggccagatcaacgagcgcaaaaaaagggagatatcatccttggtggcctgtttcctatccatttcggggtggccgctaaagatcaggatctgaagtcacgacctgaaagcgtggagtgcatccgctataacttccggggcttcagatggttgcaggctatgatttttgccatcgaggagatcaactccagtcctgcgttgttgcctaatttgaccttaggatatcgtattttcgatacctgtaacactgtatcgaaggctttggaggccaccctgtcttttgtggcgcagaacaagatagatagcctgaatctagacgaattctgtaattgttctgaacacatcccctccaccatcgccgtagtaggggccaccggttctggtgtatcaaccgccgtagcaaatctcttaggcctcttttacatcccacaggttagttatgcctcaagttcccggctgctgtctaataaaaaccagtttaagtcatttctgcgcacaattcccaatgacgaacatcaggcaaccgccatggctgacatcatagaatacttccggtggaactgggtgggcacaatcgctgccgacgatgattatgggagaccaggcattgaaaaatttcgcgaagaagcggaagagcgagacatctgtattgacttcagcgaactcatctcccaatactccgatgaagaggaaatacaacacgtcgttgaggtgattcaaaatagcacagctaaagtgatagtcgtgttttcatctggcccagacctggaacctttgattaaggagatagttagacggaatattactggtaagatttggcttgccagcgaagcctgggcaagtagttccctgattgcaatgcctcaatacttccacgtggtcggaggaactattggattcgctctgaaagctgggcagattccagggttccgcgaattccttaagaaagtgcacccacggaagagcgtacataacggatttgctaaggagttttgggaggaaactttcaactgccacctgcaggagggtgctaaagggcctctgccagtggatacgtttctcagagggcatgaagagtccggcgatcgtttcagtaacagttcaaccgcttttaggcctttatgcacaggggatgaaaacattagttctgtagagaccccatacatcgattacacccacctgagaattagttacaacgtctatcttgctgtgtatagcatcgcgcacgccctccaggatatctacacatgtcttcccggaagaggtctgttcaccaacggcagctgtgcagacatcaagaaagtggaggcttggcaggttctgaaacatttgcgccatctaaattttacaaataatatgggggaacaagttacttttgatgaatgcggcgaccttgttggcaattatagtatcatcaattggcacctgtccccggaagatggttcaatcgtgttcaaagaagtgggttattacaacgtctacgccaagaagggggagcgcttgtttattaacgaagagaaaattctatggtccggattttctcgtgaagtccccttcagcaactgcagcagagactgcctggcaggcactcggaagggaattatcgagggtgagcctacatgttgcttcgaatgtgtggaatgtcccgacggtgagtactcagatgagaccgacgccagtgcctgcaataagtgtccggacgacttctggtctaacgaaaatcatacctcttgtatcgccaaggagatcgagtttctgtcctggactgagccatttggaatcgccttgactctattcgctgtcctgggtatctttcttactgcctttgtgttaggagtatttattaagtttcgcaacacccccattgtgaaagccactaatcgagagctcagttatctattacttttttccctgctctgctgcttttcctctagtcttttctttattggagagccccaagactggacatgtagactgagacaaccagcattcggaatcagctttgttctttgcatatcctgcatcctcgtgaaaaccaacagagttctcctggtgttcgaggccaagatacctacatcgttccaccggaagtggtggggactgaacttgcaattcttactcgttttcctatgcaccttcatgcagatcgttatctgcgttatctggctgtacacagctccacctagttcctaccggaatcaggaactggaggatgaaatcatatttattacttgccatgaaggcagcctgatggccctcggctttttgatcggctacacctgtcttctcgccgctatatgctttttctttgccttcaagtcgcgcaaactgccagagaattttaacgaagccaaatttattacattctccatgctcatattcttcatcgtgtggatcagtttcatacctgcttacgcctcaacctacggaaagtttgtgagcgcagtggaggtgatcgcgattcttgctgctagtttcggcctgctggcttgcatattcttcaacaaaatctacatcatcttattcaaacccagccggaatactattgaggaagtaagatgcagtacggctgctcatgcattcaaggttgcggcaagagcgactctccggagatccaatgtcagtcgtaagcgttcaagctcattgggaggatctaccggaagtacgccgagcagctccatctcaagtaagagcaatagcgaggatccctttccacagccggaaagacagaaacaacagcagcctctggccctcacccagcaagagcagcagcaacagcctttgactctcccccagcagcagaggtctcaacaacaaccgaggtgtaagcaaaaggtcattttcggatccggaacggtgaccttttcactttcatttgatgagccacagaaaaacgcaatggcacaccgcaattcaacacaccagaacagtctagaggctcagaagagctctgacaccctgacccggcacgaacccctgctgcctcttcaatgcggcgaaacagacctggacctgaccgtgcaggaaacgggacttcaaggacctgtaggcggagatcaaaggccggaggttgaagaccctgaggaactgtctccagcgctggtggtcagcagtagccagtcatttgttatctccggcggcggcagtaccgtaaccgaaaacgtcgtgaactcatag

SEQ ID NO: 110536 - DNA, 3237 bp, Artificial Sequence
  Description of Artificial Sequence: Synthetic coding sequence
atggctttttacagctgctgctgggttctcctcgcactgacttggcacactagcgcatacggtcctgatcagagagcacagaaaaaaggggacattatacttggggggctcttccctatccattttggggtcgctgcaaaggaccaggacctcaagagccgtccagagagtgtggagtgcatacgatacaatttcaggggcttcagatggctgcaggcaatgatcttcgcgatagaggagatcaattcttcacccgctcttttgcctaatctaactctcggctaccggattttcgatacttgtaataccgtgtcaaaagcactggaggctaccttgtctttcgtggcacagaacaagatcgatagtctgaacctggacgaattctgtaactgctctgaacacatccctagtacaatcgccgtggtaggagctacggggagcggcgtgagtaccgcagtggccaatctcttaggcctgttctatatcccacaggtttcttacgcatcttctagcaggctgttatccaacaaaaaccagttcaaaagtttcttaagaaccattcccaacgacgagcaccaggcgactgcaatggcagacatcatagagtacttccgctggaactgggtcggtaccattgctgccgatgacgactacgggcgtcccggcatcgagaaatttcgcgaagaggccgaagagagagacatctgcatcgatttctcagaacttattagccagtattctgatgaggaggagattcagcatgtggtcgaagtcattcaaaactccactgcaaaagtgatcgtggtcttttcatccggtcctgatcttgaacccctgatcaaggagatcgttaggagaaacatcaccggtaagatatggttggccagtgaggcatgggcttctagcagtctgatcgcaatgccccagtactttcacgtggtcgggggcaccatcggattcgctctcaaggcagggcaaatccctggctttcgtgaattccttaagaaggtacaccctaggaagagcgtgcacaacggcttcgctaaagaattctgggaggaaacctttaactgccacctgcaggagggcgcaaaaggacctctcccggtggacacatttctgagagggcacgaagagtcaggcgaccgattctccaattcgtctactgcttttaggcctttatgcaccggcgatgagaatatctcttcggtcgagaccccttacatcgattacactcatttgcgcatttcatacaacgtgtatttagctgtatatagcatcgcccacgccttgcaagatatttacacctgtctgcccgggaggggactgtttacaaacgggagctgtgcagatattaagaaggtggaggcgtggcaggtgctcaaacacctgagacaccttaattttacaaataatatgggtgagcaggtcaccttcgatgagtgcggggacttggtcggcaattacagcatcattaactggcacctgagcccggaagacgggtctatcgttttcaaggaggtggggtattacaatgtctacgctaagaaaggtgagaggctgttcatcaatgaggaaaagattctttggtcaggcttcagcagggaagtgcctttcagtaactgctctcgcgactgtctggctggcaccaggaagggtatcattgaaggtgagccaacttgctgcttcgaatgcgtagaatgtccggacggcgagtacagcgatgagacagatgcgtcagcctgtaataagtgccccgatgatttttggagcaatgaaaatcatacttcttgtattgccaaagagatcgagttcctgtcatggaccgaacctttcggcatcgccctcacgctcttcgccgtgctgggaattttccttactgctttcgtgctcggtgtattcattaaattccgtaacacaccgatcgtaaaggctacaaaccgcgaacttagctatctgctgcttttctccttgctctgctgtttcagcagcagcctgttcttcatcggggagcctcaagactggacctgtcgcttgaggcagccggcatttggcatttcatttgtgttgtgcatttcgtgtatcctggtgaagaccaatagagtgctacttgtgttcgaggcgaagattcctacatctttccatagaaagtggtggggcctgaacttacagttcctgctggtcttcctgtgcactttcatgcaaatcgtgatctgtgtaatctggctgtacacagcccctccaagctcgtatagaaaccaagagttagaggatgagataatatttatcacgtgccatgagggatctctgatggcactcggcttcctcattggatacacctgcttgctggctgcaatttgttttttctttgctttcaaatcaaggaagctgcccgagaactttaacgaagccaagttcattactttttccatgcttattttctttattgtgtggatttcctttatccctgcttacgcatcaacctacggtaaattcgtgtcagccgtggaggtgatcgctatactggccgcaagttttggtctactggcttgtatatttttcaataagatttacataatcctgtttaagccttcacggaacaccattgaggaagttcgttgtagtactgccgcgcatgctttcaaagtcgctgcgcgcgccactctgcgtcgctccaatgtgtcgaggaagcgctctagctccttgggtggcagtacaggatccaccccctcctcttctataagtagtaagtctaacagtgaagacccctttcctcagcccgagaggcaaaagcagcaacagcctcttgccctgacccagcaagagcagcaacaacagccactcaccctcccgcagcaacagcgttcacagcagcaacctcggtgtaagcagaaggtaatcttcggtagcggaaccgtgaccttctcactgtcctttgacgagccgcagaaaaacgccatggctcacagaaattctacacatcaaaactcactggaggctcagaaatccagcgatactctgacacgccatgaacccttgctcccactgcaatgtggcgaaacagacctcgatcttaccgttcaggaaacaggcctgcagggacctgtcggaggtgatcagagaccggaagtggaagaccctgaggagttaagcccagccctagttgtgtcttcgagccagtcatttgttattagcggcggcggtagcacagtgaccgagaacgtggtgaatagctag

SEQ ID NO: 110537 - DNA, 3267 bp, Artificial Sequence
  Description of Artificial Sequence: Synthetic coding sequence
atggcattctactcctgttgttgggtccttctggccctgacatggcatacgtcagcgtatgggcctgatcaacgtgcgcagaaaaagggagacattattctcgggggcctgttcccaatccacttcggcgtggccgccaaagaccaggacctcaaatcgcgccctgagagcgttgagtgtatcagatacaattttcgcgggtttcgatggctgcaagccatgatcttcgctatcgaggagataaatagttctcctgcgttactcccgaacttaaccctgggatataggatcttcgatacgtgcaatacagtttccaaggctttggaggcaacgctgagtttcgttgcccaaaacaaaatagacagcctgaacctggatgaattttgcaactgttctgaacacatcccaagtacaatcgctgtcgttggcgcaaccgggtcaggtgttagcaccgcagtggctaatttgctggggcttttctatatcccgcaggttagttacgcaagtagctccagactcttgagcaacaagaatcagtttaaaagctttttacgcaccatcccaaacgacgaacaccaggccacggcgatggcagatataattgagtatttccgatggaactgggttgggaccatagcggcggacgatgattatggaaggcctggcatagaaaagtttcgagaggaagccgaggagcgcgatatttgcattgatttctcggaactgattagtcagtattccgatgaagaagagatccagcacgttgtcgaggtgatccaaaattccacagccaaggtgatcgtcgtcttttctagcgggcctgaccttgagcccctaattaaagagatcgtcaggcggaatattacagggaaaatatggctggcctccgaagcgtgggcttccagttctctgatcgccatgccccagtatttccatgttgtgggaggtacaatcggtttcgctctcaaagctggccagatccctggcttcagagaatttctgaagaaggttcacccaaggaagtcggttcataatggattcgctaaagaattctgggaagaaacatttaattgtcacctccaggagggagcgaagggccccctcccagtcgatacgtttctgcgcgggcacgaggaaagcggggatcggttctccaacagctcaacggctttcagacccctgtgtacaggcgatgaaaacatcagttccgtcgaaactccttatatagactatacccacctgagaatttcatacaacgtgtacttggccgtgtactcgattgcccacgcccttcaggacatttacacctgcctccctggtcgggggctgttcaccaacggcagctgtgcagacatcaagaaggtcgaagcatggcaggtattaaaacatctccggcacctaaatttcaccaataacatgggagaacaggtgacctttgacgaatgcggagacctggtgggtaattattctatcatcaactggcatctctccccagaagacggatcaattgtcttcaaggaggtcggctactacaatgtatatgcaaagaagggggagagactcttcatcaacgaggagaaaatcctatggagtggattcagtcgcgaacctctgacctttgtcctgtcagtcctgcaagtccctttctccaactgtagccgggactgcttagcgggtaccagaaaagggatcattgaaggggaaccaacttgctgcttcgaatgtgtggaatgcccagatggagagtactcagacgaaacagatgcttccgcctgtaacaaatgccctgacgacttctggagcaacgagaaccacacttcctgtatcgcaaaagagattgagttcctgagctggactgaaccattcggaattgcccttactctcttcgcagttttaggcattttcctgactgcatttgtattgggggtgtttattaagttccgcaatactcccatcgtgaaggctacaaatcgcgaactgtcttatctcctgttgttctccctcctgtgctgtttcagcagctctttgttttttataggggagccccaggactggacttgcaggctaagacagccagcttttgggattagtttcgtcctgtgcatctcctgtattctagtgaaaaccaaccgggtactgctggtgttcgaggcaaagattccaacctcattccatcgtaaatggtggggactgaatctgcaatttttgctggtctttctatgtacgtttatgcaaatagtaatctgcgttatctggctatatactgctccccccagcagttacagaaaccaggagctggaagacgagatcatctttattacatgccacgaggggagcctcatggcgcttggattcctaatcgggtacacatgccttcttgccgcaatctgctttttctttgcatttaagtcccggaaattgcccgagaactttaatgaggccaagttcataacattttccatgctcattttctttatcgtgtggatctcttttatcccagcctacgcgtccacctacggaaaatttgtgagtgccgtcgaggtcattgcaattctggccgcatcttttggtctcctggcatgcatttttttcaacaagatatatatcatattatttaagccctcacgtaataccattgaagaggtgcgttgctccaccgccgcccatgctttcaaagttgctgccagggccacgctccggagatcaaacgtctcacggaaacgcagcagctccctcggcggaagtaccggcagtacacctagctccagcatctcttcgaaatctaacagcgaagatccgttccctcaacccgagagacaaaagcaacaacagccccttgccctgacacaacaggagcaacagcagcagcccctgactctgcctcagcaacagcgctcccagcagcagccgcgctgcaagcagaaggtcattttcggctcgggaacggtgaccttttcccttagcttcgatgagccccagaaaaacgctatggcccatcgcaacagtactcatcaaaactcactggaagcccagaaatcctccgataccctgacacggcacgaacccctactgccactgcagtgcggtgagacggacctcgacctcacagtccaagagactggcttgcagggaccggtgggcggggatcagaggcctgaggtggaagaccctgaagagctgtcccctgctttagtagtgtcttccagccagtcttttgttatttccggaggcgggtccaccgtcaccgaaaatgtggtgaattcctag

SEQ ID NO: 110538 - DNA, 978 bp, Artificial Sequence
  Description of Artificial Sequence: Synthetic coding sequence
atggccaggcctgtgagcgaccggacccctgccccgcttctgcttgggggcccagcgggaacaccccctggaggcggggccctgttaggtctgcgcagtctcctgcagggtaccagtaagcctaaagagcctgcaagctgcttgcttaaggagaaagagcggaaagccgccctacctgccgccaccacgcccggaccagggcttgagacggcaggtcccgctgacgcgccagccggtgccgtggtcggtggcggttctcctcgcgggaggcccggaccagtgcccgcaccagggctcctggcacccctcttgtgggagcggacactccccttcggggacgttgaatatgtcgacctcgacgctttcttgttggagcatgggctcccgcccagtccccctccacccggaggcccaagtcctgaaccctctcccgcacggacccctgcgccaagcccgggtcccggctcctgcggttctgcgagcccccgctcctccccagggcacgctccggccagagcagccctggggactgcgagcggtcaccgggccggcctgacctcacgtgatacgccgagcccagtagaccctgacaccgtggaggttctcatgacatttgaacctgatccagcggacctcgcgctgtccagcattccaggccacgagacattcgacccccggcggcatcgattctcggaggaggaactgaagccccagccaattatgaagaaagcccgcaaaatccaggtacctgaagagcagaaggatgaaaagtattggtctagaagatacaaaaataacgaagccgccaagaggagcagggatgctcggaggcttaaagagaatcagattagcgtcagggctgccttcttagagaaggagaacgcactgttacgccaagaggtggtggccgtcaggcaagaactcagccactatcgcgccgtgctaagccggtaccaggcacaacatggcgcgctctag

SEQ ID NO: 110539 - DNA, 969 bp, Artificial Sequence
  Description of Artificial Sequence: Synthetic coding sequence
tctcaaaggggtaaagggacctgtcccggtagccatcgtaaccacgcctcttccctgccctcccatggcctggtaagtattcagggcattagcgcccctgccggccagtggcccgcccctcctccatggtcccaggagggaatgcagtgccatagggacctggctctgagccaggccttatggggctggcaattgagcaagcagtccgggtgggcgcatccctctttgccacactcgcctttgccatccactgtgcactcttgtagttgggcaccgccacacctgcagcgacatctgcccctggccactgtctctccaggtaccacccagttaacccaggggcccgctgggcgaacgctgggtcagacccaggctagctgcccagagcccagaccttctatggacgccgtggatgccaccatggagaaactgagggctcaatgcctctctcgaggggcaagcgggatccagggcctcgcaagattctttaggcagctcgaccgcgacggttcccggtctcttgacgctgatgagttcaggcaaggactggctaagcttggactggtcctggaccaagcagaggcagagggagtgtgccgcaaatgggatcggaatggaagcggaactcttgatctagaagaattccttcgcgccttacggccacctatgtctcaagctagagaggctgttatcgctgccgctttcgctaagctagacagatccggtgacggggtcgtgacggttgacgatctgcgcggcgtgtattccggtagggctcacccaaaggtgcgctctggggagtggaccgaagacgaagtattgcggagatttctcgataattttgactcaagcgagaaggacggacaggtgacgttagctgagtttcaagactattatagcggcgtatccgcttccatgaataccgatgaggagtttgtagctatgatgacttccgcttggcaattatag

SEQ ID NO: 110540 - DNA, 489 bp, Artificial Sequence
  Description of Artificial Sequence: Synthetic coding sequence
atggatgccgttgacgccaccatggagaaactcagggcccagtgtcttagtaggggagcgtcaggtatccaaggcctggcccggtttttccggcagctggaccgtgatggcagtcgatccctggacgctgacgaattcagacaaggacttgccaagctgggtcttgtgctggatcaggcagaggcagaaggggtctgccgcaaatgggaccggaatggtagcggtacgctcgacttagaggagtttctccgagcactcagacctccaatgagtcaggcccgtgaggctgtaatagccgcagcctttgcgaagcttgaccgctccggtgatggcgtcgtcacggtcgacgacttaaggggagtgtactccgggagggcccacccgaaagtcactttagccgagttccaagactattacagcggggtgagcgctagcatgaacacggacgaagaattcgtcgccatgatgacaagcgcttggcaactttag

SEQ ID NO: 110541 - DNA, 882 bp, Artificial Sequence
  Description of Artificial Sequence: Synthetic coding sequence
ctcattaatatactgtatagagctgtgatctctgaccctgagcagaaccttgccattgaacagaaggagagcgatcacatcctgccagacagcaaaatgacacccttacgattccgaaaacggacgcttcacgagacaaaaattaggactcactctactctaaccgagaatgtgcttagtcacaaactgcaatttgacggtcggattgtaagccggaccaacgttttgccttttatccagaaaagtatttatagccaccagtgcgggcgaagaaaagggaagcagtacaggctcggcgatttttatgtgggggcaactctcacttttttgtcatcagaccatttgagtctgccagagagcattaaagagaataccctccttaagctgcggatcacaaacatagaccagatcgccctggattctctcaagacagcatccatggaacaagaagacgacatcattattcaggagaccaacgataggctggtattcaaggctatacaggatgttctcaaggaaaaacttcacaagcgaggagtccggattctgactggtctgggcaagtatttccaacagttggataaggaaggtaatgggctgttagacaaggctgacttcaagcaggccctcaaggtctttcacctggaggtctccgaaaaagattttgagtccgcatggctaattttgaacgataatggcaacggaaaagttgactatggtgagttcaagcgggggatcatcggtgagatgaatgaataccggaaatcctatgtgcggaaggcttttatgaagctggacttcaataaaagcggcagtgtgccgatcatcaatatacgaaaatgttattgtgccaagaagcactcccaggtcatctctgggtag

SEQ ID NO: 110542 - DNA, 1149 bp, Artificial Sequence
  Description of Artificial Sequence: Synthetic coding sequence
atgatcgaccacctgtcgagagccgtgatttcagacccggaacagaacctcgccatcgaacagaaggagtccgatcacattctgcctgacagcaagatgacccctctgaggtttagaaagagaacactccatgagactaaaattagaacacactcaacacttactgaaaacgtcctgtctcataagctacaatttgacgggagaattgtgtctcgcaacggtagggatgcctgccgggagttgatcggtttctttttcacacacgatcagagcctgactatctacgaatatcgccagttcggcaaaaacagaactaacgtcttgcccttcattcagaaatctatttattcccaccagtgtggcagacgcaagggaaaacaatataggctcggtgatttttacgtcggcgcgacactgacttttctgtcctccgatcatttgagtttgcctgagtctattaaggagaacacattgctgaaattacggattaccaatatcgatcagattgccctcgatagcctgaaaactgcttctatggaacaggaagacgacattattatacaggaaacaaacgatagactcgtgtttaaggctatccaagatgttctgaaggagaagctgcataaacgaggggtaaggattctgaccggtctgggtaagtactttcagcagcttgataaagagggcaacgggttactggacaaggctgacttcaagcaggccctgaaagtgtttcatctggaggtgtctgaaaaagacttcgagtctgcctggctgatccttaacgataacggcaatggtaaagtggactacggagagttcaagcgaggcattatcggggagatgaacgaatacaggaagtcctacgtgcgtaaggcctttatgaagctggacttcaacaaatctgggagtgtgccgatcatcaatattagaaaatgttattgcgccaaaaaacacagccaggtgatctccggccactctacggaagaggagatcaagagctcttttttggaaactttgaaggtagcctgtagtaagtctgatgaggtgagttatggcgagtttgaggactactacgagggattgagtattgggatagttgatgatgaggactttgtcaatatcctacggacaccttggggcatctag

SEQ ID NO: 110543 - DNA, 1674 bp, Artificial Sequence
  Description of Artificial Sequence: Synthetic coding sequence
atgggtaatagtttttgctatactgcagtctactgtatgattaacactggcacccagatggaccttgaggttaagggtgtggccgcaacatcccggtcccagattcagcccttttttggtcgcaaaaagcctcttcaacagaggtggactagcgaatcctggactaatcagaacagttgtcctccagtggtgccaagactcgatctgggcagcctcgttgactccgatgatgaagataacttcagttacatcccgctgagcaccgccaacctgcctaacagctccagcacgctgggttgggtcactccgtgccagactccatatactcaatatcacctgaacaagctggaccagaacatcatccccgagaatctgccagccccaaccgacaaatgtaaactgaaatatcagcagtgtaagactgaaatcaaggaagggtacaaacaatactcccagagaaacgcagaaaacactaagtctaatgtgacccacaaacagagcccaagaaacaagatcgatgaaaagtgcgtgcaggatgaggaagccaatacagacgacttaaccacccttgataggaaggctatcctacaacagggttacgcagataactcatgtgacaagcagcagagagcccgcaagcttgacgcagagatcgtggcagcagagaaaaaaaagcagattgtcgctgagcaggtaatgattgatcacctctcccgagctgttatctccgaccctgaacagaacctggccatagaacaaaaagagtccgatcatatcttgcctgacagtaaaatgacccccttgcggtttaggaagagaactctacatgaaaccaaaatccggacccattctacactgactgagaacgtgctgtctcataaacttcagttcgatggtaggatagtatctcgcaatggcagagacgcctgtagagagttgatcgggttctttttcactcacgatcagtctctgacgatctacgagtaccgccagttcggtaagaacagaaccaatgtgttacccttcattcagaagtcgatttactctcatcagtgcgggaggcgcaaaggcaaacagtaccggctcggagatttctatgtcggggccacactgacatttctgtcaagcgatcacctgtcattgccagaatccataaaggagaatacactccttaagctgagaatcaccaatatcgaccagattgcattggatagtctcaagaccgccagtatggaacaggaggacgacatcattatccaggagactaatgatagactggtgttcaaagccattcaggacgtgctgaaggaaaagctccacaagcggggtgtccggattctcacagggctaggcaagtactttcagcagctggataaagagggcaatggactgctggacaaggctgatttcaagcaggcactgaaggtgtttcacctcgaggtgagtgagaaggacttcgagtccgcctggctcatattgaacgataatgggaatggaaaggttgactatggggaatttaagcgtggtattattggcgaaatgaacgagtatagaaagtcttatgtaaggaaggcctttatgaaactcgactttaataagtccggatccgtcccgataatcaatatccgcaaatgttactgtgccaagaaacatagccaagtcatctccggatag

SEQ ID NO: 110544 - DNA, 615 bp, Artificial Sequence
  Description of Artificial Sequence: Synthetic coding sequence
atggaacaggaagatgatattatcattcaggagacaaacgacagactggtgttcaaggccattcaggatgtcctgaaagaaaagctccacaaaaggggggttcgaatcctgactggactcggaaaatattttcagcagcttgacaaggaggggaatggtttactggacaaggccgactttaaacaggccctgaaggtcttccacctggaggtgtcagaaaaggatttcgagtcagcatggttgattctcaacgataatggaaacggcaaggtggattacggtgaattcaaacgcggaatcatcggagaaatgaacgagtacagaaagagttacgtcagaaaagcttttatgaagctggactttaacaagtctggttccgttcctatcatcaatatacggaagtgctattgcgctaaaaaacattcacaggtaatctccggtcactctaccgaggaggaaattaaaagctcattcctcgagacactcaaggtcgcttgcagcaagagcgacgaagtgtcttacggcgagttcgaggattattatgagggactcagcattggcatcgtcgacgacgaggatttcgtcaatatcctgagaaccccttgggggatttag

SEQ ID NO: 110545 - DNA, 3009 bp, Artificial Sequence
  Description of Artificial Sequence: Synthetic coding sequence
atggctgctcatgagtgggactggtttcagagagaagaactaatcggccagatcagcgatatcagagtgcagaacttgcaggtggagagggagaatgtgcaaaagcggacgtttactaggtggataaatttgcacctggaaaagtgcaaccctccactggaggtaaaagacctgtttgtggatatccaggacggaaagatactgatggccctgctggaggttttatctggccggaacctgctgcacgagtataagagctccagccatagaatcttccgcctgaacaacattgccaaagcgctcaaatttctggaggatagcaatgtgaagctggtgtcaattgatgccgctgaaattgccgacggcaatccctcgctggtactcggcctgatctggaacatcattctgtttttccagattaaggaattaacaggcaatctgagtcggaactctccgtcaagcagcttgtcaccaggatcaggggggactgacagtgacagtagttttccccccactccaactgccgagagatctgtggctattagcgtaaaagatcagaggaaagcaatcaaagccctgctcgcatgggtccaacggaaaaccagaaagtatggagtggccgtgcaggattttgctggcagttggaggtctggacttgcatttctcgccgtcataaaggcgatcgacccgtcccttgtagatatgaagcaggctcttgagaacagtacccgcgagaacctcgagaaagcattttctatcgcacaggacgccctgcacataccccggctgctggaacccgaggacattatggtcgatacgcctgatgaacagtccatcatgacctacgtggcacagtttctggagcgcttcccagagctggaagctgaggacattttcgacagcgacaaagaagtcccaatcgaatccaccttcgtcaggataaaggaaactccctccgagcaagagagtaaggtgtttgtgctaacagagaacggcgagcgcacctacaccgtcaatcacgaaaccagtcatccgccaccttcgaaagtgtttgtgtgcgataagccggaatcaatgaaagaatttcggttggacggtgtgagctcccatgccctcagcgacagtagcacagagttcatgcaccagatcattgatcaggtcctccagggtgggcccggaaagaccagcgatatatcggagccatctcccgagtcctccattctctcgagtcgcaaggagaacggacgttctaactcactcccgattaagaagactgtgcattttgaggccgatacatataaggatccattctgctcgaaaaacttgtctctgtgcttcgaaggttcccctagagtcgctaaggaatcccttagacaggacggccatgtgttggccgtagaagttgccgaggagaaagagcagaagcaggagagctccaagattcccgagagtagctcagacaaagtggccggcgatatcttccttgtggaaggcactaacaataactcccagagctccagctgtaatggcgccttggagagtaccgcgcgccacgatgaggaatcccactccctcagccctcctggggaaaacacagttatggccgatagcttccagattaaagtgaacctcatgaccgtcgaggcactagaggaaggcgattacttcgaggcaattccccttaaagcatccaagtttaatagtgatttgatcgactttgccagcacttcccaggcgttcaataaagtgccttctccccatgagacaaagcccgatgaggacgccgaagcgttcgagaaccacgcagagaagctgggaaagcgctccatcaagagtgcacacaagaaaaaagactcacccgagccacaggtcaaaatggataagcacgagcctcaccaggactcaggtgaggaggctgagggatgcccaagtgcccccgaagagacaccggtggataaaaaacccgaagttcacgagaaagccaaaaggaagagtacgagaccccactatgaggaagagggcgaggatgacgaccttcagggtgttggcgaggaactttccagctctccccctagttcttgcgtcagtctggaaacgctggggagccattcggaggaagggctggactttaaaccttcacccccgctttctaaggtatcagtgatccctcacgatctgttctattttccccactacgaggtccccctggcagccgtgctggaggcttatgtagaagaccctgaggacttaaagaacgaggaaatggatctagaagaacctgaagggtatatgcccgacctggatagtcgagaggaggaggcagacggctcccagagctctagctctagctccgtgcccggcgagtccctccccagcgcctccgatcaggtgctatatttaagccgggggggagttggtaccactcccgcgtcggagcctgcaccacttgctccccatgaggaccatcagcaaagggagacaaaggagaacgacccgatggatagccatcagtcacaagagtcgccaaacttggaaaacatcgctaacccactagaagagaacgttacgaaggaaagtatctcgtcgaagaaaaaggaaaagaggaagcacgtcgatcatgtggagtccagtctgttcgtggccccggggtctgtgcagagttcagatgacctagaagaagattcctctgactactcaattccatcccggacaagccactccgacagtagtatttacttacgcaggcacacgcatcgctcaagtgaaagtgaccacttctcttatgtacagctcaggaatgcagccgacttagatgataggcgcaacaggattttaacgcggaaggcaaactcctccggtgaggcaatgagtctcggtagtcacagcccgcagtcagattctctcacccagctagtccagcaacccgatatgatgtattttatcctgtttctctggctcctcgtgtactgtctgctcctgtttccccagctcgacgtgtctcggctatag

SEQ ID NO: 110546 - DNA, 450 bp, Artificial Sequence
  Description of Artificial Sequence: Synthetic coding sequence
atggcagaccagctcaccgaggagcagattgctgagttcaaggaagccttcagtctgttcgataaggacggcgacggaacgatcactaccaaggagttggggaccgttatgcgcagtctggggcagaaccctactgaggccgagcttcaagacatgattaatgaagtcgacgccgacgggaatggaacgatcgactttccagagtttctgaccatgatggctcgcaaaatgaaagatacagacagtgaggaagagattcgcgaggcatttagggtcttcgataaggatggcaacggctacattagcgctgctgaattgagacatgtcatgaccaacctgggcgagaagctcactgatgaggaggtggacgagatgatcagggaggctgacatcgacggcgacggccaggtgaattatgaggagtttgtccagatgatgactgcaaagtag

SEQ ID NO: 110547 - DNA, 450 bp, Artificial Sequence
  Description of Artificial Sequence: Synthetic coding sequence
atggccgaccagctgaccgaggagcaaatagccgaatttaaagaggccttcagtctgtttgataaggacggtgatggtacaataaccactaaagaactcggaacagtgatgcggtccctggggcagaatcccaccgaagctgaattacaggacatgattaacgaggtggatgcagacggcaacggtacaatagacttccccgaatttctgacaatgatggcccggaagatgaaagatactgactccgaggaggaaattcgggaggccttccgggtattcgataaagacggaaatggttatatcagtgccgctgaactcaggcacgttatgactaatttgggcgagaagctcacggacgaagaggtggacgagatgattcgcgaggccgatatcgatggcgacggacaggtaaactacgaggagttcgtgcagatgatgactgcgaaatag

SEQ ID NO: 110548 - DNA, 450 bp, Artificial Sequence
  Description of Artificial Sequence: Synthetic coding sequence
atggccgaccaactaaccgaggagcagatcgctgagtttaaagaagcattcagtctgtttgataaggatggggatggcaccatcacaaccaaagaactcggaacggtgatgaggagtttaggccagaatccaacagaagctgagttgcaagacatgattaatgaggttgatgccgatggaaatggaacgattgattttcctgagttccttaccatgatggctcggaaaatgaaggatactgactccgaggaagaaatccgtgaggctttccgggtctttgacaaggacggcaacggatatattagcgccgctgagttacgtcacgtgatgacaaatctgggagagaagttaaccgatgaggaagtggatgaaatgattcgagaggcagatatcgacggcgatggtcaagttaactacgaggaattcgtccagatgatgaccgccaaatag

SEQ ID NO: 110549 - DNA, 450 bp, Artificial Sequence
  Description of Artificial Sequence: Synthetic coding sequence
atggccgaccagctgacagaggagcagatagccgaatttaaggaggctttcagcctatttgacaaagacggcgatggtacaatcaccaccaaggaattgggaactgtaatgcgcagcctgggacagaaccctacagaggccgagctgcaagatatgattaacgaagtagacgcggatgggaatggtaccatagacttccccgaatttctgacaatgatggcccggaagatgaaggatacagactctgaggaggagattagggaggcctttagggtctttgacaaggatggcaatgggtatatctctgccgccgagctgcgccatgtcatgaccaaccttggggagaagctaactgatgaggaggttgatgagatgatcagagaggctgacatcgatggagacggacaggtcaattacgaagagtttgtgcagatgatgacagctaagtag

SEQ ID NO: 110550 - DNA, 5022 bp, Artificial Sequence
  Description of Artificial Sequence: Synthetic coding sequence
atgtggcgcgctgagggcaagtggctacctaaaacatcaaggaaatccgttagccagtcagtcttttgcggcactagtacctactgcgtcctgaataccgtcccccctatagaggacgaccacggaaattccaacagttctcacgttaagattttcttgcccaagaaattactcgaatgcttgccaaaatgttcaagtttgccgaaggaaagacaccgatggaacaccaacgaggaaatcgccgcctatctgatcacatttgaaaaacatgaggaatggctcacgacttccccaaagactagaccgcaaaatgggagcatgatcttgtacaatcgcaagaaggtaaagtaccggaaagacgggtactgctggaaaaagagaaaggatggaaagacaacccgcgaggaccatatgaagctcaaagtgcagggggtcgagtgtttatacggatgctacgttcactcctctatcatccccaccttccaccgcaggtgctattggctgctgcaaaaccccgacatcgtcctggtgcactacctcaatgtgcctgccatagaggactgtggcaagccctgcggtccaattctatgctcgatcaatactgataaaaaggagtgggccaaatggacaaaggaggaactgattggtcaactgaagcctatgttccatggtatcaagtggacttgctcaaacggcaactcgagttctggtttcagtgtggaacagctggtgcagcagattctggactctcatcaaacgaagccgcagccgaggactcacaactgtctctgcactggatccctgggagctggtggcagcgtgcaccacaagtgtaacagtgcgaagcatcggattatctctcctaaggtggaacccagaacagggggatacggctcccacagcgaggttcagcacaacgacgtgtcagagggtaagcacgagcactcccactcgaaaggttcttcccgtgagaagcgaaacgggaaggttgctaagccggtgctcctccaccagagtagtactgaggtgagttcaaccaaccaggtggaggtgcctgacactacacagtcgagcccagtctccatcagcagcgggctcaatagcgacccagatatggtggattcccctgtcgtcacgggagtgtcaggcatggctgtcgcttccgtgatggggtctctttcccaatcagctactgtgttcatgtctgaggtgaccaatgaggccgtctacactatgtctccaaccgccgggcctaaccaccatctcctctccccagacgcaagccagggcttagttctggccgtttcctcagacgggcataaattcgcgtttcccacaactggcagcagcgaaagcctaagtatgctgcccacaaatgtgtctgaagagttggtgctgagtaccacacttgacgggggcaggaagatacctgaaacaaccatgaattttgaccctgactgcttcttgaataaccccaagcagggccagacttatggcggcggagggctgaaagccgagatggttagctccaatattcgccacagtccacccggggagcgaagcttcagcttcacgactgtcctgacaaaagagattaagactgaagatacatcctttgagcagcagatggccaaggaggcttatagctccagcgcagcggctgtagcggcatcttccctcacgttgaccgccggcagctcccttctgccttcaggcggagggctgtccccctctaccacgctggaacagatggatttttctgccattgactctaataaggactacacttcatccttcagtcagacaggacacagccctcacattcatcaaacgcccagtcctagcttcttcctccaagacgctagtaagccactgccagttgagcagaacacccactcttcccttagcgattcaggagggacatttgtcatgcctactgtgaagaccgaggcttcttcccagacaagctcctgtagcgggcacgtcgaaaccaggattgagtccacttcatcactgcatctaatgcaattccaggctaactttcaggccatgaccgcagaaggtgaggtcactatggaaacgtcacaggcagccgaaggctcagaggttctgctgaaatcaggggagctccaggcttgtagttctgagcattatctacagcctgaaactaatggcgtcatacggtctgcgggcggcgtgcctatccttcccggaaacgtggtgcagggcctctaccccgtggcacagccgtctctcggcaatgcttcgaacatggagctgagtctggatcacttcgatataagcttttcgaatcagttctctgatcttatcaacgacttcatcagtgtagaaggaggcagcagcaccatttacggacaccagctggtgagcggcgactctaccgcactgtctcaaagcgaggacggcgctagagcaccgttcactcaggcagaaatgtgcttgccttgttgctccccccagcagggatcactgcaactgtctagcagcgagggcggcgcgtccacaatggcctatatgcacgtcgcggaagttgtatcggcagccagcgcccagggcacacttggaatgcttcaacaaagtggcagggtgttcatggtgaccgactactccccggagtggtcatatccagaaggtggggtcaaggtactgattacgggaccctggcaggaggcctcaaacaactatagctgcttatttgatcaaatctcagtgccagcatcgctcatccaaccaggcgtacttagatgctattgccccgctcatgatacaggcctggttacactgcaagtggcctttaacaatcagatcatctcaaactcggttgtgtttgagtacaaagccagagcactgcctactctcccgtctagccaacatgactggctgtccctggacgataaccagttccggatgagcatcctggagaggctcgaacagatggaaaggcgcatggctgagatgacaggctcccaacaacacaaacaagcgtccggtggaggttcttcaggaggcggatcaggcagtggaaacggagggtcccaagctcagtgtgcctctggaacaggcgctctaggtagctgctttgaatctcgtgtggtggttgtttgtgaaaagatgatgagccgagcatgttgggcaaagagcaagcacctgatccacagtaaaacatttcggggcatgacccttctccacctggcagccgcacagggctatgctacattaatccagacgcttattaagtggcggaccaagcacgcagacagtatagatctcgaactggaggttgacccgctcaacgtggaccactttagctgcacacccttaatgtgggcatgtgccctgggacacctggaagccgctgttgtgctgtataaatgggatcggcgggccattagcataccggactctctcgggagactacctttgggaatcgccaggtcccgcgggcatgtgaaactggccgaatgtctcgaacacctgcaacgagacgaacaggcacagcttgggcaaaatccaaggatccactgtcctgcctcggaagagccatccactgaaagctggatggcacagtggcatagtgaggcgattagctcgcctgagatccccaagggggtcactgttatcgctagcacgaaccctgaactgcggcgacctcgatctgagccatcaaactactattcatcagagtcccataaagactatcccgcgccgaaaaaacataaactcaaccccgagtatttccagacccgtcaggaaaagcttttgccaacggcattgagtttagaggagcctaatattcggaaacagtcaccctccagcaagcaatcagtgccggaaacgctcagcccttccgaaggcgtcagggattttagccgggagctgtctcctcccacacctgagactgccgcattccaggcaagcggatcccaacctgttggcaaatggaattcgaaagatctgtacataggcgtgagtaccgtgcaggttacaggtaatcccaagggaacgtccgtcgggaaagaggcagcccctagtcaggtccgccctagggagccgatgagtgtgctcatgatggctaatcgggaagttgtgaacacagagttaggcagctaccgggatagtgctgagaacgaagaatgcggtcagccaatggatgacatacaggtgaacatgatgacactggcagaacatattattgaggccacccccgatagaatcaaacaggaaaattttgtcccgatggaatcatctggcctggagcgcactgacccagcgacaatctcctctaccatgagctggctggcttcatacctcgctgatgcagattgtctgccgagcgccgcacagattaggtccgcatataatgagccactgacaccatccagcaatacttccctgagtcccgtcggtagccctgtttccgagatagcattcgaaaagcccaatcttccatcagccgctgactggtctgagttcctgtctgccagcaccagcgagaaggttgagaacgaattcgcgcaactaactctaagtgatcatgaacagagagagctgtacgaagccgcccggctggtgcagacggcattccggaagtacaagggccgtcccctacgcgaacagcaggaggtcgctgcggcggtgattcaaaggtgctatcgcaagtataagcagtacgccctctacaagaagatgacccaagcggcgatcctcattcaatcgaagttcagatcgtattatgagcagaaaaaattccaacagtccaggcgcgccgcggtcctgatccagaaatactatcggagctacaaaaagtgcggcaaaagacgtcaggcaaggcgcacagccgtgatcgtgcagcagaagttgcgctcatctctgctgaccaagaaacaggaccaggcggctagaaagatcatgcggttcctgagaaggtgtcgtcattctccgttggtggatcacaggctgtacaaaaggagtgaacgcatagaaaaaggtcaggggacctag

SEQ ID NO: 110551 - DNA, 1911 bp, Artificial Sequence
  Description of Artificial Sequence: Synthetic coding sequence
atgatgagccgcgcttgttgggccaagtctaagcatctgatacacagcaagacattcaggggcatgactcttctgcacctggccgctgcccagggatacgcaacccttatccagaccctcatcaagtggcggaccaaacatgctgattctatcgaccttgagctcgaggtcgacccactgaatgttgaccacttttcgtgcactccgctcatgtgggcttgcgcattagggcacctagaagccgctgtggttctctataaatgggacagacgggccataagcattccagattctctggggagactcccactgggtatcgccaggtcccgggggcacgtgaagctggccgagtgtctggaacatcttcaaagggacgagcaggcgcaactcgggcagaacccacggattcactgccccgcgtcggaggaaccttctaccgaatcctggatggcccagtggcatagcgaagcaatcagcagccctgagatcccaaagggggttaccgtgatcgcctcaacaaacccagaactgcgtagaccgaggtccgagcccagcaattactactcatcggagtctcacaaggactaccccgcccccaaaaaacataagcttaaccctgagtacttccaaacgcgccaggagaaattgctgccaacagcgctcagccttgaagagcccaatattaggaagcagtctccaagcagcaaacagagcgtgccagaaactctgtcaccctcagaaggggttcgcgatttctcccgcgagctgtcaccacccacacctgagaccgcggccttccaggcctctggaagccagcccgttggcaagtggaactcaaaggatctctacatcggcgtgtccactgtgcaggtgacaggtaaccctaaagggacaagcgtgggaaaagaagcagccccgtcccaggtccgcccgagagagccaatgtcagttctgatgatggccaacagagaagtggtcaacactgagctgggcagttaccgtgatagcgccgaaaacgaggagtgtggtcagcccatggatgatatccaggtgaatatgatgaccttagcagaacacataatcgaagcaacccccgacagaattaagcaagagaatttcgtgccaatggaatcctccggactggaacgcacagaccctgcaacaatttccagcaccatgagctggctcgcatcatacctagctgatgctgattgtctccccagcgcagctcaaatccggagcgcctacaacgaacctctgaccccctcatccaacacatcacttagccctgttgggtctccagtgtccgagatcgccttcgagaagcccaacctgcctagcgctgccgactggtccgagttcctgagtgcttcgacgtctgaaaaagtcgaaaatgagtttgcccagctgactcttagtgaccacgagcaacgcgagctctacgaagccgcccgtctggtccagacagccttcaggaaatataaaggccgtcccctgagagagcagcaggaagtggcagcagctgtgatccaaaggtgctatcggaagtacaaacaaggcaagaacatctgtctgaagtacgcgttgtataagaagatgactcaggcagcaatccttatccaaagcaagttcaggtcctactatgaacagaaaaaattccagcagagccggagggccgcggtgttaatccagaagtattacagatcctacaaaaaatgtggtaaacggaggcaagctcggaggactgccgtcatcgtgcagcagaaattgcgcagtagtctgcttaccaaaaagcaggaccaagctgctcggaaaattatgcgatttctgcgtaggtgtaggcaccgggtgaaggagctcaaaaaggccaaagagcttgaggatatccaacagcaccccctggccatgtag

SEQ ID NO: 110552 - DNA, 2151 bp, Artificial Sequence
  Description of Artificial Sequence: Synthetic coding sequence
atggcctgtccggtaagccctgaccataaacaagagggcgcacacgataccggcttagtgaccttacaggtggcttttaataatcagatcatttccaactctgtggtgttcgagtataaagctcgtgccctccccacactaccttcctcccagcacgattggttgtcattagatgacaatcagttcagaatgtcaatcctcgagcgccttgagcaaatggaacggaggatggccgagatgaccggctctcagcagcacaaacaggcatctggaggaggcagtagtggaggaggctccggctctggcaacggcgggtctcaggctcagtgcgcgtccggtacaggcgccctggggtcttgtttcgagagccgcgtggtcgtggtgtgcgaaaagatgatgagtagagcctgttgggccaagagcaagcacttaattcatagcaagacctttaggggcatgaccctgctgcatcttgccgccgcgcagggctacgcgaccctgatccagactctgatcaagtggcgcacgaagcacgccgattctattgacttagagctcgaggtcgatccgctcaatgtggaccattttagttgcacaccgttaatgtgggcctgtgctctcggccatttggaggcagcagtggtgttgtataaatgggataggagagctatcagcatcccagacagcctcggtaggctgcccctcggaatcgcccggtccaggggccatgtgaaactcgctgagtgtctagagcacctccagcgggatgaacaagcccaactgggacagaacccccgaattcattgtcccgcctctgaggaaccttccacagagagctggatggcccagtggcatagtgaagccatcagttcccccgaaatcccaaaaggcgtcactgtgatcgccagcacaaatcccgagttgcggcgccccaggagtgaacccagcaactactactctagcgagtcgcataaagactacccagctccgaagaagcataaactgaatccggagtacttccaaacacgacaggagaaactgttacctacggcactgagcctcgaggagccgaacatccgcaaacagtcaccctcaagcaagcagtccgtgcctgaaacactatcgccaagcgagggagtcagggatttctctagagaactgagccctcccactcccgaaacagccgccttccaggcttctggatcccagccagtgggcaagtggaatagcaaggacctctatattggcgtgtcaaccgttcaggtaactggcaatccaaagggcacgtctgttgggaaggaagcagctccctcacaagtccgcccccgggaacctatgagcgttcttatgatggccaaccgcgaggttgtgaatactgaacttggaagctatcgcgactcggctgagaacgaggagtgcggacagcccatggacgatatccaggtcaatatgatgacgctcgcagagcacattattgaggccaccctctccagtactatgtcatggctggcctcatatctggcagacgccgactgcctgccctccgctgcccaaatacggtctgcatacaacgagccattgactccctcttctaacacgtctttaagtcctgttggctcacccgtgagtgaaattgctttcgagaaggtggagaacgagttcgcccagctaaccctctccgaccacgaacagagagagctgtatgaggcggccagattagtccaaactgcgttccggaaatataagggacgccccctgcgggagcagcaggaagtggccgcagcggtcatccaacgctgctataggaagtataagcagtatgccctctataagaagatgacacaggctgcaattttaattcaaagcaaattcagaagctattacgaacagaagaaatttcagcaaagtcggcgcgctgcagtgcttatccagaagtactatcgctcttacaaaaagtgtggtaagaggaggcaggccaggcgaaccgctgtgatcgtgcagcagaaacttcgttcatctctgctgacaaagaaacaggaccaggccgcacggaagattatgcgtttcctgcggagatgccggcacagagtcaaggagctgaaaaaagcgaaggagctggaggacatccagcagcatcccctcgccatgtag

SEQ ID NO: 110553 - DNA, 4980 bp, Artificial Sequence
  Description of Artificial Sequence: Synthetic coding sequence
atgtggcgcgccgagggcaagtggctccctaaaactagcagaaagtcagtgtcgcagtctgtgttttgcggtacttccacttactgtgtgctcaacactgtgcctcccattgaggacgaccacggtaacagtaatagcagtcacgtaaagatcttcctgccaaaaaaactcctagagtgcctgcccaagtgctccagcctaccaaaggagcggcacagatggaacacgaatgaggagatcgcagcgtacctgatcacgttcgagaagcacgaggagtggctcacaaccagccccaagacccgtccgcagaatggctctatgatactatataacagaaagaaagttaaatatcgaaaagacggctattgttggaaaaaacggaaggacgggaagacaacacgcgaggaccacatgaagctgaaggttcagggtgtggaatgcctctatggttgctacgttcactcatcaattatacccacgttccaccgccgctgttactggctcctgcaaaatccggatatagttctggtccactacctgaatgtccctgcaatagaagattgtggaaaaccctgtggcccaattctgtgcagcatcaacacggataagaaggagtgggcgaaatggaccaaggaggaactcatcgggcaattgaagccgatgttccacgggattaagtggacttgctcaaatggcaactcctcttctggttttagcgtggagcaactggtgcaacagatactggattctcaccaaacgaagccccagccccgcacacataactgcttgtgtaccgggtctctcggagctggaggtagcgttcatcacaagtgcaattccgctaagcatcgtattatttctcctaaagtcgagccacgaaccggcggatatggttcacattctgaagtgcagcataatgatgtgtctgagggcaaacacgagcactcccattccaagggctctagtcgcgaaaaacggaacggaaaggttgcaaaaccggtactgctgcaccagagcagcactgaagtttcctccacgaatcaggttgaggtgccggatacaacacagagtagccccgtgtctatatccagcggccttaattctgacccagacatggtggattccccggtcgtgacgggcgtttctggtatggccgtcgctagcgtgatgggctctctgtcacagtcagcaacagtgttcatgagcgaagtgaccaacgaggctgtgtataccatgagccccactgctggaccaaatcaccacctcctgagcccagacgcttctcagggcctggtcttagctgtgagtagtgacggtcacaaatttgcctttcccactacgggatcgagcgaatcgctttctatgctgcccacaaatgtatccgaggaacttgtcctctctaccacactggacggtggtcgcaaaatccctgaaacgacaatgaatttcgaccccgactgtttcctcaacaatcctaaacagggccaaacatatggaggcggcggtctgaaggcagagatggtgtctagcaatattcgtcactcgccaccaggagagaggtcttttagcttcactacagtcctgactaaagaaattaagacagaggacacaagctttgagcagcagatggcgaaggaagcatattctagtagtgctgctgccgttgccgcaagttccctgaccctgaccgcaggtagctcattgcttccaagcggcgggggcctgtcaccatcaacaacactggagcagatggacttctcggccatcgattctaataaagattatacatcctctttctcccagacaggacattctccccacatccaccagaccccctcaccctcattcttcctgcaggacgcatctaagccacttcccgtggagcagaacacacattcctccttgtccgactcggggggcactttcgtgatgcctacggtgaagacagaggcctcctcacagacaagctcatgctccggacatgtggaaacccgcatcgagagcaccagtagtctgcacctgatgcaatttcaagccaacttccaggcgatgaccgccgagggcgaggtgacgatggagactagtcaggcggcagaaggaagcgaggtgctgctgaaatcaggcgaattacaggcatgctctagcgagcactaccttcagcccgagacgaatggggtgatacgttccgccggcggggtcccaatccttccaggtaacgttgtgcagggcctgtatcccgtggcgcagccatctctgggcaatgccagtaacatggaactctcactggatcatttcgacataagtttctcaaaccaattttctgatttgattaacgacttcatctctgtggagggtggatcctctaccatctacggacatcagctagtgtcgggcgattccaccgcactctcccagtccgaggacggggcacgagccccctttacacaggccgaaatgtgcttgccgtgttgctcaccccaacaaggaagcctgcagctaagttccagcgaaggcggtgcctcaaccatggcatacatgcacgtggccgaggtagtaagcgcggcttccgcccagggcacactgggaatgctgcagcagagcgggagggtcttcatggttaccgattactcccctgaatggtcttatcctgaaggcggggtgaaagtcctcatcactggaccttggcaggaagcttccaacaactactcgtgcctattcgatcagattagtgtgcccgcctcactcattcagcccggcgtactgcggtgctattgccccgcccatgataccggactggtaaccctgcaggtcgccttcaacaaccagatcatatccaactcggtcgtgttcgagtacaaggcgagggcactacctactctgccatcttctcagcacgactggctgagtctggacgacaatcaattccgcatgagtattctcgagagacttgagcaaatggagagaagaatggctgagatgaccgggtcccagcagcacaagcaggccagcgggggtggctccagcggcggaggcagcggcagtggcaatggaggcagccaggcccagtgcgcttctggaactggggccctcggaagctgcttcgaaagccgggtggtcgtcgtctgcgagaagatgatgagccgtgcttgctgggcaaaatctaaacacctgatccatagtaagacatttagggggatgaccctcctgcacttagcagccgcccaggggtacgctaccctgattcaaacattgataaagtggcggaccaagcacgcagatagcatcgacctagagctcgaggtcgacccactcaacgtcgatcacttctcatgtaccccactgatgtgggcctgtgctctgggccacctcgaagccgcggtcgtgctctataaatgggaccggcgagcgatttcaatcccagactcactgggcagactgcctctaggaatcgccagatcacgaggccatgtgaagctagcagaatgcctggagcacctccaacgcgacgagcaggcccagctgggacagaaccctagaatccattgtcctgccagtgaagagccgagcaccgaaagttggatggcacagtggcactctgaggccatctcaagtccggagattcctaaaggagtgactgtcatagcgtctaccaatcctgagcttaggcggccccgtagtgaaccttccaactattattcatccgaatcccataaggattaccccgccccgaaaaagcacaaattaaatcccgagtatttccaaacaagacaggaaaaactcctgcctactgcgctctcgctagaggaacctaacatacgtaagcagtctcccagtagtaagcaaagcgtccccgagaccctgtcccctagcgaaggggtacgggatttttctagagagctaagcccacctactcctgaaacggcagcgtttcaagctagcgggtcacagcctgtgggaaaatggaattcaaaagacttgtacatcggcgtctccactgtgcaagtgaccggcaaccctaaaggcacatccgttgggaaggaagcagccccttcacaggtcagacctcgggaacccatgagtgtactaatgatggccaatcgggaggtagttaatacagaactgggatcatatagggactctgccgagaatgaggagtgcgggcagccgatggacgatatacaggtgaacatgatgactctggcagagcacataatcgaagcgaccccagacaggatcaaacaagaaaactttgtgccgatggaatccagcggtctcgagaggaccgatcctgccacaatcagctctactatgagttggctggcctcttacctggcagatgcagattgcctcccaagcgccgcccagattcgcctgtcacctgtgggatcccctgtgtcagaaatagcctttgagaaacctaacctgccttcggccgcagattggtcagaattcctctcggcctctacatctgagaaagtcgagaacgaattcgcacagctaactctatccgatcacgagcagagggaactctatgaggccgcccggctggtgcaaaccgcattccgcaaatacaaggggcgtcctctgagagaacagcaggaggtagcagctgcagtgatccaacggtgttaccggaagtataagcaatacgctctgtataaaaagatgacccaagccgctatcctgattcagtcaaagtttcggagttactatgaacagaagaaatttcagcaatcccgaagagcggccgtgcttatacagaaatactacagaagctacaagaagtgcggcaagagacgacaagctagacgcacagccgtaattgtgcagcagaagctgcgctcatctttgttgacgaaaaaacaagatcaggccgctaggaaaatcatgcgctttctccggcgctgcagacacagggttaaagagctgaagaaggccaaagagctggaggatattcagcagcatccactggccatgtag

SEQ ID NO: 110554 - DNA, 243 bp, Artificial Sequence
  Description of Artificial Sequence: Synthetic coding sequence
atgtggagagctgaagggaagtggttacccaagaccagtcgtaaatcggtgagtcagtctgtgttttgcggaacatctacctattgtgttttgaataccgttcctcctatcgaagacgatcacggcaacagtaactccagccatgtgaaaatattcctgcctaaaaaacttcttgaatgcctgcccaaatgcagcagtctgcccaaagagaggcatcgttggaacaccaacgagcggtcatag

SEQ ID NO: 110555 - DNA, 306 bp, Artificial Sequence
  Description of Artificial Sequence: Synthetic coding sequence
atgtggcgtgccgagggaaagtggctacccaagaccagccgtaagagtgtctctcagtccgtattttgcggcacatcgacatattgcgttttgaacaccgtgcctcctatcgaggacgaccacggaaattccaactcaagtcatgtaaagatcttccttccaaaaaaactgctggagtgtcttccaaagtgcagctctctcccaaaggaacgacataggtggaatactaacgaggccctaacaacgcacctgtttatgggagcagcgaagaagagagatccccagagttggagtcacgaaggatag

SEQ ID NO: 110556 - DNA, 3609 bp, Artificial Sequence
  Description of Artificial Sequence: Synthetic coding sequence
atgaacactaaggatacaaccgaagttgctgagaatagccatcatctgaagatcttcctgcccaagaagctcctggagtgcctccctcgctgtcctctgcttccaccggaacgacttcgctggaatacaaatgaggaaatcgcctcatatctgatcacttttgagaagcacgacgaatggctgtcctgcgctccaaagactaggccgcagaatggatccatcattctctataaccgaaagaaggtgaagtaccggaaggacggatacctgtggaagaaaaggaaggacgggaaaacgacaagggaagaccatatgaaacttaaagtgcaggggatggaatgcctgtatggctgttatgtgcattcctctatcgttcccacatttcatcggagatgttactggttgcttcagaatccagatatcgtgctcgtccattaccttaatgtccccgccttagaagattgtggtaagggctgctcaccaatcttctgcagtattagttctgacaggagagaatggctgaagtggtcacgggaggagcttttaggacagctgaaacccatgttccacggcattaaatggagctgcgggaatgggacagaagagttctctgtggagcacctagttcaacagattttggacactcatcccactaagcccgctcctagaactcatgcatgcctttgcagtggaggactgggctcaggatctcttactcacaaatgctctagcactaaacacaggatcatctcccccaaggtcgaacctcgtgctttaaccttaacttccattccacacgcgcaccccccagagccccctccccttatcgcacctctgccacccgagctgcccaaagcccatacgtcaccgtcttcttcatcgagctccagctctagcgggtttgcagaacccctcgaaatccgaccaagcccccccacctctcgcgggggaagcagtagggggggaactgccattcttctgctgaccggccttgaacagcgcgctggagggctcactccaacccgccacctggcacctcaagcagacccgagacccagtatgtccctggcggttgtagtgggcaccgagccctccgctccccccgccccacctagtcctgctttcgatccggaccgatttctgaacagcccccagagaggacaaacttacggaggcggccagggcgtctctcccgatttccctgaggctgaggctgcccataccccctgttctgcacttgagccggctgcagccctggagccgcaagccgcggcccgcggccctccacctcagtctgtagcaggcggtcgcagaggtaactgcttttttatacaggacgatgattccggcgaggagttaaagggccacggcgctgcaccccccataccatccccaccaccaagcccaccaccatcccccgcccccctggaacctagctcaagagtagggaggggggaggctttgttcggcggccccgtaggtgccagcgagctggaaccatttagcctaagctctttcccagacctgatgggcgaactgatatcagacgaagctccatcaataccagctccgactccccaactgtctccagcattgagcaccataaccgattttagtcccgagtggtcttacccggagggcggagtgaaggtgctgataaccggcccgtggaccgaggcagccgagcactacagctgcgttttcgaccacattgcggtgcccgcctccctggtccaacccggggttttgcgttgttattgcccggcacatgaagtcgggctggtgagcctgcaggtcgccggcagggaaggtccgctgagcgcctccgtgttatttgagtatcgtgcccgcagattcctatccctgcccagtactcaactggattggctgtcattagacgataatcagtttcggatgagtatcctggagcggctcgagcagatggaaaagcgtatggccgaaatcgccgctgcaggccaggttccatgccaggggcctgatgccccccctgtccaggatgaagggcaaggccctggcttcgaggctagggtggttgtgctcgtggagagcatgatcccacgctctacgtggaagggccctgagcgcctcgcccacggcagtccgttcaggggaatgtctctcctgcatctcgcagcagcccagggctatgcccgcctgattgaaacattaagtcagtggagaagtgtggagactggctcactggatctagaacaggaagtggaccctctgaatgttgaccatttctcgtgcactccgctgatgtgggcatgtgccctgggccatttagaagccgccgttctcctattccgatggaaccggcaagcactcagcatccccgatagcttggggcgactgcccctcagtgtcgcccactcgagaggacacgtaaggcttgctcggtgcctggaagagctacagagacaggagccaagcgtggaaccgcctttcgcactgtcccccccaagtagttcgcccgacaccggtctgtcatccgtttctagtccatcagaactatcagacggtacgttctctgtcacttccgcttacagcagcgccccagatggttctccccccccagccccattaccggccagtgagatgacaatggaagacatggcccccggccagctgtctagtggggtgcctgaagctccgctgctactgatggattatgaagccaccaacagtaagggacctttatcatctctcccagcactcccccctgccagtgacgatggcgcggccccagaagacgcggacagtccacaggcagtggacgtcatccctgttgacatgatctcactcgccaagcagattatcgaggctacccctgagagaattaagcgggaagattttgtgggtctgccagaggcaggggcatctatgagagagcgcaccggggccgtaggactgtcagagacaatgagctggctcgctagctatttggagaacgttgaccacttccctagcagcactcccccgtctgaattgccattcgaaagagggaggcttgcggttccttcagcaccttcctgggctgagtttctgagtgcgtccacgagcggaaaaatggaatccgacttcgccctgctgacgctgtccgaccacgaacagagagagctgtatgaagccgcccgggtgattcagacggcattccgcaaatataaaggaagaagactgaaggagcagcaggaggttgcggctgctgtgatccaacgatgctacagaaaatataagcaattgacttggattgcattaaagtttgctctgtacaaaaagatgacacaggcagccatcctgattcagagcaaatttcgctcgtactacgaacagaagagatttcagcagagccggagggcggcagtactcatccaacagcattatcggagctaccgccgtaggcccggacccccccatcggaccagcgcaaccctgccagctcgcaacaagggctctttcctaacaaaaaagcaggaccaggcggcgcggaaaattatgaggttcctgcgaaggtgtagacaccggatgagggaacttaaacagaaccaggagttggagggtctgcctcagcctggactggcaacttag

SEQ ID NO: 110557 - DNA, 3588 bp, Artificial Sequence
  Description of Artificial Sequence: Synthetic coding sequence
atgaacacaaaggatactacagaagtagctgagaattcacatcatctgaaaatcttcctgccgaagaaattactggagtgcctcccccgttgtcctctgcttccgccggaaagattgcgctggaatacaaacgaggagatcgccagttacctaataacgttcgaaaaacatgacgaatggctgtcatgtgcccctaaaacaaggccccagaacggcagtatcattttatacaatcgaaaaaaagtcaagtatcgtaaggacggatacttatggaagaaaaggaaggacggtaaaaccactcgcgaagaccatatgaagctgaaggtgcaggggatggagtgtttgtatgggtgttacgttcattcatctatcgtccccacttttcacagaaggtgttactggctcctgcaaaaccccgatatagtgctagttcactaccttaacgtgcccgcacttgaggattgcgggaagggatgttctcccattttctgctctatttcctcagatcgccgggaatggctcaagtggagccgcgaggagcttctcggtcagctgaaacccatgttccacggcatcaagtggtcatgtgggaacggaaccgaggagttttccgtcgagcacctcgtccagcagattctagacacccaccctacaaaaccagcgccccgaactcacgcgtgcctgtgttccggcgggctgggcagcggttcattgacccataaatgttcttctaccaagcatcggattatcagccctaaggtggagcccagggctctgactttgacttccattccccatgcccaccctccagaaccacctcctctcatcgctcctcttccccccgagttgccaaaggcccacacctcaccgtcctcctcctcctcttcgagttctagcggctttgcggagccattggagattcgaccgtcacctcctacatccagaggtggctctagtagggggggtacagctatactgcttctaacaggcctggagcagcgagctggggggctgacccctacacgacacctggctccgcaggcagatcctcggccatcaatgtctttagccgtggtcgtgggcactgaacccagtgcaccccctgcacctcctagcccagccttcgatcctgatagatttctgaactctccccagcggggccaaacctacggcggcgggcaaggggtgagccctgacttccccgaagcagaagccgcccacacaccgtgcagtgcactggagccagccgccgctctggaaccccaggctgccgcccgaggaccgcccccacagtccgtggcgggaggccggagaggtaactgttttttcatccaggatgatgatagcggtgaggagctgaaagggcatggagcagccccccctatccccagtccaccaccatcacctcctccttccccggctcccctcgaaccaagctctcgggttggccgcggcgaggctctgtttggcggtccggtcggagcaagtgagttggagccgttctctctctcttccttcccagacctgatgggggagctcatatccgatgaggcacccagcataccggcccctaccccgcagctgagtccagcactttctaccatcaccgatttctccccagagtggagttatcccgagggcggcgttaaagttctgatcaccggtccatggaccgaggccgccgaacactattcctgcgtctttgatcatatagcagtaccagccagcctggtgcagcccggcgtgctgagatgttactgccccgcgcatgaggttggtctggttagcttgcaggtagctgggagggaagggccactgtctgcatctgtgctgtttgaataccgggctcgcaggtttctaagcctgccctccactcagctcgactggctctctctggatgataaccagtttaggatgtcaatcttagagcgcctcgagcaaatggagaagagaatggcagagatagctgccgcgggccaggtgccatgccagggtcctgatgcccccccagtgcaagatgaagggcagggcccagggttcgaagccagagtcgtggtgctcgtcgaatcgatgatcccaaggagcacatggaagggcccagaacgtctcgcccacggttcgcctttcagagggatgagtcttctgcacctggccgccgcacagggatacgcacgactcatcgaaacattatcacaatggcgctcagtggagactggcagtttagatcttgaacaagaggttgaccccctgaatgtcgatcatttctcgtgcaccccattaatgtgggcatgtgctcttggccatcttgaagctgccgtgctgctgtttaggtggaaccgacaggccctctcaatccctgattcactgggacggcttcccctgtctgttgcccatagccgaggccacgttcggctggcccgatgcctcgaagagctgcagagacaggaacctagtgtagagccaccattcgcactgtcacctccaagctcctcccctgacaccggcctgagttccgtctcctcaccttcagagctttcagacggcacctttagcgtgacaagtgcttatagctccgcacccgacggatctccgccccccgcccctcttccagccagtgaaatgaccatggaagacatggcccctggccagttgtcaagcggcgtacctgaagcaccattgttgctgatggactatgaggccacaaatagcaaaggcccgctgtcctccctccccgctttgccccctgcttctgatgacggcgccgccccagaggatgctgattctccacaagcggtggatgtgatccccgtcgacatgatatccctggctaaacagataatcgaagccactcccgaacggattaaaagagaggatttcgttggacttcctgaggctggagcttccatgagagaacgaaccggcgccgtggggctttcagagaccatgtcatggttagcctcctatttagaaaatgtggaccacttcccttccagcacgcccccttcggaactcccattcgagcgagggagacttgccgttccaagcgcccctagctgggccgagtttctgagcgctagcacttcgggcaagatggaaagtgactttgccctattgaccctgtctgaccacgagcagagagaactgtatgaggccgctagggtaatccagactgcctttcggaaatacaagggccggcggcttaaggaacagcaggaagtagccgcagccgtgatacagagatgttacagaaaatacaagcagtttgcgctatataaaaagatgacccaggccgcaatcctgatccagtcaaaattccgtagctactacgagcagaagcggtttcagcagtccaggcgcgctgccgtcctgatccagcagcactatcggtcttatcgcagacggcctgggccaccccaccgaactagcgccacactgcccgctcgtaacaagggtagtttcctgacaaaaaagcaggatcaagctgcacgaaaaattatgcgcttccttcgcagatgtaggcacagaatgcgggagttgaagcagaaccaagagctggaaggactaccgcagcctggcctggctacgtag

SEQ ID NO: 110558 - DNA, 3606 bp, Artificial Sequence
  Description of Artificial Sequence: Synthetic coding sequence
atgggcacagactccccctcaccgcgtccactgcgccctggtgttacactgccacctggagccttgacgatgaacaccaaggacaccacagaagtcgcagaaaatagccaccacctgaaaattttcctgccaaagaaacttctcgagtgcttacctagatgccccctgcttccacctgagcgcctcagatggaacaccaatgaggaaattgcctcttatctaattacattcgaaaagcacgacgagtggctgagctgtgctccaaaaactagaccacagaacgggagcattattctctataatcggaagaaggtgaagtaccggaaagatgggtatctctggaaaaagaggaaggatgggaagaccacccgggaagaccatatgaagctcaaggtgcagggtatggagaacccagacatcgtcctcgtccattacctgaatgttccagctttggaggactgcggtaaaggatgctctccaattttttgcagcatctcatctgacaggcgcgagtggctgaagtggtccagagaggagctcttgggccagttgaagcccatgttccatgggatcaagtggtcctgtgggaacggcaccgaagagttctcggtagaacacctggtgcagcagattttggacacccatcctacgaaaccagcacctcggactcacgcatgcctgtgtagtggcggcctaggcagtggatctttaacccacaagtgttccagtacaaaacatcggatcatctcccccaaggtcgaaccacgggcgctcacattgacatcaatcccccacgctcacccacccgagccacccccattgatcgcccctttaccaccagagctccccaaagcccacacctcgcccagtagttcgagctcttcatcatcctctgggtttgctgagcctcttgaaattcggcccagtccccccactagccgcgggggatctagtcgtggtggtaccgctatcctgctgttaacggggcttgagcaaagggccggcggactgactcccacccggcatctggcaccacaagccgaccccagaccttccatgtcactggctgtggtcgtgggaactgaaccttctgctccgcccgcccccccctcacccgcctttgaccccgacaggtttcttaattcgccgcagcgagggcagacctacggagggggccagggcgtgagtcctgatttccccgaagccgaagctgcgcatactccctgtagcgcccttgagccggcggccgccttggagccccaggcagctgctcgcgggccccccccacagagtgttgcaggcggtaggagaggcaactgcttttttatccaggacgatgacagtggagaggagctgaaaggccatggcgccgccccccctattccgtcccccccaccatcacctcctcctagcccagccccactagaacccagcagcagagtaggccgcggggaggcgctgttcgggggtcctgtcggcgcttctgaacttgaaccgttcagcttgagtagtttcccggatctcatgggagaattgatcagcgacgaggctccttctatcccagcaccaacgcctcagctgagtccagccctgtctaccattaccgatttcagccctgagtggtcctatccagaaggaggcgtcaaggttctgatcaccggtccatggaccgaggcagctgagcactactcctgtgtgtttgaccatattgcagtgccagcgtccctcgtccagcctggtgtgcttaggtgttactgtccagcacacgaagtgggactggttagtctgcaggtagctggcagagagggcccgctcagtgcttccgtgttgttcgaataccgagcacggcggttcctgtctctgccaagtacccaacttgactggctgtcactcgacgacaatcaatttcgaatgtcaatcctggaacgccttgagcagatggaaaaacggatggccgagatcgccgctgccggacaggtgccctgccagggtcctgatgccccgccagtccaggatgaggggcaggggccaggattcgaggctagagtcgtcgtgctcgtggaatctatgatacctcgcagcacatggaaaggccctgagaggcttgcccatggaagtccattcagggggatgagcctgctacacctggctgcagcccagggctacgcaagactcatcgagacgctctctcagtggagaagcgtggagaccggcagcttagatcttgaacaggaggtggaccccctgaacgtcgatcatttttcatgtacccccctgatgtgggcatgcgctctggggcatcttgaggctgccgtgcttctttttcgatggaacagacaagcactgtccattcctgactcacttgggaggctgccattgagcgtcgcgcactcccggggacatgtccgattagcccgctgcctggaggagctgcaaagacaggaaccttcagtagagccacccttcgccttaagcccgccatcttcttccccagacaccggcttgtccagcgtgagcagcccctcagagctctctgacggtactttctcagtgacgtcagcgtacagctccgcccctgacggaagtccacctcccgccccattacctgctagtgaaatgactatggaggatatggctccagggcagctctcatctggcgtgcctgaagcaccactgttgttaatggattatgaagctacaaattcgaaaggacccctatccagcttgcccgccctgccgccagcatctgacgatggagctgctccagaagacgctgacagccctcaagccgtggacgtcatccccgtggatatgatcagcctcgccaagcagatcatcgaagctacaccagagcgcatcaaacgcgaagattttgtgggtcttcccgaggccggggcatcaatgagggagcggacaggagcagtcggtttaagcgaaacaatgtcttggttggcatcctatcttgaaaacgtagatcatttcccatcctcaacacctcctagcgaattaccctttgaacgcggaagactcgcagtaccatcagctcccagttgggctgaatttttgagcgcttctacctcgggcaaaatggagtcggactttgctctgctgactctgtcagatcacgaacagagggaactgtatgaagcagcacgggtgatccagacggccttccggaaatataagggtagaagactgaaagaacagcaggaagtggcggctgccgtgattcagcgctgctaccggaaatataagcagctgacctggatagctcttaagttcgccttgtacaagaaaatgacgcaagccgcaatcttgattcaatctaaattcagaagctattatgaacagaaaaggtttcagcagtcccgccgtgcagcagttctgatacagcagcattaccggtcctaccgcagacgacccggtcccccgcaccgtacctccgctaccctccccgccagaaataaaggttcattcttaaccaagaagcaggatcaggctgcccggaaaatcatgagattcctgcgccgatgtagacaccgcatgagagaactcaaacagaaccaagagctggagggcctcccccaacctggattggcaacttag

SEQ ID NO: 110559 - DNA, 3594 bp, Artificial Sequence
  Description of Artificial Sequence: Synthetic coding sequence
atggcagcagccgctgtcacacgcggcacccccggggaaaactcccaccatttgaaaatctttttgccaaaaaagttgcttgaatgcctccctcgctgccctttgctgccccccgagcggctgaggtggaataccaacgaggaaatagcctcctatttaatcaccttcgagaagcacgatgaatggttgagctgcgctcctaagaccaggccccagaatggctcaattatcctgtacaaccgtaaaaaggtcaagtaccgtaaggatggatacctctggaaaaagaggaaggacgggaagaccacccgtgaggaccacatgaagctgaaagtgcagggaatggagtgcctctacggctgctacgtgcattcctctattgtgccaacctttcaccgtaggtgctactggttgttacagaacccagacatagtgctggtacattacctgaatgtgcctgccctggaggactgcggaaagggctgttcacccattttttgtagcatttccagtgatagaagagaatggctgaagtggtctcgagaagaacttttaggtcaactgaagcccatgtttcatggcattaaatggtcatgtggaaatggcaccgaagaatttagtgtggagcatttggtgcagcaaattctggatacccaccccaccaaacccgcccccagaacacacgcctgcctgtgcagcggcggtctgggatccggcagcctgacacacaagtgttcctcgaccaaacaccgaatcataagccctaaggtcgaaccgagggcattgactctgacctctatcccacatgcgcatcctcccgaaccaccgcctttgatcgccccactgcctcctgaactgccaaaagcacacacatcccccagctcctcatcctcatcgtcttcctcaggattcgcagagccactggagattaggccttcaccccctactagtagggggggtagcagcagaggcgggaccgccatcctgctcctgaccggactggaacaacgggccgggggactaacgccaactcgccatctcgccccccaggccgacccccgccctagtatgagccttgccgtagtggttgggactgagccatccgctccccccgccccacccagtcccgcatttgacccagatcggtttcttaattccccccagcgcggtcagacctacggagggggacagggcgtttcacctgattttcccgaggctgaggccgcccatactccttgctccgctctagaaccagcggcggccctagaaccacaggcagctgctcgcggtccacccccccagtctgtcgccggaggccggaggggaaattgtttcttcattcaggacgacgactccggtgaggagctgaagggacacggggctgctcccccaatccctagccccccaccaagtccccctccctccccagcaccactagagcctagttcgagagtcggacgaggcgaagctcttttcggaggaccggtgggagctagtgaacttgagcctttctccctcagctcctttcctgatctgatgggggagctcatttctgatgaggccccctcgatcccagcccccacccctcagcttagtccggctctgtcaacaatcaccgatttttctcctgaatggtcctatcctgagggcggagtcaaggtgctgatcacagggccttggaccgaggcagctgagcactatagctgtgtctttgaccacatcgctgtccccgcctctctagtccagccaggggtcttgagatgctactgtcccgcccatgaggtgggcctggtctccctccaggtcgccggccgagaaggccctctgtctgcctccgtcctgtttgaatatcgtgctagacgatttttgagcttaccatcaacacagctcgattggctctccttggatgacaatcagtttcgcatgagcattttggaacggttagaacagatggagaaacgcatggctgaaatcgcagcagctgggcaggtgccatgccagggaccagacgcccctcctgtgcaggacgaaggacagggacctggtttcgaggcgcgcgtagttgtacttgtagagtctatgattcccaggtcaacatggaagggtccagaaaggcttgcccacggcagcccgttcagaggcatgtcactgttgcacctggccgccgcgcaggggtacgcccgcctcatcgagacgctgagccagtggcggtctgttgagaccggcagcctcgatctggagcaggaggttgatccactgaatgtcgaccacttctcttgtacacccttgatgtgggcatgtgcactcggccatttggaggcggctgttctcctcttccgatggaatcgccaggcgctttcaatccctgacagcctcggccgcctgcctctgtctgtcgcgcattcacggggacatgtgcgactggctagatgcctcgaggagctccagaggcaggaaccttctgtggagcccccgttcgccctttcccctccaagctctagccctgataccggactctctagcgtgtcttccccctccgaactgagtgatggcaccttctcggtgacttcagcttactccagcgctcccgacggcagcccacctcctgcaccactgcctgcctcagaaatgacaatggaggatatggccccaggccagctcagcagtggcgtgccagaggcacctttgctgctgatggactacgaggcgaccaacagtaagggcccactgagtagcctccccgctttgccgcccgccagcgatgatggagctgctcctgaggacgccgactccccccaagcagtagacgtgatcccagtcgacatgatcagtcttgcaaaacaaatcatcgaggcaacacccgagcggattaagcgggaagatttcgtcggtctcccggaggctggagcatcaatgcgcgagaggactggggctgtcggattgtctgagaccatgagttggctggcctcctacctcgagaatgtcgatcattttccttcttctacccctccatccgaactgccttttgaacgtggccgcctcgctgtcccctcagcaccttcctgggcggagttcttgtccgcttccaccagcggaaaaatggagtcagactttgcactcctaaccctttcagatcacgaacagcgtgagctctacgaagctgcccgggtcatccaaaccgcattcagaaaatataaaggtcgcagactcaaagagcagcaagaggttgctgccgcagtgatccaacgctgctaccgaaagtacaagcaattcgccttgtataagaaaatgacgcaagcggcaatcttgatccagagcaaatttagatcctactatgagcagaaacgattccagcagtccaggcgagcagccgtgttaatccaacagcattaccggtcataccgaaggagaccgggcccccctcatcgaacctccgctaccctgccggctcgaaataagggaagttttctgaccaaaaaacaggatcaagccgcacgaaaaatcatgcgattcctccgcagatgcagacatcgcatgcgagaactcaagcagaatcaggagctggagggactcccacagcccggcctggctacctag

SEQ ID NO: 110560 - DNA, 3726 bp, Artificial Sequence
  Description of Artificial Sequence: Synthetic coding sequence
atggggaccgactccccctcacccagaccactaagaccgggagtcaccctacctccaggcgccctcacgatgaacacaaaagatacgaccgaggtggcggagaattcccaccatttgaagattttcttgccaaaaaagttactagagtgccttccccgctgtccccttcttccgccagagcgcctccggtggaacactaacgaagagatcgcctcctatttgatcacatttgagaaacatgatgagtggctgtcatgtgctcctaaaacacgcccgcagaacggcagcataatcctgtataaccgcaagaaggtcaaataccggaaggatgggtacctttggaagaaacgaaaggatggcaagacaactagagaggaccatatgaaattgaaagtgcagggtatggagtgtttgtacgggtgctacgtgcactcttccatcgttcctacatttcaccgccggtgctactggctgctgcagaacccagacatcgtcctggtacattacctgaacgtgcctgcactggaagattgtggtaagggatgctcgcctatcttctgctcgattagctcagaccggagagagtggcttaaatggagtagagaggagctattaggccagcttaagccaatgttccacggaatcaagtggtcttgtggcaacggtaccgaagagtttagtgtagagcatttggtacaacagatcctcgatactcaccccaccaagcctgcccctagaacacacgcttgcctctgctccggtggcttgggctcaggcagcctcacacacaaatgcagcagtacaaaacataggatcatatcaccaaaagttgaacccagagccctgacacttacctccattccacacgctcatccacctgagccccctccactaattgcaccactgcctcccgagttgcctaaggcacatacaagcccatcttcaagttcttcttccagctctagtggatttgcagaaccactcgaaatccgccctagtcctcccacgtcacggggtgggtcttcgcgaggcggaacagctatcctccttctgacaggcctggaacaacgggccggcggccttactcctactcgccatctcgccccacaggcagaccctaggccaagcatgagtttggctgtggtggtgggaaccgagcccagcgccccacctgccccgccctcacctgctttcgaccctgaccgatttcttaattcccctcaacgcgggcaaacgtacggcggtggccagggggtgtcccctgactttccagaagctgaagccgcccatacaccttgtagcgctctcgagccagccgcggctttggaaccccaagccgccgcccggggaccccccccacagtcagtggccggagggaggcgcggaaattgtttctttatccaggacgatgactcaggggaggaactgaaaggccatggtgcggcgcctcctatccctagcccaccaccgtctccacctcccagcccggcccccctggagccgagcagccgggtcggccggggggaggcactctttggggggcccgtgggtgccagcgaattagagccattttctttgagtagcttccccgatttgatgggcgagctaatttccgatgaggcaccgtccattcccgctccgactccacagctctctcccgctctgagcactattaccgatttctcgccagaatggtcatacccagagggcggcgtaaaggtgctgatcacaggaccctggacggaggccgctgagcactatagttgtgtatttgatcatattgctgttcccgcgtcacttgtccagcctggcgtgctgcggtgttattgcccagctcacgaggtcggcctggttagtctgcaggtcgccgggagagagggtccactgtcagcatccgtcctgttcgaatacagggcacgaaggttcttaagcttgccatcgacccagcttgattggctgagcctggacgataatcagttccgcatgagcatactagagagattagagcagatggaaaagaggatggctgaaatcgccgccgctggccaggtaccctgccaaggacccgacgctcccccagtccaggatgagggccaaggacccgggttcgaggcaagggtggttgtcctggtcgagagtatgattccaaggagcacctggaaaggaccagagagattggcacacgggtcacctttccggggcatgagcctgttgcacttggccgctgcccaaggctatgctagactgatcgagaccttgagccaatggagaagtgtggagacagggtccctagacctggagcaggaggttgatcctctcaacgtggatcacttttcatgcacacctcttatgtgggcttgcgcactgggccacctggaggctgccgtcctcctcttccgctggaatcggcaggccctttcaatccccgattcgctggggagactgcctctgagcgtggcacactccagagggcacgtgagattagccaggtgtctcgaggaacttcaaagacaggagccttcggtggaaccccccttcgcattgtcgcctccctcttcgagccctgatacaggactgagtagcgtctcgtccccatctgagctctccgatggcaccttttctgtgacctcggcttactcatccgcccctgacgggagcccacccccagctcctctccctgctagcgagatgaccatggaggatatggcacctggtcagctgagtagcggggtccccgaagccccactgctgctcatggattacgaagcaactaatagcaaagggcccctctcctctctgcctgccctgcctcctgcaagcgacgatggcgccgctcccgaggacgcagattccccccaggcggttgacgtaatccctgtggacatgatcagcctcgcaaaacaaattatcgaggccacccccgagcgcatcaaacgggaggatttcgtggggctgcccgaggccggcgcttccatgcgtgagcgcaccggcgcagtggggctctccgaaacaatgtcatggctggcgagctaccttgagaacgtggaccatttcccaagcagtactcctccctcagagctaccattcgagcgcggcagactggcagtgcctagcgccccaagctgggccgaatttctgagtgcaagcacctcaggaaaaatggagtctgacttcgcattgttgacactttcagatcacgagcagagggaactgtacgaggcggctagagtgatccagacagcatttagaaaatacaaaggccgccgcctgaaggaacagcaagaggtggcagccgcagtaatccagaggtgctatcgaaagtataagcaactgacctggattgcgctcaagtttgccctgtataaaaagatgacccaggcagccattcttatccagtctaaattcaggagttattacgagcagaaacgttttcagcagtccagaagagcggcagtgctaatccaacaacactaccgtagctacagacggaggcccggcccccctcatagaaccagtgcgaccctacccgcccggaacaagctgttgagccaccaagaagctggtcctgggtcccccgaggatcacgagattccagcagcccttcccacacaggacgaggggaccgaagccgagccaggcgctggtcgggctagtcccgcgggcacagggcatatgacctggcccccacccttcagccccccctggggaagacttgtgcagtcctag

SEQ ID NO: 110561 - DNA, 4470 bp, Artificial Sequence
  Description of Artificial Sequence: Synthetic coding sequence
atgggagacgctgccgatcctcgcgaaatgcggaagactttcattgtccccgccatcaaaccgttcgaccactacgacttcagccgggcaaagatcgcctgcaatctggcctggcttgtggcaaaagctttcgggacagagaatgttccagaagagctccaggagcctttctatacagaccaatacgaccaagagcacattaaacctcccgtggtgaacttactactctccgccgagttatactgtcgtgctggtagcctgattctcaagagtgatgccgccaagccacttttagggcatgacgccgttatacaggcattagcccagaagggcctgtacgtgacagaccaagagaaactcgttaccgaaagagacctgcataaaaagccgattcaaatgtccgcacacctggcaatgatcgataccctgatgatggcctacactgttgagatggtgtctatagaaaaagtcattgcctgtgctcagcaatacagcgcatttttccaggctacagatctgccttacgatatcgaagacgcggttatgtattggataaacaaggttaacgagcatctgaaggatattatggagcaggagcaaaagcttaaggagcaccacactgtcgaggctccgggcggccaaaaaagcccaagcaagtggttttggaagctggtccccgcccgctacagaaaggagcagaccctgctgaaacaactgccatgtatcccgctggtggagaatctgctcaaagacgggacagacggatgcgccctggctgctctgatccacttttattgtcctgatgttgtgcggcttgaagatatctgcctcaaggaaactatgtctctcgccgactctttgtataatctgcagttaatccaggaattttgccaggaatatctcaaccaatgctgtcactttacactggaagacatgttatatgcggcctcttcaattaaatcaaactaccttgtgttcatggccgaattgttttggtggtttgaggtggtcaagccatcttttgttcaacctcgcgtggttcgccctcaaggtgccgaaccagtgaaagacatgccttcaatccccgtgttaaatgccgccaaacggaatgtcctggacagcagtagcgatttcccgtcaagcggcgaaggtgcaacctttacccagagccaccatcacttgccttcacgctactcccgcccccaagcgcattcaagtgctagtggcggtataagacgaagctcaagcatgtcctacgttgatggctttatcggcacttggcccaaggaaaagcgctcctctgtgcacggcgtgagcttcgatatcagttttgacaaggaggactctgtgcagagatcaacacctaatcgtggtattacaaggtccatttctaatgaggggctgacattgaacaattctcacgtatctaaacacatacgcaaaaacctatcctttaagcccatcaatggagaggaggaggcagagtctatcgaggaagaactaaacatcgacagccattccgatctgaaaagttgtgtccccctgaataccaatgaattgaatagtaacgagaacatacactataaattacctaacggagccttacaaaatcgcattctactcgacgaatttggcaatcagattgagacaccctccattgaagaagccctgcagataattcatgacaccgagaagtcacctcatactccgcagcccgatcagattgctaatggcttctttctccattcacaggagatgagtattctgaacagcaacataaaactgaatcagtcatcccccgacaatgtaaccgatactaagggcgctctgtcccctatcacagacaacacggaggtggacacaggaattcacgtcccgtctgaggacatccctgaaaccatggatgaggactcgtccctgcgtgactataccgtgagtctggattctgacatggatgatgcatccaaattcttgcaggactatgatattcgcactgggaacaccagagaggccctttcaccatgtccctcaacggtgagcaccaaaagccagcctggctccagcgccagctcatcctccggggtgaaaatgacctcgtttgctgaacagaagttccgaaagttaaaccacactgacggcaaatcctccggatcctcctctcagaaaaccacgccagaaggctctgaactcaacattccccacgtcgtagcttgggcacagatacccgaggaaaccgggctaccccagggccgcgacactactcaattactcgcaagcgagatggtccacctgaggatgaagctggaagagaaacgtcgggctatagaggcacaaaagaaaaaaatggaggctgcctttactaagcaaaggcagaaaatgggtaggactgcatttctgactgtagtcaaaaaaaagggcgacggaatcagtccgctgagggaggaagccgctggtgccgaggatgagaaagtttataccgaccgagcaaaggaaaaggaaagccagaagacagacggccagcggtccaaaagtttggccgatatcaaggaaagtatggaaaatccacaagctaaatggctgaagtccccgaccacaccaatagacccagaaaaacaatggaatctggcctctccatctgaagaaacgctgaacgaaggagagattttggaatatacgaaaagcatagaaaagctgaattcttccctccatttcctgcagcaggagatgcagaggttgagccttcaacaggaaatgctgatgcagatgagagaacaacagtcgtgggtcatttctcctccccaaccctctccacagaagcagatccgcgatttcaaaccatctaagcaggcaggcttatcctccgcgattgcaccgttcagttctgactctccaaggcccacacatccatcccctcagtcctccaaccggaagagcgctagcttttccgtcaaatcccagcggaccccgcgcccgaatgaactgaagataactcctctcaaccggaccctgacacctcccaggagtgtggattccttaccccggctaagaagattttcacctagccaggttccaatccagacccggtcatttgtgtgcttcggagatgacggcgaaccacaactaaaggagagtaagccaaaagaggaagtcaagaaggaggaactcgaaagcaaaggtaccctggaacagcgtggccacaacccagaggagaaagaaatcaagcctttcgagagtacggtctctgaggtcctcagtcttccggttaccgagactgtctgtctgacaccgaacgaggatcagctgaaccagcccaccgaaccaccccctaaacctgtcttcccccccactgcaccaaaaaacgtaaatctcatcgaagtgagtctctccgatttaaaaccacccgagaaggctgacgttcctgttgagaaatatgatggagagtctgataaggagcagtttgatgatgaccagaaagtttgttgcggcttttttttcaaggacgaccagaaagccgagaacgatatggccatgaaacgggctgcacttctggaaaagcgcttgaggcgggaaaaggaaactcagttaagaaagcaacagctggaagccgagatggagcacaaaaaagaagaaacaaggcgcaagacggaggaggaaaggcagaagaaagaggatgagcgcgcccggcgcgaattcatcagacaagagtatatgcgtcgcaaacagctgaagctgatggaggacatggacaccgtcatcaagcctcgtccacaagtggtgaagcagaagaagcagaggcctaagtcgatccatcgagatcacattgagtccccaaaaacgccgattaagggcccacccgtttcctcattaagcctggcgtccctgaacacaggcgacaacgaatctgtccactcaggtaagcgaaccccacgttcagagagcgtggaaggcttcctgtctcctagccgctgtgggtcccgtaatggggagaaggactgggaaaatgcgtctaccacctcctccgtcgcctcaggaactgagtatactggccctaaactgtataaggaaccctctgctaagagcaataagcatattattcaaaacgccctcgctcactgctgtctggcaggaaaagtaaatgagggccagaagaaaaaaatcttggaggagatggagaaatcggacgcaaacaactttctgattctctttcgcgattcaggctgtcagttcagaagtctgtatacttactgccccgagaccgaggaaatcaacaagctcacagggatagggcctaagagtataaccaaaaaaatgattgaaggcctctataagtataattcagatcgcaaacaattctcgcatatccctgccaagacactgtctgcatccgtggatgctatcaccatccattcccatctgtggcaaactaagagacccgtaacccccaaaaagctgttgccaaccaaagcctag

SEQ ID NO: 110562 - DNA, 4437 bp, Artificial Sequence
  Description of Artificial Sequence: Synthetic coding sequence
atgggggacgcggctgatcccagggagatgcgtaaaacctttattgtgcctgcaatcaaacctttcgaccactacgatttttcaagggccaagattgcatgtaacttagcctggttagttgcaaaagcgttcgggacagagaacgtacctgaagaattgcaggagccattttacacggaccagtacgatcaggagcacattaagcctcccgttgtcaacctgctcctgagcgccgagctgtattgccgggcaggcagtctgatcctgaagtctgacgcggctaagcctctgctgggacacgatgccgtgatccaagcgctcgcgcagaaaggcctgtacgtgactgatcaggagaagctcgttaccgagcgtgatctgcataaaaagcccattcagatgtccgcccacttagcaatgatcgatactctcatgatggcctacaccgtggagatggtctcaatcgagaaggttatcgcctgtgcccagcagtattcggcatttttccaagcgaccgatctaccgtacgatattgaagacgctgtaatgtattggattaataaggtgaacgagcacctaaaggatattatggagcaggaacagaagctcaaggaacatcacaccgtggaggctcccgggggtcagaaagctagatatcggaaggaacagaccttgctcaaacagttgccgtgcataccacttgtggagaatctgcttaaagacggtaccgacgggtgcgcccttgctgccctaatccatttctactgtccggatgtggttcggttagaggatatctgtctgaaggaaacaatgtccctcgcggacagcttgtacaatctgcagttgatacaggagttttgtcaggagtatctaaatcaatgttgtcacttcacactggaggacatgctctacgcagcaagttctataaagagtaattacttggtgttcatggccgaactgttctggtggtttgaggtagtgaaaccatcttttgttcaaccccgggtagtgaggccgcagggtgctgagccagtgaaagacatgccaagtattccagtcctgaatgctgccaagcgtaatgtcctggatagcagtagtgacttcccatcgtccggcgaaggcgccactttcacccaatcccatcaccacctgccctcacgctatagccgcccccaagctcactcttctgcgagtggcggcattcggagaagctcatcaatgagctacgttgatggctttataggaacttggccgaaagagaagaggtcttccgtacacggtgtgtcatttgatatttcatttgataaggaagacagtgtgcaaaggagcacccccaatagggggatcaccagatcaatttccaacgagggactgactctgaacaactctcacgtctccaaacacatccgaaagaatctatccttcaagcccatcaatggcgaggaggaagccgaatctattgaagaagagctgaacatagatagccactccgatcttaagtcctgcgtaccactgaataccaacgagctgaacagcaacgagaacattcattataagctgccgaatggggctcttcaaaacaggatactgctcgacgagtttggtaaccaaattgagactccatcaatagaggaggccctccagatcatccatgacaccgagaaatcaccccacactccccagcctgaccaaatagcaaatggcttcttcctgcacagccaggagatgagcatacttaactccaacatcaaacttaaccaaagtagcccagacaacgtcacagatacaaagggcgcgttgtcccctatcacagataataccgaggtagacactggtatacacgtgccttcggaggatatccctgaaaccatggatgaggactctagcttgcgcgactacaccgtgtccctcgattctgatatggacgatgcttccaagttcttgcaggactacgatatccgcactggcaacactagggaggcactgtcaccttgtccttccacagtatcaaccaagtcacagccaggctcctccgcttcatctagttcaggcgtgaaaatgacctcgttcgccgaacagaaatttcgcaagctgaaccacaccgacggtaaatcatccgggtccagctcgcagaaaactaccccggaagggtctgagctgaacattccacacgtggtggcctgggcccagatccctgaagaaacaggacttccccaaggaagggatacaacacaactgctggctagcgagatggtccatctccggatgaagctcgaggaaaagcggagggctatcgaagcccagaaaaaaaaaatggaggctgcctttaccaagcaacgccagaagatgggaagaacagccttcctgacagtggtcaagaagaaaggagatggaatctctccactccgagaggaagccgcaggcgctgaggatgaaaaagtctacaccgacagggcaaaggagaaagaatcgcagaagaccgatggccagagatcaaagagccttgccgatatcaaggagtcaatggaaaacccccaagccaaatggttgaagagccctaccacaccaatcgacccagagaagcagtggaacttagcctcgccttccgaagagacactgaacgaaggcgaaattctggagtataccaagtcgatcgaaaagttaaattctagcttacactttctgcaacaggagatgcagagattgtctttgcagcaggaaatgttgatgcaaatgcgagagcagcaatcttgggttatctctccaccccaacccagtccccagaagcagataagagactttaagccgtccaaacaagccggactgagtagtgctattgcccccttttcctccgattctcctagacccacccacccttcgccccaaagcagcaaccggaagtctgcctccttctctgtaaaatcccaacgtacaccacgaccaaatgaactgaagattactccactcaacagaacccttactccacccagaagcgttgacagtcttcctcgcctgcgtcgcttcagtcccagtcaggtcccgatccaaacccgcagcttcgtttgcttcggcgatgatggggagccacaactcaaggaatcaaaaccgaaggaggaagtgaaaaaagaggagcttgaatccaagggtacgcttgaacagcgtggacataatccggaggagaaagagataaagccattcgaaagtacggtctcagaggtgctgtctttaccggtgaccgagacagtgtgtctaacccccaatgaagaccagctgaatcagccgaccgagccgccacctaagccagtttttcctccaactgcgcccaaaaatgttaatcttattgaagtgagcctgagcgatctgaagccacccgagaaagctgacgtccccgtcgagaaatatgacggggaatcggataaggagcaattcgacgacgaccaaaaagtctgctgtggcttcttcttcaaagacgaccaaaaggccgagaatgacatggccatgaagagagcagccctcctggagaagcggctccgccgtgaaaaggagactcagctgagaaagcagcagctggaagcagagatggaacataagaaagaggagactcgccgaaagaccgaggaggaaaggcagaaaaaggaggatgaaagagcaaggagagaattcataagacaggagtacatgagacggaagcaattaaagctgatggaggacatggatacagtgatcaagccaagaccccaggtggtgaagcagaaaaagcagagacctaaatccatacatagagaccatattgagtccccgaaaacacccattaagggccctcctgtgtccagcctgtcacttgcaagtctcaatactggagataacgaatcagtacactccggaaagagaacacctcgttcggagtcagtcgaaggattcctgagtcccagtcggtgtggaagtcggaacggggagaaggactgggagaatgcatcaacgacttcatctgtcgccagtggaacggagtacaccggacctaaactgtacaaggagccttctgccaaatcgaataagcacatcattcagaatgccttggctcattgctgcttggcgggaaaagttaacgagggccagaagaagaagatcttggaggaaatggaaaagtctgatgccaataatttcctgatcttatttcgcgactcgggctgccaattccggtctctatacacctactgtcccgaaaccgaggaaatcaacaagctgaccgggatcggcccaaaatccatcacaaagaaaatgatagaaggactgtacaagtataattctgatcggaagcagttttcgcacatccccgccaagaccctcagtgccagtgtggatgccatcaccatacattctcacctttggcagacaaaacggccagtaacaccaaaaaagttacttcccacaaaagcctag

SEQ ID NO: 110563 - DNA, 4389 bp, Artificial Sequence
  Description of Artificial Sequence: Synthetic coding sequence
atgggagatgcagcagatccccgtgaaatgagaaaaacatttatcgtcccagcaatcaagccttttgatcattatgacttctcgagagccaagatagcatgcaacctggcctggctggtcgctaaggcatttggaaccgaaaacgtccctgaggaactgcaggaacccttttataccgaccagtatgaccaagagcatataaagccgccagttgtgaacttactgctgtccgccgagctatattgcagagccggatccctaatcctgaaatccgacgctgccaagccactgcttggccatgacgctgtgattcaggcgcttgcgcagaagggcctgtatgtgactgaccaggaaaaacttgtcactgagagggatcttcacaaaaaacccatccagatgagtgctcatctagccatgatcgacacactcatgatggcctacactgtggagatggtgtcaattgaaaaggtgatcgcatgcgcccagcagtacagcgcatttttccaggctacggacctcccctatgacattgaggatgctgtaatgtattggatcaataaggtgaacgagcatcttaaagacatcatggagcaagagcagaaattgaaggaacatcataccgtagaggctcccggaggccagaaggcaaggtaccgtaaagagcaaaccctgctgaaacaactgccttgcatccccctggttgaaaatctgctgaaggatgggacagatggctgtgccctggccgccctgatccatttctactgtcctgacgtagtaaggctcgaagatatctgcctaaaggaaactatgagcctcgccgactccctctacaacctgcagctgattcaagagttttgccaggaatatctgaaccagtgttgtcatttcaccctggaagatatgctttatgctgcctcctccattaaatcaaactacctggtcttcatggcagagttattttggtggtttgaggttgtgaaacctagcttcgtacaaccgagagttgttcggccacagggcgccgaacccgttaaagatatgccctctatccctgttctcaacgctgctaagagaaatgtgttggactcgtcttctgactttccctcccggtactcccggccacaggcacatagctccgcctccggcggaataagacgctcgtcttccatgtcttacgtcgacgggtttatcggtacatggccaaaggaaaagagatctagcgttcatggtgtgtctttcgacatctcctttgacaaggaagattcagtccaaagatcaacaccaaaccgaggaatcaccagatccattagcaacgaggggctaaccttgaacaactcccatgtgagcaagcacatcagaaagaacctcagcttcaagccaatcaacggcgaggaggaggccgagtctattgaagaggaactgaatattgattctcatagcgatctgaagagttgcgtgccgctgaataccaatgaattgaattcaaatgagaacattcactataaattgccaaatggtgcgttacagaatagaatcctcctagacgagttcggtaaccaaatcgaaaccccgtctattgaggaggccctgcagattatccacgacactgagaagtcaccccatactccacagccggatcagatcgccaacggctttttcttgcactcccaggaaatgtctattctcaactctaatatcaagcttaaccagagctcccccgataatgtaactgatacgaagggcgctctgagcccaatcacggacaacaccgaggtggacactggtatccatgttccctctgaagacattcctgaaacaatggatgaagactctagtttacgggattacacggtgtctctcgactcagatatggatgatgcctctaagttcttgcaggactatgacattagaacaggtaataccagagaagctttgagtccttgtcctagtaccgtgagcacaaaaagccaacccggtagctcagcttcttcttcttcaggagtcaagatgacttctttcgcagagcagaagttccggaagctcaatcatacggatggcaagagtagcgggagcagcagccagaagacaaccccagagggcagcgagctgaatattccccacgtcgtggcgtgggcgcagattccggaagagactggacttccccaagggagagacacgacccagcttctggcctccgagatggtgcacctccgaatgaaacttgaagagaaaagacgggccattgaggctcaaaaaaaaaaaatggaggctgcttttacaaagcagagacagaagatggggcggactgccttcctgacggtcgtgaaaaagaagggcgacgggatcagccctctaagagaggaggccgcaggagcagaagacgaaaaagtgtacaccgacagagccaaagagaaagagtcccaaaagacagacgggcagcgcagtaagagcctagctgacatcaaggagtccatggaaaatcctcaggccaaatggctgaagtcgcccactactcctattgatcctgaaaagcagtggaatctagcatcccccagtgaagagactctgaacgaaggcgagattcttgagtacactaaaagcattgagaagttaaatagcagtcttcatttcctgcagcaggagatgcagagattaagtttgcagcaggaaatgttaatgcagatgcgggagcagcagtcatgggtaattagtcctcctcaaccctcacctcagaagcagattagggacttcaaacccagtaagcaagccgggctgtccagtgcaatcgcaccgtttagttccgactccccacgacccacccatccttcaccccagtcatccaatcggaaatcagccagtttcagcgtgaagtcccaacgcaccccccgccccaacgagttaaaaattaccccactcaaccgcactctcactccgccaagatccgtggacagcttgcctagacttaggcggttcagcccctctcaagtgcctatccagactagatcctttgtatgctttggcgacgatggagagccccaacttaaggaatccaagccaaaagaagaagtcaaaaaggaggagctcgagtctaaaggaaccttagaacagcgcggccacaacccagaggagaaggaaataaaaccttttgaatcaacagtgagcgaggttctaagcctcccagtgaccgaaacagtgtgtttaacaccgaatgaggatcagctgaatcagcccacggaacctccaccaaagcctgtattcccacctactgcacctaaaaatgtgaatctaatcgaagttagcctctccgacctgaaacctccggagaaggctgatgttcccgtggaaaaatacgatggcgagagcgataaagaacaattcgatgacgaccagaaggtctgctgcggatttttctttaaggacgaccagaaagctgagaatgatatggccatgaaacgcgccgctttgctagagaagcggctgaggagggagaaggaaactcagttacggaagcagcagctggaagcagagatggaacacaaaaaggaggaaacaaggcgaaagacggaggaagaacgacaaaaaaaggaggacgagagagctcgacgcgaattcattcggcaggaatacatgcggcggaaacagcttaagctcatggaggacatggatactgtgataaaacctagacctcaggtcgtcaaacagaagaagcagcgacctaagagtatccaccgggatcacatcgaaagccccaaaacccctatcaaaggcccaccagtgagttcattatctctggcctcacttaataccggtgataatgagtccgtccattctggtaagaggacaccaaggtcggagtctgttgagggcttcctctctccatctcgctgtgggtcaaggaatggtgagaaggattgggagaacgcgtctacaacatcatcagtagcctccggcactgagtacacgggccccaaactttataaggagccctccgccaaatcgaataaacacatcattcagaacgccctagcccactgttgtctcgctggcaaggtcaacgaggggcagaagaagaagattctggaggagatggaaaaatcggacgccaataacttcctgattcttttccgcgactccggctgtcagttcagaagcttgtacacttactgcccagaaaccgaggagataaacaaactaacaggaattggcccaaagtcaatcacaaagaaaatgatcgagggcctgtataaatacaatagtgatcggaaacagttttcacacatccccgccaaaaccctgtccgctagtgtcgacgcgataacgatccatagccacctctggcagacaaaaaggccggtcacaccgaagaagctgctgccgaccaaggcttag

SEQ ID NO: 110564 - DNA, 450 bp, Artificial Sequence
  Description of Artificial Sequence: Synthetic coding sequence
atggctgaccagctcactgaggagcaggtcactgagtttaaagaggccttttccctttttgataaggacggcgacggatgtatcaccacacgagagctggggacagtcatgagaagtctgggacagaatccaaccgaagccgagctgagagacatgatgtccgagattgacagagatggaaacggaacagtggatttccctgagttcctgggtatgatggcgcgtaagatgaaggacaccgataatgaagaggagatcagagaggcctttcgggtctttgacaaagatggcaacggcttcgtgtccgcagccgaattgcggcacgtgatgactcgtctgggggagaagttgtccgatgaagaagtggatgagatgattcgggccgcagataccgatggcgatggtcaggtgaattatgaagaattcgtgcgtgtgctggttagcaagtag

SEQ ID NO: 110565 - DNA, 546 bp, Artificial Sequence
  Description of Artificial Sequence: Synthetic coding sequence
atgggcctccagcaggagatttctctccagccatggtgccaccaccctgcggagtcctgtcagaccactacagatatgacagaacgcctgagcgccgaacaaataaaagagtataagggcgtttttgaaatgtttgatgaggagggaaacggtgaggtcaaaaccggcgagctagagtggcttatgagtctattgggcatcaacccgaccaaaagcgagttggcatccatggcaaaggacgttgatagggacaataaaggctttttcaattgcgacggctttttggctctcatgggcgtgtatcacgagaaggcacagaatcaagaaagtgagctgcgcgccgccttccgggtattcgacaaagaagggaagggttacattgattggaacactttgaagtacgttttaatgaatgccggcgagccactgaacgaggtggaggcagagcaaatgatgaaggaggctgataaagatggagacaggacaatcgattacgaagaatttgttgcaatgatgaccggagaaagcttcaagctgattcagtag

SEQ ID NO: 110566 - DNA, 495 bp, Artificial Sequence
  Description of Artificial Sequence: Synthetic coding sequence
atggggcttcagcaagagataagtctgaccgagcggttatcagcagaacaaattaaggagtataaaggtgtttttgagatgttcgatgaagaggggaacggagaggtcaaaactggagaactggagtggctgatgtccctgctgggaattaaccccacaaaatccgaattggccagcatggctaaggacgtggatcgagacaacaaggggttttttaactgtgatggatttctggctctgatgggcgtctaccatgaaaaggctcagaaccaagagtcagaactgagggcggcctttagagttttcgataaggaggggaaaggatatattgattggaatacactcaaatacgtgctgatgaatgcaggcgagcccttaaacgaagttgaggccgaacagatgatgaaagaggcagataaagacggcgacagaactatagattatgaggaattcgtggcaatgatgacaggagagagctttaaattgatacagtag

SEQ ID NO: 110567 - DNA, 1779 bp, Artificial Sequence
  Description of Artificial Sequence: Synthetic coding sequence
atggagggtaaatggctcctatgcatgttactggtgctgggtacggccatcgttgaggctcacgacggacacgacgatgatgtgatagatattgaggacgatctggatgacgttatagaggaagtggaagattccaaaccagacactactgcacccccgagcagtcctaaagtcacttacaaggcccctgtgccgacaggcgaagtctattttgccgatagcttcgatagaggcacccttagcggttggatactgtcaaaagcgaaaaaggacgacaccgacgacgaaatcgcaaagtatgatggtaaatgggaggtggaggaaatgaaagagagtaaattgcccggtgacaaaggcctcgttctcatgagcagagctaagcaccatgctatctcggctaaactcaacaagcctttcctgttcgacacaaagccacttatcgtacaatatgaggtaaactttcaaaatggaatcgagtgcggtggcgcctatgtcaagctcctaagtaagaccccggagttgaacctggaccagttccatgataaaaccccgtacaccattatgttcggccctgataaatgtggggaggattataaattgcattttattttccgccacaaaaacccaaagacagggatttatgaggagaagcacgcgaaaagacccgacgctgatttgaagacatattttactgacaagaaaacccacctctatacactcatcttgaaccccgataattccttcgagatccttgtggaccagtccgtggtcaatagcggtaacctattgaacgacatgaccccaccagtaaacccctccagggaaattgaagacccagaggatcgaaaaccggaggattgggacgagaggcccaagatacccgatccggaagccgtcaaacccgatgattgggacgaggacgcacccgccaaaatcccagacgaggaggccaccaagccagagggctggctggacgacgagcccgagtatgtgcccgatccagacgccgagaaacctgaggactgggacgaggacatggacggggagtgggaagctcctcaaatagccaaccctcgatgcgaaagtgcaccaggatgcggagtttggcagcggccagtgatagacaatcctaactataaggggaagtggaaacctcccatgatagacaaccctagttatcaggggatttggaagcccagaaaaatacctaacccagacttttttgaagacctcgagccttttcgtatgacaccgttctccgccattgggctcgaactgtggtcaatgacatccgatattttcttcgacaatttcatcatttgtgcagaccgccgcattgtggatgattgggccaacgatggttggggactgaagaaggcggccgatggtgctgccgaaccaggtgttgtcggacaaatgatcgaagccgcggaagagcgcccctggctgtgggtggtgtatatcctgaccgtggctctgcccgtgttcttggtaattctcttctgttgctctgggaaaaagcagacatccggaatggaatataagaaaactgacgcccctcagccggatgtcaaagaggaagaggaggagaaggaggaagagaaagacaagggggatgaagaggaggagggggaggagaagttggaggagaaacaaaaaagcgacgcggaagaggacggagggactgtgtcccaggaggaagaagaccgcaagccgaaagctgaagaggatgagatcctgaataggagtccgagaaatcgaaagccaaggagggagtag

SEQ ID NO: 110568 - DNA, 852 bp, Artificial Sequence
  Description of Artificial Sequence: Synthetic coding sequence
atgctgctagttctaggaacagcaatcgtcgaagctcacgatggccacgatgacgatgtgatcgacattgaagacgaccttgacgacgtgattgaggaagttgaggattccaagccggataccaccgcaccaccaagtagtccaaaagtaacctacaaagcaccagtgccaacaggagaagtctattttgcggactcgttcgaccggggaacgctgagtggctggatcctctccaaggcaaaaaaggatgacacagatgacgaaatcgctaagtatgatgggaagtgggaagtcgaagaaatgaaggagtctaaactgccaggggataaaggactggtcttgatgagccgcgccaagcaccatgctatctccgccaaactaaacaagccgttcctgtttgataccaagcccctgatagttcagtacgaggtcaactttcagaatgggatagagtgtggaggcgcatataactgcttcctgaagcatcagaactctacctgggatcagtttcatgacaaaactccatacacaatcatgttcgggccagataaatgtggagaggactacaagctgcacttcatctttcgacacaagaatcccaagaccggtatctatgaagaaaagcatgcaaagcgacccgacgccgatctaaagacctatttcaccgacaaaaagacccatctgtatactttaatcctcaaccctgacaactccttcgaaattcttgtggatcagagcgtcccacctgtaaacccatccagggagatagaagacccggaggaccggaaaccagaggactgggacgaaagacccaaaattcctgaccctgaggcagtgaagcccgacgattag

SEQ ID NO: 110569 - DNA, 984 bp, Artificial Sequence
  Description of Artificial Sequence: Synthetic coding sequence
atggaaggcaagtggctcctttgcatgcttttggtgcttggaacagccattgtagaagcacatgacggtcacgatgacgatgtcatcgacattgaggatgaccttgacgacgtaatcgaagaagtagaggaaatgaaggagagtaagttgccaggtgacaagggcttagtgctgatgtcccgagccaagcaccacgctataagtgcaaagctaaacaagcccttcttgtttgacacaaagccgctgatcgtgcagtacgaggtgaactttcagaacggcatcgaatgcggcggagcctacgtgaagttgctaagcaagactccagagctgaatctggatcagtttcacgacaagaccccgtacactataatgttcgggcccgataagtgtggcgaggactacaaattgcatttcattttcaggcataagaatcctaagacaggaatctacgaggaaaaacacgccaagcggcctgacgcagatttaaagacgtactttacagataaaaagacgcacttatataccctcatcttaaatccggataatagctttgagatcctagtcgatcaatctgttgtgaatagtggcaacctcctgaacgacatgaccccacccgtaaatccatcaagggaaatagaagacccagaggatcggaagcctgaggactgggatgaaagaccaaagatccctgaccctgaagctgtgaaaccagacgattgggacgaagacgcaccggcaaaaatcccagatgaggaagccacaaaacctgaaggatggttggatgacgagccggagtatgtgcccgaccctgacgctgaaaaacctgaagattgggatgaggatatggatggagagtgggaagcccctcagattgctaacccaagatgcgagtcagcaccaggttgtggggtttggcagcgtccggtagtagacatacaaaaaacctctagacatcaccatcagcaggcaccagtggaacactag

SEQ ID NO: 110570 - DNA, 1884 bp, Artificial Sequence
  Description of Artificial Sequence: Synthetic coding sequence
atggcagatagaaggactccaaccccattcgctggttgcaggctgccgcgccagcgcagagcccgcgacgccagccaggtttccgcccctgggaccaggcggatcatggagggcaaatggttattatgcatgttactggtgctcggcacagcaatagtggaagcgcatgatggtcacgatgatgatgtaatcgatattgaggatgaccttgacgacgtgatagaggaggtggaggactccaaaccagatacaaccgcccctccttccagtccgaaagtcacctacaaggcacccgtccctactggcgaggtgtacttcgccgactcttttgacagagggacactgtcaggctggatcctgtctaaagccaaaaaggatgataccgacgatgaaattgcgaaatatgatgggaaatgggaggtggaagagatgaaggagagcaaactgccgggcgataagggactcgtcctaatgtctcgggctaaacatcatgctatcagtgcaaagctcaataagccctttctgtttgacaccaaaccgctgatcgtacaatacgaggtgaatttccagaacggtatcgagtgcggaggtgcctacgtgaagctgctcagcaagacgcctgaattgaacctggatcagttccacgacaaaacaccttacactattatgtttggtcctgacaagtgcggcgaagattacaagctgcacttcatcttcagacataagaatcccaaaactggtatctacgaggaaaaacatgcaaaaaggccagacgccgatttgaagacctacttcacagataagaaaactcacctgtataccctgattctcaaccctgacaattccttcgagatcctcgtggaccagtccgtggttaattctggcaacctcctaaacgacatgacaccacccgtcaacccttcacgcgagatcgaggaccctgaggaccgtaaaccagaggattgggacgagcggcccaaaatcccagatcccgaggccgtaaagcccgatgactgggacgaagatgcaccggctaagatcccggatgaggaagccacaaaaccagagggctggctagacgatgaaccggagtacgttccagatcctgacgctgagaagcctgaggactgggacgaggatatggacggcgaatgggaagcaccacaaatcgccaatccacgttgtgagtccgcccctggatgtggcgtttggcagagaccagtgatagacaaccctaattacaaagggaagtggaaacctccaatgatagataatcccagttaccagggtatctggaagccacgcaaaattcccaatcccgattttttcgaggacttggagccattccggatgaccccatttagcgctattggactggaactgtggtccatgaccagtgacatttttttcgacaattttataatctgtgcagacaggagaattgtggacgattgggccaacgacggttggggcctcaagaaggctgccgacggtgccgctgagccaggagtggtcggccagatgatagaggctgcggaagagcggccttggctctgggtggtgtacatccttaccgtagcacttcccgtgtttcttgttattctcttttgttgcagcgggaagaagcagacatcgggtatggagtacaagaaaactgacgccccccaacccgacgtgaaggaggaagaggaagagaaggaagaagagaaagacaagggtgacgaggaggaggaaggggaggaaaaactggaagagaaacaaaagagcgacgcagaggaggatggcgggacagtgagccaggaagaagaggatcgcaagccgaaagcggaggaagatgaaatcttgaacaggtcacccagaaaccgaaagccccgtagagaatag

SEQ ID NO: 110571 - DNA, 1779 bp, Artificial Sequence
  Description of Artificial Sequence: Synthetic coding sequence
atggaaggaaaatggctgctgtgtatgttattggttctcggcactgcgatagtagaggcccacgatggtcacgacgacgatgtcatcgacattgaagacgacctcgatgacgtgattgaggaagttgaagattccaagcctgatacaacagctcctccgagttccccaaaagtcacgtataaggctcccgtgcccactggagaagtctattttgcggactctttcgacagggggacactgtcaggctggattctgagtaaggctaaaaaagatgacaccgatgacgaaattgccaagtacgatggtaagtgggaagtagaggaaatgaaggaaagcaagctgccaggggataagggtctggttctgatgagcagagcaaagcaccatgctatatctgccaagctaaataagccctttttgttcgataccaaaccccttattgtgcagtatgaagtgaactttcagaacggtatagagtgcggcggagcctacgtgaagctactcagtaagacccctgagctgaatctagatcagttccacgacaaaacaccctacacgatcatgtttgggcccgacaaatgtggcgaggattacaagctccacttcattttccggcataagaaccccaagactgggatatatgaagaaaagcacgcaaagagaccggacgctgacctgaaaacttattttacagacaaaaagacccacctctacactcttatcttaaaccctgacaattccttcgagattctggttgaccaaagtgtggtaaatagcggcaacctgctcaatgatatgaccccgcccgttaatccttctcgcgaaattgaggacccagaagatcggaagcccgaagactgggacgagcgaccaaaaattcccgatccagaagcagtgaagccagacgactgggacgaagacgcccctgcaaagattcctgatgaagaggctaccaagccagaggggtggcttgatgacgagcctgagtacgtgcccgaccccgatgctgaaaaacccgaagattgggatgaggacatggacggagagtgggaagctcctcaaatcgctaacccccggtgtgaatctgcccccggttgtggtgtttggcaacggcccgtcatcgacaaccccaattacaagggcaagtggaagccccctatgatcgataacccctcgtatcaggggatttggaagccccggaagatccccaaccctgacttctttgaagatcttgaacccttccggatgacccccttctcggccataggactggaactgtggtcaatgacatctgatatattttttgacaatttcattatctgcgctgacagacgcattgtcgacgactgggcaaatgacggatggggtctgaagaaagccgcagacggtgcggccgaacccggagtggtgggacagatgattgaggcagctgaggagcggccgtggttatgggtggtgtatatcctgactgtagccttgccagtgtttctggtgattttattctgctgcagcggcaaaaagcagacttccggcatggagtacaagaaaactgacgctccacagccagacgtgaaggaagaggaggaggagaaagaggaggaaaaagacaaaggggatgaggaagaggaaggagaggaaaagctggaagagaaacagaaaagcgatgcagaggaagacggcggcacggtatctcaggaagaggaagaccgaaagccgaaagccgaggaggacgaaatccttaacaggtctccaaggaatcgcaaacctcgccgcgagtag

SEQ ID NO: 110572 - DNA, 405 bp, Artificial Sequence
  Description of Artificial Sequence: Synthetic coding sequence
atggagggaaagtggttgctgtgcatgctcttggttttgggaaccgcgatagtcgaggcgcatgatggacatgacgacgatgtgatagacatagaggacgacctggatgacgttattgaagaagtggaggatagtaaaccagacacaaccgcgccccctagctcgccgaaagtcacatataaggcgcccgtgcccacgggagaagtgtattttgctgacagcttcgacagaggaaccctgtctggttggatactgtccaaggccaagaaggatgacacagacgatgagattgccaagtacgacggtaagtgggaagttgaggagatgaaagaatctaaacttcctggagacaaaggcctcgtcctgatgtcccgtgccaaacaccatgccatcagtgctaagtag

SEQ ID NO: 110573 - DNA, 507 bp, Artificial Sequence
  Description of Artificial Sequence: Synthetic coding sequence
atggaaggcaagtggttgctttgcatgttgcttgtgttgggtacagcaatagtggaagcacacgatggccatgatgatgatgtgatcgatatcgaggacgacctcgacgatgtgatagaggaggttgaagattctaagccagatactactgcgcctcctagttcccctaaggtcacatacaaagctccagtgcccaccggggaggtgtacttcgctgactcattcgatcgcggaactcttagcgggtggatactgagcaaggccaaaaaggatgatacagatgacgagatagcaaagtatgacggaaagtgggaagttgaagagatgaaggagagcaagctcccaggcgacaaggggctcgtactgatgagtagggccaagcatcatgctatatccgctaagctaaataaacccttcttgttcgatactaaacccctgattgtccagtacgaggttaattttcagaacggcatagagtgtggcggcgcttatgtgaagcttttatag

SEQ ID NO: 110574 - DNA, 1779 bp, Artificial Sequence
  Description of Artificial Sequence: Synthetic coding sequence
atggagggaaaatggcttttatgcatgttattggtgcttggaaccgccattgtagaagctcacgatgggcacgacgacgatgttatcgatatcgaggacgacttggacgacgtgatagaggaggtagaagattccaaacccgacacgacggccccaccttctagtccaaaggtgacttataaggctccggtgcctaccggagaggtttacttcgcggatagcttcgatcgggggacactgtctggttggattctctcaaaagccaaaaaagatgacaccgacgacgagatagcaaagtatgacggaaaatgggaagtggaagaaatgaaagagtccaagctgcctggcgataaagggttggtgctgatgtctagggccaagcatcacgcgatttcagccaagctaaacaagcccttcctgttcgacactaagccacttatagttcagtacgaagtgaacttccagaatggaatcgaatgcggcggagcctatgtgaagcttctcagcaagactcctgaattaaatctcgaccaattccacgacaagacaccatacaccatcatgttcggtccggataaatgtggcgaggactacaaactccacttcattttccgccacaaaaatccaaaaacaggtatctatgaagagaaacatgccaagagacccgatgccgaccttaagacatacttcacagacaaaaagactcatctgtacactctcatactgaacccagacaactcgtttgagatcctggtggatcagagcgtagtgaacagtggtaacctgctcaacgacatgacaccccccgtaaacccgtcaagagaaattgaagacccggaggaccgcaagcccgaggactgggacgagcgccctaaaattccagatcccgaggcagttaagccagacgattgggatgaggatgctcccgccaagatccccgacgaggaggccaccaagcccgaagggtggttagacgacgaaccagaatacgttcctgatcctgacgccgagaaacccgaggactgggatgaggacatggatggagagtgggaagcaccacaaatcgccaatccccgctgcgagagtgctccaggatgcggtgtgtggcaacgcccagtcatcgacaatcccaactacaagggaaaatggaagcctcccatgatcgataatcctagctaccaagggatctggaaacctcgaaagattcctaaccctgacttcttcgaggatctggagccatttcgaatgacgccattcagtgcgatcgggctggagctgtggagtatgaccagtgatatttttttcgacaattttattatttgcgcagacagaaggattgtagatgactgggccaacgatggctgggggctgaagaaggcggctgatggtgcagcggagcccggtgtggtcggccagatgattgaggctgccgaggagcggccatggctgtgggtggtgtatattctcactgtagctctccctgtgtttctggtgatcctgttttgctgctctggcaagaaacagacctctggaatggagtacaaaaaaacggacgctcctcagcccgacgtgaaggaagaggaagaagagaaagaggaggaaaaggataaaggcgacgaagaggaggagggcgaggaaaaattggaggagaagcaaaaatctgatgccgaggaggacgggggcacagtttcccaggaggaggaagaccgaaagcctaaagctgaagaggatgagattttgaaccgcagccctcgcaaccgaaagcctcgacgcgaatag

SEQ ID NO: 110575 - DNA, 240 bp, Artificial Sequence
  Description of Artificial Sequence: Synthetic coding sequence
atggagggaaagtggctgctgtgcatgctgctggtgcttggcacagcaatcgtcgaagcgcacgatggtcacgacgacgatgtcatagacatcgaggatgacctggacgatgttatcgaggaggtagaggatagcaagcccgatacaactgctcctccgagctcgcctaaagtgacgtataaggccccagttccaactggtgaagtgtattttgccgactcattcgacaggggcacatag

SEQ ID NO: 110576 - DNA, 99 bp, Artificial Sequence
  Description of Artificial Sequence: Synthetic coding sequence
atggaaggcaagtggctgctatgtatgctactagtcttagggaccgccatcgtggaggctcacgatggacatgacgacgatgttatagacatagagtag

SEQ ID NO: 110577 - DNA, 1455 bp, Artificial Sequence
  Description of Artificial Sequence: Synthetic coding sequence
atgaaagagtccaaactgcccggggataaggggctggtccttatgtcgcgagctaagcaccatgccattagcgcgaagctcaacaagccttttttgttcgataccaaaccactgattgtccagtatgaagtcaatttccaaaatggtatcgagtgtggaggagcctacgtcaagcttttgagtaagacacccgagctgaatcttgaccagtttcatgacaagaccccttatactatcatgtttggacctgataaatgtggtgaggattataagctgcatttcatcttcagacacaaaaacccaaaaactggaatttatgaggaaaaacacgccaaacgcccggatgctgacctcaaaacatactttaccgacaaaaagacccacttatatacactgattctgaaccccgacaactcgtttgaaattctcgtagatcagtccgtggtgaactcaggaaatttactgaatgatatgactcctcccgtgaatccgtccagagagatcgaagacccagaggataggaaacctgaggattgggatgaacggcctaagattcctgaccccgaagccgttaaacccgatgactgggacgaagatgccccagccaagattcccgatgaggaagcaaccaagcccgaaggctggcttgacgatgagcctgagtacgtgcctgatccagacgccgagaagcccgaagattgggatgaagacatggacggggagtgggaagccccacagatcgccaacccaaggtgtgagtcagcaccgggttgtggggtgtggcagagaccagtaatcgacaaccctaactacaagggcaaatggaaacctcctatgattgataatccatcttatcagggtatttggaagcccaggaaaattcctaatccagatttttttgaggacctcgagccattcaggatgactcccttttcggccatagggctggaactttggagcatgactagcgatatcttcttcgacaattttattatctgcgctgacagaagaatcgtggatgattgggctaacgatggttggggcctgaaaaaggctgcagatggcgccgctgaaccaggcgtggtgggacagatgattgaggcagccgaagagcgaccgtggctgtgggtggtgtatatcctgacggtggcgctgcctgtgttcctggtgattctattttgttgttcagggaaaaaacagacatcaggaatggagtataagaagacagatgcgccccagccagacgtcaaggaagaggaagaggaaaaagaagaagaaaaggataagggtgatgaagaagaggaaggcgaggagaaattagaagagaagcagaaatctgacgcagaggaggacggaggcacggtgtcacaggaagaggaagacagaaagccaaaagcggaagaagacgagatactgaatcgcagtccacggaatagaaaacctcgacgggagtag

SEQ ID NO: 110578 - DNA, 324 bp, Artificial Sequence
  Description of Artificial Sequence: Synthetic coding sequence
atggaaggaaagtggctgctatgcatgctgctcgttctcggcacagccatcgttgaagcccatgacggccatgatgatgacgtcatcgatatcgaggatgatctggacgacgtaatcgaagaagtcgaagatagcaagccagatactactgcgccgccaagctctcctaaggtgacatacaaggcccctgtcccaacaggcgaagtctacttcgcagattcctttgatagaggaaccctcagcggctggatcttgtcaaaggcgaagaaggatgacacagacgacgagatagctaagtatgatggcaagtgggaagtggaatag

SEQ ID NO: 110579 - DNA, 435 bp, Artificial Sequence
  Description of Artificial Sequence: Synthetic coding sequence
atggaaggaaaatggctgctgtgtatgttacttgtgttggggactgcaatcgtggaggctcacgatggccacgacgacgacgtgatagacatcgaagatgacctggacgacgtcattgaagaagtggaagattctaaaccagacaccacagctcctccctcatccccaaaagtcacatataaggccccggtccctaccggggaggtctactttgccgattcctttgatcgggggacgctttctggttggatcctctccaaagctaaaaaggacgataccgacgatgagatcgctaagtatgatgggaagtgggaagttgaagaaatgaaagagagcaaactccctggggacaagggactcgtgctgatgtcacgcgccaagcatcacgccatctccgctaagttgaacaagcctttcctgttcgacacaaaatag

SEQ ID NO: 110580 - DNA, 420 bp, Artificial Sequence
  Description of Artificial Sequence: Synthetic coding sequence
atgagggcgggacggggcgcaacgccagctagagaactgtttcgcgacgcagccttccccgcggcagactcatcgctattctgcgatctaagcacacccctggcgcagttcagggaggacattacatggaggaggccccaagaaatctgtgccacgcctaggctgttccccgacgatcctcgagaaggtcaggtaaagcagggactgctaggcgattgttggttcttatgtgcatgcgcagccctccagaagagtcggcacctgttggatcaggtctcatgtccagtgcagctccccgcagattggacgtgtaaggtccaaccagtttggctagagttcccctgcttacccatcagctgtaggttgcgcgtctcttcagatacaagcccggattctgccacctggggaagttggaaatag

SEQ ID NO: 110581 - DNA, 417 bp, Artificial Sequence
  Description of Artificial Sequence: Synthetic coding sequence
atgcgcgcgggccgcggagcaactccagcccgcgagctgtttcgcgatgctgcctttccagccgcagattcaagcctattttgtgatctcagcacccctttagcacaatttcgcgaagatataacttggagaagaccgcaggtgcctgaaggcgggaggtcgcaggatgcgcctcctctactgctacaggagcctctgctctcttgcgtccctcatcggtatgcccaggaagtcagccgtctgtgcttgctcccagctggtacctacaaggtcgtcccctccacatacttgcctgacaccgagggcgcctttactgtaaccatcgccacccgcattgaccgacccagtatccattcacaagagatgcttggacagtttcttcaagaggtctccattatggccgtcatgaaaacctag

SEQ ID NO: 110582 - DNA, 1554 bp, Artificial Sequence
  Description of Artificial Sequence: Synthetic coding sequence
atgcgcgcaggtaggggggcaactccagctagagagctgtttagggatgctgctttcccagccgccgattccagtcttttctgtgacctatccacgcctttggcccagttccgggaagacattacttggagacgcccacaagaaatttgcgctacgcctcggctatttcccgatgatccaagagaggggcaggtaaagcagggattgctcggggactgttggtttctatgcgcttgcgcagcgctgcagaaaagccgccacctgctggaccaagttatcccccccggccagccaagttgggcagaccaggaataccgcgggtcttttacttgtaggatctggcaattcggtaggtgggttgaagtgacaacagatgaccggctgccgtgtttggctggacgactgtgttttagcaggtgccagcgagaggacgtgttctggcttcctcttctggaaaaagtatacgcaaaggtgcatggaagttacgaacatttgtgggctgggcaagttgctgacgctctcgtggatcttaccggaggtctggctgaacggtggaaccttaagggcgtcgccggctctgggggacagcaggacaggccaggtcggtgggagcaccggacatgccgccagctccttcaccttaaggaccaatgcctcatcagctgttgcgtgctgtcaccccgcgctggtgcaagagaattgggtgagttccacgcttttattgtaagtgacttgcgcgagctccaaggtcaagccggacaatgcattcttctcctgcgcatccaaaatccgtggggccgccggtgctggcaaggactgtggcgagaagggggagaagggtggtctcaggtcgacgctgctgtagctagcgagctcctcagccaattgcaggagggagaattctgggtggaagaagaagaattcctgcgagagttcgacgagctcactgttgggtacccagtaaccgaggcaggacacctgcagagcctctatacagagcggcttctctgccacacccgcgcgctccctggagcctgggtcaaggggcagagcgcaggaggatgtcgtaataatagcgggtttcctagtaatcctaagttttggcttcgggtgtcagaaccatccgaagtgtacatcgccgtcctgcagaggtctcgcctacacgccgccgattgggcaggacgtgcgcgggcccttgtcggggattcacacacctcctggtctccggcatccataccgggtaagcactatcaggcagtgggtctgcatctctggaaggtccccgaagggggtagaagccaagacgccccacccctcctgctgcaggaacccctgctgagctgtgtgccacatcgctacgctcaggaggtttcgcggctgtgtctgttgcccgccggaacatacaaagtggtgcccagtacctacctcccagatacagaaggggctttcactgtgacaattgccacaagaatagatcgacctagtatacattcccaggagatgttggggcagtttctgcaagaagtgtcgatcatggccgtcatgaagacgtag

SEQ ID NO: 110583 - DNA, 1335 bp, Artificial Sequence
  Description of Artificial Sequence: Synthetic coding sequence
atgagagccggcaggggagccactccagcaagagagctcttccgcgacgccgcatttccagcggcggacagctcccttttctgtgatctgtccacaccgttagcacagttccgggaggatatcacttggaggaggcctcaggaaatctgtgcgacccctcgcttgtttcctgatgacccccgtgaggggcaggtgaagcagggcctgctgggggattgttggtttttgtgcgcctgcgccgctcttcagaaaagtcgccacctcttagaccaagtcatcccgcctggacaacctagttgggctgaccaggagtatcggggttccttcacatgtcgcatctggcagtttgggcggtgggtggaggttaccactgatgaccgtctaccttgtttggccggccgcctgtgtttcagcagatgtcagagggaagatgttttttggctgcccctgcttgaaaaagtctacgcaaaggtacatggttcctacgagcacctgtgggcaggccaggtggctgatgcattggtagacttaacgggaggcctcgctgaacgatggaatctgaagggcgtggccggaagcggcggccaacaggacaggcccggtcgttgggaacaccgaacatgtcggcagctgctgcatctgaaggatcagtgccttatctcgtgctgtgttttgtcacctagggccggcgccagagagctcggggaatttcatgcattcatcgtctcggatttgcgggaactgcaaggacaagcagggcaatgcattctcctgcttaggattcagaatccttggggtaggcgttgctggcagggattgtggcgagaaggtggcgaaggctggtcacaggtggatgccgccgtggcttccgagctgctgtcccagctgcaagaaggagagttctgggtcgaggaagaagagtttttgagggaattcgacgagctgaccgtgggctatccagttaccgaagctggccacctacagtccctgtacactgagcggctgctgtgccatacgcgtgctctccctggagcatgggtgaagggtcagtctgccgggggatgtagaaataactcagggttcccttctaatcctaagttctggttgcgagtgtcagaaccgtccgaggtgtatatcgctgtgttgcaacgctcaagactgcacgccgcagactgggctgggagggcccgcgccctagtaggcgatagtcacacctcatggtcccctgctagcatccccggcaagcattatcaagccgtggggctgcacctgtggaagggcgtgaccctggggactaccttgttccctgtgccgagctggatgtggcctacctag

SEQ ID NO: 110584 - DNA, 2019 bp, Artificial Sequence
  Description of Artificial Sequence: Synthetic coding sequence
atgcgcgctggacggggcgccacccctgcgagagaactgttcagagatgctgccttcccagcggcagattcaagtctcttttgtgacctgtctactcctctcgctcagtttcgggaagacatcacatggaggcggccccaggaaatttgtgccacccctaggttattcccagacgaccctagagagggccaggttaagcaagggctgctcggcgactgttggttcctgtgcgcctgcgccgccctgcaaaaatctcgtcatctgctggaccaagttatacctcccggccagccttcttgggcagatcaggaatacagggggtcatttacctgcagaatatggcaatttggccgctgggtcgaggtgacaacagacgaccgccttccttgtttagctgggaggctgtgcttctccaggtgtcaaagggaagatgttttctggctacccttgctagaaaaagtgtacgctaaggtgcatggctcctacgagcatctgtgggctggacaagtcgctgacgctcttgtggacctgacaggagggctggccgagaggtggaacttaaaaggagtggctggctctggcggacagcaggaccgcccgggtaggtgggagcaccggacctgtcgtcagctgttgcacctaaaggaccagtgtctgatttcttgttgtgtcttgagccctcgcgcgggggcccgcgagctgggcgaatttcacgcttttatcgtctcggatctacgggaactccaaggacaggcaggccagtgtatacttctcctccgaatccagaatccatgggggcgcaggtgctggcaagggttgtggcgtgaaggaggagagggttggtcacaggttgatgcagccgtcgcttcagagctcctttcacagctccaggaaggcgagttttgggtcgaggaagaggaattcctccgggagttcgatgaactgaccgtgggttaccccgtcacggaagccggtcatctgcagagcttgtatacagaacggttgctgtgccatacaagagcgctgcccggagcgtgggtgaaagggcagtctgctggagggtgtcggaacaactccggcttccctagtaaccccaaattttggttacgggtcagcgagccatctgaagtgtacattgcagttttgcagcgcagcagactgcatgccgccgactgggcaggaagagcaagggccctggtgggcgatagccacacgtcctggtctcctgcttctattcctggcaaacattaccaggcagttggcttgcatctatggaaagtcgagaagcggcgcgttaacctgcctcgagtactcagtatgccgccggtggccggaacagcttgccacgcatacgaccgcgaggttcatcttcggtgtgagttgagcccaggttactatctcgctgtcccctcaaccttcttaaaagatgccccaggggagtttctgttgcgggtgtttagcacaggcagggtgagcttgtcagctatacgggccgtggcaaagaacaccactccaggagccgccctgccggccggcgagtggggtactgtacagctaaggggatcttggagagttggacagactgcaggaggctcgcgtaattttgcgtcctaccccactaacccatgctttcccttctccgtacctgagggaccaggccctcggtgtgtcagaattaccttgcatcagcactgccgcccaagtgacaccgaatttcatcccattggcttccatatcttccaggtacccgaaggcgggagatcccaggacgccccccccctgctccttcaggagccactgctttcctgtgtaccacatcgatacgcccaagaggtgtctcgcctatgcctgttgccagccggcacctacaaggtggtaccctccacatatttacccgacaccgagggcgccttcaccgttaccattgctaccaggattgacaggcccagtatacactctcaggagatgctgggccagtttttgcaggaagtctctataatggctgtaatgaaaacatag

SEQ ID NO: 110585 - DNA, 2220 bp, Artificial Sequence
  Description of Artificial Sequence: Synthetic coding sequence
atgctttattcacctgggccgagcctccccgaaagtgccgagagcctcgacggaagtcaggaggataagcctcggggtagctgcgccgaacctacttttactgataccggtatggtagcacatatcaacaactcaaggctgaaggccaaaggtgttggccagcatgacaacgcacaaaacttcggaaaccagtccttcgaagaactcagggccgcctgcctccgcaagggcgagttatttgaagacccactattccccgcggagcctagctctttgggcttcaaggatctcggcccaaacagcaagaacgttcagaacataagctggcagcgcccaaaggatattattaataaccctctgtttatcatggatggcatctcaccgacggacatctgccaggggatcctcggcgactgctggttgctagcagccattggatcactgactacctgccccaaactgctctaccgagtcgtgccaagaggtcagtccttcaagaagaactatgctggaatattccatttccagatttggcagttcggacagtgggttaacgtcgtcgtcgatgataggctcccaactaagaatgacaagctcgtgttcgttcatagcaccgagcggagcgagttttggtcagccttactcgaaaaggcatacgccaaactgagcggctcatatgaggctctctccggaggctccactatggagggcctcgaggacttcaccggaggtgttgctcagtctttccaactacagaggccaccacagaacctgctccggctccttcggaaagctgtggagagaagctctcttatgggttgctctatcgaagtaacatccgactctgagctagaaagcatgaccgataagatgctggtgaggggccacgcttatagtgtgacgggactccaagatgtgcactaccgaggcaagatggagacccttattcgggtgaggaacccatggggacggatcgagtggaacggcgcttggtctgactccgcccgcgaatgggaggaagtcgcctccgacattcagatgcaactgctccacaagaccgaagatggggaattctggatgtcctatcaagatttcctcaacaattttacgctgttggagatttgtaatctgacaccagataccttgagtggggactataagagctattggcataccaccttctacgagggaagctggcgccgcgggagcagtgccgggggctgcagaaatcaccccggaactttctggaccaatccccagttcaagatctccttgcccgaaggcgacgatcctgaggacgatgccgaaggaaacgtggtcgtttgtacatgcctggtggctctcatgcagaagaactggaggcatgccaggcagcagggggcccagctccagaccatcggttttgtgttgtatgccgtgccaaaagagtttcagaatatccaggatgttcatctcaaaaaagaatttttcaccaaatatcaggaccatggtttctccgaaatcttcacaaactcacgggaggtaagcagtcaactacggttaccaccaggagagtatatcatcattccttctacatttgagccacatcgtgatgctgattttttactgcgcgtttttacagaaaaacactcagaaagctgggaactggacgaagtgaattacgcagaacagctgcaagaggagaaggtgagcgaggatgatatggaccaggactttcttcacctttttaagatcgtggctggcgaaggcaaggagattggagtttatgagctgcagaggctgctgaacaggatggctattaaatttaaatcattcaagacaaagggattcgggctggacgcttgtcgatgcatgatcaatctgatggataaggatggcagcggtaagcttggcctcctggagttcaagatcctgtggaagaagctgaagaagtggatggatatattccgggaatgcgaccaggatcattcagggacgctgaattcgtacgagatgaggctggtgatcgagaaagccgggattaaactgaacaataaggtgatgcaggtgttggtcgctcgttacgcagacgatgatctgattattgacttcgactcctttatctcctgcttcttgaggcttaagaccatgtttaccttcttcctcaccatggacccaaagaacaccgggcacatctgcctgtcgctggagcagtggctgcaaatgaccatgtggggttag

SEQ ID NO: 110586 - DNA, 2220 bp, Artificial Sequence
  Description of Artificial Sequence: Synthetic coding sequence
atgctgtattcaccagggcccagtctccccgaatcagcagagagtcttgatggctctcaagaggataaacctcgcgggtcttgcgccgagccaactttcaccgataccggcatggtcgctcacatcaataacagtcgactcaaggctaaaggggtcggccagcacgacaacgctcagaattttggcaaccaatcattcgaagaactaagggccgcctgcctcaggaagggcgagctgtttgaggaccccttattcccagcagaaccctcatcgctcggcttcaaggacttgggccccaacagcaagaatgtacagaatatctcgtggcagcgccctaaggatatcattaataaccctcttttcatcatggacggtataagccccacagatatttgtcaggggatcctgggagactgctggttgcttgccgccattggcagcttgaccacttgtcctaagctgttgtaccgcgtggtgcctaggggacaatcttttaagaagaattatgcaggaattttccattttcaaatctggcagttcggacagtgggttaacgtagtcgtggacgaccgcctccccaccaaaaatgataaactggtcttcgtccattccactgagagatcagagttttggtcagcactgttggagaaagcctacgcgaagctgtctgggtcttatgaagcattgtcaggaggaagtaccatggagggtcttgaagacttcaccggaggtgtggcccagagtttccaactacagagaccaccacagaacttgctcaggctgttacgcaaggccgtagaacgcagctccctcatgggatgcagcattgaggtcacctcggattctgagctggagagcatgaccgataaaatgctggtacgcggacacgcttacagcgtcaccggactgcaggatgtgcactataggggcaaaatggaaacactcatccgggtgcggaatccttggggaaggattgagtggaacggcgcatggtccgattccgcccgggagtgggaagaagtcgctagtgatattcagatgcagctgctgcataagactgaagacggcgagttctggatgtcgtaccaggatttcctgaataatttcacactgctggagatttgcaacctgacacccgacaccttatctggggactataagagctactggcataccaccttctatgaagggtcgtggcgccgagggtcaagtgccggtgggtgtcgcaatcacccaggtaccttctggacaaacccgcaattcaaaatttccctaccagaaggtgacgatcctgaggatgatgccgaaggtaatgtcgtggtttgcacgtgtctggtagccctgatgcagaagaattggagacacgctcggcaacagggagctcaactgcagacgattggcttcgtgctgtatgcagtcgccagtcccttccagaatatccaagacgtgcatttgaaaaaggaattttttaccaaataccaggatcatggcttcagtgaaattttcactaattctcgcgaagtgtccagtcagctacgacttcctcctggtgagtacatcatcattccttcaacgtttgagcctcatagagacgctgactttctgctgcgagtgtttactgagaagcattctgagtcatgggaactggatgaagtcaattacgctgagcagttgcaggaagagaaagtgtcagaagacgacatggaccaggactttttacacctcttcaagattgtcgcgggggagggtaaggaaatcggagtgtatgaacttcagagactcctgaacagaatggcaattaagtttaaatcttttaagacaaaagggttcggccttgatgcttgtcgttgcatgatcaatctgatggataaggacggttctggaaagctgggtctgctcgaattcaagattctttggaagaaacttaagaagtggatggacatctttcgagaatgcgatcaggatcacagcggaacacttaattcgtacgaaatgcgtttggtgattgaaaaggccggaatcaagctgaacaataaagttatgcaggtgttggtggctaggtacgcagacgacgatctgatcatcgatttcgatagcttcatttcctgtttcctccggctgaaaactatgttcacttttttcctcactatggatcctaagaatacaggccacatttgtctcagcctggagcagtggctccagatgacgatgtggggctag

SEQ ID NO: 110587 - DNA, 2160 bp, Artificial Sequence
  Description of Artificial Sequence: Synthetic coding sequence
atggcgagcagcagcggacgagtaactatacagctggtcgacgaagaagccggagtcggtgccggcagactccagttatttagaggccagagttacgaagcaattagagcggcctgcttggactcaggaatcctctttagggacccgtattttcccgccgggccggatgctctgggatacgatcagcttggacccgacagcgagaaggccaagggtgttaagtggatgcgcccacacgagttttgcgcagaacccaagttcatctgcgaggacatgtctagaaccgacgtctgtcaggggagtcttggaaattgttggttccttgcagcagcagcttctcttactctctatccacgcctgcttaggagagtcgtgccccccggccaagattttcagcacggatacgccggagtgtttcactttcagctctggcagtttggccgatggatggatgtagtggttgatgaccgcttgcccgtccgagagggaaagctgatgttcgtaagatctgaacagaggaatgaattctgggcaccccttttggagaaggcatacgcaaaactgcacggttcctacgaggtgatgcgcggaggtcacatgaacgaggcttttgtggattttacgggaggtgtcggggaggtcctctacctcaggcagaactccatgggactgttcagcgccctgaggcacgccttagccaaagagagccttgtgggagcaacagcactgagtgatcgtggtgaatatcgcacggaggaggggctcgtgaaaggccacgcttatagcatcaccgggacacacaaggtctttcttggttttaccaaagtcagactgcttcggctgcgaaatccatggggctgcgtcgaatggacaggagcctggtcagattcctgccccagatgggacacacttccaactgagtgtcgcgatgcgctgctcgtgaagaaagaggatggagagttctggatggagctgcgggacttccttctgcatttcgacactgttcagatttgcagtctgtctccggaggtgcttggtccttcacccgaggggggcggatggcacgtgcatacctttcagggccgctgggtcagagggttcaactctggaggcagtcagcctaatgcagagacgttttggactaaccctcagtttcggctcaccctgttggagcccgatgaggaggacgacgaggatgaggaggggccctggggcgggtggggcgccgctggggctcgagggcccgcccgaggggggcgcacccctaaatgcacggtgctcttaagcctgatccagcggaaccgacgcaggttacgagcaaaggggcttacgtatctgactgttgggttccatgtgtttcaaatccctgaggagctcctgggcttgtgggatagcccccggagccatgcgttgctgccccgcttgctgcgggccgatcgtagtccgctgagcgcaaggagagacgtgaccaggcgctgttgtctcagaccaggacactatctcgtcgtgccctccactgctcacgctggtgatgaagcggatttcacactacgtgtgttcagcgaacggcggcatacggccgtggagatcgacgatgtcatcagcgctgatctgcaatccctacaaggaccttacctccccctggaactggggctagagcagctctttcaggagctagcgggagaggaagaggagctgaacgcctcacagttgcaggctctgcttagcatcgcgttagaaccagcccgcgcccacacctctaccccccgagagatcggattgaggacctgtgaacagctcctacagtgttttggccacggacagagtctcgcgctgcatcacttccaacaactctggggctacttactagagtggcaggccatctttaataagtttgacgaagacacgtcaggcactatgaactcgtacgagctgcgcttagccctcaatgcagccggtttccatctgaacaatcagttaacccagacactcacctctagatatcgcgattcacgacttcgggttgacttcgaacgctttgtcagttgcgtggcccatttaacatgcatcttttgtcattgctcccagcacctcgatggcggggagggggtgatatgccttacacacagacagtggatggaggttgcgacctttagctag

SEQ ID NO: 110588 - DNA, 2448 bp, Artificial Sequence
  Description of Artificial Sequence: Synthetic coding sequence
atgcccaccgtaatctccgcgtccgtggctccacgaactgccgccgagccaagatccccagggcctgtccctcatccagctcagagcaaggccactgaggccgggggagggaatcctagtggtatctacagtgcaatcatatctagaaatttcccaataatcggcgtgaaggagaagacgtttgagcagttacacaagaaatgtctggagaagaaagtgctgtacgtggatcccgagttcccaccagatgagacgtccctgttctattctcagaagttccctatccaattcgtttggaaaaggccaccggagatctgtgaaaatccccgcttcattatcgacggagctaacaggacggacatctgccagggggaacttggtgactgttggttcctggccgccatagcatgtctgacgctgaatcagcacctcctgtttcgtgtcatacctcacgatcaatccttcattgaaaactacgcaggcatttttcacttccaattttggcgttacggggagtgggttgacgtcgtgatcgacgactgcctccccacttacaacaatcagctcgtctttaccaaatcaaaccatagaaacgagttttggtccgcgctgctcgaaaaggcttatgccaagctccatggtagctatgaagccttgaaggggggaaatacaactgaggccatggaagattttaccggcggcgttgcagagttttttgagattcgtgatgcaccgtcagacatgtacaaaataatgaagaaagctattgagcggggaagccttatggggtgctccattgatgacggaactaatatgacctacggaacatctccatccgggctgaatatgggcgaattaatcgcacggatggtgaggaacatggataactccctgctccaggatagtgatctggacccccggggcagtgatgaacgcccgactcgcacgatcattccggtgcagtacgagacccggatggcctgtggattggtgagggggcatgcgtatagtgtcaccggactggatgaggtccctttcaaaggtgaaaaggtcaaactcgtcaggttgcgtaatccatgggggcaggtggaatggaacggatcatggagtgataggtggaaagattggagttttgtggacaaggatgagaaggccagacttcagcaccaggtgacggaggacggcgaattctggatgtcttatgaagacttcatataccacttcacgaaattggagatctgtaatctgacagccgatgccctgcagagcgataagcttcagacgtggacagtctcagtaaatgagggcagatgggtgcgcgggtgttcggctggggggtgtcggaatttccccgacacattctggaccaaccctcaatataggctgaaactgctggaggaagacgatgaccctgatgattccgaggtaatctgcagctttcttgtcgctctgatgcagaagaaccggcgtaaggatcggaagctgggagcctccctcttcaccattgggttcgcgatctacgaggttccccaccagatgcacggcaataaacaacacctccagaaggactttttcttgtacaatgcaagcaaggcacggtctaaaacgtacattaacatgcgggaagtatctcagcgtttcaggctgccccctagcgagtacgtgattgtgccctctacttacgagcctcatcaggaaggcgagtttattctgagggtcttttccgagaagcgaaacctgtctgaggaagtggaaaataccatctccgtggatcgccctgtaccgatcatcttcgtgtcagatagggccaactccaataaggagcttggtgtggatcaggagtctgaggaggggaagggtaagacttcccccgacaagcagaagcaaagcccccagcctcagcctggctcctctgaccaggagagtgaggaacagcagcagttcagaaacatttttaagcaaatcgccggagatgacatggagatttgtgcagacgagcttaaaaaggttttgaacactgtcgttaataagcacaaggacctgaaaacccacggatttacactggagtcatgccgcagtatgatcgccctcatggatacggacggctccgggaaactgaacctacaggagttccatcacctgtggaacaagattaaggcctggcaaaaaatctttaagcactatgatactgatcaaagtggcaccatcaattcctacgaaatgaggaacgctgtgaacgatgcagggttccatcttaataaccagctgtacgatatcatcacgatgagatatgctgacaaacatatgaacatagattttgactcattcatatgctgcttcgtccggctggaggggatgtttagggcgtttcatgccttcgataaggacggcgatgggatcatcaagctaaatgtgcttgaatggctgcagcttacgatgtacgcatag

SEQ ID NO: 110589 - DNA, 930 bp, Artificial Sequence
  Description of Artificial Sequence: Synthetic coding sequence
atgcatggaaataaacagcacttacaaaaagattttttcctgtataacgcctctaaagccaggtcgaaaacctacattaatatgcgggaagtcagtcagaggttccggcttcctccctccgaatatgtgatcgtcccctccacttatgaaccgcaccaggaaggagagttcatcttgcgggtcttctccgaaaagcgaaacctgagtgaggaggtcgagaacactatatccgtcgatcgacccgtccggaaggagacttataagcccattatttttgtcagcgatcgagcgaactcaaacaaggagctgggcgtcgatcaggaaagcgaagagggcaaaggaaagacgagtccagacaagcagaagcagagcccgcagccccagcctggcagctcagatcaggagagcgaggagcagcaacagtttaggaatattttcaagcagatcgcgggcgatgatatggagatttgtgccgatgagctcaagaaagttctgaataccgttgtaaataagcacaaggatctgaagacccacggctttaccctggagtcttgtcggtccatgatcgctctgatggacactgatggttctgggaaattgaacctgcaggaattccatcatctatggaataaaattaaagcctggcagaaaattttcaagcattacgatacggaccagtccgggaccattaacagttacgaaatgagaaacgctgtaaatgacgccggctttcacctaaataaccagttgtacgacatcatcactatgcgctatgcggacaaacatatgaatattgacttcgattctttcatctgctgctttgtgagactggaaggaatgtttcgggcgttccatgcattcgataaggatggcgatgggattattaagctcaacgtcctggagtggttgcaattgaccatgtacgcttag

SEQ ID NO: 110590 - DNA, 471 bp, Artificial Sequence
  Description of Artificial Sequence: Synthetic coding sequence
atggagatttgtgccgatgagctgaagaaagttctcaatacagtcgtaaacaaacataaagacctcaaaacacatgggttcacgctggagtcatgccggagcatgatagcgctaatggacacagacggctctggaaagcttaacttacaagagttccatcacctgtggaataaaatcaaagcttggcagaaaatttttaagcactacgataccgaccagtccggcacgatcaattcttatgaaatgcggaacgctgtaaacgacgccgggtttcatctcaacaatcagttatacgacatcattacaatgagatatgcagataagcatatgaacatcgacttcgactccttcatttgttgctttgtgcggctcgaaggaatgtttcgcgcatttcatgccttcgataaggatggagatggaatcatcaagctgaatgttttggagtggttgcagctgacgatgtatgcgtag

SEQ ID NO: 110591 - DNA, 2190 bp, Artificial Sequence
  Description of Artificial Sequence: Synthetic coding sequence
atgccgacagttatcagtgccagcgtggccccacggactgctgcagagccacgcagccccggtccagtcccgcatcccgcacagtccaaggccacagaagcagggggcggcaaccctagcgggatctacagtgccatcattagtcgcaacttccccattatcggtgtcaaggagaaaaccttcgagcagcttcataaaaaatgtctcgagaaaaaagtcctgtacgtggatccagagtttccacctgacgaaacttcccttttctattctcagaaatttcccatccagttcgtatggaagcgcccccctgagatctgtgagaatcctagattcataattgacggcgcaaataggactgatatatgccaaggagaactgggagactgttggttcctggctgccatcgcatgcttgactctgaaccagcacttacttttccgtgtgatccctcacgatcaatccttcattgagaactatgctgggatctttcacttccagttttggaggtacggggaatgggtggacgtggtaatcgatgactgtctccctacttataataaccagctggtgtttacaaaaagtaaccaccggaacgagttctggagcgccctgctggagaaggcctacgccaaactgcatggatcctacgaggctctgaagggcggaaacaccaccgaggccatggaagactttacaggaggagtggctgagttttttgaaattcgtgacgcccctagcgatatgtataaaatcatgaaaaaggcgatcgagcgaggttctctcatggggtgtagtatcgacacaatcatcccagttcagtatgaaactagaatggcatgcggactggtgaggggccatgcctattcggtcaccggcctggatgaagtgccttttaaaggcgaaaaagttaaactggtgaggttgcgtaacccctgggggcaagtggaatggaatggttcctggtccgaccggtggaaggactggagctttgtggataaggacgagaaggcccggctgcagcaccaggtcactgaggacggagaattctggatgagttacgaggatttcatctaccactttaccaagctcgaaatttgtaatctcactgccgacgctctgcagagcgataaactgcaaacatggactgtcagcgtgaacgagggaaggtgggttagaggttgttctgccggaggatgtcgaaacttccccgataccttctggactaatccccagtacaggctgaagctgctagaggaagacgacgacccagatgacagcgaggtcatatgtagttttctggtggccttgatgcagaagaaccgtaggaaggatcggaaattaggggcctcactctttacaattggtttcgccatctacgaggtccccaaggagatgcacgggaataagcagcacttgcagaaagatttcttcctctacaatgcttccaaagcacggtctaaaacttacatcaatatgcgggaggtgtcccagcgcttccgactgcctccatctgagtatgttatcgtgccatctacatatgaaccccaccaggaaggcgaatttatcctccgggttttttctgagaaacgaaacctgtctgaggaggtggagaatactataagcgtcgacagacctgttccacagccggggtcatccgaccaagagtcagaagaacagcagcagttcaggaatatctttaaacagatcgccggagacgacatggagatctgtgctgatgaactcaaaaaggttctgaacaccgtggtaaacaaacataaggatctgaagacacacggatttactcttgaatcctgccggtctatgattgcactgatggataccgatggaagtggcaagttgaacctacaggagttccaccatctgtggaacaagatcaaagcatggcagaaaattttcaaacattacgacacagatcaatcgggcactattaattcctacgaaatgcgtaatgccgtgaatgacgctggcttccacctgaacaaccagctgtacgatatcataaccatgcggtacgcggacaagcatatgaatattgattttgactctttcatttgttgttttgtcaggctcgagggtatgttccgggcatttcacgcctttgacaaagatggcgacggcatcatcaaactcaatgttctggaatggctgcaactgacaatgtacgcctag

SEQ ID NO: 110592 - DNA, 2187 bp, Artificial Sequence
  Description of Artificial Sequence: Synthetic coding sequence
atgtcctggcaaatatcactgaagacgcagactacacaacagaaaaatgaaatttgcgaaaacccaaggttcatcattgatggggcaaatcgaactgacatttgtcagggagagttaggtgactgctggtttcttgcagccattgcctgcctaacacttaaccagcatctgctgttcagagtgattccgcacgaccaaagctttatagaaaactatgcgggcatttttcatttccagttctggagatatggcgagtgggtggacgtagtgattgatgattgcctgcctacatacaacaatcagctggttttcactaagagcaaccaccgaaacgaattttggtcagcgcttcttgaaaaggcgtatgccaagctgcatggctcttacgaagcgctcaaaggaggcaacacaacagaagcaatggaagattttaccggtggtgtcgccgaattcttcgagattcgcgatgctccctccgacatgtacaaaataatgaagaaggccatcgagaggggatccctgatggggtgctcaattgatgacggaactaacatgacgtatggtacaagcccctccggcttgaatatgggcgagctgatcgcccggatggttcgcaatatggataacagtctgcttcaggacagcgacctagacccccggggcagtgacgagcggccaacaagaactattatccctgtgcaatacgagacgagaatggcatgcggattagtccgggggcacgcctactccgtcaccgggctggacgaggttccgttcaaaggcgaaaaggtaaaactggtcagactcagaaatccttgggggcaggtggagtggaatggcagctggtcggaccgatggaaggactggtctttcgtggataaggatgagaaagcccgtctacagcaccaggtgacggaggatggcgagttttggatgtcctatgaggatttcatatatcactttacaaagttggagatctgcaacttaacagctgacgctttgcagtctgacaagcttcagacgtggaccgtgtccgtgaatgagggtagatgggttcgtggctgctcagcaggagggtgtaggaacttccccgatacattctggacaaacccacagtacagactgaagttactcgaggaggacgacgaccccgatgattccgaggtcatatgcagcttcttagtggccctcatgcaaaagaacaggcggaaagaccgcaagctcggagccagcctgttcacaattggattcgccatttacgaggtacccaaagaaatgcatgggaataagcagcatctacagaaggatttttttctgtacaacgcctcgaaggcgcggagcaagacctatattaatatgagggaggtgagtcagagattcaggctgcctccatcagagtacgtcattgttccttcaacatacgagccacatcaggaaggagaattcatcctgcgagttttttctgaaaagcgcaacctttccgaggaagtggagaacactatctccgtggatcggcccgtccctattatctttgtctctgatagagcgaactctaacaaggagctcggcgtggatcaagagagcgaggagggtaagggaaagacatctccagataagcagaaacagtccccacagcctcagccaggaagctccgaccaggaaagcgaagagcagcaacagttccgcaacatatttaaacagatagctggcgatgacatggaaatttgcgctgatgagctgaagaaagtcctaaacaccgttgtaaacaaacacaaggatctaaagacgcacggcttcaccctggaaagctgtagaagtatgatcgctttgatggatacagacggttcagggaaactgaaccttcaggagttccaccacctgtggaataagataaaagcttggcagaagatctttaagcactacgacactgatcaatctgggacaataaatagctacgaaatgaggaatgctgtgaacgacgcaggatttcacttgaacaaccaactctacgacattattactatgcggtatgctgataagcacatgaatattgattttgacagcttcatctgttgcttcgtccggctcgaaggtatgtttcgggctttccatgcattcgataaagacggcgacgggattataaaactcaacgtgcttgaatggctgcaactgaccatgtatgcttag

SEQ ID NO: 110593 - DNA, 2448 bp, Artificial Sequence
  Description of Artificial Sequence: Synthetic coding sequence
atgccaactgtaatcagcgcaagcgtggcccctagaacagctgccgaacccaggagtcctggtccagtaccccacccagcccagagcaaagccactgaggcgggcggtggcaatcctagcgggatttacagtgctataatatctcgcaatttcccaatcatcggagtgaaggagaagacatttgagcaactccataaaaagtgccttgagaaaaaagtgctttatgttgaccccgaattccctccagacgagacgtcactgttttactcccagaaattccctatccagttcgtctggaagcgacctcccgagatctgcgagaaccctcgatttatcatcgacggcgccaacagaactgatatttgtcagggagaactgggagactgttggtttttggccgccattgcttgcctcacattaaatcagcacttattgttcagggtgatccctcatgaccagtcgttcattgagaattacgcagggatctttcattttcagttttggaggtatggagaatgggtcgatgttgtgatagatgattgtcttccaacatataacaaccagttggtctttacaaagtctaaccatcggaatgaattctggagcgctctcctagaaaaagcatatgccaagcttcatggctcgtatgaagctttaaaggggggcaatacaactgaggccatggaggactttaccggcggtgtggcagaattcttcgaaattcgagatgcaccttccgacatgtataagataatgaagaaggcgattgaacgtggctctctgatgggatgtagcatcgacgacggaaccaacatgacgtatgggacatctccgagcggactcaatatgggagaacttattgcccggatggttcgaaatatggacaatagcctgctccaggacagcgacctcgacccaaggggtagcgacgaacggccaactcggactatcatacccgtgcaatatgagacacggatggcttgtgggcttgtgcgtgggcacgcctactctgtaacaggcctggatgaagttccattcaaaggcgaaaaggtcaagcttgtgcggctcagaaacccttggggtcaagttgaatggaacggctcttggagtgacaggtggaaagactggtcattcgtggataaagacgaaaaggccaggctgcagcaccaagtgactgaagatggtgaattctggatgagctatgaggattttatttaccattttaccaaactcgaaatctgtaacttaactgcagacgcgcttcagtccgacaagctgcagacctggacagtttccgttaacgaaggccggtgggtgcgtgggtgttctgccggtggttgcagaaacttcccagacactttctggaccaaccctcaataccgcctgaagttgttggaggaggacgatgacccagatgactctgaagtgatttgttcattcctggtggcattaatgcaaaaaaatagaagaaaggatcgaaaactcggagcttccctgtttaccataggattcgccatttatgaagtcccgaaggagatgcatggcaataagcagcatttacagaaagatttttttttatacaatgcgtccaaggcccggtccaaaacgtacattaatatgcgcgaggtcagccagaggttccgactaccaccttctgagtacgtaatagtgccctcaacttacgagccacaccaggagggtgaattcatcctgagggtcttcagcgagaaaagaaaccttagtgaggaagtggagaacaccataagcgtggatcgacctgtaccaattatctttgtgagtgatcgcgccaacagcaacaaagaactcggcgtggaccaggagtccgaagagggcaaagggaagacaagccccgacaagcaaaaacagtccccccagccacaacctgggagttctgaccaggagtctgaggaacagcagcagtttcggaacatatttaagcagatcgcaggagacgatatggagatctgcgctgacgagcttaagaaggtcctcaacaccgtggtaaacaaacacaaggacttaaagactcacggatttactctcgaaagctgtagatccatgatcgcactgatggacaccgatgggtccgggaaactgaacttgcaggagtttcatcacctgtggaataaaatcaaagcatggcagaaaatctttaaacattacgacactgatcagagtgggacgattaattcctacgagatgaggaacgccgttaacgatgccgggtttcacttgaataaccagctgtacgacataatcactatgcgatatgctgataaacatatgaacattgatttcgattcctttatatgctgctttgttcggttagaaggtatgtttcgcgcctttcatgctttcgacaaggatggcgacggaatcatcaaactgaacgttctcgagtggctccagctcacaatgtacgcctag

SEQ ID NO: 110594 - DNA, 2466 bp, Artificial Sequence
  Description of Artificial Sequence: Synthetic coding sequence
atgcccacggtgatctcagcgagtgtggcccctcggacggccgcagaacctagatcacctggcccagtgccgcatccagcacaatccaaggcgacagaagcaggcggcggcaacccttccggaatatatagtgccatcatcagccggaatttccccattatcggggtaaaggagaaaacctttgagcagttgcacaaaaagtgcttagaaaagaaagtgctgtatgtcgacccagaatttccaccagacgagacctcactgttctatagccaaaaatttcccatccagtttgtgtggaagcggcccccggagatctgtgaaaatcctcggttcattatcgacggggccaataggactgacatctgtcaaggcgaactgggcgattgctggttcctggccgctatagcgtgcctgacgctgaatcagcacctactgttcagagtcatcccacacgaccagtcgtttatcgaaaactacgcgggtatcttccacttccaattctggcgctacggagaatgggttgacgtcgtgattgacgactgtctgcccacttataacaatcagctcgtttttaccaaaagcaaccatagaaacgagttctggtccgctctcttagagaaggcttatgctaaactgcatggaagctatgaggccctcaaaggcggcaataccaccgaggcgatggaagattttactggtggcgttgctgagttcttcgagattcgggacgccccctctgatatgtataagattatgaagaaggccatcgagaggggaagcttaatgggttgttccatcgacgatgggacaaacatgacatacggcactagtccctctggtctgaatatgggagagctgatcgctcgtatggttcgcaatatggataactcactactacaggactccgacctcgacccacgtgggagcgatgagcggcccacacggaccatcatccctgtgcaatacgaaacgcgaatggcttgtgggctggtccgcggccatgcttactcagtcaccgggcttgacgaagtgccttttaaaggagaaaaggtgaaattggttaggttacgcaatccctggggccaagtggaatggaacggttcatggtctgaccgttggaaggattggagttttgtggacaaggatgagaaggctaggctgcagcaccaagtcacagaggatggcgagttctggatgtcttacgaggatttcatttatcacttcacaaagctcgaaatctgtaacctgactgcagacgcgctgcagtcggacaaactccagacttggacagtcagtgtgaatgaaggtagatgggtgagaggctgctctgccggcgggtgtaggaacttcccagatactttttggaccaacccccagtatagacttaaattgctggaggaggacgacgatcccgacgatagtgaagtcatctgttcattcttggtggctttgatgcagaagaacaggcgcaaagatcggaaactgggtgctagcttgttcaccatcggattcgccatttacgaggttcccaaggagatgcacggtaataaacagcacttgcagaaggacttcttcctttacaatgcatcaaaggcgcgcagcaagacttacattaatatgcgtgaggtgtcacagcgatttcggttgcctccatctgagtatgtgatcgttcccagcacatatgagcctcatcaggagggagagttcatccttcgggtttttagcgagaagcgcaacctctcggaggaagtggagaacactatcagtgtggatagacctgttaaaaagaaaaagaccaaaccaattatcttcgtgagcgatcgtgcaaacagcaacaaagaactcggcgtggaccaggagtctgaggagggcaaaggcaagacatcccccgataagcagaagcagtcaccacagccacaacctggaagctctgaccaagagagtgaagagcagcagcagtttaggaatatctttaaacagattgccggcgatgatatggagatatgtgctgacgagcttaagaaagttctaaatacggtcgtgaataaacacaaagacctcaaaacacatggtttcactctcgagagttgtcgtagcatgatcgcattaatggacaccgacgggagcggtaaacttaacctccaggagtttcaccacctgtggaataaaattaaagcgtggcagaagatctttaaacactacgacacagaccagtccgggaccatcaattcctacgagatgcggaacgccgtcaacgatgccggctttcacttgaataatcagctctacgacatcatcacaatgcggtacgccgacaaacacatgaacattgactttgactcattcatttgctgttttgtcaggctagagggcatgtttagagctttccacgcctttgacaaggacggtgacgggattatcaaactgaatgtgctggagtggcttcagcttaccatgtacgcatag

SEQ ID NO: 110595 - DNA, 930 bp, Artificial Sequence
  Description of Artificial Sequence: Synthetic coding sequence
atgcacggcaataagcaacacctccagaaagacttcttcctttataacgcctctaaagcccgtagtaaaacctatattaacatgagggaagtgagtcagcggtttcggttgcccccttcagagtatgtcatcgtccccagcacttacgagcctcaccaggagggagaatttatactgcgcgtgttttcagaaaaaagaaacctgtcagaagaagtggagaacacaatatcagtcgatcgccctgtcaaaaaaaagaaaaccaagccaatcatctttgtgagcgatcgagccaattccaacaaagaactcggcgttgaccaagagtcagaggagggaaaggggaagacgtccccggacaaacagaagcaaagccctcagcctcagcccggctccagcgaccaagaatcagaggaacaacagcaattccgcaacatctttaagcaaattgccggggatgatatggaaatctgcgcggatgagttgaaaaaagtgctaaatacagtggtgaacaaacataaagatctcaagacccacggatttaccctggagagttgccgctccatgattgcgctgatggatacagacggctcgggtaagttgaacctccaggaattccatcacttgtggaataaaataaaagcatggcaaaagatcttcaaacattatgataccgatcagtctggtactattaactcttatgaaatgcgaaacgccgtgaatgacgccggctttcacctgaacaatcagttatacgatataattaccatgaggtacgctgacaagcacatgaatatagacttcgattcttttatttgctgttttgtccggctagaaggcatgtttagagctttccacgcatttgataaggatggtgatgggattattaagctgaacgtcctggaatggctgcagctgactatgtatgcctag

SEQ ID NO: 110596 - DNA, 471 bp, Artificial Sequence
  Description of Artificial Sequence: Synthetic coding sequence
atggagatatgtgccgacgaacttaagaaagtgctgaacacagtagtgaacaagcacaaagacctcaagacacacgggtttacccttgaaagttgccggtcaatgatagctctgatggatacagatgggagtggcaagctgaatctccaggagttccaccacctgtggaacaaaatcaaagcatggcagaaaattttcaagcattacgacacggatcagagtggcactataaattcttatgaaatgaggaatgcggtgaatgatgcaggcttccatctcaataaccaactctacgatataatcaccatgagatatgctgacaaacatatgaacatagatttcgactccttcatttgttgtttcgtgaggctcgaagggatgtttagggccttccacgcctttgataaggacggggacggaattattaaactgaacgtcctggagtggctccagttgacaatgtacgcctag

SEQ ID NO: 110597 - DNA, 1923 bp, Artificial Sequence
  Description of Artificial Sequence: Synthetic coding sequence
atgtttagttgcgtgaaaccctacgaggatcagaattactcagcgctgaggcgcgattgtcggcgccgtaaggtactgtttgaagatcctctgttccccgcaactgatgacagcctatattacaaggggacaccaggtcccgccgtgcggtggaagagaccgaagggaatttgcgaggatccccggctctttgtggacggaatttcctcccatgacctccatcaggggcaggtcgggaattgctggtttgttgcagcctgttctagcctcgctagtcgggaatctctctggcagaaggtgatccccgactggaaagaacaggaatgggacccagagaagcccaacgcctatgccgggattttccatttccacttctggagattcggggagtgggtcgacgtggttatcgacgacaggcttcccacagtcaataatcagctcatctactgccactctaattctcggaatgagttttggtgcgctctggttgagaaggcttacgccaaactggctgggtgctatcaggcacttgacggaggcaacactgccgatgccctggtcgacttcacggggggagtatcagagcccatcgacctgaccgaaggcgacttcgcaaatgatgagaccaaaaggaatcaactatttgaacgcatgcttaaggtccacagtagagggggacttatctccgcctccatcaaggctgtcactgcagccgacatggaagcacgtctggcctgcggactggtgaagggccatgcttacgccgttacagatgtgcgtaaagttagactgggacacggcctcctcgctttcttcaagagcgagaagctggacatgatccgactacggaatccctggggtgagcgtgaatggaacgggccatggtccgatacttctgaggagtggcagaaagtcagcaagagcgagagagagaagatgggcgttactgtgcaagacgatggcgagttttggatgacttttgaagatgtgtgtcgctactttaccgacataattaagtgcagagtgatcaacacgtcacatctttccatccacaaaacatgggaggaggcaagattacatggagcctggacacttcacgaggacccacggcagaatagaggcggggggtgtataaatcataaggacacattttttcagaatccccagtacatctttgaagtgaagaagcctgaggacgaagtccttatctgtatccagcagcgtccgaaaagaagcacccgacgcgagggcaagggggagaacctggcaatcggtttcgatatatacaaggttgaggagaacagacagtaccggatgcactctttgcagcacaaggccgcctcctccatctacatcaacagtcggagtgtgtttctaaggactgatcagccggaggggaggtatgtgatcatacctacaacctttgagcccggtcataccggggaattcctgctgagagtgttcactgacgtcccctccaactgccgtgaactaagactggatgaaccccctcatacgtgttggagctctttgtgcgggtatccccagctcgtcactcaggtccacgtgctgggggcagctggtcttaaagattcaccaactggcgcaaacagttacgtaatcatcaagtgcgaaggcgacaaagttcgatccgccgtccaaaagggtacttctacccccgagtataatgtgaaagggattttttatcgaaagaagctgagtcaacctataacggttcaagtgtggaatcaccgggtgctcaaagacgagttcctcggccaggtccacctgaaagccgaccccgacaatctgcaggcgctccacaccctacacctgagggacagaaacagccgccaaccctctaatcttccaggcactgtcgccgtgcacatcctgagttccacttcgttgatggctgtctag

SEQ ID NO: 110598 - DNA, 2043 bp, Artificial Sequence
  Description of Artificial Sequence: Synthetic coding sequence
atgtcctgcacaggcaccccgagctgcatctatttactatctgccctgtccttacaagatctagtgctggactgggagcctcgtggtgtgcccccccctcttccaggagcagcagcaactatgttttcttgtgtcaaaccatatgaagaccagaactactcagcgctgcggcgggattgtcgtaggcgtaaagtcctgttcgaagacccactgtttccggccactgatgactccctatactataaaggcacgcccggaccagcggtgaggtggaagagaccaaagggtatctgcgaggatcctcgactgtttgtggacggaatttcatctcacgacctgcaccagggacaagtgggcaactgctggtttgtggcggcctgctcctctctcgcatctagggagagtttgtggcagaaggtaatccctgactggaaggagcaggagtgggaccctgaaaagcctaacgcgtacgcaggaatttttcacttccacttctggcgcttcggcgagtgggtggacgtagtcatcgatgaccgactcccaactgtgaataaccaactgatctactgtcactccaattctcgcaacgaattctggtgcgccctcgtggaaaaggcctatgcaaaactggctggttgctaccaggcactggatggaggtaacactgccgatgccctcgtagatttcacaggaggtgtgagcgagccaatcgacctaactgagggagactttgcaaacgacgagactaagagaaatcagctgtttgaacgaatgctgaaggtgcatagtagggggggcctcataagtgcttcgattaaagctgtgacggccgcagacatggaggcaaggctggcgtgtgggcttgttaagggccacgcatacgctgtgacagatgtcagaaaggttcgcttgggtcacggcctgctcgctttttttaaaagtgagaagttagacatgattagattacggaatccctggggagagcgcgagtggaacgggccctggagcgatacttctgaggagtggcaaaaagtctcaaaatccgagcgagagaagatgggcgttactgtccaggacgacggtgaattctggatgacattcgaggacgtctgccgctactttaccgacatcattaaatgcagggtcattaataccagccatctgtccattcacaaaacgtgggaagaagcgcgcttacatggggcatggactcttcatgaggatccgcggcagaacagaggcggaggctgcatcaatcataaagatacttttttccaaaatccccagtatatttttgaggtaaagaagcctgaggatgaagtgctcatttgtatccaacagcggcccaagagaagcacacgaagagaggggaaaggcgagaacctggctatcggatttgacatctataaggtggaagagaacagacaatataggatgcacagcttgcaacacaaggctgcctcctcgatctatattaacagccgctcggtcttcctcaggaccgatcagccagagggacgctacgtgataattcctacaacattcgaacctggccacactggcgagtttctgctgagggtcttcaccgatgtgccatctaactgccgggaattgcggttagacgaacctccacatacctgctggtctagcctttgtggatacccgcagctcgtgacccaggtacacgttttgggggccgccggcctgaaggactctcccaccggtgcaaacagctacgtgattattaagtgcgagggagacaaagttagatctgccgttcagaaaggaacgagtacccctgagtataacgtgaaaggaatcttctataggaaaaagctaagccagcctattacagtccaggtgtggaatcatagggtcttaaaggatgagtttctcggtcaggtgcacctgaaggcggaccccgataacttgcaggcccttcatacactgcatttgagggaccgaaactccagacaaccgtccaacctccccggcacggtggccgtgcacatcttgagctccacaagccttatggcagtttag

SEQ ID NO: 110599 - DNA, 294 bp, Artificial Sequence
  Description of Artificial Sequence: Synthetic coding sequence
atgttttcctgcgttaagccatacgaagaccagaactatagcgcgctgagaagggattgcaggagacggaaagtcctgttcgaggaccccctatttcctgctacagatgacagcctgtactacaaagggacaccgggtcccgcagtgcgctggaaaaggccgaagggtatctgtgaagatcctaggctgttcgtggatggaatctcctcccacgatttgcaccaagggcaggtaggaaactgctggtttgtggccgcatgtagctctctagcctcccgggagtccttatggtag

SEQ ID NO: 110600 - DNA, 1923 bp, Artificial Sequence
  Description of Artificial Sequence: Synthetic coding sequence
atgttttcatgcgtgaagccatatgaggatcagaactattctgccctgcggcgcgactgtcgccggagaaaggtcttgttcgaagacccactgttcccagcaactgatgacagcctctattataaaggtacccctggcccagctgtgagatggaagcgaccaaagggcatctgtgaggatcctaggctgttcgtggacggcatcagttctcatgacctacaccaaggacaagttggcaactgctggtttgtggctgcctgcagtagcctcgctagcagagagagcctgtggcagaaagtgatccccgactggaaggagcaggaatgggaccccgagaagcccaacgcctatgccgggatattccacttccatttttggcgttttggggagtgggtcgacgtggtgattgacgacaggcttccaacagtgaacaaccagctgatttactgtcactcaaactccaggaatgagttttggtgtgcactggttgagaaagcgtatgccaagctcgcaggatgttaccaagctttagatgggggaaacaccgctgatgctctcgtggactttactggtggtgtctcagagccaatcgacctaacagaaggggatttcgctaatgacgagacaaagcgcaaccagctgtttgagcgaatgttgaaagtccattcccggggcggcctgatctctgcttcaataaaggccgtcacagctgcagacatggaagcacgcctcgcctgcggtctggtgaagggacacgcatatgcagtgaccgatgtgcgcaaggtgaggctgggccatggcctgctggcattctttaagtccgaaaaactggacatgatccgcttgcgaaatccttggggcgagcgagaatggaatggcccatggtcagacacgagtgaggaatggcagaaagtgtccaagagcgagagagaaaagatgggcgttaccgtgcaagatgatggagagttctggatgactttcgaggatgtgtgtagatacttcaccgatatcattaagtgccgcgtgatcaataccagccacttgtctatacacaaaacctgggaggaggcaaggctccacggagcctggacactgcacgaagacccacgacagaataggggcggaggctgcattaaccacaaggatacatttttccagaacccacaatatatttttgaggttaagaaaccagaagatgaagttttaatctgcatccagcagagacctaagcgtagcacccggagggaggggaaaggcgaaaacctggccatcggctttgatatttataaggtcgaggaaaacagacaatacaggatgcatagccttcagcataaggcagctagctcgatatacattaactctcgaagcgtgttcctaaggacagaccaaccagaggggcgctacgttatcatccctactaccttcgagcctgggcacacaggagagttcctgctccgagtctttaccgatgtcccctcaaactgccgcgagcttcgccttgatgagccaccacatacatgttggtccagtctgtgtggttaccctcagctcgtcactcaggtgcatgtgctgggtgcggccggactcaaggattctccgaccggggctaactcctacgtgatcataaagtgtgaaggcgacaaggttcggtccgcggttcaaaaggggacctccacgcccgaatacaacgtcaaaggaatcttctaccgtaagaagttaagccagcctatcacggtacaggtctggaatcaccgggttttgaaggacgaattcttggggcaggtacacctgaaggccgatcccgacaatctccaggccttgcacacactgcatctacgggatcgaaacagcaggcaacctagtaacctccctggcacagtcgctgtgcatattctttcgtcaacctctctcatggctgtgtag

SEQ ID NO: 110601 - DNA, 1674 bp, Artificial Sequence
  Description of Artificial Sequence: Synthetic coding sequence
atgttttcttgtgtgaaaccctatgaggatcaaaattattccgcactccgacgcgactgcagacggagaaaagtcctcttcgaggatccgctttttccagcgaccgatgactcactgtactataaaggcacccctggcccagcagtcaggtggaagcggccaaagtacagcggacattccttggcccctcacagacccggctggggtgacgcaagaaggatggagaatgtgcctcgacctggcagtagtgggtgcccctcctccagtttgcgggcacgagatctcggtatctgcgaagatccacgtctgttcgttgatggaattagttcccatgacttgcaccaaggccaggtgggtaactgctggttcgtagctgcatgttcctcattggcgagtcgtgagtcattatggcaaaaggtcatacccgattggaaagagcaagagtgggaccccgaaaaacctaacgcatacgctggaatatttcattttcatttttggcggtttggagagtgggttgacgtggtcatagacgatcgtctgccgaccgtgaataaccaactgatttactgccattcaaacagtcgaaacgaattctggtgcgcgcttgtggagaaggcctatgccaagctggcgggttgttatcaagccctggacgggggcaacactgccgatgcactggttgactttaccgggggcgtgagcgaacctatcgatctgaccgagggagacttcgccaatgacgaaaccaaacgcaatcaactgttcgagcgcatgctcaaggtccactctcgaggtggcctgatctcagcctcaataaaggcagtgaccgctgcggatatggaagctagactcgcttgtggactagtgaaaggccacgcatacgcagtcactgacgtacgaaaggtccggctcggtcacggcttgcttgccttttttaagtcagagaagctggacatgataagattaaggaacccgtggggtgaaagagaatggaatgggccttggtctgacacgtctgaggagtggcaaaaggtaagtaagtccgagcgggagaagatgggtgtcacagttcaggatgatggcgagttctggatgacgtttgaggatgtctgtaggtattttaccgatattatcaagtgccgtgtgatcaacaccagtcacctgagtatccataagacctgggaggaggcacgtctccatggagcctggaccctgcatgaggatcctcggcagaaccgcggagggggttgcattaaccacaaagatacttttttccagaatccgcagtatatctttgaggttaagaagcccgaagatgaagtcctcatttgtattcagcagaggccaaagcgaagcacgcgtagagaaggcaagggggaaaacctcgccattgggttcgacatttataaggtggaggagaacaggcagtatcgaatgcactccttgcagcacaaagcggcaagctcaatctatatcaactcaaggagtgtgttcctgcgcactgaccagcctgaaggacggtacgtcataattccgaccacttttgaaccaggccacacgggggagtttctgcttcgagtctttacagacgtccctagcaattgtcgcgagctccgcttggatgaaccccctcacacatgctggagctctctctgcggctatccacagtggtag

SEQ ID NO: 110602 - DNA, 2442 bp, Artificial Sequence
  Description of Artificial Sequence: Synthetic coding sequence
atggacgccacagctctggagagggacgcggtccagtttgcccggctcgccgttcagagggatcacgagggacgatattctgaagccgttttttactataaggaggccgcacaggctttgatctatgccgagatggctggaagttcacttgagaatatccaagagaagattaccgagtatctggagcgggtgcaggccctccacagcgccgtccagtctaagagtgcggacccattaaagagtaaacaccagttagacctcgaaagggctcatttcctggtgacacaagcctttgacgaggatgaaaaggaaaatgtcgaggatgccatcgaactctacaccgaggccgtggacctctgcttgaaaacctcatatgaaaccgccgataaggtgctgcagaacaagttgaagcagcttgctcggcaagccctcgacagagctgaagccctgagcgagccgctaacgaaacctgttgggaagatttccagcacctcagtgaaacccaagccccccccagtacgagcccattttcccctgggggcaaacccgttcttagagaggccacagtcatttattagcccccaatcctgtgatgcgcagggacagcgttacaccgccgaggaaatcgaggtgctgagaaccacctcaaagattaacgggatagagtacgttccgttcatgaatgtggacctgcgcgagcggtttgcttaccccatgccgttctgcgaccgatgggggaagttacctctgtcacccaaacagaaaaccacattcagcaaatgggttcggccagaagatttgacgaacaaccccacaatgatttacaccgtgtccagtttctccattaagcagactatagtatcggattgtagttttgtagcttcccttgcaatctcagcggcctacgagcgcaggttcaataagaaactaatcactggtatcatctacccacaaaacaaggacggagagccagagtataacccttgcggtaagtacatggtcaagctacacctgaatggtgtacccaggaaggttattatcgacgaccaattgccagtcgaccacaagggcgagctgctgtgttcctatagcaacaataagagtgaactctgggtgagtctgatcgagaaagcgtacatgaaggtgatgggcgggtatgatttccccggcagcaactcgaatattgatttacacgcgctcaccggatggatccctgaaagaatagctatgcactcagattcacagacattcagcaaagacaactcctttcgtatgctctatcaacgcttccataagggcgacgtgctgatcaccgcgtcgaccgggatgatgaccgaggcggaaggggagaaatgggggcttgtccccactcatgcatatgccgtcctagacattcgtgagtttaagggcctgcgattcattcagctgaagaacccctggtcccacttacggtggaaaggtaggtatagtgaaaacgatgttaaaaattggactcctgagctccaaaagtatctgaactttgacccacgcacagcgcagaaaattgacaacggcattttttggatttcttgggacgacttatgtcagtattacgacgtaatctacctctcctggaaccctggactgtttaaagaatcaacctgcattcactccacgtgggacgccaagcagggcccggttaaggatgcgtattctctggcaaataacccacagtataagctcgaagtgcaatgcccccagggaggcgcggctgtgtgggttctgctgtcgagacacataactgataaggacgacttcgctaataaccgagagtttattacgatggtcgtatacaagactgacggtaagaaggtgtactaccccgcagacccacccccgtatattgatgggattcgcatcaacagcccacattatctcactaagatcaagctgacaaccccaggaactcacacatttaccctcgttgtcagccaatatgaaaaacaaaatactatccattataccgttcgggtgtacagtgcctgcagtttcacattttccaaaattccctctccttacacactgagcaagcgcataaacggcaaatggtctggccagagtgcgggaggatgtggaaatttccaagaaacccacaaaaacaatccaatatatcagtttcacattgaaaaaacaggcccacttctgattgagcttcgaggtccacggcaatattcagttggtttcgaggtggtgacagtgagtactttgggcgatccagggccccatggctttctgaggaagtcaagcggcgactatcgatgtgggttctgctaccttgagttagaaaacataccctcaggaatcttcaacattattccctctaccttcctgcctaaacaagaaggcccctttttcttggacttcaacagcatcatccccatcaagataacacagctgcagtag

SEQ ID NO: 110603 - DNA, 2073 bp, Artificial Sequence
  Description of Artificial Sequence: Synthetic coding sequence
atgccttatctctaccgagcgcctggacctcaggcccacccagtacccaaggacgcacgtattacccactcaagcgggcagtcattcgagcagatgcgccaagagtgcctgcagcgtggcacactttttgaggacgcggatttcccggcgagcaatagttcactattttattcagagcggccccaaatcccattcgtttggaaacgcccaggcgagatcgtgaaaaatcccgaatttatcttggggggtgccactcggactgacatttgccaaggagagcttggcgactgctggctgctggccgcaatcgcaagcctgaccctcaatcagaaggcgctggctagggttatcccccaggaccagtcatttggaccaggctacgctggcatcttccattttcagttttggcagcactctgaatggctggacgtcgtgattgacgacagactgcccaccttccgcgataggcttgttttcttacactctgctgatcacaatgaattctggagcgcactcctggagaaggcgtacgctaaactgaacggtagctatgaggcactgaagggagggtccgccattgaggccatggaggactttacagggggcgtggcagaaactttccagactaaggaggcgccagaaaacttctatgagatcctggaaaaggcgcttaaaagagggtctctcctggggtgctttattgacactaggtcggccgcagagtcggaggcgagaaccccatttggcctaatcaaaggacatgcctactccgttacaggtattgaccaagtgagttttcgaggccaaagaatcgaactgattaggatacggaatccctggggacaggtggaatggaacggcagttggtccgactcctccccagagtggcggtcggtgggtcctgcggaacagaagaggctgtgtcacacagcattagatgatggagaattttggatggcctttaaagacttcaaggcccatttcgacaaggttgagatctgtaatttaacacctgacgcccttgaagaggatgcaattcacaaatgggaggtcaccgtacaccaaggctcttgggtgagaggctctaccgccgggggctgtaggaattttctcgatacattttggaccaacccacagattaagctttcactcactgaaaaggatgagggacaagaggagtgctcttttctggtagcactcatgcaaaaagataggagaaaactaaagcggtttggagccaacgtcctcacaatcgggtacgcaatatacgagtgtcctgataaggatgagcacctgaacaaagatttttttcgataccatgcttctcgtgcaaggtcgaagacttttattaatttaagggaggttagcgatcgcttcaagttaccacccggagaatacatcctgattccatctacattcgaacctcaccaggaggctgacttctgccttcgaatcttttctgaaaaaaaggccattacaagggacatggacggaaacgtagacatagacctccccgaacccccgaagcctaccccccccgaccaggagacagaggaggagcagcggtttcgagccttgttcgaacaggttgccggagaggacatggaggtcacagctgaggagctggaatacgtgttgaatgcagttcttcagaaaaaaaaagacattaaatttaagaagcttagcctgataagctgcaagaacattatatctctgatggacaccagtgggaacggcaagcttgaatttgatgaatttaaggtgttctgggacaaattgaaacagtggatcaatcttttcctcaggtttgatgcagataaatcaggcaccatgagcacttacgagctccgaactgctctcaaggcggccggtttccagctctcctcacacttgctacagctcatagttctcagatatgcagacgaagagttacaactggacttcgacgatttcctcaactgcttggttaggctagagaacgcctctagggtatttcaggctctgagcacaaaaaataaagaattcattcatctgaacataaatgagttcatccacctgacaatgaatatttag

SEQ ID NO: 110604 - DNA, 1995 bp, Artificial Sequence
  Description of Artificial Sequence: Synthetic coding sequence
atgccttatctctacagagctcctggccctcaggctcatccagtcccaaaggatgcccggataactcacagcagcggccaatcgttcgagcagatgagacaggagtgcctgcagcgcggtactttatttgaggatgctgattttccggcctccaactcttcattattttactcagagaggccacagatcccgttcgtatggaagcgccccggcgagattgtgaaaaaccccgagtttatcctcggaggcgctacaaggacagatatttgtcagggagagctgggtgactgttggctgctggcagccattgcaagcctcaccctcaatcagaaagccctggcacgtgtgatcccacaggaccagagttttggtcccggctacgctgggatctttcactttcaattctggcagcactcagagtggttggatgtagtgatcgacgatcgcctcccaactttcagggaccgactggtctttctgcatagtgccgaccacaacgagttttggagtgcccttctggagaaggcttatgccaaactgaatgggtcttatgaggctcttaagggcggatcggcaatcgaggcgatggaagatttcacaggcggcgtggccgagacatttcagactaaagaggcgcccgagaatttctacgaaattctggaaaaagcccttaagagaggttcactgctagggtgtttcattgatacgcgctcagcagccgaatctgaggccaggacaccgtttggtctgattaaaggccacgcttactccgtcactggaatcgaccaagtgtcatttagaggacaacggatagagttgatcagaatcagaaatccttggggccaggtggaatggaacgggtcgtggtctgatcgtatggcatttaaggatttcaaagcccacttcgacaaagttgagatctgcaacctgaccccagatgcgctggaagaggatgcaattcacaagtgggaggtgacagtgcaccagggttcttgggtcagagggagtactgcaggtgggtgtaggaacttcctggacactttttggacaaacccccaaattaaattatcgctgaccgagaaagatgaagggcaggaagagtgcagttttttggtcgcgctgatgcagaaggaccgccgcaaactaaaaagattcggggctaatgtgctgacgatcggatacgccatttatgagtgccccgacaaggatgaacacttgaataaggacttcttccgctaccatgcttccagggcccgcagcaaaacattcatcaacctcagagaagtgagcgaccggtttaagctgccacccggagagtacatcctcatcccaagcacctttgaaccccatcaggaagctgacttctgtttgcgaatcttcagcgagaagaaggccataacccgcgatatggacggcaatgtagacatcgaccttccggagccccctaagccgacaccacccgaccaggagaccgaagaggaacagcggttcagagctctttttgagcaggtggctggagaagatatggaggtgaccgccgaagaactcgaatacgtccttaacgctgtcctccagaaaaagaaagatattaaatttaaaaaactctccctgatttcatgcaaaaatataattagcctgatggacacatctggtaacgggaaactcgaattcgatgagttcaaagtgttttgggacaagcttaaacagtggatcaacttgttcttgagattcgacgctgataaatccggcactatgtccacttatgagttgaggacagcactgaaggctgccggcttccagctgtctagccatcttctgcagctgatcgtcctaaggtatgctgatgaggagctccagctggactttgatgactttctcaactgtctggtgcgcctggagaacgcttcccgggtgttccaagcactttctacgaagaacaaagagtttatccacttgaatatcaatgaatttatccatctgaccatgaacatttag

SEQ ID NO: 110605 - DNA, 1884 bp, Artificial Sequence
  Description of Artificial Sequence: Synthetic coding sequence
atgccctacttgtaccgtgcacccggaccacaagcacatccggtcccaaaggacgcaaggattacgcactctagcggccagagtttcgagcagatgcgccaggagtgcctgcaacgtggcactctctttgaagacgcagattttcccgcctcaaattcaagcctattctacagcgagcgacctcaaataccgtttgtgtggaaacggccgggcttttggcagcactctgagtggctggacgttgtgatcgatgatcgacttcctacattccgcgatcggttggtgttcctccactcagcggatcataacgaattttggtcagcgctgctggagaaggcgtacgcaaaactgaatggttcttatgaggctctgaagggcggctccgctattgaagcaatggaagacttcaccggcggcgtggccgaaacatttcagaccaaggaggcacctgagaatttttacgaaatactggagaaagcattgaagagaggctcactgctgggctgctttattgacactcgcagtgccgccgagtcggaagccaggactcccttcggtctgatcaaaggccatgcctattccgtcaccgggatagaccaggtcagttttaggggtcagcggatcgagcttatacggattagaaacccatgggggcaggtggagtggaacgggagctggagcgattctagccccgagtggaggtcggtagggccagctgaacagaaacgtctttgccatactgccctcgacgatggcgaattttggatggctttcaaggacttcaaggcacacttcgacaaggttgaaatctgcaacctgactccagatgctctggaggaagacgcgattcataaatgggaagtcaccgtccaccagggcagttgggtgcggggatccaccgctggcggctgcagaaacttcctggatactttctggacgaaccctcagattaagctcagtctgacggagaaagatgagggacaggaggaatgttcctttttggtggctctaatgcagaaggacaggagaaaactgaagcggttcggagcaaacgtactgacaattggatacgcgatctacgaatgcccggacaaggacgaacacctgaacaaggatttctttaggtaccatgccagtcgtgccaggtctaagacttttatcaacctgagggaggtatccgatcggtttaagcttccacctggagagtatattcttatcccctcaacatttgagcctcaccaggaagcagatttctgcctccggatcttctcagaaaaaaaagctattacccgtgatatggatggaaacgtggacatagatctccccgagcccccaaagcctacgcctcccgatcaggaaactgaagaggagcaacgattccgggcactgttcgagcaagtagcaggcgaggatatggaagtcacagctgaggaactggagtacgtgcttaacgccgtgttgcaaaagaagaaggacattaagtttaaaaagttgtctctcatctcctgtaaaaacatcatttcattgatggatacaagtggtaacggcaagcttgaatttgatgagttcaaagtattttgggacaagctgaagcagtggattaacctctttctgaggttcgatgcagataagtcaggcacaatgtctacatatgagcttcgcacagcactgaaagccgctggtttccaattatctagccatttgctgcagttaatcgtattgcggtacgccgacgaggagcttcagctcgatttcgatgatttcctgaactgtcttgtgcgacttgaaaacgcaagtagagtgtttcaggctttgtcgacaaagaacaaggaattcattcacctgaatatcaacgaatttattcatctgactatgaatatctag

SEQ ID NO: 110606 - DNA, 807 bp, Artificial Sequence
  Description of Artificial Sequence: Synthetic coding sequence
atgtttctagtgaattcctttctgaaggggggaggtggcggcggaggcggcgggggaggactcggcggtgggttggggaacgtcctgggcggactgatttcaggagccggcggcggaggcggaggtgggggcgggggcggcggcgggggcggcggcggcggcggcggcaccgccatgagaatcctcgggggagtgatatcagctatttctgaggctgcagcccagtataatcccgagcctcctccacctcggacccattatagcaatattgaggccaacgagtcagaagaagtccgccaatttagacgactgtttgcccagctcgccggcgatgatatggaagtgtcagcaaccgagctcatgaatattttgaacaaggtggttacaagacaccccgatctgaagaccgacggttttggtattgacacctgccgcagcatggtggctgtgatggattccgacacaacgggcaaactcggtttcgaggaatttaaatacctgtggaacaatattaagagatggcaggcaatttacaagcaattcgacacagatcggagtggaaccatctgcagctcggaactgcccggggcctttgaggcagctggcttccatttaaacgaacatctgtacaacatgatcattagaaggtatagcgacgagagcggaaacatggactttgacaacttcatcagctgtttggttaggttggacgctatgttccgggcattcaagtcactggataaagacggaaccggacaaatacaggtcaatattcaggagtggctgcagttgaccatgtactcctag

SEQ ID NO: 110607 - DNA, 2061 bp, Artificial Sequence
  Description of Artificial Sequence: Synthetic coding sequence
atgaaccccaccgagaccaaggccgtcaagacagagcctgaaaagaaaagccagtctactaagctcagcgtggtccatgaaaaaaagtcacaggaggggaagcctaaggaacacactgagcctaaatcgctcccaaaacaggcctctgatacagggagcaatgacgcccacaacaaaaaggctgtgtcccgctccgccgagcagcagcctagcgagaagtccaccgagcccaagaccaaaccacaggacatgatctccgccggcggagaaagtgtggccggaattacagcgatatcaggtaagccaggcgacaagaagaaagagaagaaaagcctaaccccagccgtccctgtggaaagcaaacctgacaaaccatccggcaaaagcggaatggatgctgccctggatgatctcatcgacacactcggcggtccagaggaaacggaagaggagaatacaacatacaccgggccagaggtgagcgacccaatgagcagtacttatattgaggaactcgggaagcgcgaggtgactatccctcctaagtacagagaacttctggcgaagaaggaaggcatcacggggccaccggcagacagtagcaagcctattggacctgacgacgccatcgatgccctcagcagcgacttcacatgcggaagccctacagctgccggcaagaagaccgaaaaagaggaaagcactgaggtccttaaggcacaatctgctgggacagttcgcagcgctgcacctcctcaggagaaaaagaggaaggtcgaaaaggacaccatgagcgatcaagcccttgaggccttatccgctagcctcggcaccaggcaagcagagccagaactcgatctgcgcagcatcaaagaggtggacgaagcaaaagccaaagaagaaaaactcgaaaaatgcggcgaagatgacgagactataccaagcgagtaccggctgaaacctgctactgataaagacggcaagcctttgcttcccgaacccgaagagaagcccaaacccagaagtgaaagcgagctcatcgacgaattatcagaagatttcgatcgcagtgagtgcaaggaaaaaccttctaagccgaccgaaaagacagaagaaagcaaagcagctgcgcctgcaccggtcagcgaagccgtctgtagaacatccatgtgtagtatccagtctgctccccccgagcctgctactctgaaggggaccgtccctgacgacgccgtagaggccttagcagactctctaggcaaaaaagaagcagacccagaggatggtaaacctgtcatggacaaagtaaaggaaaaggccaaagaggaggaccgcgaaaagctgggggaaaaagaagagacaatccctccagattacagattagaggaggtgaaggataaagatgggaagccgctgttacctaaagaatcaaaggaacaactcccccccatgtccgaagacttcctcctagatgcccttagcgaggatttctcaggtcctcagaacgcttcgagtctgaagttcgaagatgccaaattagctgccgctattagcgaggtggtcagccagacaccagcctctacaacacaggctggcgctcctcctcgtgatacctcacagtccgataaggacctggacgatgctcttgacaaattgagtgattcactgggtcagagacaacccgacccagacgaaaataagcctatggaggataaggtcaaggagaaggcaaaggccgagcatcgggataagttgggggagagagacgacactattccaccggaataccggcaccttctggatgataacgggcaagacaaacctgttaaacccccaaccaagaaatccgaagacagcaaaaagccagcagacgaccaagacccgatagatgctctctccggtgatttggacagttgtccttctacgacagagacaagtcagaacaccgccaaagacaagtgcaaaaaagctgcatcttccagtaaggctcccaaaaatgggggtaaagccaaagattccgcaaagaccaccgaggaaactagcaagccaaaggatgactag

SEQ ID NO: 110608 - DNA, 2271 bp, Artificial Sequence
  Description of Artificial Sequence: Synthetic coding sequence
atgtctcagcctggccagaaaccagcagccagcccacgcccccgccgggctgctgcagctaggaggacccatgaacacgtgagcgagaagactagcgagtccccaagcaaacccggcgagaagaagggcagtgacgagaaaaaagctgcctcactgggatctagtcaatcatcccggacatatgctggtgggaccgctagtgccacgaaggttagcgcaagctcgggcgctacaagtaagtcctcttctatgaacccaacagaaactaaggccgtgaaaaccgagccagagaaaaaatctcaatctacaaagctcagcgtcgtgcatgagaagaaaagccaggagggaaaacctaaagagcacaccgagcctaagtccttgcctaagcaggccagtgacaccggtagcaacgatgctcataataaaaaggcagtctcaagatcggctgaacagcagccgagtgagaagagcacagaacccaaaactaagccacaagacatgatttccgctgggggcgagtccgttgcagggatcacggccatctccggaaagcctggagataagaaaaaagagaaaaagtctctgacaccggcggtgcccgtggaaagtaagcccgataaaccatctggtaaatcaggcatggacgcagccttagacgatctgatcgacacacttggcggtccagaagaaactgaagaagagaacacaacatacacaggcccagaggtgagtgaccctatgtccagtacctacattgaagagcttggaaagagggaagtcaccattcctcccaagtatagagaattgcttgcaaaacccatcggtccggacgatgctatcgatgcactctcgtcagattttacatgtggatctccgacagctgcaggcaaaaaaaccgaaaaagaagagagtacagaggtgctgaaagcccaatctgccgggacggtgaggtccgcagcaccacctcaggagaagaaaagaaaggtggagaaggataccatgagcgaccaagcactggaagccctgtctgctagcttggggacaaggcaggccgagccagaacttgatctgagatcaatcaaagaggttgacgaagccaaagccaaggaagaaaagctggaaaagtgtggggaggacgacgagaccatcccctctgagtataggctgaagcccgcgaccgacaaagacggaaagcccctgctccccgagcctgaagagaagccaaagccccgctctgaaagcgagttgatagatgagctaagcgaagacttcgatcggtcagagtgcaaggagaaaccttcgaagcccactgagaaaacggaagagtccaaggctgctgcgcctgcacctgtgagcgaagctgtttgcaggacgagcatgtgcagcattcagtccgcacctcctgagcccgccaccctcaagggcaccgtgcccgacgacgcagtggaggcactcgctgatagccttggaaaaaaggaggccgacccagaagacggaaaaccggtgatggataaagtgaaggagaaggccaaggaggaagacagagagaaactaggcgaaaaggaggagacaataccacccgactataggctagaggaagtcaaagataaggatggcaaaccgctgctgcccaaagagagcaaggagcagctccctcccatgagtgaggactttctgctggatgctctatccgaagatttttcaggcccccagaatgcgagctctctgaagtttgaggacgcgaaactcgcagctgccatctccgaggtagttagccagaccccggccagcactacccaggcaggagcccctccccgagacacttcacagagtgataaagacctggacgacgcacttgataagctctcagattccttgggccagaggcagcccgaccctgatgagaacaagcctatggaagataaagtgaaggagaaggccaaagcagaacatagagacaagcttggggagagggatgacacaattccccccgaataccgccatttgctggacgataacggtcaggataagcctgtcaagccacctaccaagaagagcgaagatagcaagaagcccgccgatgaccaagacccgattgacgcactgtccggtgatttggattcttgtcccagcacaacagagaccagccagaatactgcaaaggataaatgcaagaaagccgcttcatcttcaaaggcgccaaagaatggtggcaaggcaaaagattctgcaaaaaccaccgaagaaacgtcgaaacctaaggacgactag

SEQ ID NO: 110609 - DNA, 2088 bp, Artificial Sequence
  Description of Artificial Sequence: Synthetic coding sequence
atgaacccaaccgaaactaaggccatccctgtgtcccaacagatggaagggccacatctacccaataaaaaaaaacacaagaagcaggccgtcaaaacggagcccgaaaagaaaagccagtccaccaaactgtccgttgtacacgaaaagaaatctcaggaaggcaagcctaaggagcatacagagcctaagtccctgcccaagcaggcctccgatacgggatccaatgacgctcataacaaaaaggcagtgtcccgatctgctgaacagcagcctagcgaaaaatctacagaacccaaaacaaagccccaggacatgattagtgctggaggggagtctgtggcaggcattacggcaatttccggtaagcctggggataaaaagaaagagaaaaagagcctgacccccgccgttccggtggagtccaagcccgacaagccttctggtaagagcggcatggatgccgcgctcgatgacctaatcgacacactgggtggccctgaggagacagaagaagagaacacaacatatactggccccgaagtgtccgaccccatgtccagcacctacatcgaggagttaggcaaaagggaggtgacaatccctccaaagtatcgcgagctgctggcgaaaccaattgggcccgacgacgcaatcgacgctctctcaagcgatttcacatgtggaagccccaccgccgcaggcaagaagactgagaaggaggaatctactgaagtcctgaaagcccagagtgccggaacagtaagatcagcagctccaccccaggagaaaaaacgaaaggttgagaaggacacaatgtccgatcaggccttggaagccttatctgcgagtctcgggactcggcaggcggagcccgagctcgatttgcgctccataaaggaagtggatgaggccaaggccaaggaagaaaagctggaaaagtgtggcgaggacgatgaaaccattccttccgagtatcgcttaaaacccgccaccgacaaagacggcaaaccgctgctcccggaacctgaggaaaagccaaagccacgcagtgagagcgagctcatcgatgaactgagtgaagacttcgaccgcagtgagtgcaaggagaagcctagtaagcccaccgagaagactgaggaatccaaggccgctgctcctgccccggttagcgaagccgtgtgccggacttctatgtgtagcatccaaagcgctccaccggagcctgctacattgaaaggaaccgtgccggacgacgctgtcgaagccctcgctgattcactggggaagaaggaagctgatcctgaggacgggaagccagtgatggataaagtgaaggagaaggccaaagaagaggaccgcgaaaagttgggggaaaaggaggaaaccatcccacctgattatcgtttagaggaagttaaagataaggatggtaaacccctcttgcctaaggaatcaaaggaacagcttcccccgatgtcggaggatttccttctcgacgcgctgtctgaagacttttctggaccccagaatgcctccagcctaaagttcgaggatgccaagttggctgccgctatctctgaggttgtgtcacagactcccgcttccactactcaagccggagcaccacctcgagacacctcgcagagcgacaaggatctggatgatgccttagataagctctctgatagcctcggccagcgacagccagaccctgacgaaaataaacctatggaagataaggtgaaggaaaaagccaaagcggagcatagagacaagttaggcgaacgtgacgatactattccaccagaataccgccatctgcttgatgacaatggacaggacaagcctgttaaacccccaactaaaaagtccgaggattccaagaagcccgccgatgatcaagatcctattgacgcactcagcggtgacttagactcctgccccagcaccaccgagacctctcagaatactgcaaaagataagtgtaagaaagccgcttcgtcatctaaggccccaaagaacgggggcaaggccaaagacagtgcaaagaccactgaagagactagcaagcccaaagacgattag

SEQ ID NO: 110610 - DNA, 2127 bp, Artificial Sequence
  Description of Artificial Sequence: Synthetic coding sequence
atgaatcccactgagactaaagccatccccgtgtcacagcagatggagggaccgcacctgcccaataaaaaaaaacataaaaaacaggccgtaaagaccgaaccagaaaagaagtcacagtctacgaagctgagcgtggtgcacgagaagaaaagccaggagggcaaaccaaaagagcacaccgaaccaaagagtctacccaagcaggccagcgatactgggagcaacgacgcgcataacaaaaaggcagtgtccagatctgcggagcagcaaccctcggaaaaatccaccgagccaaagaccaagccccaggatatgatttccgctggaggggagtcagtcgccggcatcaccgccatttcgggaaagccaggggataagaagaaagagaaaaaatccttaacgcccgcagtgcccgtggagagcaagcctgacaagccgagcgggaagtcaggaatggatgcagctctggacgacctcattgacacactaggagggcccgaagaaactgaggaagaaaacactacctacactggaccggaggtaagcgaccccatgagttctacctatatagaggaacttggcaagagggaagtgacaataccacctaaatacagggagctgctggcaaagaaagaaggtattactggaccccccgccgatagttcaaagccgattggacccgatgatgctatcgacgcgctttctagtgatttcacctgcggatctcccactgctgcaggcaaaaagacagagaaagaggaatctaccgaagtgctgaaggcacagtccgcggggacagtgcggtctgccgctccaccccaggagaagaaacgcaaggtcgagaaggacacaatgagcgaccaagccctcgaggccttatcagctagcctcgggaccaggcaagcagagcccgagctggacctgcgctctatcaaagaagtggacgaagcaaaagccaaagaggagaaactcgagaagtgtggggaggacgatgaaacaattccttctgaatatagacttaagccagctaccgacaaggatggaaagcccttactgcctgaacccgaagagaaacctaaaccaaggtcagaaagcgagctcatcgacgaactatccgaagacttcgataggagtgagtgcaaggagaagcccagcaaaccaaccgaaaaaactgaggagtccaaggcagccgcccccgctcctgtgtcagaggccgtatgtcggacatctatgtgtagtatccagtctgcccctccagagcccgctaccctcaagggaacagtgcccgacgatgcagtcgaagctctggcggatagcctcggaaagaaggaggccgaccccgaagacggcaagcctgtcatggataaggttaaggaaaaggccaaggaggaggaccgcgagaaattgggagagaaagaggagacaattccaccagactacaggttggaagaagtcaaggataaagatggcaaacccctccttccaaaagagagtaaggaacagctgccaccaatgtctgaagacttccttctcgacgcactatccgaggacttcagcggaccacagaacgcaagctccctgaaatttgaggacgccaaattggcggccgctatcagtgaggtggtgtcccaaacgccggcttccactacccaggcaggggcccccccacgagatacctctcagagcgataaagatcttgacgacgctcttgacaagctctcagattccctgggccaaaggcagcccgaccctgacgagaacaagcccatggaggataaagtgaaagagaaagccaaggccgaacaccgggacaagttgggagaacgcgacgacactattccaccagagtacaggcatctgctcgatgacaacgggcaggacaaaccggttaaaccacctaccaaaaaaagtgaagatagcaagaagcccgctgatgatcaggaccctatagatgccctctcgggcgacctggactcgtgtccaagcaccactgaaacctcccaaaacaccgctaaggacaaatgtaaaaaagcggcatccagtagcaaggctcccaagaatggtggcaaagctaaggatagcgcgaagaccaccgaagagacctccaaaccgaaagacgactag

SEQ ID NO: 110611 - DNA, 2319 bp, Artificial Sequence
  Description of Artificial Sequence: Synthetic coding sequence
atgtcgcagccaggccagaaaccagcagcctctcccaggcccagacgtgcggcggccgcacgccggacccacgagcacgtgagcgagaagacaagcgagtctccctccaaacccggcgaaaagaagggcagtgatgaaaaaaaagcagccagccttgggtccagtcagtcaagccggacatatgccggaggaacagcatccgccacgaaagtgtcagcatcttccggagccacttccaagagtagcagtatgaacccaactgagaccaaggcaatccccgtgtcccagcagatggagggaccacacttgccaaataaaaagaagcacaaaaagcaggcggtgaagacagaaccagagaagaagtcccagtccaccaagcccaagagtctaccaaagcaggcctccgatacaggttccaacgacgcccataataaaaaagccgtttcgaggtctgccgaacaacagccctccgaaaaatctacagagcccaagaccaagccccaagacatgatctccgctggcggcgagagcgtcgcgggaatcacagcaatctcagggaagccaggggataagaagaaggagaaaaagtcactcactcccgccgtgccagtggaaagcaagcctgataagcccagcggcaagagtggaatggacgccgcactcgacgatctcatcgataccctgggaggcccagaggaaaccgaagaggagaacaccacttatactggcccagaggtgtctgatcctatgtcaagcacatacatcgaggaactcggcaagcgcgaggtcacaatccccccaaagtaccgggaactccttgcgaaaaaagaagggatcacaggcccacctgctgattcttccaagcctattggaccggatgacgcgattgacgctctgagttccgatttcacctgcggaagtcccacggccgcagggaagaagacagagaaagaagagtccacagaagtactgaaggctcaatccgctgggaccgtgcggtccgcagccccaccacaggagaagaagaggaaagttgaaaaagacactatgtcagaccaggccctggaggcattgagtgctagcctggggacgaggcaggccgagccagaactggatctcaggtcgatcaaagaggtcgatgaggcgaaggcaaaagaggagaaactggagaagtgtggggaggatgatgaaacaatccccagcgaatatcgacttaaaccagcaaccgataaagacgggaagcccctgctgcctgagcccgaagagaagcctaagccccgcagtgagtctgaattaatcgatgagctgagtgaggattttgacaggagcgaatgtaaagaaaaaccctcgaagcccaccgagaaaaccgaggaatccaaagctgctgctcccgcccccgtcagcgaagcggtatgccgaactagcatgtgttccattcagagcgcccccccagaacccgcaacgctgaagggaacagtcccggatgacgccgtggaagcactggcagactctttggggaaaaaggaggctgatcccgaggatggtaagcctgtcatggataaagtcaaggaaaaagcaaaggaagaggatagggagaagctgggcgaaaaggaagagacgattccccccgattatcgactggaggaagttaaagacaaggacggaaagccccttcttccgaaagagagtaaagaacaactgcctcccatgagcgaagatttcttgctcgatgcgttgagcgaggatttttccggacctcagaacgcatccagcttgaagttcgaggacgcaaaactggccgccgccatctccgaagtggtgtcccagacgcctgcctccactacacaggccggcgctcctccgagggacactagtcagtccgataaagacctcgacgacgccctcgataagttgtctgactctcttgggcagcgacaaccagacccagatgagaataaaccaatggaagacaaggtcaaagaaaaagcgaaagctgagcatcgggacaagctgggcgaaagggatgacacgattccacctgagtatcgccacctgctagatgacaatggacaggataagccagtcaagccccccacaaaaaagagcgaagattcaaagaaaccagctgacgatcaggatcccatagatgcgctgagcggcgatctggattcctgtccaagcactaccgagacatcccagaacacagcaaaggacaaatgtaaaaaagcagcctcttcatcgaaagccccaaaaaatggaggtaaagcaaaggacagcgcaaagaccacagaagagacatctaagccaaaagatgattag

SEQ ID NO: 110612 - DNA, 2376 bp, Artificial Sequence
  Description of Artificial Sequence: Synthetic coding sequence
atgtcccagcccggtcagaagcctgctgcatctcctaggccccgacgagctgcagctgccagacgcactcacgaacacgttagtgagaagacaagtgaatctcctagtaagcctggggagaagaaaggaagcgatgaaaagaaagctgcctctctgggctctagtcagtcctcccgcacttacgctggtgggactgcctccgcaaccaaagtgtccgcatcttcaggtgccacatctaagagttccagtatgaacccaactgaaacaaaagccatacccgtgtcccaacagatggaagggcctcatttgcctaacaaaaagaagcacaagaagcaggccgtcaagaccgaaccagagaagaagagtcagagcacaaaattatcggtagttcacgaaaaaaaaagccaggaaggaaaacctaaggagcacaccgaacctaagtccctccctaagcaggctagtgatactggttcaaatgatgcacacaacaaaaaagctgtaagtcgtagcgcggagcaacagccttctgagaaatcaactgaacccaaaaccaagcctcaggatatgatttctgctggaggtgagtctgtggccgggatcactgctatttcaggaaaaccgggggacaagaaaaaagaaaagaagagtttgactccagccgtgccagtcgaatcgaaacccgataagccttctggaaagagtgggatggacgccgcactagatgaccttatcgataccctggggggccccgaagagacagaagaagaaaatacgacatacacgggtcctgaagtctcggaccccatgagcagcacttacatcgaggagttgggtaaaagagaagtgactataccacccaagtaccgtgaactactggccaagaaggagggcatcacaggcccacctgctgacagttcgaaacctattggtcccgacgacgccatcgacgccctgagcagcgatttcacatgtggctctccaactgctgcaggtaaaaaaaccgaaaaggaggaatccaccgaggttctcaaggcgcagagcgctggcaccgtccggtccgctgccccccctcaagagaagaagagaaaggtcgagaaggacacaatgtcagatcaagctctggaagcactgtccgccagcctgggcactcggcaggccgaacccgagcttgacctcaggtcaatcaaggaggtggatgaagcaaaagctaaagaagagaagctggaaaagtgtggggaggacgacgagaccatccccagcgaataccgcttaaagcccgccacagataaagacggcaagcccctgttacccgaacctgaagaaaagcccaagccgaggagcgagtccgaattaatcgatgaactgtcagaggattttgatcggagcgagtgcaaagagaagccgtccaaaccaacggaaaaaacagaagagagcaaggcagccgcccctgcaccagtgagcgaagcagtgtgccgtacaagcatgtgctcaatacagtctgctccacccgagcctgcgactctgaagggaactgtgcctgatgatgccgtagaggccctagccgacagtttgggaaaaaaggaggccgatccggaagatggaaaacccgtcatggacaaggtgaaagagaaagctaaagaggaagatagagagaagctcggagagaaggaagaaaccataccccctgactatagattagaagaagtgaaagacaaggacgggaagcccctgctccctaaggagagcaaggagcagcttcccccaatgtcagaagacttcttattggacgctctctctgaggactttagtgggccgcagaacgcaagctccctgaagttcgaagatgccaaactcgccgccgctattagtgaggtcgtaagccagacccctgcttctacgacccaggccggtgctccaccgagagatacgtcccagtccgacaaagatctagatgacgcacttgacaaactgagcgactccctcggtcagaggcagccggatcccgatgagaataaaccaatggaagataaggtgaaagagaaggccaaggcagagcacagagataagctgggggaacgggatgacacaatcccccctgaataccgccatctgctcgacgacaacggccaggataagccagtcaagcccccaacaaaaaagtccgaagactcaaaaaaacccgcggacgatcaggacccaatcgacgcactttccggcgatctagattcttgccctagtacgaccgagacgagccagaacactgctaaggacaagtgcaagaaagcagcatcttccagcaaggccccgaaaaatgggggcaaagcgaaggactcagccaaaacaaccgaggagaccagcaaaccaaaggatgattag

SEQ ID NO: 110613 - DNA, 2265 bp, Artificial Sequence
  Description of Artificial Sequence: Synthetic coding sequence
atggcattcgccagctggtggtacaagacccacgtgagcgagaaaacgtccgaatccccctctaaacccggtgagaagaaaggctccgacgagaagaaggctgccagcctcgggtcctctcagagctccaggacctatgctggcggaaccgcctcggctaccaaggtgtctgcctctagtggggccacatcgaagagcagttccatgaatccaactgagactaaagccgtgaagacggaaccagagaagaaaagtcagtccaccaagctcagcgtcgtacacgaaaagaagagccaggaagggaagcccaaagagcacactgagccaaagtcccttcctaagcaggccagcgacactggaagtaacgatgctcataataaaaaggctgtttcccggagcgccgaacagcagccatccgagaagtcaacagagcctaagaccaaaccccaggacatgataagcgctgggggcgagtcagtggctggcattaccgctattagcggaaagccaggcgataaaaaaaaggaaaagaagtcactgacacccgccgtacccgttgagagcaagccagataaaccctctgggaagtcagggatggatgccgctctggatgacctgatagacaccctgggaggccccgaagagacagaggaagaaaatacaacttacaccggacccgaggttagtgacccaatgtcctccacctatattgaggagctcggcaagcgggaagtgacaatcccgccgaagtatcgcgagctgttagcaaagaaggaaggcataaccgggccccctgccgatagctctaagcctattggtcctgatgacgccatagacgccctgtcatccgatttcacctgcggttcccccactgccgcaggaaaaaagactgaaaaagaagaaagtaccgaggtgctgaaagcccagtcagccggtactgtgaggtccgccgctcccccccaggagaaaaagcgcaaggttgagaaagataccatgagcgaccaggccctggaggcgctttcagctagcctgggtacccgccaggccgaacctgagctggatctgcgatcaatcaaagaggtggatgaagctaaggctaaagaggagaaactagagaagtgcggcgaggacgacgagactatccccagcgagtatcggttgaagcccgcgaccgacaaagacgggaaaccgctgttacccgaacctgaagagaagccaaaaccacgttccgagtcagagctgattgacgagctgtctgaggacttcgataggtcagagtgcaaggagaagccttccaagccaaccgagaaaaccgaggaatcaaaggccgccgcgcctgcccccgtgtcagaggccgtctgccgtaccagcatgtgtagcatccagtctgcccctcccgaaccagcaacccttaagggaactgtgcctgacgacgcagttgaggccctagctgacagcctggggaagaaagaggctgaccccgaggatggcaagccagtgatggataaggtgaaagagaaggccaaggaagaggaccgagaaaagctcggtgagaaagaggagaccattccacccgactacaggcttgaggaggtcaaggacaaggacgggaaaccacttcttccaaaggagagcaaggagcaactcccaccgatgagtgaagatttccttctcgacgcactgagtgaagacttctctggtccacagaatgcaagctcactgaaattcgaggatgcaaagctggcagcggccatttctgaagtggtctcacaaacccccgcatctaccacacaggccggcgccccacccagagacacctcccagagtgacaaagacctcgatgatgcattggataagctgagcgactcattaggacagcggcagcccgatcctgacgagaacaaacctatggaagataaggtaaaggagaaggccaaggcagaacatcgcgataaactcggcgagcgcgacgacaccataccccccgagtaccgccatctcttagatgacaatgggcaagataaaccggtcaagcctccaactaagaagtctgaggactcaaaaaagcccgccgacgaccaggatcccattgacgccctgtctggagacctcgatagttgtccttccactacggagacctcccagaatactgcaaaggacaaatgcaaaaaggcagcaagtagttctaaagcacccaaaaatggaggtaaggctaaagatagcgcgaagaccaccgaagaaacttctaaaccaaaggacgattag

SEQ ID NO: 110614 - DNA, 2376 bp, Artificial Sequence
  Description of Artificial Sequence: Synthetic coding sequence
atgtcacaacccggacagaaacccgctgctagccctagaccccgtagagccgccgcagcaagacgaactcatgagcacgtttccgagaaaacttcagaatcccctagcaaacccggcgagaaaaagggatcagacgaaaagaaggccgcatccctgggatcctcacagagttctcgaacttatgctggcggaactgccagcgcaaccaaagtgtccgcttcatcaggggcaacctccaagtcctcgagcatgaaccccaccgagaccaaggcgatccctgtctcccagcaaatggaaggaccacacctgcccaataagaagaaacacaagaaacaggctgtgaagacagaacctgagaaaaagtctcaatccacaaagctttctgttgtgcatgaaaagaagagccaggaagggaagcccaaggagcatactgagccgaaatccctgcctaagcaggcctctgacacgggctcaaatgacgcacacaataagaaggctgtgagtagatccgccgagcagcaaccttcagaaaagagcaccgagcctaagaccaagccccaggatatgatttctgccggtggtgaaagtgtcgcggggattacagctatctcgggaaaacccggggataagaagaaagaaaaaaagagccttacacccgccgtacccgtggagagcaaaccagataagccaagcggtaaaagtggtatggatgccgccctcgacgacctaattgataccctgggtggccctgaggagaccgaggaggagaataccacatacaccgggccagaggtcagcgatccgatgagcagtacctacattgaagaactcgggaaaagagaggtcaccattccacctaaatatagggagcttctggctaaaaaagaggggatcactggtccaccagctgacagttccaagccgatagggcctgacgatgccatagatgccctcagttctgatttcacttgcggcagccccaccgccgcagggaaaaagactgaaaaggaagagagcacagaagttctgaaggctcaaagtgcaggtactgtgcggtccgcagccccccctcaagagaaaaagcgcaaggttgagaaagatacaatgtcagaccaagcattggaagctctcagtgcatctctaggaactcgccaggccgaacccgaactggatctaaggtccatcaaggaagttgacgaagccaaggcaaaggaagaaaagctggagaagtgcggcgaagatgatgaaacaatccccagcgagtaccgtctaaagccagccacagataaggacggcaagccactcctaccagagccggaagagaagcccaagcccagatctgagtctgaattaatcgatgaactctccgaggatttcgaccgcagcgaatgcaaagaaaagcccagcaagccaaccgagaaaacagaagaaagcaaggccgcagctcctgcacccgtttccgaagctgtttgccgtacaagtatgtgctctatacagtctgcaccgcctgagccagcgaccctgaaaggaaccgtgccagacgacgcagtcgaggcgctggccgattccctggggaagaaggaggcagatcctgaggatggaaagcccgttatggacaaggtgaaagaaaaggctaaagaggaggatcgtgaaaaactgggagagaaggaggagaccatccctccagactacagacttgaggaggtaaaggataaggacggcaaaccgctccttcctaaagaatcgaaagagcagctgccgcccatgtctgaggatttcttgctggatgcactgtccgaggatttctctggtccccagaacgcctcctctctgaaattcgaggacgcgaaactggctgctgcaatctcagaggttgtctcccagactccggcatcgaccacgcaagcaggcgctcccccgagggacactagccaatcggataaagacctcgacgacgccttggataaactgtctgacagtttgggtcagagacaaccagatccggacgaaaataagcctatggaagacaaagttaaagaaaaggccaaggccgaacaccgcgataaacttggcgagagggatgataccattcctcccgagtatcgccacctgctcgacgataatggccaggacaaacctgttaaaccaccaactaagaagtccgaggacagcaagaagccggctgacgatcaggatcctattgacgctctcagtggtgacctcgactcttgccccagcacaacggagacatctcagaacaccgcaaaagacaagtgcaagaaagccgcttcttcgtcaaaagcaccgaagaacggcggcaaagctaaagactcagctaagaccactgaggagacatccaaacccaaggatgactag

SEQ ID NO: 110615 - DNA, 1929 bp, Artificial Sequence
  Description of Artificial Sequence: Synthetic coding sequence
atgaacccaactgagaccaaggccatcccagtgagccagcagatggaggggccccacttgccaaacaaaaaaaagcacaagaaacaagccgtgaaaacagaacccgagaaaaaatctcagtcaacaaagctctctgtcgttcatgagaagaagtcacaggaaggcaagcccaaagagcatactgaacctaagtcgttaccgaaacaggcttcagacactggtagcaacgacgctcataacaagaaggctgtcagccggagtgcggagcagcagcctagcgagaagagtactgagcccaaaacaaagccgcaggacatgatttcagcgggtggagagtccgtggccggaattaccgctatctccggcaagccaggcgacaagaagaaagagaagaagtccttgaccccggccgtcccagtggagtcaaaaccagacaagccctcaggaaagtccggaatggacgctgctctcgatgatctcatagatactctgggagggcccgaggagacggaagaagagaacacaacttataccgggcccgaggtctccgatcccatgagttctacatatattgaagagctggggaaacgggaggttaccatccccccaaagtaccgcgagcttctggcaaaaaaggaggggattacaggtcctccagctgactcttcaaagccaattggccctgacgacgccatcgacgcattgagcagtgactttacctgcgggtctcccaccgctgccgggaagaagaccgaaaaagaagaatccacagaagtgcttaaggctcagagtgcaggaacggtgcgctcagccgctccaccacaagaaaaaaagagaaaagtcgagaaagacacaatgagcgatcaggcactggaggccctctccgcctcccttggcacaaggcaggccgaaccggaactggacctgcgatcaatcaaagaagtcgatgaggcaaaggcaaaggaagaaaagctcgaaaagtgcggggaggacgacgagactatcccaagcgagtaccgactcaagcccgccacagataaagacggtaagcctctgctccctgaacctgaggaaaaacctaaacctaggtcagagtcggaactgatcgatgagttatcagaagacttcgacagatctgagtgcaaggagaagccgtccaagccaacagaaaagacagaggagtcaaaagccgccgcccccgctccagtgtctgaagccgtctgtcgcacgtctatgtgctccattcagagcgctccccctgaacctgctaccttaaaaggaacagtgccggatgacgctgttgaggcgttagccgacagcctggggaagaaagaggccgatccggaggacggtaagcccgtgatggataaggtgaaggaaaaggcaaaggaagaggatcgtgaaaaactgggtgaaaaagaggagactattccacctgactaccgtctagaagaagttaaggataaggatggaaagcccctgctccctaaagagagtaaagagcagctgccaccgatgagtgaggacttcctcctagacgctttgagtgaggacttttcaggacctcaaaatgccagctcgttgaagttcgaggatgccaaactggcagccgccatctcagaggttgtttcccagaccccagcgtctacaacccaggcaggggcgcctccacgggatacttcgcagtctgataaagatttggatgatgcgctggacaaattaagtgactcactggggcaacggcaaccagaccctgatgaaaataagccgatggaggataaggtcaaggagaaagcaaaagctgagcacagagacaagctaggagaacgcgacgatacaattccgccggagtataggcacttgctggatgacaatggccaggataagcctgtgaagcctcctaccaagaaatctgaggattccaaatag

SEQ ID NO: 110616 - DNA, 2085 bp, Artificial Sequence
  Description of Artificial Sequence: Synthetic coding sequence
atggaaggaccccatctacccaataagaaaaagcacaaaaaacaggctgtgaagacagagccagaaaaaaaatctcaatccaccaaactgtcagtggttcatgagaaaaagagccaggaaggcaaacccaaggaacacacggaacctaagagtctgcctaaacaggccagcgataccggatcaaacgacgcccataacaaaaaagccgtttctcgatccgctgagcagcaacctagtgagaagtccacggagcccaagacaaaaccccaggacatgatttctgcaggcggggaatcagtcgcaggcatcacagctatcagtgggaaacctggggataaaaaaaaggaaaaaaagagcctcactcctgctgtgcccgtggagtctaagccggacaagccgtcggggaagtctggaatggacgccgctctcgatgatttgatcgataccctggggggccctgaagaaactgaggaagagaataccacttatacagggccagaagtgtccgaccccatgtcgagcacatatatcgaggagctcggcaagagagaggttacgatcccccctaagtaccgcgaactcctcgcaaagaaagagggtataacggggccccccgctgattcttctaaacccatcggacctgacgatgctatcgacgccctgtcctctgacttcacatgcggatcaccaacagcagcaggaaaaaagaccgagaaggaggaaagcactgaagttcttaaggcccaatctgcaggcaccgtgaggtccgctgccccacctcaggaaaagaagcgcaaagtggaaaaagacacaatgtctgaccaggctctggaggcgctctccgcgagtctggggactcgacaggccgaacctgaactggatttgaggtcaataaaagaggtggacgaggcgaaggcaaaagaagagaagcttgagaagtgtggtgaagacgacgagaccatcccttctgaatacagactgaaaccagctacagacaaggatgggaagccactgctgccagagcctgaagaaaaacctaagccccgatctgaatcagagttaatcgatgagttgtcagaagactttgaccggtctgagtgtaaggagaaaccatcaaagccaaccgaaaaaacagaggaaagcaaggcagcagctcctgcccctgtttccgaggcagtctgccggacatctatgtgtagcattcaaagcgccccccccgagccagcgactctgaagggcacagtgcccgacgacgccgttgaggcattagcagatagcctcgggaagaaggaggccgatccagaggacggtaaacccgtcatggacaaggtcaaggagaaggccaaggaggaggacagggagaagctgggcgaaaaagaagagaccatccctccagattatcggctggaggaggtaaaagacaaagacgggaagccccttctcccaaaggagagcaaagagcaactcccacccatgtctgaagattttttgctcgacgctctgtccgaggatttcagcggacctcagaatgcttcatccctgaaattcgaggacgctaagctcgcagcagccatttctgaggtcgtcagccagacacctgcctctacgactcaggctggggcacccccacgcgacacctcgcagagtgacaaggaccttgatgacgccttagacaagttaagcgacagtctgggccagcgtcagccagaccccgatgaaaataagccgatggaggataaggttaaggaaaaggccaaagctgaacaccgcgacaaactgggagagcgcgatgacaccattcccccagaatatagacacttgcttgatgataacggacaagataaacccgtcaagccccctaccaaaaaatcagaggactctaaaaagccagcggatgaccaggatcctatcgacgcactcagcggcgacctggacagctgccctagcacaaccgagacgagccagaacaccgcgaaagacaaatgtaagaaagctgcctccagcagcaaagccccaaaaaacgggggaaaggctaaggacagtgctaagaccacagaggagacctccaaacctaaggacgactag

SEQ ID NO: 110617 - DNA, 2253 bp, Artificial Sequence
  Description of Artificial Sequence: Synthetic coding sequence
atgagtcagcctggacagaagcctgcagccagccctaggccccggcgcgctgccgccgccaggcggactcacgaacacgttagtgaaaagacctcagagtctccgtctaagcctggtgaaaaaaagggcagcgacgagaagaaggcggcttcgctcggatccagtcagtctagtaggacctacgcaggcggaaccgcgtcagcgactaaggtgagcgccagctccggggctaccagcaaatcgtcctccatgaatccaactgagaccaaagctgtgaagaccgaacctgaaaaaaaatcccagtctactaagcctaaatctctacccaagcaggccagtgatactggatccaacgacgcccacaacaaaaaagccgtcagcagatcagcagagcagcagccatcggaaaagtcaactgagccaaaaacaaagcctcaggatatgatcagcgctggtggagagtctgtggctgggattacagccatcagtggcaaaccgggagataagaagaaagaaaagaagtcccttacccctgctgtgcccgttgagagcaagcccgataaacctagcgggaaaagcgggatggacgctgccttggacgatctaatcgacacacttgggggccctgaggaaacagaggaggaaaacactacgtacaccggccccgaggtatctgatccaatgtcttcaacttatatcgaggaactcggcaaaagagaggttacgataccccctaagtaccgcgaattgttagccaaaaaggagggcattactggtcctcccgccgattcctccaagcccataggccccgacgatgccatcgacgctctgagctccgacttcacctgtggaagccctaccgctgctggtaagaaaacagagaaagaggaaagtactgaggtgctcaaagcccagtccgctgggactgtcaggagcgcagcccctccacaagagaaaaagcggaaggtcgaaaaggatacaatgtccgaccaagcgctggaggccctctcggcttccctgggaaccaggcaggctgagcccgagctggaccttcgaagcatcaaagaggtggacgaggctaaagcaaaggaagagaagttagagaaatgcggggaggacgacgagacgattccatcggagtatcgccttaagccggccactgacaaagatggcaagccgttgcttccggagcctgaagagaaacccaagccgagaagcgagtccgagctcatcgacgaactgtccgaagatttcgatagatccgagtgcaaggaaaaacccagcaagcccaccgagaagacagaagagagtaaagccgctgccccagccccagtcagcgaggccgtatgtaggacgagtatgtgctcaatccaaagcgccccgcctgagccagctaccttaaaaggcactgtacccgacgatgccgtggaagcattggccgactccctcgggaagaaagaggcagatcccgaagacggcaaacccgttatggacaaagtaaaagagaaagccaaagaagaagatagagaaaaactgggagagaaggaagagacaattccacccgactaccgtctggaggaagtgaaggacaaagatggtaaacccttactgcctaaggagagtaaagaacagctacctccaatgagcgaggatttcctcctggacgcattatcagaggacttttctggtccacagaacgcttcatcactcaaatttgaggatgctaagctagctgctgcaatctctgaagtcgtgtcccaaacacccgcctctacaacacaggccggggcacctccccgggatacctcccaaagcgataaagatctggacgatgccctggacaagttgtccgacagcttaggtcagcggcagcctgacccagacgagaataaaccaatggaggacaaggtgaaagaaaaagccaaagccgagcatagagacaagctgggagagcgggatgataccattccaccagagtacaggcaccttcttgacgacaacggccaggacaaacccgttaaacctccaacaaaaaaatcagaggattctaagaaaccggccgatgatcaggaccccatcgatgccttgtccggtgacctggactcctgcccttcaaccaccgagacctcccagaacaccgcgaaagataagtgcaagaaagcggcttcatcatctaaggcacctaagaatggcggcaaggctaaagacagcgccaaaactacagaggagacttctaaacccaaggatgactag

SEQ ID NO: 110618 - DNA, 1254 bp, Artificial Sequence
  Description of Artificial Sequence: Synthetic coding sequence
atgctattgtctgttccattgctcctggggctgcttggcctggccgttgcggaacctgccgtgtatttcaaagaacagttcctggatggtgacgggtggacgtctagatggatagagtccaagcacaagagtgactttggaaaattcgtgctctcctccgggaaattctacggagatgaggaaaaagacaaggggcttcagacatcccaggatgcacgattctacgccctgtctgctagtttcgaacccttctcaaacaaaggccagaccctggtggttcagttcacggtgaagcacgaacagaacatcgattgcggtggaggatacgtaaaattattcccgaattctttagaccagacggacatgcatggggatagtgaatataacattatgttcggacctgacatttgtggccccggtacaaagaaggttcatgttatcttcaactataaaggaaagaacgttctcataaataaagacatacgctgtaaggatgatgagtttactcatctgtataccctaattgtgcggccagacaacacatacgaggtcaaaatcgataattcccaagtagagtcagggtccttggaagacgattgggacttcctgcctccaaaaaagatcaaagacccggatgctagcaagcccgaggactgggacgaaagagccaaaattgacgacccaactgacagcaaacccgaggactgggataaacccgaacatatccctgatcctgatgcaaagaaacccgaggactgggacgaggagatggacggagagtgggagccacctgtcattcaaaaccccgaatataaaggtgagtggaaacctagacagattgataaccccgattacaaaggcacatggatccatcccgagattgacaatcccgaatactctcctgacccatccatctacgcttacgacaactttggtgtgctggggctcgacctttggcaggtgaagtcgggcaccatctttgataattttctgattacaaatgacgaggcttatgccgaggaatttggtaatgagacctggggagttacaaaggcagccgaaaagcagatgaaggacaagcaggacgaagaacagcggttaaaagaggaggaagaggataagaaacgaaaggaggaagaggaggcggaagataaggaggacgacgaagacaaggatgaggatgaagaagatgaggaggacaaggaggaggatgaggaggaggatgttcccggacaggcgaaagatgagctgtag

SEQ ID NO: 110619 - DNA, 891 bp, Artificial Sequence
  Description of Artificial Sequence: Synthetic coding sequence
atgcatggtgacagtgagtacaacatcatgttcggccctgacatatgcggcccagggactaaaaaggtgcatgtgatctttaactacaagggcaagaacgttttgataaacaaggacatccgttgcaaagacgatgagttcacccacctgtacactctcattgtgcgccctgacaacacttatgaggtaaagatcgataattctcaagtggaatcaggctcactagaagatgactgggatttccttccgccaaaaaaaattaaggaccccgacgcctcaaaacccgaggattgggatgaaagggccaaaatagacgacccgaccgactcgaaacccgaggactgggacaaacccgagcatattccggatcctgatgctaaaaaaccagaggactgggacgaagagatggatggtgagtgggagccccccgtcatccaaaatcctgaatataaaggggagtggaaacccaggcaaatcgacaacccagactacaagggaacctggatccaccctgagattgataatccagagtattctcctgacccttcaatctatgcttacgataacttcggggtcctggggctggacttgtggcaggtgaaatccggaaccatctttgataactttttaataactaatgacgaagcctacgcagaggagtttggcaacgaaacatggggcgtcacaaaggccgctgagaaacaaatgaaagacaagcaggatgaggaacaacggctcaaggaggaggaagaggacaaaaagagaaaggaagaagaggaggccgaagacaaggaggacgatgaagataaggatgaggatgaggaagacgaagaagacaaagaagaagatgaggaggaagacgtaccaggccaagctaaagatgagctgtag

SEQ ID NO: 110620 - DNA, 1155 bp, Artificial Sequence
  Description of Artificial Sequence: Synthetic coding sequence
atggccagagccctcgtgcagttgtgggccatctgcatgctccgggttgcgcttgctacagtctactttcaggaagagttcctcgacggcgagcattggcgcaaccgctggctacagtccaccaacgactcgcggtttggtcactttagattaagcagtggcaagttttacggacacaaggaaaaagataaaggtctccagacaacccagaatggacgtttctacgcaataagtgctcgcttcaagccgtttagcaataaaggcaagaccctggtcatccagtataccgtcaaacacgaacagaaaatggattgcgggggcggatatattaaggtgttcccggccgatattgatcaaaagaacctgaatggtaagagccagtactatatcatgttcggtcctgatatctgcggctttgatatcaagaaagtgcacgtcatcctgcactttaagaacaaataccatgaaaacaaaaaattgatcaggtgtaaagtggatggctttactcacctatacactctcattttgagacctgacctttcttacgatgtcaaaattgacggccaaagtatcgaatcaggttctattgagtatgattggaatttgaccagtctgaaaaaggaaacatctcccgcagagtccaaggattgggaacagaccaaagacaacaaagcccaggactgggagaagcactttttagatgcctcaactagcaaacagtcggattggaatggggacttagacggagactggcctgcccccatgttgcagaaacccccttatcaagatggactgaaacccgaaggaattcataaggacgtgtggcttcacagaaagatgaagaatacagactacctcactcagtacgatctgtcagaattcgaaaacattggggccattggccttgagttgtggcaggtgcgtagcggaacaatatttgataactttctcattaccgacgacgaggaatatgctgataattttgggaaggcaacatggggtgaaaccaagggaccagagcgcgagatggatgcgattcaagccaaagaggagatgaagaaggcccgagaggaggaagaagaggagttgctttccgggaagatcaatcgccatgaacactacttcaaccagttccaccggcgaaacgagctgtag

SEQ ID NO: 110621 - DNA, 1191 bp, Artificial Sequence
  Description of Artificial Sequence: Synthetic coding sequence
atgtccgctaccgataggatggggcccagggccgttcccgggcttcggttggcactcctgctgttactcgtgcttggaactcccaaaagcggcgtgcagggacaagagggcctcgacttccctgaatacgacggtgtcgatagggtaatcaacgtgaatgccaagaactataaaaacgtgttcaaaaagtacgaggtgttggcgttactatatcacgagccacctgaagatgacaaagccagccagcggcagttcgaaatggaggagttgatccttgagctcgcagcgcaagttctcgaagataagggcgtgggatttggacttgtggattcagaaaaggacgccgcagttgccaaaaaactcggactgacagaagtcgatagcatgtacgtctttaagggggacgaggtcatcgagtatgatggggagttctctgctgataccattgtggaatttcttctggacgtcctggaagatccggtagagctgatagaaggtgagcgtgagctccaagccttcgagaatatagaagacgaaattaaattgatcggttattttaaaagtaaagacagtgaacactacaaggctttcgaggacgccgctgaagaatttcacccatacataccatttttcgccaccttcgatagcaaagtggcaaaaaagctcaccttgaagctgaatgaaattgatttctatgaagcattcatggaagagcctgtgacgatccccgacaagcctaactcagaagaggaaatcgttaacttcgtggaggaacaccgacgcagcaccctgcgaaaactcaaacccgaatctatgtatgaaacctgggaagacgacatggacggaatacatattgtggcattcgctgaagaagctgatcccgatggattcgaattcctcgagacccttaaggccgtggcccaggacaacaccgagaaccccgatttatccatcatctggatagatcctgatgatttccctctattagtcccatactgggaaaagacgtttgacatagacctctcagctcctcaaattggggtcgttaatgtgacggacgctgattccgtctggatggagatggatgatgaagaggatctgcccagcgcagaagaactggaggactggctggaggatgtgctggagggggaaataaacacagaggacgatgatgatgacgacgacgattag

SEQ ID NO: 110622 - DNA, 1173 bp, Artificial Sequence
  Description of Artificial Sequence: Synthetic coding sequence
atgggtccccgggcggtccccgggctccgcttggcgctcctactgctgctagtcctgggtacgccgaaatcaggagttcagggacaagaaggcctggacttccctgagtacgacggtgtggatagggtgataaatgttaacgctaagaattacaagaacgtctttaagaaatacgaagttttagctcttctctatcacgagccaccggaagacgacaaagccagccaacgacagtttgaaatggaagagttaatactggagctcgccgcccaagtgttagaagataagggagttggttttggtctggttgacagcgagaaagacgcggcggtcgctaagaaacttggcctcactgaggtcgatagtatgtacgtattcaagggagatgaggtcatcgaatatgacggtgagttctcagcagataccatcgtcgaattcctgctggatgttttagaagatcccgttgagctgatagagggcgagcgagaactgcaggcattcgagaatattgaggacgaaatcaaactcatcgggtatttcaagtccaaagatagcgagcactacaaagcctttgaggacgcagccgaggagtttcacccctatatccctttctttgcgacattcgactccaaggttgcaaagaagctgactctgaaactgaacgagatcgatttctacgaagcctttatggaagagcctgtcaccatacccgataagcccaacagtgaagaagagatcgtcaactttgtcgaggagcatagacgctctaccctacggaagttgaagccagagtcaatgtatgaaacttgggaggacgatatggatggtatccatatcgtggcctttgctgaggaagctgaccccgacggattcgagttcctagaaactctgaaggccgtggctcaggacaacaccgaaaatcctgacctttccattatctggattgatccagatgatttccctctactggtaccatattgggagaagacctttgatatcgatctctcagcaccccagattggagtggttaacgtgactgatgcagactctgtctggatggagatggacgatgaagaggatcttcctagcgctgaggagcttgaggattggctggaggacgtcctcgaaggtgagattaacaccgaggacgacgacgacgacgatgacgattag

SEQ ID NO: 110623 - DNA, 936 bp, Artificial Sequence
  Description of Artificial Sequence: Synthetic coding sequence
atgtctatgcagcgtacgacacggatgtgttcacgatccatgaggtgttggcatagtagcaccatgaatccgccaaggatgactcgaccccataaagataactccctgggactgaccgaagtggacagcatgtatgtgtttaagggggacgaggtgatagaatacgacggcgaattttcagccgatacaattgtggagtttctgctggatgtgcttgaggaccctgtggagttgatcgaaggggaaagagagctgcaggctttcgagaacatcgaagacgagatcaagcttatcggttacttcaagtctaaagattcggaacactacaaagctttcgaggatgcggcagaagagtttcacccttatataccattctttgccacttttgatagcaaagtagcgaaaaagctgactctaaaactgaatgagatcgacttttatgaagccttcatggaggaaccggtgactattccagataagcccaactcagaagaggagatagtcaacttcgttgaggaacatagacgtagcactctcagaaagctaaagcccgagagcatgtatgagacctgggaagatgacatggacggcatccatatagtggcattcgctgaagaagccgaccccgatggattcgaatttttggagactctgaaggccgtagcacaggacaacaccgaaaaccctgatctgtcaatcatctggatcgaccctgacgactttcccttattggtgccttactgggagaaaacctttgatattgatttatctgcaccacagatcggtgtggtgaacgtgaccgatgccgattcagtttggatggaaatggatgatgaggaggatctgccttccgccgaagagctggaagactggcttgaagacgtgctggagggcgaaataaacactgaggacgatgatgatgatgacgatgattag

SEQ ID NO: 110624 - DNA, 1200 bp, Artificial Sequence
  Description of Artificial Sequence: Synthetic coding sequence
atgaaacgaactcacctgtttatagtcggcatttacttcctgagttcatgccgtgctgaggaagggctgaatttccccacctacgatggaaaggatagggtcgtctccctctccgagaaaaacttcaagcaagtattgaagaaatatgacctcttgtgtctttattaccacgagccagtgtcatctgataaagtaactcagaagcagtttcagctcaaggaaattgtgctagagcttgtcgcacaggttcttgaacacaaagccatcgggtttgtgatggtggacgcaaaaaaagaagccaaactcgccaagaaactaggtttcgacgaggagggcagcctttacatcctcaagggggacaggacgattgaattcgacggcgagtttgccgctgacgtgctcgtggaattcctcctcgacctaatcgaggatccggtggagatcatcagctccaagcttgaagtgcaggcctttgagaggatagaggattacattaaactgattggcttttttaagtctgaagacagcgagtattacaaggcgtttgaggaggcagcagaacactttcagccatacatcaagtttttcgcgacttttgacaagggggtggccaaaaagctgtccttgaaaatgaacgaagtcgacttctacgagccctttatggacgagcccatcgctatacccaacaagccatatactgaagaggaactggtagaattcgttaaagaacatcagcgacccactttgcgccgactgcgccccgaggagatgtttgagacttgggaggatgacctgaacggtatacacatcgtggctttcgccgagaagagcgaccctgacgggtacgaatttttagagattttaaaacaggtggcacgggacaacaccgataatcctgatctgtcaatcctgtggatcgatcccgatgatttccccctcttggtggcttattgggagaagacatttaagattgacctgttcagaccacagattggcgtggtgaacgtgacggatgcggatagcgtctggatggagatccccgatgatgatgatttgcctacggccgaggagctggaagattggatcgaggatgtcttatctggaaagatcaacactgaggacgacgacgaggacgatgatgacgatgacaatagcgacgaagaagataacgacgattctgacgacgatgacgatgaatag

SEQ ID NO: 110625 - DNA, 1062 bp, Artificial Sequence
  Description of Artificial Sequence: Synthetic coding sequence
atgaaacgcacacatttatttattgtgggaatatactttctgagctcttgcagagctgaggagggcctgaatttccccacttatgatggcaaagatcgcgtcgtcagcctgagcgaaaaaaactttaagcaggtgctaaagaagtatgatctcctctgcctatattatcacgaaccggtatccagtgataaggtgacacagaaacaattccagctgaaggaaatcgttctggaactcgtcgcgcaggtgcttgaacataaggcgattgggttcgtgatggtggatgccaagaaagaagccaagctggctaagaagttgggcttcgacgaggaaggaagcctgtatatcctcaagggcgatagaactattgaattcgacggtgagttcgctgcagacgtccttgtcgagttcctgctggacctgattgaggaccctgttgagatcatctcgagcaagctcgaagtgcaagccttcgagaggattgaagactatatcaagctcataggattctttaaaagcgaggactctgaatactataaggcctttgaggaagcagcagaacactttcagccctacataaaattcttcgcaacatttgataagggggtggccaaaaagttgtctctgaagatgaacgaggtggatttctacgagccctttatggatgaaccaatcgctatcccgaataaaccttatacagatggatacgagttcctggagatcctcaagcaagtggcaagggacaacaccgacaacccagacctgagtattttatggatcgacccagacgactttcccctgctagtggcctactgggaaaaaacttttaagatcgatctttttagacctcagattggcgtagttaacgtaactgacgccgatagtgtttggatggaaattcccgacgacgatgacctgccaactgcagaagaactggaggattggattgaagatgtcctgtcagggaaaataaatactgaagatgatgacgaagacgacgatgatgacgataacagcgacgaagaggataacgatgacagcgatgatgacgacgacgaatag

SEQ ID NO: 110626 - DNA, 987 bp, Artificial Sequence
  Description of Artificial Sequence: Synthetic coding sequence
atgaagaggacgcatctatttatcgtcggtatctacttccttagctcctgtagagcggaggaaggcctaaacttcccaacatacgacggcaaggatcgcgtggtatcattgtccgagaaaaactttaagcaagtcttgaagaaatatgatttattgtgtctatactaccatgagcctgtttctagtgataaggtgacccagaaacagtttcaactcaaagaaatcgtgctggagctggtcgcccaagtgcttgagcataaagcgatcggctttgtgatggttgacgcaaaaaaagaagctaaactggcaaaaaagctggactataaggcttttgaggaggcagctgaacatttccagccgtacattaaattttttgcaactttcgacaagggagtggctaagaaactgtcattaaagatgaacgaggttgacttttacgaaccattcatggacgagcccatcgccatccccaacaagccttacacggaggaagaactggtggagttcgtcaaggagcaccagcgcccaactctaaggcgcctcagacctgaagagatgtttgagacgtgggaagatgatttgaacggcatacacatcgtggcctttgcagaaaagtccgatccagacggatatgagttcctggaaatcttgaaacaggttgcccgggataacacggataatccagacctgagcattctctggatcgatcctgatgactttcctctgctcgtggcatattgggagaaaacctttaaaatagatctgttccgaccgcagattggagtggtgaacgtgaccgacgccgacagcgtgtggatggaaatcccagatgacgatgaccttccaacagccgaggagctggaggactggatcgaggacgtgctttccggcaaaattaatacagaggacgacgacgaagacgatgatgatgacgacaactccgatgaagaagataatgacgatagtgacgacgacgacgatgaatag

SEQ ID NO: 110627 - DNA, 948 bp, Artificial Sequence
  Description of Artificial Sequence: Synthetic coding sequence
atggacctgcgccaatttctgatgtgtttgagcttgtgtaccgcatttgccttgtctaagcccacagaaaagaaggatcgggtgcaccatgaacctcagttgagtgacaaagttcacaatgatgctcagagtttcgattacgaccacgacgcgttcctcggggccgaagaggccaagacttttgatcagcttacaccagaagaatccaaggagaggttgggaaagatagtgtccaagatagatggggataaggacggattcgtaaccgtggacgaactcaaagactggatcaaattcgcccagaaacgatggatttacgaagatgtcgaaagacagtggaaaggacatgatctgaacgaagatggactagtctcttgggaggaatacaaaaatgctacatacggatatgttctagacgaccccgaccctgatgatggattcaattacaaacagatgatggtgcgtgacgagcggcgttttaagatggcagacaaggatggcgatcttatcgctaccaaagaagagttcacagccttcttgcatcctgaggaatacgactacatgaaagacatagtggtccaggagactatggaggatattgataagaatgccgatggatttatcgatctggaagaatacatcggcgatatgtatagccatgatggtaataccgatgagcccgaatgggttaagaccgagagagagcagtttgttgaattccgggacaagaatagagacggcaaaatggacaaggaggagacaaaggattggatcctccctagcgattacgatcacgctgaggccgaggctcgccacctggtctatgaaagcgaccagaataaggacggaaagctgaccaaagaggaaattgtcgacaaatatgatctcttcgtgggatctcaagcaacagactttggggaggccctcgtaagacacgacgaattctag

SEQ ID NO: 110628 - DNA, 465 bp, Artificial Sequence
  Description of Artificial Sequence: Synthetic coding sequence
atggatctgcgacagttccttatgtgtctcagtctttgcacagcgttcgctctgtctaaacccactgagaaaaaagaccgggtgcatcacgagccacagctttcagataaggtgcacaacgacgctcagtccttcgactacgatcacgatgcgtttcttggagcggaagaagcaaagacattcgatcaattaacaccagaggaatccaaagagaggctcggaaagatcgtttctaagatcgacggcgataaagatggttttgtcactgtagatgagctcaaagactggatcctgccaagcgactacgaccacgccgaagccgaggccagacacctcgtctacgagagtgatcagaataaggatggaaagttaacgaaggaagagattgtggacaagtatgatctgtttgttggctcacaagcaaccgacttcggcgaggcgctggtgaggcacgacgagttctag

SEQ ID NO: 110629 - DNA, 948 bp, Artificial Sequence
  Description of Artificial Sequence: Synthetic coding sequence
atggacctaagacagtttctgatgtgcctgtcgctctgcactgcctttgctttgtctaaacccaccgagaagaaggacagagtacatcacgaacctcagctgagcgacaaggtgcataatgacgcccagagcttcgactacgaccatgatgccttcctgggcgctgaggaagccaaaacatttgaccagctgacacccgaggaatcgaaggagcgtttgggaatgattgtggacaagatcgacgccgataaggatggtttcgtgactgaaggggagcttaagtcctggataaagcacgcacagaaaaaatatatctatgacaacgtcgaaaaccagtggcaggaatttgacatgaaccaggacggattaatttcttgggacgaatacaggaacgtgacctacggaacatacttagacgacccagatccagatgatggcttcaactataaacagatgatggtccgtgatgaacgacgattcaagatggccgataaggatggcgatctgatcgctactaaggaggaattcacagcctttttgcacccagaggagtacgactacatgaaggacattgtagtgcaagagacaatggaggatatcgataagaatgctgacgggtttattgacctagaggaatacatcggcgacatgtacagccacgatggaaatacagacgaacctgagtgggtgaaaaccgaaagagagcagttcgtcgagttccgagacaagaaccgggacggcaagatggacaaggaggaaacaaaggactggattttaccatctgactacgaccacgcagaggccgaagcacgtcacctagtgtatgagagtgatcagaacaaagacggaaagctgaccaaagaagaaattgttgataaatacgacttgtttgtgggaagccaggccacggattttggcgaggctcttgtaagacacgacgagttctag

SEQ ID NO: 110630 - DNA, 972 bp, Artificial Sequence
  Description of Artificial Sequence: Synthetic coding sequence
atgaaagagaccgacctgatcataatggacctgcgtcagttcttgatgtgtctttcattgtgcacggcgttcgctctatctaaacctacagagaagaaagatagggtgcaccatgaaccccagctgagcgacaaagtgcacaacgacgctcagtctttcgattacgaccacgatgcgtttctgggggctgaggaagcaaagacatttgatcagctgacacccgaagagagcaaggaaaggttgggaaaaatcgttagtaagatcgacggcgacaaggatggattcgttacagtggacgagctcaaagattggatcaagttcgcccagaagagatggatctatgaggatgtggaaaggcagtggaagggccacgacttgaatgaagatggcctcgtgagctgggaagaatacaagaacgctacatacggctatgtgctggacgatcctgacccagatgacggcttcaattacaagcagatgatggtgagggacgagcgacgtttcaagatggctgataaggacggagacctgatagccaccaaggaagaattcacagcttttctgcatccagaagagtatgattatatgaaagacattgtggtccaggagacaatggaggacattgacaaaaatgccgacgggttcattgatctcgaagaatacataggtgacatgtatagtcacgatgggaataccgacgagccagagtgggtaaagaccgagagggagcagttcgtcgaatttagggataagaatagggacggcaagatggacaaggaggagactaaagattggattctcccatctgactacgatcacgctgaagccgaggctagacacctagtgtacgaatccgaccaaaataaggacggaaagctgactaaggaagagatagtggacaaatacgacctgttcgtgggctctcaagccacagatttcggcgaagctcttgtgcgtcatgatgagttctag

SEQ ID NO: 110631 - DNA, 444 bp, Artificial Sequence
  Description of Artificial Sequence: Synthetic coding sequence
tgaattgcgactaaagaggagtttacagcattcctccacccagaagaatatgactatatgaaggacatcgtggtccaagagaccatggaagacattgacaagaacgccgatggcttcatagatttagaagaatacattggggatatgtactcccacgacggtaacaccgacgagccagaatgggtcaagacagagcgcgagcaattcgtggagttccgcgacaagaatagagatggcaaaatggataaagaagaaacaaaggattggatcctgccctcagactacgaccatgcagaagctgaggcccgccatctggtttatgaatccgaccagaataaggatggaaagctaaccaaggaggagatagtagataaatacgatcttttcgttggttcccaagccacagactttggcgaggccttagtcaggcacgacgaattctag

SEQ ID NO: 110632 - DNA, 675 bp, Artificial Sequence
  Description of Artificial Sequence: Synthetic coding sequence
atggacctaaggcagtttctgatgtgtctgtccctttgcacagcattcgcactgtccaagccaacagagaagaaggaccgggtccaccacgaaccacagctgtcggacaaagtccataacgacgcgcaaagctttgactatgatcacgacgccttccttggtgcagaggaggctaagaccttcgatcagctgactcccgaggagtcaaaagagcggcttggaaaaatcgttagcaaaatcgatggcgacaaggacgggttcgtgactgtagacgaattgaaagattggatcaagtttgcacagaagagatggatctatgaggatgtagaacgtcaatggaaagggcacgacctaaacgaggatggcctggtaagctgggaggagtataagaatgctacgtacggctatgtgctagacgatccagatcctgacgatggtttcaactataagcagatgatggttcgagatgaacgtcgctttaagatggccgacaaggatggggacctgatcgcgacaaaagaagagtttaccgccttccttcaccccgaggaatatgactatatgaaggacattgtagtgcaggaaaccatggaagacatagacaagaatgcagacggctttatcgatttggaggaatacattgggtggcaagcctatcagggaggtgaccgctag

SEQ ID NO: 110633 - DNA, 444 bp, Artificial Sequence
  Description of Artificial Sequence: Synthetic coding sequence
atgaaagagacagatctcattattatggacctccgtcaatttcttatgtgcctgtccttatgcacagccttcgcactatccaagccaactgagaaaaaagatcgggttcatcatgaaccacagctgtccgacaaggtccataacgacgctcagagctttgactacgatcacgatgcatttctgggtgccgaggaagcaaaaaccttcgatcagctgacccctgaagaatccaaggaacgcctgggcaaaatagtctcgaaaatcgacggcgacaaagacggatttgtgaccgtggatgagctgaaagattggattaaattcgctcagaaacggtggatatacgaggacgtggaaaggcagtggaagggacatgacctcaacgaggatgggctggttagctgggaggagtataagaacgcaacctacggttatgtccttgaatag

SEQ ID NO: 110634 - DNA, 513 bp, Artificial Sequence
  Description of Artificial Sequence: Synthetic coding sequence
atggatctcagacagtttcttatgtgtctttcactctgcaccgcattcgctctgtcaaagcccactgaaaagaaggatagggtgcaccacgagcctcaactgagcgacaaggttcataacgacgctcagtcttttgattacgaccacgacgcctttctcggggccgaagaggccaaaaccttcgaccagctcactcccgaggagtctaaagagcggctgggaatgattgtggataaaatcgacgcggacaaggacggtttcgtcacagagggtgagcttaaatcatggattaaacacgcccagaaaaaatatatttacgataacgtggagaaccagtggcaagaattcgacatgaaccaggacgggctgatctcatgggacgagtaccgcaatgtgacctatgggacttacctggacgatccagatccagacgacggattcaactataaacaaatgatggtgagagatgagcggcgatttaagatggctgatcgggcccgcgccgtgtgctag

SEQ ID NO: 110635 - DNA, 606 bp, Artificial Sequence
  Description of Artificial Sequence: Synthetic coding sequence
atggatctacgacaattcttaatgtgtctttccctatgtacagcttttgcactgtctaagcctaccgagaaaaaggaccgtgttcaccacgaaccgcagttatctgataaagtgcataacgacgcacaatcctttgactatgaccacgacgcctttctgggcgccgaggaagccaagacttttgaccagctcactcccgaggagagcaaggaaagactcggcatgatagtcgataaaatcgacgctgacaaggatgggtttgtaaccgagggcgaattgaaaagttggataaaacacgcccagaaaaagtatatctatgacaacgtggaaaatcaatggcaggaattcgacatgaaccaggatggactgatctcgtgggatgagtaccgcaacgtaacttacggcacttaccttgatgatccagacccagacgacggattcaactacaagcagatgatggttagggatgaaagacgcttcaaaatggctgacaaagacggggacctgattgccactaaagaggaaattgttgacaaatacgacctgtttgtggggtctcaggctacagacttcggtgaagccctggtacgacacgacgaattctag

SEQ ID NO: 110636 - DNA, 798 bp, Artificial Sequence
  Description of Artificial Sequence: Synthetic coding sequence
atggacttgagacagttccttatgtgtctcagtttgtgcacggccttcgcactcagcaaacccactgagaaaaaggacagggtgcaccatgagcctcaattgagcgacaaagttcacaacgatgcccaaagcttcgactacgatcacgatgctttcttgggggccgaagaagcaaagacctttgaccagttgacacctgaggaatccaaggaacgtctgggcaaaattgtgtctaagatcgacggcgataaggacgggtttgtaaccgtggatgagctcaaagactggatcaagttcgcacagaaacgctggatctacgaagacgtggagcggcagtggaagggccacgatcttaatgaggacggcctggtctcttgggaagagtacaagaatgcaacgtacggttatgtgctcgatgacccagaccctgatgacggcttcaactataagcagatgatggtgcgtgacgagagaagattcaagatggccgacaaagatggagatcttattgcgacaaaagaggagtttaccgcttttctccatccagaggaatatgattatatgaaagacattgtggtacaagagactatggaagatattgacaagaatgccgacggctttatcgacctggaagagtacatcggtgatatgtattctcacgatggcaataccgacgagtctgaccagaacaaagacggaaaactgaccaaggaggagattgtcgataaatacgacctgttcgttggttcgcaggccaccgactttggggaggcgttggtccgccacgacgagttttag

SEQ ID NO: 110637 - DNA, 495 bp, Artificial Sequence
  Description of Artificial Sequence: Synthetic coding sequence
atgatggtgagggatgaaaggcgttttaaaatggccgataaagatggggatctgatcgccaccaaggaggagttcactgctttcttacaccccgaagaatatgattacatgaaagacattgtggtgcaggaaactatggaggatattgacaaaaatgcagacggattcatcgatctcgaagagtatattggtgacatgtattcgcacgatggcaacacagatgaacctgagtgggttaaaacggagagagaacagttcgttgaatttagggacaaaaacagagacggaaagatggataaggaagagactaaagactggattttacctagtgattacgatcacgcagaagcagaagcaagacaccttgtgtacgagtccgaccagaacaaggacggaaagctgactaaagaggagattgtggacaaatacgacttgtttgttgggagtcaggcaaccgactttggtgaggccttagtgaggcacgatgagttctag

SEQ ID NO: 110638 - DNA, 972 bp, Artificial Sequence
  Description of Artificial Sequence: Synthetic coding sequence
atgaaggagacagatctaatcattatggacctgagacagtttctcatgtgcctgtcactatgcacggcctttgcattatccaaacctactgagaagaaagacagagtccaccacgagccacagctgagcgacaaggtacacaacgatgcccaaagctttgattacgatcacgacgccttcctcggagccgaggaagcaaaaacgtttgatcagttgactcctgaagaaagtaaagagcgcctgggcatgatcgtcgataaaatcgatgcagacaaggatggctttgttaccgaaggggagctcaagtcgtggatcaagcatgcacagaagaaatatatttatgataatgtggagaaccaatggcaagagttcgatatgaaccaggatggtctgatctcctgggacgagtacaggaacgtgacatacggcacctatttggacgacccagacccagatgatggctttaactataagcaaatgatggtacgagacgagaggagattcaagatggctgataaagacggcgacctcattgctactaaggaggagttcacagccttcctccaccccgaagagtatgactatatgaaagacattgtggtgcaggagacaatggaggacatcgacaagaatgcagacggctttattgatttggaggagtatatcggagacatgtattcccacgatgggaatactgacgagccggaatgggttaaaacagaacgggagcagtttgttgagttcagagataagaaccgcgacggaaagatggacaaagaggaaacaaaagactggattttaccaagcgattatgatcacgccgaagccgaagctagacacctggtatacgagtctgatcagaataaggacggcaaacttactaaggaagaaatcgtcgacaaatacgacctctttgtcggttcccaggcaacagacttcggcgaagctttggtaaggcacgacgagttttag

SEQ ID NO: 110639 - DNA, 1116 bp, Artificial Sequence
  Description of Artificial Sequence: Synthetic coding sequence
atggaactggagttggacgcaggcgaccaggacctgctcgccttcttgttggaagagagcggcgatctggggactgcaccggatgaagccgtcagagcacctctggattgggcactccccctcagtgaggtaccttctgattgggaggtcgatgatctgctgtgctccttactatctcctcctgcttcattgaacattctgagctcttcaaatccctgcctcgtgcatcatgaccatacctattcccttcctcgagaaactgtgtccatggacctcgaatcagaatcgtgtaggaaggagggcacgcagatgacaccgcagcatatggaggaattagccgagcaggaaatagcgagactcgtgctgaccgacgaggagaaaagcctgctggagaaagagggcctaattctgccggaaacattgccactgaccaaaaccgaagagcagattttgaagagagtgaggcgcaaaataaggaacaagcgatctgcacaggagtcccgccgaaagaagaaggtttacgttggaggcctagaaagcagagtcttgaaatacaccgcgcagaacatggagctccagaacaaggtccagctactggaagaacagaacctgtccctcctggatcagctccggaagttacaagcaatggtgatcgagatttcaaataagacaagtagcagctcgacgtgcattctggtgctgctggtctcattctgtctcttactcgtccctgctatgtactcaagcgacacacgaggttccctgcctgcggagcacggcgtgttgtcacgacagctacgcgccttgccctccgaagacccataccagctcgaattgcccgccctgcagtccgaggtgcctaaagactctacccaccagtggctagatgggtccgactgcgtgcttcaggcccctggcaacacatcctgtctcttgcactatatgccacaagccccatctgctgaaccccccctagagtggcctttcccggacctgttctctgagcctctgtgcaggggtccaatcctgcctctgcaagctaacctgacacgaaaaggcgggtggctgccaactgggagtccaagtgtaattctgcaggaccgctatagcggctag

SEQ ID NO: 110640 - DNA, 1386 bp, Artificial Sequence
  Description of Artificial Sequence: Synthetic coding sequence
atgaacacagatctggccgccggaaagatggcatctgcggcctgtagcatggatcctatagacagctttgagctcctagacctgctgttcgatcgccaggacggcatcctgcgccatgtggagttgggcgaagggtgggggcacgtaaaggatcagcaggtgctgccgaatccagattctgacgatttcctctccagtatcctgggttccggcgactcactaccttcgtcccccctttggtcccccgaaggaagcgactctggtataagtgaggatctgccttccgatccacaggatacacctccacgaagcggaccagcgacatctccagccggttgccaccctgcacaaccagggaaggggccctgcttgagttatcatccagggaattcttgtagcaccaccacaccaggcccagtgatccaggtgcctgaggccagtgttacaatcgacctggagatgtggtcccccggggggcgcatatgtgctgagaaacccgcggatcctgttgacctcagtccgcgctgtaatcttacggttaaggatctgctgctctctggttcatcaggggacttgcaacagcatcacctgggggccagctatctgctacgccccggagccggtcattgtcaggaactagtcctaaccgaagacgagaaaaagttgttggcaaaagagggaattactctaccaactcagctacccttgacaaagtacgaggagcgcgtacttaaaaagattcggaggaaaatccgtaataagcaatccgcccaagaatctcggaaaaagaagaaggagtatatcgatgggctggagacacgaatgagcgcctgcactgcacaaaaccaggagctgcagagaaaggtccttcaccttgaaaaacaaaacctgtcgctgctggagcaactgaagaagctgcaggcaattgttgttcagagtacgtccaaatcagcccagactgggacttgcgtcgcagtgctcctcctttctttcgctctgattatcctgccgagcatttctccctttggccctaataagaccgaatcccccggtgattttgctcccgtgcgggtgttcagccggaccctccacaacgatgcggcgagtcgcgtcgctgctgacgctgtccctggctcagaggcccccgggccccgtccggaggccgacaccactagagaggaatctccagggtcaccgggagccgattggggttttcaggacacggctaatctcaccaacagtaccgaggagctggacaatgccactctagtactgcgaaatgctacagagggcctgggacaggttgccctcctcgattgggtcgcaccggggccatcgactggctctggccgggccggcctagaagcggccggcgacgaattgtag

SEQ ID NO: 110641 - DNA, 900 bp, Artificial Sequence
  Description of Artificial Sequence: Synthetic coding sequence
atggcgtctgcagcgtgcagtatggatcccatcgatagcttcgagctgttagatttgctgtttgatagacaagatgggattttgcgacatgtcgagcttggtgagggatggggccatgtgaaggaccaggtccttcccaacccagactccgacgactttctgtcttcaattctgggctctggggatagccttccctcttctcctctatggtcacccgaaggatctgacagcgggatttcagaggatctgcctagtgatccccaagatacccctccgcggagtggtccagcgacttcaccagctggctgtcacccagcccagccaggtaagggaccctgtttaagttatcatcccggaaattcctgtagcacaactacacccggccctgtaattcagcagcagcaccacctcggcgcaagttatctcctgagacccggtgcaggccactgccaggaactggtcctgacagaagacgaaaaaaaacttctggcaaaagaaggcattacactcccaacgcagcttccactgacaaaatacgaagaacgtgtgctgaaaaaaatacgacggaagatcaggaacaaacagagtgcccaggagtctcggaaaaagaaaaaagagtacatcgatggactggagactcgctcttgttgttgccctctcccctcttcttcaagtccaccctcagccctgttagcccctacaaaacctcgagcactcggaaccctccgactgtacgagtgcagccccgagctgtgtacaacaatgcttccaccagcctggttgctgatgttgtgccaggccccccgaccgcaggatccagacccccgtctgacccagcctgaaaagagcctgcaggaagcgcccggtcagaccggcgcaagtcggactccccgtacctag

SEQ ID NO: 110642 - DNA, 1260 bp, Artificial Sequence
  Description of Artificial Sequence: Synthetic coding sequence
atgaacactgacttagcggctggtaaaatggcgtcggctgcctgctccatggaccccatcgactcctttgaactcctggacctcctgtttgaccggcaggatgggatcctgagacatgtcgagctgggtgagggctggggacacgttaaagaccagcaggtgctccccaaccctgatagtgatgattttttaagctctattctgggttccggagatagcttacccagttcacccttgtggagccccgaaggcagtgattccggaatttcagaagatctccctagtgacccccaagatacccctccaaggtccggccccgctaccagcccagccggctgccatcccgcccagcccggcaaggggccttgtttatcttatcatccaggcaattcttgcagcacaaccaccccaggccctgtgatccaggtgcccgaagcaagcgttactattgacctggagatgtggtcccccggaggaaggatttgtgctgagaagccagctgatcctgttgatctgtccccgcggtgcaacctgaccgtgaaggaccttctgctgagcgggtcgagcggcgacctgcagcagcaccacctgggcgccagctatctgcttaggccgggcgcaggtcattgtcaggagttggtgctcacagaagacgaaaagaagttactggctaaggagggtatcaccctgcctacgcagctgcctctcacaaaatacgaggagcgggtgctcaagaaaatccgccgcaagataaggaacaagcagagtgcccaagagtcccggaaaaagaaaaaagcaattgtggtgcaaagcacgtctaaatccgcacagaccggcacgtgcgttgcagtactgctgctttcttttgccttaatcatcctgccttctatctcccccttcggacctaataagacggaatccccaggggattttgcacccgttagggtatttagtcgcacactgcacaatgacgccgcctcccgcgtcgcagcagatgctgttcctggaagtgaagcccccggtcctcgtcctgaagcagacacgacaagagaagaaagccccggctcaccaggagctgattggggctttcaggataccgcaaacctgactaactcgactgaagagctggacaacgcaacacttgtgctcagaaacgcaactgagggcctcgggcaggtggcactcttggactgggtcgcgcccggaccaagtacagggagtggtcgggctggcttagaagccgcgggagacgagctctag

SEQ ID NO: 110643 - DNA, 1188 bp, Artificial Sequence
  Description of Artificial Sequence: Synthetic coding sequence
atggatttggggatccccgatctgctggacgcatggctcgaaccaccggaggacatcttctccaccggaagcgtgctggagctcggcttacattgcccaccacccgaggttccggtgaccaggcttcaggaacagggactgcagggatggaagtctggaggggacaggggctgcggcttgcaggaatccgaacccgaagactttctgaaactcttcatcgatcccaacgaggtttattgtagcgaggctagtcccggctcagactctgggatctcggaggacccttgccatcctgattcaccacccgcccctcgggcaacatcaagccccatgttgtacgaggtcgtctatgaggccggggccttggaaagaatgcagggagaaaccgggcccaacgtgggcctaatcagcatccagctcgatcagtggagtccagcatttatggttccagactcctgcatggtatccgagctccctttcgacgcccacgcgcatattctgccaagagcggggaccgtggctcctgtcccctgtacaacgctgctcccctgtcaaactctgttcctcacggacgaggagaagcggcttcttggacaggaaggggtaagcctaccctctcacttaccccttacaaaagccgaagaaagggttctgaaaaaagtgagaaggaaaatcagaaataaacagtccgcacaagactcaaggcgccgcaaaaaagagtacattgacgggctggaatcccgcgtggctgcctgcagcgcacagaatcaagagcttcagaagaaggtgcaagaactggagcggcacaacattagtttagtggcccaacttagacagttgcagacacttattgcccagaccagtaacaaggccgcgcagacatctacctgcgttctcatcctgctgttctccctggctctcattatcctgccatctttttccccttttcagtccagaccagaagccggctcggaggattatcagccccatggtgtaacaagccgtaacatcctcacccacaaagatgtcaccgaaaaccttgaaacccaggttgtagaatctagactacgagagccccccggagcaaaagatgcaaacggttcgaccaggacactgcttgaaaaaatgggaggcaagcccagaccctccggacgtatccgtagtgtcctgcatgccgatgagatgtag

SEQ ID NO: 110644 - DNA, 1128 bp, Artificial Sequence
  Description of Artificial Sequence: Synthetic coding sequence
atggacctgggtatccccgacttactggatgcctggttggagcccccggaggacatattctctacaggctcggtgctcgagctgggactgcactgcccccccccagaggtgcccggccttcaagaaagcgaacccgaggattttctgaagttgtttattgaccccaatgaggtgtactgttctgaggctagccctggctccgatagcggtatatcggaggatccctgtcaccctgatagtccccctgccccgagagccacatcctctccgatgctgtatgaggtggtgtatgaagctggggctcttgagcgaatgcagggagagaccggtcccaatgtgggcttaatatctatccaactcgaccagtggtcacctgcctttatggttcctgattcctgcatggtttctgagctgcccttcgatgcccacgctcacattctgcccagggcaggcacggtggccccagtgccctgcactaccctgctcccttgccagaccctctttctgacagacgaagagaagaggcttcttggacaggagggagttagtctcccatcccatctgccactcaccaaggccgaggagagagtgctgaagaaggtccgaaggaagattagaaacaaacagagcgcccaagacagcagaaggcggaagaaagaatacatcgatggccttgaatcccgcgtcgccgcctgctctgcacaaaaccaagagctgcaaaagaaggttcaggagttagaacggcataacattagcctcgttgctcaactgagacagttgcagacactcattgcacagacctcaaacaaggcggcacagacaagtacctgcgtactgatccttttgttctcactcgccctgatcattttgccatcattttcacctttccagtcgcgcccggaagccggaagtgaagactatcaaccacacggtgtcacttcaaggaacatactgacacacaaggatgtcacggagaacttagagacacaagtggtcgagtctcgactgcgtgaacccccaggcgctaaagatgctaatggctcaactcgaactttgctcgaaaagatgggaggaaagccaagaccttccggtaggatccgctcggtgcttcacgcagatgaaatgtag

SEQ ID NO: 110645 - DNA, 654 bp, Artificial Sequence
  Description of Artificial Sequence: Synthetic coding sequence
atggacctgggtattccagacctgttagatgcatggctggaaccacccgaagatatcttttcgaccggatctgtgctggagctaggccttcattgcccgcctcctgaagtgcctgttacacggctccaggagcagggattgcaggggtggaagagcggtggtgatcggggttgtggcctacaggagagtgaacccgaagattttctcaagctgttcattgatccaaatgaggtgtactgcagtgaagcttctcctggaagcgatagcggaatcagcgaagatccctgccaccccgactcgcctcctgcgccccgggccacatcatctcctatgctgtatgaggtagtttacgaagccggcgccctggagcgcatgcaaggggagacgggcccaaacgtcggactgatcagcatacagctcgatcagtggtcaccagccttcatggtccctgattcttgcatggtgtccgagcttcctttcgatgcacatgcacacatactgccccgggccggaaccgtggcccctgtgccatgcaccacccttttgccatgtcagaccttgtttctgactgatgaagagaagcggctgctcggacaagagggagtaagcctcccttctcatctgcctcttactaaggtcacttgcttcccctag

SEQ ID NO: 110646 - DNA, 1188 bp, Artificial Sequence
  Description of Artificial Sequence: Synthetic coding sequence
atggacctgggcattcccgaccttctggatgcttggctcgagccgccagaagatatattctcaacgggctctgtgctggagctagggctgcactgcccacctcctgaagtgcctgttaccagactgcaggagcaaggacttcagggttggaagagcggtggcgataggggctgcgggctgcaggagtccgagccagaagacttcttgaaactgtttatagaccccaacgaggtgtattgttcagaagcttccccaggctcagactctggtatttccgaggatccttgtcatcccgattccccacccgcgccacgtgccacctcgtccccaatgctgtacgaagtggtgtatgaggcgggtgcgctggagcgcatgcagggcgagacagggcctaacgtgggtctcatatccatccagctggatcaatggtctcccgccttcatggtacccgattcttgcatggtgagtgagctgcccttcgacgcacacgcccacattcttccaagggccggaactgtcgcaccggtcccttgcactaccctcctgccttgccagactctattcttgactgacgaggagaagcgcctccttggacaggagggcgtttcactgccaagtcacctgccacttactaaagccgaagagcgcgtcctgaagaaggtgagaagaaaaatcagaaacaagcaaagcgcccaggactctcgcaggcgtaagaaagagtatattgacggactggagtccagggtcgcggcatgttctgcgcagaaccaggaactgcagaagaaagtgcaggagttagagcggcacaacatatccttggtggcacagctgcgacagctgcagaccttgatcgcacagactagcaataaagccgcacagacatctacctgtgtgctaatattgttattctcgctagctctcattatccttccttctttttcgcctttccagagcagacctgaggccggctccgaagactaccagcctcacggagtaactagtcgaaatatactcacacacaaagacgtgactgaaaatctggagacccaggtggtggagagtagactgagagaaccgcccggagccaaggatgccaatggatcaacaaggacactcctggagaagatgggcggcaaacctagaccgtccggccggatacgcagcgtgcttcacgccgatgaaatgtag

SEQ ID NO: 110647 - DNA, 1188 bp, Artificial Sequence
  Description of Artificial Sequence: Synthetic coding sequence
atggacttaggcatacctgatcttttagacgcctggttagagccgcctgaggatatttttagcacagggagcgtcctggaacttgggcttcactgcccccctcccgaggtgcctgtgaccaggctgcaggaacaggggctgcaaggatggaaatctggaggggatcggggctgcgggcttcaggaaagcgagccagaagatttcttaaagttgttcatcgaccccaacgaagtatattgttctgaagcctcacccgggtcggacagcggcatttcagaggatccttgtcatcccgacagcccgcccgcccctagagccacgagctctcccatgctgtatgaggtggtatatgaggcaggcgcgctcgagagaatgcagggtgaaactggcccaaacgtggggctgataagcatacagttagaccaatggagccccgctttcatggtaccggacagctgtatggtttcagaactccctttcgatgcccatgcccatattctcccccgggccgggactgtggcccccgtgccttgtacaacactcctgccctgccaaaccttgttcctcactgatgaagaaaagagactgctaggccaggagggggtatccctcccatcccatctgccgctgaccaaagcggaggagcgtgtgctcaagaaggtgcgcaggaagattcgcaataagcaaagtgcccaggactctaggcggcggaaaaaggagtacattgatggtctggaaagcagggtcgccgcctgttccgcgcagaaccaggagttgcaaaagaaagtgcaggagctcgaacggcataacatatcgctggttgcccagctgaggcagctacagacacttattgcccagacctcaaataaggctgcacagaccagcacctgtgtgctgatccttttgttttcgctggccctgatcattcttcccagcttttctcctttccaatcaaggccagaggccggatctgaggattaccagccacatggggtaacctcccgcaatatattgacacacaaagacgtgactgagaatctggaaacccaggtggtggagtctcggctgcgtgaacctccaggcgccaaggatgcaaatggcagcaccaggactcttctggagaagatgggaggcaaacctcgaccctcaggcaggataaggtctgtcctgcatgctgatgaaatgtag

SEQ ID NO: 110648 - DNA, 747 bp, Artificial Sequence
  Description of Artificial Sequence: Synthetic coding sequence
atggttcctgacagctgtatggtgtcagagctgccttttgatgcacacgcccatattctgccgagagccggtactgttgcacctgtgccttgcacaacactcctgccttgccagaccctcttcctgaccgatgaggagaagaggctgctcggtcaggagggcgtctctctcccctctcacttgcctttgaccaaggctgaggagagggtgttaaagaaggttcgtagaaaaattcgcaacaaacagtcagctcaagactcaagacgccggaagaaggaatacatagacgggctggaaagtcgcgtggccgcctgctctgcacagaaccaggaattgcagaaaaaggtgcaggaactggagcgccacaacatcagtctggtggcacaactgagacagctccagacactaattgcacagacctctaataaggcagcacagacttcaacatgcgtgctgattcttctctttagtttagccctgatcatcctgccgtctttttccccctttcagagccggcccgaagctggctctgaggattatcagcctcacggcgttacctcgaggaacatcttaacacacaaggatgtcaccgaaaacctggagactcaggtggtggagtccagattgagagaaccacctggtgcgaaggacgctaatggcagcactagaacacttctggagaagatgggaggtaaaccaaggcccagtgggaggatccggagtgtgttacacgctgatgagatgtag

SEQ ID NO: 110649 - DNA, 549 bp, Artificial Sequence
  Description of Artificial Sequence: Synthetic coding sequence
atggacctgggcattcctgatcttctcgatgcatggttggagccgccggaggacatcttcagtacaggctccgttctggagctgggcctgcattgtcccccgccggaagtccctgtgacgagattgcaggagcagggcctgcaaggatggaagagcggcggagaccgcggatgtggcctgcaggaaagtgaaccggaagacttcctaaagttgttcattgatccaaacgaggtctactgtagcgaggcatcccctggtagtgatagcggtatttctgaagacccctgtcatccggacagccccccagctccccgcgctacttccagccctatgctttacgaagtggtgtatgaggcaggtgccctggaacgcatgcagggggaaacgggccctaacgttgggctgataagcatacagctcgaccagtggtcaccagcattcatggtaccagactcctgcatggtgagtgaactcccatttgacgctcacgcgcatattttaccccgtgctggaacagtcgcacccgtgccctgtacaaccttagtttag

SEQ ID NO: 110650 - DNA, 687 bp, Artificial Sequence
  Description of Artificial Sequence: Synthetic coding sequence
atggatctgggaattcctgatttgctagacgcctggctggaacccccagaagatatattctccacaggatcggtcctggagctgggcctgcactgcccaccccccgaagtgcctggattgcaggagtccgagccagaagactttctgaaattgttcattgacccgaatgaagtgtattgctcagaagcaagccctggctccgacagcggcatatctgaagatccctgtcatccggattcccctcctgctccaagagccacatcctctcctatgctgtacgaggttgtgtacgaggcgggtgccttggaaagaatgcaaggggaaacagggcctaacgtgggattgatttcaattcagctggatcagtggagtcccgccttcatggtgccagatagctgtatggtatccgaactacctttcgatgcccatgcacacattctccccagggccggtacagttgcccccgtcccatgtacaactctgctcccatgccagacactcttccttaccgacgaagagaaacggcttctgggtcaggaaggggtcagtcttccaagccatctccctctcacgaaagcagaagagcgggtgctaaaaaaagtgcgccggaaaattcggaataagcaatctgcacaggactctcgacgacgcaagaaagaatacattgatggcctggagtcaagatag

SEQ ID NO: 110651 - DNA, 1047 bp, Artificial Sequence
  Description of Artificial Sequence: Synthetic coding sequence
atgtcaaagtgtgcccggaagaagtacattaagaccaacccccgccaaatgactatggagacagtcgaatcccagcatgacggctctatcaccgcttcgttaacagagtcaaaaagcgcgcatgttcagacccagaccggtcaaaactctatccctgcactggctcaggtctctgtcgctggtagtgggactcgcagaggctcccccgctgtgacactggttcagctcccctccgggcagactatacacgtgcagggtgtcattcagacccctcaaccctgggtgatccaaagcagtgagattcacacagtgcaggtggctgcaatcgcagagacagacgagtccgcggaatccgagggagtcatcgattcccacaaacggcgggagatcttgagcagacgacccagttaccggaagatcctcaacgagctgtcttcagacgttccaggcgtgcctaaaatagaggaggaaagatcagaagaagagggcacacccccctctatcgctaccatggcagtgcctacaagtatttaccagactagcactggacagtacatcgccatcgcccaaggcgggacaatccagatcagcaatcctgggagcgacggcgtgcaaggacttcaagcacttactatgacaaattccggcgcccccccacccggtgcgaccatcgtgcagtacgccgctcaaagcgctgatgggacccagcagtttttcgtacctggtagtcaagtggtagtgcaggccgccactggagacatgcccacctaccagattcgtgcaccaacggccgctctgcctcagggcgtggtgatggctgcatctcctggaagtctccattccccccagcagctggcagaagaagcgacccggaagcgcgagctacggctaatgaagaatcgcgaggccgccagagaatgcagacgcaagaagaaggagtatgtgaaatgcctcgagaatagagtagcagtgctggagaaccagaacaagaccctgattgaggaacttaaagctctgaaagatttatactgccacaaggtagaatag

SEQ ID NO: 110652 - DNA, 900 bp, Artificial Sequence
  Description of Artificial Sequence: Synthetic coding sequence
atgtccaagtgcgctaggaagaaatatatcaaaaccaacccacgacagatgaccatggaaacggtagaaagtcagcacgacggttctattaccgcaagcctcactgaatctaaaagcgcgcacgtacagacccagaccgggcaaaactcgattcccgcactggcgcaggttgccgccatcgcagaaaccgacgaatctgccgaatcagaaggggtcattgactcccataagaggcgcgaaatcctctcaaggcggccttcttaccggaagatcctaaatgaactgtcaagcgacgtgcctggagtccccaaaatcgaagaggagcgatccgaggaggaggggacccccccatcaatagctactatggcagtgcctacctccatctaccagaccagcacaggacagtacatcgcaatcgctcagggtgggaccatacaaattagcaatccggggagtgacggggtgcaaggactgcaggccttgacaatgacaaacagtggagctccacctccaggcgccaccatcgtgcagtatgctgctcagagtgccgatggaacccaacagttctttgtccctggctcccaggtcgtggtgcaggctgcaaccggtgacatgcccacctatcaaatacgtgctcccactgctgctctaccacagggcgtggtgatggccgcatctccgggatctctgcacagtccccagcagctggcagaggaggcgactaggaagagggaactcaggcttatgaagaatagggaagcggcccgcgagtgtcgtcgcaagaagaaggagtatgtcaagtgtctcgagaaccgcgtggctgtgctggagaatcagaacaagacactcatcgaagagttaaaggccctgaaagatttgtattgccacaaggtagagtag

SEQ ID NO: 110653 - DNA, 738 bp, Artificial Sequence
  Description of Artificial Sequence: Synthetic coding sequence
atggtggcagccattgcggagacagacgaaagcgcagaatctgaaggtgtgatcgatagccacaagcggcgcgagatcctgtctaggcgacccagctaccgcaagatattgaatgagctttctagtgacgttccgggtgtgccaaaaattgaagaagagcggtcagaggaggaagggactcctccgagcatcgccactatggccgttccaacgagtatttaccagactagtaccggtcagtacattgccatcgcgcagggcgggacgatccagatcagtaatccaggaagtgacggagtccaggggctgcaggctcttacaatgactaacagcggcgccccccctcccggtgctaccattgtgcaatacgccgcccagagcgcagacgggacacaacagtttttcgtgccaggatctcaggtggtcgtgcaggccgcaaccggtgacatgcctacctaccagatccgcgctcccaccgctgcgctgccgcaaggggtggtgatggctgcttcgcctggctctttacattcaccacaacagctagctgaagaagcaactcggaagagggagctgagactgatgaagaaccgggaagccgctaaggagtgcagaaggagaaaaaaggaatatgtgaaatgtctagagtcaagggtggcagtgctggaggtgcagaataaaaagctcattgaagaactggagaccctgaaggacatttgctcacctaagaccgactactag

SEQ ID NO: 110654 - DNA, 288 bp, Artificial Sequence
  Description of Artificial Sequence: Synthetic coding sequence
atgcccacataccaaatccgcgcgccaacggcagccttgccccagggtgtggtgatggcggcatctcccggatctctgcactctccgcagcaactggccgaggaagccaccaggaaaagagagctcaggttaatgaagaatcgtgaggccgcaagagagtgccgacgaaagaaaaaagagtacgtcaaatgcttagaaaaccgagtagcagtgttggaaaaccaaaataagactctgatcgaggagcttaaagcactgaaagacctgtattgtcacaaagttgaatag

SEQ ID NO: 110655 - DNA, 903 bp, Artificial Sequence
  Description of Artificial Sequence: Synthetic coding sequence
atgtcaaaatgtgctaggaaaaaatatattaaaaccaatcctcgccaaatgactatggagaccgtggagtcacagcacgacggaagcattaccgcctccctaaccgaatccaagtcggctcacgttcagacccaaaccggtcagaactctattcccgccctagctcaggtcgctgctattgctgagacggatgaatccgccgagtcagaaggagttatcgattcgcataagaggcgagaaatactcagcagaagaccttcctatcgaaagattctgaatgagctctcatctgatgttcctggcgtcccaaaaattgaggaggagcggagtgaggaggaagggacgcctccgtccatcgccaccatggctgtcccaacctccatctaccagaccagcaccggtcagtatattgccatcgcccaaggaggaaccatacagattagcaacccagggagcgacggcgtgcaggggctacaagcccttactatgactaattccggggcccctccacccggtgccactatagttcagtatgccgcccagtcagcagatggtactcaacaattttttgtgcctggatcacaggtggtcgtgcaagcggcgacaggcgacatgccaacctatcagattagagcccctaccgctgcgctccctcagggcgtggtgatggcagcctcacccgggtccctccattcaccacagcaactggctgaggaggccaccagaaaacgcgagctgaggctaatgaagaatcgagaagcagccaaagaatgtcggaggcgaaagaaagagtacgtcaaatgtcttgagtctcgagttgctgtcttagaggtgcagaacaaaaagctgatcgaagagctggagaccctaaaggacatctgctccccaaagactgattattag

SEQ ID NO: 110656 - DNA, 666 bp, Artificial Sequence
  Description of Artificial Sequence: Synthetic coding sequence
atgacaatggagactgtggagtcgcaacatgatggtagcataacagcctcactgaccgagtctaaatccgcacacgtgcagacacaaaccggccagaatagcatacccgccctcgcccaggtcgcagcgatagctgagactgacgagtccgctgaatccgaaggtgtcatcgattcccataagcggagggaaattctttcccgcaggccatcataccgaaaaatattaaatgagctgagcagtgatgtcccaggagtgcccaaaattgaggaggaacggtcagaagaggaaggtacccctccgtcaattgccaccatggcagtaccaacatctatttaccagacttccacagggcagtatactgcaacaggggacatgccgacataccagatccgagcccccacagcagccttaccgcaaggggttgttatggctgcctcacccggaagccttcatagcccccagcagctagccgaggaggcaacccgcaaaagggaactgcggttgatgaaaaatcgcgaagccgccaaagagtgccgtcgccggaaaaaagagtacgttaagtgtctggagtcacgcgtagcagtcctcgaggttcaaaacaaaaaattgattgaggagctagagacgctcaaggatatatgcagccccaaaacagactactag

SEQ ID NO: 110657 - DNA, 747 bp, Artificial Sequence
  Description of Artificial Sequence: Synthetic coding sequence
atgagcaaatgtgctcggaaaaagtatatcaagaccaatcccagacagatgaccatggaaacagtcgagagccagcatgacggttcaattacagccagcctgaccgagtccaagtctgcccacgtccagacgcagactggtcagaattccataccggccttagcccaggtggctgccatagctgagacagatgagtccgccgagtcggaaggcgttattgactctcataaaaggcgcgagatcctctcccgcaggccgagctaccggaagatcttaaacgaactctcttctgatgtacccggcgtacccaaaatcgaggaagaacgtagtgaggaagaagggaccccgccctccatagctacgatggcagtccctacttccatctatcagaccagtactggccagtacaatgaagaaactgagctagctccttcccatatggcggccgcgaccggagatatgccaacttaccagattcgcgctccgacagccgcattgcctcagggggtggtgatggctgcctctccggggtccttgcactcaccccaacagctggccgaggaagctactagaaagagggaattgagacttatgaagaacagggaagctgcacgagaatgccgacggaagaagaaggaatacgtgaagtgcctggagaacagagtcgccgtccttgagaaccaaaacaaaacgctgatcgaagaactgaaggcactgaaagacctctattgccacaaagtggaatag

SEQ ID NO: 110658 - DNA, 327 bp, Artificial Sequence
  Description of Artificial Sequence: Synthetic coding sequence
atggcagtgacgggagacgatacagcagccactggagatatgcctacgtaccaaatccgcgctcctacagccgccttgccacaaggtgtagttatggctgccagccctggttccctgcacagcccccagcagctggccgaggaggctactcggaaacgggaattgcgactcatgaagaacagggaagccgcaagggagtgcagaaggaaaaagaaagagtatgttaaatgccttgagaatagagtggctgttctagaaaatcagaataaaacgttaatcgaagaactcaaggctctgaaggacttgtactgccataaggtagagtag

SEQ ID NO: 110659 - DNA, 813 bp, Artificial Sequence
  Description of Artificial Sequence: Synthetic coding sequence
atgtggtggcaccagcacaacttgtgctttcgccgacctattgaggaagattacagcagcggcgatgttgaggaaaaagtggctgccattgctgagactgatgagtctgcagagagtgaaggggttatcgactcacacaagagaagggagatactcagtagaaggccctcttatcgcaagattctaaatgagctatcgtcagacgttccgggggtacctaagatcgaggaggagcggagcgaagaggaaggaaccccacctagcatcgccacgatggctgtccccacctccatttatcagactagcacgggacagtatattgccatcgcccagggtggtacaattcaaatttctaacccgggaagtgacggagttcagggtttgcaggcattgacaatgactaacagcggcgcaccgccaccaggtgcaaccatcgtgcagtatgctgcccagtccgcggatgggacacagcagtttttcgtccctggctcacaggtggtcgtgcaggcagctacaggcgacatgcccacctaccagattagagcgcccactgccgccttacctcagggagttgtaatggctgcatctcctggcagtctacacagtcctcagcagctcgcggaggaggccacacgtaaacgcgaactcaggctcatgaagaaccgcgaggcagccaaggaatgccgccgccgaaagaaggagtatgttaaatgcctcgaatctcgcgtggctgtcctggaggtgcaaaacaagaagttgatcgaggaactggagactctgaaggatatctgttcccctaaaaccgactactag

SEQ ID NO: 110660 - DNA, 999 bp, Artificial Sequence
  Description of Artificial Sequence: Synthetic coding sequence
atgaccatggagacagtggaatctcagcacgacggcagtatcactgcatctttaactgaaagcaaatccgcgcacgtgcaaacccagactggccagaatagcattcccgccctggcacaggtgtcagtggcgggcagtggcaccagacgaggatcaccggccgttacacttgtgcaactgccctctgggcagacaattcacgttcaaggggtcattcagaccccccaaccttgggtgattcagtcctcagagatccatacagttcaggtggcagctattgccgaaaccgatgagtctgccgaaagtgaaggggtgattgatagccacaagaggcgtgagattctgtctcggcgccccagctatcgcaagatactgaatgagctgagctccgatgtgccaggggtgcctaaaatcgaagaggagcggtctgaggaggagggaacacctccttccatcgccacgatggctgtgcctactagtatctaccagacaagtaccggacagtacattgctatcgcgcaagggggcaccattcagatctcaaatccgggtagcgacggggttcagggcctgcaggctcttactatgaccaactccggggcgcctcctcccggggcaactattgtacagtacgcggcacagtcagccgacggaacccagcagttcttcgtccccggttcccaagtggtggtccaagccgccaccggggacatgccaacctatcagatccgagctccaactgccgccttaccccagggtgtggtgatggccgcctcacccgggagcctacatagtccacaacagctcgctgaggaagccacccgcaagcgcgagctccgcctgatgaagaacagggaggccgcacgcgagtgccgccggaaaaaaaaagagtacgtcaaatgcttggagaatagagtggcagtactggagaatcaaaacaagacactgattgaagagttgaaagctctgaaggacctgtactgccacaaggtggagtag

SEQ ID NO: 110661 - DNA, 1002 bp, Artificial Sequence
  Description of Artificial Sequence: Synthetic coding sequence
atgaccatggaaacggtagaatcccagcacgacggtagcatcaccgcatccctgacagagagcaaaagtgctcatgtacagactcagacagggcaaaacagcattccagcacttgcgcaagtgagcgtagccgggtccggcacccgcaggggcagccccgctgttacactggtccaactcccttccggccagacaatccacgtgcagggtgtaatacagaccccccagccgtgggtgattcagtctagcgaaatccacaccgtacaggtcgcggccatcgccgagacggacgagtctgccgagtctgaaggcgtcatcgacagccataagcggcgggagatcctgtcacgccggccgtcttaccggaagatccttaatgagctctcttcagatgtccctggtgtgccaaagattgaggaggaacgctcagaggaagaagggactccaccgagtattgccacaatggccgtgcccacatccatctaccaaaccagcaccgggcagtatatagctatcgcgcaaggcggcaccatacaaatttcaaaccccggatctgacggggttcaaggactacaagccctgacgatgacgaattccggcgctccccctcccggggccaccatagtccagtacgccgctcaaagcgctgacggcacacaacagttcttcgttccaggtagccaagtcgtagtgcaggcagccaccggtgacatgcccacttatcagattcgggctccgaccgcagctctgccgcagggggtcgtgatggccgcttccccgggatccctccattcccctcaacagttggcagaggaggccactcggaagcgggagctgcgcctgatgaaaaacagagaggcagccaaggaatgcaggcggaggaagaaggaatacgtcaagtgtctggagtccagagtggctgtgctggaggtccagaacaaaaagcttattgaggagttagagacgctgaaggacatctgttctccgaagaccgactattag

SEQ ID NO: 110662 - DNA, 414 bp, Artificial Sequence
  Description of Artificial Sequence: Synthetic coding sequence
atgactatggagacagtggagtcgcaacacgatggatcaatcaccgcctccctgactgaaagcaagtccgctcacgtgcagactcagacagggcagaactccattcccgcactcgcacaggtggctgccatagcagaaactgacgaaagcgctgagtccgagggagtcatagatagccataagagaagggagatccttagtcgacgcccttcttatcgaaaaatcctgaatgaactgtcatcagacgtgcccggtgttcccaagatcgaagaagagcgaagcgaggaggagggaacacccccgtccattgctactatggcagtgccaacctctatttaccagaccagcaccgggcaatattcaatgtacgccgcaattagatacgacactgtactggcattgtctttgctatag

SEQ ID NO: 110663 - DNA, 666 bp, Artificial Sequence
  Description of Artificial Sequence: Synthetic coding sequence
atgactatggaaacagtggagtctcagcatgacggctccataactgctagcttgactgagtctaaatctgcacatgtccagacccagacagggcaaaacagtatcccagcactggcacaggtggctgcaatagccgaaacagacgagtctgccgaatccgagggtgtcatcgatagccacaagcgtagggaaattctgtcaaggcgacccagttatagaaaaattctcaacgaactttcgagtgacgtgcccggagtgcccaaaatcgaggaagagcgctctgaagaggaaggtacgcccccatctatagcaaccatggcagtcccgacatctatctaccagactagtacaggtcagtataccgccacaggtgatatgccaacatatcagatcagagcaccaaccgcagctctcccacaaggtgtggtgatggccgcaagtccaggatctctgcactccccgcaacagctggccgaagaggcaacacgcaagcgtgagttgcggcttatgaagaatagagaggctgcaaaagagtgtcgaaggcgaaagaaggaatatgtgaaatgcctggagagtcgcgtggctgtcctagaagtgcagaataaaaaactgatagaggaactggagacactgaaagatatctgtagtcctaaaactgactattag

SEQ ID NO: 110664 - DNA, 711 bp, Artificial Sequence
  Description of Artificial Sequence: Synthetic coding sequence
atgtcaaagtgcgcaaggaaaaaatacatcaagactaacccaaggcaaatgactatggaaacggtcgagtcacaacacgacggaagtatcacggcctccttgacagagtccaagagcgctcatgtgcaaacacagacaggacagaacagcatacccgcgcttgcccaggtggccgccattgcagagaccgatgagtcagcagagtccgaaggtgtcattgattcccacaaacgaagggagattctgtcacggagaccctcatatagaaagatccttaacgaactgtctagcgacgtcccaggcgtcccaaaaatcgaggaagagaggtctgaggaagaaggtacaccacccagcattgcaacgatggccgtgcccacttcgatctaccagacctcaacagggcagtacaccgctacaggtgacatgcctacctatcagattagggcccctacggcggcgctgccgcaaggcgttgtcatggcagccagccccggttctcttcacagtccccagcagctggccgaggaagcaaccagaaagagagaactccgcttgatgaaaaatcgtgaggccgcccgggaatgccgtagaaaaaaaaaggagtatgtcaaatgcctcgaaaatcgggtggcagtgctggagaatcaaaacaaaaccctgatagaagagttgaaagcactaaaggatctttactgtcacaaggtagaatag

SEQ ID NO: 110665 - DNA, 849 bp, Artificial Sequence
  Description of Artificial Sequence: Synthetic coding sequence
atgtggtggcaccagcataacttgtgttttcggcgccctatagaggaagattatagtagtggcgacgtggaagagaaagtggccgctatcgcggagacggacgagagcgcagaatccgagggcgttatcgatagtcataaaagaagagaaatcctttccagaaggccatcttatcgtaaaatcttaaacgaactgtcctctgacgtgcctggagttccgaaaatagaagaggaaagaagcgaggaggagggcacgcctcccagcatcgcaactatggcagtgcctactagcatctatcagacgagcactggccagtacattgccattgcccagggcgggaccattcagatctccaaccctggctctgacggtgtccagggacttcaggcgctcacaatgacaaatagcggtgcccccccacccggtgccactatcgtgcagtatgccgcacagtctgctgatgggacgcaacagttcttcgtgccaggctcccaggtcgtagtccaagacgaggagactgaactggccccgagtcatatggcagccgccactggagacatgccgacctaccagataagggcacctacagccgcactgccacagggagtagtgatggccgcctctccggggtctctccacagtccgcagcaactggccgaggaggccacacgaaagcgcgagctgcgactgatgaaaaaccgggaggccgctaaggaatgccgtcggcgcaagaaagagtacgtgaagtgtttagaaagccgagttgcagtgctcgaggtccagaacaaaaagctgatagaggagctggaaaccctgaaagacatctgctcacctaagaccgattactag

SEQ ID NO: 110666 - DNA, 1086 bp, Artificial Sequence
  Description of Artificial Sequence: Synthetic coding sequence
atgtccaagtgcgcccgaaagaagtatatcaaaaccaacccgagacagatgaccatggagactgtggaatctcaacacgacggatcaatcaccgcatccctcacagaatccaaatcagctcacgtgcagactcaaaccggccaaaatagtatcccagctcttgcacaggtgtctgtcgcaggatcagggaccagacgcggttcccctgccgtgactctcgtccaacttccatcgggtcagacaattcacgttcaaggggtcatccaaactcctcagccatgggtgatccagtccagcgaaatccacactgtacaggtggcggccattgctgagaccgacgagagcgcagagtctgagggcgttattgactcccacaagagaagggagatcctcagccggcggcccagttacaggaagatcctcaatgaattgtcctctgacgtacctggggtgcccaaaatcgaggaggaaagatccgaggaagagggcactccgccctccattgccaccatggctgtgccaacttcgatctaccagacgtctacgggacagtatattgccatcgcacagggaggcactatccagatcagcaatccaggcagcgatggcgtgcaaggcttgcaagcgttgaccatgacgaattccggtgcccctccgcctggggccacgatcgtgcagtatgcagcccaatcagccgacggcacccagcagtttttcgtgcctgggtcacaggtggtagtgcaggacgaagagaccgaacttgctccctctcacatggcggccgcgacaggtgacatgcccacgtaccaaatccgagcccccactgcggcactgccccagggagtggttatggcggcatctccaggaagcctacactcccctcaacagctggccgaggaggccacacggaagagagagctccgccttatgaaaaatcgcgaagccgcaaaagagtgcagaaggcgaaaaaaggaatacgtgaaatgcctggaatcccgggtggccgtgctggaggtacagaacaagaaattgatagaggaacttgaaaccctcaaggatatctgctctcctaagacagattattag

SEQ ID NO: 110667 - DNA, 474 bp, Artificial Sequence
  Description of Artificial Sequence: Synthetic coding sequence
atgtccaagtgcgcccgtaagaaatacatcaaaactaacccccgtcagatgactatggagacggtagagtctcaacacgatggttccataacagcctcactgacagagtcaaaatcagctcacgtccagactcagaccgggcaaaactctattccggccctggcgcaggttgcagccattgctgaaactgacgaatccgcagagtctgagggggtgattgatagccacaaacgcagagaaattctgagtaggaggcccagctatagaaaaattcttaatgaactatcctccgacgtgccgggtgtgcccaaaatcgaagaggagcgttcggaagaagagggaacccctccaagcatagcaacaatggccgtccctacaagtatataccaaacctcaacgggacaatacatcgccattgcacagggcggtactattcaaatttccaaccctggctcggacggggtccagggttag

SEQ ID NO: 110668 - DNA, 1038 bp, Artificial Sequence
  Description of Artificial Sequence: Synthetic coding sequence
atgactatggagacagtggagagccagcatgacggatcaattaccgcttcgctgaccgagagcaaatccgcccacgttcaaacacaaactggccaaaattcgatacctgctctggcacaagtgagcgtcgccggaagtgggacgaggcggggctcacctgctgtgaccctagtgcaactgccttccgggcagacaatacatgtgcagggggtgatccagactccccagccatgggtaatccagtcctccgaaatacacacggtccaagttgcagctattgcggagacagacgagagcgccgagtccgagggggtgattgattcccacaaaagaagagagattctatccagaagaccgagctatagaaaaatactaaatgaactgtcatctgacgttcctggcgtgccaaaaattgaagaagaaaggtccgaggaggaagggacgcccccctcaattgctacgatggcggtgccaaccagtatctaccagacaagcacagggcagtatatcgccatcgcccagggcgggacaattcagatatccaaccccggaagtgacggagttcagggtctccaggcactgacgatgacaaacagtggggcaccccctccaggtgctacaatcgtccaatatgcagcccagagtgctgatggcacgcagcagttcttcgtgcccggctcccaagtagttgtgcaggatgaggagactgagcttgcgccttcacacatggcagcagccactggcgacatgccgacgtaccaaattagggcccctaccgctgcccttcctcagggtgtcgtgatggctgccagccctggttcactgcactctccccagcagcttgcagaggaggccacaaggaagcgggagttgaggctgatgaagaatagagaagctgctaaagagtgcagacgccggaaaaaagaatacgtgaaatgcctggaatcacgagtggcagtcctggaagtgcagaataagaaactgatagaggagctcgaaacactgaaggacatctgctcacctaagaccgattactag

SEQ ID NO: 110669 - DNA, 858 bp, Artificial Sequence
  Description of Artificial Sequence: Synthetic coding sequence
atgtcaaaatgtgcacgtaagaaatatataaaaacaaacccacggcagatgactatggaaacggtagaatcccaacatgatggatcgattaccgcaagcttaaccgagagtaaaagcgcccacgtgcagacacagacgggacaaaactctatccccgcactcgcgcaggtttcagttgccggttctggaactcgaaggggatctccagctgtcaccctcgtgcagctgccaagcggacagacaatccacgtgcaaggtgtgatccagactccacagccatgggtgattcagagcagcgagatccataccgtgcaggtggccgctatagctgaaactgatgagtcagcagagtccgagggcgtgattgacagccacaaaaggcgcgagattctctcacgacgcccatcgtatcggaaaatcctgaatgaattgagctctgacgtgcccggtgtgcctaaaattgaggaagagagaagtgaggaggagggaactcccccctctatcgccactatggccgttccaacaagtatctatcagacttccacaggtcagtatactgcaaccggcgatatgcccacataccagatccgcgcacccactgctgccctgcctcagggcgtggttatggcagcgagccctggctctctgcacagtccccagcaactagcagaagaagcaacccggaagcgggagctcaggcttatgaaaaacagggaagcggccagggagtgccgaaggaagaagaaagagtatgtaaaatgcctcgaaaatcgggtcgcagtgctggagaaccagaataagacactgatcgaggaactgaaggcacttaaggatctgtattgccataaggtggaatag

SEQ ID NO: 110670 - DNA, 288 bp, Artificial Sequence
  Description of Artificial Sequence: Synthetic coding sequence
atgcccacctatcaaatcagggcacccaccgctgcccttccccaaggtgttgtcatggccgcgagtcctggcagcctgcatagcccacagcaactggcagaggaagctaccaggaagcgggagcttagactgatgaaaaatagggaagcggctagggaatgtagacggaagaagaaggagtacgtgaaatgcctggaaaatagagtggccgtcctcgagaaccaaaacaagacacttattgaggagctgaaggctctcaaggatctctattgccacaaagtcgaatag

SEQ ID NO: 110671 - DNA, 810 bp, Artificial Sequence
  Description of Artificial Sequence: Synthetic coding sequence
atgactatggagaccgtcgaatctcagcatgatggatcaattacagccagcctgactgagagcaagtctgcccacgtgcagacccagaccggccaaaactccataccagcgttggcacaggttagcgtggcggggagtggtaccaggcggggaagcccagctgtgacactggtgcagcttcccagcggccagacgatacatgttcaaggcgtcatccagacaccacaaccatgggtcattcaatccagtgagatccatacagtccaggttgccgctatcgctgaaacagatgaaagtgccgagtccgagggcgtcattgattcccataaacggagagagatcctgagtcgccgtccttcttaccgaaagattctcaatgagctttcaagcgacgtccctggcgtgcctaaaatcgaggaggagaggtcagaggaagagggcactccaccaagcattgcaaccatggcagtgcctaccagcatttaccaaacatctactgggcagtacaccgccaccggcgatatgcccacctaccagatccgggctcctacggccgcgcttccccaaggggtggtgatggccgcatcccccggaagcctccactccccccagcagttagcagaggaggcaacaaggaagcgcgagctccggctcatgaagaatcgggaggccgcacgggaatgtcgccggaaaaagaaagagtacgtgaagtgcctcgagaaccgagtggccgtgctggaaaatcagaacaaaacactaatcgaggagctgaaagcccttaaggatctctactgccacaaagtggagtag

SEQ ID NO: 110672 - DNA, 585 bp, Artificial Sequence
  Description of Artificial Sequence: Synthetic coding sequence
atggtggcagccatcgctgagaccgacgagagtgccgagtctgaaggtgtcattgattcacacaaacggcgggagatcctctctcgccgcccctcatatcgcaagatattaaatgaactgagctccgatgtgcctggagttccaaagattgaggaggagagaagcgaagaggaaggcactccgccctctatagccactatggccgtccctacatccatttatcagacctctacgggccagtacaatgaggaaacagaactcgccccttcccatatggcagctgccacaggagatatgccgacctatcagatccgggcccccaccgctgccctcccacaaggggtggtaatggcagcatccccaggaagtctgcattctcctcagcagctggctgaggaagccaccagaaaacgagaactgcgtttaatgaaaaaccgggaagccgcaaaagagtgtcgacgacgaaagaaagaatacgtgaaatgtctggagtcacgagtagccgttctggaggtccagaataaaaagttaatagaagagttagagactctgaaagatatctgctccccaaagacagactattag

SEQ ID NO: 110673 - DNA, 363 bp, Artificial Sequence
  Description of Artificial Sequence: Synthetic coding sequence
atggcagtgaccggcgacgacacggatgaagaaacagagctcgcccccagtcacatggctgcagctacaggggacatgccgacataccagatccgcgcgcccaccgccgcactgcctcagggcgtggtgatggcagcttctcctgggtcccttcatagtccacagcagttagccgaagaagcaacccgaaagcgggaattacggcttatgaaaaatagagaggctgccagagagtgccggcggaagaagaaagagtacgtgaagtgcttagagaaccgcgttgctgtactcgaaaaccagaacaaaaccctgatagaagaactgaaggcgctgaaggatttatattgccacaaagttgagtag

SEQ ID NO: 110674 - DNA, 291 bp, Artificial Sequence
  Description of Artificial Sequence: Synthetic coding sequence
atgcccacctatcagattcgggcacccactgcggccttgccccagggagttgtgatggctgcctcccccggatctttacattcaccgcagcagctcgccgaagaggcaacacgaaagcgggagctgcgcctaatgaaaaatcgcgaggccgcaaaggagtgcagaagaagaaaaaaagaatatgtcaaatgtctggaatccagggtggcagtcctcgaagtccagaataaaaaactcatagaggagctggaaacccttaaagacatttgttctcccaagacggattattag

SEQ ID NO: 110675 - DNA, 339 bp, Artificial Sequence
  Description of Artificial Sequence: Synthetic coding sequence
atgaacagaacccaagagctgtccgggcagctgagcgctgcaactggcgacatgcccacctaccagattagagctccaactgctgccctcccacaaggggtggtaatggccgcgtctcctggctcgctccactcacctcaacagctggcggaggaggccaccaggaaaagggaactccgcctcatgaaaaaccgcgaggcagcaagggaatgtaggagaaaaaagaaggagtacgtaaaatgcctggagaaccgtgttgctgttcttgagaaccaaaacaaaacacttatcgaggagctgaaagctctcaaagatctgtactgtcacaaagtagaatag

SEQ ID NO: 110676 - DNA, 939 bp, Artificial Sequence
  Description of Artificial Sequence: Synthetic coding sequence
atgtcgaagtgtgctaggaagaaatatatcaaaacgaatccacggcaaatgactatggagaccgttgaatctcagcacgacggaagtattaccgcttccttaaccgaaagtaagtcggctcacgtgcagactcagacaggtcagaactcaattcccgccttagctcaagtggcagccatcgcagagactgacgagagcgccgagtccgaaggtgtgattgactcccacaaaaggcgggaaattctgtctcggcgcccaagctataggaaaattcttaacgagctgagtagtgatgtgccaggggtgccaaagatcgaagaggaaagaagtgaggaggagggcacccctccttctatagctaccatggcagtgccgacatcgatctaccagacatccactgggcagtatatcgccatcgcccagggcggcactatccagatttctaaccccggctcagatggtgtgcagggcctgcaggctctcaccatgacaaacagtggagcccccccccctggggccaccattgtccagtacgcagcacagtctgctgacggtacccagcagtttttcgtgccaggatcccaggttgtagtgcaagatgaggagaccgagcttgctccatcacacatggccgccgccaccggtgacatgcctacctaccagataagggccccaacggccgctctgccccaaggggtggtaatggctgcaagtccagggagccttcacagcccccagcagcttgctgaagaagcgacgcgcaagcgggagctcaggctgatgaaaaaccgcgaagccgccaaggaatgcagacggcggaaaaaagaatatgtgaagtgtctggaatcccgggtggcggtactagaggtccaaaataagaaacttatcgaagagcttgagactctcaaagatatctgctcaccaaagacagactattag

SEQ ID NO: 110677 - DNA, 660 bp, Artificial Sequence
  Description of Artificial Sequence: Synthetic coding sequence
atgtggtggcatcagcacaacctatgttttagaaggcctatcgaggaggattattcgagcggtgacgtcgaggagaaggtagctgccatcgccgaaactgatgagagcgccgagagtgaaggcgtaatagattcacacaagcgtcgtgagattctcagtaggagaccaagctatcgcaagatcctgaacgagcttagtagcgatgttcctggggtccctaagatcgaagaggaacgatccgaggaggaagggaccccccctagcatcgctacaatggcggtgcccacctcaatttatcagacttccacaggtcagtacaacgaggaaaccgaactggccccgtctcacatggcagccgccacgggggatatgccaacttaccagatccgggcccccaccgccgcgttgccgcagggtgtcgtcatggcagcatccccagggtctctccactcacctcagcagctcgccgaggaggctaccaggaagcgagaactacgtctgatgaaaaatcgggaggctgccaaggaatgtcgccgcaggaagaaggagtacgtcaagtgtcttgagtcaagagtcgccgtactcgaggtgcagaacaagaagttaattgaggagctggagacgttgaaggatatatgttctccgaaaacggactactag

SEQ ID NO: 110678 - DNA, 366 bp, Artificial Sequence
  Description of Artificial Sequence: Synthetic coding sequence
atggcggtgaccggcgacgacaccgatgaagaaacagagctggctcctagccatatggcggctgcaacaggggacatgcccacataccagatccgcgctccaacagctgcactcccccagggagtagtgatggccgcttctcccgggtcccttcatagtcctcagcagctcgcagaagaagcgacccgtaagagagagttacgcttgatgaagaatcgcgaggcagctaaggagtgtagacgacgcaaaaaagagtatgtgaagtgtctggagtcacgcgtggcagtattagaggtgcagaataagaaactcattgaggagctggaaaccctcaaggacatatgttccccaaagactgattattag

SEQ ID NO: 110679 - DNA, 330 bp, Artificial Sequence
  Description of Artificial Sequence: Synthetic coding sequence
atggccgtaaccggcgatgacacagcggcaaccggggatatgccaacttaccagattagggcccctacggcagccttaccgcagggcgtggttatggccgcttcccccggctccttgcatagcccccaacagttggccgaagaggctacgcgtaaacgggagctgcgcttaatgaagaatagagaagccgctaaggagtgccgacgcagaaagaaagagtacgtgaagtgcctggagtcacgcgttgccgttcttgaggtgcagaacaaaaaactcatcgaggagctcgaaaccctaaaggacatttgctctcccaaaacagactattag

SEQ ID NO: 110680 - DNA, 309 bp, Artificial Sequence
  Description of Artificial Sequence: Synthetic coding sequence
atggctgcagccacgggcgacatgcccacataccaaatcagagccccaactgcggccctacctcagggagtggtcatggccgcctctcccggttccctgcactctcctcagcagctcgccgaggaagcaactcggaagcgcgagctccggctaatgaagaaccgggaagctgctcgcgagtgcagacgaaagaagaaggagtatgtaaagtgtttggagaatcgcgtggccgtgttggaaaatcagaataaaaccctgatcgaggaattaaaggccctcaaggacttgtattgccataaggttgagtag

SEQ ID NO: 110681 - DNA, 414 bp, Artificial Sequence
  Description of Artificial Sequence: Synthetic coding sequence
atgacaatggaaaccgttgagtcacaacacgacggatcaatcaccgcctctctcacggaatccaagtctgcacatgtccaaacccagaccggacagaacagtatcccagccctggcccaggtggccgccattgctgaaactgatgaatcagcagaaagtgaaggtgttatcgattctcataagaggagggagatcctgtccaggaggccctcctatcgcaagattctcaatgaattgtctagtgatgtcccaggcgtaccaaaaattgaggaagagcgctccgaggaagaaggaacgcccccatccatcgccactatggctgtgcccacatctatttaccagacaagcacaggacagtattccatgtatgccgcgattcgctatgataccgtccttgccttgtctctgctgtag

SEQ ID NO: 110682 - DNA, 618 bp, Artificial Sequence
  Description of Artificial Sequence: Synthetic coding sequence
atgaccatggaaacggttgagtcacagcatgatgggtctatcaccgcctccttgactgagagtaagtccgctcacgtgcaaacccagacaggacagaattccatacctgcccttgcccaagtggtggctattgcccagggaggcactattcagatttccaatcccggctctgatggtgtgcaggggctccaagctttaactatgacaaacagcggggctccgccgccaggggcaaccattgtacaatacgccgctcagtccgccgacggcacccagcagttctttgtgcccgggagccaagtagtcgtgcaggccgccacaggagacatgcccacctatcagatccgtgctcctacagctgctctcccccaaggggtggtaatggccgcctctccaggatccctccactccccccaacagctggcagaggaagccaccaggaagagagagttgcggttaatgaagaatcgggaagcggcgaaagagtgcagaagacggaagaaagagtatgttaagtgcctggaatccagagttgctgtgttggaggtgcaaaataagaagcttattgaggagcttgagactcttaaggacatctgttcacctaagaccgactactag

SEQ ID NO: 110683 - DNA, 813 bp, Artificial Sequence
  Description of Artificial Sequence: Synthetic coding sequence
atgaccatggaaaccgtcgagagtcagcacgacggatctatcacagcgagcctcacagagagcaaatccgctcacgtgcagacccaaacaggtcagaacagtatccctgccctcgcacaggtgagcgtagcgggttcaggaacaagaaggggatcacccgctgtaacgctggtccagctgccatcagggcagaccatccacgtccagggggtgatccaaacaccgcagccgtgggtcattcagtcgtccgagatacacacagttcaggtggccgctattgccgaaaccgacgaaagtgctgagtcggaaggcgtgatcgatagccataagcggagggagatcctgtcgcgtaggccttcctaccgaaaaatcctcaacgaattgagctctgatgtgcccggggttcctaaaatcgaagaagagagaagtgaagaagagggaacccctccctcaatcgccacaatggcggttcccacctccatttaccagacaagcaccggccagtatactgctacaggtgacatgccgacataccagatacgagccccaactgcagcgttgccgcagggagtggtgatggccgcatccccgggtagtctgcattcaccacagcagcttgccgaagaggccacgcgcaaacgggaattgagactgatgaagaacagagaagccgctaaggagtgccggcgtagaaagaaggagtatgtgaagtgcttggaatcgcgggtggctgtgctcgaagtccaaaacaaaaagctaatcgaggagctcgagaccctcaaagatatttgtagccccaaaaccgattattag

SEQ ID NO: 110684 - DNA, 342 bp, Artificial Sequence
  Description of Artificial Sequence: Synthetic coding sequence
atgaaccggacacaggaactgtctggccagttatctgccgccactggagacatgcctacttaccaaatacgtgcacccaccgctgccctgcctcagggtgtagtcatggccgcctcgccgggttcactgcatagtcctcagcaactcgcagaggaagccacacgcaaacgggaactgcgacttatgaagaatcgggaggccgctaaggagtgcaggaggcggaaaaaggaatacgtgaagtgtttggaaagccgggtggccgtcctggaagtgcagaacaaaaagctcattgaggagttggagacactcaaagatatctgctcgcccaaaaccgattactag

SEQ ID NO: 110685 - DNA, 465 bp, Artificial Sequence
  Description of Artificial Sequence: Synthetic coding sequence
atgacaatggaaaccgtcgagtcccaacacgacggttccatcaccgccagcctaacagagagcaaatccgctcatgtccagactcaaacaggccagaacagcattcccgccctggcacaggttgatgaggaaaccgagctcgctccctcgcacatggcagctgcaaccggcgacatgccaacataccagattagggccccaacagcagccttgccacaaggcgttgtgatggccgctagcccagggtccttgcactccccacagcaactggccgaggaggccaccaggaaacgagagctgaggctgatgaagaatcgggaggcagccaaagagtgtcgcaggcggaaaaaggagtacgtgaagtgcctggagtcccgggtggcagtgctcgaggtccagaacaaaaaactgattgaagagctcgaaactttgaaggatatttgcagtcctaagacagactactag

SEQ ID NO: 110686 - DNA, 339 bp, Artificial Sequence
  Description of Artificial Sequence: Synthetic coding sequence
atgtcggcagaagttcctgaggccgctagtgccgaggaacagaaagagatggaggataaagtgacaagcccggagaaggcggaggaggctaagctaaaagcgagatacccccatctcgggcagaaacccggcgggagcgatttcctgcggaagcgactccagaaggggcagaagtacttcgacagtggggattataatatggctaaggctaagatgaaaaacaaacagctgccaacagccgccccagataaaacagaggtcaccggagatcacattcctacaccacaggacctgccacagcgaaaaccatccctggtggcttccaaacttgctgggtag

SEQ ID NO: 110687 - DNA, 1926 bp, Artificial Sequence
  Description of Artificial Sequence: Synthetic coding sequence
atgactgaaaagcctgaatttcagagtcaggtgtacaactacgcaaaagacaacaacatcaagcaggattctttcaaggaagagaacccaatggaaacttctgtgagcgcgaataccgaccagcttgggaacgaatactttagacagcctcctccgcgaagcccccctctcatccattgcagtggcgaaatgctcaagtttactgagaagagcctggctaaaagtatcgcgaaggagtcggcgctgaacccctctcagccgcccagttttctctgtaaaacagcagtacctagcaaggaaattcaaaactacggggagatacctgaaatgagcgtctcatatgagaaagaggtgaccgctgagggagtagagaggccagagatcgtgtccacctggagttccgctggtataagctggcggagcgaggcgtgccgggaaaattgcgagatgcccgactgggaacagtcagcagagtccttgcaacccgttcaagaggacatggctctcaacgaagtgttgcagaagctgaagcacaccaaccggaagcaagaagtcaggattcaagaattgcaatgcagcaacctatatttggagaaacgcgtcaaggaactccagatgaagatcactaagcagcaagtgtttattgacgtcattaacaaactaaaggagaacgttgaggagctgattgaggataagtacaagatcatccttgagaagaatgacactaagaagaccctgcagaacctggaggaggtcttggctaatacccagaaacatctgcaagagagtaggaatgacaaagagatgttgcagctgcagttcaaaaagatcaaggccaattatgtctgcctgcaggagcgttacatgaccgagatgcagcaaaagaacaagtccgtatcccagtatctcgagatggacaagactctgtccaagaaggaagaagaggtggagcgattgcagcagctgaaaaaagagctagaaaaagctaccgcctccgccctggatttattaaagagagagaaagaggcccaggagcaggagtttttaagccttcaggaggaattccaaaaactcgaaaaggaaaatttggaagagagacagaagctgaaatccagattggagaagcttctaacccaggtgagaaaccttcagttcatgtcagagaacgagagaacaaagaacattaaattgcaacagcagataaatgaagtgaagaacgagaacgccaagctgaagcaacaggtggccagaagcgaagaacaaaattacgtccctaagtttgaaactgcccagctcaaagatcagctggaagaggttctcaagagcgatattacgaaggacactaagacaacgcatagcaacttgctgcctgactgcagcccatgtgaagagcgcctgaacccggccgatatcaaacgggcttcacagctggcaagcaagatgcatagcttgttggccctgatggtcggcttactaacctgccaggatattattaacagcgacgcggaacactttaaagagagcgagaaagtgagcgacattatgctgcagaagctcaaatcactgcacctcaaaaaaaagaccctcgataaggaggtcatagactgcgatagtgacgaggctaagtctattcgggacgtcccgactcttctgggagcaaaactcgacaaatatcatagcctgaacgaagagctggactttctcgtgacatcctatgaggaaatcatcgaatgtgccgaccagaggttagctatcagccactcacaaattgcccatctcgaagaaaggaacaaacatcttgaggacctgatccggaaacctcgcgagaaagcccggaagccccggtcaaaatcactcgagaatcatcccaaaagcatgaccatgatgccagcactgttcaaggaaaatagaaacgatcttgattag

SEQ ID NO: 110688 - DNA, 2475 bp, Artificial Sequence
  Description of Artificial Sequence: Synthetic coding sequence
atgaataaggattaccagaagttctggtcttctccgtcagacccagtccactttgaagtggacacgagtcacgagaaagtggagagcatgtccgagagcgatacaatgaatgtgtccaatctatctcagggagtgatgctttctcacagtcccatctgcatggaaaccactgggacaacttgtgatctaccgcagaatgagattaaaaacttcgaaagagaaaatgaatacgagagtacattatgtgaagacgcctatggaactctggataatctgctcaacgacaataacatcgaaaactacagcactaacgctctgattcagccagtagataccatctcaatttctagtttgagacagtttgaaactgtgtgtaagtttcattgggtggaagccttcgacgacgaaatgaccgaaaagcccgagtttcaatcccaggtctacaactacgcgaaagacaacaatattaagcaggactcatttaaggaggagaatccaatggagacgtccgtctcagctaacacagaccaattaggaaatgagtacttcagacaaccgcctcctcggtcacctcccctaatccactgctcgggagagatgcttaagtttaccgagaagagcttggctaagagtatcgccaaggaatctgccttaaaccccagccagcccccctccttcctgtgcaagactgcagtgcccagtaaagagattcagaactatggagaaatcccagagatgagtgttagctatgaaaaagaagtcaccgcagaaggtgtggagcgccccgagattgtatccacatggtcgtctgccggaatatcttggcggtcagaagcctgccgtgagaattgcgaaatgcccgactgggagcaaagcgccgagagtctgcagcccgttcaggaggacatggcgctgaatgaggtgctgcagaaacttaagcacaccaatagaaaacaagaggttaggattcaggagttacagtgttcaaatctgtatctggagaagcgagtgaaagaactgcagatgaagattacaaagcaacaggtgtttatcgacgtaattaacaaactgaaagaaaatgtggaggaattaattgaggataagtacaaaatcattctggagaaaaacgatactaagaaaactttacaaaatcttgaggaggtccttgccaacacccagaagcatttacaggaatctaggaacgacaaagagatgcttcagttgcagtttaagaagatcaaagccaactacgtttgtcttcaggagaggtatatgactgagatgcagcaaaagaataaatccgtatcccagtatctggagatggataagacattatcaaagaaagaagaggaagtggaacgacttcagcagctcaagaaagagctggagaaagccaccgcctccgcattggatctcctgaagagggagaaagaagctcaggaacaggaatttttgtccctgcaggaggagttccaaaaacttgaaaaagaaaacctcgaggagagacagaagctgaagtctagactcgaaaagctactgacccaggtgaggaaccttcaatttatgtccgagaacgagcggacaaagaatataaagctgcagcagcagattaatgaggttaagaatgaaaatgccaaactgaaacagcaggtggctcggtctgaggaacagaattatgtgcccaaattcgagactgcccagctgaaggaccaactcgaagaggtgctgaaatcagatataacaaaggacaccaagactacgcacagcaacctcctcccagattgtagtccatgcgaagagcgccttaatccagcagatattaaacgcgcaagccagctagcctccaagatgcattctttacttgctctgatggttggactcctcacatgtcaggacatcatcaactctgatgctgagcatttcaaggagtcagagaaagtttcggatataatgctgcagaaactgaaaagcctgcatttgaagaagaagactctggataaggaactactgaaacacaaagaccggataaccacttttcgggagctgatagccaaagagaaagctttccaggatcatgccattaaggtgatcgattgtgactccgacgaggctaagtctatcagagacgtgccgacactcctcggggctaaactcgataagtatcattccctaaatgaggaactggactttctcgtgacttcctatgaagaaatcattgagtgcgccgaccagagattagcaatcagtcattcccagatagcacatctggaagagaggaacaagcacctggaggatctgatccggaagccccgagagaaggcgcggaaaccgcgtagtaagagccttgagaaccacccaaagtctatgacgatgctcgcctacaatctctatatatttattgggtatagattgggcgccgtggcagacgcatgcaacccaagtaccctcggcgggcgcggtggctggataacctag

SEQ ID NO: 110689 - DNA, 2334 bp, Artificial Sequence
  Description of Artificial Sequence: Synthetic coding sequence
atgaataaggattaccagaagttctggtcttctcccagcgatcccgtgcatttcgaggtggatacaagccatgaaaaagtggagtctatgagcgaaagcgacaccatgaatgtttctaacctctcacagggcgtcatgctgtcccacagccccatctgcatggagacaacagggaccacatgcgaccttccccagaacgagattaaaaacttcgagcgtgaaaatgagtatgagtccaccctctgcgaagacgcttacggaacgctggataatctgctgaacgacaacaatattgagaattatagcaccaatgcactgattcagcccgtggatacaatcagcatctcttccctgaggcagtttgagacagtctgtaagtttcattgggtcgaagcatttgacgacgagatgaccgaaaaaccggaattccagtcccaggtgtataattacgccaaagataataatataaagcaggactcattcaaggaagagaaccccatggagactagcgtgtccgccaacacagaccagctcggcaatgagtattttcggcaacctccccctcgttcaccacctctgattcattgtagtggggagatgctcaagttcacagagaagagcctcgccaagtccatcgccaaagagtccgcactaaacccaagccaaccaccttcctttctgtgcaagaccgccgttcctagtaaggaaatccagaattacggggaaattccagagatgagcgtctcctacgagaaggaagtaaccgccgagggggtggaaagacctgaaattgtctcaacttggagctcggctggaatcagctggagatcagaggcttgtagagagaattgtgagatgcctgactgggagcagagcgctgagtctctgcaaccagttcaggaagacatggccctcaatgaagttttacaaaaactcaagcatacaaatcggaagcaggaggtgcggatccaagaactccaatgttccaatttgtatttagagaagagggtcaaggaactgcagatgaagattaccaaacagcaggtgtttatcgacgtgatcaacaaactcaaggagaacgttgaagaactcatcgaggataaatacaaaataatcctggaaaagaacgacaccaaaaaaaccctccagaatctcgaagaggttctggccaatacacagaaacatttgcaggagtctagaaacgacaaagagatgctacaattacagttcaagaagatcaaggccaactatgtgtgtctacaggagcggtacatgaccgaaatgcagcagaaaaataaaagcgtaagccagtatctggagatggataagactctgtctaagaaagaggaggaagtcgagcgactacagcagttgaagaaggagctggagaaagccaccgcatctgccctggatctgctaaagcgggagaaagaggcccaggagcaggaattcctgtcactccaggaggagttccaaaagcttgaaaaggagaacctcgaagagcggcagaagctgaagagccgcctggaaaaacttctgactcaagtccggaacctgcagtttatgtccgagaatgagcggaccaaaaacataaagctacagcagcagataaatgaggtcaaaaatgaaaacgcaaagctgaagcaacaagtcgcacgcagcgaggaacaaaactatgtgccaaagtttgaaacggcccagcttaaagaccagcttgaagaggttctgaaaagtgacattactaaggatacaaagactacccactctaatctgttacccgactgctctccctgcgaagagagactgaaccccgccgatatcaaaagggccagtcagctagccagtaaaatgcattccctcctggctcttatggttgggttgctaacttgccaggatatcattaactccgatgccgagcattttaaagaaagcgagaaggtgagcgacatcatgctgcagaagttaaagtcactccatctcaaaaaaaaaaccctagacaaggaggtcatcgactgcgattcagacgaagctaaatccataagagatgtaccaactttgctcggggccaagttagacaaataccacagcctgaacgaggaactcgatttcctcgtaaccagctacgaggaaatcatagagtgcgccgaccagcgactggccattagtcacagccagattgcccatttggaggagagaaataagcacctggaggacctgatccggaagccccgcgaaaaggccagaaagccaaggtcaaagagcctggaaaatcaccccaagagcatgacaatgatgcccgcactgttcaaagagaaccgcaatgatctcgactag

SEQ ID NO: 110690 - DNA, 2103 bp, Artificial Sequence
  Description of Artificial Sequence: Synthetic coding sequence
atgaataaggactaccagaagttttggtcaagcccgagtgatccagtgcacttcgaagtggacaccagccacgaaaaggttgagtctatgtcagagtcagataccatgaatgtaagcaatttatcacagggagtgatgctttcgcacagtcctatttgtatggaaacaactggcacaacttgtgatctgccacagaacgagatcaagaattttgaacgcgaaaatgaatacgaaagtacactttgtgaagacgcttatggcacgctggataacctcctgaacgacaacaatattgagaattactctacaaacgccctaatacagccagtcgacactatctcaatttcttcattgcgccaattcgagactgtgtgcaaattccactgggtggaagcctttgacgatgaaatgactgaaaagcccgaatttcagtcgcaggtgtataattacgctaaagacaacaacatcaagcaggactctttcaaggaggagaaccctatggaaacttccgtctctgccaataccgatcagctgggcaacgagtactttaggcagccccccccgcgcagtcctccactgattcactgctcaggcgagatgctcaagtttacagaaaagtctctggcaaagtctattgccaaggagagcgctttaaaccctagccagcccccgtcgttcctgtgtaaaacggctgtgcctagtaaagaaattcaaaattacggagagataccagaaatgtccgtgtcctatgagaaggaagtgaccgcggaaggcgtcgagaggcccgagatcgttagcacttggagcagcgccggcataagttggcgttccgaagcttgtcgagaaaactgtgaaatgccagattgggagcaatccgccgagtccctgcagccagtccaagaggacatggccttaaatgaggtgctgcaaaagctcaaacacaccaacagaaaacaagaagtcaggatacaggaactgcaatgctccaacctctatttggaaaaaagggtgaaagagcttcagatgaaaatcactaaacaacaggtcttcattgacgtgataaacaagctgaaggagaatgtggaagagctgattgaggacaaatacaagatcatcttggagaaaaatgatactaagaagacattacagaatctggaagaagtgctggcaaacacccaaaagcacctgcaggaaagccggaacgacaaggaaatgcttcagctgcagtttaaaaagatcaaggcgaactacgtttgcctccaggaaaggtacatgacggaaatgcagcagaaaaacaagtcggtgtcacagtacttggagatggacaaaacactcagcaaaaaggaggaggaggtggagcggctccagcagctgaaaaaggaactggaaaaggcaaccgcaagtgcattggacctgctgaaacgggagaaagaagcccaagagcaagagtttctatctctccaagaggaatttcagaagctagagaaagagaatctggaggaacggcagaagctgaagagccgcttagaaaagcttctgacccaagttcggaacttacagtttatgtctgagaatgaacgtacaaagaatattaaattgcagcagcagatcaacgaggtcaaaaatgaaaatgctaaactgaagcagcaggtggcaaggtcggaagagcagaattacgtgcccaaattcgagacggctcagctcaaggatcaactcgaagaggtcctgaagagcgacatcaccaaggatacaaaaaccacacatagcaatctgctgccagactgttccccttgcgaggagcgactaaatcctgccgacatcaaaagagcctcgcaactagcctcaaagatgcactctctgctggcgctgatggtggggctcctgacttgccaggacattattaactccgacgctgagcatttcaaagaatccgagaaggtgagcgacataatgttgcagaagttaaagagcttgcacctgaagaaaaagaccttggataaagaattgctcaaacacaaagatcggattacaacgtttagggaactgatcgcaaaggaaaaggcgtttcaggaccatgcaattaaggtctttcagggagtttag

SEQ ID NO: 110691 - DNA, 2520 bp, Artificial Sequence
  Description of Artificial Sequence: Synthetic coding sequence
atgaacaaggactatcagaagttctggtcgtcgccatcagacccagtgcatttcgaggtcgacacctctcatgaaaaggtcgaaagcatgtccgagagtgatactatgaacgtgtctaatttgagccaaggagtgatgctctcccatagtcccatttgtatggagaccaccggcaccacatgtgacttgccccagaatgagatcaagaatttcgaaagagagaacgaatatgaatccaccttatgcgaggacgcgtacggtacgctggacaacttgctgaacgacaataacatcgagaactactctaccaatgcactaatccagcctgttgatactatttcaatctcgagcctgcgccaatttgaaactgtatgcaagtttcattgggtggaagcatttgatgacgagatgactgaaaagccggaatttcaaagccaagtctacaactacgccaaggacaacaatataaagcaggactcttttaaagaggaaaacccaatggaaacatcggtttcggctaataccgatcagctgggcaatgaatactttcgtcagcctcccccccggtctcctcccttgattcattgttctggagagatgctgaagttcacagaaaaatccctagctaagtcaatcgcaaaagagagcgcattgaacccgtctcagcccccatctttcttgtgcaagacggccgtgccctcaaaggaaatccagaattatggggagattccagaaatgagcgtgagctatgagaaggaagttacggccgaaggcgtggagcgtcccgagatcgttagtacctggtcctctgccggaatctcatggcgaagcgaagcatgtcgggaaaattgcgagatgcccgactgggagcaatctgcggagtctttgcagccagtccaggaagacatggccctgaatgaagtgctgcaaaagcttaagcatacaaaccgaaaacaggaggtccgcatacaggagttgcagtgtagcaatctttatctggaaaagcgcgtaaaggaactccaaatgaagatcaccaaacagcaagtgttcattgatgtgatcaacaaactgaaggagaatgtggaagaattgatcgaggataagtacaaaatcatcttggaaaaaaatgacaccaagaaaaccctgcagaatctcgaagaggtgctggccaacacacagaagcaccttcaggaatctagaaacgacaaagagatgctgcagttgcaatttaaaaaaattaaagctaattacgtttgtctgcaggagcgatatatgactgagatgcagcagaagaataagtccgtctcacaatacctcgaaatggacaaaacgctgagcaagaaagaggaggaggtggagcgcctacagcagctcaaaaaggagctcgaaaaggctacagcgtcagccctggacctgctaaagcgggagaaagaagcacaggaacaagaattcctctcattacaggaagagttccagaagctcgagaaggagaacctggaagagcgccagaagctgaaaagtaggttggaaaaactgttaacacaagtgcggaacttgcagttcatgtcagagaatgaacgaaccaaaaacatcaagctgcagcagcagattaatgaggtgaaaaacgaaaatgccaaactgaaacagcaagtcgccagatctgaggaacaaaactacgtccctaaatttgaaactgcacagcttaaagaccagctcgaggaagtcctgaagtccgatattaccaaagacaccaagacgactcacagcaaccttctgccagactgctcgccctgtgaggagcgactgaaccccgccgacattaaacgagcgtcccagctggcatcgaagatgcatagcctgctggccctgatggttggcttacttacttgccaggacataataaacagtgacgcggagcatttcaaagaatccgaaaaggtgagtgatatcatgctccaaaaactcaagtctcttcacctgaagaaaaagacgctagataaagagctgctgaagcacaaggatagaatcactaccttccgagagctgatagccaaagaaaaggccttccaagaccacgcaatcaaggtgatcgactgcgacagcgatgaggccaagtcaatacgagatgttccgactttgctcggggctaagctagacaagtaccactctcttaacgaagagttggacttcttgataacaaagctcggacaccttctagagtcaaaagagaaccactgcaacagactgatcgaagaaaacgataaatatcagagacacctcgggaatctgattaaaaaagtcacctcctacgaggagatcatcgaatgtgccgaccagcgactggccatctcccatagtcaaatcgcacatttggaggaacgaaataagcacctggaagacttgatcaggaagccaagggagaaagcaaggaagcctcgatcaaagtccctggagaaccacccaaagagtatgacaatgatgcctgctctgtttaaagagaataggaatgatttggactag

SEQ ID NO: 110692 - DNA, 2112 bp, Artificial Sequence
  Description of Artificial Sequence: Synthetic coding sequence
atggcggatcgaagaagacagcgagctagccaggacacagaagacgaggagtctggcgcatcaggctctgattccggtggcagcccactgagggggggggggagttgctccggctccgcgggtggaggtgggtcagggagcctgccatctcagcggggggggagaaccggcgcactccacctccggagagtggagtcggggggggctaagagtgctgaagaatctgagtgcgagtctgaggatgggattgaaggagatgcggtcctttcggattatgagtccgctgaagacagtgagggagaggaaggcgaatattcagaggaagagaactctaaggtcgagctgaaatctgaggctaacgacgcggttaacagcagcactaaggaagagaagggcgaagaaaagccagacactaaatcaacagtgaccggggaacgccagtcgggcgatggccaggagagcacagagccggttgaaaacaaggtcgggaagaagggaccgaaacatttggacgatgatgaggaccggaaaaaccccgcttatattcctaggaaaggcctgtttttcgagcatgacctcagaggacagacccaggaagaggaagtgagacccaaaggacgtcagcgaaagctgtggaaggacgaaggcaggtgggagcacgacaaattcagggaggatgaacaagccccaaaaagtagacaggagctcatcgctctgtatggctacgatatacggtccgcacataatcctgatgatatcaagccgcgccgtattcgcaaaccccgttacgggtcaccgccgcagcgggatcccaactggaacggtgagaggttgaataaatctcacaggcaccaggggctgggtggcactctccccccacgcacctttatcaataggaatgccgctggcacaggtcgaatgtccgcccctcgcaactactcaaggtctggaggatttaaggaggggagagccggattccggcccgtggaagccgggggccaacacggggggagatctggagagacagttaaacacgagatctcctaccgctcacgacgactcgagcagaccagtgtccgggatccatctccagaggcagacgcacctgtattggggagcccagagaaagaagaggccgcttctgaacccccagctgccgctccagacgccgctcctcctccccccgacagaccaatcgagaaaaagtcttactccagagcccgccgcacaaggacgaaagtgggagatgccgtgaagttggccgaggaagttccacctccccctgaggggctgatcccagctccacccgtgcccgaaacaactcctacgcctcccactaaaaccggtacttgggaagctcccgtcgattcgagcacttctggcctggaacaggacgttgctcagcttaatattgcagagcagaactggtccccaggccagccaagcttcttgcagcccagagagctgaggggcatgcccaaccacatacacatgggtgccggccctcctccacaattcaaccggatggaggaaatgggagtgcagggcgggcgagccaagagatacagcagtcagcggcaaaggccggtgccagagccacccgctccccccgtccatatctcgattatggaaggccattactatgatcccctgcagtttcaggggcccatctacacacacggcgattcacctgccccccttccgccccaggggatgctggttcagcctgggatgaacctacctcatcctggcctgcacccacaccagaccccggcacccctccctaacccaggactctatccccccccggtgtcaatgtcgcctggtcagccccctcctcaacagttgctggctccaacatacttttcagcccccggggtgatgaatttcggaaatccttcctacccttacgcaccaggagctctgccccccccacccccacctcatctatacccaaacacccaggccccgagtcaggtctatggcggcgtcacttactataaccccgcccagcagcaagtgcagcctaagcctagccctccacggcgcactccgcagccggtgacaatcaagccgcctccgccagaggtggtcagcaggggaagtagctag

SEQ ID NO: 110693 - DNA, 2112 bp, Artificial Sequence
  Description of Artificial Sequence: Synthetic coding sequence
atggcagacaggaggagacagagggcatcgcaggacaccgaggatgaagagagcggggcatccgggtcagacagcggtggatccccactcaggggcggcggctcatgctcaggttccgcgggtggcggggggtcgggaagtctgccaagccaaagaggagggcgaaccggtgccttgcaccttcgaagggtggaaagtggtggtgcgaaatctgcggaagagagcgaatgcgaatctgaggacggcattgagggtgatgcggtgctgtcagactatgaaagtgccgaagactctgaaggagaggagggagagtacagcgaggaggaaaattctaaggtggaactcaagtccgaagcaaatgacgctgtgaatagctcgactaaggaggaaaagggagaggaaaagcccgacactaaatctaccgtgaccggcgaacggcagagcggagacggccaggaatcgaccgagcctgtcgaaaacaaagtgggcaagaaagggcctaagcacttagatgatgacgaggatcgtaaaaatcctgcctacattccacggaaagggttgtttttcgaacacgatctgcgcggccaaacacaggaagaagaagtccggcccaagggccgacagcgcaagttgtggaaggacgagggtcggtgggagcacgacaagtttagagaggatgagcaagctcctaagtctaggcaggagttgatagcactctatgggtatgatatacgaagcgcccataatccagacgatattaaaccacgtaggatacggaaacctagatatgggtctcccccgcagagagatccaaactggaatggtgagcgcctaaacaagtcacaccgccaccagggcctcggtggaactctcccgccacgaactttcatcaaccgtaacgctgccggaacagggagaatgtcagcgccccgaaattattctaggtccggtggtttcaaggaaggacgcgctggttttagaccagttgaggctggtggtcagcacggtggacgaagtggcgaaaccgtgaagcacgaaatcagttatcgctctcgacggctagagcaaacatccgtgcgggaccccagtccggaggccgacgccccggtcctgggctcgccggaaaaggaagaggctgcttcagaaccccctgctgctgctcctgacgcagctcccccaccaccagacaggcccatcgagaagaagtcgtacagtcgggccagacgtaccagaactaaagtcggcgacgcggtgaagcttgccgaggaggtgccaccacccccagagggtctcatccccgcccctcctgtcccagagacaacaccgactcctcctacaaagacgggtacctgggaggcccctgttgatagcagcactagcgggctggagcaggatgtggcccagctgaacattgctgagcaaaactggtcacccggacagccgtcatttttgcaaccacgggaactgcggggaatgcccaaccatatccacatgggcgccgggccgccaccccaattcaaccgcatggaagaaatgggagttcagggcggccgggccaaacgctacagcagccagcgtcagcggcctgtcccagaaccccctgccccacccgtgcatatttcaatcatggagggccactactacgatcctttacagttccaggggcccatttatacccacggagatagccctgctccgctaccccctcaggggatgctcgttcagcctgggatgaatctgcctcaccccggactgcacccccatcagactcccgcgccgttaccaaaccccgggttatatccccctccggtaagtatgtctccaggccaaccgccacctcagcagctgctcgcccctacatacttttcggctccgggggtgatgaattttgggaaccccagctacccttatgctcctggggccctgcctccgcctccacccccacacctgtatccgaatacgcaggctccgagccaggtgtatgggggtgtcacgtactacaacccagcccagcagcaggtgcaacccaaacctagtccccctaggagaactccacagcccgttactataaagccccccccgccggaggtcgtgagccgtgggtcgagctag

SEQ ID NO: 110694 - DNA, 1926 bp, Artificial Sequence
  Description of Artificial Sequence: Synthetic coding sequence
atggcggataggcgaaggcagcgggcttctcaggataccgaagatgaggagagtggtgcaagtgggtcggactccgggggcagtcccctgcgcggagggggctcttgcagtggctcagctggagggggcggatccggctccctgccaagccagcgcgggggacgtaccggggcgctgcatctgcgccgggttgaatccggaggcgctaagtccgcagaggaaagcgagtgtgagtccgaggacgggattgagggcgacgctgtgctgagcgattatgagtccgcggaggactccgagggcgaagaaggtgagtattccgaagaagagaactcaaaggtggaactaaagtctgaagccaacgacgccgttaatagtagtaccaaggaagagaagggagaagagaagcccgacacaaagtccaccgtgactggtgagaggcagtctggcgacggtcaggaatcgacagaaccagtggaaaataaagttggcaaaaaagggcccaagcatctagatgatgacgaggaccgcaagaatccagcctatatccctcgcaaaggcctgtttttcgagcacgacttgcggggccagacacaggaggaggaagtgagaccaaaaggcaggcaaaggaaactctggaaggacgagggccgctgggaacacgacaagtttcgggaagacgagcaagcccctaaatctcgacaggaactgattgcattgtatgggtatgacatccgaagtgcgcataaccccgacgacattaagcccaggcggattagaaagcctcgctatggttcaccacctcagagggatcctaattggaatggggagcgactcaacaaatcccaccggcaccagggcctgggaggtactctgcccccgcggacgttcattaaccgaaatgccgccggtaccggtcgcatgtcagcccccagaaactacagtcgatccggagggtttaaagaaggccgtgctggattcagacccgtcgaagctggaggccaacacgggggaagaagcggagagaccgttaaacacgagatctcttaccggtcaaggaggctggaacagactagtgtgagagaccccagccccgaggccgacgcgcccgtgctgggctctcctgaaaaggaagaggcggcctccgagcctccagcagccgcaccagacgccgcaccccccccaccggatcgcccaatcgagaaaaaatcgtattctcgtgcccgtagaaccaggacaaaggtgggcgacgccgtaaagctggccgaggaagtccctccccctcccgaggggttaattcccgcacctccagtgcccgaaaccactccgaccccaccaacaaaaaccgggacgtgggaggctcccgtcgattcctccactagcggactggagcaggacgtagcccaactgaacattgcagaacagaattggtctccgggccaaccatcattcctccagccccgtgaactgcgggggatgcctaatcacatccatatgggggcaggcccaccgccccagttcaacaggatggaagagatgggcgtgcaagggggcagggccaagcgctattccagccaacgacaacgccctgtccctgagcctcccgcccccccggtgcacatctccattatggaggggcattactatgatcccctgcagtttcagggaccaatctatactcacggcgattcccctgcgcctttgccgccccaaggaatgctggtgcagcctggaatgaacttgccacaccctggcctgcacccacaccagactcctgcatgtccagactcccagacactgaggcactgtgagtcttgcctgtgttggtctacagtcttctcctgcaaagatttctcgatgtgcggaggtgtgttttgctattgttttaaaggatgcccattcgtgataagcattgtgacatggagatag

SEQ ID NO: 110695 - DNA, 543 bp, Artificial Sequence
  Description of Artificial Sequence: Synthetic coding sequence
atgcaggccgaagggcgaggcactggcggttcaaccggggacgcagatggtcctggtggccctggaattcccgatggcccgggaggcaacgccggcggaccgggggaagccggcgctacaggggggcgaggccccaggggcgctggagctgcgcgagccagcggacctggtggcggagccccacgaggccctcacggaggggcggctagtggtctgaatgggtgttgtcgctgtggtgcaaggggaccggagagcagacttctcgagttttatttggccatgccttttgcaacccctatggaggccgagctcgctagacgctcgctggcgcaggatgcaccgccactgcccgtgccaggcgtgcttttgaaggagtttaccgtgtccggtaacatactcacaatcagattaaccgccgccgaccacagacagttgcagctttctatcagttcatgtctgcagcaactgagccttctcatgtggattacgcagtgtttcctgccagtgtttttggctcagccaccatccggccaacgcagatag

SEQ ID NO: 110696 - DNA, 570 bp, Artificial Sequence
  Description of Artificial Sequence: Synthetic coding sequence
atgaccgacaaaaccgagaaagtggcagtcgacccagaaaccgtgttcaagagaccccgtgagtgcgatagtcctagttatcagaaacggcaacgtatggcattgctggcacgtaaacagggggccggggattcgttaatcgccggttccgccatgtctaaggcaaagaaactcatgaccggtcacgcgatacctccatcacagctcgactcccagatcgatgacttcactggatttagcaaagatagaatgatgcagaagcctggatcaaacgcgcctgtaggtggaaacgttactagcagcttctctggagatgacctagaatgtcgcgagacagctagtagcccaaagtcacaaagggaaatcaacgcggacatcaagcggaaactggtgaaggagctgagatgcgtggggcaaaagtatgagaagatctttgaaatgctggagggcgtacagggccctaccgctgtgcgtaaaagatttttcgaatcaattatcaaggaggcggcacgctgcatgcggcgggattttgtgaaacaccttaagaagaagctaaaaaggatgatttag

SEQ ID NO: 110697 - DNA, 570 bp, Artificial Sequence
  Description of Artificial Sequence: Synthetic coding sequence
atgactgacaaaactgaaaaagttgcagtggacccagagaccgtcttcaaacgaccaagggagtgtgattcaccctcctaccagaagcgccaacgcatggcacttctcgcacgaaaacaaggggccggcgatagtttgatcgcaggttcagcgatgagcaaagagaaaaagttaatgactgggcacgctatccccccctcccaacttgattctcagattgatgactttaccgggttctcgaaggaccgcatgatgcagaagcctgggtccaacgcccccgtaggggggaacgtaacatctagtttctcaggtgacgatctggaatgccgggagaccgcatcatctcctaagtcacaacaggagatcaatgctgatataaaacgaaagctagtaaaagagctaagatgtgtgggccagaaatacgagaaaatcttcgagatgctcgagggagtgcagggaccaacagccgtgcgcaaaaggttctttgagtctataatcaaagaggctgccaggtgcatgaggagggactttgtgaagcacttgaaaaagaagttgaagcgaatgatatag

SEQ ID NO: 110698 - DNA, 570 bp, Artificial Sequence
  Description of Artificial Sequence: Synthetic coding sequence
atgactgacaagaccgagaaagtcgccgtcgatcctgaaaccgtgttcaaacggcctcgagagtgtgactcaccctcctatcaaaagcgccaacgaatggctttgctggcaaggaaacagggtgcgggcgactccttgattgcaggaagtgcgatgtcgaaagaaaaaaagctcatgaccggccatgctatccccccgtcacagctggacagtcagatcgatgacttcaccgggttcagcaaggatcggatgatgcagaagccaggtagtaatgcccctgtgggaggaaacgttacatcctcattttctggagatgacctagagtgtcgggagaccgcttcatcacccaaatcccagcaagaaattaatgccgacattaagaggaaactcgttaaagaattacgttgtgtgggccagaagtatgaaaaaattttcgagatgttagagggagttcagggccctaccgcggtcaggaaaaggttctttgagtctattataaaagaggctgctcgctgtatgagaagagatttcgtgaagcacctgaaaaaaaaacttaaacgcatgatctag

SEQ ID NO: 110699 - DNA, 570 bp, Artificial Sequence
  Description of Artificial Sequence: Synthetic coding sequence
atgactgataagaccgaaaaagtggccgttgatccagaaaccgtattcaagcggccgcgggagtgcgactcgccatcatatcagaaaagacagcggatggcgctcctggcccgtaagcagggcgcgggagactcactgattgcaggatctgcaatgtcaaaagagaagaagttgatgactggacatgccataccaccaagccagctggacagtcagatcgacgacttcaccggtttttctaaggatcgcatgatgcagaagcccggctctaatgcacccgtgggggggaacgttacctcatcatttagcggtgacgacctagagtgtcgcgagacagctagctcccctaaatcccagcgcgagatcaacgccgacataaagcgcaagctggtcaaggagctgcgatgcgttggccagaaatatgagaagattttcgaaatgctggagggagtgcagggacctaccgccgttcgaaagcggttcttcgaaagcataatcaaagaggccgcccggtgtatgcgcagagattttgttaagcaccttaagaagaaactaaaacgtatgatttag

SEQ ID NO: 110700 - DNA, 570 bp, Artificial Sequence
  Description of Artificial Sequence: Synthetic coding sequence
atgaccgataagactgagaaagtggctgtcgacccagaaacagtcttcaaaagacccagagagtgtgactccccgtcctatcagaaacgccagaggatggccctgctggcccgaaagcagggcgccggcgattctcttattgccggatccgccatgagcaaagagaagaaactcatgacaggtcatgctatacctccatcccagttggattcccaaatcgatgacttcacaggtttttcaaaggacagaatgatgcagaagccagggtctaacgcgcctgtggggggcaatgtcactagctcatttagcggtgacgacctggagtgccgcgagactgcttcctctccaaagtcccagcgggagattaatgccgatataaagcgaaaactggtcaaagagctaaggtgtgtgggacagaaatatgagaaaatcttcgaaatgctggagggggtccagggccctacagcagtacggaagaggtttttcgagtcaattattaaagaggcggcccgctgcatgagacgcgactttgtgaaacaccttaagaagaagctcaaaaggatgatttag

SEQ ID NO: 110701 - DNA, 570 bp, Artificial Sequence
  Description of Artificial Sequence: Synthetic coding sequence
atgacagataaaactgagaaggttgctgtagaccccgagaccgtgtttaaacgccctcgcgagtgcgacagcccctcttaccagaaacgccaacggatggccctcctggcccgaaagcagggagccggtgactcgctgatcgcggggtccgcgatgagtaaggaaaagaagcttatgaccggacacgctatccctccatctcagttggactctcagattgatgactttacaggattcagcaaggaccgaatgatgcagaagccaggctccaacgccccagtcggcggcaatgtgacatcatcctttagcggggacgacttggagtgtcgcgagacagcaagtagcccaaagagtcagcaggaaattaacgcagatataaagagaaaactggtgaaagagctgcgctgcgttggacagaagtatgagaagatcttcgaaatgctggaaggcgtgcagggcccaaccgctgtccgaaaacgcttcttcgagagtatcatcaaagaagctgctcgctgtatgcgaagagatttcgttaaacaccttaagaaaaagcttaagagaatgatttag

SEQ ID NO: 110702 - DNA, 570 bp, Artificial Sequence
  Description of Artificial Sequence: Synthetic coding sequence
atgaccgataagaccgaaaaggtagccgtagatccagagaccgtattcaagagaccccgcgagtgcgatagcccatcttaccaaaaaagacagaggatggctcttctggccaggaaacagggcgctggtgactcgctgatcgctggaagcgcaatgtccaaagctaagaagctgatgacaggccacgccatcccccctagccaactggacagtcagatagacgacttcacaggtttcagcaaggatcgcatgatgcagaagccaggaagtaacgcccccgtcggtggtaacgtcaccagctcattctccggcgatgacttagagtgcagggagacagcttcgagcccaaagtctcagcaggagatcaacgccgatataaaacggaagctcgtaaaggaactaaggtgtgtcggtcaaaaatacgaaaagattttcgagatgctagaaggagtccagggccctaccgccgtgcgtaaacgattcttcgaatctataattaaggaagccgctagatgcatgcgtagagatttcgtgaaacatctgaaaaagaagctgaagcgcatgatttag

SEQ ID NO: 110703 - DNA, 570 bp, Artificial Sequence
  Description of Artificial Sequence: Synthetic coding sequence
atgactgataaaaccgaaaaggttgctgtcgacccagagacagtgtttaagcggcctagagagtgcgactcaccaagctatcagaagagacaacgaatggccctgcttgcacggaaacagggcgctggggattccctaattgcaggtagcgctatgagtaaggccaaaaaactaatgactgggcacgccataccccctagccaattggattctcagatcgatgacttcacaggcttctcgaaagatagaatgatgcaaaaacccggttccaacgcccctgtgggaggcaacgttacctcctcattctctggagacgaccttgagtgccgggaaacggccagttcaccaaagtctcagcaagagattaacgcagacattaaacgaaaactcgtaaaggagctgcggtgcgttggccagaagtatgaaaagatctttgagatgctagaaggagtccagggacctacggctgtccgtaaacgcttctttgaatccatcatcaaagaagccgctcgctgcatgagacgtgattttgtgaagcacctgaagaagaaattgaaaaggatgatatag

SEQ ID NO: 110704 - DNA, 570 bp, Artificial Sequence
  Description of Artificial Sequence: Synthetic coding sequence
atgaccgataagacagagaaagtcgccgtcgatccagagaccgttttcaagaggccaagagagtgcgactccccgtcatatcagaaacggcagagaatggccctgctggcccgcaagcagggcgccggagattccctgattgcaggttcagctatgagcaaagaaaagaagctgatgaccgggcacgccattccaccatcccagcttgattcgcagattgatgacttcactggcttctcaaaggatgggatgatgcagaagcctggaagtaacgctcccgtgggtggtaacgtcacgagtaacttctccggtgatgatctggaatgccggggcattgcatcatcacctaagagtcaacaggagatcaacgccgacataaaatgtcaggttgtgaaagaaatccgatgcttgggaaggaaatacgagaaaattttcgaaatgctggaaggcgtccaggggcctacagcagtgaggaaacggtttttcgagtcgatcattaaggaggcggcccggtgcatgaggcgcgatttcgtaaagcatctgaagaagaagcttaagcgcatgatatag

SEQ ID NO: 110705 - DNA, 570 bp, Artificial Sequence
  Description of Artificial Sequence: Synthetic coding sequence
atgaccgacaagacagagaaagtggcagtagaccctgaaactgttttcaaacgcccgagggaatgtgacagcccttcctatcaaaagaggcaacggatggcccttcttgcaaggaaacagggcgcaggtgatagtttgattgctggaagtgctatgtcaaaagagaagaagctgatgacagggcatgctatccctccctcacaactcgattctcagatcgacgattttaccgggttcagcaaggatggcatgatgcaaaagcctggtagtaacgctcccgtcggaggcaacgttacctcgaatttttccggtgatgacctggagtgccgggggatcgcttctagtcccaaatcccaacaggaaataaatgcggacatcaagtgccaggttgtgaaggagatccggtgcctagggcgaaaatacgaaaagatattcgaaatgctcgagggcgtgcaggggcccaccgctgtgaggaaaaggttcttcgagtctatcatcaaagaggcagcccgttgcatgaggagggactttgtaaaacatttgaaaaagaagctcaagcgaatgatctag

SEQ ID NO: 110706 - DNA, 570 bp, Artificial Sequence
  Description of Artificial Sequence: Synthetic coding sequence
atgactgacaagacagagaaagtggcagtcgatcccgagacagttttcaaacgtccccgagaatgtgacagtccgtcataccagaaaagacagcgcatggccttactggcccgcaaacagggcgccggtgacagcttaatcgctggaagcgcaatgtctaaggcgaaaaaacttatgaccgggcacgctatccctccatcccagctcgattcccagattgacgacttcacgggtttctctaaggacagaatgatgcagaagccaggttccaatgctcccgtggggggcaatgtcactagctctttcagcggagacgacttagagtgccgcgaaacagcctcttctcctaaatcacagcaggaaatcaatgccgacataaaacgcaaactcgttaaagagctacgctgtgtgggtcagaaatatgaaaagatctttgaaatgctagagggtgtgcagggaccaacggccgtacgaaaaagattttttgaaagcatcataaaagaagctgcacgttgcatgaggcgggacttcgtcaagcacctgaagaagaagctgaaaaggatgatttag

SEQ ID NO: 110707 - DNA, 570 bp, Artificial Sequence
  Description of Artificial Sequence: Synthetic coding sequence
atgactgataaaactgagaaggtagcggtcgatcccgaaactgtgttcaaacgtccgcgggagtgtgattcaccatcttatcagaaacgccagaggatggcccttcttgctcgtaaacaaggtgctggcgatagcctcatagcaggcagcgcgatgagtaaagctaagaagctgatgaccggacatgccattcctccgagtcagctagacagccagatcgatgacttcaccggcttctcgaaagacagaatgatgcagaagcccggctctaatgctcctgtgggaggaaacgtgaccagtagcttctctggcgatgacttagaatgtcgcgaaacagcctcaagccctaagtcacagcaggagatcaatgcagatattaaacgcaaattggtcaaggagctcagatgtgtgggccagaagtacgagaagatattcgagatgttagagggagtgcaaggacccactgcagtcagaaaaaggttcttcgaatctattattaaggaagccgctcgatgtatgcgcagagacttcgttaaacatttaaagaaaaagctgaagcgtatgatttag

SEQ ID NO: 110708 - DNA, 867 bp, Artificial Sequence
  Description of Artificial Sequence: Synthetic coding sequence
atgtccgctaccggagatcgccaccctacccagggcgaccaggaggctcccgtgtcccaagaaggcgcgcaggctgaggcagccggggctgggaatcaagagggtggggactctgggcccgattccagcgacgtggttccagccgccgaagtagtcggcgtcgccggtccggtggaagggctgggagaggaggagggggagcaggcagctggacttgcagccgtgcccaggggggggtcggcagaagaggactccgacattggacctgcaacagaggaagaggaggaggaggaaggtaatgaggcggctaatttcgacctagccgttgtagcccggcgctaccctgcttccggcatccactttgtgctcctggatatggtacattccctgttgcacaggttgtctcataatgatcacatcctcatcgagaaccggcagctgtctaggctgatggtgggtccccacgcggcggcaaggaatctttggggaaatctgcctccactgctcctgccacaaaggctgggagccggtgctgcggcaagagccggcgagggactagggttgattcaggaagccgctagcgtgcccgaacctgctgttccggcagatttggctgagatggcccgggaaccggccgaagaagcagcggaagagaaactcagcgaggaagccaccgaagagccggacgcagaggagccagctaccgaggagccaactgcgcaggaggccaccgcacccgaggaagtcaccaagtcccagcctgagaagtgggatgaggaagcccaggacgccgcgggggaagaggagaaagagcaagagaaggagaaggacgccgagaacaaagtaaagaatagcaagggaacatag

SEQ ID NO: 110709 - DNA, 867 bp, Artificial Sequence
  Description of Artificial Sequence: Synthetic coding sequence
atgtctgcgaccggggacagacacccaacgcagggtgaccaggaagctcctgtgtctcaggagggcgcacaagccgaggccgctggagccggaaatcaggagggaggcgatagcgggcccgattcttctgatgtggtgcccgcagccgaagtcgttggtgtggccggtcctgttgagggcctaggtgaagaggagggtgaacaggcggcaggactggcggctgtgccgaggggaggtagtgcagaagaagattccgacattggtccggcaacggaggaagaagaggaggaggaaggtaacgaagccgccaattttgacctggcggttgttgctcggagataccccgcatcggggatacactttgtcctactcgatatggtccattcactccttcatcgactgagccataacgaccacattctcatcgagaataggcagctgtcacggctgatggtgggcccgcacgcagccgcccgaaacctgtggggaaacttaccccccctccttctgcctcagcgtctcggggcaggggcagcagctcgggcgggcgagggactgggtttaattcaagaggccgcgagcgttcccgaacctgcggtccccgccgatctagccgaaatggcacgagagcctgcagaggaagccgcagaggagaaactgagcgaggaagctactgaagaacctgacgcagaggagccagcgactgaggagcccaccgctcaggaagccactgcccctgaagaagtgaccaaaagtcaacccgaaaaatgggacgaagaggctcaggacgctgccggtgaggaagaaaaggaacaggagaaggagaaggatgccgaaaacaaggtgaaaaactccaagggcacatag

SEQ ID NO: 110710 - DNA, 867 bp, Artificial Sequence
  Description of Artificial Sequence: Synthetic coding sequence
atgtctgccactggggaccgtcatcccacccagggggatcaagaggctcccgtgtcgcaagagggcgctcaggccgaggctgctggtgcaggaaaccaggagggcggggactccggtcccgactcgtctgatgttgtgcccgctgctgaagtagtcggcgtggctggccctgtagaggggctaggggaggaggaaggagagcaggcagccgggctcgccgcggttccccgcggaggctccgctgaggaggactcggatattgggcccgcaactgaggaagaggaggaagaagagggaaacgaggcggcgaactttgatctggccgtcgtcgccaggcggtacccggcttccgggatccacttcgtgctcctggacatggtgcattccctcctgcacagactgtcacataacgaccatatcttaatcgagaaccggcagctctcccgattaatggtagggccacatgcggcagcccggaatctgtggggaaacctccctcccttgctcctaccccagagactcggggccggagcagcagcccgagctggagagggtttaggacttattcaggaggccgcgtccgtgccagaacccgctgtgcccgccgacctggccgaaatggccagagaacccgctgaagaggcggcagaagagaagctctcggaggaggccacggaagagcccgacgccgaggagccagccactgaggaacccactgctcaagaggcaacggcgccagaggaggtgacaaaatcgcaaccagagaaatgggacgaagaggcccaggacgcagccggcgaagaggagaaagagcaggaaaaagagaaggatgctgagaacaaggtgaaaaacagcaagggcacttag

SEQ ID NO: 110711 - DNA, 867 bp, Artificial Sequence
  Description of Artificial Sequence: Synthetic coding sequence
atgtccgctactggagatcgacatcccactcagggagatcaagaagccccagtcagtcaagaaggggctcaggcggaggcggcaggagctgggaaccaggaaggcggagattctggccccgactccagcgacgtcgtgcccgctgccgaagtggtgggcgttgccggcccggtggagggtctcggcgaggaagagggcgagcaggcggcaggtctggctgcggttccacggggagggagcgccgaggaggacagcgatatcggtccagccactgaagaagaagaggaagaggagggaaatgaagcggccaacttcgatctggccgtagtcgcacgtcgttaccctgcttccggcattcactttgtgttgttagacatggtccacagtctcctccaccgcttgtctcacaacgaccacatccttatcgaaaatcgtcagttgtctcgcctgatggtaggcccgcatgcagcggccaggaacctttggggtaacttgcccccgctcctgcttccacagagactgggagccggcgcagccgcccgtgcaggggagggcctgggactaatccaggaagcagcctctgtgccggaacccgccgtaccagctgacttggctgagatggcacgggagcccgctgaggaagctgccgaggaaaagctcagcgaggaggccaccgaggagccagatgccgaagagcctgctaccgaggaacccacagctcaggaggcgactgctcctgaagaggtgaccaaatcacaaccagagaaatgggatgaagaagcccaggatgcggccggagaagaagagaaagaacaggagaaggagaaggacgccgagaacaaagtcaagaatagcaagggaacttag

SEQ ID NO: 110712 - DNA, 867 bp, Artificial Sequence
  Description of Artificial Sequence: Synthetic coding sequence
atgtctgcaaccggcgatagacaccccactcagggagaccaggaggctccagtgagccaggaaggagcccaggctgaggcagcgggggcaggtaatcaggagggcggggacagcggcccagattcgagcgacgtggtacctgcagctgaagtagtcggggtagcagggcctgtcgagggcctgggtgaggaggagggagagcaagctgcaggactcgcagccgttccacgcggcggttctgctgaagaggactcggatatcggtcccgccaccgaggaagaagaggaagaggaaggcaatgaagccgcaaacttcgatctggcagttgttgcgcgcaggtaccccgcatccggaattcactttgtgctccttgatatggttcatagcctcctacacaggttgagccacaatgaccacatcctgatcgagaatcgccagcttagtagattgatggtgggccctcatgccgctgcgcgcaatttatgggggaatttgccgcctcttctcctccctcagcggctgggcgccggagccgcagcaagagcaggtgaggggctcgggctgatccaggaagccgcgtctgtccctgaaccagccgtccctgctgacctggccgagatggctcgagagcccgccgaggaggcagccgaggaaaaactcagcgaggaagccaccgaggagcccgacgcagaagagcctgcaacagaagagccaacggctcaagaggctactgctcccgaagaggtgacgaaatcccaacctgaaaagtgggacgaggaggcacaggatgccgcaggggaagaggaaaaagagcaggagaaagagaaggacgcggagaacaaagtcaagaactcaaagggcacttag

SEQ ID NO: 110713 - DNA, 867 bp, Artificial Sequence
  Description of Artificial Sequence: Synthetic coding sequence
atgagcgcaacaggggaccggcaccctacgcagggtgaccaggaggcgcccgtgtcgcaggagggcgcgcaggccgaggcagctggtgctggcaaccaggaagggggggattctggccctgactcaagtgatgtggtgccagccgctgaggtggtaggagtggccgggcctgtggaagggcttggcgaagaggagggcgaacaggctgctggcttggcagcagtgccaaggggcggcagcgctgaagaggacagcgacataggcccagccaccgaggaggaagaggaggaggagggcaacgaggccgcaaattttgaccttgccgtagtggcacggcgctatcccgcgagtggcattcacttcgtgctgttggacatggttcactccctcctccaccgactgagccacaatgaccacatactgatcgagaatcgccaactgagccgactgatggtgggcccccatgccgctgcgcgcaacctgtggggaaacttgcccccactgttgcttcctcaaagattaggggccggggctgcagccagagcgggcgaaggcctcggtctcattcaggaagctgcatccgtccccgagcctgcggtgccggcagacctggccgaaatggccagggaacccgcagaggaggcagcggaggaaaaactttctgaggaggccacagaggaacctgatgctgaggagcccgcgaccgaggagcctactgcccaggaagctaccgccccggaagaggtcactaagagccagcccgagaaatgggatgaggaggcccaagacgcggcaggcgaagaagagaaagaacaggagaaggagaaagatgccgagaacaaggtgaagaactctaaaggcacatag

SEQ ID NO: 110714 - DNA, 867 bp, Artificial Sequence
  Description of Artificial Sequence: Synthetic coding sequence
atgagtgccacgggtgatagacacccgacacagggagaccaggaggctccagtttcacaagaaggagcacaagcggaggctgccggtgctgggaatcaggaggggggagattcggggcccgacagttccgacgtcgtgccagctgccgaggtcgtaggagtagccggcccagtggagggattgggcgaggaagagggcgaacaagccgctggactggctgccgtgcctcgtggaggctctgccgaagaggattccgacatcggaccggctaccgaagaggaggaggaggaagaaggtaatgaggctgcaaattttgacctggctgtcgtggcgagacgatatcctgccagcggcattcatttcgtcctgctcgatatggtacactccctcctgcaccgactgagccacaacgatcacatcctgatcgagaatagacagttatctcgccttatggtaggcccccatgctgctgccagaaatctatggggcaacctgccccctctgctgctgccacaacggctcggtgctggagctgctgcccgcgcgggcgagggcctgggattgatccaagaggccgcatccgtgccagaacccgcggtgccagccgacctagcagagatggccagggaacccgcggaagaggccgccgaggagaaacttagtgaggaagcaacggaagaacctgacgcagaggagccggccacggaggagccaactgcacaagaggcaaccgcgccagaggaagtgacaaagagccagccagagaagtgggacgaggaggcccaggatgcagcaggagaggaggagaaggaacaggagaaggagaaagacgctgagaataaagtgaagaatagcaaaggaacctag

SEQ ID NO: 110715 - DNA, 867 bp, Artificial Sequence
  Description of Artificial Sequence: Synthetic coding sequence
atgagcgctacgggcgaccgccatccaacacagggcgatcaggaagcacccgtcagccaggagggagcacaagccgaggccgctggggccggcaaccaggaaggcggtgatagcggacctgattctagtgatgttgtccccgccgcggaggtggtgggagttgccgggcccgttgaaggattaggagaggaggagggggagcaggctgccggactggctgctgtgcccagggggggatccgctgaggaagacagcgacatcggaccagccaccgaagaagaggaagaagaagaaggaaacgaagcagccaactttgatcttgccgtggttgctcggagataccccgcctcagggatccacttcgtcctgttggatatggtacactccctcctgcatcgcttgtcccacaacgaccatattctcattgagaacaggcagctctccaggctcatggtcggcccccacgccgcggcccgcaacctttggggcaacctcccaccactcttgctgcctcagagactgggggccggagcagcagcgagggctggcgaaggactcgggttgatccaggaagcggcctctgttccagaacccgcggtgccagctgacctagcggagatggcaagggaaccagcagaggaggccgctgaagagaagttatcagaagaggccacagaagaaccggatgcagaggaacctgccactgaggagcccactgcccaggaagccacagcaccagaggaagtgactaaatcacagcctgagaaatgggacgaggaggcacaggacgccgcaggagaggaggagaaggagcaggagaaagaaaaggatgcggagaataaagtgaagaatagcaaggggacatag

SEQ ID NO: 110716 - DNA, 867 bp, Artificial Sequence
  Description of Artificial Sequence: Synthetic coding sequence
atgtcagccactggagacagacacccaactcagggcgaccaggaggcgccagtgagccaagagggcgctcaagccgaggccgcaggcgccggtaatcaagagggtggagactcagggccagatagcagtgatgtagttcccgccgcagaggtggtcggagtggctggtcccgtagagggcttgggtgaagaagagggggagcaggctgcagggctggccgctgtgccaagaggcggctccgcggaggaagacagtgacataggaccagccactgaagaggaggaggaggaagaaggcaacgaagcagctaattttgacctggcagtggtcgcccggcgctatcccgcatcaggtatccatttcgtgttgctcgacatggtacactctctgctacatagactttcacacaacgaccacatattaatcgagaacaggcagctgtctcgactgatggtggggccgcatgccgcggcacgtaacctgtggggcaatctgccgcctttgctgcttccacagagactgggggcaggagctgctgccagagcgggggagggtttaggtctgatccaggaggccgctagcgtgccagaaccagctgtgccggccgatctggctgagatggccagggaacccgccgaggaggccgctgaagaaaagctaagtgaggaggcgaccgaggaaccagacgcagaggaaccagctaccgaagaaccgactgctcaggaggccacagccccagaggaggtgactaagagtcagccagaaaaatgggacgaggaggcacaggatgccgccggcgaggaggagaaggaacaggagaaagaaaaggacgcggagaacaaggtaaagaatagtaagggtacctag

SEQ ID NO: 110717 - DNA, 867 bp, Artificial Sequence
  Description of Artificial Sequence: Synthetic coding sequence
atgtcggctacgggagaccgccatcctactcaaggtgaccaggaagccccagtctcccaagagggagcacaggccgaggcagccggcgccggaaatcaggaggggggcgactcagggccggatagttcagacgtagtgccggccgctgaggtcgtgggggtggcaggtcctgttgagggcctgggtgaagaagaaggggagcaggccgctggtctggctgctgttcccagaggtgggtctgccgaggaggacagtgatattggccccgcgacggaagaggaggaagaggaagaagggaacgaggccgctaatttcgacctcgcagtcgtggctcggagatatcctgcttcaggtattcacttcgttttgcttgatatggtgcacagcctgctccatagactcagtcataacgatcacatccttatcgagaatagacagttgagtcgattgatggtgggaccccacgcagccgcccgaaatctttggggcaacctccctcccctcttactgccacagaggcttggtgctggggcagctgctcgcgccggagaagggctgggcctgatccaagaagccgcctcagtccctgagcctgccgtgcctgcagatttagcggagatggcaagggagcccgccgaggaggctgctgaggagaaattatccgaggaggccacggaagagccagatgcagaggagcctgcaactgaggagcctaccgctcaggaggcaactgcccccgaagaagtaacaaagagccagcctgagaagtgggatgaggaagctcaggatgcggcgggagaggaggaaaaggagcaagagaaagagaaagatgcagagaacaaagtgaaaaactccaagggcacgtag

SEQ ID NO: 110718 - DNA, 867 bp, Artificial Sequence
  Description of Artificial Sequence: Synthetic coding sequence
atgtcagcgaccggggataggcaccccacacagggagaccaagaggcaccggtcagccaggagggtgcccaggctgaggccgctggagctgggaaccaagaaggcggagacagtgggccggactcctccgacgtggtcccagccgctgaagttgtaggcgttgcaggtcctgtggagggactcggggaggaggagggcgagcaagcggccgggctcgccgccgtgcctaggggcggctcagcagaagaagactcagacatcggtccagctacagaggaagaggaggaggaagaaggtaatgaggcggctaacttcgatctcgctgtggtggctcgccgatatcctgcttcaggaatccattttgtgctactggacatggtgcattctctcttacaccggctctcccacaatgatcacattttgatcgagaaccgtcaactgagcagactgatggtggggccccacgccgctgcacgcaatctgtgggggaacctacctcctcttctcctccctcagagactgggagcgggcgcagctgcgagagccggagaggggcttggactcatacaggaggcggcctccgtcccggagccagctgtgccggcagatctcgcagaaatggcccgcgaaccagcggaagaggcagctgaagagaagctgtcagaggaggctaccgaggagcctgatgcagaggaacccgcaacagaagagcctaccgctcaggaggcgaccgcaccagaagaggtaactaaaagccagcccgagaagtgggacgaggaggcgcaggacgctgccggagaggaagaaaaggagcaagaaaaagagaaagacgccgagaacaaggtcaagaactcaaaaggaacttag

SEQ ID NO: 110719 - DNA, 867 bp, Artificial Sequence
  Description of Artificial Sequence: Synthetic coding sequence
atgtctgccacaggggatcgccatcctacgcagggtgatcaggaagccccagtttcccaagagggcgcccaggccgaggccgctggcgctggcaatcaagagggcggcgactctgggcctgactctagcgatgtggtcccagcagctgaggtggtgggcgtggctgggccagttgaaggcctgggagaggaagagggcgagcaggcagcaggcctcgccgctgtacccagaggagggtccgctgaagaagactcagacatcggaccggctactgaggaagaggaagaagaggaagggaatgaggcagcgaacttcgatctggccgttgtggcccggaggtatccagcgagtgggatacactttgtgttactggacatggttcactcccttttgcaccggctcagtcacaatgatcatattcttattgaaaacagacagttgtcacggctgatggtgggcccgcacgcagcagcaagaaatctttgggggaacttgcctccactgctgcttccccaacggctcggcgctggcgcagcagctagggccggagagggactgggacttatccaagaagccgcatctgtacccgaacctgcagtgccagcagaccttgctgaaatggctagagaacctgccgaagaggccgccgaggaaaaactctcagaagaggcgaccgaagaacctgacgccgaggagcccgcaacggaggagccgaccgctcaggaggccacggcccctgaagaggtaaccaaatcccagccagaaaaatgggatgaagaggcccaggacgccgccggtgaagaagagaaagagcaggagaaagagaaggacgctgaaaacaaagtgaaaaattccaagggaacatag

SEQ ID NO: 110720 - DNA, 867 bp, Artificial Sequence
  Description of Artificial Sequence: Synthetic coding sequence
atgagcgccacaggcgatcgacacccgactcagggagatcaagaggcccctgtgagtcaagaaggcgcacaggctgaagcagccggggcaggcaatcaggaagggggggacagtgggccggactcatctgatgtagtgccagcggccgaggtggtgggggtggctggacctgtggaaggcctcggggaggaagagggtgagcaagccgccgggctggccgcagtgcccagaggtggaagtgccgaggaagactccgatattggtccagccaccgaggaggaagaggaagaggaaggcaacgaggctgccaactttgacttggccgtagtcgctcgtaggtatcccgccagcggcattcacttcgttctgctggacatggtacactccctactccatcggttgtcccataatgaccacatcctgattgagaacagacaactttcccgattgatggtcggaccccatgcagccgcccggaacctttgggggaacttgcctcctcttcttctaccccagcgtttgggtgccggagctgcggcgcgcgctggggagggtctggggctgattcaggaagccgctagcgtacctgagccagccgtcccagctgatctggcagaaatggcccgagagccagctgaggaagccgccgaagagaaactgtccgaggaggccacggaagagcccgatgccgaggagcccgcgaccgaggaaccaactgctcaagaggcaaccgcccctgaggaggtgacaaaatctcagcctgaaaaatgggatgaagaagctcaggatgccgctggcgaggaggaaaaggaacaggagaaagagaaggacgccgagaataaagtgaagaactctaaaggcacatag

SEQ ID NO: 110721 - DNA, 867 bp, Artificial Sequence
  Description of Artificial Sequence: Synthetic coding sequence
atgtccgccactggtgacagacaccccacccagggggaccaggaggcaccagtgagtcaggagggagcacaggccgaagcagccggagccggaaatcaagaaggcggggacagcggtcctgactcatcagatgtggtgcctgctgcagaagtcgtgggggtggccggtccagtggagggcctcggggaggaagagggtgaacaggccgcaggcttagcagctgtgcccaggggagggtcagccgaggaagactcggatataggacctgccaccgaggaggaggaggaggaggagggcaatgaggcagccaacttcgatctggccgtcgtggcccgccgatatcccgcctctggcatacacttcgttcttctcgatatggtccatagcttgttacatcgcctgagccacaacgaccacatcctgattgaaaatcgccagctgtccagacttatggtaggccctcatgcggcagcccgaaacttgtggggaaacctgcctcctttactcctcccgcagagacttggagccggcgccgctgcacgggcaggcgaggggcttggtctcatccaagaggcggctagcgtgccagagcccgctgtgcccgccgacctggctgagatggcaagagagcctgctgaggaagccgctgaggagaagctgtcggaggaagccaccgaagaacccgatgctgaggagcccgccacggaggaacctaccgcccaggaggctacagctccagaggaagtgaccaagtcgcagccagaaaagtgggacgaagaagcgcaggacgccgcaggggaggaagaaaaggagcaggaaaaggagaaggatgctgagaataaggtgaaaaattccaaaggcacatag

SEQ ID NO: 110722 - DNA, 900 bp, Artificial Sequence
  Description of Artificial Sequence: Synthetic coding sequence
atgtcagcgacaggcgacaggcacccaactcaaggagaccaagaggctccagtaagtcaggaaggggcgcaagctgaggctgctggtgccgggaatcaggaaggcggggacagcggtcccgattcatccgacatggtccccgccgctgaggtggtcggggtggctggccctgttgaaggactaggggaagaagagggtgagcaggccgcagggctcgctgcagtaccacaggggggcagtgcagaagaagattccgatatcggcccagctacggaggaagaggaggaggaagaggagggcaacgaagctgctaactttgacttagcggtggcaacacggcgataccccgctgctggtattggctttgtatttttatacctcgtgcacagcctgctcagaagactctaccataacgatcatatccagatagccaaccgccatctgagtagactcatggtcggcccccacgctgctgtcccaaacctgtgggataatccccctctgctgctcttaagccaacgcttaggtgcaggcgccgccgcacctgagggcgagggccttggactaatccaggaggccgcatcagtacaggaagctgccagcgtgccggaaccggccgtgcccgctgacctggccgagatggccagagagcccgcagaagaggccgccgacgagaagcctcccgaagaggctgccgaggaaaaattgacggaggaggcaacagaggagccggctgctgaggagcccacctctgaggaggccgtcgcccctgaggaggtgactaagtcccagccggagaagtgggacgaagaggcccaggacgcagccggcgaggaggagaaggaacaggagaaggagaaggacgtcgagaacaaggtgaaaaacagcaagggaacctag

SEQ ID NO: 110723 - DNA, 1419 bp, Artificial Sequence
  Description of Artificial Sequence: Synthetic coding sequence
atgaagtctatcctcgatggcctggccgatactacctttaggactataacaaccgacttgctgtacgtcggatctaatgatatccaatatgaagacatcaagggggatatggcaagcaaactaggatacttcccccagaaatttccactgacatcctttagaggatctccgttccaggaaaagatgactgctggcgataaccctcagctcgtgcctgctgaccaggtgaatatcaccgaattttataataagagcctgtcctcttttaaagagaacgaagagaatattcaatgcggggagaattttatggacattgagtgcttcatggtgctaaacccctcacaacagctcgctatcgccgtgctaagtctgacactgggtacattcacagtgctggagaacctgctggtgttgtgcgtgatccttcactctcgaagtctgcggtgccgaccgtcttatcacttcatcggctccttggcggttgcggatttattggggtcggtaatttttgtctattcctttatcgatttccatgtcttccaccgcaaggactcccggaatgtgttcctcttcaaactgggaggcgtgaccgcctctttcacagcctcagtaggcagcctttttcttacggctatcgaccgctatatttcaatccaccggccgcttgcctataagaggatcgtgacccggccaaaagctgtggtagcattttgcctcatgtggaccattgctatcgtgattgccgtcttacccctgctggggtggaattgcgaaaaactacagtcagtctgctcagacatctttcctcacattgatgagacatacctgatgttctggattggcgtgacctctgtgttgctactgtttattgtttacgcttatatgtatatcttgtggaaggctcacagccatgcagtgaggatgattcagcgtggaacccagaagtccatcatcattcatacgagcgaagatggaaaggtccaggtgactaggccggaccaggcaaggatggatatccgactcgccaaaacactagtactgattctggtcgtgctaatcatatgttggggaccactgctggcgatcatggtctatgatgtgtttggtaaaatgaataagttgatcaagaccgtctttgccttctgtagcatgctgtgcctgctgaacagcacagtcaatcccatcatctatgcccttaggtcaaaagacctgagacacgcatttcgctctatgtttccatcatgcgaagggactgctcagccgcttgacaattctatgggcgactccgattgtctgcacaagcatgctaataatgccgcatctgtgcatagggctgcggagagctgcatcaagagcaccgtcaagatcgcaaaggtgaccatgtccgttagcaccgacacctccgctgaagctctgtag

SEQ ID NO: 110724 - DNA, 1419 bp, Artificial Sequence
  Description of Artificial Sequence: Synthetic coding sequence
atgaaatcaattctggacggccttgctgatacaacttttcgcacaattaccaccgacctgttgtacgtgggcagtaacgatattcaatacgaggatatcaaaggcgatatggctagcaagctgggctatttccctcaaaagtttcctctgacctcctttcgcggatcaccatttcaagaaaagatgactgctggtgacaacccacagctggtgccagctgaccaagtgaatatcacggaattctataataagtcgctgtctagtttcaaggagaatgaggaaaacattcagtgtggagagaactttatggatattgaatgctttatggttctgaaccccagccagcagctagccatcgctgtcctgtctcttacgctggggacctttactgtactggagaatctcttggtcctctgtgtgatcctccattcacgctcactccggtgcagaccttcataccactttattgggagcctggctgtggctgacttattgggaagcgtaatcttcgtgtactcatttatagattttcacgtgtttcacaggaaagactccagaaatgtgtttctgttcaaactgggtggtgttacggcgtcattcaccgcaagtgtgggtagcctgtttctcacggccatcgaccgctatatctctatacacaggcccctcgcatataaacggatagttaccagaccaaaggccgttgtagcgttttgcctgatgtggacaatcgcaatagtgattgcggtgctgcctttgctcggctggaactgcgagaagctccaatccgtgtgtagcgatatcttcccccatatagatgagacttacctcatgttttggataggcgtgaccagtgtgcttctcttatttattgtctacgcttacatgtacatactatggaaggctcattcccatgccgtgagaatgatccaacggggaacacaaaagtcaatcatcattcacacctctgaggatggcaaagtgcaagtcacccggcctgaccaggccaggatggacatcaggctcgccaagacgctcgtgctgatcctcgttgtcctgattatttgttggggacctcttctggccatcatggtgtatgacgtcttcgggaaaatgaataaactgatcaagacggtgttcgccttttgctcaatgctgtgcctgttaaactcgacggtcaaccccatcatatatgccttgagatctaaagacctacgccacgcatttcggagcatgtttccctcttgtgaaggcaccgcccaacctctcgataattccatgggggactccgactgtctgcacaaacacgccaacaatgctgctagcgtgcatcgcgcggcagaatcatgcataaagagcaccgtcaagatcgcaaaggtgaccatgtcagtgagcaccgacacatctgcagaagctttatag

SEQ ID NO: 110725 - DNA, 1419 bp, Artificial Sequence
  Description of Artificial Sequence: Synthetic coding sequence
atgaagagcatccttgatggcctagcagacactactttcagaacaatcacaactgatcttctctacgttggttctaatgatattcagtacgaggacattaagggggacatggcctcaaagcttggctatttcccccaaaagttccccctgacgtctttccgcgggtctcctttccaggaaaagatgacagcaggggacaacccacaactcgtcccggcagaccaagttaatatcactgagttctacaataagagcctctcttcattcaaagagaacgaagaaaatattcagtgcggagagaactttatggacatagagtgtttcatggtcctcaatccttcacagcaattggctattgccgtgctttcattgactctgggtacgtttacagtgttagagaatttgctggtgctgtgtgttatactacactccagaagtttgcgatgtcgaccctcttatcactttattggctctctcgctgtggccgacttattgggcagtgttatttttgtatattcattcattgatttccacgtgttccacaggaaggattcccgaaacgtgtttctgtttaagctgggaggagtgacggcatccttcacagctagcgtgggctctttgttcctaaccgccatcgaccggtatattagcatacaccggcctctggcctataagaggatcgttacacggcccaaggcagttgtcgccttctgtttgatgtggaccatagcgattgtgattgccgtgctgcctcttctggggtggaattgcgaaaaactacagagcgtgtgcagcgatatcttcccccacatcgatgaaacttatctaatgttttggatcggcgtgacatccgtgttgctgctgttcattgtgtacgcgtacatgtatattttgtggaaggctcatagccacgctgtacggatgatccagcgcgggactcagaaatctatcatcattcatacttctgaagacgggaaagtgcaggttacgagacctgatcaggctcggatggatatacgcctggccaagactcttgtcttgattcttgttgtgctgatcatctgctggggacccctgttggctatcatggtctacgatgtgttcgggaagatgaacaagctcattaagaccgtttttgcattctgtagtatgctatgcctgctgaattcaacagtcaatccaattatctacgctctacgaagcaaggatctgaggcacgccttccgatctatgtttcccagctgcgagggcacggcacagcccctcgacaacagtatgggtgactcagattgcctgcataaacacgcaaataatgccgcaagcgtgcatagagcagccgagtcatgcattaagtccaccgtcaagatcgctaaagtcactatgagcgtgagcacagacacatcagcagaggcgttgtag

SEQ ID NO: 110726 - DNA, 1320 bp, Artificial Sequence
  Description of Artificial Sequence: Synthetic coding sequence
atgaagtccatcttggacggcctcgctgacacaaccttccgtaccattaccacagacctgcttggaagtccttttcaagagaagatgaccgccggtgacaatccccagctggtcccagctgaccaggtgaatatcactgagttctataacaagagtctgagttcctttaaggagaacgaggagaacatccagtgtggggaaaacttcatggatatcgaatgctttatggtactcaatccctctcagcagttggccatagccgtcctttccctgaccctgggaacattcacagtgctggaaaacctgctggtactgtgtgtgatactgcacagccgcagcttgaggtgcagacccagctaccacttcattggcagcctggccgtagctgatctgctgggcagtgtaattttcgtgtatagcttcatcgatttccacgttttccacagaaaggactcccggaatgtgttcctgttcaaactcgggggcgtgacagcgtcttttacagccagcgtgggtagcctcttcctcacagccattgatagatacatcagcatccatcggccactggcatacaagcgcattgtgacccgtccaaaggcggtggtggccttctgtctgatgtggacaattgccattgttattgccgtgctgccactgctcggctggaattgcgaaaagttgcaatcagtttgctcagacatcttcccccatatcgacgaaacatatcttatgttctggatcggggtgaccagcgtgctcctcttgttcatcgtctatgcctatatgtatattctctggaaggctcacagccatgctgtccgcatgattcaacgcgggacccaaaaaagcataatcatccacaccagtgaggatggcaaagtgcaggttacccggcctgatcaggcccgcatggatatccggttagccaagactctggtccttatcctggtggttctgattatttgctggggacccctgctggccatcatggtgtacgacgtctttggaaagatgaacaagctcattaaaaccgtgttcgccttctgctccatgctgtgcttgctcaattcaactgttaacccgatcatctacgccttaagatcaaaagatctgcgtcatgcctttaggagcatgtttccctcgtgtgagggtaccgcccagcccctggacaactctatgggagacagtgattgtctccataagcacgcgaacaatgccgccagtgtgcatagagccgccgagtcatgcatcaagagcacggtcaagatagctaaggtaactatgagtgtctccactgatactagtgccgaggccctgtag

SEQ ID NO: 110727 - DNA, 1419 bp, Artificial Sequence
  Description of Artificial Sequence: Synthetic coding sequence
atgaagtccattctggatggcctcgctgacaccacgtttcggacaattactacggaccttctctatgtgggctccaacgatatccagtatgaggatattaagggcgacatggctagcaagctgggctactttcctcagaaattcccactgaccagttttcggggtagcccatttcaggagaagatgacggctggcgataatcctcaactagtaccagctgaccaagtgaatatcactgaattttacaataaatctcttagcagctttaaggagaatgaagaaaacatacagtgcggggaaaattttatggacattgagtgtttcatggttttgaacccttcacagcagcttgcaatcgcagtgttgagcctgaccctcggaactttcacagtgctggagaacttactagtgctatgcgttattctgcattcaaggtccctgcgctgcagaccctcctaccatttcattggcagcctggcagttgcagatctcctgggtagcgtaatttttgtgtactcttttatcgatttccatgtctttcacaggaaagattccaggaatgtattcctgtttaagctgggtggagtaaccgcttcttttaccgcttccgttggttctctatttctaactgccatagacagatacatatctatccaccgcccgctagcctacaagagaattgtcacacggcccaaggctgtcgtggcattttgtcttatgtggacgattgccattgtgatagccgtcctccctctgctgggctggaactgtgaaaagctccagtctgtctgctctgatatctttccacacatagacgagacttatctcatgttctggattggagtgacctccgtcctgctcttgtttattgtgtatgcttatatgtatattctgtggaaggctcactcacacgctgttaggatgattcagagaggcactcagaagtccatcattatacatactagcgaggacggaaaagtccaagtgactaggcctgatcaggcccgcatggacattcggctggcgaagacgctggtccttatcctggtagtattgataatctgctgggggccccttttggcgatcatggtctatgatgtgtttgggaaaatgaacaaactaatcaagacagtgtttgctttctgtagtatgctatgtctgcttaactccacagtcaatcccatcatttacgctctgcgcagcaaagatttgagacacgctttccgttcaatgttcccgtcgtgtgagggcacggcccagcctttagacaattcaatgggggacagtgactgtttgcataaacatgccaataacgcagcgtcagtgcatagagcggccgaatcctgtatcaagagcactgtgaagatcgctaaggtgacaatgtctgttagtaccgatacctcggctgaagccctgtag

SEQ ID NO: 110728 - DNA, 1419 bp, Artificial Sequence
  Description of Artificial Sequence: Synthetic coding sequence
atgaaatccatcttggatggccttgctgatacaaccttcaggaccatcacaaccgacctgctatatgtgggatctaacgatatccagtatgaagatattaagggggacatggcctctaaactaggatattttccccaaaaattcccgcttacctccttccgcgggagtccatttcaagaaaaaatgactgctggcgacaaccctcagctggtgccggctgatcaggtcaacatcacagagttttataataaaagcctgtccagctttaaggagaacgaggaaaacatccagtgcggcgagaacttcatggatatcgaatgcttcatggtgttgaacccatcacaacagctggcaatcgccgttctttcccttacgctgggcaccttcactgtgttggagaacttgctggtcctctgtgtgatcctgcacagtcgtagccttcgctgtcgaccttcctatcattttatcggcagcctagcagtagcagatctgctgggctccgtgatattcgtctactcatttatcgacttccatgtattccatcggaaggacagccgaaacgtgttcctctttaaactgggaggagtgactgcctctttcacagcaagcgtcggctcactctttctcaccgcgatagacagatatatcagcatccaccggcctctggcttacaagcgtattgtgaccagacccaaggctgtggtcgctttttgccttatgtggactatcgctattgtgattgccgtactaccactcctgggatggaattgtgagaagctgcaaagcgtttgcagtgatatatttccccatattgatgaaacttatctcatgttctggatcggagtgacctccgttctgctgctgttcatcgtttatgcctacatgtacattctctggaaggcccattcccacgccgtacggatgatccaacggggtacccagaagtccattattatccacactagcgaagatggaaaagtccaggtgacacgccctgaccaggcgcgaatggatatccgtctggcaaagactcttgtgcttatcctagtggtgcttattatttgttgggggcctttgttggccataatggtgtacgatgtcttcgggaagatgaataagctgatcaagacagtgttcgctttctgttcaatgctctgtctcctgaatagcacggtgaatcccataatttatgcgctcagaagcaaggatctgcggcacgcttttaggtcaatgtttccaagctgcgagggcaccgcccagccactcgataatagcatgggcgactccgactgcctccacaaacatgcaaataatgccgccagcgttcaccgagcagctgagagttgtattaagtcgactgtgaagattgcaaaggtcacaatgtctgtgagtacggacacctccgcagaagcgctgtag

SEQ ID NO: 110729 - DNA, 1236 bp, Artificial Sequence
  Description of Artificial Sequence: Synthetic coding sequence
atggcactgcagattccgccgtccgcaccgagcccgctgacaagctgtacatgggcccagatgaccttcagcactaagacttcaaaggaaaatgaagagaacatccagtgtggcgagaattttatggacatcgaatgcttcatggtcctgaacccttctcaacagctcgccatcgccgtcttgtccctgactctgggaacatttacggtcctagaaaatctgctggtgctttgtgtaattctacacagcaggtcattgaggtgtaggcccagctatcacttcatcgggagcctggccgtcgctgatctcctcggctcggtaatcttcgtctatagtttcatagacttccatgttttccaccgcaaggattcacgcaatgtgtttttatttaaattaggcggcgttacagcttcattcactgcaagtgtcgggtccctgtttctaacagccattgatcgctatattagtattcaccggccactggcatataaacgtatcgtgacccgccccaaggcagtggtggcattctgtttgatgtggaccatagccatcgtcatcgctgttctgccattgctcggatggaactgcgaaaagcttcagagcgtttgcagtgatatcttcccccatattgacgagacctatctcatgttctggatcggggtgacatcagttctgctgctgttcatcgtatacgcttatatgtacatcctgtggaaggcccactctcatgctgttcggatgatccaaagaggcactcagaagtccatcataatacatacttccgaggacgggaaggtccaggtcacccgaccagaccaagctaggatggatatcagactggctaaaaccctggttctgatcctggtggtgctgatcatttgctgggggcctttactggcaatcatggtctacgatgtgttcggaaagatgaacaagctgatcaagactgtcttcgccttctgttccatgctatgtctgcttaactctaccgtcaatcctatcatttatgcactgcgctcaaaagatctccggcatgctttccgatcgatgttcccctcctgtgaagggaccgcacagccactggacaattctatgggagatagcgactgcctccacaaacatgccaacaacgctgcctcggtgcatagggctgcggagtcttgcataaaaagtaccgtgaagattgcgaaagtgacgatgtctgtcagcacagacacgtctgctgaagcattgtag

SEQ ID NO: 110730 - DNA, 1419 bp, Artificial Sequence
  Description of Artificial Sequence: Synthetic coding sequence
atgaagagcatcctggacgggctcgcggatacaacctttagaactatcaccacagatcttctctatgtcggatcaaacgacattcaatacgaagacatcaagggtgacatggcaagcaaactgggctacttcccccagaaattcccgctcacctctttccgcgggtccccatttcaggagaaaatgaccgccggcgacaacccacagctggttcccgcagatcaggtgaatattactgagttttacaataaatccctcagttcctttaaagagaatgaggaaaatatccagtgcggtgaaaactttatggacattgaatgttttatggtgcttaatccatcacaacagctggctatagctgtgctttcactaaccctcggcactttcacggtgctggaaaacctcctagttctctgtgtcatcttacactcacggagtctgaggtgcagaccctcttaccattttattggctccctcgcagttgctgatctgctaggatctgtgatctttgtttactcattcatcgatttccacgtctttcatagaaaggactcacgaaacgtgtttctgttcaagctaggcggcgtgacggcttcgttcaccgcaagtgttggctcactcttcctgaccgcaatagaccggtatattagtatccacaggccccttgcatacaaacgcattgtgactcggccaaaggcggtggttgcattttgccttatgtggaccatagctattgttattgccgtattgcccttgttgggttggaattgtgagaagcttcaatccgtttgcagcgacatattcccgcacatcgacgaaacatatcttatgttctggatcggcgtcacctctgttcttttactatttattgtgtatgcatacatgtatattctgtggaaggcacatagtcacgccgtgcgaatgattcaacgaggtacccagaaatcaatcatcatacatacttcggaggacggaaaggttcaagtgactaggccagatcaagcgcggatggacatacgattggcgaaaacactggtgctcattttggtggtcctcataatatgttgggggccattactcgccatcatggtgtatgacgtcttcggtaagatgaacaaactgataaagactgtgttcgctttctgctccatgctgtgcctgctcaattccacagtgaatccgattatatacgccctgaggtcaaaggatctacgccacgcttttcgttctatgttcccttcttgtgaaggaacggcgcagcccctggacaattcaatgggcgattctgattgtctacataagcacgccaataatgcagcttcagtccatagagccgctgagagttgtatcaagtccacggtcaagattgccaaggtcaccatgagcgtaagcacggacacaagtgcagaggccttgtag

SEQ ID NO: 110731 - DNA, 237 bp, Artificial Sequence
  Description of Artificial Sequence: Synthetic coding sequence
atgaagtcgatcctcgatggactggctgacacaaccttccgtaccatcaccactgatctgctgtacgtgggcagcaacgacatccaatacgaggacattaagggcgatatggccagcaagctgggttactttcctcagaaatttcctttaacaagcttccggggaagtccttttcaggagaaaatgacagctggcgacaacccacagttagtcccagctgatcaggtgaacatctag

SEQ ID NO: 110732 - DNA, 1083 bp, Artificial Sequence
  Description of Artificial Sequence: Synthetic coding sequence
atggaggaatgttgggtgacagagattgccaatggtagcaaagacggcttagatagtaatccaatgaaagactacatgatactcagcggtcctcaaaagactgccgtggctgtgctttgcacattgttaggactactctctgctcttgagaacgtggctgtcctttacctcattctctcttcgcaccaacttcggcggaaaccatcctacctcttcatcggaagtctagcaggcgccgacttcctggcctccgtcgtctttgcttgttcttttgtcaactttcacgtcttccacggagtcgactccaaagccgttttcctactgaagatcggctctgtcaccatgaccttcaccgcttctgtggggagcttgttgctcaccgctattgataggtatttgtgcctgagatatccgccttcctataaggctctgcttactcggggcagggcattagtgaccctgggaatcatgtgggtactgagtgccctcgtgtcatatcttcctctgatggggtggacgtgctgtccacggccctgctctgagctgttcccccttatacctaatgattacctgctgtcttggctgctctttattgccttcctgtttagcggaatcatttacacttacgggcatgttctttggaaggcccaccagcacgttgcatcattatccggacaccaggatagacaggtacccgggatggcacgtatgcgcctggatgtgagattagccaagacacttggtttggttttggcagtgctgcttatttgctggtttcccgtcctcgcattgatggcccactccttggccactacacttagtgatcaagtgaaaaaagcctttgccttctgctccatgctgtgtctcattaattcaatggtaaatcccgtcatatatgcactgagaagcggagagatcaggtcttccgcacaccactgccttgcccactggaagaagtgcgtgcgcggtctgggtagtgaagccaaggaagaggccccgcgttcgtccgtaacagagactgaggctgacggcaaaatcactccctggcccgacagtcgggacctggacctgagcgattgttag

SEQ ID NO: 110733 - DNA, 1083 bp, Artificial Sequence
  Description of Artificial Sequence: Synthetic coding sequence
atggaggaatgttgggtcaccgagattgccaacggatcgaaggatgggctcgacagtaaccctatgaaagactacatgattttgtccggtccccagaaaacagctgttgccgtcctctgtaccctgctaggcttgctctccgcccttgaaaatgtagccgtactgtacctgatcttgtcgagtcatcaactcaggcggaaacctagttatctgttcatcgggtctttggcaggggccgattttttagcctccgtagtatttgcatgcagcttcgttaacttccatgtctttcatggcgtggacagcaaggctgtctttctgctgaagatcggatccgtgactatgacattcactgcctctgtgggctccctgctgctgaccgcgattgacagatatttatgtcttaggtaccctccaagctataaagctctgttaactagaggccgggcgctagttacgctcggcatcatgtgggtcctttcggccctggtgagttatctccctcttatgggatggacttgttgcccgcggccgtgctcagaactcttcccgcttataccaaacgattatctgctctcctggctactatttatcgcattcctattcagcggcatcatctatacttatggacacgtcctctggaaggcacatcaacacgtggctagcctgagcggccatcaggacagacaagtgcctgggatggcccgcatgcgcttagacgtccgcttagccaagaccctgggactggtgttggctgtcttactgatatgctggttccctgtgctcgccctcatggcacacagcctggccacgactttgagtgatcaggtcaagaaggcctttgctttctgctctatgctatgcctgatcaactcaatggtcaacccagtcatatatgctctccgcagcggcgagattcgcagctccgcccatcactgtctggctcattggaagaaatgcgtgcggggccttggcagcgaagcaaaggaggaagcacctcgctctagcgtcacagagacagaagcagacggaaagatcacaccctggcccgattcccgggatctggacctcagtgattgttag

SEQ ID NO: 110734 - DNA, 837 bp, Artificial Sequence
  Description of Artificial Sequence: Synthetic coding sequence
atggatagcatgcctgagccggccagtcggtgccttctcttactgccactgctgctactcttactcctcctgctgcctgccccagaactcggtccaagccaggccggcgctgaggaaaatgactgggtgcgtctcccaagtaagtgtgaagtctgcaagtacgtggcggtggagctgaagagcgccttcgaagaaactgggaagacaaaggaggtgatcggcacaggctacggcattctggatcagaaggctagtggtgtgaagtacaccaaaagcgaccttcgattgatcgaggttacagagacgatatgtaagagactgctagactactcgctgcacaaagagcggaccggttcgaacagatttgctaaaggcatgtcagagacgttcgagacgctacacaatttggtgcacaaaggcgtgaaagttgtgatggacattccatacgagctgtggaacgagacatctgctgaggttgcagaccttaagaagcaatgcgatgttctcgtagaggaattcgaggaggtcatcgaggactggtaccgaaatcatcaagaggaggacctcactgaattcctgtgcgccaaccacgtcctcaaagggaaggacactagctgcttagctgagcagtggagcgggaagaagggggataccgccgccctgggagggaagaaatccaaaaaaaaatcctctagggccaaggccgctggggggagatcttcttcatccaaacagagaaaggaactcggaggcctggaaggagacccctccccagaagaggatgaaggcattcagaaagcaagccctctgacccattcacctcctgacgaattgtag

SEQ ID NO: 110735 - DNA, 165 bp, Artificial Sequence
  Description of Artificial Sequence: Synthetic coding sequence
atggactccatgccagagccagcctctcgctgtctactgcttcttccactgctcctgttgttactgctgctgttacccgcccccgagctgggcccatcccaggccggagctgaggagaacgactgggtacggctaccctcgaagtgcgaaggcacttgtggctag

SEQ ID NO: 110736 - DNA, 747 bp, Artificial Sequence
  Description of Artificial Sequence: Synthetic coding sequence
atggggccagtcagattgggtatcctgttattcctgttcttggccgttcacgaggcttgggcaggaatgctgaaggaagaggatgatgataccgaacggctgccgtccaagtgcgaggtttgcaaactgctaagcaccgaactgcaggccgagctgagtaggacaggccgctctagggaggttctggagttaggtcaggtgttggataccggtaaaagaaaaaggcacgtgccttacagtgtttccgaaaccaggctggaggaggctctcgagaatttatgcgagcgcatactcgattactctgtgcacgccgagcgaaagggatctctgcggtatgctaagggccaaagtcaaactatggctacactaaaagggctggtccagaagggtgtcaaagtggaccttggcatccctttagagctctgggacgagcccagtgttgaagtgacttatcttaagaaacagtgcgagaccatgctggaggaattcgaagatattgtcggcgactggtactttcatcaccaggagcagccccttcagaactttctatgcgagggccacgtcctccctgcagccgagaccgcctgtctgcaggagacctggacgggcaaagagattacagatggtgaggaaaagactgagggagaggaggagcaagaggaagaagaagaggaagaagaggaagaggggggcgataaaatgacaaagaccggatcacatcccaaacttgaccgggaggacctgtag

SEQ ID NO: 110737 - DNA, 798 bp, Artificial Sequence
  Description of Artificial Sequence: Synthetic coding sequence
atgagggaggagatgtccctagggtgtcaggaggcattcgagatattcaagcgggaccacgctgatagcgtaaccattgatgacaacaagcagatcctgaagcaaaggttctccgaggccaaagcactgggagagtctatcaatgaagcgcgttctaagatcggccatttaaaggaggaaataacccaacgtcacatacagcaggtcgccctgggtatctcggaaaatatggccgtccccctgatgcctgaccagcaggaggaaaaacttagatcccaactagaagaggaaaagcggcgctacaaaactatgtttacaaggctgaaggccttgaaggtcgagattgaacaccttcagctgttgatggacaaagctaaggttaaacttcagaaggagtttgaggtgtggtgggccgaggaagcgaccaacttacaagttaacagtcctgcagtgaatagtctggaccataccaagccatttctacagacaagcgattctcagcacgagtggtctcagcttctgagcaataagtccagcggcggatgggaggtgcaagaccagggtacaggacgtttcgatgtttgtgatgtgaatgcacgaaagatcttgcctagtccttgcccgtccccccatagccagaagcagtcctccacctctacgcccttagaggattctatccctaaacggcccgttagcagtattcctttgacaggggattctcaaacagattctgatatcatcgcctttatcaaggctagacagagcatcctgcagaagcaatgcctgggttccaactag

SEQ ID NO: 110738 - DNA, 1185 bp, Artificial Sequence
  Description of Artificial Sequence: Synthetic coding sequence
atggcaaatatgcagggactcgtggagaggttagaaagagcggttagccgcttggagagtctgtccgcagaatcacaccgacctcccggcaactgtggagaagtgaatggcgtgattgccggtgtggccccttctgtggaagccttcgataaactgatggactcaatggttgctgagttcctcaagaatagccgaatcctggcaggcgatgtggagacccatgccgaaatggtgcactctgcctttcaggcccaaagggccttcctcctgatggccagtcagtatcaacagcctcatgaaaatgatgtagctgccctgttgaagcccatttctgaaaaaatacaggagatccagaccttcagggagaggaacaggggaagcaacatgtttaatcacctgtcggcggtgtcagaaagtatacccgcgctgggttggatcgctgttagtcccaaaccacccccactgcctccaccaggaccgcctcccctattcgagaacgagggaaagaaggaggagtcatccccttcgaggagcgcactgttcgcccagcttaaccagggtgaggctattacaaaagggctccggcacgtgacggatgatcaaaagacatataagaatcccagtttgagagcccaaggcggccagacccagtcacccacaaagtctcacacaccatcgcccactagtcctaaaagctacccatcacagaagcatgcaccagtcttggagttggaaggaaagaagtggcgcgtggagtatcaagaggacagaaacgatctagttataagcgagacagaactgaagcaggtggcatatatcttcaaatgcgagaagagtacaatccagattaaaggaaaagtgaattccattatcatcgacaactgcaagaaactgggactcgtctttgataatgtggtgggaatcgtagaggtcataaatagccaggacatccagatccaagtcatggggcgggttccaaccatttccatcaacaagaccgaggggtgtcacatttacctatctgaggacgctcttgactgcgagatcgtgtccgcaaaaagctctgagatgaatattctcattcctcaagatggtgactacagggaatttcctatccctgaacagttcaagacggcctgggatggttcaaagctcattaccgagccggcggagatcatggcctag

SEQ ID NO: 110739 - DNA, 597 bp, Artificial Sequence
  Description of Artificial Sequence: Synthetic coding sequence
atgaagctgtatagcttatccgttctgtacaagggggaggcaaaagttgtactcctgaaagcagcttacgatgtcagctccttctctttttttcaacgctcgagcgtgcaggagtttatgacgtttacctctcaactgatcgtggaacggtcctccaagggtacaagagcttccgttaaagaacaggactacctatgccacgtgtacgttcgcaacgacagtctcgcaggcgttgtgatcgccgacaatgaatacccttctagggtggcctttaccctgctggaaaaggtccttgacgaattcagcaagcaggtggacagaatcgactggcctgtcggcagccctgctactattcattatcccgctttggacggacacctgtcaaggtaccagaacccacgcgaagccgatcctatgactaaggtgcaagcggagttggatgagaccaagataatactacacaacaccatggaatctctgctggagcggggtgaaaaactggacgatctagtgtcaaaatctgaagtgctggggacccagagcaaggccttttataagaccgctcgcaagcagaattcatgttgtgctattatgtag

SEQ ID NO: 110740 - DNA, 3036 bp, Artificial Sequence
  Description of Artificial Sequence: Synthetic coding sequence
atgcagaagccaagtgggctgaagcctccgggccgagggggtaagcatagtagcccaatgggcaggacatccaccggttccgcgtcaagctccgccgccgtggccgctagctcgaaagaaggctctcctctgcacaaacagtcctccgggccgagctcctctcctgcagccgctgctgccccagaaaagcctggtcctaaagcagccgaggttggagatgatttcttaggtgacttcgtcgttggtgagcgtgtgtgggtaaacggggtgaagccaggagtggtgcaatacctgggggagacccagttcgcgcccggccagtgggccggcgtcgtgctggatgaccccgtggggaagaatgacggtgctgtaggcggggtgagatactttgagtgcccggccctccagggaatcttcaccaggcccagcaagttaacgagacaacctaccgccgagggttccggctctgacgcacactctgtcgaaagtctgacagcacagaatctttctctgcattcagggaccgccacaccacccttgactagcagagtcattcccctcagggagtcagtattgaacagttccgtgaagacaggaaacgaatcagggtcaaatctgtccgactcggggtccgtgaaaaggggtgagaaagatctccgccttggagatagggtgctcgtgggggggaccaaaactggtgttgttcgttacgttggcgaaaccgactttgctaaaggcgagtggtgcggcgtggagctggatgaaccacttggtaagaacgatggtgccgtcgcaggaacgcgatacttccagtgtccacccaagttcggcttgtttgctcccatccataaagtgatccggatcggattcccttcaacgagcccagcaaaagctaagaaaacaaaacgcatggctatgggtgtctccgccctgactcattccccttcatcctcatctatctcctcagtctccagcgttgcgtcttctgtcggtggtcgcccttcccgcagcggtctgctaaccgagacgagctccagatacgctaggaagatcagtggaactaccgcactgcaggaagccttaaaggaaaaacagcaacacattgaacagctgctagccgaaagagaccttgaacgcgccgaagtcgctaaggcgacttctcacatctgcgaggtggagaaggaaatcgcactactgaaagcccagcatgagcagtacgtggcagaggctgaagagaagcttcaacgggctaggctgctcgttgaatctgttagaaaagaaaaagtggacttatctaaccagctagaggaagagcgcaggaaagtggaggacttacagtttcgcgtggaagaggagtccattacaaaaggcgatctcgaactgacgacggtcgcggaaaagtcgagagtcctgcagcttgaggaggagctgactttacgccgcggggaaattgaagagttacagcagtgtctgttgcatagcggaccgcccccccccgaccatccagatgctgctgaaattctgcggctgcgggagaggctcctgtcagcaagcaaagaacaccagcgggaatccggggtcctcagagacaagtacgaaaaagctttgaaggcataccaggctgaggtggataagttgcgtgcggctaacgaaaaatacgcacaggaggtagccggtctcaaggataaagtgcaacaggccaccagcgagaacatgggtctcatggataattggaaaagcaagctggattccttggctagtgaccatcagaaatccctagaggacctcaaagcaaccctcaattcagggccaggcgcacagcagaaagaaattggcgagctgaaagccgtcatggaaggaatcaaaatggagcaccagctggagcttgggaacctgcaggccaagcatgatctggagactgcaatgcacgtgaaggaaaaggaagctctgcgcgagaaattacaggaagcacaagaagagctggccggacttcagcgacactggcgggcccagctcgaggtgcaggcttcacagcatagattggaactgcaggaagcacaggatcagcgcagagatgccgaattgcgggtccacgagctggaaaagctggatgtcgagtaccgagggcaggcccaggcgatcgaattcttgaaggagcagatctcactagcagagaaaaaaatgttggactatgaaaggctgcagagagctgaagcgcaggggaagcaagaagtggaatctctccgggagaaactcctggtggccgaaaatagattgcaggctgttgaggcgctctgttcttcccaacacacccacatgattgagagtaacgatatctcagaggagactattcgaactaaggagaccgttgaaggtctgcaggataagctaaacaagcgtgacaaagaagtgacagcactgacgtctcagactgagatgttgcgggcccaggtaagcgcactggaatctaagtgcaaaagcggcgagaagaaagtggatgccctgctgaaagagaaacggaggcttgaggccgagctggagacagtcagcaggaagacacatgacgcatctggccagcttgtattgataagtcaggagttactaagaaaagagcgttcactcaatgaactgcgagtgttgctactggaagccaataggcattctcctggaccggagcgggacttgtctagggaggtccacaaagctgagtggcgcattaaagaacagaagctcaaagacgatatccgtggactccgggagaagctaactggactcgataaggagaaatccctgtctgatcagagacgttactcattgattgacaggtccagcgcacctgagctcctcaggctgcagcatcaattgatgtccactgaggacgcgctacgtgatgccctggatcaggcccagcaggttgaaaagctgatggaggccatgagatcctgtcccgacaaggcccaaactatcggtaactccggaagcgccaacggcatccatcagcaggacaaggcacagaaacaggaggacaaacactag

SEQ ID NO: 110741 - DNA, 3141 bp, Artificial Sequence
  Description of Artificial Sequence: Synthetic coding sequence
atgcagaaacccagtggcctcaagccccctgggaggggtggcaaacacagctccccaatggggaggaccagcacaggatcagcatccagcagcgccgccgttgcagcctctagcaaggaaggcagtcctctccacaaacagtcttctggtccctcctcatctccggccgcagctgcggctcccgaaaagccagggccaaaggcggcagaggtcggtgatgatttcctcggggacttcgtggtgggcgaaagagtttgggtgaatggagtgaaacccggcgtagtgcagtacctgggcgagacccagtttgcccccggccagtgggccggcgttgtgctggacgacccagttgggaagaatgatggagctgtgggcggggtccggtattttgagtgtcccgccctgcaggggatttttactaggccaagcaaactgaccagacagcctaccgccgaaggaagcggaagtgatgcccacagtgtcgagagcttgaccgctcaaaacctcagcttacactctgggaccgctacacccccgttgacatccagagtgattcctctgcgcgaaagtgtcctcaattcatcggtgaagactggaaatgaaagcggaagtaatctgagcgattcgggctctgtgaaacggggggaaaaggatctgcggctcggagatcgcgtgctagtcggagggactaaaactggggtggtccgatatgtcggcgagaccgattttgccaagggggagtggtgcggggtggaacttgacgaacccctgggcaagaatgacggcgccgtggcagggacgcgatacttccagtgcccgcccaagttcggcctcttcgccccaattcataaggtcattaggattggcttcccctcaacgtctccggcaaaggccaagaaaaccaaaaggatggccatgggcgtttcggccttaacccactccccaagttcttcttctattagcagcgtatcctctgttgcgagttctgtaggcggcagaccctcaaggtctggcctcctcaccgagacaagctctaggtatgccaggaagatttcggggaccactgccctccaggaagctctgaaggagaaacagcagcatattgagcagctgctcgcagaacgtgatctggaaagggcggaggtggcaaaagccacttcccacatctgcgaagttgagaaggaaatcgcactcctgaaggctcagcatgagcaatacgtcgcagaagccgaagaaaaactgcagcgtgctaggctgttagtcgaatccgtcaggaaagaaaaagtggacctgtctaatcagctagaggaggaaagacgcaaagttgaggacctgcaatttcgggtcgaggaggagtccataacaaagggcgatctggaaacccagacacagctggagcatgctaggatcggtgagttagagcagtccctccttctggagaaagcacaggctgagagacttctgagggagctcgccgataatcggctcacaactgtcgctgagaagtcaagagtcctgcagctcgaggaagaattgactctgcgacggggcgaaatcgaagagctgcaacagtgcctgctccacagtgggccacccccccccgatcaccctgacgcagccgagatattaagactgcgtgagcgactgttaagtgcaagcaaggagcaccagcgtgagagcggcgtgctgagggacaaatacgagaaagctttaaaagcttaccaggcagaagtagacaagctgcgggccgctaacgaaaagtatgcccaagaagtggcaggtctgaaggataaagttcagcaagctaccagcgaaaatatgggtctaatggacaattggaagtccaagttagactccctcgcgtcggatcaccagaaaagcctggaggatctgaaggcgactttaaacagcggccctggtgcccagcagaaggagatcggcgaattaaaagccgtcatggaagggatcaaaatggagcaccaactcgagttaggaaacctccaggctaaacacgacctggagactgccatgcatgtaaaggagaaggaagcattaagagagaaactgcaggaagcccaagaggagcttgccgggcttcagaggcattggagagctcagctagaagtccaggcaagccagcaccgactggagctgcaagaagcacaggaccaaagaagagacgccgaactgagggtccacgagttagagaaactcgatgtggagtatcgtggccaagcccaagctatcgagttcttaaaagagcagatctctctggccgaaaaaaaaatgttggactacgaacgtttacagagggccgaagcacaggggaagcaggaggtggaatcattacgcgaaaagctcctcgtggccgagaaccgcctgcaggccgtggaggccctgtgctcttctcaacacactcatatgatagagtcaaatgacatcagcgaggaaacgattcgtacaaaggaaacagttgaggggctgcaagataagctgaacaaacgcgacaaggaggttacggcactgactagccagaccgagatgctgagggcccaggtgtcagccttggaatccaaatgcaagagtggcgaaaaaaaagttgacgctctgctcaaagagaagcgtcggctcgaggccgaattggaaactgtctctcgtaaaacccacgatgcatccggacaactcgtgctgatcagccaagagcttctgcggaaggaaagatcacttaatgaactgcgcgtgttattgttggaggcgaatagacattcacctgggcctgaacgagacctgagcagggaagtgcataaagccgagtggcggatcaaggagcaaaagctgaaggacgatattcgcggtttgcgggaaaagcttactggactggacaaagagaaaagcctgtctgatcaacggcgctattccctgatagatcgctcaagtgcaccagaactgctacggttgcagcaccagctgatgagcacagaagacgcgctgcgggacgcccttgatcaggcccagcaagttgagaagttgatggaagccatgagaagttgcccagataaagcacaaaccattggcaattctggatcagccaacggtatccaccaacaggacaaggctcaaaagcaggaagacaaacattag

SEQ ID NO: 110742 - DNA, 153 bp, Artificial Sequence
  Description of Artificial Sequence: Synthetic coding sequence
ctggaagaggaaaggagaaaggtggaggacctgcagtttagggtggaagaggagagcattactaaaggcgatctcgaggccgaggatcacctttctcccgagccctcgatgctgacaaccgtggccgagaaatctcgcgtccttcaactgtag

SEQ ID NO: 110743 - DNA, 3141 bp, Artificial Sequence
  Description of Artificial Sequence: Synthetic coding sequence
atgcagaagccttcagggctgaaaccacccggtcgcgggggcaaacactccagtccgatggggagaaccagtacaggctccgcctcctcttcagccgccgtagcagcctcaagtaaggagggcagtcctctgcacaagcagtcctccggaccttcgtctagtccagccgctgctgctgcccctgagaaaccaggcccaaaagctgccgaagtgggagacgatttcctgggcgattttgtggtcggggaacgggtctgggtgaacggggtaaagccaggcgttgttcagtatctgggcgagacccagttcgctcccggccaatgggcaggcgtggttttagacgatcctgttgggaagaatgacggggccgtgggcggggtacgatatttcgagtgccccgctcttcagggaatttttactcggccaagcaagctgactcgtcaaccaactgctgaaggaagtggctctgacgctcactctgtggagtcgcttactgcacagaatctttctctgcactctggaacagcaactcccccactcacttccagagtcatccctctcagggagtccgtactcaactcttctgtcaagactggcaatgagagtggttccaacctgagcgattccggctccgtgaagagaggtgagaaagacctcagactaggcgacagagtacttgtggggggtactaaaactggagtggtgagatatgtcggcgaaactgacttcgcaaagggagaatggtgcggagtcgaattggatgaaccactgggcaaaaatgacggggctgtcgccggcacgagatattttcagtgtcctcccaagtttgggctgtttgcaccaattcataaagttattcggatcgggttcccttcaaccagccccgctaaggccaagaaaacaaagcggatggcaatgggagtttcagctctgacgcactccccctctagctcaagtatctcatcagttagctccgtcgctagctccgtgggaggccgtcccagtagatcgggtcttctgacagaaacctctagccgctatgctcgaaagatcagtggaactactgcgctccaagaagcccttaaagaaaaacaacagcacattgagcagctgctagccgagcgcgacttggagagggctgaggtcgcgaaagctactagccatatttgtgaggtagaaaaagaaattgcgctcttgaaggcgcagcatgagcagtatgttgccgaggctgaggagaaactgcagagagccaggcttttggtcgagtcagtgagaaaagagaaggtggatctctcaaaccagctcgaagaagagaggaggaaggttgaggacctgcagtttcgagtcgaagaggaatcgatcactaagggggacctggagactcagactcagctggaacacgcaaggatcggcgagctggagcagtccctgctgttggagaaagcccaagccgagcggttattgcgggagctcgccgataatagactgactaccgtggctgaaaagagccgagtccttcagctcgaggaggagcttactctacgtcggggggagatcgaagaactgcagcaatgtctgctgcatagcggccccccgcccccagatcatccagatgccgccgagatcctgcgactccgcgagagactgttgagcgcatcaaaagagcatcagcgagagtccggcgtcctgcgtgacaagtatgaaaaagctttaaaggcctaccaagcagaggtcgataaattgagggccgctaacgagaaatatgcgcaagaggtagcaggccttaaagataaagttcagcaagctacttctgagaatatgggactgatggacaactggaaaagcaaactggatagcctcgcttctgatcatcagaaatctctcgaagatttgaaggcaaccctgaattccggaccaggagcacaacagaaggagatcggcgagctgaaagctgtgatggagggcatcaaaatggaacaccagttggaactgggcaacctgcaggccaagcacgacctggagacggccatgcatgtgaaggagaaggaggccctacgagagaaactgcaagaggcgcaagaggaacttgctggtctgcagagacattggcgagcccagcttgaggttcaagctagtcagcacaggctcgaactgcaggaggcgcaggaccagagacgcgacgctgagcttcgagtccacgagctcgaaaagcttgacgtggagtacagaggccaagcgcaggcaattgagttcttaaaggaacagatctccctggctgaaaaaaagatgctggattacgaaaggctgcagcgcgccgaagcccagggcaagcaagaggtggaatctcttcgcgaaaagttacttgttgccgagaataggctccaggctgtagaggccctgtgctctagtcagcatacgcacatgatcgaaagcaatgatatctctgaagagactatccgaacaaaggagacagtggaagggcttcaggacaagctgaataaaagagataaagaggtcactgctttaaccagtcagactgagatgctgcgcgcccaggtgtcggctttagagagtaagtgtaagtccggcgaaaagaaagttgatgcccttctcaaagagaagagaagacttgaagccgaactcgagacagtctccagaaaaactcatgatgcaagcggccagctggttctcatatcccaggaactcctgagaaaagagcgttcactcaacgagctaagagtgctgttacttgaagccaacaggcattcacctggacccgaacgcgatttgtccagagaggtgcacaaagccgagtggaggatcaaggagcagaagttgaaagatgatatccgcggtttacgggagaaattgaccggtctggataaggagaaatctctctctgatcagcgtagatactccctgatcgatagatcatctgcacccgagttgttgagactgcagcatcagctgatgagcacggaggacgcgctacgggacgccctggaccaggcccaacaggtcgagaagctgatggaagccatgcggagttgtccggataaggctcagacgatcggcaatagcggaagcgctaacgggatccatcagcaggacaaggcacagaaacaagagaacactcactag

SEQ ID NO: 110744 - DNA, 4827 bp, Artificial Sequence
  Description of Artificial Sequence: Synthetic coding sequence
atgtatagtgcacaccggccactcatgcctgcaagcagcgcagcctcacgtgggctgggtatgttcgtgtggactaacgtggagccacggtctgtcgccgtttttccatggcacagcctggttcctttcctggccccgtctcagcccgatccttctgtgcagccctcagaggctcagcagccagcctcccaccctgtggccagcaaccagagcaaagagcctgctgaaagcgccgccgttgcacatgagagaccgccaggcgggaccggtagtgcagaccctgagcgcccacctggggcgacgtgccctgagtccccaggccccggacctccacaccccctgggagtagtagagagtggcaagggtccgccgcctactaccgaggaggaagcctccgggcccccaggcgagcccaggctggactcagagaccgagtccgatcacgatgacgcgttcctaagcataatgtctcccgaaattcaactgccgttaccccccgggaaaaggaggacccagtccctctctgccctgccgaaggagcgagattccagttccgaaaaggatggacgctctcctaataagagagagaaagaccacatcagaagaccgatgaatgcctttatgatcttctcgaaacggcatcgcgccctcgtccaccaaaggcacccaaatcaagacaatcggacagttagtaaaatcttgggcgagtggtggtacgctttgggccctaaggagaagcagaagtatcatgacctagcgtttcaggttaaggaagctcacttcaaggcacatcctgactggaaatggtgtaataaggataggaagaaatcttcttccgaggcaaagcctacaagcctggggctggccggagggcataaggagacccgggagcgctcaatgagcgagacagggaccgctgccgcccccggcgtctcttcggagctcctatccgtcgctgctcagactctgttgtcatcggacacaaaagctccgggctcctcctcctgtggggctgaacggctgcacactgtcggtggaccaggatctgccagaccaagagcttttagccatagcggagtccattccctggatggcggtgaagttgattcgcaggctctccaggagctgacccagatggtctctggtcccgcctcttactctggacctaagccttccacgcaatatggagcccccggacctttcgctgctcccggcgagggtggcgccctggccgccactggcaggccacccctgctccccactagagctagtagaagccagagagccgcatctgaagatatgactagcgacgaagagaggatggtgatttgtgaagaagaaggcgacgatgatgtgatcgctgacgacgggttcggaacaaccgacatcgatctgaaatgcaaggaacgggtaactgattctgagtcgggggatagcagcggggaagatcccgagggaaataagggctttgggcgcaaggtgttttcaccagtgattaggtcatcgttcactcactgtaggcctccattggatcccgagccccccggtcctcctgaccctcccgttgccttcgggaaggggtatggctccgccccctctagcagcgcgagcagtcccgcctcttcgtctgcgagtgcagctactagtttttccctcgggagtggtacctttaaagctcaggaaagcgggcaggggagtaccgccggcccactccggcctccgcctcccggggcagggggcccagccaccccttccaaggctacccgcttcttgcccatggacccggccacgtttcgccgtaagaggccggagtccgtgggggggttagagccacccggcccaagtgtcatcgctgctcccccttccggaggcggcaacatcctgcagaccttagtactgccacctaataaggaagagcaggaagggggcggcgcgcgggtgccaagcgcgcccgctccctcattggcatacggcgcccccgccgctccactctctcgccccgccgccactatggttactaacgtggttcgccccgtcagttctacacctgtgcccattgcgagcaaaccatttccaaccagtggcagggccgaagcgagtcctaatgataccgccggggccaggaccgagatgggaactggcagtagagtgcctggcggttcccccctaggcgtgagcctcgtgtactcagacaaaaaaagcgcggctgccacatctcccgcacctcacttggtggctgggcccttgttaggtaccgttggcaaagccccagccaccgtgacaaatttgctcgtgggcacccctggctatggcgctccggctccgcccgcagtgcagtttattgcccagggcgctccaggcggcggaaccacagccgggtctggggctggagccggctcagggcccaacggccccgttccactggggatattacaaccaggggccctcggtaaagcaggtgggataacccaggtgcagtacattttgccaaccttaccccaacagttacaagtggccccagctcctgccccggccccggggacaaaagcagctgcacccagtggtccggctcctactaccagcatcagattcaccctgcctcctggcacctctactaatggcaaagtcttagctgcaacggctcccacaccgggtatcccaattcttcagtccgtcccatccgccccaccaccaaaggctcagtccgtatctcctgtgcaggccccaccaccgggcggatctgcacagctcctcccagggaaagtattggtccccctggcagccccatccatgtctgtgcggggagggggcgcgggccagccgctgcctctagtatccccccccttcagtgtgcctgtacagaacggagctcaaccacccagcaaaattattcagcttaccccagtgcctgtatcaactcccagcgggcttgtaccgccactgtctcccgccaccctgcccggccctaccagtcagccccaaaaagtcttgctgccctccagcactcggatcacctatgtgcagtctgctggaggacatgcactgcctctaggtaccagtccagcaagttcccaggcaggcactgtcacttcatacggtcccacgagctcagttgcgcttggtttcacatcactcggtccctccggtcccgcctttgtgcagcctctactgtccgcaggccaggccccacttctcgcccccgggcaggttggtgtgtccccagttccgagcccacaactccctcctgcatgtgcggctcctggaggacctgtgattactgctttctattccgggtcccctgcccctacttcctccgcgccactagctcaaccaagccaggcgccgccatccctagtatatactgtagctaccagtaccacaccccccgccgcaacaatccttcccaaggggccaccggcccccgctaccgcaacgcccgcacccactagcccattccctagtgctaccgctggtagtatgacatattctctggtcgctccaaaagcccagaggccttcgccgaaagcccctcagaaggtgaaggccgccatagcctccatccccgtgggctctttcgaggccggagcttcaggacgacctggaccggcccctagacagcctctcgagcctgggcctgtgcgagagcctaccgcccccgaatcagaattggaaggacagccaactcccccagcaccgccccctctgccagaaacttggacccccaccgccagatccagtcctccgctgcccccccctgcagaggagcgcacctcagcgaaagggcccgagacaatggcatcgaagttcccatcctcgtcctctgactggcgcgtgcctggacagggtttggagaataggggagagccacccacaccaccatcccccgctcctgctcctgcagttgcccctggcggttctagcgagtcatctagcggacgtgctgccggcgacacccctgaacgcaaagaggcagccggcactggcaagaaggttaaagttcggcctccaccccttaagaagacctttgactctgtggacaatcgggtattgtctgaggttgattttgaggagagatttgcggagctgcccgagttcaggccagaggaggttctgcctagccccacactccagtctctagccacaagcccacgtgcgatcctgggatcttaccgtaaaaagaggaaaaacagcaccgacctcgactctgccccagaagatccaactagcccaaagcgcaaaatgagacgcagatcaagttgtagttctgaacctaacacacccaagtcagctaagtgcgaaggggatattttcacgttcgacaggaccgggacggaagccgaagacgtgctgggagagttagaatacgacaaagttccctattcatctctcagacgaactctggaccagagaagggccctcgtaatgcaactttttcaggaccatgggtttttccccagtgcccaggccaccgccgcatttcaggctcgctacgcagatatttttcccagtaaggtgtgtttgcagctcaagataagggaggtgaggcagaaaatcatgcaggctgctacgccaaccgagcagcctcccggagccgaggcaccacttcccgtgccccctcctactggaacggctgccgcaccggctcctactccatctcctgcaggaggccctgaccctacttctccttcttcagacagcggcactgctcaggccgccccccctcttccccctccgccggagagcgggccgggacaaccgggctgggagggcgctccccaaccgtcgccaccacctcctggcccctccacagccgcgacgggacgctag

SEQ ID NO: 110745 - DNA, 1002 bp, Artificial Sequence
  Description of Artificial Sequence: Synthetic coding sequence
atgtatacagccatcccacaatcaggtagtccttttcccgggtctgtgcaggaccctgggctgcacgtctggagagtcgagaaactaaaaccagtcccagtggctcaagagaaccagggtgtgttcttttccggagactcctacctggtcctccacaatggacccgaagaggtttctcatctgcatctgtggatcggccagcagtcgagtagagatgagcagggtgcgtgcgccgtgctggccgtgcatctgaatacactgctgggcgaaaggcccgtgcagcaccgagaagtacaagggaatgaatcagatttatttatgagttacttccccagaggattgaaataccaggagggaggcgtggagtcggccttccataaaaccagcaccggggcgccggctgctatcaagaagttgtatcaggtgaagggaaagaagaatatccgagctactgagcgggccttgaattgggatagttttaacaccggggactgcttcatacttgacctcggacagaacatattcgcctggtgtggaggtaaatctaacatactggaacgaaataaggcgcgtgacctagcattggccatcagggactctgagagacaggggaaggctcaggtcctcggaccaaaaccggctctcaaggagggcaatcccgaggaagacctcactgctgataaagccaatgcccaggcagccgccttatacaaagtgagcgacgccacaggccagatgaatttgactaaagtcgcggattcctctcccttcgctctcgagttgctgatttcagatgattgcttcgtactagacaacgggctctgcggaaagatctatatttggaagggtagaaaggccaatgagaaggaaagacaggctgctcttcaggttgccgaggggttcatctctagaatgcaatacgcgcctaatacacaggtcgaaatcttaccccagggccacgagagtcctatctttaaacagttcttcaaggattggaagtag

SEQ ID NO: 110746 - DNA, 861 bp, Artificial Sequence
  Description of Artificial Sequence: Synthetic coding sequence
atggctgactttgacgaccgggtgagcgacgaagagaaggtgcgtattgctgcaaagtttataactcacgccccgcctggcgagttcaacgaggtatttaatgacgttcgcctgctcctgaataatgacaacctactgcgcgagggcgccgcccatgcctttgcccagtacaacatggaccagttcactcccgtaaagattgaaggatacgaggaccaggtactcattaccgagcatggtgacctgggcaactcacggttcttggaccccaggaacaaaatcagtttcaagtttgaccacctcaggaaggaggcctcagatccacagccagaggaggctgatgggggactcaaatcatggagagagtcgtgcgatagcgccttacgggcctacgttaaggatcattactccaatggattctgtactgtgtacgcaaaaacaattgatggtcagcagactatcattgcctgcatagaaagtcaccaattccagcctaagaacttttggaacggcaggtggagatccgaatggaaatttaccattactcctcccactgctcaggtcgtgggagtgttgaaaatacaagtccattactacgaagacggaaatgtacagctcgtctctcacaaggacgtgcaggattccctgactgtatctaatgaagctcaaaccgctaaagaattcatcaaaataattgaaaacgctgagaatgagtatcagacagcaattagcgagaactatcagactatgtcagataccacattcaaagctctacgaagacagctcccagtgacaagaacgaaaatagactggaacaaaatcctgtcatacaagatcggcaaagagatgcagaatgcatag

SEQ ID NO: 110747 - DNA, 861 bp, Artificial Sequence
  Description of Artificial Sequence: Synthetic coding sequence
atggctgatcttgaggaacaactgtcggatgaggaaaaagtccggatagcagcaaagtttatcattcacgctcctcctggagaattcaatgaagtgtttaacgacgtgcgactgctgcttaataatgacaatctgttgcgggagggggcagctcacgcctttgcgcagtacaatttggatcagttcaccccagtgaaaatcgaaggctatgaggaccaggtcctgattaccgaacacggagatctaggtaacgggaagttccttgatccaaaaaatcggatctgtttcaagttcgaccatctccgcaaagaagcaaccgatccacgtccatgcgaagtagagaacgccgtggaatcatggcgcaccagtgtggagactgctttgcgggcatacgtgaaagagcattaccctaacggagtctgcacagtttacggaaaaaagatcgacggccagcaaactattatagcttgcatagaatcccatcagttccaggcaaagaatttctggaatggaagatggcgtagcgaatggaagtttactattaccccatccacgactcaggtcgtgggcatactgaaaatacaggtccattactatgaagatggaaacgttcagctggtttcccataaagatattcaggacagcctgacagtatccaacgaagtgcagaccgccaaggaatttatcaaaatcgttgaagccgctgagaacgaataccagactgctatcagcgaaaactaccagacaatgtctgatacaactttcaaagcactgagaaggcaactgccagtgacaaggactaaaatagattggaacaaaattctgtcttacaagatcgggaaggagatgcagaatgcctag

SEQ ID NO: 110748 - DNA, 519 bp, Artificial Sequence
  Description of Artificial Sequence: Synthetic coding sequence
atggccgatttggaggagcagctctccgatgaggaaaaagtgaggattgccgccaagttcatcatccacgcaccacctggtgaattcaatgaggtgtttaacgatgtccgtctactgctgaataatgataacctattgcgcgagggggcagcccatgcctttgcccaatacaatctagaccagtttacgccagtgaaaattgaagggtacgaggaccaagtgttgatcacagaacacggggacttgggaaatgggaaattcctcgaccctaagaaccgcatatgctttaaattcgatcatctacgcaaagaggccactgatcctagaccatgtgaagtcgagaacgcggtagaaagctggcgaacttccgtggagaccgccctccgcgcgtatgtgaaggaacattatccaaatggcgtctgcactgagtggagtctggaggtgcgtatggaggtctacaaccatagttttaaccacagctctggttggcacctggagaactctggctccctgctgtag

SEQ ID NO: 110749 - DNA, 900 bp, Artificial Sequence
  Description of Artificial Sequence: Synthetic coding sequence
atgacactatccgtactgtcacggaaggacaaggaacgcgtgattagacgcctgctgctccaggcaccccctggcgagtttgtgaatgcgtttgacgatttgtgcttgctaatcagggatgagaagcttatgcatcatcagggggaatgcgcaggccaccaacattgtcagaagtactctgtgcccctctgcatcgacgggaaccctgtcctcctcagccaccacaacgttatgggagactaccgattttttgatcatcagtctaagttgagttttaaatatgatctcctgcagaaccagcttaaagatattcaaagtcacgggatcatccagaatgaggctgagtacctgcgggtagttcttctttgtgccctgaagctctatgtcaatgaccactacccaaaaggaaactgcaatatgctacggaagactgtaaagagtaaggagtatctgatcgcatgcatcgaagatcacaattacgagacaggagagtgctggaatggactgtggaaaagcaagtggatctttcaggtaaacccctttctcacccaggtgacgggccggatatttgttcaagctcatttttttcgctgcgtgaatctccatattgaaatatccaaggacctgaaagaatcccttgagattgtgaatcaagcccagctcgctctgtcctttgcccgccttgtagaagaacaagaaaacaagttccaggctgcggttctggaagagctgcaggagcttagcaatgaagcgctacgtaaaattttgcggcgcgatctgcctgtgaccagaaccttgattgattggcacaggatcctttcagacttgaacttggttatgtatcctaagctggggtacgtaatttacagtcgctccgtcctgtgtaactggatcatctag

SEQ ID NO: 110750 - DNA, 834 bp, Artificial Sequence
  Description of Artificial Sequence: Synthetic coding sequence
atgtccgatcagcagctggattgcgccctggatctgatgaggcggctacctcctcaacagatcgaaaagaatctctcagacctcattgacttggtccctagcctgtgtgaggaccttctgtcctcagtggaccagcccctcaagattgccagggacaaggtcgtcgggaaagactatttgctgtgtgattacaatagagacggtgatagctatagaagcccttggagcaataaatacgatccccctctggaagatggcgccatgccctccgcgagacttaggaagttggaggtggaggcaaataacgcgttcgaccagtatagggatttgtactttgagggcggcgttagctcagtttacttgtgggaccttgaccacgggttcgctggcgtcatcttaatcaagaaggctggcgatgggagcaagaagataaaggggtgttgggattccatacatgtggtggaggttcaggaaaagtccagcgggagaactgcgcactataaactgacatctacggtaatgttgtggctgcagactaataaatctgggtctggcacaatgaatctgggggggagtctcactcgccagatggagaaggatgagactgtgtctgattgttcaccgcatatcgccaatatcggtcggctcgttgaggacatggaaaataagatccgcagcacactgaatgagatatattttggtaaaaccaaagacatagtgaacggcttgcgcagtatcgacgcgatcccagacaaccagaagtttaaacaactgcagagggaacttagccaggtgcttacccagaggcagatctacatccagcccgacaattag

SEQ ID NO: 110751 - DNA, 783 bp, Artificial Sequence
  Description of Artificial Sequence: Synthetic coding sequence
atgccaagacagttccaggacaccgggttctctcgaccaggccttgggcagccaaggcgctgcgatccagagccccgtaagtcggatcagcagctggattgcgctctcgatttgatgcgccgtctgcctccccagcagatagaaaagaacctgagcgatcttatcgatctcgtgccgtccctgtgtgaagacttgctttcatccgtggatcagcctttgaagattgccagggacaaagtggtcggcaaggattacctgctctgcgattataatagggacggagactcatatcggagcccttggtctaataagtatgaccctccgttggaagacggagcaatgccaagtgccaggttaaggaagctggaagtggaggccaataatgcgttcgaccagtatcgcgacctgtatttcgagggcggcgtctcaagcgtctacttatgggacctagaccatggttttgccggggttatcctgattaagaaggcgggcgatgggtccaagaagatcaaggggtgttgggactcgatccacgtggtggaagttcaagagaagtcgtctggaagaacggctcactacaaactcacatcaacagtgatgctttggcttcagactaacaagagcggttcgggcactatgaacctgggcgggtccctgacacgacagatggagaaggacgaaaccgtctcggactgttctccacatatagctaacattggaaggcttgtggaagtgtgtgccgatttctgtcggcaaattaagacccggtcgtctgaagagtag

SEQ ID NO: 110752 - DNA, 834 bp, Artificial Sequence
  Description of Artificial Sequence: Synthetic coding sequence
atgtctgatcagcagcttgattgcgccctggacttgatgcggagattacctccacagcagatcgagaaaaacctgtccgatttgatcgatctcgtccctagtctttgcgaggacctgctttctagcgtggaccaaccactcaagatagcccgcgacaaggtagtgggaaaggattatttgctgtgcgattacaacagggacggcgacagttatagaagtccttggtctaacaagtacgatccccctctggaagatggagccatgccatctgcacgactcaggaaactcgaggtggaagctaacaatgcttttgatcagtatagggatctgtattttgaaggcggcgtcagttccgtgtatctgtgggacctggatcatggctttgccggcgtcatcctgataaagaaagctggagacgggtctaagaagatcaaggggtgttgggattcaatacacgtggtcgaagttcaggagaagagctcagggcgtactgctcactataagctgacctccacggtgatgctgtggcttcaaactaacaaaagtggaagcggcaccatgaacctgggcggaagccttaccaggcagatggaaaaggatgagacggttagcgattgctcaccacacatcgcgaacataggaagactggtggaagatatggagaataaaattcgttctacacttaacgagatatacttcgggaaaaccaaggatatagtcaacggactgagaagcattgatgccatccccgataatcagaagtttaagcagttacaacgtgagctttcacaggtcctgacacagaggcaaatttacatacagcctgacaactag

SEQ ID NO: 110753 - DNA, 783 bp, Artificial Sequence
  Description of Artificial Sequence: Synthetic coding sequence
atgcgcaggctacccccccagcagattgaaaagaacttatccgatttgatagacctagtgcctagtctctgtgaggacttactatcttcggtagaccagcctctgaagattgcaagagacaaggtggtcggcaaggactacttgttgtgtgattacaacagggacggtgacagttacaggtccccctggtccaacaaatatgaccccccactggaggacggcgccatgccttcagctaggctgcggaagctagaagtcgaagcgaataatgcttttgatcagtaccgggacttatatttcgagggcggagtgagttctgtttatctttgggatctggatcacggctttgcgggagtgatcctgattaagaaagctggcgatggcagcaagaaaatcaaggggtgttgggacagtatacatgtcgttgaggtacaggaaaagagttctgggagaacagcccattataaactcacaagtactgttatgttgtggctccaaacaaacaaatccggctccggcacgatgaatctaggcgggagccttacccgacagatggagaaggatgagacagtgtcggattgttcgccccatatcgcaaacatcggccggctcgtagaggatatggagaataagatcagatctaccctgaatgagatctactttggcaaaacaaaggatatcgtcaacggactgcggtcagtgcaaacatttgccgacaagtcgaagcaggaggctctgaagaacgatctcgtggaggctctgaaacgcaagcagcagtgctag

SEQ ID NO: 110754 - DNA, 1005 bp, Artificial Sequence
  Description of Artificial Sequence: Synthetic coding sequence
atgggcgggccacaggataaggatgaacgtacgatcgctctggtccgaccttggccgtgggggcaccaagcactagatccggcatatggacttgacacaatgcatcctagtcgcagaagcctgcccttccctttaaactgccagcttgcccgcgtgggcactgcagattacggatctccatcggatcagagcgatcagcaactggattgtgctttggatctaatgcgcagattgcctccccagcaaatcgaaaagaatctgagcgaccttatagatctggttccttctctgtgtgaggacctgctttcgtccgtcgatcagccactcaaaatcgcacgggacaaggtggtcgggaaggactatctgctgtgcgactataatagggacggtgactcataccgcagtccctggagcaataaatacgatcctcccctggaggatggcgctatgccatccgctagacttcgaaaattggaagtggaagcgaataacgccttcgatcagtatagagacctgtactttgaaggcggtgtgagctcggtttacttgtgggatttagaccatggattcgctggagtgattctgatcaaaaaagcaggcgatggctccaaaaaaatcaaagggtgttgggatagcatccacgtggtcgaggtgcaggagaaatcttctggccggaccgcccactacaagctgacatccacagtgatgctctggctgcaaactaataaatccgggtcagggaccatgaacttgggaggctcactgactcggcagatggagaaggatgaaacggtaagcgattgctcccctcatattgcaaacattgggagactggttgaggatatggaaaacaagattcggtccaccctcaatgaaatctatttcggaaaaaccaaggacattgtgaatggcttgcgttcggtgcaaacattcgcagataaatctaagcaggaagcattgaagaacgaccttgtggaggcgcttaagagaaagcagcagtgctag

SEQ ID NO: 110755 - DNA, 819 bp, Artificial Sequence
  Description of Artificial Sequence: Synthetic coding sequence
atgtccgatcagcaactggactgcgcactggatctgatgcgacggctgccaccccagcagattgaaaagaacctgagtgacctgatcgatcttgtgccgagcctctgtgaggatctccttagctcggttgaccagcctctcaagatcgctcgtgacaaggttgtgggtaaagattacctcctgtgcgactataacagagatggggattcctacagaagtccctggagcaataaatatgaccctcccctcgaagacggagcaatgccatctgcccgcctgagaaagctcgaggtagaggcaaataatgcctttgaccaatacagggatctctactttgaggggggcgtctcttccgtttatctttgggatctggaccacgggttcgccggggtgattcttattaagaaggccggtgacggctccaaaaagattaaaggatgctgggattcaatccatgtagtagaagtacaagaaaagtcttcagggcgtacagcacactataaactcacctctaccgtgatgctatggctgcagaccaacaagtccggcagtggaacgatgaacctagggggttctctgaccaggcaaatggagaaggatgagactgtgtctgattgcagccctcacatcgcaaatattggaagactggtggaggatatggaaaataaaatcaggagtaccctcaatgagatctatttcgggaagactaaagacatcgtcaatggtctcagatcagtacagaccttcgccgacaagtccaaacaagaagccctgaagaatgacttagttgaggccctgaaaaggaagcagcaatgctag

SEQ ID NO: 110756 - DNA, 621 bp, Artificial Sequence
  Description of Artificial Sequence: Synthetic coding sequence
atgcgcaggctccccccacagcagatcgagaagaatctgtcagatctcattgacttggtgccaagtctctgtgaggacctcttgagctcggtggatcagccactcaaaattgcaagagacaaggtggttggtaaggactacctcctgtgcgattacaatagagatggcgattcttatcgtagcccttggagcaataagtacgatcccccgctggaagatggggccatgccctctgcaaggctaaggaaactcgaggttgaggctaacaacgccttcgatcagtatagagacttgtatttcgaaggcggagtctcttcagtctatctttgggatctggaccatggcttcgccggggttattctgattaaaaaggcgggtgatggcagcaagaaaattaagggatgctgggatagcattcatgtggtggaagtgcaggagaagtccagcggccgcacagcacattataagctcaccagcactgtgatgctgtggctgcaaacaaataaaagtggcagcggtacaatgaatctgggagggagcctgactaggcagatggaaaaggatgaaacagtttcagattgtagtccacacattgccaacataggacggctggtcgaatag

SEQ ID NO: 110757 - DNA, 906 bp, Artificial Sequence
  Description of Artificial Sequence: Synthetic coding sequence
atgcatcccagtaggagatctttaccatttcccctcaactgccagctcgcccgcgtgggtacagccgactacggatcaccgagtgatcagagtgaccaacagttggactgcgctctagacctcatgaggcgcctcccgccccagcagatcgaaaagaatctgtctgatctgatagatctcgtcccctctctgtgcgaggacctcctttcttcagtggatcagcctctcaaaatagctcgggataaggtagtcggaaaggactacctgctctgtgattataaccgggacggggattcttaccgctcgccttggagcaataagtatgaccccccacttgaagacggagccatgccctcagcccgactgcgaaagctggaagtggaagctaacaacgccttcgaccaatacagagacctgtattttgagggcggtgtgtcatcagtatatttatgggacctcgatcacggcttcgccggtgtcattctcatcaagaaagctggggacggtagtaagaagattaaaggatgctgggactctatccacgtagtggaggtgcaggagaaatcctctggcagaaccgctcactataagcttacaagcacagtgatgctgtggttgcagacaaataagagcggctccggtacgatgaacctgggtggctccctgacgcgccagatggagaaggacgagaccgtgagcgattgctctccacatatcgccaatatcggtcgactggtggaagacatggaaaataagattcgctcaacactgaacgagatttactttgggaagacaaaggatatagtcaacgggttgagatcagtacaaacatttgccgacaagtctaagcaggaagctctcaaaaatgacctcgtcgaagctttgaaacgcaaacagcaatgctag

SEQ ID NO: 110758 - DNA, 366 bp, Artificial Sequence
  Description of Artificial Sequence: Synthetic coding sequence
atgctaaaggttccctccttatgcgaagatctgctctcaagcgttgaccagcctctgaagatcgccagagacaaagtcgtggggaaggactaccttctttgcgactacaatcgcgacggcgacagctatcgatctccctggtctaacaagtacgaccctcctctcgaggatggcgctatgccctctgcaagactgaggaagctcgaggtggaagcaaacaatgcgttcgaccagtatcgcgacttatacttcgaagggggggtatcatcagtctacctttgggatctggatcacggattcgctggtgtgatcctcatcaagaaggctggggacggatcaaagaagatcaaagggtgctgggactag

SEQ ID NO: 110759 - DNA, 1047 bp, Artificial Sequence
  Description of Artificial Sequence: Synthetic coding sequence
atgtacacagctattccgcagagtggatcaccgtttcccgggtccgtgcaggaccccgggcttcatgtttggcgggtcgagaaactgaaacccgtgcctgttgcacaagaaaatcaaggagtgttttttagcggagattcctacctcgtcctccataatgggcccgaagaggtaagtcatcttcatctgtggatcggccagcaaagctctagagacgaacagggcgcctgtgctgtgttggcagtgcacctgaatacactgttgggggagcggcctgtacagcatagggaggttcaggggaacgagtcagatctgttcatgagctactttccaagagggctgaagtatcaggagggaggggttgagtccgcttttcacaaaacttcaacaggagccccagctgccattaaaaagttatatcaggttaagggaaaaaaaaatatccgagctacagagagggccctaaactgggattctttcaatactggggattgcttcattctggacttgggccagaacatctttgcatggtgtggaggcaaaagtaacatcctggaacgcaataaggccagagatctcgccttggccatcagggacagcgagagacagggcaaggcacaagttgagatcgtgactgacggcgaagaacctgccgaaatgatccaggttctcggccccaagccagccctgaaggaaggcaacccggaggaggatctcacagcggacaaagccaacgctcaggcggccgcactctataaggtgtccgatgcaaccggccagatgaacctcacaaaagtggccgattcttcccctttcgccctggagcttctgattagtgacgactgttttgtgttggacaatggactctgcgggaaaatctacatctggaaggggcggaaggctaatgaaaaagaacgccaggccgccctccaggttgctgagggattcatttctcggatgcagtatgcacctaacactcaggtcgagatcctgcctcagggacacgaatcccccatatttaagcagttctttaaagattggaaatag

SEQ ID NO: 110760 - DNA, 657 bp, Artificial Sequence
  Description of Artificial Sequence: Synthetic coding sequence
atgtacacagcgattccccagtccggctcgccctttccaggatccgtgcaggatccaggcctccacgtgtggagagtggagaagttaaagccagtacccgtggcccaggagaaccagggagtgttttttagtggagactcttatctggtgttacataatggccccgaggaggtgtcacatctgcacctgtggatagggcaacaatcatccagggacgagcagggcgcttgcgccgtgctcgctgtgcatctgaatactcttctcggcgagcggcctgtgcaacaccgggaagtgcaggggaatgaatccgacctgtttatgtcctactttccaagagggctcaaatatcaggaaggtggagttgaatccgccttccacaagaccagcactggagctccagctgcaatcaagaagctgtatcaggttaaaggaaaaaaaaatatccgcgccactgaacgggccctgaactgggactcttttaataccggcgactgcttcatactcgacctcgggcagaatatcttcgcctggtgtggaggcaagagcaacatcttggaacgcaacaaagcaagggatttagcacttgctatacgcgattcggaaagacagggtaaggctcaagtagaaatagtaactgacggcgaagagcctgcttag

SEQ ID NO: 110761 - DNA, 1047 bp, Artificial Sequence
  Description of Artificial Sequence: Synthetic coding sequence
atgtacaccgccattccccaaagcggctcaccctttcccggctcagtgcaggatccaggcctccatgtgtggagagtggaaaagctgaagccagtgcctgtggcccaggaaaaccagggggtgtttttttcaggagactcttacctggtactccacaacggaccagaagaagtctcacacttgcacctctggattggacaacagagttctagggacgaacagggggcctgcgccgtgctggctgttcacctgaacacattactcggcgaacgtcctgtgcaacaccgcgaggtgcagggcaatgagagcgatctcttcatgagctacttcccgcggggcttgaagtaccaggagggcggagtggaaagtgcgttccataaaacgtccaccggcgctcctgccgctataaaaaagttatatcaggtaaaagggaagaaaaatatcagggccaccgagcgcgcactgaactgggactcgtttaatactggagattgcttcatcctggaccttggtcaaaatatctttgcttggtgtggaggaaaatcaaatattctggagcgaaacaaggcccgggatttggctctcgccatacgcgatagcgaacgtcaaggcaaggcccaagtagagatcgtgactgacggtgaggagcctgcagagatgatacaggtcctcggtccaaagccggcgcttaaggaagggaacccggaagaggacctaactgccgacaaagctaatgcccaagccgccgctctgtataaagtttcggatgctactggccagatgaaccttaccaaagtggccgacagctcacctttcgccctggaactgctcattagtgatgactgcttcgtcctcgataatggcctctgtgggaagatatacatctggaagggtcgcaaagcgaacgaaaaagagcggcaggctgctctgcaggttgctgagggattcatttcgcgcatgcagtatgctccaaatacacaagtggaaatcctccctcaggggcatgagtctcctatcttcaaacaattcttcaaagattggaagtag

SEQ ID NO: 110762 - DNA, 1047 bp, Artificial Sequence
  Description of Artificial Sequence: Synthetic coding sequence
atgtatacagccatcccgcagtcgggatctccatttcccgggagtgtgcaagaccctggcctccatgtgtggcgggtcgagaagctcaagcctgtacccgtggcacaggagaatcagggcgtgttcttttctggggactcttacctggtcctccacaacggccctgaagaagtcagtcatctgcatctgtggattggacagcagtcttcacgggacgaacaaggagcatgcgcagttctggctgtgcacttaaatacactgttaggggagaggcccgtgcaacatcgggaggttcagggcaacgagtccgatctcttcatgtcttatttccctagggggctgaagtaccaagaaggtggcgtggaatccgcattccacaaaactagcacaggcgcacctgccgcaatcaaaaagttgtatcaggtgaaaggcaaaaagaacattcgggccacagaacgggccctcaactgggactcttttaatactggggactgctttatcctggatctgggacagaatatctttgcttggtgtggcggaaagagtaatatcctcgagcgaaacaaggccagggacctcgccctggctattcgggactcagaaagacagggtaaggcccaggtggagatcgtgactgacggagaagaacctgcagaaatgattcaggtgctggggccgaaacctgcccttaaagagggaaatcctgaagaggatctgacagcagacaaagccaatgcccaggccgcagccctctataaagtgagtgacgctacagggcagatgaacctgacaaaagttgccgattcatcaccctttgcactggaactcctaatcagcgacgattgtttcgtgctagacaacggcctgtgtggcaaaatttacatttggaagggaaggaaagctaacgaaaaggagcggcaggccgctttgcaagtagccgagggctttattagccgaatgcagtatgcgcccaacacgcaggtggagatcctgccccagggacacgaaagccccatttttaaacagttctttaaggactggaagtag

SEQ ID NO: 110763 - DNA, 762 bp, Artificial Sequence
  Description of Artificial Sequence: Synthetic coding sequence
atgtatactgcaatcccacagtccggttctccttttcccgggtccgtgcaggatccaggtcttcacgtgtggcgggtggagaagctgaaacccgttcccgtggctcaggaaaatcagggggtctttttctcgggcgatagttaccttgtattacacaacggtccagaggaggttagccatctgcatctttggatagggcagcagagttcgagagatgagcaaggtgcctgcgccgttctcgccgtgcacctcaatacacttttgggagagaggccagttcagcaccgcgaagtgcaaggtaacgagagcgacctgttcatgagttattttccccggggcttaaaataccaggaggggggcgttgaaagtgcttttcacaaaaccagcaccggcgctcctgcagcgataaaaaagctctatcaggtgaaaggaaagaagaacattagagctacagaaagggcactcaattgggactcctttaacaccggtgactgcttcatcttagaccttggccaaaatatttttgcgtggtgtggcggaaagtcaaacattctggaaagaaacaaggccagagacctggcactggccatcagagatagcgaaagacagggaaaagctcaggtggaaatcgtaacagatggtgaagaaccagctgaaatgatccaagtccttggacccaaacccgctctcaaagagggaaacccagaagaggatcttactgcggacaaggcaaacgcccaagccgccgcgctgtataagtag

SEQ ID NO: 110764 - DNA, 762 bp, Artificial Sequence
  Description of Artificial Sequence: Synthetic coding sequence
atgtacaccgccattcctcagagtgggtctcccttccctggatctgtgcaggaccctgggcttcatgtgtggcgtgtagagaagctgaagcctgtgccggttgctcaggagaaccagggagtgtttttcagcggagatagctacctcgtgctgcacaacggtccagaagaggtttctcacctgcacctatggatagggcagcagtcctcacgggacgaacagggggcctgcgcggtcctcgccgtccatcttaataccctgttgggtgaacggccagtccaacaccgggaagtgcagggcaatgaatcagacctgtttatgagctatttccccaggggcctaaagtaccaagagggcggtgtagaatctgcattccataagacctctaccggagctcctgcggcaattaaaaaactgtatcaagtgaagggtaagaagaacataagggcaaccgagcgcgctctgaactgggactccttcaacacgggtgattgctttatcttagatttaggacagaacatatttgcctggtgtggtggaaagagcaatatcttggaacggaataaggcacgggatctggcccttgccattcgtgacagtgagcgtcagggtaaagcgcaagtggaaatcgtcacagatggcgaagagcccgctgagatgatccaggtgctgggcccgaagcctgcacttaaggagggtaatccagaagaggatttaaccgctgacaaggccaatgcgcaagcagccgcactgtacaaatag

SEQ ID NO: 110765 - DNA, 762 bp, Artificial Sequence
  Description of Artificial Sequence: Synthetic coding sequence
atgtacactgccatcccccaatccgggtccccttttccaggcagcgtccaggatcctggcctgcacgtgtggcgtgtggaaaaactcaaacccgtgcctgtggcacaggaaaatcagggggtgttttttagtggcgacagctacctcgtgctccacaacggtccagaagaggtgagccacctccacctatggatagggcagcaaagtagtagagacgagcagggcgcctgtgcagtcttagctgtccacctgaataccctcctaggggagcgtcccgtgcagcatcgggaggtccagggcaacgaaagtgacctgtttatgtcctatttcccccggggtctgaagtaccaggaggggggagtcgaatccgcatttcacaagacatcaaccggcgccccagcggctattaaaaagctgtaccaggtaaaaggcaagaagaacatcagagctactgagcgcgctttgaactgggattccttcaataccggtgattgtttcatcttagatcttggccagaatattttcgcctggtgcggtggaaagtctaatattctggagcgcaacaaagctagagatctcgctctcgccattcgggactcggagagacagggaaaagcccaggttgagatcgttactgatggagaagagcccgcagaaatgattcaggtgctcggcccaaagcctgcattgaaagaaggaaaccccgaagaagatctgactgcagacaaggctaatgcacaggctgcagcactgtacaaatag

SEQ ID NO: 110766 - DNA, 984 bp, Artificial Sequence
  Description of Artificial Sequence: Synthetic coding sequence
atgtacaccgcaatcccccagtctggttccccgtttcctggaagcgtgcaagatccagggctccatgtttggagggtggagaagctgaagccagtgcccgtcgctcaagaaaaccagggcgtttttttctcgggggactcatacctcgtgctacacaatgggcccgaagaggtgtcccatcttcacctgaacacactgctgggagagagacccgtccagcacagagaggttcaaggcaacgagtctgacttgttcatgtcctacttccccagagggctcaaataccaggagggaggcgttgaatcagcgttccacaagactagtacgggagcaccagccgctattaaaaagttataccaggtcaaaggtaaaaaaaacattagagctacagaaagggctctaaattgggacagtttcaacactggcgattgctttattttagacttagggcagaatatcttcgcatggtgtggcggcaaatccaacattctggagcgcaataaggcaagagacctcgcacttgctatccgggatagcgaaaggcaggggaaggcccaggtcgaaatagtgaccgatggtgaagaaccagccgagatgatccaggttctgggaccaaagcccgcgctgaaagagggaaaccctgaagaagacttgacagcggacaaggctaatgcccaggccgcagccctttacaaggtgagtgacgcaacagggcaaatgaatctgaccaaggtggcagactcttcccccttcgctctggagttattgatttccgatgactgctttgtgctcgacaatgggctgtgcggaaaaatctacatctggaagggacggaaggcgaatgaaaaggaacggcaagcagccctccaggtcgccgaagggtttatctccagaatgcagtatgcacctaacacccaagtggagatactcccccagggacatgagagcccaatcttcaagcaattcttcaaagattggaagtag

SEQ ID NO: 110767 - DNA, 654 bp, Artificial Sequence
  Description of Artificial Sequence: Synthetic coding sequence
atggagggtagcttcagcgatgggggcgcactgcccgaaggcctggcggaagaggccgaaccacaaggtgccgcttggagcggagatagtggcaccgtgtctcagtctcattctagcgcatctggcccgtgggaggatgagggggccgaggatggggcaccagggcgggacttgcctcttctgaggagggccgcggccggttatgcagcgtgcctgctgcccggagccggagccagacccgaggttgaggcgcttgacgcctctctggaagatctgctgacccgggtggatgagttcgtgggcatgctggatatgttgcggggcgattctagtcatgttgtgtccgagggggtgcctaggattcatgcaaaggcggctgaaatgcggcgtatctacagccgaatcgaccggctcgaggcctttgtccgcatggtgggagggcgcgtggccagaatggaggagcaggtcacaaaggccgaagcagagctgggcacgttcccccgtgccttcaagaagctgctgcatacgatgaatgtcccatctctctttagcaagagcgcgccaagccgcccgcagcaggcaggttacgaggcacctgtgctgtttaggacggaagattacttcccatgctgcagtgaacggccacagctgtag

SEQ ID NO: 110768 - DNA, 6678 bp, Artificial Sequence
  Description of Artificial Sequence: Synthetic coding sequence
atggctgccctggtgctggaggacggttcggttttaaggggccagccctttggcgccgccgtctcaacagccggcgaagtggtgtttcagaccgggatggtgggctaccccgaggctctgaccgatccgtcttacaaggcccagatcctagtgttgacctacccactgataggtaactacgggatcccacctgacgagatggacgagttcggcctgtgtaagtggttcgaatcttcgggcatacacgtagccgcactcgtggttggcgaatgttgtccgaccccctctcattggagtgccactcgcaccttgcacgagtggctacagcagcacgggatccccggtttgcagggtgtggatactcgggaacttaccaagaagttgcgcgaacaaggcagcctcttgggcaagctggttcagaatggcactgagccatctagcctacccttcctagatccgaatgctcgacccctggtgccggaagtgagcatcaagacacccagagtcttcaatacaggcggagcccccaggattctggccctggattgtggactgaagtataatcagatacgctgcctgtgccaacgcggcgcggaggtgactgtggtgccgtgggaccacgccctcgattctcaagagtacgaaggccttttcttgagtaacggcccaggcgacccagcaagctatccatcagtggtgtccactctctcaagagtgttaagtgagccaaacccgaggcccgtcttcggtatttgcctcggccaccaactcctcgcactcgccatcggagccaaaacttacaagatgcgctatggtaacagggggcataaccagccatgcctgctggtcggtagtggccgttgctttcttaccagccaaaaccacgggttcgccgtggagacagactcactcccagccgattgggcaccgttatttacgaacgcaaatgacggttccaatgaagggattgtgcacaattcccttccatttttttcagtgcagtttcatcccgagcaccaagccggcccgtctgacatggagctgctcttcgacatatttctagagacagtaaaggaagctactgccgggaatccaggtggacagacggtgagggagcggctgactgagagactttgtcccccaggcattcctaccccaggctccggcctcccccctccccgcaaggtgttgatccttggcagtggaggactaagcataggccaggctggcgaatttgattactcgggtagccaggcaatcaaagctctgaaggaggaaaatatacagacgctgctcatcaacccaaatatagctactgtgcagacctcacagggtctcgccgataaggtttatttcctgcctataaccccccactacgtgactcaagttatccggaatgaaaggcccgatggggtgctcctgactttcggggggcagacggctctgaactgcggagttgagttgaccaaagctggagtgctggccaggtatggggtgcgggtgctgggaacccctgtggagaccattgagctgaccgaagatcgacgggcattcgccgccagaatggctgagataggagagcacgttgctcctagtgaggccgccaactccctggagcaggcccaggccgccgccgagaggctgggatacccagtgctggtgagggccgccttcgcccttggaggcctgggcagtggatttgcaagcaaccgggaagaactgagtgcattagtggcgccagcctttgcacatacgtcccaagtacttgtggataagagccttaaaggatggaaggagattgaatacgaagtggtgcgtgacgcatacgggaattgtgttacagtctgcaacatggagaatttggatcctctaggaatacataccggcgaaagtatcgtagtggcaccttcccagaccctgaatgacagagagtaccagctgttgcggcagactgccataaaagttacccagcacctgggaatcgtgggggagtgtaatgtccagtacgcactgaatccagagtccgaacagtactacatcattgaagtcaacgcacggcttagtagaagtagtgccttggcctccaaagccacaggctatccactggcttacgtcgctgcgaaactggcattgggcatacccctgccagagctgcgaaattctgtgactggtggcacagctgcgtttgagccttccgtggattactgcgtcgtgaaaatccctcggtgggatctcagcaaatttctgagggtctccaccaaaatcgggtcatgcatgaagtccgtgggcgaagttatgggtattgggcgtagttttgaagaagctttccagaaagctctcaggatggttgatgagaactgtgtcggctttgaccacaccgtgaagccagtctctgatatggagctcgagacacccaccgacaaaagaatcttcgtggtggctgccgcactctgggccggctacagcgtggatcggctctatgaacttacaaggatagaccggtggtttttgcaccgtatgaagcggatcattgcccatgcccagctcctcgagcagcatcgagggcaaccactgccccctgatctcctccagcaggcaaagtgtctcgggttctccgataaacagatcgcactggctgtccttagcacagaactggctgtccgaaaactgcgccaggaattagggatttgtcctgcagtcaagcagatagataccgttgccgccgagtggcctgctcagacaaattatttgtatctcacatattggggcacaactcacgacctaacctttcggacaccgcacgtcctcgtcctggggtctggagtctacagaattggctcctcggtggagttcgactggtgcgctgtgggctgcatacaacagctccgaaaaatgggctacaaaacaatcatggtgaattacaatccagaaaccgtcagtactgactacgacatgtgcgaccgtctctactttgatgaaatatcttttgaggttgtcatggatatttatgaactggagaatcctgagggggtgatcctgtccatgggtgggcagctgcctaataacatggcaatggctctgcataggcaacagtgcagggtcctcggtacgtcccctgaagccatagactccgccgagaataggtttaaattctcaaggctgctcgacactatcgggatttcccaaccacagtggcgagaactctccgatctggagtctgcccggcagttctgccagaccgtgggatacccctgcgttgttcgcccctcttacgtactgtcaggtgctgccatgaatgtggcctatactgatggagacctggagcgattcctttcttctgctgccgccgtgtccaaagagcacccggtggtcattagtaagtttatccaggaagccaaggagatagatgtagatgctgtggcatcggatggagttgtggcagcaatagctatctctgagcacgttgagaacgcaggggtacattcaggcgatgcgacgttggttaccccaccgcaagatatcactgccaaaactctggagcgcatcaaagcaattgtccatgcagtgggtcaggagctgcaggtgacagggccgtttaatctgcaacttatcgcaaaggacgatcagctgaaggtgattgagtgtaatgtaagggtttctcgaagtttcccttttgtgtctaaaacactgggggtggatctggtggccctcgcgacccgggtaattatgggtgaagaagtggagcctgttggcctgatgactggatcaggagtcgtcggggtgaaggtaccacagttctctttctcacggttagccggggccgacgtagtccttggagtggaaatgacatccactggcgaggtggcagggttcggcgagagcaggtgcgaggcctacctcaaagcgatgttatcaacaggttttaagatccctaagaagaatatcctgttaacaatcggctcttataagaacaagagtgagttgcttccgacagtcagacttcttgaatccttgggctactcactgtatgcttcactgggcactgccgacttctacacagagcatggagtgaaagtaacagctgtggactggcacttcgaggaggcagtggatggagagtgcccacctcaaaggtcaattctcgaacagctggccgagaagaatttcgagctagtaattaacctcagtatgcggggggcagggggtcgtcgcctgtccagcttcgtgacaaagggttataggacacgcaggttggccgccgacttttcggtgccactgataatcgacatcaagtgcaccaagttattcgtggaagctctggggcagattggacccgctccccctctgaaggtacacgtggactgtatgacaagccagaagttggttcgcctccccgggctcatcgacgtgcatgtgcacctgcgcgagccaggtggaacacataaggaggattttgctagcgggaccgcagctgctttggctggaggaatcaccatggtgtgcgcgatgccaaataccagaccccctatcattgatgcccctgccctcgcacttgcccagaaacttgctgaggccggcgcaaggtgtgattttgccttgtttctgggtgcgtcttccgaaaacgcaggcactctcggtactgttgccggtagtgcggcggggctgaaactgtacctaaatgaaacattttctgaactgaggctcgatagtgtggtgcaatggatggaacattttgaaacttggcccagtcacctgcccatcgtggctcacgcagagcagcagaccgtggcagctgttctcatggtggcccaattgacccagcgaagtgtacacatctgccacgtggccaggaaagaagagattctcctgattaaagccgccaaggcccgaggtctcccggtgacctgtgaagtggcgccacaccacctctttctgtcgcacgacgacctggaaaggttagggcctggcaagggcgaggtgagaccagagctggggagccgtcaggacgtcgaggccctgtgggagaatatggctgtgattgattgtttcgcttctgaccatgccccacacacgcttgaggagaagtgcggctctcgcccccctcccgggtttcctggtctggagacaatgcttcctctgttgctgaccgccgttagcgaaggccgactgtctctggacgatcttctgcagcgcctgcaccataatccaaggagaattttccacctccctccccaggaagatacttacgtggaggtggacctggagcacgaatggactattccgtctcatatgcctttttccaaagcccactggaccccttttgagggccagaaagtgaaaggcaccgtcagaagagtagttctgcgcggtgaggtcgcctacatcgacggacaggtccttgtgcccccaggatatggccaggatgtgaggaagtggccacagggcgcagttccacagcttcctccgtcagccccagccacgtctgagatgaccaccactcccgaacgaccaagacgcggaattccagggctccctgatggacgattccatctgccccccaggatccatagagcgtccgacccggggctccctgcagaagagcccaaagaaaaatcttctaggaaagtcgccgaaccagagctgatgggcaccccggacggaacctgttacccacctccccccgtgccgagacaagcaagcccacaaaacctaggtacacctgggctgctccatccccagaccagccccctgcttcatagcttagttggccagcatatcctgtcagtccaacagttcacaaaagaccagatgagccatctgtttaacgtggctcatactctgaggatgatggtccagaaagaaagaagcctagacattctgaaaggtaaagtaatggcctccatgttttacgaagtcagtactcggacatcaagcagctttgccgcagcaatggctaggttggggggcgcagtcctcagcttttcagaggctacttcctctgtgcaaaaaggcgaaagcttagcagattccgtccaaaccatgtcttgttacgccgacgtagtggtgctgcgccatccccagcccggggctgtagaactagccgcaaagcactgcaggaggccagtcattaatgccggtgacggtgtgggagaacacccaacccaagccctcctcgatattttcaccatacgcgaagagctgggcaccgtgaatggcatgacaatcactatggtcggagacttaaagcatggccggaccgtccacagcctcgcctgcctccttactcagtacagagtgagtttgcgctatgtggcacctcccagtcttaggatgcccccaaccgtccgggcctttgtggccagcagaggcactaaacaggaggaattcgaatccatagaggaggccttacctgatacagacgtcctgtatatgacccggatacagaaggaacgatttggctctactcaggaatacgaagcttgttttggacaattcatattaactccacacatcatgacccgggctaagaaaaagatggtagtgatgcaccccatgcctcgagttaatgaaataagcgtagaggttgacagtgatccccgggcagcttacttccggcaggccgaaaacggaatgtacattaggatggcgttgttggcgaccgtgctgggacgattttag

SEQ ID NO: 110769 - DNA, 1440 bp, Artificial Sequence
  Description of Artificial Sequence: Synthetic coding sequence
atggaaaaggggcttactctaccccaggactgccgagactttgttcacagcctgaaaatgagatccaaatatgcgctgttccttgtcttcgtggtcattgtatttgtcttcatcgaaaaggagaacaaaattatttctagagtttcggataaactgaaacaaatcccacaggccctcgctgacgctaacagcactgaccctgctctgatcctcgccgaaaacgctagccttctttccctatcagagctggattctgccttttcccagttacaaagtcgcctgagaaatctgagcttgcagctgggagtggagcccgccatggaggccgccggagaagaggaggaggaacagcggaaggaggaagagcctccacggccagctgtggctggacccagacgtcatgttctcctaatggccactaccaggacgggctcatctttcgtcggggagtttttcaatcaacagggcaatatcttctacctcttcgagccactatggcatatcgagcgtaccgttagcttcgagccggggggagcaaacgcagccggctcggccttggtctacagagacgtgctcaaacagctgttcttatgcgatctatacgtgctcgagcactttattaccccactcccagaggatcatctgactcagttcatgttcagaagaggtagctctaggtctctctgcgaggatccggtttgcactcctttcgtaaagaaggtcttcgaaaagtaccattgtaaaaatcgcaggtgtggtcccttgaacgtcaccctcgccgcagaggcgtgccgcaggaaggagcacatggccctgaaagctgtcaggattcgccagctcgagtttctgcagcctctggcggaggatcctcggcttgatctgcgtgtcatccagctggtgcgcgaccccagagcagttctcgcaagcagaatggtcgccttcgctggaaaatacaagacatggaagaaatggctcgacgatgaaggccaggacggattacgggaggaagaagtacagaggcttcgaggcaattgcgagtccattcgattatcagcagagctcggactcaggcagccggcttggctccgtgggaggtatatgctcgtaaggtatgaagatgtcgcccgtggccccctacagaaagcgcgtgaaatgtacaggtttgccggaattcccctgaccccacaggttgaggactggattcagaaaaatacccaggccgcccatgatggttccggtatttacagcacgcagaaaaattcgtctgagcaatttgaaaagtggcgcttcagcatgccatttaagctggcccaggtggttcaggctgcatgcggacctgccatgcgacttttcggctacaagttggcccgggatgctgcggctttaacgaatagaagcgtgtcgctccttgaggaacgggggacgttctgggtaacttag

SEQ ID NO: 110770 - DNA, 1236 bp, Artificial Sequence
  Description of Artificial Sequence: Synthetic coding sequence
atgcagtgttcctggaaagcagtacttctcctggctctggccagcatcgccattcagtatacagccataagaactttcacagcaaagagctttcatacttgccccgggctggccgaggctgggctggccgagaggctgtgcgaagagtcccccacattcgcctataatctcagccggaagacccacatcctcatcctagcaacaacccgctcgggatctagtttcgtgggccagctgttcaaccaacacttagatgtgttctatttatttgagccattgtatcacgtgcaaaacaccctcattccccggtttactcagggcaagtcccccgccgatcgacgggttatgctcggtgccagcagagatcttctccgctcgctctatgattgtgatctgtacttcttggaaaattacatcaagcccccacctgtgaatcacaccaccgaccgcatcttccggcgcggcgcgtcgagagtgctatgttcaagaccggtctgtgaccctcccgggcccgccgacctggtccttgaagagggtgactgcgtgagaaagtgcggacttcttaacctcacggtcgcagctgaggcgtgtagagagaggagtcatgttgcgatcaagactgttagagtccctgaagtcaacgacctgagggcgttggtcgaggacccccgactaaaccttaaagtcattcagctggtgagagacccaagggggatattagctagccgtagcgagacgttcagggacacatatcgactctggcggctgtggtatgggacaggtcggaaaccctacaacttggatgtcactcagctgaccacggtgtgtgaggactttagtaatagcgtgtccaccggcctaatgcgaccaccatggctgaagggtaaatatatgctggtgcggtacgaggatcttgccaggaatcccatgaagaaaacggaagagatatacggttttctgggcatcccccttgacagccatgtggcccgctggattcagaacaataccagaggtgacccaacactcggaaagcacaaatatggcacggtgcgtaacagcgccgccaccgcagagaaatggagattccgcctgagttatgatattgttgccttcgcgcaaaacgcttgccaacaggtattggctcaactcggatacaagattgccgcctccgaggaggagctgaagaatccttccgtgtctcttgtcgaagagcgggacttcaggccattttcgtag

SEQ ID NO: 110771 - DNA, 1131 bp, Artificial Sequence
  Description of Artificial Sequence: Synthetic coding sequence
atgttccccaggccactgacgcccctggctgccccaaacggagccgaaccactgggtagagccctgagaagagccccactgggacgggcacgagccggactaggtggccccccactgctcttgccaagtatgctgatgtttgccgtgattgtggcttcctccggcctgctgctgatgatcgagaggggcattttagctgagatgaaacctctgcccctccaccctcctggaagagagggcacggcctggagggggaaggctcccaagccagggggactctctttgagagctggcgacgcagacctgcaggttcggcaggacgttaggaacagaacgctgcgggccgtttgcggtcagcccggaatgccgagagacccttgggacctccccgtggggcagcggcgcaccttactgaggcacatccttgtgagcgatcgttacaggtttttatattgctacgtgcccaaggttgcatgctcaaactggaaaagagttatgaaggttctggcaggcgtgctcgactcagtggacgtgcgactgaagatggaccacagaagcgacctggtgtttttagccgacctgcgacccgaagaaataagatatcgactgcagcattattttaaatttctcttcgtcagggaacctctggagcgcctgctcagcgcatatagaaataaatttggggaaattcgcgagtatcagcagcggtatggggcagaaattgtccggagatacagggccggcgcaggcccttccccggcaggcgacgatgtgacttttcctgagtttcttagatatctcgttgacgaggatcctgagagaatgaacgagcattggatgcctgtctatcacctgtgtcaaccttgcgcggtacattacgacttcgtcgggagctacgagcgcctggaggccgatgcaaatcaagtgctggagtgggtgcgcgccccccctcacgtgcgctttccagctcgtcaggcctggtatcggccggccagtcctgaaagccttcattaccacttgtgcagtgcacccagggctctcctccaagacgtactgcctaagtatatccttgacttctctctcttcgcttaccccttacccaacgtgaccaaagaggcctgtcagcagtag

SEQ ID NO: 110772 - DNA, 1275 bp, Artificial Sequence
  Description of Artificial Sequence: Synthetic coding sequence
atgacgcttcgccctgggacaatgcgactggcctgcatgttttctagcattctgctctttggagctgcggggctcctcttatttatttctctccaggatccaaccgaactggccccacagcaggtgcctggtattaaattcaatatcagacctcggcagcctcaccatgacctcccccccggcggatcgcaggacggggacctgaaggagcccactgagagagtaacccgtgaccttagttccggggccccacgcggccgaaaccttccagccccagatcaaccacaacctccgctgcagagaggaacccggctgcggctgagacagcgtcgcaggagacttctgattaagaagatgccagcggctgccacaatccctgctaatagctccgatgccccttttatccgtcctggacccggcacgctggatggacggtgggtgtccctccatcgctcccagcaggaaagaaagcgcgtgatgcaggaagcatgtgcaaagtaccgggccagcagcagtaggcgagcagtgaccccaagacacgtgtctcggatttttgtcgaagatcgccaccgggtgctctattgcgaggtgcccaaagcagggtgtagcaactggaagagagtgctgatggtcctcgccggccttgcgtcatctacggcagatattcaacacaatacggtgcactacgggtctgctcttaagagactggacacttttgaccgccagggcatattgcacaggctatctacttacaccaagatgctctttgttagagaaccattcgaacggttagttagtgccttcagagataagtttgaacatcctaacagttactaccaccccgtctttggcaaggccatcctggctcgttatagggctaatgcgtcacgcgaggcactgaggactggatccggggtgagattcccagagttcgtgcagtacttactagatgtccacaggcctgtgggcatggacatccactgggatcatgtcagtcgattatgttctccctgcctgattgattatgatttcgtcggcaaatttgaatcgatggaggacgatgcaaacttttttctgtcgcttatccgtgctccccgaaatctgacatttccgaggttcaaagacaggcactctcaagaagctcgcacaaccgcgagaattgcccaccaatacttcgcccaactgtccgcccttcagcgacagagaacatacgacttctactatatggactatttgatgtttaattactcgaagccatttgccgacctgtactag

SEQ ID NO: 110773 - DNA, 1275 bp, Artificial Sequence
  Description of Artificial Sequence: Synthetic coding sequence
atgaccttgaggccaggaacaatgagacttgcttgcatgtttagctctattctactgtttggagccgctggcctgttgctgttcatcagtctgcaggatcccactgagctggctcctcagcaggttccgggaataaaatttaatatccgtccccgccagccccaccatgatttaccgcccggtggaagtcaggacggagacctgaaagagccaaccgagcgggtgaccagagatctctcatcaggagctcccagaggccgaaatttgcccgcccccgaccagccacagcctccgctacagagaggaactcgtcttcgcctgcgacagagaaggcggcggctgctaatcaaaaaaatgcctgctgctgcaaccatccctgccaactcgtccgacgccccttttatcagacccggtcctgggacactcgacggcaggtgggtttcactgcaccgctcccaacaagagaggaaacgagtcatgcaggaggcgtgtgccaagtatagagccagcagctctcgacgtgcagtgaccccccggcatgtgagtaggatcttcgtggaagacagacaccgggtactgtactgcgaagttcccaaagctgggtgctcaaactggaagcgtgtacttatggtgctcgccgggctggccagtagtaccgcagatatccagcataatacagtccattatggtagcgccttgaaacggctggacacattcgatagacagggtatcctgcacaggctctctacatacaccaaaatgctctttgttagggaaccatttgaaagattagtttctgcgttccgggacaaattcgaacacccaaattcctactaccatccagtgtttggtaaagccatccttgcacgctatcgcgccaacgcaagtagagaggctcttaggacaggctcaggggtacgatttcccgagtttgttcagtacctgttagacgtgcatcggccagtcggcatggacatacactgggatcatgtcagtcggctgtgtagtccatgcctgattgattatgattttgtggggaagttcgagagtatggaggacgatgccaacttcttcctaagcctcatcagagctccacgtaaccttaccttccctaggttcaaggataggcactcacaggaggcgagaaccaccgcccggatagcccatcagtactttgcgcagctcagtgccctacagcgacagcggacctacgatttttattatatggactacctgatgtttaattacagcaaacccttcgccgatctttactag

SEQ ID NO: 110774 - DNA, 1275 bp, Artificial Sequence
  Description of Artificial Sequence: Synthetic coding sequence
atgaccctgcggccaggtaccatgaggctcgcctgtatgttcagttcaatacttctcttcggcgctgcgggactactgctgttcatatctctgcaggaccccactgaactggccccacaacaggtgcccggaattaagtttaatattaggcctcgccaaccccatcatgatctacctcctgggggttcccaggacggcgacctgaaagaaccaacagagcgcgtgactcgcgacctgtcttctggagcccctcgaggccggaacttgcccgcgcccgaccagccacagccgcctttacagcgaggtacgcggctccggctccgtcagaggaggcgcaggttgttgattaaaaaaatgcccgcagctgctaccattcctgcaaacagctcagacgctcccttcatcaggccgggaccgggaaccctcgatggccgttgggtatccttacaccggagccagcaggagcgcaagagagtaatgcaggaggcttgtgccaagtatcgcgccagctcctctagaagggcagtgaccccccgccacgtgtccaggatcttcgtagaagacagacacagggtcttatactgtgaagtgcctaaagcggggtgtagcaattggaagcgcgtcctcatggtgttggcgggcctggcaagttcaaccgctgacatacagcacaacaccgtccactatgggagtgctctaaaacgtctcgacactttcgaccgccagggaatcttacatagactgtccacctacacgaaaatgttatttgttagggaaccatttgaacggttagtgtctgccttcagggacaagttcgagcacccaaactcctattatcatccagttttcggtaaggcgatactggcaagataccgagcaaatgcctcccgggaggcactaagaactggaagtggggtaaggtttcctgagttcgtgcagtacctgctagatgtgcaccgtccagttgggatggatattcactgggaccacgtctctagactctgtagtccgtgcctgatcgattacgactttgtgggcaagtttgagagtatggaggatgatgctaatttctttttgagcctgatccgcgcacctcgcaaccttacatttccaagattcaaagacagacacagccaggaagcaaggactacggccagaatagcacatcagtactttgcgcagctctcagctctccaaagacaacggacctacgacttttattacatggactaccttatgttcaactactctaagccattcgccgacctctattag

SEQ ID NO: 110775 - DNA, 1686 bp, Artificial Sequence
  Description of Artificial Sequence: Synthetic coding sequence
atgaggcactgcattaactgctgcatccagctgctgccagacggtgcacacaagcagcaggtcaactgtcagggcggacctcaccatggccaccaggcctgtccaacgtgcaaaggcgaaaacaaaattctgttccgagtcgatagtaagcaaatgaatctgttagcagtcctggaggtgcgcaccgaagggaacgaaaattggggcgggtttctccggttcaagaagggcaaacggtgctctctcgttttcggcttgattattatgacacttgtgatggcctcctacattcttagtggcgcccaccaggagctgcttattagcagccccttccactacggcgggtttccgtccaatcctagcctgatggactctgaaaaccctagcgacaccaaagagcaccatcatcaatcctcggttaataatatctcctatatgaaagattatccgtctattaaacttatcatcaattccatcacgaccaggatcgagttcactactaggcagttgcccgaccttgaagacctgaagaagcaggagctgcatatgttcagcgtgattcccaacaagttcctacctaactctaagagcccctgctggtatgaggagttcagcggccagaataccacagatccatacttgaccaacagttacgtgctgtactccaaaagatttcggtctacctttgatgccctcagaaaagctttttggggtcacttagctcacgcccacggaaagcacttccgcctgcgttgcctgcctcatttttacattattggacagcccaagtgcggaaccactgatctgtacgaccgtctgaggcttcaccccgaggtgaaattcagcgccatcaaagaacctcactggtggacaagaaagcgctttggaatagtacgtttgcgggatggcctaagggacaggtatcccgtggaagattacctggatctgttcgacctcgccgcccatcagattcatcagggactgcaggcaagcagcgccaaagaacagtcaaagatgaacaccatcattatcggtgaagcatccgcttcaactatgtgggacaataatgcttggacctttttttacgacaacagcaccgatggcgaaccgccattcctaacccaagatttcatccacgcgtttcaacccaatgcacgcctgatcgtcatgctgagagatcctgtcgaaaggttatactccgattatctatactttgcttcctcaaacaaaagcgctgatgacttccacgaaaaggtcactgaggcacttcagctgtttgaaaattgtatgctcgattattctcttagggcctgcgtttacaacaacacactgaacaacgctatgcctgttcgactgcaggttggtctgtatgcagtctatctcctggactggctttctgtttttgataaacagcagttcctgattctgagactcgaggaccacgccagcaatgtcaaatatacgatgcataaagtgtttcagttcctgaatttaggacccctttcagagaaacaagaagcacttatgactaagtctccagcaagcaatgccaggagacccgaagatagaaacctgggacctatgtggcccatcacacagaaaattttgcgggacttctatcgtccgttcaatgcccgcctggctcaggtgctcgcggatgaggcatttgcttggaaaactacatag

SEQ ID NO: 110776 - DNA, 1521 bp, Artificial Sequence
  Description of Artificial Sequence: Synthetic coding sequence
atgaggcattgtattaactgctgcatacagctgttgccagacggggcccacaaacagcaagtaaattgccagggtggaccacaccatggacaccaggcttgcccaacctgcaagggcgaaaataaaatcctattccgagttgacagtaagcagatgaatctgttagctgtgctggaagtgcgaaccgaggggaatgagaattggggaggatttcttcgcttcaaaaaaggtaagagatgtagtttggtctttggactcattattatgacattagtgatggcttcatacatcctgagcggggcgcatcaggaactccttatttcgagtccatttcactatggtggtttcccttctaatccttctctcatggactctgagaatccctccgacacaaaagagcatcaccatcagtcctcagtgaacaacatctcttacatgaaggactaccccagtatcaaactgatcattaattcaatcacaacgcgaatagagttcacgacccgacagctgccggatctggaggacctcaagaagcaagagctgcacatgtttagtgtcatacctaacaagtttttgcctaattcaaagagcccctgttggtacgaggagttctccggacagaatactacagatccctacctaacaaattcttacgttctttattcgaagcgttttcggtcgaccttcgacgctttgcgcaaagcattttgggggcaccttgctcatgctcacggaaagcatttcaggctgagatgcctgccacatttttacatcataggccaacccaagtgcggcactactgacctgtatgacagattacggctccaccccgaggtgaaattcagtgccattaaggaaccgcattggtggaccagaaagaggtttggtatcgtgagactacgcgacgggctcagagataggtacccagttgaagattatcttgatctctttgaccttgcggcacaccagattcatcagggactgcaggcatccagtgctaaagagcagtcaaagatgaataccattataataggcgaggcttccgccagcactatgtgggacaacaacgcatggacattcttttatgataacagcaccgacggtgaacctccttttctgactcaggatttcattcacgcctttcagcctaacgcacgattgatagtaatgctacgagaccctgtcgagaggctctactctgattatctgtacttcgcatcaagcaataagagcgccgatgactttcatgagaaggtcaccgaggcgctgcagcttttcgaaaattgtatgcttgactacagcctcagagcatgcgtgtacaataacaccttgaacaatgctatgcccgtttgcaccccgccacctcgcacacctcgagcagggccctggcagaaagagctcgtgtgctgttactatgcttccggcattgtggggctgagattttctatcggtaccgaacgctccgtgctgatgtgcaagtgttgcagtccactgtttatggacgtgaaggctgagaattag

SEQ ID NO: 110777 - DNA, 624 bp, Artificial Sequence
  Description of Artificial Sequence: Synthetic coding sequence
atgcgccactgcattaattgttgtattcaactcttgcctgacggcgcccacaaacagcaagtcaactgccagggtggccctcatcacggccaccaggcgtgtcccacatgcaaaggagaaaacaaaatcctctttagggtggactcaaagcaaatgaacctcctcgccgtgctggaagtgcggaccgaaggtaacgagaactggggaggcttcctgagatttaagaaggggaagcgctgttccttggtattcggcctgataatcatgacgctggtgatggcctcctatattctgtctggagctcatcaggagttattgatcagttcgccctttcactacggcgggtttccatctaatccaagtctgatggattctgaaaatcccagcgacaccaaggagcatcaccatcagtcaagtgtaaacaatatctcctatatgaaagactacccttccattaaactcatcattaacagtatcacaaccaggatcgagttcaccacaaggcaactcccagacttagaagacttgaagaaacaagagcttcacatgttctctgtgattccgaataaattcctcccgaaacacaacgcccaagctgaactgggcttgaatgtggcctgctag

SEQ ID NO: 110778 - DNA, 1686 bp, Artificial Sequence
  Description of Artificial Sequence: Synthetic coding sequence
atgcggcactgcataaactgttgtattcagttacttcccgatggagctcacaagcagcaggtcaattgccagggtgggcctcatcatggtcatcaggcctgcccaacctgcaaaggggagaataagattctctttagggtcgacagcaaacagatgaaccttttggcagtgctggaggtcagaaccgaagggaacgagaactggggtggttttttaaggtttaaaaaagggaagagatgttcattagtgttcggccttattataatgaccctggtcatggcctcctacattctaagcggagcccaccaggaattgcttattagctcccccttccactacggtgggtttccgtcgaaccccagccttatggactcagagaatcctagcgacacaaaggaacatcatcatcagagctcagtaaacaacatttcgtacatgaaggattatccctccataaaactgattatcaacagcatcactacacggatcgagttcaccactagacagctaccagacctcgaggatctcaagaagcaggagttgcatatgtttagcgttattccaaacaaatttctccctaactccaagtcaccttgctggtacgaagagttctctggacagaatactaccgatccatacctgactaactcgtacgttctttacagtaaaagatttcgatctacctttgatgcgctaaggaaagccttctggggacacttggctcacgctcacggaaagcattttcgtctgaggtgcttgcctcatttctatatcattggccagccgaaatgtggcaccaccgatttgtacgataggctccgcctgcatcctgaggtaaaattcagcgcaatcaaagaaccccattggtggacaaggaagaggttcggtattgttaggttacgagatggcctcagggacaggtatcctgttgaagattatttggatctcttcgatctcgcggctcatcagatccatcaagggctacaggccagtagtgcaaaggagcagagtaagatgaatacaattataattggtgaggctagcgctagcaccatgtgggataacaatgcgtggaccttcttctatgacaactctaccgatggagaacccccctttctaacgcaggattttatacatgctttccagcctaatgcccgtctaatagtaatgctaagagatcccgtggagcggctgtactccgattacctctactttgcctccagtaacaagagtgctgacgacttccatgagaaagtaacagaggcactacaattgttcgaaaactgtatgctggattactcactgcgggcctgcgtttacaataataccctgaacaacgctatgccagtgaggctgcaggtggggttgtacgccgtgtatctgctggactggttaagcgttttcgacaaacaacagtttctgattctgcgcctggaggatcatgcctccaacgttaagtacacgatgcacaaagttttccaatttttgaaccttggcccgttgtcagaaaagcaggaggccttgatgactaagtcacccgcctcaaacgcgcgccgtccagaggaccgcaatttgggaccaatgtggcccattacacagaaaattctgcgcgacttttaccgtccattcaatgcacgcttggcccaagttctggcggacgaagcattcgcatggaagaccacctag

SEQ ID NO: 110779 - DNA, 1449 bp, Artificial Sequence
  Description of Artificial Sequence: Synthetic coding sequence
atgaggcactgcatcaactgttgcatacaactgctgcccgatggagcccataaacagcaggtcaattgccagggtggaccccatcatggtcatcaggcatgccccacctgcaagggagaaaacaagattctgttccgcgtggactcgaaacagatgaacttgctggctgtgctggaagtccgcacagaggggaatgaaaactggggtggattcttgcgcttcaagaaaggtaagcggtgcagcctcgtgtttggcctgatcattatgactttagttatggcttcttatatcttgagcggagctcatcaggaattgcttatcagctctcctttccattacggaggctttcccagcaacccttctctgatggactcggagaacccttccgacaccaaagaacatcaccatcagagctctgttaataacatttcctatatgaaagactatccatctatcaaactgattataaacagtataacaacccggattgaatttacaaccaggcagctaccggaccttgaggatctaaagaagcaagagctgcacatgttcagcgttattccaaataaatttttgcccaacagcaaaagcccttgctggtacgaagaattttcaggccagaacaccacagatccctatctcactaatagttacgtgctgtactccaaacggttcaggagtacatttgatgccctcaggaaagctttctgggggcacctggcccacgcccatggtaagcactttaggctgagatgccttccacacttttacatcatcggacagcccaaatgcggcaccacagatctttatgaccgcctgcggttgcaccccgaagtgaaatttagtgccattaaggaaccccattggtggactcgcaagcgctttggtattgtcagactccgggacggccttcgtgacaggtaccccgtcgaggattatctcgacttgttcgacctggccgcgcaccagattcatcaaggtttacaggcaagtagtgcgaaggagcagtccaaaatgaacaccatcatcattggggaggcgtccgccagtaccatgtgggataacaacgcgtggacattcttttacgacaactccacagacggcgaaccaccattcctgacccaggactttattcatgcatttcagccgaatgctagacttatcgttatgctgcgcgatcccgtggaacgcctgtacagcgactacctgtatttcgccagtagcaacaagtccgcagacgattttcatgaaaaagtgacagaggcgttgcagctgttcgagaactgtatgctagactattctctccgggcttgtgtgtataacaatacccttaacaacgcaatgccagtgtgcacgcctcccccagtaccacccgaattggcgcctgggaggcggagctggttcgttgtgatcatgcaggctgcgctttgggtttgcgtcagcgcctag

SEQ ID NO: 110780 - DNA, 1236 bp, Artificial Sequence
  Description of Artificial Sequence: Synthetic coding sequence
atgggaatgagagcaagagtgccaaaggtggcacattcgactcgacgcccgccagcagccagaatgtggttgccgcgcttctcctctaaaacggttaccgtgctgcttcttgctcaaacaacttgcctgcttctcttcattatctctaggccagggccatcaagccctgctggcggggaagatagagtacacgtactggtgttaagctcttggagaagcggctcatccttcctaggccagttattctctcagcatcccgatgtgttctatctgatggagccggcatggcacgtatggactaccctatctcagggctctgcggcaacgctccacatggctgtccgagatctgatgaggtctatattcctgtgcgacatggacgtctttgatgcctacatgcctcagtctcgcaacctctccgcgttttttaactgggccacttccagggccctgtgttcaccaccggcttgcagcgcctttccaaggggcacaataagtaaacaggatgtctgcaagacactctgtactcggcagccattctcgcttgccagggaagcgtgccggagctatagccacgttgtcttgaaggaggtccggttttttaacctgcaggtgttgtacccactcctttcagatcctgcgctcaatttaagaatcgtacatctggtccgagaccctagagcagtccttagaagcagagaggctgcaggacccatactggctcgtgacaacggcatagtcctagggacgaacggaaaatgggttgaggctgaccctcacttacggttgattcgcgaagtctgtcgcagccatgttcgcatcgctgaggccgcaaccctgaagcccccaccatttcttcgggggaggtatagactcgtgcgcttcgaggacctggcaagggagccactagccgagataagggctttgtatgcttttactggcttgactctgactccacagctagaggcgtggattcataacatcactcatggctctgggattgggaaacctatcgaggcatttcacacttccagccgaaacgccaggaatgtgagccaagcgtggagacatgctctgccgtttaccaaaattcttagggtgcaagaggtgtgtgctggagccttacaattactggggtatcggcctgtgtattctgctgaccaacagcgagacctgacactcgacctggttcttcctcgtggacccgaccacttttcatgggcctctccagattag

SEQ ID NO: 110781 - DNA, 1254 bp, Artificial Sequence
  Description of Artificial Sequence: Synthetic coding sequence
atgtcccggcacttgccgtggatctgcgatcagcggtgttcatccccaagttctccaggtagatggcctccggcagctaggatgtggctgcctcgattctctagtaaaaccgtcactgtcctgctgctggcgcagacgacatgcctcctgctcttcatcatctccaggccgggaccgtcttcacctgccgggggcgaggatcgcgtgcacgtgctggtccttagttcttggaggagcggctctagttttctgggtcagttattttcacagcaccccgacgtgttctacttgatggagccagcttggcatgtgtggacgacgctgtcacagggatctgcggccacactgcacatggctgtgcgcgatttgatgaggtccatattcctctgtgacatggacgtgttcgatgcgtacatgcctcagagtcgaaatttgtccgcttttttcaactgggccacctctcgcgccctctgcagtccgccggcttgctcagccttcccaaggggcactatctcaaaacaggacgtgtgtaagactctatgcactagacagccattctcactggctcgcgaagcttgccgttcatactctcacgtcgtcttgaaggaggtgcgtttttttaatctccaggtcctctaccctctgctgagtgaccccgcactgaatctccgaatcgtccatctagttagagacccccgtgcagttctgcgctcacgcgaggccgctggccccattctggcccgagataatggcattgttttaggaactaatgggaagtgggtcgaggccgacccgcatctgcggctcatcagggaagtgtgtagaagccatgtgagaattgcagaggctgccaccctaaagccgccaccgtttctaagggggagatatcgcctcgttcgcttcgaggatctggccagggaacccctggccgaaatacgggcactctacgcgttcacagggcttactctgaccccgcagttggaagcctggatccataatatcacacatgggtccggcatcgggaaacccattgaagccttccacacctcttctaggaacgcacgaaacgtttcccaagcctggagacacgctttaccattcacaaagatactgcgggtgcaggaagtttgtgcaggcgctctccagctcctgggatacagaccagtgtacagtgctgaccagcagagggatttaacactagacttggttcttccgagaggcccggaccatttttcttgggcgagtcccgactag

SEQ ID NO: 110782 - DNA, 1188 bp, Artificial Sequence
  Description of Artificial Sequence: Synthetic coding sequence
atgtggcttcccagagtgagctcaacggctgtgactgcactgctactggctcaaacattcctgcttttgtttctggtgagtcgtccaggcccgagctctccagccggaggagaggcccgggtgcacgtgctggtgttgtcatcatggcggagtgggtctagttttgtaggacagctttttaatcagcatcctgatgtgttctatcttatggaacctgcctggcacgtatggacgactctttctcagggtagcgccgccactctgcacatggcggtcagagatctggtgaggtccgtttttctttgcgacatggacgtgttcgatgcttacctaccttggcggcggaaccttagtgaccttttccaatgggctgtgtccagggctctatgttcccctccggcatgttctgcttttccgcgcggtgcgatatcctccgaggcagtttgtaagcctttatgtgcaagacagtctttcaccctggcacgggaagcctgtagatcctatagtcacgtggtgctgaaggaagtgaggttcttcaatctgcaggtgctgtatcccctgctgtctgaccctgcattgaaccttcgcatcgtgcatctcgtacgtgatccacgggccgtgctccgatcacgcgagcaaacagccaaggctttggctcgagataacggtatcgtgcttggcactaatgggacctgggtcgaagcagatcctggcttgagagtggtgcgggaagtttgccggagccacgtgaggatcgcagaggccgcaaccctgaagccccctccattcttgcggggtcgctaccggcttgtgagatttgaggatttggcacgcgagcctttagctgaaatcagagccttgtacgccttcacgggcctctccctgactcctcagttggaggcctggatacacaacatcacccatgggtctgggccaggcgccaggcgggaggcgtttaaaacatcgagcagaaatgccctgaatgtctcccaggcctggagacacgcgctgccttttgcaaaaattcgccgcgtgcaggaattgtgtgccggggccttacaacttctcgggtaccggccggtctacagcgaagacgagcagcggaacctcgccctggatcttgttttgccacgcggactaaatggattcacttgggcctcttccacagctagccatccaagaaattag

SEQ ID NO: 110783 - DNA, 1188 bp, Artificial Sequence
  Description of Artificial Sequence: Synthetic coding sequence
atgtggcttccccgcgtctcatcaaccgccgtcactgccctgcttctggcccagacatttctgctgctctttctggtttcgcgccccggcccttcctcacctgctggaggagaggctcgtgtccatgtcctggtactgtcatcctggagatctggatcctcatttgtgggccagctcttcaatcagcatccggacgtattttatcttatggagccagcatggcacgtttggaccaccctgtcccaggggtccgcagccaccctgcacatggccgttcgggaccttgtgcggtccgtgttcttatgtgatatggacgtctttgacgcttacttgccctggaggcggaatctcagtgacctgttccaatgggccgtgagtcgagctctgtgttcccctcctgcttgttcagccttcccccgaggagccatatcctccgaggccgtttgcaaacccctctgcgcaaggcaaagttttacactggctcgcgaagcctgtcggtcgtatagtcacgtcgtgcttaaggaagttcggtttttcaacttgcaggtactgtacccgctgctgtctgacccagccttgaatctgcgtatcgttcacctcgtccgcgacccaagagccgtgttacgctcccgggagcagaccgcaaaagccttggccagagataatggcatcgtgctggggacaaatggcacctgggtggaggctgaccctgggttgcgcgttgtcagggaagtatgtaggtcccatgtgagaattgccgaggcagccacattaaaacccccaccattcttgaggggcaggtataggttggtgcgtttcgaagatttggcgagggagccactagccgagatccgcgctctctatgcctttacggggctaagcttaaccccgcaactggaggcatggattcacaacatcacacacggttccgggccaggggcccggagggaggcctttaagaccagttcaaggaacgcactcaatgtctctcaagcttggcgccacgccctgccttttgcaaaaatccggcgggttcaggagttgtgcgccggtgcgctgcagctgttgggatataggcctgtctattctgaggatgagcaacgaaacctggcgttagacctggtgctgccgcgaggtctcaacggttttacatgggccagctccactgccagtcatcccaggaattag

SEQ ID NO: 110784 - DNA, 1461 bp, Artificial Sequence
  Description of Artificial Sequence: Synthetic coding sequence
atgaagggccgccgccgacgccgccgcgaatactgcaagtttgccctcctcctggtactgtacacgctcgtcctgttgctcgtgccctcagtactggatggaggacgcgatggcgacaaaggtgccgagcactgtcctggcttacagcggtccctgggggtgtggagcttggaggctgcggccgctggggaacgcgaacagggagctgaagcgcgcgctgccgaggagggcggggctaaccagagccctcggtttccatcgaatctgtctggtgcagtaggtgaagctgtgtcgcgcgaaaagcagcacatttacgtgcacgctacttggagaactggaagcagctttcttggcgagctgtttaaccagcatcccgatgtgttctatttgtatgagcctatgtggcacctgtggcaggcactgtaccccggcgacgctgagtctttacagggcgcccttagggacatgctgcgaagtctgttcagatgtgatttcagtgtccttcggctctacgccccacctggagatcccgcagcaagagcccctgacacagcgaatctaacaacagcagctctgtttaggtggcgcaccaacaaagtcatatgcagccctccactctgccctggcgccccccgagcacgggccgaggtgggccttgtggaggacacggcttgcgagagatcttgtccgcccgtggcaattcgggcccttgaggccgagtgcagaaagtaccccgtcgtggtcattaaggacgtgcgcctgctggacctcggggtcctggtgcctctgctgcgcgatcctggacttaacttgaaggttgtccagctttttcgggacccccgagcggttcacaatagccggcttaagagtcggcaggggttgctgagagagtctatccaggtgttgagaacgcgccagcggggcgatcggttccaccgggttctccttgcccacggagtgggtgcacgtcctggcgggcagtcccgggcattgcctgccgccccacgcgccgatttcttcctcactggggccctcgaggtgatttgcgaggcctggcttagggacctgctctttgcacggggcgcaccagcctggcttcggcgccgttatctgcgtctgcggtatgaggacttagttcgacaaccgcgggcccagctacggaggctgttgcgctttagtgggctaagggccttagcggccctggacgcctttgccctgaatatgacccggggggccgcttacggcgcagatcgcccgttccatctctcagcccgtgacgctagggaggcagtgcacgcctggcgggaaagactgagcagggagcaggtccgacaggtagaagcggcatgtgctcctgctatgaggctgctggcctacccaagaagcggcgaggagggagatgccgagcagcctagagaaggcgagacacccctggaaatggacgctgacggcgctacttag

SEQ ID NO: 110785 - DNA, 1593 bp, Artificial Sequence
  Description of Artificial Sequence: Synthetic coding sequence
atgtctcgaagcccccaaagagctctgcctccgggggcactaccgagactgttgcaggctgctcccgccgccgccccccgtgccctgctgccccagtggccacggaggcccggacgacgctggccagcctccccactgggcatgaaggttttcaggcggaaggccctggtgttatgcgccgggtatgctctgctcttagttcttaccatgctgaacctgttggactacaaatggcataaagagcccttgcagcagtgtaaccccgacggtccactgggcgcagctgccggtgcagcagggggctcatggggccggcccggccctcctccagccggcccccctagagcccatgcgagactggatctacgtacaccttaccgaccccccgccgcggccgtgggagccgctcccgctgccgctgccggaatggcaggggtagctgctccccctggaaacggaacgcgggggaccggaggggtgggagacaaaagacagttggtgtatgtgtttactacctggcgcagcggctcctccttcttcggagaactatttaatcagaatccggaagtgttcttcctgtatgagccagtatggcacgtatggcaaaaactatacccgggcgatgctgtctcacttcagggggctgccagagacatgctgagcgcgctgtatagatgcgacctgtctgtgttccaattatactcaccagccgggtccggaggcaggaacctgactaccctgggaatatttggagctgccacgaataaagtggtctgtagcagtccactgtgccctgcttataggaaggaggtggtcggcctggtcgacgaccgcgtttgcaaaaagtgtcctccccagcgtctggcaaggtttgaggaagaatgcagaaagtatcgcacacttgtgatcaagggcgtcagggtcttcgatgtggccgtgttggccccgctgttgagagatcctgctctcgacctgaaagtgatccacttagtgagagatccccgggccgtggcttcgtctagaattcgcagcaggcatggccttataagagagtccctccaggtggtcagaagtagggatccccgggctcaccgaatgccttttctggaagctgcagggcacaagttgggcgctaaaaaagagggcgtaggtggccctgcggactatcacgcactgggcgcgatggaggtgatctgcaatagcatggccaaaactctacaaaccgccttgcagcctcccgattggctgcaaggacactacctggtggttcgctatgaggacctggtaggcgatccggtgaaaaccttgaggcgggtttatgattttgtggggctgctcgtttcccctgagatggaacagtttgcgctcaatatgacttccggttctggctcttcctctaagcctttcgtagtctccgctagaaacgctacacaggctgccaatgcttggagaaccgccctgacatttcaacagatcaaacaagtggaggagttctgttaccagccaatggctgtgctcggttatgagcgagttaattcacctgaagaggtgaaagacctcagtaagaccctgcttcggaagcctaggttgtag

SEQ ID NO: 110786 - DNA, 1071 bp, Artificial Sequence
  Description of Artificial Sequence: Synthetic coding sequence
atgcatcatcaatggttgctgctggcagcttgcttttgggtgatatttatgttcatggtagcaagcaagtttatcaccctgacgtttaaggaccccgacgtgtactccgcaaaacaagagtttctgttcttgacaacgatgcctgaggttagaaagttacccgaggaaaagcacatacctgaagaactgaaacccacaggcaaggaactgccagatagtcagctcgttcagcctctggtgtatatggaacgactggagttgatccggaacgtgtgccgcgacgacgccttaaaaaacctgagtcatacccctgtcagcaaattcgtgctggaccgtatcttcgtgtgtgataaacataaaatcttgttttgtcagactcccaaggtgggtaacactcaatggaaaaaggtgctcatcgtgctcaacggggccttcagttcaatagaggaaatccctgagaatgtggtgcatgatcatgagaaaaacggcctgccaagactcagttcctttagcgatgctgagatccaaaagcggctgaagacttacttcaagttctttatagtacgtgacccctttgaacggctgatatcggcattcaaggacaagtttgttcataatccccggttcgagccctggtacagacacgagatagccccagggattattcgcaagtatcgccggaacaggacggaaacacggggaatacagtttgaagactttgttcgctatttgggggacccgaatcatcgctggttggatcttcagttcggcgatcatatcatccactgggtaacctatgtagaactgtgtgcaccatgtgagatcatgtattccgtaataggacatcacgagaccctcgaagatgacgctccatacatcctgaaggaggccggcatagaccatctggttagttaccccacaatccctcccggcatcactgtttacaatcgcaccaaagttgagcattacttccttggcatctccaaacgggatatccggagattgtacgcgcggttcgaaggggatttcaagctcttcggctatcagaagccggatttccttctgaattag

SEQ ID NO: 110787 - DNA, 426 bp, Artificial Sequence
  Description of Artificial Sequence: Synthetic coding sequence
atgcatcaccagtggctcctgctggcagcatgtttctgggttatctttatgtttatggtagcctctaaatttatcactttgacctttaaagatcccgacgtctattcagcgaaacaggaattccttttcctgactacaatgcccgaggtccggaagttgccagaggaaaaacacataccagaagaattaaaacccaccgggaaagagctccctgatagccagctggtgcaacccctggtttatatggaacggcttgagctcatccgaaacgtttgcagagacgatgctctcaagaacctgtcacacacacctgtgtcaaagtttgtcctggatcgaatcttcgtctgcgacaaacataaaatcctgttctgccagacgcccaaagtcggtaacacacagtggaaaaaagtgctaattgtgctctag

SEQ ID NO: 110788 - DNA, 1071 bp, Artificial Sequence
  Description of Artificial Sequence: Synthetic coding sequence
atgcatcaccagtggctgctgctggctgcgtgtttctgggtgatcttcatgttcatggtagctagcaagtttatcaccctcactttcaaggacccagatgtgtactccgcaaaacaagaatttctgtttctgacaactatgccagaggttcggaagctgcctgaagagaagcacatacccgaagagctaaagcctacgggcaaggagctccctgacagtcaactagttcagcctctcgtttatatggaaaggctcgaactgatcagaaatgtgtgtcgggacgatgccctgaagaatctgagccacacacctgtgtccaagtttgtgctggacaggatatttgtgtgtgacaagcataagatcctattttgtcagacacccaaggtgggcaacacgcagtggaagaaggtcttaattgtcctgaacggagctttttcgtcaatcgaggagattcctgagaacgttgtgcatgaccacgagaagaatggacttcctcgcctatcttcattctcagacgccgaaattcagaagagactgaagacgtactttaagtttttcatcgtgcgggaccccttcgagcgacttattagtgctttcaaagacaagtttgttcacaatccacgattcgagccatggtatagacatgagatcgcccctggcattattcggaaatatcggaggaaccgaacagagaccaggggcattcagttcgaggatttcgttagataccttggcgaccctaatcacagatggctggatctgcaattcggcgatcacatcatccactgggtcacatacgtggaactctgtgccccatgcgagattatgtatagtgttattggccatcacgagactctagaggacgacgcaccatatatcttgaaggaggccggtatcgatcatctcgtctcttatccaaccatccctccaggtattacagtctacaaccggactaaagtggaacactattttctgggcatttcaaagcgggacatcagacgactatacgcaaggtttgaaggagacttcaagctgtttggatatcagaagcccgattttcttttaaattag

SEQ ID NO: 110789 - DNA, 195 bp, Artificial Sequence
  Description of Artificial Sequence: Synthetic coding sequence
atgcatcaccagtggttgttgctggctgcttgtttttgggttatattcatgttcatggtggcctcaaaattcattacacttacattcaaagaccctgatgtctattctgctaaacaggagtttctgtttttgaccacaatgccagaggttcgcaaactgcctgaggagaagcatatccctgaagagctgaagtag

SEQ ID NO: 110790 - DNA, 402 bp, Artificial Sequence
  Description of Artificial Sequence: Synthetic coding sequence
atgcatcaccaatggttgctcctcgccgcatgtttctgggtgattttcatgtttatggtggcatccaagtttatcactctgacattcaaagatccagacgtctactccgctaagcaggagttcctttttctgaccactatgcctgaggtgaggaaactacccgaggagaaacacataccagaggagctgaaacctacaggcaaagagcttccagatagtcaattggtccaacccctcgtctatatggagaggctcgagctaatccgaaatgtctgtcgcgacgacgctctcaaaaacctgtcgcatacacccgtttctaagtttgtccttgatcgaatctttgtctgcgataagcacaaaatcctgttctgccagacacctaaagtgggtaacacccagtag

SEQ ID NO: 110791 - DNA, 258 bp, Artificial Sequence
  Description of Artificial Sequence: Synthetic coding sequence
atgcaccaccagtggctgttattggctgcctgtttctgggttatctttatgttcatggttgcctctaagttcatcactctgaccttcaaagaccccgacgtctacagtgccaaacaggaattcctgtttctcacgacaatgccggaggttcgaaagcttcctgaggaaaaacatatcccggaggaacttaagcccaccggaaaggagctgcccgattcccaactcgtgcagcctctcgtttacatggaacggctatag

SEQ ID NO: 110792 - DNA, 102 bp, Artificial Sequence
  Description of Artificial Sequence: Synthetic coding sequence
atgcaccaccagtggctgctactggcagcgtgtttctgggtcatcttcatgttcatggtagcctcaaagtttattaccctcacttttaaggaccccgactag

SEQ ID NO: 110793 - DNA, 1215 bp, Artificial Sequence
  Description of Artificial Sequence: Synthetic coding sequence
atgcagagaaaagcaggcaaaaaagagcatgtgcagctacgagataagcggaaccaggaaccacagttcagaggcaacactgcccgaaagtgtgagccacaggccgcagagggtcgcgtgtccgagtggttacgctgcgataatatgcaccatcagtggttgctccttgccgcctgcttttgggtcatctttatgtttatggtggctagtaagttcataaccttgacttttaaggaccccgatgtctactcagctaagcaggaattcctattcctgacaacaatgcccgaggtgaggaaactcccagaggaaaagcacatcccagaggagttaaaacccacaggaaaggaactgcctgattcccagctcgtgcaaccattagtctatatggagcgcctggagttaattcgaaacgtgtgcagagatgatgccctgaagaacctaagccacactccagtgagcaagttcgttcttgatagaatctttgtgtgcgacaagcacaaaattcttttttgccagacaccaaaggttggcaacacacaatggaagaaggtactgatcgtactgaacggagcgttctcctcaattgaggagatccccgagaatgtggtgcacgaccatgagaaaaacggtctgcctcgcctctctagtttcagtgacgcggaaatccagaagcgtctgaaaacctactttaaatttttcatagtgagggacccctttgaacgactgataagcgcatttaaggataagtttgtccacaaccccaggttcgaaccgtggtatcggcacgagattgcacctggtattatcaggaaatacagaaggaacagaacggagaccaggggcatacagttcgaggactttgtcaggtatttaggtgaccccaaccaccggtggctcgacctccagtttggagatcacatcattcattgggtcacatacgtagagttatgcgcaccctgtgaaatcatgtacagcgtcatcgggcaccatgagaccctggaagacgacgcaccatacatccttaaagaagcaggaatcgaccacctcgtgtcttatccaacaatcccacccggaatcacagtttacaataggactaaggttgaacactatttcctgggcatcagtaagcgcgatattagacggttgtacgcacgctttgagggagacttcaagctttttggctatcagaagcctgacttcctcctgaactag

SEQ ID NO: 110794 - DNA, 786 bp, Artificial Sequence
  Description of Artificial Sequence: Synthetic coding sequence
atggcgagcccagattggggatatgacgacaagaatggtcctgagcagtggtctaagctgtatcccatagccaacgggaacaatcagtctcccgtagacattaagacgtccgagacaaaacacgacacaagcctgaagccaatcagtgtgtcctataatcccgctaccgctaaggagattatcaacgtgggtcactcatttcacgtgaactttgaggataacgacaacagatcggttttgaaggggggtcctttctccgactcttaccgtctgttccagtttcactttcattgggggtctactaatgagcacggctccgaacacacggtcgatggcgtcaagtactccgcggagcttcatgttgcccattggaacagtgctaagtattcaagcttggctgaagcggcctcaaaagcagatggactggcagtgattggtgtcctgatgaaggttggtgaagctaaccccaagttgcagaaggtactcgatgcactacaagcaatcaagacgaagggaaaacgcgccccttttactaatttcgacccgtccacacttctgccatcttctctagacttctggacgtacccaggtagtctgacccatccacctctgtacgagtcggtgacatggatcatctgtaaggaaagcatttccgtgagttccgaacagctggctcagtttcgttctctactcagtaatgtcgaaggagacaatgccgtcccaatgcagcataataaccgccccacccagccactcaaaggaagaaccgtaagggcttctttttag

SEQ ID NO: 110795 - DNA, 786 bp, Artificial Sequence
  Description of Artificial Sequence: Synthetic coding sequence
atggcttcgcctgactgggggtacgacgacaaaaatgggcctgagcagtggagtaagctctatcctatcgctaatggcaacaaccaatctccagtcgacattaagactagcgagacgaagcacgacacaagcctgaagcccatctctgtcagttacaatccagccaccgcaaaggaaattatcaatgtgggacattcctttcatgtgaactttgaagacaacgataatcggtcggtgctcaagggtggccctttcagtgattcttaccgcttattccagtttcacttccattggggaagcactaatgaacatggcagcgagcacacagtcgacggcgttaaatactccgcagagctccacgttgctcactggaatagcgccaagtattcaagcttagctgaggcagcgagcaaggcagacggcctcgccgtgatcggagtcctgatgaaggttggggaagcgaaccctaaacttcaaaaggtgctcgatgcgcttcaagcaattaagaccaaggggaaaagggcacccttcaccaacttcgaccccagcaccttgttaccatcaagcctggacttttggacgtatcccggatcgcttacacatcctcccctgtacgagtcagtgacgtggatcatttgtaaggaaagcatcagtgtttcaagcgagcagcttgcccagttccgcagcctgctgtctaatgtggagggcgataacgccgtgccaatgcagcacaacaatcgacctacacagcccctgaaagggcggacagttagagcttccttctag

SEQ ID NO: 110796 - DNA, 786 bp, Artificial Sequence
  Description of Artificial Sequence: Synthetic coding sequence
atggcctctcctgattggggatacgatgacaagaatggccctgaacagtggtctaaattgtaccctatcgcaaatggcaacaatcagtcccccgttgacatcaagacatccgagaccaagcacgacaccagcctgaagcctatttccgtgtcgtacaatcccgccacggccaaggagatcatcaacgtgggccattcgttccatgtcaatttcgaagacaatgacaataggagtgtgcttaagggtgggcctttcagtgatagctaccggctgtttcaatttcacttccattgggggtcaaccaacgagcatggatctgagcacaccgttgatggcgtgaaatattcagctgagttacatgtggcacactggaactccgccaagtacagcagtctggctgaagctgcatcaaaagccgatggtctcgctgtaattggagtgctcatgaaggtcggcgaggcaaatcctaaactgcaaaaagtcctcgatgctctgcaggctattaagaccaaaggaaagagagcaccattcaccaatttcgacccatccacgctcctgccaagttctctggacttctggacataccctggttctctcacgcatcctcctttgtacgaatccgtcacatggatcatatgcaaagagtctatctctgtctcatcggagcaattagcccaattccggtcactgctgtctaacgtcgagggtgacaacgcggtgcctatgcagcataataataggcctacccagcctcttaagggccgcaccgtgagagcatccttctag

SEQ ID NO: 110797 - DNA, 531 bp, Artificial Sequence
  Description of Artificial Sequence: Synthetic coding sequence
atggcgagcccagattggggctacgatgacaaaaacgggccagagcagtggtccaagctgtatccaattgccaacggtaataatcagagccctgtcgacattaaaacctcggaaacaaagcatgatacttctttaaagccaatctcagtgagctataaccctgcaacggcaaaagagattattaacgtgggccactccttccacgttaatttcgaagacaatgacaatcgaagcgtcctgaagggcggaccattcagcgacagttaccgcctcttccagtttcatttccactggggcagcaccaacgaacacggcagtgaacatacggtggatggagtgaaatattcagccgagctgcatgtggctcactggaacagcgccaagtatagctccctggcggaggctgcttcgaaagcggacggcctggcggtaataggggtgctgatgaaagtgggcgaagcaaatcctaaattgcagaaggtgctggatgctctgcaggcaatcaaaacaaaggggaagcgggccccatag

SEQ ID NO: 110798 - DNA, 756 bp, Artificial Sequence
  Description of Artificial Sequence: Synthetic coding sequence
atggcatccccagattggggatatgacgacaagaacggtcccgaacagtggtccaaactttatccgatcgcaaacgggaacaaccagtcgcccgtcgacattaaaacctcagagaccaagcatgacacatctctcaagccaataagcgtgtcttacaatcccgcgactgccaaggaaataattaatgtgggccattctttccacgtcaacttcgaagacaacgacaaccgctcagtgctgaagggtgggccatttagcgacagctacagactgtttcagtttcattttcattggggtagtaccaatgaacatgggtctgagcatacagtcgatggagtaaaatatagtgccgagctgcatgtcgcccattggaactcagcgaagtattcttctttggcagaagccgcatcaaaagctgatggtttggccgtgataggagtcctgatgaaagtaggtgaggcaaacccaaagctgcagaaagtgctcgacgctctgcaggctatcaagaccaagggtaaaagggcgcccttcaccaatttcgaccccagcaccctgttgcctagctccttagacttctggacgtaccctggcagtttgacccaccccccgttgtatgaaagtgtgacctggattatctgcaaggaatctatatcagtttcgagtgagcagctggcacagtttagatctttgctgtccaacgtcgagggcgacaatgcggtacctatgcagcacaacaaccgccctacacagccttag

SEQ ID NO: 110799 - DNA, 69 bp, Artificial Sequence
  Description of Artificial Sequence: Synthetic coding sequence
atggcaagccctgactggggctatgacgataagaatggtcccgaacagtggtcaaaactctatccatag

SEQ ID NO: 110800 - DNA, 450 bp, Artificial Sequence
  Description of Artificial Sequence: Synthetic coding sequence
atggcatctcctgactgggggtacgacgataaaaacggccctgagcaatggtccaagctctaccctattgccaacggaaacaaccagagccccgtcgatatcaagacctctgagactaagcacgatacatccctcaaaccaatctccgtttcatacaatccagccacagctaaagagataatcaatgtcggccatagcttccatgtgaatttcgaggacaacgacaaccgctccgtcttaaagggtggaccgttttccgatagttataggctcttccagttccactttcattggggaagtaccaacgaacacggctcagagcacacagtggacggcgtgaagtattctgcggagttgcatgtggcacactggaactctgccaagtacagctctctggccgaggcagcctcgaaggcagatggattagccgttattggagtgctcatgtag

SEQ ID NO: 110801 - DNA, 450 bp, Artificial Sequence
  Description of Artificial Sequence: Synthetic coding sequence
atggcgtctccagattggggctacgacgacaaaaatggccctgaacaatggagtaagctgtaccctatcgccaacggaaataatcagagtcccgtagacatcaaaacgagcgagacaaagcatgacaccagtctcaagccaatttctgttagctacaaccccgccaccgccaaagagatcataaatgtagggcacagctttcatgtcaacttcgaggataacgataaccggtctgtcttaaaaggcggacctttctccgacagctatcggctatttcagttccacttccactggggtagtactaacgaacacggaagtgagcacacagtcgacggggtcaaatacagcgccgagctgcacgttgcccactggaactctgctaaatatagcagtcttgcagaagctgcatcaaaggcggacgggctggcagtcatcggggtgctgatgtag

SEQ ID NO: 110802 - DNA, 357 bp, Artificial Sequence
  Description of Artificial Sequence: Synthetic coding sequence
atggcatcacctgattggggttacgatgacaaaaacggtccagagcaatggagcaaactttaccccatagctaatggcaacaaccaaagccctgtggatatcaaaaccagtgaaaccaagcacgatacttcactcaaaccaatttcagtgtcttacaaccccgccacagctaaagaaattatcaatgttgggcactcattccacgttaacttcgaagataatgataaccgtagtgtcttgaagggaggccccttcagcgactcttacaggctgttccagttccatttccactggggatccacaaatgagcacgggtctgagcataccgtcgatggagtcaaatactctgctgaatag

SEQ ID NO: 110803 - DNA, 447 bp, Artificial Sequence
  Description of Artificial Sequence: Synthetic coding sequence
atggctagccccgattgggggtatgatgataaaaacggccccgaacaatggtctaagttgtaccccattgccaacggcaacaatcaaagccctgtagacatcaagacctctgagacgaagcacgacacatccctgaaaccaattagtgtttcgtacaatcccgctaccgcgaaggagattattaatgtgggacattcgttccatgtaaactttgaagacaatgataatagatccgtgctgaagggcggacctttttccgattcatacaggctgttccaatttcattttcactggggatctaccaatgagcacgggtccgagcacaccgttgatggagtgaagtactcagcagagctacacgtagctcattggaacagtgctaaatacagcagcttggcagaagcagcaagcaaggccgatgggctggctgttatcggagtcctttag

SEQ ID NO: 110804 - DNA, 786 bp, Artificial Sequence
  Description of Artificial Sequence: Synthetic coding sequence
atggcatcaccggattggggctacgacgataaaaacggtcctgagcagtggtctaaactctatcctatcgctaatggcaacaaccaatcccccgtagatattaagacatccgagaccaagcatgacacttctttgaaacccatttccgtaagctataatcccgcaaccgcaaaggagattataaatgtcgggcattcctttcacgttaattttgaagataatgacaaccgctctgttttgaaagggggccccttttccgattcttatcgactgtttcagttccactttcactggggaagcaccaacgagcacggttccgagcatacagttgacggcgtgaagtactccgccgagctgcacgttgcccattggaattctgcaaaatacagttctctcgctgaggctgcaagcaaggctgatgggctggccgtgataggggtgctaatgaaggtgggagaggctaacccaaagttgcagaaagtgctggatgccctgcaggccattaaaactaaagggaaaagagctccctttaccaattttgacccctcgacacttctgccttcctctttggacttttggacctatcctggctctttgacacaccctcccctctatgaatcagtgacctggattatctgcaaggagtccatttctgtgtcatctgagcagctcgctcaatttcgctcattgctgagcaatgtagagggtgacaatgctgtccctatgcagcataacaacaggcctacgcagccactcaagggaagaacagttagggccagcttctag

SEQ ID NO: 110805 - DNA, 300 bp, Artificial Sequence
  Description of Artificial Sequence: Synthetic coding sequence
atggcatccccagattggggatatgatgataaaaatggccccgagcaatggagtaagctctatcccatcgcaaatggtaataaccaaagcccagtggatatcaaaacctcagaaacaaaacatgacaccagcctaaagcccataagcgtgagctacaacccagccactgccaaagaaatcataaatgtgggacactcctttcacgttaacttcgaggacaacgacaacaggtccgtcctcaaaggaggtcctttttctgatagctatagactgttccaattccacttccattgggggtag

SEQ ID NO: 110806 - DNA, 786 bp, Artificial Sequence
  Description of Artificial Sequence: Synthetic coding sequence
atggctagcccagactggggctatgatgataaaaacgggcctgagcagtggagcaaactctaccccatcgccaatgggaataaccagtcacctgtcgatatcaaaacgtctgaaacaaagcatgatactagtctgaagcccatctctgtcagttacaaccccgctaccgctaaggagatcatcaatgtgggtcacagttttcatgttaactttgaagataatgataatagaagtgtgctcaagggcggccccttctcggattcctataggctatttcagttccactttcactggggaagtactaacgaacacgggtccgagcacaccgttgacggcgttaagtactccgccgagcttcacgtggcgcattggaattcagccaaatattcctctttagccgaggcggctagcaaggccgatgggctggcggtgatcggcgtactgatgaaggttggtgaagccaaccccaaactccaaaaggtgctggacgcactccaggccatcaaaactaaaggcaaaagagcaccttttactaattttgatccctccaccctgctgcctagctctttggatttctggacctaccccggctccctcacccacccccctctgtacgaatcagtgacttggattatctgtaaagaatctatttccgtgtcctctgagcagctggcacagtttcggagccttctgtctaatgtagaaggtgacaacgctgtacccatgcagcacaataaccggcctacccaacctctgaaaggcaggaccgtcagggcttcattctag

SEQ ID NO: 110807 - DNA, 786 bp, Artificial Sequence
  Description of Artificial Sequence: Synthetic coding sequence
atggcttccccggattggggctacgacgacaagaacggaccagaacagtggagtaagctctaccctatagcaaacggaaacaatcagtcccccgtcgacattaaaacaagtgaaaccaagcatgacacaagtctcaaaccaatctctgtgtcttacaaccccgcaacagccaaggaaatcatcaacgtgggacattctttccacgtaaattttgaggacaatgacaaccgcagcgtcctgaaggggggacccttttctgacagttatcggctcttccagtttcactttcactggggcagtacaaacgagcacgggagcgaacacaccgtggacggggtgaagtactccgctgaactccacgtcgcacactggaactccgcaaagtactcttccctggctgaagccgcctccaaagcagacggtctggcagtaattggtgtactgatgaaggtgggagaagccaaccctaagctgcagaaggtactggacgcactacaagcaattaaaactaaggggaaaagggccccgtttactaacttcgatcccagcacactcctgccatcttctctggacttctggacataccccggttcccttacacacccccccctgtatgaaagtgtcacatggatcatttgcaaggagagcatatctgttagctcggaacagctcgcccagttccgctcactgctctccaacgttgaaggcgataacgctgtcccaatgcagcataacaacagacccacacagccgctgaagggtagaactgtaagggctagcttttag

SEQ ID NO: 110808 - DNA, 783 bp, Artificial Sequence
  Description of Artificial Sequence: Synthetic coding sequence
atgtctcaccactgggggtatgggaagcacaatggccctgagcactggcataaagatttcccgattgcaaaaggcgagcggcagagcccggtcgatattgacacccatacagccaagtacgaccctagcctgaagccgctctctgtgtcgtacgatcaggcaacttctttacgcatcctaaataatggacacgcatttaacgtggagtttgatgattcccaggataaggccgtgctgaagggcgggcctctagacggtacctatcgactcattcaatttcattttcattggggcagcttagacgggcagggttccgaacacacagtggacaaaaaaaagtacgccgctgaattgcatctggttcattggaacacgaagtacggtgacttcggcaaagctgtgcagcagccagatggactggcagtgctgggcatcttcttaaaagtcggctctgccaagccaggcctacagaaagtggttgatgttctcgattctattaagaccaagggtaaaagcgccgactttaccaacttcgatcctaggggtctactccctgaatccctggactactggacgtacccaggatctctgactactcccccactgctcgaatgcgtgacctggattgtcctgaaggagcctatttcagtgtcatctgaacaggtgctgaagttcaggaaactgaattttaatggcgaaggcgagcctgaggagttgatggtggataattggaggcccgcacagccgctgaagaatcgacagataaaggcttctttcaagtag

SEQ ID NO: 110809 - DNA, 783 bp, Artificial Sequence
  Description of Artificial Sequence: Synthetic coding sequence
atggccaaggaatggggctacgcatcccataacggtcctgaccactggcacgaactctttccgaatgcgaaaggggaaaatcagagccctgttgaattacacaccaaggacattaggcatgatccaagtctgcaaccctggagtgtttcctatgacggcgggtctgcaaagacgatcctcaacaatggcaagacttgccgggtggtgttcgatgacacatacgaccggagcatgctgcgggggggacccctacctggaccatatcgactgagacagtttcatttgcactggggctcctcagacgatcacggaagtgaacacaccgtcgatggggtaaagtatgctgcagaactgcacttagtgcactggaacccaaagtacaacaccttcaaagaggccctcaaacaacgagatgggatagcagtcattggcattttcctgaaaattggacatgagaatggggaattccagatcttcctcgacgctctagataaaattaaaacaaaggggaaagaggctccctttacaaagtttgacccatcctgcctcttccctgcctgtagggattattggacataccaaggctctttcaccacccccccatgcgaggagtgtatcgtctggttgctgttgaaggagccaatgaccgtatccagcgatcagatggccaaactgcgcagcctgttgagtagcgcagagaacgagcctcccgtacctttggttagtaactggcgacctccacagccaattaataatagggtcgtccgggcctccttcaaatag

SEQ ID NO: 110810 - DNA, 735 bp, Artificial Sequence
  Description of Artificial Sequence: Synthetic coding sequence
atggctaaagagtggggctacgcatcacacaacggcccggaccactggcatgaacttttccctaatgctaagggggagaatcaatcaccatggagcgtgtcatatgacggcggcagcgcaaagactatactaaacaatgggaagacttgtagggtcgtgtttgatgatacatatgatagatctatgctgagaggcggtcctctccctggtccgtaccgactgaggcaattccatttgcattggggcagctccgacgatcacggtagcgaacacactgtggacggcgttaagtatgccgctgagctccatcttgtgcactggaatcctaaatacaacaccttcaaggaagccttgaaacagagggacggaatcgctgttattggaatatttctcaaaatcgggcacgaaaatggcgagtttcaaattttcctcgacgctctggacaaaatcaagaccaaaggtaaagaagctccttttacaaagttcgatccatcttgcctctttccagcttgtcgtgattactggacatatcaaggcagttttaccacccctccctgtgaggagtgtattgtttggctactccttaaggaacccatgaccgtatcttccgaccaaatggctaaacttcgtagcttgctttcaagcgccgagaacgagccacctgtgcccttagtatccaactggcgaccgccacagcccattaacaatagagtggtgagagcatccttcaaatag

SEQ ID NO: 110811 - DNA, 954 bp, Artificial Sequence
  Description of Artificial Sequence: Synthetic coding sequence
atggtggtgatgaattccctgcgcgtgattctccaagcgtcacctggaaaactgctgtggcgtaagtttcagatccctcgcttcatgcccgctagaccttgctcattatatacgtgcacctataagactcgaaaccgggcgttgcacccattgtgggagtcagtagatttagtccccggaggagatagacagtcaccaataaacatacggtggcgcgacagtgtgtacgatcccggtctgaagcctctcacaattagttacgaccctgctacctgccttcacgtctggaacaatgggtactcgttcctcgtggaatttgaggactcaactgataaaagtgttattaagggcggcccactcgagcacaactatcgcctgaagcagtttcatttccactggggagcaatcgacgcatgggggtccgagcacacggtcgactcaaagtgcttcccagccgaattacatttagtgcactggaatgctgtaagattcgaaaactttgaagacgccgccctcgaagaaaatgggctggctgtgatcggagtgtttttaaagttgggaaagcaccacaaggagctgcaaaagcttgtggataccctcccctccataaaacacaaagacgccctcgtggaattcggcagtttcgaccctagctgtctcatgccaacttgccctgactactggacatatagcgggagcctgaccactcccccgctgtcagaatccgtaacctggatcataaaaaagcagcctgtagaggtcgatcacgaccagcttgagcagtttagaaccctgctctttacaagcgaaggcgagaaggaaaaacgaatggtcgataactttagacccctgcagccacttatgaatcgcactgtgcggagttccttcaggcatgattacgttctgaatgtgcaggccaaacctaaacccgccacaagccaggctacaccatag

SEQ ID NO: 110812 - DNA, 954 bp, Artificial Sequence
  Description of Artificial Sequence: Synthetic coding sequence
atggtggtaatgaactctctcagggtgatcttacaggcctctcctggtaagctactgtggaggaaatttcagattccacggttcatgcctgccaggccatgttccttatacacctgtacgtataaaaccaggaaccgggcactacacccgctctgggagtccgtagacctggtacccggaggagaccgccagtcacccattaacatcaggtggagagattcagtgtatgatcccggcctgaagccactgacaatctcatatgaccccgctacatgtctgcacgtctggaataacgggtacagcttcctggtcgaatttgaggattctactgacaaatccgtgataaagggtggtcctctggaacataactaccgcctaaagcaattccattttcactggggcgctatagatgcttgggggtccgagcatacagtggacagcaagtgctttccagcggagctccacctggtccattggaacgccgtaagattcgaaaactttgaagatgcggcactggaagaaaatggcttagccgtaatcggagtctttctaaaactggggaaacaccataaggagctccagaagttagtggatacacttccatctatcaagcataaagacgcccttgttgagtttggatctttcgaccctagttgccttatgcctacttgccctgactactggacctactctggtagcctgaccacaccaccactttctgaaagcgtaacatggatcatcaagaagcagccggtggaggtggatcatgatcagctcgagcaatttaggaccctgttgtttaccagtgagggggagaaggaaaagaggatggtggacaattttagacctctgcagcccctaatgaaccggaccgtgaggagcagctttaggcacgactatgtgctaaacgtccaagcgaaaccgaagcccgcgactagccaggccacgccctag

SEQ ID NO: 110813 - DNA, 411 bp, Artificial Sequence
  Description of Artificial Sequence: Synthetic coding sequence
atggtggttatgaatagcctgcgggtgattctgcaagcgtcacctgggaagctgctatggagaaagttccagattccacgatttatgccagctagaccttgctccttatatacatgcacgtataagactcgcaaccgagccctccaccctctctgggagtctgtggacctcgtcccggggggcgatcggcaatctcctattaacatacgatggagagactcagtctatgatcctggtctgaagcctctgacaatctcttacgatcctgccacatgcctgcacgtgtggaataatggatattcgtttctcgttgaatttgaggactcaaccgacaaaagcgtgatcaagggaggtccattggagcacaattatcgactgaaacagtttcactttcattggggagccatctag

SEQ ID NO: 110814 - DNA, 231 bp, Artificial Sequence
  Description of Artificial Sequence: Synthetic coding sequence
atggtcgtcatgaattcactcagagtaatcttgcaggcctcccctggtaagctgctttggcgcaaattccagattccacggttcatgccagcccggccatgcagtctctacacatgcacatacaagacgcgaaacagggcactgcacccactctgggagagcgtagacctcgtgcctgggggggatagacagtcccccatcaacattcgctggagagatagcgtatactag

SEQ ID NO: 110815 - DNA, 540 bp, Artificial Sequence
  Description of Artificial Sequence: Synthetic coding sequence
atgagggcactggttctcctgctatccctgtttctgctgggcggccaggcccagcatgtgagtgattggacctatagcgagggagccctggatgaggctcactggccgcaacattaccctgcatgcggaggtcagcgccagtcccctataaaccttcagcgcaccaaagttagatacaatccctccctgaaaggtctgaacatgacagggtatgagactcaggccggtgaatttcctatggtaaataatgggcacacggactggcaggcagaactctttttaccctctctatcctctccttgtggcgagggggctaagcacaagggccagcgacagtggctttgtagccccagtcttgatagttggtgggaggcaatcatagatggcgggagcttgtgggctacactggctgagtgcggcctgcgagctgaaggcccagaagaggggcgccatatggaagagaagtcccccgcttcacagggtgcttgttcgggaagccgcctgccaatcagccgcgggccttgtacattttttctctag

SEQ ID NO: 110816 - DNA, 942 bp, Artificial Sequence
  Description of Artificial Sequence: Synthetic coding sequence
atgagagcactggttctgctactgagtctgtttctcttgggcgggcaggctcagcatgtgtcagactggacctatagcgagggcgcccttgatgaagctcactggcctcagcactatccagcctgcggcgggcaaaggcagtctcctatcaatttacagaggaccaaagtcaggtataatccttcactgaaaggccttaacatgaccgggtatgagacccaggccggcgaattcccaatggttaataatgggcacaccgtgcagatatcccttccctctactatgcgaatgactgtggccgacggaacggtgtacattgcccagcagatgcactttcattggggcggcgcctcctcagaaatctccggcagcgagcacactgtcgatggtatcaggcacgtgattgagattcatattgtgcattacaattctaagtataaatcctatgatattgctcaggatgccccagacggtctggccgtgctcgcggcttttgtggaggttaaaaactaccccgaaaatacctattatagtaacttcatttcacacttggccaatattaaatatcctggccaacggacaactctgactggcctcgatgtgcaggacatgctccctagaaatctgcagcactattatacttaccacgggagtctgactacccctccttgtaccgagaacgtgcactggtttgtgttggcagactttgtgaaacttagcagaacccaggtttggaaactcgaaaattccctactggatcaccggaataaaaccatccacaatgattatcggaggacccaaccactgaaccacagagtggtggaatcgaactttccaaatcagggcaaaggtcatggcggtcatagagggagatcccagaacccgcgggtccagccaaccagcactaggcatcccctcgcacttgggtcactcgaagcgtag

SEQ ID NO: 110817 - DNA, 927 bp, Artificial Sequence
  Description of Artificial Sequence: Synthetic coding sequence
atgcgcgcactggtgctcttactctcgctattcttgctaggtgggcaagcacagcacgttagcgactggacctattctgaaggtgctctggatgaagcccactggccacagcactatccggcctgtggcgggcagcggcagtcccccattaatctccagcggacgaaggtgagatataaccctagcctgaaggggctgaatatgaccgggtacgagactcaggctggagaatttccaatggtcaataacggacacactgtgcagatcagccttcccagcacgatgcggatgactgtcgctgacgggaccgtgtacatcgcccagcagatgcatttccattggggtggagcttctagcgaaatttccggcagcgaacatacagtggacgggatccgacatgtgatcgaaatacatatcgttcattacaacagtaagtacaaatcttacgacatcgcccaggatgccccagatgggttggccgtgttggcagcattcgtggaagtcaagaactacccagaaaacacatattattctaatttcattagccacttagccaatatcaagtatccgggtcagcgtactaccttgaccgggctcgatgttcaagacatgttgcccagaaacctgcagcattactacacttatcatggctctcttacaactccaccatgtactgagaatgttcactggttcgtgctggctgatttcgtcaagctgtctcggacgcaggtgtggaagctggaaaattctttgcttgatcaccggaacaaaaccatccacaatgactacaggcggacccagccactgaatcatcgagtcgttgaatccaattttccaaaccaggaatacactctcggttccgaatttcaattctatctgcacaagatcgaagagatcttagactacctgcgacgcgcactcaattag

SEQ ID NO: 110818 - DNA, 795 bp, Artificial Sequence
  Description of Artificial Sequence: Synthetic coding sequence
atgaccggccaccatgggtggggttacggtcaagacgacggaccttctcattggcataagctctatccaatcgcccaaggcgatcggcagtcacccattaatattatttctagtcaggctgtatactccccttctcttcagccactggagctgtcttacgaggcttgtatgtctctgtctattactaacaacgggcatagcgtacaagtagactttaatgacagcgacgatcggacagtcgtaacgggaggcccccttgagggcccctacaggctcaagcagtttcacttccattggggcaagaaacatgacgtgggaagtgaacatactgtggatggaaagagcttcccgagtgaattacacttggtccactggaacgccaagaaatatagcacattcggcgaagctgcctccgcccccgatggcttagcagtggtgggcgtgttcctggagacgggagacgaacatccctccatgaatcggctgaccgacgccctgtacatggtgcgttttaagggtaccaaagcacagtttagttgctttaaccccaaatgtctgcttccagcttccagacactattggacctatcctgggtctctgactacaccaccgctgtctgagtctgtgacttggatcgtgttgcgcgagcctatctgtatcagcgaacggcagatgggaaaatttcgtagcctacttttcacaagcgaggacgatgagaggatccatatggtgaacaatttccgccccccacaaccactgaaaggaagagtagtcaaggcaagctttcgagcttag

SEQ ID NO: 110819 - DNA, 627 bp, Artificial Sequence
  Description of Artificial Sequence: Synthetic coding sequence
atgagcctcagcatcactaacaatggccactcagtgcaggtcgacttcaacgattcggatgacagaaccgttgtgaccggggggccgctggaaggcccttaccgactcaagcagttccacttccattggggtaagaaacacgacgtgggaagcgaacacaccgtggatgggaaaagctttccttcagaattgcacttagtgcactggaacgccaaaaagtacagcacattcggcgaggccgcctccgcacctgacggactagctgtagtcggtgtcttcctggaaaccggtgacgaacatccatcaatgaatagactgacagacgctctgtacatggtgcgttttaagggaacgaaggcccagttcagttgctttaatccaaagtgcctgctgccagccagtagacactactggacatatcctgggtctctgactacaccacctctgagcgagagcgttacttggatcgttttgcgggagcctatttgtatttcagagaggcagatgggaaagtttcggtccctgttgttcacaagtgaggacgatgagagaatccacatggttaacaactttcgaccccctcagccattaaaaggacgcgttgtcaaggcttcttttagggcctag

SEQ ID NO: 110820 - DNA, 873 bp, Artificial Sequence
  Description of Artificial Sequence: Synthetic coding sequence
atggccgacttaagcttcatcgaggacacagtggcttttccagaaaaggaagaagacgaagaagaagaggaggaaggcgtggagtggggctatgaggagggggtggagtggggacttgtgtttcccgacgccaatggggagtaccagtcacccattaacctaaattcacgcgaagctcgttacgatccatccctgctggatgtcaggctgagtcctaattatgtggtctgccgggactgtgaagtaaccaatgatggccacactatacaggtgattctgaaaagcaagtctgtgctatcaggcgggccacttcctcaaggccacgagtttgaattgtatgaggtgcggttccactgggggcgtgagaatcagcggggttcagaacacacggttaattttaaggcctttccaatggagcttcacctcattcattggaactcaacactttttggttccatcgacgaggcagtaggaaagcctcatggaatcgccatcatcgcactgtttgtccagataggcaaagagcacgttggcttgaaggctgtgaccgaaatattgcaagatatccagtataaagggaaatccaagactatcccctgcttcaaccctaacacgctgctccctgaccccctgctgcgtgactattgggtatatgagggcagcctgacaattcccccgtgcagtgaaggtgtaacttggattctgttcagatatcctttgaccatctcccaacttcaaattgaagagtttaggaggctgcgtacccacgtaaagggcgccgagttggtagagggttgcgacggaattttgggggataacttcaggcctacccagcccttgagcgaccgggtgattcgtgcagcctttcagtag

SEQ ID NO: 110821 - DNA, 987 bp, Artificial Sequence
  Description of Artificial Sequence: Synthetic coding sequence
atggaaatcgtatgggaggtcttattccttttacaggcgaacttcatcgtctgcatttccgctcaacagaatagccccaagatccacgaagggtggtgggcgtataaggaagtggttcagggctcctttgtgccagtgcctagtttctggggactggtgaatagcgcctggaacctgtgctcagtcggtaaaagacagagcccagtgaacatcgagacatcacatatgatatttgaccctttcctgactcccttgagaatcaatacgggaggaagaaaagttagcggcaccatgtataacacagggcgccatgtcagtctgcggcttgacaaggaacacctcgtgaacataagcgggggaccgatgacttactctcaccgcctcgaggagatcaggctgcacttcggaagtgaagattcccaggggtcagagcacctcctgaatggccaagctttctctggcgaagtgcaattgattcactacaaccacgaactttacactaacgtcacagaggcggcaaagtctcctaatgggttggtggtggtgtcaatcttcattaaagtgagtgattccagcaatccctttctgaatcgcatgcttaatcgcgacactatcactaggataacatataagaatgatgcatatctgttgcagggactgaatattgaagaactctatcctgagaccagctccttcattacctacgacggctccatgaccattcccccatgctatgagactgcctcatggattatcatgaacaaaccggtgtatatcacaaggatgcagatgcacagcctgaggctgctatctcagaaccagccctctcagattttcctctcgatgtccgacaattttcgccccgtgcagccgttaaataaccgctgcattagaactaatatcaatttctccctgcaggggaaagattgccccaacaacagggctcagaagctgcaataccgtgtcaacgagtggctgctgaaatag

SEQ ID NO: 110822 - DNA, 1005 bp, Artificial Sequence
  Description of Artificial Sequence: Synthetic coding sequence
atggccagtattcggagtcgttctggctgtggatttaccgagcctgatgaactgtgcatggtcggcgtgcgggaaaacgcccaacagaatagccccaagatccatgaaggctggtgggcctacaaggaggtcgtgcaaggatcctttgtccctgtcccctccttctggggtctcgttaattctgcctggaacctgtgttccgtcggcaagcgccaatcgcctgtgaacatcgagacatcacacatgatctttgatccatttctgactccacttagaataaacacaggcggtcgaaaagttagcgggactatgtacaacacaggccgtcatgtgagcctgcgtctggacaaagagcatctggtgaacatctcaggggggccaatgacctatagccaccgcctcgaggaaattaggctccactttggatctgaagattcccagggttccgagcacctgttgaatggtcaggctttctccggggaggtccaacttatacattacaaccatgagctgtacaccaatgttactgaggccgccaagagtccaaatgggctcgtcgttgtgagtatctttatcaaagtgtccgactcaagtaatccctttcttaatcgcatgctcaacagggatactattacacgcatcacatacaagaacgatgcttacctcctccaaggtctgaatatagaggaattgtaccccgagacgtcctccttcatcacttacgatgggtctatgaccattcctccatgttacgaaacagcctcttggatcataatgaacaagcccgtgtacattacaagaatgcaaatgcattctcttcggctgttgtctcagaaccagccctctcagatcttcctttccatgtccgataatttccgcccagtgcaaccattgaacaatcggtgcattaggaccaacattaatttcagcctccagggcaaggattgccccaataaccgcgcccagaaactccagtatcgcgtgaacgagtggctgttgaagtag

SEQ ID NO: 110823 - DNA, 987 bp, Artificial Sequence
  Description of Artificial Sequence: Synthetic coding sequence
atggagatcgtgtgggaggttctgtttctccttcaagcaaacttcatagtctgcatcagtgcccagcagaattcacctaagattcacgagggctggtgggcttataaagaggtggtgcagggatcgttcgttccggtcccgagcttttgggggcttgtcaactctgcctggaacctgtgcagcgtgggtaaacggcagtcgcctgttaacattgagacaagtcacatgatctttgacccttttctgaccccattaagaataaacaccggcggccgtaaagtatctgggacaatgtacaacacaggacgacatgtctctctgcggctggataaagaacacctggtgaatataagtggcgggcccatgacatacagtcacaggctagaagaaatccggctgcactttgggtcagaagattcccagggcagcgaacacttactcaacggacaggccttctccggtgaagtgcagttgattcactacaatcatgagctgtacacaaacgtgacagaggcagccaagagcccaaatggactggttgtggtgagcatttttataaaggtgagcgatagcagtaacccattcctaaacaggatgttaaatcgtgatacgatcactcgcatcacatacaaaaatgatgcttatctgctccaggggcttaatatcgaggagttgtatccagagaccagcagttttatcacttatgacggctcgatgaccattcctccctgctacgaaactgcaagctggattatcatgaacaagccggtatatatcacgcgaatgcagatgcacagcctgagattgctctcccagaatcagcccagccaaatctttctatctatgtcagataactttagaccagttcagccactgaataaccggtgtatcagaaccaatatcaacttcagcctccaaggcaaggactgcccgaataatcgcgcgcagaaactgcagtatcgtgtgaacgagtggctattgaagtag

SEQ ID NO: 110824 - DNA, 987 bp, Artificial Sequence
  Description of Artificial Sequence: Synthetic coding sequence
atggaaatcgtgtgggaggtgctgtttctgcttcaggcaaatttcatagtttgtattagcgcccagcagaactcaccaaaaattcatgagggctggtgggcctacaaagaggtggtgcaggggtcttttgtgcccgttccctctttctggggcctggtcaacagcgcttggaatctgtgctctgtgggaaagcgtcagtctcccgtaaacatcgagacttcgcacatgattttcgacccgtttctgaccccgctgaggataaacactggcggaagaaaggtgagtggcacaatgtataatacagggaggcatgtctccctgaggttggataaagagcatctggttaacatcagcgggggtccgatgacttatagtcaccgattagaggagattaggttgcacttcggcagcgaagattcccagggatctgaacacctgcttaatggccaggcctttagcggcgaagtgcagctgatccattacaaccacgaactgtataccaatgttacagaggccgccaaaagcccgaacggtctggtcgttgtgtcgatctttatcaaagtgtctgattccagcaatccctttttgaaccggatgctgaacagagataccattactaggatcacttacaaaaacgatgcataccttttgcaaggtttgaacatcgaagagctctatcctgagacatccagctttatcacgtacgatggaagcatgacaatccctccatgctacgaaactgccagttggatcattatgaacaagccagtgtatattactcgtatgcaaatgcactcactgcgactgctgtcccagaatcagccgagtcagatctttctgtccatgtccgacaatttccgccccgtacaaccacttaataatcgctgtataaggaccaacatcaatttctcattgcaggggaaagactgcccaaataatagagcacagaagttacagtatcgcgtgaatgagtggctcctgaagtag

SEQ ID NO: 110825 - DNA, 987 bp, Artificial Sequence
  Description of Artificial Sequence: Synthetic coding sequence
atgggggctgctgcccgattaagcgccccccgagctctagtgctctgggccgccctgggggcggcagcgcacatcggccctgcgcccgaccccgaagattggtggtcatacaaggacaacctgcagggcaatttcgtgccaggacctccgttttggggcctggtgaacgcggcgtggagtctctgtgccgtcggaaagaggcagagccctgtggacgtggaactcaagagggtgttgtatgacccattcctgccgccccttagactgagcactggcggtgagaaactgagaggcactctgtacaacaccgggcggcatgtgagcttcctacccgctccaagaccagtcgtgaacgtgtctggcgggccattactttactctcacaggctgtccgagctccgcctgttattcggtgccagggacggagctggctccgagcaccaaattaaccatcagggattctctgccgaggttcagttgatacatttcaaccaagaactgtatggcaacttctccgccgcaagccgtggcccaaatgggctggccatactgagtcttttcgtgaacgtcgcctcaaccagcaatcctttcctcagtcgtcttcttaatagggacactatcacccgcatctcatataaaaacgacgcatatttcctgcaggatctcagcctagaactcctgtttccagagtccttcggcttcattacctatcagggcagtctgtctacccctccatgctccgagacagtgacctggatcctcatcgatagggccctcaatattaccagtttgcagatgcacagcttgagactgctgtcacagaaccccccaagccaaatctttcagtctctctccggcaactctcgccccctccagcctctagcccacagagccctgcgcggtaacagagatccccggcaccccgaacggaggtgtagagggcctaattacagactgcacgtcgacggggtcccccatggtcgctag

SEQ ID NO: 110826 - DNA, 1065 bp, Artificial Sequence
  Description of Artificial Sequence: Synthetic coding sequence
atgccacggcgcagtctccacgccgccgcggtcttgctgctggtgattctaaaagagcagccctcctccccagcccccgtcaacggatccaaatggacctatttcgggcccgacggtgagaatagctggtcaaagaaatacccatcatgcggaggcttactgcagagtcccatcgatcttcattctgacatcttgcagtatgatgcttcgctgactcccctggagttccaggggtacaatctcagtgccaacaaacagtttctgctgaccaacaacggccactctgttaaacttaatctgcctagcgatatgcatattcagggcctgcagagcagatacagtgctacccagttgcacttgcactgggggaacccaaacgatccccatggctcggaacacacagttagcggccagcacttcgctgccgaactccacattgtgcactacaactctgatctctaccccgacgctagcacagcgtccaacaaatcagagggcctggcagtgctggccgtgctcattgaaatgggcagctttaatccctcatatgataagatcttcagccacctgcagcatgtgaagtataagggtcaagaggcctttgttcctggctttaacatcgaagagttgttgcctgaacggactgctgagtactaccggtacagaggcagcttgaccacccctccgtgcaaccctacagtgttgtggacagtctttagaaacccagttcaaatttctcaggaacagctgctggccctcgagaccgcgctgtactgcacccacatggacgatcctagtccaagggaaatgatcaataatttcagacaggttcagaagttcgatgaacggctggtgtataccagtttttctcaagttcaagtttgcactgctgccggcctttccctcggtattattttgtctcttgccttggccggtatcctgggtatatgtattgttgttgtggtgagcatctggttgtttaggaggaagtcaattaagaagggtgataacaaaggggtgatctacaagcctgccacgaagatggagaccgaggcccacgcctag

SEQ ID NO: 110827 - DNA, 1032 bp, Artificial Sequence
  Description of Artificial Sequence: Synthetic coding sequence
atgccaagaagaagccttcacgccgcggcggttctcctgttggtgatcttaaaagagcaaccttcctcgcccgcaccagtgaatggatcaaagtggacctacttcgggccagacggagagaattcttggtccaagaaatatccgtcctgtggaggtcttctacagtcccctattgatctgcactcggacatcctgcagtatgacgcaagcctcacgccgctggaatttcagggctacaacctgtcagcaaataagcaattcctcttaacaaacaacggtcatagtgtgaagctgaatttgcctagcgacatgcatattcagggcttacagagccggtattccgctacccaactgcacctgcactgggggaaccctaatgacccgcatgggagcgaacacactgtcagtggacaacacttcgccgccgaactgcacattgttcactacaatagcgacctttaccctgatgcgagcacagcttccaacaaatcggaaggactggccgttcttgccgtcctgatcgagatgggaagttttaacccctcctacgataagattttttcacacttgcagcatgttaagtacaagggacaggaggctttcgtgccggggtttaacatcgaagagttgttgcccgagaggactgctgaatattaccgctacagaggctccttgactacacctccttgtaacccaactgtattgtggacagtgttccgcaaccctgtccaaatctctcaggaacagctgctcgccctggaaaccgccctgtattgtacccacatggacgacccttcaccccgcgagatgatcaacaactttcggcaggttcaaaagttcgacgagaggctcgtgtatacctccttctcgcagggcattatcctatctcttgctctggccggaatattaggaatctgtattgttgtggtggtaagtatatggctcttccggaggaagagcatcaaaaagggtgataacaagggcgtcatctacaagcctgcaacaaagatggaaaccgaagctcacgcctag

SEQ ID NO: 110828 - DNA, 852 bp, Artificial Sequence
  Description of Artificial Sequence: Synthetic coding sequence
atgccacgtagatctctccatgctgccgctgtgctgctgctcgttatcctcaaggagcagccatcaagtcccgccccagttaatgggtctaagtggacctatttcgtcaagctgaacctccctagcgatatgcacattcaggggttacagtctaggtattcagctacacagctccatctgcactgggggaaccccaatgacccccacggctctgagcacactgtaagcgggcagcactttgccgcggagttgcatatcgttcactacaactctgatctgtatcctgatgcctccactgcctccaacaagagtgagggcctagccgtgcttgcggtcctcattgaaatgggatctttcaacccaagctatgacaaaattttctctcatctgcagcatgttaagtacaaaggccaggaggccttcgtgccaggtttcaatatcgaagagctgctgccagagcgcacagctgagtattataggtatcgcggaagcttgacaactccaccctgcaaccctactgtgttgtggactgtgttcaggaatcccgtgcagatctcccaagaacagcttcttgcgctagagaccgctctgtattgcacacacatggacgatccaagcccgcgagagatgataaacaacttcagacaggtgcagaagtttgacgagaggctggtatatactagtttctctcagggaatcatcctgagtctagccctggcaggaattctgggaatctgcatcgtggttgtggtgagtatctggctctttaggagaaagagtatcaaaaagggggacaataagggggtcatctataagccggcgactaaaatggagacagaggctcatgcttag

SEQ ID NO: 110829 - DNA, 1014 bp, Artificial Sequence
  Description of Artificial Sequence: Synthetic coding sequence
atgctcttttccgcccttctcttagaagtcatctggatcttggccgctgatgggggacaacattggacatacgaagggccccatggacaggatcactggcccgcaagctatcctgagtgcggtaataacgcccagtctccaattgacatccagaccgactcagtcacattcgacccggacctgcctgcactgcagccccatgggtacgaccagcctgggacagagcccctagacctgcacaacaatggacacacagttcagctgagcctgcctagcacactgtaccttgggggactgccaagaaaatacgtggcggcccagctgcatctgcactggggacagaaaggttctcctggcggcagcgagcatcagatcaattccgaggccacatttgcagagctacatattgtgcactatgatagcgactcctacgatagtctttcggaggcggcagaaagacctcagggattagccgtcctagggatccttattgaagtaggcgaaaccaagaacatcgcctatgaacacatattatctcacctacacgaggtgaggcacaaggaccaaaaaacatccgtcccccctttcaacttgcgcgagcttctacctaaacagctaggccaatacttccgctataacggcagcttaacaacacctccttgctatcagtccgtgctttggacagttttttataggcgctcacaaatctccatggagcagcttgagaagctgcaaggcactctgtttagcaccgaggaagagccctccaagctgctggtccagaattatagggcgctgcagcccctgaatcagcggatggttttcgcgtccttcatccaagctggcagcagttacacaacaggtgagatgctcagtctcggggtggggattctggtgggctgcctgtgcctgcttctagcagtgtattttatcgctcgcaagatacggaagaagaggctggagaatcgcaaatcagtcgtttttacttcagctcaagcgacaaccgaagcatag

SEQ ID NO: 110830 - DNA, 834 bp, Artificial Sequence
  Description of Artificial Sequence: Synthetic coding sequence
atgtcctccggtatccacgtggccctggtgacaggtggcaacaagggcattgggcttgccattgtcagagacctgtgtaggctgttctcaggagatgtggttttgaccgctcgtgacgtcacacgggggcaggcggctgtgcagcaattgcaggccgaaggcctcagccccaggttccaccagctggacatcgatgatctgcagtcaataagagctttaagagacttccttcgaaaggaatacggcgggctagacgtactggttaataatgccggcatcgcattcaaggtggccgatccaacccctttccatatacaggccgaggtgacaatgaaaacaaacttctttggaacccgggacgtttgtaccgagcttctgccgctgatcaaaccgcagggtcgtgttgtaaacgtgtcatccattatgagtgtgagagcattaaagtcttgttcaccagagctgcaacagaaattcagatcagaaactatcaccgaagaggagttggtgggcctgatgaacaagtttgtggaggataccaagaagggtgttcatcagaaggaagggtggccaagttctgcctacggcgtgactaaaattggcgtaaccgtgctctcccggatccacgccaggaagctctccgagcagaggaaaggtgacaagattctactgaacgcatgttgccctggatgggtgcgcacggatatggctgggccaaaggcgactaagtcaccggaggagggcgccgagacgcccgtctatctcgcactgcttccacccgatgcagaaggtccgcatggtcagttcgttagcgaaaagcgcgtagaacagtggtag

SEQ ID NO: 110831 - DNA, 834 bp, Artificial Sequence
  Description of Artificial Sequence: Synthetic coding sequence
atgagttcttgctcccgcgtcgccctcgtcacaggcgccaatagaggcattggcctggccatcgccagggagctgtgcagacagttttcaggagacgtggtgctgaccgctcgggatgtcgcccgcggccaggcggctgtccagcaactgcaggcagaaggcttgagcccacgatttcatcagcttgatattgacgatctgcagtctatccgggctctgcgcgactttctgagaaaagagtatggcggcctgaatgtgcttgtgaataacgcagcagtggcctttaaatccgatgatcccatgccgtttgatataaaggctgagatgaccctgaagaccaacttcttcgccacgagaaatatgtgtaacgaacttcttcccatcatgaaacctcatggacgtgttgttaatatctccagcctgcagtgcttgcgggcctttgaaaactgcagcgaggacctccaagagcggtttcacagtgagaccctgacggagggggatctggtcgatctgatgaagaagtttgttgaggacacgaaaaatgaagtgcatgagcgagaaggctggcccaattcaccatatggcgtgtctaagttaggagtgaccgttctctctcggatcctcgcccgacgcctggatgaaaagagaaaggctgataggatcttggtgaacgcctgctgtcccggacccgtcaaaaccgacatggatggcaaagacagcattaggactgtagaggagggggccgagactcctgtctacctggctctgctcccacctgatgcaactgagcctcaggggcaactggtccatgataaagtcgtgcagaattggtag

SEQ ID NO: 110832 - DNA, 2169 bp, Artificial Sequence
  Description of Artificial Sequence: Synthetic coding sequence
atgctgacaatgggccggctccagctggtggtgctggggctcacatgttgctgggccgtggctagtgccgcaaagcttggagccgtgtacaccgaaggcggctttgttgagggagtaaataagaaactcggactgttgggagactccgtggacatctttaagggcataccctttgccgctcctaccaaagcccttgagaacccgcagccacacccagggtggcaaggcaccctgaaggctaaaaacttcaagaagcgatgtctgcaggcaactataacgcaggatagtacatatggagacgaggactgtctttaccttaacatctgggttccccagggccgtaagcaggtcagcagagatctaccggtgatgatctggatctatggtggcgcattcctgatgggatccggacacggagctaacttcctgaataactatctgtacgatggggaggaaattgccacgcggggcaacgttattgtggtgacttttaattatcgggtgggtccgctaggatttctgtccaccggcgacgcgaaccttccaggcaactatggccttcgagaccagcacatggccattgcttgggtgaagcgtaatatcgctgctttcggcggtgaccccaataacattacgctcttcggggagtccgccggcggtgcttccgtgtctctgcagactcttagcccatacaataagggtctcatccgcagagcgatcagtcagtctggggtggcgttgtcaccttgggtgatccagaaaaatccgctgttctgggccaagaaagtggcggaaaaagtcggatgtcccgttggcgacgccgccagaatggcccagtgtctgaaggtgaccgaccctcgcgcactgacactggcttacaaagtccccctcgctggtctcgagtatccgatgctccactatgtgggattcgtgcctgtcatcgacggcgactttataccagcagatcctatcaacctctacgccaacgcggctgacattgattatattgctgggacaaataacatggacggccacattttcgctagtattgacatgcccgccatcaacaagggaaataagaaggtgacagaagacttctacaagcttgtttccgaattcacaataactaaggggttgagaggggcgaagacaactttcgacgtgtatactgaaagctgggcccaggacccctctcaggagaataagaaaaagacggtggtggattttgagaccgacgtgttgtttttagttcccaccgagatcgctctggctcaacaccgcgctaacgcaaaaagcgcaaaaacgtatgcctacttattctctcacccatctagaatgcctgtgtatccgaaatgggtgggcgccgatcatgctgatgatattcagtatgtgtttgggaaaccgttcgcaacccctaccggatatcggcctcaagatagaactgtcagcaaggccatgatcgcatactggaccaactttgccaagactggagatcctaacatgggtgatagcgcggtgcccacgcattgggagccctacactacagaaaactctggctatctggaaattaccaagaagatggggtcctcgtccatgaaaaggtcgttgcggaccaacttcctccggtactggacactgacttatcttgccctgcccactgttactgaccaagaggccacgcctgtccccccgaccggcgactccgaggccacccctgtgccccccacgggcgattcagaaactgcccctgtccctcctactggagatagcggcgcgccgccggtaccacccacaggcgacagcggcgcccccccggtgccgcccaccggcgactcaggagctccacccgtgcctcccaccggcgatagtggagcaccccccgtgccaccaaccggcgatagcggcgctcctccagtgcctcccacaggggatgcgggacctcctcccgttccaccgaccggggattccggagcgccccctgtgccaccgacgggtgattccggcgcaccacctgtgactcctactggggattctgagaccgccccagtgccccctacgggggacagcggagcccctcctgtgcccccaacaggagatagtgaggctgcccctgtccccccaacagacgactcaaaagaggctcagatgcccgcggtgatcagattttag

SEQ ID NO: 110833 - DNA, 2064 bp, Artificial Sequence
  Description of Artificial Sequence: Synthetic coding sequence
atgggcaggttacagcttgtcgttctagggttgacttgctgctgggcagtggcctcagcagctaagttgggggcagtgtataccgaaggaggatttgtcgagggcgtcaataagaagctgggcctactaggtgattcagttgatattttcaaaggcatccccttcgctgcacccaccaaggccttagaaaacccacagccacatccgggctggcagggtaccctgaaagctaagaatttcaaaaaaagatgcctccaagccactattacccaggatagcacctatggagacgaggattgtctgtatctgaatatctgggtaccgcagggacgaaagcaggtgtcacgagacctacccgtcatgatttggatttacggcggggcgttccttatggggtccggccacggtgcaaattttctgaacaattacctttatgacggcgaggaaatcgccacccgcggcaatgtgatcgtcgttacctttaactacagggttggtccactcggctttctgtcaacaggcgacgccaatctccctggaaactatggactgcgagaccaacacatggctatcgcctgggttaagaggaatattgcagcattcgggggtgatccaaataatatcacgctattcggggaaagtgccggaggcgctagcgtgtccctccagactctgtcaccttataacaaagggcttatcaggagagctatttcacagtcaggcgttgctctctccccatgggtcattcagaagaaccccctgttctgggccaagaaggttgcggaaaaggtgggatgccctgtgggtgacgcagctcgcatggcccagtgcctgaaggtaacagatcccagagccttaaccttggcctacaaagtgcccctcgccggcttggagtatcctatgctacattatgtgggattcgtccctgtcatcgatggcgatttcatcccagctgatccgatcaatctatacgcgaatgccgccgacatcgattacatagccggtaccaacaacatggacggtcatattttcgcgagcatcgacatgccagctataaacaagggcaataagaaagtgacggaggaggacttctacaaactggtgtctgaatttaccatcacaaaaggccttaggggtgccaagacaactttcgatgtttatactgagagttgggcccaagacccaagtcaggagaacaagaaaaagaccgtcgtggactttgagactgatgtcctatttctcgttcccactgagatcgcactggcccagcacagagctaacgcgaaagaccctaacatgggcgactccgccgtccccacccattgggagccatatacaaccgagaactctgggtacctggagatcactaaaaagatgggctcttcctccatgaaaaggagcctgcgaacaaacttccttcgatactggaccttaacatacctggcactgccaaccgttactgaccaagaagccactcctgttcccccaacaggggatagcgaagctactcctgtgcctcccaccggggatagcgaaaccgcacctgtgccccccaccggagacagtggcgcaccccccgtcccacccaccggagatagcggggctccccccgtgccccccaccggagatagcggcgcaccacctgtccccccaaccggggacagcggcgctccgccggtgccgcctaccggtgacagcggcgccccaccagtccctcctaccggcgacagcggtgcgcccccagtgccacctacaggagattccggcgctccccccgtcccaccaacaggcgatagcggggcaccgcccgtgcctcccactggcgatgccgggcccccacccgtgccccccacaggcgacagcggcgctccgcccgtcccccctacgggtgattcaggggcaccaccggtgacccctactggtgattcggaaaccgcacccgtgccccctactggtgactcgggcgctccgccggttccaccgacaggagactccgaagccgctccagtccccccaacggacgattccaaagaagctcagatgccggcagtgatacgcttttag

SEQ ID NO: 110834 - DNA, 2271 bp, Artificial Sequence
  Description of Artificial Sequence: Synthetic coding sequence
atgttgactatgggccgcctgcagttggtggtgttgggcctgacgtgttgctgggcggtagcctctgcagcaaaattgggcgctgtgtacactgaaggtggattcgtcgagggcgtaaacaagaaactagggctcctgggcgactctgttgatattttcaagggcattcccttcgccgccccaaccaaagcgctagagaaccctcaaccccacccgggctggcagggcacactcaaagccaagaacttcaagaaacgatgtctccaggcaactatcactcaggattccacgtacggcgatgaagactgtctgtacctcaacatttgggtgcctcagggccgcaagcaggtctctcgagacctgccagtgatgatttggatatacgggggcgcattcctgatgggatcaggacacggagccaacttccttaacaactatttgtatgatggagaggagatagcaacccgtggcaatgttatcgtcgtgactttcaactacagggttggacctctgggcttcctgtcaactggggatgccaacctcccgggtaactatggcttgagggaccagcatatggcaatcgcctgggtgaaacggaatatcgctgccttcgggggtgaccccaacaacattactctgtttggcgaatctgccggaggcgcgagcgttagtctacagactctgtcaccctacaacaaaggcctgattaggcgggctatcagccagtccggagtcgcactcagcccttgggtgattcagaagaaccctctattctgggccaagaaggtggctgaaaaagtcgggtgtccagttggcgatgcagccaggatggcgcaatgcctaaaagtaactgatcctagagccctcaccttagcatacaaggtgcctctagctggcctggaatatcccatgctgcattacgtcggctttgtgcctgtgattgacggcgactttatcccagccgaccctatcaatctgtacgcgaacgccgctgatatagactacatagcagggacaaataatatggatgggcacatctttgcaagtatcgacatgcccgcaattaataagggcaataagaaggttaccgaagaggatttttacaagctcgtgtctgagttcactattaccaaagggctccggggcgctaagacaacatttgacgtgtatacagaaagctgggcccaagatccttcacaggagaataagaagaaaacagtcgttgatttcgagacagatgttcttttcctggttccgaccgaaatagccctggcccaacatagggccaacgccaaatcagccaagacctacgcctacctgttctcccacccttcaagaatgcctgtataccctaaatgggtcggggctgatcacgctgacgacatccaatatgtgttcggtaaaccgttcgctactccaaccggctaccgccctcaggatcgtactgtgagtaaggcaatgattgcgtattggacgaacttcgcgaagaccggcgaccccaatatgggcgattccgcagtcccaacacactgggaaccgtacacaaccgagaattctggctacctagagatcactaagaaaatgggcagcagcagcatgaagcgatctcttaggaccaactttttaaggtactggaccttgacttatctcgccttgccaacagtcacagaccaggaagcaaccccagtgccccccacaggcgactctgaagcaaccccagtccctcctaccggggattccgagaccgccccagtgccacccaccggagattccggcgctccgccagtgccacctacaggggatagcggagccccacccgtgccacccacaggagatagcggggctcctcccgtgccgccgactggcgatagtggcgcccctccagttccgcccacaggggacagtggagccccccccgttcctccaactggagactcaggagcccctcccgtcccgccgaccggcgacagcggggcccccccagtgccaccaacgggcgatagcggtgcccctccagtgcccccaaccggggatgccggccctcctcctgtgccgcccacaggcgatagcggagcacctcccgtgcccccaacgggggactcgggcgctccaccggtaactccaacgggcgattcagaaaccgcacccgtcccacctacaggagattccggtgcccccccagtgccccccacgggcgattctgaagcagcccccgtgccccctactgatgactctaaagaagcacagatgcccgctgtgatccggttctag

SEQ ID NO: 110835 - DNA, 1707 bp, Artificial Sequence
  Description of Artificial Sequence: Synthetic coding sequence
atgtggttaagagcattcattctggccacgctgagcgcatccgcagcttgggccggtcacccctcatcacctcctgtggtagatactgttcacggcaaggtcctgggaaaatttgtgtccctcgaaggttttgctcaacccgtggccattttcctcggtatcccctttgcaaaaccgccattgggaccactgcgctttaccccacctcaacctgctgagccttggtcgtttgttaagaacgccacctcttatccacccatgtgtactcaggaccctaaagcaggacagctcctcagtgagctgtttacaaaccgcaaggagaatattccgttaaagttgtcggaggattgtctgtatcttaatatctacacacctgccgaccttactaagaaaaaccgccttcctgtgatggtgtggattcacggtggaggtctgatggtgggagctgcctctacgtatgacggcctagctttggcagcccatgagaatgtggtcgtggttaccatacagtacagactggggatttggggctttttctctactggggacgagcactcgcggggcaattggggccacctcgatcaagtggccgcactgagatgggtgcaagataatatcgccagctttgggggcaatccaggctcggtgaccatttttggggagtctgctggcggggagtccgtgagcgtcctggtgttgagccctttagcgaaaaatctctttcatcgcgccattagcgaaagtggcgtagctttgacatctgtactggtgaaaaaaggcgacgttaagcccctcgcagagcagatcgctatcaccgccggatgtaaaaccactacttccgccgtgatggtccactgcctgaggcagaagaccgaagaggaattattggaaacaaccttaaaaatgaagttcctgtctctggatctgcagggagacccacgggagagccagcctctactgggcactgtaatcgatggaatgctcttgttaaagaccccagaggaactgcaagctgagagaaatttccacacagttccttatatggtaggtataaacaaacaggagttcggatggcttatcccaatgcagctgatgagttatcccctcagtgagggccagctcgatcaaaaaaccgctatgtcactactgtggaagtcctaccccctcgtctgtatcgccaaggagcttattcctgaagcaacagaaaagtatcttggcgggaccgatgacaccgttaagaagaaggatttatttctggatctcatcgcagacgtcatgtttggcgtgccatccgtgatcgtcgccaggaatcatagagacgccggcgcccccacctatatgtacgagttccagtatcgccctagcttctctagcgatatgaaaccaaaaaccgtgataggagatcacggtgacgagttgttctcagtgttcggcgctccatttctgaaggagggcgcctctgaggaagagattcgcctctctaaaatggtgatgaagttctgggccaactttgctcggaacggcaacccaaacggtgagggccttcctcactggcccgaatataatcagaaggagggatatctgcagattggcgccaacacgcaggcagctcagaaacttaaagacaaggaggtagctttctggactaatttatttgccaagaaggctgtggaaaagcccccacagaccgagcacatcgaactatag

SEQ ID NO: 110836 - DNA, 1704 bp, Artificial Sequence
  Description of Artificial Sequence: Synthetic coding sequence
atgtggctcagggccttcatcctggctacattgtctgcttccgctgcttggggccacccaagttctccaccggttgtcgataccgtacacggcaaagtgctgggtaagttcgtcagcctggagggatttgcccagcctgtggcaatatttctcggcattccattcgcaaagccccctttgggtcctctacggtttacacctccccaacccgccgaaccctggtccttcgttaaaaacgcgacgagctaccctccaatgtgtacccaggatcctaaggcaggccagctgctttctgagctgttcacgaaccgtaaagagaatatccccctcaaactgagtgaagattgtttgtaccttaacatctacacacctgccgatcttactaagaaaaatcgtctgccggtcatggtgtggatccacgggggaggcttaatggtgggagctgccagtacttacgacggcctggctcttgccgctcacgaaaatgtggtggtagtcacaattcagtatagactgggaatatggggatttttctctacaggagatgaacattccagggggaactgggggcacctggaccaggttgccgctctgcggtgggtgcaggataacatcgcatcctttgggggaaatcccggatccgtgacaatctttggcgaaagcgccgggggggagtccgtctcagttctagtactgtccccactggccaaaaatctgttccaccgagctatatccgaaagtggagtggccctgacaagtgtgctcgtaaagaagggtgatgtgaagcccctcgcagagcagatcgcaatcaccgcaggatgcaagacaactactagcgccgtcatggtgcactgtcttcgacagaagactgaggaagagctgctcgagaccacgctaaagatgaagtttctgtccctggatctgcagggcgaccctcgcgagtcacagcctctgctgggaacagtgattgacgggatgttgctgctgaaaactcccgaagagctgcaggctgaacgcaatttccatacagtcccgtacatggtcggtatcaataagcaggaattcgggtggcttataccgatgcagcttatgtcatacccattgtccgagggccagctggaccaaaaaacagccatgtccctcttgtggaaatcctatcctctagtgtgcatcgccaaggagttaatacccgaggccaccgaaaagtacctggggggcaccgacgacacagtaaaaaagaaggacctcttcttggacttaattgctgatgtgatgttcggggtgccttcagttatcgtcgcgcggaatcacagagatgccggggcacctacctacatgtatgagttccagtatcgccctagtttttccagcgatatgaaacccaaaaccgtgatcggggatcacggtgatgaactgttttcggtgtttggggcaccttttctaaaggagggcgccagtgaggaagaaattcgcctaagtaagatggtgatgaagttctgggctaatttcgctaggaacggtaaccccaatggtgaagggcttccacactggccggagtataatcagaaagagggctatttacaaatcggggctaacacacaagcagctcagaagctaaaggataaggaggtcgccttttggaccaatctctttgccaaaaaagcagtcgaaaagcctccccagaccgagcatatcgaattatag

SEQ ID NO: 110837 - DNA, 1701 bp, Artificial Sequence
  Description of Artificial Sequence: Synthetic coding sequence
atgtggttgcgcgccttcatactggccactttaagtgcgagcgccgcttgggggcatccatcttcacccccagtagtggacactgttcatggaaaagtgcttgggaaatttgtatcactggagggttttgcacagcctgttgctatttttctgggcattccttttgctaaacctccgctcggaccattgagatttaccccgccgcagcccgccgagccgtggagtttcgtgaaaaacgcgacctcatatccacccatgtgcacccaggatcccaaagccgggcagctgttatctgaactgttcacaaatcgaaaagagaacattcccctgaaactatccgaagactgcctgtacctgaacatctacacacctgctgatcttacaaagaaaaatcgactgccagtaatggtttggattcacgggggtggcttaatggtgggagccgcttccacttacgatggcctagctctcgccgcccatgagaatgtcgtggtggtgaccatccaatacaggctgggaatttggggctttttctccacaggagacgagcattcccggggaaattggggtcacctagatcaagtggcagctctcaggtgggtacaggacaacattgcatcattcgggggcaacccaggttcagtaaccatctttggagagtccgctggcggagagagcgtctccgtcttagtcctgtccccactggctaagaatctatttcatcgggccatatccgaatccggagtcgctctgacaagcgtgttggtgaaaaagggcgatgtcaaacccttggctgaacagatcgccatcacagcgggatgtaagacgactactagcgccgtaatggtgcactgcctgcggcaaaaaaccgaagaggagctgctcgagactaccttgaagatgaaattcctgtctctagatctccaaggggaccccagagagtctcagcccctcctgggcacagttatcgacggcatgctcctactgaagacccccgaggaactgcaggcagagcgcaacttccacacagtcccctatatggtgggtatcaacaagcaggagttcggctggctgattcccatgctgatgagctaccccctttcagaaggccagctggaccagaagacagcgatgagcctcctgtggaaatcttaccccctcgtctgtattgctaaggagttgattcccgaagctactgagaaatatctcggaggaacggacgacacagtgaagaaaaaggacctttttctggatctcattgccgatgtaatgtttggagtcccgagtgtaatagttgctagaaaccacagggacgcgggtgctcccacgtatatgtatgagtttcagtatagaccgagttttagcagtgacatgaagcccaaaaccgtgattggtgaccatggcgatgaattattctctgtgtttggtgcgccctttctcaaggagggcgcctccgaggaggagatccggctgtcgaaaatggtgatgaaattttgggccaactttgctcgaaacggtaatcccaatggagaggggttaccccactggcctgaatacaaccagaaggaaggctatcttcaaatcggagcaaacacacaggctgcccagaagctgaaggataaggaggtcgccttctggacaaatctctttgctaagaaagctgttgagaagcccccacagacggaacatatagaactttag

SEQ ID NO: 110838 - DNA, 1299 bp, Artificial Sequence
  Description of Artificial Sequence: Synthetic coding sequence
atggtgtggatccatggcggcggtcttatggtcggggcggcaagcacttacgacggactggccctcgctgcccacgaaaatgtcgtagtcgtcacaattcagtatcgcttaggcatttggggctttttctccactggcgatgagcattctcgcggaaactgggggcaccttgaccaggtcgccgcacttcgatgggtgcaggataacattgcaagtttcggagggaatccagggtcggtgaccatttttggcgagtctgccggcggcgaatccgttagcgtattggtcctgtcccctctggccaagaatctgttccaccgcgcaatcagcgagtccggggtggccctgacatccgttctggtgaaaaagggggatgtgaaaccgcttgccgaacaaattgctatcacggcgggatgcaagacaacaacttccgcagttatggtgcattgccttcgccagaaaacagaggaagagctgctcgagaccaccctcaaaatgaagtttttatcgctggatcttcagggagatccacgggaaagccagcctctgctgggcactgtcatcgatggcatgctgctactgaaaacccccgaggagctacaggccgaaagaaactttcacactgtgccctacatggtgggcattaataagcaggaattcggatggttaattcctatgcagcttatgtcttatccattgtctgaaggacagctcgatcaaaaaacagcaatgtctctgctctggaagtcctacccgcttgtgtgtatcgccaaagaacttatacctgaggctaccgagaaatacctcggcgggacagacgataccgtgaagaagaaggacctgttcttggatctcattgccgatgtaatgttcggcgtcccttcagtgattgtagcgaggaatcacagagatgctggagccccaacctatatgtacgagtttcagtatagaccatctttttccagtgacatgaagcccaaaactgttatcggcgatcacggagatgagctgttctccgtcttcggtgccccattcttgaaggaaggggccagtgaagaggaaattagactctccaagatggtgatgaagttttgggccaacttcgcccgtaacggcaacccaaatggcgaaggcctgcctcactggcctgaatataatcagaaggagggttatctgcagatcggagcgaacacgcaggcagcccaaaagcttaaggacaaggaggttgccttttggacgaatctcttcgccaaaaaggccgtcgaaaaaccccctcagactgagcacattgagctctag

SEQ ID NO: 110839 - DNA, 1716 bp, Artificial Sequence
  Description of Artificial Sequence: Synthetic coding sequence
atggagcgagcagtgcgcgtggagtctggagtgctcgtcggggtcgtttgtctgctcctggcatgccctgctacggcaaccggtcctgaggtggcacagccagaggtagacactaccctgggccgggttagaggcagacaggtcggcgttaaaggcactgatagactggtgaatgtctttttggggatacctttcgcacagccgccgctaggacctgatcgattcagcgcacctcaccctgcccagccatgggagggcgtgcgcgatgccagtaccgcaccgcccatgtgtctgcaggatgtcgaatctatgaacagtagccgtttcgtgttgaacggcaaacagcaaatcttttccgtgtccgaggattgcctagtccttaacgtctatagtcccgccgaggtccctgcaggcagcggcaggccagtgatggtgtgggtgcatggcggtgctctgatcacaggggctgctacgtcatatgacggtagcgctcttgccgcctacggggatgttgtggtggtaacagtccaatacagactgggagtgctcggctttttctccacaggtgatgaacacgccccaggaaaccaggggtttttagatgtggtagctgctctcagatgggtgcaggagaacatcgcccctttcgggggcgatctgaattgtgtcaccgtgtttggagggtcggcaggagggagcataatctccggattggtcctgtccccagtggccgcaggtttatttcaccgcgctatcactcaatccggggtaataacgacacccggtattatcgactcccacccatggcctttggcccaaaagatcgctaacaccctggcttgctcctccagcagccctgctgaaatggttcagtgtctgcagcagaaggaaggagaggaactcgtactgagtaaaaagctgaaaaacactatttatcccttgaccgttgatggcaccgtgtttcccaaatctcctaaggagctattgaaggaaaaacccttccactctgtgcccttcttaatgggggtcaacaaccacgaattcagctggctgataccccgcggctggggattattggatacaatggagcagatgagcagagaggacatgcttgctatttctacccccgtccttaccagtctagacgttccaccggaaatgatgccaacagttattgatgagtacctcggatccaactccgatgcccaggctaagtgtcaagcttttcaggaatttatgggagacgtcttcataaacgtgcccaccgtgtcattttcacggtacctgcgggacagtggatcccccgtgtttttttacgagttccagcatcgcccgtcttctttcgccaaaataaaacctgcttgggtgaaggcggaccacggtgctgagggcgccttcgtgttcggtgggccattcttgatggacgaaagtagccgtttggcattccctgaggcaacagaggaagagaagcagttgtccttgactatgatggcccagtggactcatttcgctcggaccggagacccgaactcgaaagccctgcccccttggccccagttcaatcaagctgagcaatatttggagattaacccagtaccccgggcggggcagaaatttcgagaagcatggatgcagttctggtccgaaactttaccgagcaagattcagcagtggcatcaaaagcaaaaaaacaggaaggctcaagaagacctgtag

SEQ ID NO: 110840 - DNA, 633 bp, Artificial Sequence
  Description of Artificial Sequence: Synthetic coding sequence
atggagcagatgtctagggaagatatgctggccataagcacacctgtgttaactagcctggatgtacctcctgaaatgatgcctacggttatcgacgagtatttggggagcaattcagacgcccaagcgaagtgccaggcgtttcaagagtttatgggagatgtgttcattaacgtgccaaccgtgtcattttcccggtatctccgcgatagtggaagccctgtcttcttttacgaatttcaacaccgcccgagttccttcgccaaaataaagccagcatgggtgaaggcagaccacggcgccgaaggtgcctttgtattcggtggaccgtttctaatggacgaatcttccaggctggctttccccgaagcgacggaggaagagaaacagctgagcctaactatgatggcacagtggacgcatttcgcccgcactggggatcccaacagcaaagctctacctccatggcctcagtttaatcaggccgagcaatacctcgagatcaatcctgtgccacgcgccggtcagaaatttagggaggcctggatgcagttttggagtgagaccttacctagcaaaattcagcagtggcaccagaagcagaaaaatcgtaaagcacaagaggatttgtag

SEQ ID NO: 110841 - DNA, 1707 bp, Artificial Sequence
  Description of Artificial Sequence: Synthetic coding sequence
atggagagagctgtgagagtcgagtctggggtactcgtcggggtggtatgccttctgctcgcttgccctgctactgccaccggcccagaggttgctcaacccgaagttgatactacgctcggccgtgtgcgagggcggcaagtgggcgtgaagggtaccgatcgcctggtgaatgtgttccttggcattccctttgcccagccccccctcggcccggacaggttttcagcaccgcacccggcccagccatgggaaggagtcagggatgcgtcaacagctcctccgatgtgccttcaggatgtggaatccatgaattcctccaggttcgtcctgaacggcaaacagcagatttttagcgtcagcgaagactgtttggttctgaatgtctattcccccgccgaagtgcccgctggttcagggcggccagtgatggtgtgggtgcacgggggtgcccttataacgggagccgccacttcctacgatggtagcgccttagcagcctatggggacgttgtcgtggtgaccgtccagtatagattgggcgtgctgggattcttttctacaggcgatgagcacgcaccaggcaatcaaggattcttagatgtcgtagctgcattgcgttgggttcaggaaaatattgccccatttggcggggacttgaactgcgtcaccgtgttcggcggcagcgcaggcggttccattattagcggactcgtgttaagcccggtcgcagcaggcctgttccatagagctatcacccagagcggggttatcactaccccagggattattgatagtcacccctggccactcgcccagaagatcgcgaacacactggcttgcagctcctcttcacccgccgaaatggtacagtgccttcagcagaaagaaggggaggagctcgtgctatccaaaaagctcaagaacactatctatcctcttactgtagacggaactgtattcccgaagtcaccaaaggagctgctgaaagaaaaaccctttcacagcgttccttttctgatgggagttaacaatcacgaattcagctggttgattcctagagggtggggactcttggacaccatggaacaaatgtctagagaagacatgctggccattagcacacccgtactgacatcactcgacgtaccgcctgaaatgatgccaactgtgatcgacgagtatctcggctccaactcagacgcccaggcaaaatgtcaggcgtttcaggagtttatgggggatgtgtttatcaatgtgcctactgtaagctttagcaggtacctgagggattcaggatccccagtcttcttttacgagttccagcaccgtccatctagctttgctaagataaagcccgcatgggtcaaagccgaccacggagccgaaggcgctttcgtgttcggagggccgttcctgatggacgaatcatcaagactcgaagcaaccgaggaggagaagcaactgagtctcacaatgatggcccagtggacccactttgcccgcacaggcgaccctaactcaaaggcactacctccttggccccagtttaaccaagcagagcaatatctagagatcaatcctgtgcccagggctgggcagaagtttcgagaggcgtggatgcagttctggtccgagaccctgccatctaagattcagcagtggcatcaaaaacagaaaaaccgtaaggcgcaggaagatctctag

SEQ ID NO: 110842 - DNA, 738 bp, Artificial Sequence
  Description of Artificial Sequence: Synthetic coding sequence
atggcaaatgaagcttacccttgcccctgcgacatcggccatagattagagtacggcggactggggcgagaagtgcaagtcgaacacattaaggcttatgtaactaagagtccggtcgatgcaggcaaggcagtgattgtgattcaagacatcttcggctggcagctgcccaatactcgatatatagctgatatgattagcggcaacgggtatacaacaattgtgcctgacttcttcgtgggccaggaaccctgggacccaagtggggactggagcatctttcccgagtggcttaagacacgcaatgcacagaagattgatcgggagatttccgccatcctcaagtacctgaagcagcaatgccacgcacagaaaatcggcatcgtcggcttttgctggggagggacagctgtccatcatttgatgatgaaatactcggaattcagagcaggagtgtccgtgtacgggattgtcaaggactcagaagatatatacaatttaaagaatcccactctgttcatttttgcggaaaatgacgtcgtgataccactcaaggatgtgtccctcctgacccagaagctgaaggagcattgtaaggtggagtatcagatcaagactttttccggacagacacacggattcgtgcaccgcaagcgagaagactgttcacctgctgacaaaccttatatcgacgaggcacgccggaatctgatcgagtggctgaacaaatatatgtag

SEQ ID NO: 110843 - DNA, 1260 bp, Artificial Sequence
  Description of Artificial Sequence: Synthetic coding sequence
atgagggggctgctcgtactctctgtcctgctgggcgcggttttcgggaaggaggactttgtgggtcaccaggtcctcaggatctctgttgcggatgaagctcaggtccaaaaagtgaaagaactagaggacctggaacacttacagctggacttctggcggggacctgcccaccccggatcccctatcgacgtcagagttcccttccctagcattcaagcggtgaagatttttttagaaagccacggcatttcttacgagaccatgattgaggatgtccaatcactgcttgatgaagagcaggagcagatgttcgctttccgaagtcgggcccggtccacagataccttcaattatgcaacctatcacacactcgaagagatatacgactttctggacctgctcgttgctgaaaatcctcacctggtgtctaagatccagatcgggaacacctatgagggtcggccaatctacgtgttgaagttctcaaccggtggcagcaaacgaccagcaatttggatcgacacaggaatccactcccgcgagtgggtgacccaggcaagcggcgtatggtttgccaagaaaattacgcaggactacgggcaagatgctgccttcaccgccattctggataccttggacatctttcttgagatcgtgaccaatccagacggttttgctttcacccattctactaaccgaatgtggcggaagacccgaagccatacagcggggtcactgtgcatcggggttgacccaaataggaattgggacgccggattcggactcagcggagcttcaagcaatccgtgttccgaaacttaccatggcaagttcgcgaacagcgaggttgaagtaaagagcatcgtggattttgtgaaagatcacggcaatataaaggcttttatctctattcattcttacagccagctcctcatgtatccttatggttataagactgagccagtccctgaccaagacgaactagatcagctgtcgaaggctgcagtgaccgcactcgcttctctgtacggcacaaaattcaactatggctcaattatcaaggccatctaccaggctagtggtagtactattgactggacgtatagtcaggggatcaagtactcattcacctttgaactcagggatacggggcggtatggctttctgttacctgcatcgcagatcatccccaccgccaaggagacctggttggccctcttgaccatcatggagcacaccctcaatcacccatattag

SEQ ID NO: 110844 - DNA, 1098 bp, Artificial Sequence
  Description of Artificial Sequence: Synthetic coding sequence
atggatcgcgctgccctcctaggtctcgctcgactctgtgcactgtgggcagccctactggtgcttttcccttacggagcacaaggaaattggatgtggctgggcattgcctcatttggcgtacctgagaagctggggtgcgccaacctgccactgaatagccgccaaaaggagctgtgcaagagaaagccttacctgcttccctctatacgggaaggcgccaggcttggaattcaggaatgtggcagccaattccgccacgaacggtggaactgcatgatcacagcagccgctacgactgctccaatgggggcgtccccgctgttcgggtacgagctgtcctccggcaccaaggagacagcctttatatacgcagtgatggctgctgggctcgtgcattccgttactcgctcctgtagtgccggtaatatgactgaatgcagctgcgatacaacattgcagaacggtggatccgcttctgagggatggcactggggggggtgcagcgacgacgtccagtacggcatgtggttcagcagaaagtttcttgattttcccattggaaataccaccggtaaggagaataaggttctgctcgctatgaatcttcacaacaatgaagctggacgccaagcagtggccaagctgatgagcgtggactgtagatgccacggagtgtcgggaagttgtgcagtgaaaacttgctggaaaacgatgtcgagcttcgagaaaataggccacttgctcaaggataaatatgagaatagcatacagattagcgacaaaacaaaacggaaaatgcgtaggcgcgagaaagaccagcgtaagattcccatccacaaagacgacctgctttatgttaacaaaagtcccaattattgtgttgaggacaagaagttggggataccgggaacacaaggcagagagtgcaatcggacgagtgaaggggcagatggttgtaacttgctttgctgcggaagaggttacaatacacacgtggtgcggcacgtggaacggtgtgagtgtaagttcatttggtgctgctacgttcgttgcagaagatgcgaatcaatgaccgacgtgcacacctgcaaatag

SEQ ID NO: 110845 - DNA, 1254 bp, Artificial Sequence
  Description of Artificial Sequence: Synthetic coding sequence
atgcgccttatcctgcccgtaggccttatagccacaactctggcaattgcccccgtgcggtttgatagagaaaaggtgtttagggtgaagccacaagacgaaaagcaggcagacatcattaaggacctcgccaaaacgaacgagctggacttctggtaccctggtgccacacatcacgtggccgctaatatgatggttgacttccgagtgagcgaaaaagagtcacaggccatccagtctgccctggatcagaacaaaatgcattatgagatactcattcacgatctgcaggaagagattgagaagcagtttgacgtcaaggaagatattcctggtcgccactcatacgcaaagtataataattgggagaaaatcgtcgcgtggactgagaagatgatggataaataccccgagatggtgtctcggatcaagatcgggtctacagtcgaagataacccactctacgtgttaaaaatcggcgaaaaaaatgagcgccgcaaggcaatcttcaccgattgtgggattcatgctcgtgaatgggtaagccccgccttttgccagtggttcgtgtatcaagctacaaaaacatatggccggaacaagatcatgaccaagttgctggataggatgaacttttacatccttcctgtatttaacgtggatggttatatttggtcctggactaaaaatcgcatgtggaggaaaaaccgatccaaaaatcagaattccaaatgcatagggacagacctcaatcgcaactttaatgcctcttggaatagcattcccaacactaatgatccgtgtgctgacaactacagaggctctgcgccggagagtgaaaaggaaaccaaggccgtgactaacttcatcaggtctcacctgaatgagatcaaagtgtatattacattccacagctactcgcaaatgctgctcttcccgtacggatatactagcaagctgccacccaatcacgaagatcttgcaaaagtggctaaaatcgggacggatgtactgtcgacccggtacgagacaagatacatatatggtcctatcgagtcaacaatctatcccattagcgggagcagtctcgactgggcttacgatctcgggatcaagcatactttcgcttttgaactgagagacaagggcaaattcggcttcctgcttcccgagagcagaatcaagcctacatgtcgcgaaacgatgcttgctgtgaagttcattgccaagtacatactgaagcacacctcatag

SEQ ID NO: 110846 - DNA, 1260 bp, Artificial Sequence
  Description of Artificial Sequence: Synthetic coding sequence
atggctatgaggctgattctattctttggcgcactgttcggccatatttattgtttggaaaccttcgtgggcgaccaagtgctggagatcgtaccctctaacgaagagcagattaagaacttactccagctcgaagcccaggaacaccttcagcttgacttctggaagagccctaccacaccaggagaaactgcacatgtacgcgtgccatttgtcaacgtacaggccgtgaaagtgtttctggagtcacaggggattgcctacagcatcatgattgaagatgtccaggttctcttggacaaggagaatgaagagatgctgtttaatcgccgtagggagcggagcggtaatttcaattttggtgcataccacacattggaggagatctctcaggagatggacaatctcgtggcggagcaccctgggctcgtgagcaaggtgaacatcgggagctcattcgaaaaccggcccatgaacgttctaaagtttagcacgggcggggataaaccggccatctggttagacgccggaatacatgcacgggaatgggtgacccaggctaccgccttgtggacagccaataaaattgtatcagattacggcaaggacccaagcataaccagcatcttggatgcacttgatatatttctcctgcctgtgaccaatccagacggctatgtttttagtcagacaaaaaatcgaatgtggcggaagacgcgcagcaaggtatctggctctctgtgcgtaggtgttgaccccaacagaaactgggatgcagggtttggcggccccggagcatcctctaatccatgtagcgacagctaccatgggccttcagccaactctgaagtggaagtcaaatctatagtcgacttcatcaaatctcatggtaaggtgaaggcttttatcactttacacagttattcccagctcctcatgttcccatatggttataaatgtaccaaactggatgattttgacgagctgtccgaagtggcccagaaggcagcacagagcctgcgttcgcttcacggcactaagtataaagtgggacctatctgtagcgtcatttatcaggcctccgggggctctatagattggagttacgactatggcattaagtatagcttcgccttcgagctgcgagacacaggacgatacggtttccttctccctgctcgccagattctgcccaccgctgaggagacctggctggggctgaaggctattatggaacatgtcagagaccacccttactag

SEQ ID NO: 110847 - DNA, 1167 bp, Artificial Sequence
  Description of Artificial Sequence: Synthetic coding sequence
atgaggtggattttgttcatcggagcccttattggatcttccatttgcggccaggagaagtttttcggcgaccaggttcttaggatcaatgtccgtaatggagatgaaatttccaaactttctcaactcgtgaattccaataatctcaagctgaatttctggaaatccccctcatcttttaaccgccccgttgacgttttagttccgtcagtttccttgcaggcattcaaatcctttctgaggtcccaagggctcgaatacgctgtcaccatcgaggacctccaaatttaccacgagatggataatatcgccgccgacttccccgatctggcccgccgcgtgaagattggccattcctttgagaatagaccaatgtacgtcctgaaattttccacagggaaaggtgtaagacgcccagccgtgtggctgaatgccgggatccattccagggagtggatctctcaagcgacagcaatctggacggctaggaagatagtcagtgattatcagagggatcctgcaataactagtattcttgagaagatggacatctttctccttcctgtcgctaaccctgacggatacgtctacacacagacccaaaatcgtctgtggcgcaagactaggtctcggaaccccggttcttcttgtataggtgccgacccaaaccgcaactggaatgcctccttcgccggcaagggcgcctcagacaacccatgcagcgaagtataccacggcccccatgcaaacagcgaggtcgaggtcaaatctgtggtggacttcattcagaagcacggcaacttcaagggtttcatagacctccactcctatagccagctgttgatgtatccgtacggttatagtgtgaagaaagcgccagatgccgaagaattggataaggtcgccaggcttgccgccaaggctctcgcatcggtcagtgggacagagtaccaggtgggtccaacttgtaccactgtatacccggccagtggaagctccatcgactgggcgtatgataatggtattaaattcgcattcactttcgagctgagagacaccggcacttacggctttctcctgccggcaaatcagatcattcccaccgcagaggaaacatggctcgggcttaaaacaatcatggagcatgttagggacaacttatactag

SEQ ID NO: 110848 - DNA, 681 bp, Artificial Sequence
  Description of Artificial Sequence: Synthetic coding sequence
atgaagatcgtgtccgattaccagcgggaccctgcaattactagtattcttgagaaaatggacatcttcttactcccagtggcaaaccccgatggctatgtttacacccagacacaaaaccgcctctggagaaaaacacggtctcgaaatcctggctcctcctgcatcggtgccgacccaaatcggaactggaatgcctcttttgccggaaagggagcaagtgacaacccctgtagtgaggtgtaccacggtcctcacgcaaatagtgaagtggaagtcaagtcagttgttgatttcattcagaaacacggtaactttaaagggtttatagacttgcatagttatagccaactgctgatgtatccctacggatatagcgttaagaaggccccagatgccgaggagctcgataaggttgcgcgcctcgccgcaaaggcactcgcttcagtttctgggaccgagtatcaggtaggaccaacatgtactaccgtataccccgcctcaggtagctctatagattgggcatacgacaacggcatcaagttcgcttttactttcgaacttagggatacagggacctacggattccttctccccgctaaccaaattatccctacagccgaggaaacttggcttggtctcaaaactattatggaacatgtgcgggataatctatactag

SEQ ID NO: 110849 - DNA, 582 bp, Artificial Sequence
  Description of Artificial Sequence: Synthetic coding sequence
atgcatcacctaaacaaaacgcactccggccttatccacatgttttcaatcgggcgcagttacgaaggcagaagcttgtttatcctcaagctgggccgccgtagccgtttaaaaagagccgtgtggatcgactgtggtatccacgcccgcgagtggatcggccccgccttctgccagtggtttgtgaaggaggcactgctaacatataaaagtgatccagcaatgcgcaaaatgctgaatcacctctacttctatattatgccagtgtttaatgtcgacgggtatcatttttcctggacaaacgatcgattctggcggaagacccgttcccgcaattcacggttccgctgtagaggggtggatgcgaatagaaactggaaagtcaaatggtgtgatgttagctctggcagttctatggattgggcctacaaaaatgggatcccatacgctttcgcctttgaattacgcgacaccggctacttcgggtttcttctgcctgagatgcttatcaagccaacatgcaccgagacaatgctggccgtgaagaacattaccatgcacctgttgaagaagtgcccctag

SEQ ID NO: 110850 - DNA, 1314 bp, Artificial Sequence
  Description of Artificial Sequence: Synthetic coding sequence
atgaagtgcttagggaagagacggggacaagctgcggcgtttctcccactgtgttggctgtttctcaagattctgcagccaggccactcacatctgtacaacaacagatacgcaggtgataaggttattcgctttatcccaaaaaccgaagaggaggcctatgctctgaaaaaaatcagctatcaacttaaggttgacttgtggcaaccctctagcatctcttatgtgtccgagggcacggtcactgacgtgcatatcccacagaacggctccagggcactgctggcctttttacaggaggccaatattcaatataaagttctgatcgaagatctccagaagactttggagaagggaagcagtctccatacacagagaaatcggcggagcttgtccggttacaattacgaggtttaccactcactcgaagaaatccaaaactggatgcatcacctaaacaagacacacagcgggctgattcacatgttttctatcggccgcagctacgagggaaggagcttatttattctgaagctcggacgccgtagtcgtctgaagcgcgcagtttggatcgattgcgggattcatgcacgcgagtggatcggtcccgcgttctgccaatggtttgtcaaggaagccttgctgacctataagtcggacccagctatgcgaaaaatgttgaatcatctctacttttatattatgcccgtgtttaatgtggatgggtaccatttttcctggaccaacgacagattctggcggaaaactcgatcaaggaactctcgctttcgctgtcggggtgtggatgccaatcgcaactggaaggtaaaatggtgtgatgagggcgcatccatgcacccctgcgacgacacgtactgcgggcctttccctgagtctgagccggaggtgaaggctgtggccaacttcctgcgcaaacatagaaaacacatcagggcttacctgagtttccacgcatacgctcagatgctgctctatccctactcgtacaagtatgccactattccgaactttcgatgtgtggagtccgcagcctataaggccgtgaacgcccttcagtcagtttatggagtgaggtacaggtacgggccagcctccacgaccctctatgtgtctagtggcagttcaatggactgggcctacaaaaatgggatcccgtatgcctttgcctttgagctgcgggataccggatattttgggttcctgctacctgaaatgctcatcaaacctacatgtacagaaactatgttggctgtgaagaatatcactatgcacctgctgaagaagtgtccctag

SEQ ID NO: 110851 - DNA, 948 bp, Artificial Sequence
  Description of Artificial Sequence: Synthetic coding sequence
atgaagtgcctaggtaagaggagaggtcaagccgccgcctttttaccactgtgctggctttttctgaaaattttacaacctgggcactcccatctgtacaacaatcgctacgctggggataaggtgatcagattcattcccaagacagaggaagaagcatatgcattaaaaaagatctcctaccagctcaaagttgacctgtggcagcctagcagtatctcatacgtgtctgaagggaccgttaccgatgtgcacatcccacagaacggaagtagggctctgttagcgtttctgcaggaagctaacatccaatacaaggtactcattgaggatctgcaaaagacactggagaaagggagttcactccatacgcagcggaacagacggagcttgagcggatacaattatgaggtgtaccatagcctagaggagattcaaaattggatgcaccatctcaataagacgcatagcgggctcattcatatgttttcgattggcagatcctacgagggccgcagcctcttcattctcaagctgggcaggaggtctcgattgaagcgcgccgtgtggatcgattgcggcatacatgctagagagtggatcgggccagccttttgtcagtggttcgtcaaagaagccctcctgacatacaagagcgaccccgccatgcgtaaaatgttaaatcatttgtacttctatatcatgccagtgtttaacgtcgacgggtatcatttctcatggacaaatgatcgtttctggcgcaagactcggtcacgaaatagtcggttccgttgtcggggcgtcgacgccaaccgcaattggaaagtcaagtggtgtggcaaatttgggaccaattgggacccagaccccaaggtgtctgccgggtttacacttcaaaacatgtctcctgaagactctcacggcaggctgatgttcttctgcatgtag

SEQ ID NO: 110852 - DNA, 1272 bp, Artificial Sequence
  Description of Artificial Sequence: Synthetic coding sequence
atgaagctttgttccctcgctgtgctggtaccaattgtactgttttgcgagcaacatgtattcgccttccagtcaggccaggtgctcgctgctctgccacgaacatctcgacaggtgcaagttctccaaaatctcactacgacttacgagatcgtactttggcaacctgtgacggccgatttaatcgtcaagaagaagcaagtgcactttttcgtaaatgcctcggacgtggacaacgtgaaagcccacctgaatgtgtctggaatcccttgttccgtactgcttgcagatgtagaagatcttatccagcagcaaattagcaatgatacagtcagccctcgagcctccgcaagctactatgagcagtaccatagcttgaacgaaatatatagctggattgaattcattacagagaggcatcccgatatgcttacaaaaatacatattgggtcatcattcgagaaatatcccttgtacgtcttgaaggtgagcggcaaggagcaggctgcaaagaatgctatttggatcgattgtggaattcacgcacgcgaatggatcagtccagccttctgtctttggttcatcggccacattacccagttctatggaattattgggcaatacaccaacctgctcagactggtggacttttacgtgatgccagtggtgaacgtagatggatatgactatagctggaaaaagaatcgcatgtggagaaaaaatcggtctttctacgccaataatcattgcattggaacagacttgaacagaaattttgcatcaaaacactggtgtgaagagggagcaagttcttcctcttgcagcgaaacatactgtggcctgtaccccgaatcggagcctgaagttaaggctgtagcgagtttcctgcggcggaatatcaatcagatcaaggcgtacatctcaatgcactcttacagccagcatatcgtcttcccctattcctacacccggtctaaaagtaaagatcatgaagagctgagtctggtggcgtcggaggctgtgcgagcaattgaaaaaatttctaaaaacacccgctacacccacggtcatggctctgagactctgtacttggcaccaggcggcggagatgattggatctatgacctgggcatcaagtactcattcactatcgaactacgggacaccgggacctatgggtttttgctacctgaacggtatatcaaaccgacttgccgtgaggccttcgccgcggtttccaaaattgcgtggcatgtgattaggaacgtatag

SEQ ID NO: 110853 - DNA, 1083 bp, Artificial Sequence
  Description of Artificial Sequence: Synthetic coding sequence
atgaagctctgttcactcgcggtgctggtgcccattgtactcttttgtgagcagcatgtcttcgcttttcaaagcgggcaggttcttgcggcacttccaagaacttccaggcaggtacaggtgctccagaacttaactacaacgtacgaaatcgtattgtggcaaccagtcaccgcagatttgatcgtgaagaagaaacaggtccacttttttgtgaatgcatctgatgttgacaacgtaaaggcacacctgaacgtttccggtatcccctgttccgtgctgctagcagatgtagaagatttgatccagcagcagatcagtaatgatactgtctctccacgagcaagcgcaagctactacgagcagtaccacagcttgaatgaaatatattcctggattgaattcatcactgaaagacaccccgacatgctcacgaagattcacattgggtcatcctttgaaaaatatcccctgtacgttctcaaggtgagcgggaaagaacaggcggcaaaaaatgccatctggattgattgtggcattcacgccagagaatggattagcccggccttctgcctatggtttatcggacacaatcgtatgtggagaaagaatagaagcttttacgctaataaccactgtattggtacggacctcaacaggaacttcgcctccaagcactggtgtgaggagggcgctagtagcagctcctgtagtgaaacctactgcggactatatcctgagagcgagcctgaagtcaaggccgtggcaagctttttacgtcggaatatcaaccaaatcaaggcctatatctctatgcactcctatagtcagcatatagttttcccttacagttacacgagaagcaaaagcaaagatcacgaggagcttagcttagtcgccagcgaggccgttagggccattgagaagatatccaagaacacccgttacacccatggacacggctctgaaactctttacttggcaccaggtggtggtgacgactggatatatgatctggggataaaatatagcgtaacatctaacccgccggtggagaaactgctgcccctctctctgaaatag

SEQ ID NO: 110854 - DNA, 849 bp, Artificial Sequence
  Description of Artificial Sequence: Synthetic coding sequence
atgttgcctctgttacggtgcgtgcctcgagtgctcggttcaagcgtggccgggttgagagctgccgcccccgcctcaccatttcgccagctgttgcagcccgctccccgactgtgcacacgccctttcggtttgttgtcagtccgcgccggtagcgaacgcagacccgggctgctaagaccgcgcgggccctgcgcttgtgggtgtggatgtggcagcctccacacggacggggataaggcctttgtggattttctgagcgacgaaatcaaggaggaacgcaagattcagaaacacaagacactaccaaaaatgagtgggggatgggagttggaactaaacggcaccgaggctaaactggtgcgcaaagtggcaggagagaaaattaccgtgacctttaacatcaacaatagcatacctcccacattcgatggagaggaagagcccagccagggccagaaagtcgaagagcaggaacctgaactgacctccaccccaaatttcgtggtagaggtcattaagaatgacgatggcaagaaagctctggttttggactgccattacccagaggatgaagtcgggcaagaggatgaggcggaatctgacatcttttcgatccgggaagtgagcttccaatctacaggcgaatccgagtggaaggacactaactacacattgaataccgatagtctcgactgggctttgtatgaccacctgatggattttctggctgaccgaggcgtggataacacgtttgctgatgaactagtggaattgtccaccgctctcgaacaccaagaatatatcaccttcctggaagatctgaagagcttcgttaaaagtcagtag

SEQ ID NO: 110855 - DNA, 3402 bp, Artificial Sequence
  Description of Artificial Sequence: Synthetic coding sequence
atgcgctttgtgctttccggtaatctgcatggtggtagcgtcgtagcttcttaccctttcgacgattctccggaacataaggccactggcatctactctaagacaagtgacgatgaggtgtttaagtacctcgctaaggcatatgcgagtaatcatcctatcatgaaaaccggcgaaccccactgtccgggcgacgaagatgagacgtttaaggatggcatcaccaacggcgcgcattggtatgatgtggagggtgggatgcaggattacaactatgtgtgggcgaactgcttcgagatcaccttggagctttcctgctgcaaatacccccctgcctcacagctccgacaggaatgggaaaataatagggagtctctcattactcttattgaaaaagtacatataggcgtgaaagggttcgtcaaggattctataaccggctcgggcctggaaaacgctactatatctgtggcagggatcaatcacaatataacaacaggtcggtttggtgatttctaccggttactcgttccaggaacatacaatttaaccgtggttctgacaggctatatgcctctcacagttaccaacgtcgttgtcaaggagggaccagcgactgaggtggatttctctctccggcctacggtaacaagcgtgattcccgacacaactgaggccgtgtccactgcgagcacagtggccatcccgaacatcttgagcggcacaagtagcagttatcagcctatacaacccaaagacttccatcaccaccattttcccgacatggagatcttcctcagaaggtttgctaatgaataccctaacattacccggctctactctctgggtaagagtgtagaaagtagggaactgtacgtgatggagatcagcgacaatcccggggttcacgaaccaggcgagccagaatttaaatacatcggcaacatgcatggcaacgaagtcgtaggaagagagttactgttgaaccttattgagtacttgtgtaagaattttgggactgatcctgaggtgactgatctggttcacaacactaggattcaccttatgccctccatgaacccagatggttatgagaaaagtcaggaaggtgattccatcagcgtcatcggacgaaacaactccaataatttcgacttgaataggaattttccagatcaattcgtccagataaccgacccaacccagcccgaaacaattgctgtgatgagctggatgaaaagttatccatttgtgctcagcgccaacctgcacggcggctccctggttgtgaactaccccttcgacgacgatgagcagggcttggccacttattctaaatctcctgatgacgccgtttttcagcagatagcacttagttacagtaaagaaaattcccagatgttccagggacgcccttgtaaaaatatgtatcccaatgagtattttcctcatgggatcaccaacggcgcctcttggtataatgtccccggaggcatgcaggattggaactacctccagacaaactgctttgaggttacaattgagttgggatgcgtgaaatatccgctggaaaaggaacttcccaatttctgggagcaaaaccgccgttccttgatccaatttatgaaacaggttcatcagggagtcaggggattcgtactcgatgcaacagacggtcgtggcattctgaacgctactatctcagtcgccgaaataaaccatcccgtgaccacctataagaccggggactattggcggttgctggtgccggggacatataaaattacagcatctgcacggggttacaatcccgttacaaaaaatgtcaccgtgaagtccgaaggcgcaatccaagttaacttcaccctggtgagatcatccaccgattcaaacaacgaaagcaagaaaggaaagggggcttcgagctccacaaatgatgcatcagacccgactacaaaagagttcgagactctgatcaaggatttgtcagccgagaacggtttggaatccctcatgcttagatcaagctccaatctcgcattggctttgtataggtaccactcttacaaagacttaagcgagttcctgaggggccttgttatgaactatcctcatatcacaaacctcacgaacctgggacagagtacagagtatcgccacatttggtctttggagatctcaaacaagcccaatgtttcagaacccgaagaacccaaaatcaggtttgtggccggcatccacggcaacgcccctgtcggtaccgaactgctgttggctctggccgaattcctgtgcctgaattacaagaaaaaccctgcagttacacagcttgtggataggactcgtattgtcatcgtcccatcacttaatcccgacggtcgtgagcgtgcacaggagaaggactgtacttcaaaaatcggccagactaatgcaagaggcaaggacttggacaccgattttacaaataacgcctcccagcccgaaacgaaggccattatcgagaacctgatccagaaacaagattttagtctttccgtcgctcttgacggtggctccatgctggttacttacccgtacgataagcccgtgcagactgtcgagaataaggaaacactgaagcatctggccagcctgtatgccaataaccacccgtccatgcatatgggccagccatcttgtcccaacaagtctgacgagaacatcccaggaggggtgatgcggggtgccgagtggcacagccaccttggttccatgaaggattactccgtgacatacggccattgcccagaaatcaccgtttatacgtcctgctgttacttcccatctgccgccaggctgccatctctgtgggccgacaataagaggagtctgctctcaatgttagttgaagtgcacaagggcgtccatgggttcgtaaaggacaagacggggaaacccatctcaaaagcagtcatagttctgaatgaggggatcaaagtgcaaacaaaagaagggggatacttccacgtgcttctggcgccgggcgttcacaacattatcgccatagctgacggataccagcagcagcattcccaggtgtttgtgcatcatgacgcagcctcttccgtggtgattgtgttcgacaccgacaacagaatattcggcctcccccgagaactggtcgtcaccgtttcaggtgcgactatgtccgctctgatcctgacagcgtgcattatttggtgcatctgctctattaagagcaaccgtcacaaggacgggtttcaccgcttgagacagcaccacgatgagtacgaagatgagataaggatgatgtcaaccgggtctaaaaagtcgctgctgtcccacgagttccaggatgagaccgatactgaggaggagactctttattcctccaaacactag

SEQ ID NO: 110856 - DNA, 1149 bp, Artificial Sequence
  Description of Artificial Sequence: Synthetic coding sequence
atgcgacgtagaaggcgcctgcagcaggaggacggaatttcctttgagtatcacagatatcctgaattgcgagaggcgctggtgtccgtgtggctacagtgtactgcaatctctcgcatctatacagtggggcggagctttgaaggtcgtgaacttctagtgatagagttgtctgacaatccgggcgtgcatgagccaggggaacctgagttcaaatacataggaaacatgcatggaaatgaggcagtaggccgcgaactgctgattttccttgcgcagtatctttgcaatgagtaccaaaagggcaacgaaaccatcgtcaacttgatccactctacccgaatccacataatgcccagccttaacccggacggatttgaaaaggcagccagccagcctggagagcttaaggattggttcgtagggagatccaacgcccagggcatcgatctgaatcgcaatttcccagacctggatagaatcgtttacgtgaacgagaaggaggggggtccgaacaaccacctgcttaaaaatatgaagaagattgtggatcaaaacacgaagttggcacctgagactaaggctgtgatccattggattatggacattccctttgtattgtctgcgaatctgcacggtggcgatctggtggctaattatccttatgacgaaaccagaagtggaagcgcccacgaatattcaagttccccagacgatgccatctttcaaagtttagccagagcatattccagcttcaatcccgccatgtccgatcccaaccgtccaccttgccgcaaaaacgacgatgactcttccttcgtcgatggcacaaccaatggcggtgcctggtatagcgttcccggcggtatgcaagacttcaactacctgtccagcaattgctttgagatcactgttgaactctcatgtgagaagtttccaccagaggagaccttgaagacttattgggaagataacaagaactcgctgatcagctatctggagcaaatccataggggtgtcaaaggctttgttcgggatcttcagggtaaccccatcgccaacgctaccatcagcgtggagggaattgaccacgatgtaacctcagccaaagatggtgactattggcggcttttgacatggaagctttag

SEQ ID NO: 110857 - DNA, 1431 bp, Artificial Sequence
  Description of Artificial Sequence: Synthetic coding sequence
atggccggcagggggggatccgctctcctcgccctgtgtggagctcttgcagcatgcggctggctgctaggggccgaagcacaggaacccggggctccagctgcgggcatgcgccggagacggcgactacagcaggaggatggcattagcttcgagtaccatcgctatccagaattacgtgaggccctggtgtctgtgtggctgcagtgcaccgcaatatcacgtatttacaccgtgggtagaagtttcgaggggcgggagttactggttatcgaattgagcgataatcctggagtgcacgagccaggcgagcctgaattcaaatacattggaaacatgcacgggaatgaggccgtgggtagagagctccttatctttttagcacagtatctatgcaatgaataccaaaaggggaatgagactatcgtcaacttgattcactccactagaattcatattatgccaagtctcaacccggacggcttcgaaaaggcggcatcacagccaggagagctgaaggactggtttgtgggccggtcgaacgcgcaaggtattgacctgaatagaaacttccctgacctagaccgcatagtgtacgtgaacgagaaagaaggggggcctaacaaccacctgttgaagaatatgaaaaaaattgtcgatcagaatacaaagcttgccccggaaaccaaggccgtcatacactggataatggacattccttttgtgctgtcggccaacttacacggcggtgacctagtcgctaattacccttacgacgaaacgagaagcggaagcgctcacgagtatagctcaagtcctgacgatgccatattccaaagtctagcacgggcctatagctcttttaaccccgccatgtctgaccctaaccggcctccctgtcggaagaacgacgacgattcaagtttcgttgacggcaccactaacggtggcgcctggtactctgtaccaggtggcatgcaggacttcaattacctatcaagcaattgcttcgaaattacagtcgaactgtcctgcgaaaagttcccgcctgaggaaacactgaaaacctactgggaagataacaaaaactctttaatttcttatttggagcagatacaccgtggtgtaaaaggattcgttcgggatctgcagggaaatcccatcgctaacgcaaccatttccgtcgagggtatagaccacgatgtgacatccgcgaaagacggtgactattggcgactcctgatacccggaaattacaaactcactgcctccgcccctggatatctggctatcactaaaaaagtggctgttccctactctccagctgcgggtgtagactttgaactcgagtccttttcagagagaaaggaggaagagaaagaagagctcatggagtggtggaaaatgatgtcagagacccttaacttttag

SEQ ID NO: 110858 - DNA, 1332 bp, Artificial Sequence
  Description of Artificial Sequence: Synthetic coding sequence
atggattttccttgcctatggctgggcctcctcctgccgttggtggccgctctagattttaactaccacagacaagagggcatggaagcgttcctgaagaccgttgcccagaattactccagcgtgacccacctgcatagtattgggaagagtgttaaagggcgcaacctgtgggtgttggtggttggcaggttccccaaagagcatcgcatcggcattcccgagttcaagtacgttgctaacatgcacggggatgagacagtcgggcgcgagttgctactacatctcatcgattaccttgtaacctctgacgggaaggacccagaaattaccaatctgattaatagtaccaggattcatattatgccatctatgaaccctgatgggtttgaggcagtcaagaagcccgattgctattatagcatcggacgggagaactacaaccaatacgatcttaatcgaaacttccccgacgctttcgagtataacaatgtgtcgcgccagcccgaaacagtggcagtgatgaaatggttaaagaccgaaacattcgttctgagcgcgaatctgcatggaggggctcttgtggcctcctaccctttcgacaacggagtgcaggcgacaggggctctctactcacgatctctgacccctgatgatgacgtgttccaatacttggcacacacgtatgcatcccgcaatcccaatatgaagaagggcgacgagtgcaagaacaagatgaattttcctaacggagtaaccaacggctatagctggtacccactgcagggcgggatgcaagattataattatatttgggcccagtgttttgagattaccttggagctttcttgttgcaaataccctcgagaggaaaagttgccaagtttttggaacaacaacaaagcttctcttatagaatatataaagcaggtgcatctgggcgtgaagggccaggtgttcgatcagaacggtaaccctctcccgaacgtgatcgtggaggtccaagacagaaagcacatttgcccgtacaggacgaataagtacggagaatattatcttcttctgctgcctggctcctatatcatcaacgtcactgtgcctgggcatgacccccatattactaaggtgataatccccgagaaatcccagaatttcagtgctctcaaaaaggacatattgctccctttccagggccaattagacagtatcccagtaagtaatcccagttgtcccatgatccccctgtatcgcaacctgcctgatcactccgcagcaactaaaccttccctgtttctatttcttgtgagtcttctccatatattctttaagtag

SEQ ID NO: 110859 - DNA, 1332 bp, Artificial Sequence
  Description of Artificial Sequence: Synthetic coding sequence
atggacttcccatgcctgtggctgggcctgttgcttcctctcgtggccgccctggacttcaattatcacaggcaggagggaatggaggccttcctgaaaaccgtcgcacagaactacagcagtgtaactcacctacactcgattggtaagagcgtcaagggtcggaacctgtgggttctggtcgtgggcaggtttccaaaagaacacagaatcggcatacccgagtttaagtatgtagctaacatgcatggggatgaaacggtgggcagagagctcctgctacatcttattgattacctggtgacgtcagacgggaaggacccagaaattaccaatctcataaacagcacgagaatccatattatgccctcaatgaatccggacggatttgaggccgtcaagaaacctgactgttactactccatcggccgcgaaaactataaccaatacgacttgaacaggaatttccccgacgcgtttgagtacaacaacgtatctcgccagcctgaaactgttgccgtaatgaaatggctgaaaactgaaacatttgttctgagtgcaaatctccacggcggtgcacttgttgcaagctatccctttgataacggcgtgcaggcaacaggggcactctatagcaggtccctgacaccagacgatgacgtgtttcagtatttggcacatacctacgcttcaagaaacccaaacatgaagaagggggatgaatgtaagaataaaatgaactttcccaatggtgtgaccaatggatacagttggtatcccctccaagggggaatgcaagactataattacatctgggctcaatgtttcgaaattacattagaattaagttgctgtaagtatcccagggaagagaagctgccttctttctggaacaataacaaggcttctctgatcgaatatatcaaacaggtgcaccttggcgtaaaagggcaggttttcgatcagaatggcaacccacttccaaacgttattgtggaagtacaggacaggaaacatatctgcccgtacagaacaaataaatacggagaatattatctgttactgctccctgggagttacatcatcaatgtgactgtgccaggccacgaccctcatatcactaaggtgatcatcccggagaagtctcaaaacttttcagccctgaagaaggacatattactacctttccaaggccagctcgactcaatccccgtatccaacccttcatgtcccatgattccattgtatagaaatctccccgaccattctgccgcgaccaaaccatcactgtttctatttctcgtgagcctgctgcacatcttcttcaagtag

SEQ ID NO: 110860 - DNA, 1332 bp, Artificial Sequence
  Description of Artificial Sequence: Synthetic coding sequence
atggactttccatgcctgtggctaggtctcctcctgcctctcgtggcagccctggacttcaattatcatcgccaagaggggatggaggccttcctaaagacggtggcacagaactatagtagtgtcacccacttacactctatcgggaagtcagtgaaaggaaggaatctgtgggtgcttgtggtcggaaggttccctaaggaacacaggatcggaattcctgagttcaaatatgtcgctaacatgcacggagatgagacggtgggtcgagaactgctattgcacttgatagactatctcgtcactagtgacggcaaggaccccgaaatcacgaatctaatcaattcgacaagaattcacatcatgccgagcatgaaccctgacggattcgaagccgtgaaaaagcccgattgttattattcgatcggaagagaaaactacaaccaatacgatctgaacagaaatttcccagatgcctttgagtataataacgtgtcacgtcaacccgagaccgtagccgtcatgaaatggctgaaaactgagacgtttgtgctctctgcaaacctgcacggaggcgcccttgtagcatcatacccatttgataacggggtccaggcaacaggtgccctgtactcacgcagcctgactcccgacgacgacgtcttccagtacttagctcatacctacgccagcagaaatccaaacatgaagaagggtgatgaatgcaaaaacaagatgaactttcccaatggagtgacaaacggatactcctggtatcctctgcaggggggcatgcaagattataactacatatgggcccagtgcttcgaaattactctcgagctgagctgctgcaaataccctcgagaggagaaactgccctctttctggaacaacaataaggcatctcttatcgagtacatcaaacaagtccatcttggcgtgaaaggacaggtgttcgatcaaaatggcaatccgctccctaacgtgatcgttgaggtgcaggacaggaaacatatttgtccatatcgcactaacaagtatggggaatactatctgctgctcttgcccggctcatatatcattaatgttaccgtgcctggccacgatccccatattacaaaagtcattatccccgagaagagccaaaacttttccgccctcaagaaagatatcctgctcccatttcaaggacagctggattcaatccctgtttcgaacccttcctgtcccatgattcccctgtaccgcaacttgcctgaccacagtgccgcaacaaaaccctcattatttttgtttctggtcagtttactgcacatttttttcaagtag

SEQ ID NO: 110861 - DNA, 411 bp, Artificial Sequence
  Description of Artificial Sequence: Synthetic coding sequence
atggatttcccctgcctgtggttgggtttgttactcccccttgtggccgccctcgactttaactaccaccgtcaagaaggcatggaggcattcttgaagaccgtggctcagaactattcctcagttacgcacctccatagcatcggcaagtccgtgaagggaagaaatctctgggtgttagttgttgggaggtttcctaaggaacaccggatcggcattcccgaattcaaatatgtggctaacatgcatggcgatgaaacagtcggaagggaactgttgctgcatttgatcgactacctggtgacgagcgacgggaaagatcctgagattactaacctgattaactctactcgcatccatataatgccctccatgaacccagacggatttgaagctgtgaagaaaccatag

SEQ ID NO: 110862 - DNA, 750 bp, Artificial Sequence
  Description of Artificial Sequence: Synthetic coding sequence
atggacttcccctgcctgtggctcgggctgctcttaccactcgtagctgccctggatttcaactaccacagacaggaaggcatggaagcgtttctcaaaacagtggcccagaattattcttccgttacacatctacactccatcgggaagtcagtgaaggggcgaaacctgtgggtgctggttgtcggaagatttccgaaagagcacagaatcggtattccagaatttaagtatgtggcaaatatgcacggagatgaaacagtcgggcgagagctcctgctacacctgattgactacctcgtcacgtcggatggaaaagatccggagattacgaacctcattaactcaacacgcattcatatcatgccatctatgaatcctgatggctttgaagctgtcaagaaaccagattgctattactctatcggcagagaaaattacaaccagtacgatctcaacagaaactttcctgacgccttcgagtataataatgtttcaaggcagccagaaacggtagctgtgatgaagtggctgaagacagagacattcgtactgtcagcgaatctccacggtggggcgttggtggcttcttatcctttcgacaacggtgtccaggccacgggagcgctttactccaggtcgctcaccccagacgatgatgttttccagtatctcgcacacacatacgcctcacggaaccccaacatgaaaaagggcgacgaatgtaaaaacaagatgaactttccatag

SEQ ID NO: 110863 - DNA, 1332 bp, Artificial Sequence
  Description of Artificial Sequence: Synthetic coding sequence
atggactttccatgtctttggctaggtctcctcctgcctctggtcgccgccctcgacttcaattaccaccgacaagagggcatggaagcattcctgaaaacggtggctcagaactatagttccgtgacccacctacacagcatcggtaaaagcgtcaaggggcgcaacctgtgggtcctcgtcgtgggccgtttccctaaagaacacagaatcgggatacccgagtttaagtatgtcgctaacatgcatggcgatgaaactgtagggagagaactgttgttacacctcatcgactatcttgtaacttctgacggtaaggatccagagatcaccaatctgattaattcaacgcgaatccatattatgccatctatgaaccccgacggctttgaagcagtcaaaaagcctgactgctactattcgataggacgcgaaaactacaatcaatatgaccttaatcgcaactttccggacgctttcgaatacaacaatgtgagcagacagccagagactgtggccgtcatgaagtggctgaagaccgagaccttcgtcctctccgccaatctccatggtggggccttggtagcaagttatccatttgacaacggggtacaggccactggggctctttactcccgatcattgactcctgacgacgacgtattccaatatctcgctcacacttatgccagcaggaaccccaatatgaaaaagggcgatgagtgtaaaaataagatgaacttccctaacggagtcacaaacgggtacagctggtacccactgcaggggggaatgcaggattacaattacatctgggcacaatgtttcgagattaccctggagctgtcatgctgtaagtatccccgagaagaaaagcttcctagcttctggaacaataataaagccagcttgatagaatacattaagcaggtccatttgggagtcaaaggacaagtgttcgatcaaaatgggaaccctctgcctaacgtgatcgttgaagttcaggatcgcaagcacatctgcccgtacagaacaaacaagtatggggagtactacttgctgttgctgccaggcagttatatcatcaatgtcactgttccaggacacgaccctcacattacaaaggtcatcatacctgagaaatctcagaacttcagcgccctcaagaaggatattttactacctttccagggtcagctggattcgatccctgtatccaatccttcatgtccgatgatccccctgtacagaaacctgccagatcatagtgcagccacaaaacccagcctttttctcttcctggtgtccctactgcatatcttttttaagtag

SEQ ID NO: 110864 - DNA, 1377 bp, Artificial Sequence
  Description of Artificial Sequence: Synthetic coding sequence
atgagcgatctccttagtgttttcttgcatctgcttcttctgttcaaactggtcgctcctgtgaccttcagacatcatcgatatgacgatttggtgcgaactctgtataaagtccagaatgagtgtccagggattacacgggtctacagcatcggtcgatccgtggaaggtcgacacctatacgtcctcgaattctcagaccatccaggaatacacgagccactggagccagaagtgaagtacgtaggcaacatgcacgggaatgaggcactgggtcgcgagttaatgttgcagctctccgaatttctgtgtgaagagttccggaatcgtaaccagaggatcgttcagctgattcaagacacccgaatacatatcctcccatccatgaatcccgacggctacgaggttgccgcagcgcaaggaccaaacaaaccgggatacttagtgggtagaaacaacgctaacggcgtagatcttaataggaactttcctgatctgaacacctatatttattacaacgagaagtatggcggccctaatcaccacttgcccctgccagataattggaaatcacaggtggagcctgagacaagggcagtgatccgctggatgcactcttttaacttcgtgctgtctgccaatctgcacgggggtgctgtagtggccaactacccatacgacaaatcttttgagcacagggttaggggtgtccgaaggaccgctagcacccccaccccggacgacaaactgttccagaaactagcgaaagtgtattcctacgcccacggttggatgttccagggttggaattgtggagactatttccctgatggaatcacgaacggcgctagctggtattcactttccaaaggtatgcaagattttaactacttgcatacgaattgtttcgagatcacgctggaactgtcgtgcgataagtttccacccgaagaggagctgcaacgcgagtggctcggcaatcgcgaggccttgattcaattcctggaacaggtgcatcagggaatcaagggcatggttttagacgagaattacaataatttggcaaatgccgttattagcgtgagtggtataaaccacgatgtcacctctggcgatcacggcgactatttccgtttactgttgccgggtatctacaccgtgtccgccactgcacctggttatgatcccgagacagtgacagtgactgtggggccggccgaacctactttggtgaattttcatctgaagaggagcatcccccaagttagccccgtaaggagggctccatcgagacgccatggggtacgggctaaggtgcagccacaggccagaaagaaagagatggagatgcgccagctgcagaggggacccgcttag

SEQ ID NO: 110865 - DNA, 615 bp, Artificial Sequence
  Description of Artificial Sequence: Synthetic coding sequence
atgcactccttcaatttcgtcctgtcagccaaccttcatgggggagccgttgtggctaactacccgtacgacaaaagctttgagcacagagtgaggggcgtgcgcaggactgcaagtacacctacacccgatgacaagctgttccagaagcttgctaaggtatatagctacgcccatggatggatgttccagggctggaattgcggcgactacttccctgatggtatcacgaacggagcatcttggtactcacttagcaagggcatgcaggacttcaactatctccatactaattgctttgagatcactctggaattatcttgtgacaagtttccacctgaggaagagctccagcgcgaatggctgggaaatcgggaagcattaatccagtttctggagcaggtgcaccagggaatcaagggaatggtgctagatgaaaattataataatctcgcaaacgcagtgattagcgtgagcgggatcaatcacgatgtgacttcaggcgatcacggtgactatttccgactcctgttacctggaatttacaccgtttctgcgaccgccccgggctacgacccggagactgtgaccgttacagtgggcccagctgaatag

SEQ ID NO: 110866 - DNA, 1638 bp, Artificial Sequence
  Description of Artificial Sequence: Synthetic coding sequence
atgctgccaggtgcctggctgctgtggaccagcttactgctcctcgcacgacccgcgcaaccctgcccgatgggctgtgactgctttgtacaggaagtcttctgctccgatgaggagttagccactgtgccactggacatccctccatataccaaaaatatcattttcgtcgaaaccagctttaccacgctcgagactagggctttcggtagtaacccaaatctgactaaagtggtgttccttaatactcaactctgtcagtttagaccagacgctttcggaggtctccccagattagaggacctcgaagttaccggcagcagttttctgaatttatccactaatatcttcagtaacctgacaagtttgggaaagctgaccttgaattttaacatgctggaggctttaccagaaggacttttccaacatttagcagccctggagtctttgcacctgcagggtaaccaactacaggcattgccaagacggctgtttcagcccctaacacacctgaagactctcaatctagctcagaacttgcttgcacagctaccagaggaactgtttcaccctttaactagcctgcagacccttaaactctccaacaacgcgctctcaggcctgccacagggagttttcggcaaactgggtagtttacaggagttgtttttagactctaacaacatcagcgaactgcctccacaggtgttttcccagctgttctgtctggagcgtctctggctgcagcgaaacgcaataacgcatctccccttatctatatttgctagtctcggcaacctgactttcttgagcctgcagtggaatatgctccgggtcctccctgcaggcctcttcgcccacacaccttgcctggttggattaagcctcacccacaatcagcttgaaacggtggcagaaggtacttttgcgcacttgagcaacctgagaagtttaatgctgagctataacgcaattacacatctgccggcgggcatattcagagacctggaggagctggtgaaactctaccttggatcaaacaatctcaccgcccttcatccagccttgttccaaaacctgtccaagctcgagttgctgtccctgtctaaaaaccaattgacaactctaccagagggcatcttcgacactaattataatcttttcaacctcgccctccacggtaacccttggcagtgtgattgccatcttgcgtatctgtttaattggctgcagcagtacactgacaggcttctcaacattcagacatactgcgccggccctgcttacctaaaaggacaggtcgtccccgccctcaacgagaaacagttggtgtgcccagtgacccgcgatcacctgggatttcaagtgacttggcctgatgaatcaaaggccggaggaagctgggacctcgccgtgcaggaaagagctgccagaagccaatgtacctattctaaccccgagggcacagttgttctggcttgtgatcaggcacaatgtcgctggctgaacgtgcagcttagccctcaacagggatctcttggtctgcagtataatgcaagccaggagtgggacctccgttcgagctgtggttcacttcgcctaacagtcagtattgaggcccgggcagccgggccctag

SEQ ID NO: 110867 - DNA, 1638 bp, Artificial Sequence
  Description of Artificial Sequence: Synthetic coding sequence
atgctcccaggtgcctggctcctctggactagtttgctcctcctcgctaggccggcacagccttgccctatgggttgcgattgcttcgtgcaggaggtattctgctcagatgaagagcttgccacagttcccctcgatatcccaccgtacacaaaaaatatcatcttcgtggaaacgtctttcacgacactggagactagggcattcggctccaaccctaacttaactaaggtagtattcttaaatacccagttgtgtcagtttagaccagacgccttcgggggtcttccacgattggaagatctggaagtcaccggtagcagcttcttaaacctcagcacaaatatattcagcaatctgacatctctgggcaagttgacactgaattttaacatgctggaagcccttccggagggactgttccagcacctcgctgcactagagtccctgcatctgcagggaaaccagttacaggcactaccacgcaggttgttccaacctttgacacacctcaagacacttaatctggctcaaaatctgctggcgcagctgcccgaggagctgtttcaccctctcacttctcttcaaacccttaaactgtcaaacaacgccctgtcaggcctgccccagggggtgttcgggaagctgggatctttacaggaactcttccttgattctaacaatatttctgaactgccgccacaggtcttttcccagctcttttgtctcgagagactgtggctgcaaagaaacgccattactcacctgccgttatccatattcgccagcctggggaatttgaccttcctcagcctgcaatggaacatgttacgagtgttgcctgcaggccttttcgcccataccccctgtctggtgggattgagtttaacacataatcagcttgagaccgtggccgagggtacttttgcacacctaagcaacctccggagcctcatgttgtcatacaatgctattacacaccttccagcaggaattttccgcgatttggaagagctggttaagctgtatctgggcagcaacaatctgacggccctccatcctgcgctgttccagaatctgagtaagctggaacttctttccctttctaaaaaccagttgaccacacttccagaaggaatctttgacactaattacaatttgttcaacctggctctgcatggcaatccatggcagtgtgactgccaccttgcttacttgttcaactggctgcagcagtacaccgaccgcctacttaatatccagacttactgcgcaggccccgcttacctaaaaggccaggtggttccagctctgaacgagaaacagctggtttgtccggtcacccgtgatcaccttggctttcaggttacctggccagacgaatcaaaagccggaggctcttgggatctagccgtgcaggaacgggctgcgcgctcccagtgcacttactcgaaccctgaaggcactgtggtactggcttgcgaccaagcacagtgtcgatggctgaatgtgcaactgtctccccaacagggatccctaggcctgcaatacaacgcatctcaggagtgggatctgcgttcatcctgtgggtcacttcgcttgacagtgtccatcgaagcccgggcggctggaccctag

SEQ ID NO: 110868 - DNA, 1431 bp, Artificial Sequence
  Description of Artificial Sequence: Synthetic coding sequence
atggtgggcgccatgtggaaggtgattgtgtcactggtcctgttgatgcccggaccatgcgacgggctcttcaggagtctgtaccgttctgtgtctatgcctccaaaaggcgactctggacaaccactgttcttaaccccatacatcgaggccggcaagattcaaaaaggacgcgaactgtctttagtcggtccgtttcctggccttaatatgaaatcgtatgcaggttttcttactgtgaacaagacctacaactccaatctgtttttctggttttttccggcccagatacaacccgaagacgctccagtagtgctctggcttcagggaggccccgggggatcttctatgttcgggctcttcgtagaacatggaccttacgtcgtgaccagcaacatgactctccgcgacagggattttccttggaccaccaccctgagcatgctgtacatcgacaatccagtgggcacagggttcagcttcactgacgacactcacggatatgcggtgaacgaagacgacgttgcacgggacttgtactcagccctgatccagttctttcagatcttcccagaatataagaataatgatttttatgttacgggagagagctacgcagggaaatatgttcctgctattgcccacctgatacactcgcttaaccctgtgcgagaggtaaaaataaatttgaatggtatcgccatcggggatggctactccgatcctgagtctatcattggcggatatgctgaatttctttaccagatcgggctgctagacgagaaacaaaaaaaatatttccaaaagcagtgtcatgagtgtatcgaacacatcagaaagcagaattggttcgaagcttttgaaatcctggataagcttcttgacggggatctgactagtgatccttcctatttccagaatgtgaccggctgtagcaattattataattttttaaggtgtactgaaccagaggatcaattgtattatgtcaagttcctgtccctgccagaggtaagacaggccatccacgtgggaaatcagactttcaacgacggcacaatcgtcgagaaatacctcagagaagacaccgtccagtcggtgaagccatggctgactgaaatcatgaacaactataaagtgttaatctacaatggacaacttgatatcatcgtggcggctgctctgaccgaacgtagtctcatggggatggattggaagggctcgcaggaatataagaaggccgaaaagaaagtgtggaagatcttcaaaagcgactccgaggtcgcagggtacattcggcaggcaggcgatttccatcaagtgatcattcgaggcggaggtcacattctgccatacgaccagccactgagggcattcgacatgatcaatcggtttatctacggaaaaggatgggatccttatgtgggctag

SEQ ID NO: 110869 - DNA, 1431 bp, Artificial Sequence
  Description of Artificial Sequence: Synthetic coding sequence
atggtgggtgcaatgtggaaggtcatagttagcctggtcctgctaatgcccggtccatgtgatggtttattccggagcctgtatcgctcagtatcaatgcctccaaaaggtgactcggggcaacccttgttcttgacaccctacattgaagctggtaaaatccagaaaggtagggagctgtctctcgtcggcccttttcccgggctgaacatgaaaagttacgccggcttccttaccgtcaataagacgtataatagcaacctgttcttctggttcttcccagcccagattcagccagaagatgcacccgtggttctgtggctgcaaggcggaccaggtgggtcttctatgttcggtctgtttgtagagcacggaccctacgtggtcacgtccaatatgactctccgagaccgtgattttccttggacaacaacactcagtatgctctacatcgacaatcccgtcggaacaggtttctcattcacagatgatacccacgggtacgccgtcaacgaagacgatgtggcccgagacctctattccgctctcatacagttcttccagatcttcccggagtataagaacaatgatttttacgtcaccggtgagtcttacgccggcaaatacgtgccagctattgcgcacttaatccactctctcaaccccgttcgcgaggtgaagatcaacctgaatggcatcgctatcggtgacggatattccgacccagaatccatcataggagggtatgccgaatttctctatcaaatcggactgctcgacgagaaacagaaaaagtactttcagaagcagtgtcacgagtgcatcgaacacattcgtaagcaaaattggttcgaagcattcgagatcttagacaagttgctcgacggagatttgacgagtgacccgtcatacttccaaaatgtcacgggttgtagcaactattataattttttacggtgtaccgagcccgaggaccagctctactacgtaaagtttctcagccttcctgaggtccgacaagccattcacgtggggaatcagacctttaatgatggcacaattgtggagaagtatctgagagaggatactgtgcaaagcgtgaagccatggcttacggaaatcatgaataattataaagtcttgatttacaacggacagctcgacataatcgtcgcggccgcgttgacggaacgttccctcatgggtatggactggaagggcagccaggaatacaagaaagctgagaagaaggtgtggaagatattcaaaagtgatagcgaggtggctggttacatcagacaggctggcgatttccatcaggtcattatccgcgggggcgggcacattttgccctacgatcagcccttacgcgccttcgacatgattaacagattcatctacggcaagggctgggatccatatgtgggttag

SEQ ID NO: 110870 - DNA, 1431 bp, Artificial Sequence
  Description of Artificial Sequence: Synthetic coding sequence
atggttggcgcaatgtggaaagtaattgtttccctcgtgctactcatgcccggcccgtgcgacgggctcttcagatccctgtaccggagcgtttcaatgccacccaagggagactccggtcagcccctgtttttgaccccgtacatcgaagccggtaaaattcagaaaggtagggagctgagcctagttggacccttccccggcctgaacatgaagagttacgctggcttcctgacagtgaacaagacctacaactccaatttgttcttctggtttttccccgctcagatccaacccgaggacgctcctgtcgtgttatggcttcaaggtggacctggcgggtcatctatgtttgggctttttgtagagcatggtccgtatgtcgtgacctccaacatgaccctgagagacagagactttccttggactactaccctcagtatgctttacatcgacaaccccgtgggaaccggttttagttttactgatgacacacatggctatgcggtgaatgaagatgatgtcgcgagggatttgtactccgctctgattcaattttttcagatatttcctgaatataagaataacgatttctatgtaactggggaatcgtacgccggcaagtatgtgcctgccatcgcgcacctaattcactcactgaatccagtaagggaggtaaaaataaacctcaatggcatcgccattggggacggttattctgacccagagagtatcattggaggatacgccgaatttctctaccagatcggactgctcgatgaaaaacagaaaaaatactttcaaaagcagtgtcacgaatgcatcgaacacatccggaagcaaaactggttcgaagccttcgagatattggacaagctcctagacggtgatttaacatccgaccctagctactttcagaatgtcaccggctgctccaattattataacttcttgcgctgcacagaaccggaggaccagctctactatgtgaaattcctttccctgcccgaggtgcgacaagctatccacgttggtaaccagacttttaacgacggaacaatagtcgaaaagtatttgcgtgaggacactgtgcagtccgtcaagccctggttaaccgaaattatgaacaattacaaggtgttgatttacaatgggcagctcgatatcatagtcgctgccgccctcaccgaacgctccttgatgggaatggactggaagggtagtcaggagtacaagaaggcagagaaaaaggtatggaaaatctttaagagcgattccgaagtagcaggctacataaggcaggccggagacttccatcaagtgatcattcgcggtggcgggcatatcttgccctatgaccagccgcttcgggccttcgatatgatcaaccggtttatctacgggaagggatgggatccttacgtgggctag

SEQ ID NO: 110871 - DNA, 21 bp, Artificial Sequence
  Description of Artificial Sequence: Synthetic coding sequence
atggtaggtgccatgtggtag

SEQ ID NO: 110872 - DNA, 159 bp, Artificial Sequence
  Description of Artificial Sequence: Synthetic coding sequence
atggttggtgcaatgtggaaggtgatcgtctctctcgtgctgttaatgcctggcccctgcgatggcctgtttcgaagcctgtaccgcagcgtgagtatgcctcccaaaggtgattctggccagcctctcttcttgactccatacatagaggctggttag

SEQ ID NO: 110873 - DNA, 132 bp, Artificial Sequence
  Description of Artificial Sequence: Synthetic coding sequence
atggttggcgcaatgtggaaggtgattgtgtctctggtgctattaatgcccgggccctgcgatggtttgttccggtcactctatcggtctgtgtctatgccacctaagggagactcggggcagcccctgtag

SEQ ID NO: 110874 - DNA, 699 bp, Artificial Sequence
  Description of Artificial Sequence: Synthetic coding sequence
atgtttgggctgtttgtcgagcacggcccctacgtggtgacctctaacatgaccttacgcgacagagatttcccatggacaacaactctcagcatgctttacatcgacaatccggtgggtactggattcagctttacagacgatacccatggatatgccgtgaatgaggacgatgtcgcaagagatctgtacagcgctctgattcagttcttccaaatttttcctgagtacaagaataatgacttttacgttaccggagaaagttacgcggggaagtacgtccccgccatagctcaccttatccactctctcaatcctgtcagggaggttaaaattaatttgaatggcatcgccatcggcgatggatattccgatccagaatcaatcatcggagggtacgccgagtttttataccaaattggacttttggacgaaaagcaaaagaagtacttccagaaacagtgtcatgagtgcattgaacatattcggaaacagaactggttcgaagcctttgaaatattagataaactgctcgacggagacctgacatctgatccatcttacttccagaatgttacgggatgttctaactactataatttcctccgctgcaccgagccagaagatcaactctactatgttaaatttctgtctctgcctgaggttcgccaggccccaagaggcgagtctgatttctag

SEQ ID NO: 110875 - DNA, 1581 bp, Artificial Sequence
  Description of Artificial Sequence: Synthetic coding sequence
atgggccatctctctgcgcctttgcatcgcgtcagagtcccttggcagggactgctcctcacagcttccctcctgaccttctggaatcccccaacgaccgcccagcttactaccgaatccatgcccttcaatgtggcagagggaaaagaggtccttcttctggttcacaatctgccacagcagttgtttggatatagctggtataaaggagagagggtggatggcaatcgtcagatagtcggctacgcgatcggtacacaacaggctacaccgggcccagctaatagcggcagggagaccatctatccgaatgccagcctgctaattcaaaacgtgacccagaacgatacaggtttttacaccctccaagtgatcaaatccgacctggtcaatgaggaagccactggccaatttcatgtttaccctgaacttccgaagcccagtatatccagcaataactctaatcctgtggaggacaaagatgctgtggctttcacttgtgagccagagacacaagatactacctacctgtggtggatcaataatcaatcgctgccggtctcaccgcggttgcaactgagcaacgggaacaggactctgaccctcttatcagtaactagaaacgataccggaccatatgagtgcgagattcagaatcccgtgtctgccaatagaagcgatcctgtaacgctgaacgtgacctacgggcccgacactcctacgatatccccttccgatacatactataggcctggagcaaatttgagcttatcatgttatgcggcttcaaatccacctgcccaatacagttggctgattaacgggacgtttcagcagagcacccaggagttattcattccgaacatcacagttaacaactcagggagctacacgtgtcacgctaataacagtgtgaccgggtgtaacagaacgacagtgaagaccatcatcgttacagagttaagcccagtggtagctaaacctcagattaaagcatccaaaacaaccgttactggcgataaggattccgtgaatctcacctgttccaccaatgacactgggataagcattagatggtttttcaaaaaccagtccctgccgtcgtctgagcggatgaagctctctcagggcaacacaacactgtccattaaccctgtgaagcgggaggacgcaggtacctactggtgcgaagtctttaatccaatctcaaagaatcagagcgaccccataatgttgaatgtgaattacaatgctctccctcaggagaacggtctcagcccaggggctattgccggtatagtgatcggcgtggtagccctggtggccctgattgccgtagcactggcatgttttctccatttcgggaagacaggcagggcttcagatcaacgagatctgactgagcacaagccctctgtatccaatcacacacaggatcattccaatgatccccctaataagatgaacgaagttacctactcaaccctgaacttcgaggcgcagcagccaacccagccaactagcgccagtccctcattgaccgccacggaaatcatttatagtgaggtgaagaagcagtag

SEQ ID NO: 110876 - DNA, 1080 bp, Artificial Sequence
  Description of Artificial Sequence: Synthetic coding sequence
atgccattcaacgtggccgaaggaaaagaggtgctattactggtgcataacctgccccagcagctgttcggatattcctggtataaaggtgaacgggttgatgggaacaggcagattgtgggatatgcaatcggtacacagcaagccactcctggacctgccaacagcgggagggaaactatttaccccaacgcgtcactgctgattcagaacgtcacacagaatgacacaggattttacacgctgcaggtgattaagtctgacctggtgaacgaagaagccacgggccagttccatgtgtatccagaattacctaaaccgtctatcagttccaataacagcaatcccgtcgaggataaagacgcagttgcgttcacttgtgaacccgagactcaggacacaacctatctgtggtggattaacaatcaatcactgccagtgagccctcgacttcaactcagtaatgggaaccgcacactgacactcctcagcgttacaagaaatgacacaggcccttacgagtgcgagatccagaatccagtgagcgccaatagatctgaccccgtgactctcaacgtcacctatggacctgacactccgacaatttctccttcggatacctactatagaccaggcgccaacttatcgctctcctgctacgctgccagcaaccctcctgcccagtatagctggcttattaatggcacttttcagcagagcacgcaggagttgttcatccccaacatcacggtcaataatagtggatcctatacatgtcacgctaacaattcagtcaccgggtgcaataggactactgtaaagactatcatagtgaccgagatggccttccaccatgtggccaaggccgggctcaaactgctttcctcgtctaatccacctgctagtacgagtcagtcagcaaagatcaccgataatgccttgccccaggaaaatggccttagccctggagccatcgcaggcattgtaattggagtggtagcgctggtagcccttattgcagtcgccctcgcctgcttcttacattttggaaagactgggagtagcggccccctacaatag

SEQ ID NO: 110877 - DNA, 1056 bp, Artificial Sequence
  Description of Artificial Sequence: Synthetic coding sequence
atgggtcatctgtcggcacctctccacagggttcgtgtgccttggcagggcctgctcctcacggcatcactactgacattctggaatccacccactacagctcaactgaccacagagtccatgcctttcaatgtggcggaaggcaaggaggtactcctcttagtccacaatcttccacagcaattatttgggtacagctggtacaagggggaaagagtggatggaaatcggcagatagtgggatatgccatcggaactcagcaggctacgcctggtccagcgaattccggtcgtgaaacgatataccccaacgcttctctcctgatccagaacgtcactcagaacgataccggattctataccttgcaggttatcaagtctgatttggtaaacgaggaggctacaggccagtttcacgtgtaccccgaattgccaaaaccatccataagtagcaataattccaaccctgtcgaggacaaggacgccgtggcctttacttgcgaacccgaaactcaggacaccacctatttatggtggatcaataatcagagtctgcccgtcagcccgcggctgcagttgtcaaatggtaatcggaccctcactctgctgtctgtgaccagaaatgacaccggaccttatgaatgcgaaatccagaacccagtatccgcgaacagaagcgatcctgtcactcttaacgtcacctacggtcccgacacccccacaattagcccttcagatacatactatcgaccaggcgctaacctttccctgagttgttacgcagcttctaacccgccagcccagtactcctggttaattaacggcacatttcagcagtctactcaggaactctttatcccaaatatcaccgtgaataatagtggctcctatacttgccacgccaacaattctgtgacgggctgtaacaggacaacagtaaagacgatcatcgtcaccgagtcacctgttttgggagaggatgaggccgtgcccggacagcatcatccacagcacaagccatgccaggaaggcgggtgctgggacgtgctcgtttag

SEQ ID NO: 110878 - DNA, 759 bp, Artificial Sequence
  Description of Artificial Sequence: Synthetic coding sequence
atgggacacctgagcgcaccattacacagagtaagggtaccctggcagggtttgctgcttaccgcctctctcctcaccttctggaatccgcccaccacagcccagctgacaaccgaatcgatgcctttcaatgtcgccgaaggcaaggaagtgttgctcctggtgcacaacttgccacagcagttgtttggatactcctggtacaagggagagagagtggatgggaaccgacagatcgttggctatgcaattggaacacagcaggccacccccggtccagcaaactcagggcgtgaaacaatctatccgaacgcatcactcctgattcagaatgtcacgcaaaatgatacaggtttttatacactccaggtaatcaagtcagacctggtgaatgaggaagcgaccgggcagtttcacgtgtaccacaacgcactgccccaggagaacgggctgtctcccggcgctatagcaggcattgtgattggtgtcgtcgctttggtggccttgattgccgtggctctggcttgtttcctgcacttcggcaagactgggagggcatctgaccaacgggaccttacagaacacaagccaagcgtttctaatcacacccaggatcactccaatgaccctccaaacaaaatgaatgaggtgacttattccaccttaaattttgaggcgcaacagcccacccagccaactagtgcgagcccctctcttactgctaccgagatcatctattccgaggtcaaaaagcagtag

SEQ ID NO: 110879 - DNA, 1293 bp, Artificial Sequence
  Description of Artificial Sequence: Synthetic coding sequence
atgggtcatttatcagcacccctccatcgggtacgggtaccatggcagggactcctgttgaccgcttccttgttgaccttctggaaccctccgaccaccgcccagctcacaacagagagcatgccttttaacgtcgctgaagggaaagaggtgctgcttctcgtacacaacctgccacagcaactgtttggatactcttggtacaaaggcgagcgggttgacggaaatagacagattgttggttacgctataggaacccagcaggccacgccagggccagccaacagtggacgcgaaaccatctatcctaatgccagcctgctgatccagaacgtgactcagaacgatactggcttctataccctgcaggtgatcaagtccgacctggtgaatgaggaggccaccggacagtttcacgtgtatcctgaattgccgaagccttctatttcatccaataacagtaatcccgtggaagacaaagatgctgttgccttcacatgtgagcctgagacacaggacactacttacctgtggtggattaataaccaaagtctgcccgttagcccaaggcttcaactaagtaacgggaatcggacactcactctgttgtctgtgacacggaacgatactgggccgtatgaatgcgaaatccagaaccccgtgtcagctaaccggagcgacccagtgactctaaatgtcacttatggacctgatactccaaccatctccccttcagatacctattaccgccccggagctaacctgagtctaagttgctacgctgcatccaatcctcctgcccagtactcatggctgattaacggaaccttccagcagagcacgcaggagctgtttattcctaacatcaccgtcaataattcggggagctacacctgtcatgcaaacaactctgtcacgggctgtaataggaccacagtaaaaaccataattgtcaccgacaatgcattaccccaggagaatgggctctcaccgggggctatcgccgggattgtgataggcgtggtcgccctggtggcccttattgctgtggcgctggcttgttttcttcattttggcaaaaccggccgcgcctctgatcagcgtgatcttaccgagcataagcctagtgtctccaaccacacccaggaccactctaatgatccaccaaacaagatgaacgaagtgacatactcaactcttaacttcgaggcccaacagccaacacagcctacatccgcatctccaagcctgacggcaactgaaatcatctatagtgaagtaaaaaaacaatag

SEQ ID NO: 110880 - DNA, 1386 bp, Artificial Sequence
  Description of Artificial Sequence: Synthetic coding sequence
atgggacacctatccgctccccttcacagggtgcgggtcccctggcagggcctgctactgacagcctctcttttaaccttttggaatccacctacaacggcccagctgactaccgagtccatgcccttcaacgtggctgaagggaaggaggtattactgttggtccataacctccctcagcagttgtttggttattcctggtacaaaggcgaacgggtagatggcaaccgacaaatagtcggctacgctattggaactcagcaggctacgccaggacctgcgaacagcggtcgggaaactatctacccgaatgcctcacttctgatccagaacgttacacagaacgacacgggcttctataccctacaggttattaagtcagatctggtcaacgaggaggccaccggccagtttcacgtctaccccgagttgccgaagcccagcatctcctcaaacaactcaaaccccgtggaggacaaagacgccgtggcattcacctgtgaacctgagacgcaagacacaacctacctgtggtggataaacaaccagagtctgccggtaagccccagactgcaactgtcaaatggaaatcgaaccctcacactgcttagtgtcacgcgcaatgacaccggcccgtatgaatgcgagattcagaatccagtttctgcaaacagatcagacccagtgacactgaatgtgacgtatggtcccgacacacccaccataagtccaagcgatacctattacaggccaggcgccaacttgagcctgagctgttacgccgcctccaatccgcccgcccagtatagttggctcataaacggaacctttcagcagagcacccaggaattgttcatccctaatattaccgtgaataattctggcagctacacatgccacgcaaacaattcagttacgggttgcaatagaaccaccgtgaaaactataatcgtgactgaaagacagaatctgacaatgttgccccggctggatagcaactcttgggcccaagctattctgcccagcgtgagccagtcagccgaaataacggataatgccctcccacaagagaatggtttatctcccggtgcaatcgccggaatcgtgatcggtgtcgtggccctcgtggctctcatcgctgtggcgttggcctgcttcctgcattttgggaaaactggccgcgcatctgatcagcgcgacctcacggagcataagccatcagtgagcaatcacactcaggaccactccaacgacccacctaataaaatgaatgaagtgacttattccactttgaactttgaggcacagcagcccacgcaacccacgtctgcgtctccatccctcaccgccaccgagataatttacagcgaggtaaagaaacaatag

SEQ ID NO: 110881 - DNA, 1254 bp, Artificial Sequence
  Description of Artificial Sequence: Synthetic coding sequence
atgggtcatctatcagcacctctgcatagagtcagagtgccatggcagggcctgcttctgacagcctcacttttgaccttttggaatccgcccaccaccgctcagctgacaactgaatcaatgccttttaatgtagctgaaggaaaggaggtcctgctcctcgtgcacaatttgccacagcagctgtttggttatagctggtacaagggagaacgagtggacgggaacaggcaaattgtgggctatgctatcggcacccaacaagctacccccggtcctgctaactcgggacgtgagaccatttacccaaacgctagtctcctgattcagaacgtcacgcagaatgacaccgggttctatacccttcaggtgataaagtcagaccttgtgaacgaggaggccacggggcagttccacgtttaccctgagctgcccaagccaagcattagcagcaataactccaatcccgtcgaagataaagacgctgtggcattcacctgtgaaccagagacgcaggataccacgtatctctggtggataaataaccagagcctgccagtgagcccccgtctacaactctccaatggcaacagaacgctaactctgctctcagtcacgcgcaatgacacaggtccttacgagtgtgagatacagaacccagtgagtgctaatcgtagcgaccctgtcacacttaatgtcacttatggcccagacacaccaacgatttccccaagcgacacatattacagacctggtgccaatctgtcactttcttgttatgcagcctccaacccccccgcccagtactcctggttgattaatggaacttttcagcagagtactcaggaactgtttatccctaatatcactgttaacaatagcggctcttatacatgccatgcaaacaacagtgtgacaggttgcaataggactaccgtgaaaacgatcattgtgacggagctcagtccagttgtggcgaagccccagatcaaggcaagcaagaccaccgttaccggagacaaagacagcgtcaatctgacatgcagtaccaatgatacaggcatcagcattagatggttcttcaagaatcagtcgttgccttcctcagagagaatgaaactgagccagggaaacaccaccttatccattaatcccgttaagagggaagacgcagggacttattggtgtgaggtcttcaaccccatttcaaaaaatcagagcgatcccattatgctcaatgtgaattgcaagtag

SEQ ID NO: 110882 - DNA, 1437 bp, Artificial Sequence
  Description of Artificial Sequence: Synthetic coding sequence
atgccttttaatgtcgcagagggtaaggaggtccttcttttggtgcacaacctgccacagcagctgtttggatattcatggtataagggcgagcgagtagatggcaatagacagatcgtcggatacgccatcgggacgcagcaagccacacctggaccagctaactcaggaagagagaccatttaccctaatgcctccctgctcatccagaacgtcacacagaatgatacgggcttctatactctccaggtcatcaagagcgatttagtgaatgaggaagccaccggtcagttccacgtctaccccgaactgcctaagcccagcatttcttcaaataactcaaaccccgtggaagataaggacgctgtggcgttcacttgcgaaccggaaacacaagatactacttacctgtggtggattaataaccagtccctgcccgtcagtccccggctgcaactttcaaatggaaatcggactttaaccttactttctgttactaggaacgacactggtccctatgagtgtgaaatccagaatcctgtgtctgctaatagatctgatcccgtcacactgaacgtgacctacggtccagacacgcctacaattagccccagcgatacctactatagacccggggccaatctaagtttaagctgctacgccgcctcaaatcccccagcgcagtattcatggcttatcaatggaaccttccagcagtcaacacaagagctgtttatcccaaacatcaccgtgaacaactccggtagctacacttgccatgccaacaactccgtcactggatgcaataggacaactgtgaagaccattattgtgaccgagctttccccagtcgtggctaagccacagatcaaggctagtaaaaccactgtaaccggtgacaaagactccgtgaatttaacctgcagcactaacgataccggtatctcgataaggtggtttttcaaaaatcaaagcctcccatctagtgagcggatgaagctctcccagggtaatacaaccttgagcattaacccagtgaaaagagaagatgccggaacttactggtgtgaagtgtttaatccaattagcaagaatcagagcgatcctattatgctgaatgaaatggcattccaccacgtagctaaagccggcctcaagctgctctcaagctccaatccacctgcaagcacaagccagagcgctaaaatcactgaacgccaaaacctgaccatgctgccccgtctcgactctaattcctgggctcaggctatccttcctagcgtttcgcagtctgcagaaattacagataacgccctaccccaggaaaacggtttgagtcctggagcgattgctgggatcgtgatcggagtggtcgcattagtggctttaattgccgtcgccctcgcctgttttctgcatttcggtaagactgggtag

SEQ ID NO: 110883 - DNA, 966 bp, Artificial Sequence
  Description of Artificial Sequence: Synthetic coding sequence
atgggccacctgagcgccccactgcaccgcgtaagagttccctggcaggggttgttactgaccgcgtcactcctgaccttctggaacccacccacaaccgctcagctgacgaccgagagcatgccattcaacgtagccgaggggaaggaggtccttctactcgtacacaaccttcctcagcagctgtttgggtactcttggtacaaaggcgaaagagttgacgggaacaggcagattgtgggctatgcgattggaactcaacaagccaccccagggccagccaactctggacgggagaccatctatcctaacgcgtccttattgatccagaatgtcactcagaacgacaccggattttacacgctgcaggtcataaaaagtgatctggtaaacgaggaggcaactggacagtttcatgtgtaccccgagcttcccaaaccctcgatttctagcaataattcgaacccagtggaagacaaggatgccgtggcgttcacgtgtgagcctgagacacaggataccacatacctgtggtggataaacaatcagagcctgcccgtgagtcctaggctacaattgtccaacggtaaccgaaccctaacgctgctaagcgtgacgcggaatgatacaggcccctatgaatgcgagatccagaacccagtgtccgctaatcggtccgaccctgtgacgctgaacgtgacatatggaccagacaccccaactatatccccatcagacacttactatcgtcctggagccaacctcagcctgtcttgctatgctgcctccaaccccccagctcaatacagttggttgatcaacggcacattccagcagtctacccaggagctcttcatcccaaatatcaccgtgaacaatagcggtagctacacatgccacgcaaacaactcagtgacaggttgtaaccggaccaccgtcaaaacaattatcgttactgggaagtag

SEQ ID NO: 110884 - DNA, 1458 bp, Artificial Sequence
  Description of Artificial Sequence: Synthetic coding sequence
cgtggcgatcgagctgcagtgcttgaggctttcctcgagccaaagctgagctccaccggtgaggatagagcctctcggaggcaccacggcgcgccacttagccctacctcacaatccgcttgcactctcgggctgcttctaacagcatctctgctgacattctggaaccctcccactacagcccagttgaccacggaaagcatgcccttcaacgttgccgagggaaaggaagtgctacttttagttcacaacctccctcaacagttgtttggctattcctggtataaaggcgagagagtggatggcaaccggcaaattgtgggctacgccattgggactcagcaagcaactcccggccccgccaatagcgggagggagaccatctatcctaacgcaagtctgcttattcagaacgtaactcagaatgatacaggtttttatactctgcaagtgattaaatcagacttagtgaacgaggaagcaaccggccagttccatgtctatcccgagttgcccaaaccgagtatctcatccaataattctaatcccgtggaagataaagacgccgtcgcgtttacttgtgaaccagaaacccaggacactacatacctgtggtggatcaataaccaatccttgccagttagcccgagactccaattatcaaacggcaacaggacactgacccttcttagcgtaactagaaatgataccgggccttacgaatgcgagatccagaaccccgtcagcgcgaatagatccgaccctgtcaccctgaatgtgacatatggacctgacacgccaacgatttccccttcggacacgtattatcggcctggggccaacctgtcgctttcttgttatgcagcctccaatccacctgcacagtactcctggctgattaatggaaccttccaacaatccacgcaggaactgttcatacccaatatcactgtcaacaacagcgggtcatatacatgccacgcgaacaacagcgtaacgggctgcaatcggacaaccgtcaaaacgatcatcgtcacggaactgagccccgttgttgccaagccgcagatcaaagcctctaagactacagtcaccggtgataaagatagtgtgaacctcacctgttcaacaaatgacaccgggataagtatcagatggttcttcaagaatcagagtttgccaagcagcgagcgcatgaaactgagccaaggcaataccacactgagcataaatcctgtaaagcgggaggacgctggcacctactggtgtgaagtgtttaaccctatcagtaaaaaccagagtgaccctatcatgcttaacgtgaactataatgccctgccccaggaaaacggcctctccccgggcgccattgccggcatcgtgattggtgtggttgccttggtggcactgatagccgttgccctggcctgttttctgcatttcggaaaaaccggttag

SEQ ID NO: 110885 - DNA, 1395 bp, Artificial Sequence
  Description of Artificial Sequence: Synthetic coding sequence
atggggcatctctcagcaccattacatcgagtacgcgtgccatggcagggacttttgttgaccgccagcctcctgacattttggaaccctcctaccactgcgcagctgacaacggagagtatgccgttcaacgtagcagagggcaaggaagtgttgcttttggtgcacaatctcccccagcaactgttcggctactcatggtataaaggagaaagagtggatggaaacaggcagattgtgggttacgccataggtactcagcaagctaccccaggacccgcgaatagcggccgggagaccatttaccccaatgcctccctgcttatccagaacgtgacacaaaacgataccggattttatactctgcaggtgatcaaatcagacctggtcaacgaggaagctaccggccagtttcacgtctatccggaactgcctaagcccagtatctcttcgaataacagcaatcctgtcgaggataaagatgccgttgcatttacatgcgaacccgagacccaagacaccacatacctgtggtggatcaataatcaatcactgcccgtgtccccccgcctccagctcagtaacggcaacaggactctcaccttgttatccgtaacccggaacgatactggaccctacgaatgcgaaattcagaaccctgtgagtgcgaaccggtctgaccccgttactctcaacgtgacctatgggccagatactcccaccataagccccagtgacacttactatcgccccggggctaacttgtcattgtcttgttacgcagctagcaaccctcctgctcagtattcctggctgattaacgggaccttccagcagagcactcaggagctgttcattccgaacataactgtcaataattcaggctcctatacatgccatgcgaataatagcgtcaccgggtgtaacagaaccactgtgaaaaccatcatagtcactgagctctcgccggtcgtagcaaagccacaaattaaggcgtcaaagaccactgtaacaggcgacaaagacagcgtgaatctcacctgcagcacaaacgatacaggcatctcaatacggtggtttttcaagaatcagtccctgccttcgtcagagagaatgaaactgtcccagggcaacacgaccctctccattaatcccgtgaaacgtgaggacgccggcacctactggtgcgaagtctttaacccaatcagcaagaatcagtcagatcccataatgctcaacgttaactacaacgccctgccccaggagaacggcctgagccccggcgcgattgctggtatagttatcggggtggtggcactcgtggcgctgattgccgtggctctcgcctgcttcctgcactttggcaagacgggttccagcggaccactgcaatag

SEQ ID NO: 110886 - DNA, 1107 bp, Artificial Sequence
  Description of Artificial Sequence: Synthetic coding sequence
atgggacatctctccgcaccgctccaccgagttcgtgtgccctggcagggcctcctactgacagcatctctgctgaccttttggaatccgccgactactgcgcagctgaccaccgagtcgatgccctttaatgtcgctgagggtaaagaggtgctgctcctggtgcataatctaccccagcagctgttcggctacagctggtataagggagagcgggtcgacgggaaccgtcaaatagtaggatacgctattgggacccagcaggcaacacccggccctgcaaattcagggcgcgaaaccatctatcccaacgcttcccttctgatccaaaacgttactcagaatgacaccggcttctataccctgcaggtgataaagtctgacctcgtgaatgaggaagccacagggcagttccacgtgtatcctgaacttcccaaacccagtatcagctctaataatagcaatccagttgaggataaggatgccgttgcctttacatgcgagcctgagactcaggacacgacttatctctggtggattaacaaccagtcactgcctgtgtcccctcgtctgcagctctccaacggaaatcggacactcaccctgctctcggtcactcgaaacgatactgggccttacgaatgcgagatacagaaccccgtttcagcaaaccggtctgatccagtaacactgaatgtcacctatggtccagatacccctaccatctctccttctgatacatactaccggcccggggcaaatttgagccttagctgttacgctgcgagcaatccccctgcccaatattcctggctaattaatggtacctttcagcagtcaacccaggagctctttattcctaacatcaccgtcaataatagcggctcctacacctgtcatgctaataatagtgtaacagggtgtaataggacaacagtcaagactataattgtcacggacaacgctctgccccaggagaacggattaagtcctggcgcgatagccgggattgtgataggagtggtcgccctggtggccctgattgcggtggctttggcatgctttcttcatttcggaaagacaggatcgagtgggcccctgcagtag

SEQ ID NO: 110887 - DNA, 906 bp, Artificial Sequence
  Description of Artificial Sequence: Synthetic coding sequence
atgttagctctcagagtggctcgcggttcttggggagccctcaggggcgctgcttgggctccaggcacacggccgagtaagagaagggcttgctgggctctgctgccaccggttccctgctgtcttggatgcctagcggagaggtggcgtctacgcccggcggcgctggggcttagacttcccggcatcggccagaggaaccattgctccggcgctggcaaagctgcccctaggccagctgctggtgccggagccgcagctgaggccccaggaggacagtggggtcccgcaagcacaccttccttgtatgagaacccttggactattccgaacatgctgtccatgacccggattggactcgctcctgtgctaggctatctaatcatagaggaggattttaacatcgctctcggcgtcttcgcactagcaggattaactgacctgctggatggctttatagctcgtaactgggccaatcagcgctcagccctcggatcggctcttgacccactcgcagataagatattgataagtatcctgtacgtgagcctcacctatgcagacctgattcccgtacccctgacgtacatgatcatctcccgtgatgttatgctgatagcggccgtgttctatgttcgttaccggaccttacctacacccagaacgcttgccaagtacttcaacccgtgttacgcaaccgcacgcctcaagccaaccttcattagcaaggtcaacactgcagtccagcttattttggtggccgctagcctggcagcccccgtgttcaattatgctgattcgatctatctccagatcttgtggtgcttcacagctttcaccactgccgcttcagcttactcttattaccactatggaaggaagactgtacaggtcatcaaggactag

SEQ ID NO: 110888 - DNA, 609 bp, Artificial Sequence
  Description of Artificial Sequence: Synthetic coding sequence
atgccccaatatgagaatccatggacgattccgaatatgctctcaatgacgaggattggcctcgctcctgtacttggatatttgatcatcgaagaggactttaacattgccctgggcgtctttgcgctagccggactaacagaccttctggatgggtttatcgctcggaattgggccaatcagcgatctgctcttggctccgcacttgaccccctggccgataaaatactgatctctatcctctacgtgtccctgacgtacgccgatctgatccccgtgcccctaacttacatgattatttcgcgggatgtcatgctgatcgccgcagttttctatgtgcgctacaggaccttaccgacacctagaacgctggcaaagtatttcaatccatgctacgccaccgcgcggctgaaacctacattcatcagcaaggtgaatacagccgtccagctgatcctagtagcggcctccctggctgcacccgtgtttaattacgcagattccatctatctccagatcctgtggtgcttcaccgcctttacaactgccgcgtctgcctactcctactatcattacggacggaagacggttcaggtcattaaggactag

SEQ ID NO: 110889 - DNA, 618 bp, Artificial Sequence
  Description of Artificial Sequence: Synthetic coding sequence
atgctggctcttcgcgtggcaagaggatcatggggcgcactgcggggggccgcctgggcaccgggcactcggcctagcaagcggagagcatgctgggctctgctgccacctgtgccatgttgcctgggctgtctcgccgaaagatggcgcctccggcccgccgccctgggtctcaggctccccggtatcggccaacgcaatcattgtagcggcgccggaaaggctgctcctcggcctgctgcgggggccggtgccgctgccgaggcaccagggggccagtggggacctgcaagcaccccctcactgtatgaaaatccttggactattcctaacatgttaagtatgacacgtataggcctggctcctgtactgggctacctgataatcgaagaagacttcaatattgcactcggtgtgtttgctttggccggcctgacagacctgttggatggtttcatagccagaaattgggccaaccagcgcagcgcgctgggttcagctttggatccgctcgcagacaaaatactgatttcaattctatacgtttccctaacctacgccgatctcattccagctaacacgtgtcaggtatttcagtctctattatgccattgttag

SEQ ID NO: 110890 - DNA, 12210 bp, Artificial Sequence
  Description of Artificial Sequence: Synthetic coding sequence
atggccagccgcgatagcaaccacgccggtgagtcgttcctggggtctgatggggatgaagaggccacaagagaactggagactgaggaagagagcgagggggaggaagatgagacggcagcggagtctgaggaggagccagattccagactttcagatcaggacgaagagggcaagattaaacaggagtatatcatttcagacccatctttcagcatggtgaccgtccagcgggaagattcggggatcacctgggaaactaactctagccgttcatccactccctgggcctcggaggaaagtcagacaagcggcgtgtgctccagggaaggcagcaccgtgaatagtccgcccggcaatgtatctttcatcgtcgacgaggtgaaaaaagtcagaaaaaggacccataagagtaagcatggttctccatctttgcggcgaaaaggaaacaggaagaggaactccttcgaaagccaggatgtgcctacgaacaagaaaggtagtccgctgacctccgcgtctcaggtgttgacaacggagaaagagaaaagctacaccggtatctacgataaggccaggaaaaagaaaaccaccagtaacacccctccaatcacgggagctatttacaaggagcacaaacctctagtcctacgacccgtgtacattggaactgttcaatataagatcaagatgttcaactcggtaaaggaagaactaatccctttgcagttctatggaaccttgcctaagggctatgtgatcaaagagatacactatcgtaaaggcaaggacgccagcatctccctggagccagacctggacaactccggctcaaacaccgttagcaagacccgtaaactagttgcccagtcaatcgaagataaggtgaaggaggtgtttcctccctggcgaggagccttatctaaaggatccgaatcactgacattgatgttttcacatgaagatcagaaaaagatttacgcagactcccccctaaacgccacctcagcgctcgagcacacagtgccgtcctatagcagtagcggccgagctgagcagggcatacaactgcggcatagtcagtcagtcccacagcaacctgaggacgaagccaagcctcacgaggtggagcctcctagcgtaactccagacacccctgctaccatgttccttcggaccactaaggaagaatgtgagctcgcctctcctggcactgctgccagcgaaaatgacagttcagtctcaccgtcgtttgctaatgaggtgaaaaaagaggacgtatactccgctcatcactccataagcctcgaggccgcttcccctggtctggcagcttctacccaagatggacttgaccctgaccaggaacagcctgaccttacctcaatcgaaagagccgagccggtgtccgccaagctgactccgacacatcctagcgtcaagggtgaaaaggaggagaacatgcttgagccaagcataagcctctctgagccactgatgttggaggagccagaaaaagaggagattgagacatcccttcctatcgctattactcctgagccggaggatagtaatttggtcgaggaagaaatagtggaactggactaccctgagagccctcttgtttcggaaaagccatttccaccgcacatgagccctgaagtcgaacacaaagaggaagaactcattctgcccctgctggctgcatcttcccctgaacacgtggctctttccgaggaagaaagagaggagatcgccagcgtaagcacagggtccgccttcgttagcgagtactccgtccctcaagacctgaatcatgagttgcaggagcaagaaggagagccagttccaccgagcaacgtggaggctatcgccgagcatgcagtgctgtctgaggaggagaatgaggagttcgaggcctatagtcccgcagccgctcccacatcggagagttctctgagtccttccacaaccgagaagacctctgagaaccagagcccactctttagtaccgtgacccctgagtacatggtcctgtctggcgatgaagcctccgaaagtggttgttataccccagattctactagcgcgtctgagtactctgtgccctccctcgccacaaaggagtccctgaagaaaaccatcgaccggaagagcccactgatcttgaagggggtgtctgagtacatgatcccatctgaggaaaaggaagacaccggcagctttacccctgctgtggcccccgctagtgaaccatctctgtctccatctacgacagagaagacgtccgagtgtcagtcacctttgcccagcacagcaacctccgagcatgtggtgccaagtgagggcgaggatcttggcagcgaaaggttcacccccgacagcaagttgataagcaagtacgctgctccacttaacgccactcaggagagtcagaagaagatcatcaatgaggcctctcagtttaagcccaagggcatcagcgagcatacagtgctcagcgtggatggtaaggaagtgatcggcccttcttcgcccgaccttgtggtcgcctctgagcacagttttcctccacatactacagaaatgacaagcgagtgtcaggctcctcctctgtctgccacaccttcggagtatgtggttcttagcgacgaggaagccgttgaattagagcgctacactccgagctcaacgagtgccagcgagttctccgtccctccatacgccactcctgaggcccaggaggaggaaatcgtgcatcggtccttgaacttgaagggagcctcttcaccaatgaatctgtccgaggaagaccaagaggatattggccctttttcccccgactccgcctttgtgtcagagttcagcttccccccttatgctacccaagaggcggagaaaagagagttcgagtgcgactctccgatctgtctgacctccccttccgagcatactattctgtctgacgaggacaccgaggaagccgagctgttttctcctgacagtgctagccaggtgtccatccctccctttagaattagcgaaaccgagaagaatgaactagaaccagacagtcttctgactgccgttagcgcatccggatatagctgcttctccgaggccgatgaagaggatattggctccacagccgcgacacccgtaagcgaacaattcagttctagtcagaaacagaaagccgagacgttccctctgatgtcacccctagaagacctttctctgccccccagcactgacaagagtgagaaagcagaaatcaagcctgaaattccaacaacaagcacgagtgtgtccgagtatttgatacttgctcagaaacagaagacacaggcttatctcgagccagaatccgaagacctaattccctcccatctgacatcagaagtggaaaaaggcgagcgcgaggcttcttcctccgtggccgctattccggcggcactgcctgctcaaagttctatcgtaaaggaagagacaaagccagcttctccacactccgttctgcctgatagtgttcccgcaatcaaaaaggaacaggagccaaccgccgctctgaccctcaaggcggctgacgaacagatggccttgtctaaagtcagaaaggaagaaattgtgccagactcccaagaggcaacggcccatgtgtcccaggaccaaaagatggagcctcaaccccccaacgtgcctgagagcgagatgaaatactccgttctacccgatatggtggacgaacctaagaagggcgtgaaaccaaagctggtgctgaacgtgacttccgaactagaacagcggaagttgtccaagaacgagcctgaggtgatcaagccatatagtcccctgaaagaaacttccctcagcggtccagaggcactttccgccgtgaaaatggaaatgaagcatgacagcaaaatcactactacacccatcgttctgcattcggcttcatccggggtggaaaagcaggtggagcatggcccgccagcgctggccttttcagccctgtccgaagagattaaaaaggaaatagagccgagctctagcacgacgaccgcttctgtcaccaagttagacagtaaccttactcgggcggtaaaagaggagattcctacagattcaagcctcatcacaccagttgaccgccccgtcctgaccaaggttggcaaaggcgagctgggctccggtctcccccccctggtgacctctgccgacgaacattcagtacttgctgaggaagataaagtggcgattaagggggcttctcccatcgaaacatccagtaaacatttggcgtggtccgaagccgaaaaagagatcaaattcgatagcctgccctcagtcagctcaatcgccgaacactctgtgttgtctgaagtggaggcgaaagaagtgaaagctggtcttcctgtgattaagacctcctctagccaacactctgataaatccgaggaagccagggtagaggacaaacaagatctcctgttttccaccgtctgtgacagcgagcgcttagtttcttcacagaaaaagtccctgatgagcacctcagaagtgcttgagcccgagcacgaactgccgctaagcttatggggcgaaattaaaaagaaagagacagagctgccatcgtctcagaatgtgtctccagcttcaaagcatatcattcccaaggggaaggatgaggaaacggcctcgtcatctccagagctggaaaatctggccagcggcctggctcccaccctattattactgtctgacgacaagaacaagcccgctgtggaagtgagctccacagcccagggagattttccaagcgagaagcaggatgtggctcttgccgaactttcccttgagcccgaaaagaaagacaagccccaccaaccccttgagctccccaacgccggcagcgaattttcgagcgacttgggtcgtcagtcaggatccattggtactaagcaggctaagtcacccatcacggagaccgaggactcagttctggagaaggggcctgccgagctccgctctcgcgaaggtaaggaggagaaccgcgagctgtgcgcttcgtctactatgccagccataagcgagttgagtagcctgctccgagaggaatctcagaatgaagaaattaagccatttagtcctaagatcatcagtctcgaaagtaaagagccccctgccagtgtcgctgagggaggaaatccggaggaattccaaccctttaccttttcgctgaagggcctgtctgaggaggtctcccatcccgccgattttaagaagggagggaatcaggaaatcggtcctctgcccccaacaggcaatttgaaggcccaggtcatgggcgacattctcgacaaactttccgaagagacgggccatcctaactcctcacaggtcttgcagtcaataaccgaaccgtccaaaattgctccttcagacctgctggtggagcagaaaaagacagagaaagcacttcatagtgaccagacggtgaagctccctgatgtgagcacgagctccgaggataaacaggacttggggataaagcaattttccctgatgcgagagaatctgccccttgagcaatcaaaatcttttatgacaaccaagcccgccgacgtgaaagagacaaaaatggaggagttctttatatctcccaaagacgaaaactggatgcttgggaaacccgagaatgttgcctctcaacatgaacaaagaatcgctggcagcgtacagttagacagttcctcaagcaacgaactgagaccaggtcagctaaaggctgctgtgtcttctaaggaccatacctgcgaggtaaggaagcaggtgctcccacatagtgccgaggaaagtcacctgagcagccaggaggccgtcagcgcgctagatacatcctccgggaatactgaaacactgtcctcaaaaagctattcatccgaggaggtgaagctcgccgaggaacctaaatcactggtgctcgctgggaatgtggagcgcaatatagcggagggaaaggagatccactctcttatggagagcgaaagtcttctcctcgaaaaagcaaataccgagttgtcgtggccctcaaaagaagatagccaggagaaaataaaattgccacccgaacgattcttccagaagcctgtcagcggcctctccgtagaacaggtaaagagtgagacaatctccagtagtgtgaagacggcccacttcccagccgaaggagtagagccagctttgggcaatgaaaaggaagcccatcgcagcaccccgccattccctgaggagaaacccctggaggagtccaagatggtgcagtccaaggtaatcgatgacgcagacgaagggaaaaaaccttctcctgaagtgaagattcctacgcaacgaaaacccatcagctctatacacgctcgggagcctcagagtccggaatcgcctgaggtgactcagaaccctcccactcaacccaaagtagctaagcccgatctgccggaggagaagggcaagaagggcatcagcagctttaagagctggatgtctagcctcttctttggctctagtactccagataataaggttgctgagcaggaggatctcgagacccagcctagtcccagcgtggagaaagctgtcactgtcatcgaccccgagggaaccattcctacaaatttcaacgtagcagaaaaaccagcagaccactcactgagcgaggtgaaactgaaaactgccgacgagcctagggggaccctggtaaaatcaggagatggacagaacgttaaagagaagtcgatgattcttagtaatgtagaggatttgcagcaacctaagtttatttctgaggtctcccgagaggattacgggaaaaaagagatatccggcgactctgaagagatgaacattaatagtgtggtgacttcagccgacggcgaaaacttagagatccagtcatactctctgatcggagaaaaactggtgatggaggaggccaaaacaattgtgcccccacatgtgaccgattccaaacgggtgcagaaacctgctatcgctcccccgtccaaatggaacatctcaatttttaaggaagaaccccgcagcgaccagaagcagaaatctctcctgagcttcgacgttgtcgataaggtgccacagcagccgaagtccgcttcctctaattttgcgtcaaaaaacatcactaaagagtctgaaaagccagagtcgatcatccttcccgttgaggaatctaagggatcactgatcgattttagcgaagatcggctgaaaaaggagatgcagaaccccacaagcctgaaaatttccgaggaggagaccaaattgcgttctgtttcacctacagagaagaaggataatcttgaaaaccggtcttatacactcgccgagaaaaaggttcttgctgagaaacagaattctgtcgctccgctggagctccgcgacagcaatgagatcggaaagacacagataaccctcgggtccaggtcaacagagctgaaagaaagtaaggcagacgccatgccacagcacttttaccaaaacgaggattacaatgagcgccccaagatcatcgtcggttcggagaaagagaagggcgaagagaaagaaaaccaggtgtacgtccttagcgaaggaaagaagcaacaagaacaccagccgtactccgtcaatgtggctgagtccatgagtcgggagagcgacattagtctgggccattccctgggtgagacgcagagtttctcactagtcaaagccacctctgttaccgagaaaagtgaagcaatgttagccgaggcacatccggagatccgcgaggctaaggccgtgggcacgcagcctcatcccctggaggagtccaaagtgctagtagaaaagaccaaaaccttcttgcccgttgctctgagctgccgggatgagattgagaatcactctctatctcaggagggtaacctggtgctggagaagagctctagggatatgcccgatcatagcgaggagaaggagcaatttagggagagtgaactcagcaaagggggatccgtggatataaccaaagaaactgtcaagcaaggctttcaagaaaaagctgttggtacgcagcctagacctctcgaggaaagcaaagtactcgtcgaaaaaaccaaaacttttctgcccgtggtgctctcttgtcacgacgaaatcgaaaaccacagcttaagccaggaaggaaacctggtattggagaaatcttccagggacatgccagatcactccgaggaaaaagagcagttcaaagaaagcgagctgtggaaggggggaagcgttgatataaccaaggagtcaatgaaggaagggttcccaagcaaagagtcagaacgaaccctcgcgcggcccttcgacgaaaccaaatcctccgagacaccaccctatctgctgtctccagtgaaacctcaaaccctggcctccggggccagtcccgagattaacgctgttaagaaaaaagaaatgccccgttcagagctgaccccggagcggcatacggtacacactatccagacaagtaaagatgatactagcgacgttcccaaacagtcggtcttagtttctaaacatcatttagaagccgcagaggatacacgtgtcaaagagccgttgtcttccgccaagagcaattatgctcagtttattagtaacaccagcgccagcaacgcggataagatggtgtcaaacaaggagatgcccaaagaacctgaggatacttacgctaagggtgaggatttcacagtgactagcaagcccgcaggattgagcgaggaccaaaagactgccttctcaataatctctgagggttgtgaaatacttaatatccatgcacccgcatttatttcctccatcgaccaggaagaaagtgagcagatgcaggacaaactcgagtacttggaagaaaaagcatctttcaagactattcccttgccagatgacagcgagacagtcgcttgccataaaaccctaaagagtcgcctggaggacgagaaagtcacaccgcttaaagaaaacaaacaaaaggagactcacaagacaaaggaagaaattagtacagattcagagactgacctgtcgttcatccagcccactatccccagtgaagaggactattttgagaaatacactctaatcgattacaatataagccctgaccccgaaaaacaaaaagcaccccagaaactgaatgtggaggagaaattgagcaaggaggtgacggaagaaacaattagctttcccgttagctcggtggagagcgcactggagcacgaatatgatctagtgaagctggatgagtcgttctacgggccggaaaagggccacaatatcctgagtcacccagagacacagtctcaaaactctgcggaccgcaacgtatctaaggatacaaagagagacgtggactctaagagccctggtatgcctctattcgaggcggaggagggcgtcctctcccggactcagatatttccaaccactattaaagtgatcgatcccgagtttttggaggaaccccccgccttggcgtttctgtataaagatttgtatgaggaggcagtgggcgagaaaaaaaaggaggaggagaccgctagcgaaggtgatagcgttaatagcgaggcaagctttccttcaagaaactccgacactgatgatggcactgggatttatttcgagaagtatatactcaaggatgatatactccacgacacatctctgacacagaaagaccagggacagggcttggaggagaaacgagtcgggaaagatgactcatatcagccaattgcggcagaaggcgagatctgggggaaatttgggaccatatgcagagaaaagtccttagaagagcaaaaaggagtatatggtgagggggagtccgtcgatcacgtcgagacggtcggcaacgtggccatgcaaaagaaagccccaataacagaggacgtccgggtcgccacccaaaaaatcagctatgccgtgccctttgaggatacacatcatgtccttgagagagctgatgaggccggctcccacggaaacgaagttggcaatgcaagccctgaagtgaacctgaacgtgcccgttcaggtaagtttccccgaagaagagttcgccagcggcgccacgcatgtgcaggaaacttccttggaagagcccaagatcctggtgccaccagagcccagcgaggagcggctaaggaacagtccagtccaggacgagtatgaatttactgagagtctgcacaacgaagtggtgccgcaggacatcctgtcagaggagttatcgtcagagtcgacccctgaagacgttctgtcccagggtaaagagtcttttgaacatataagcgagaacgagttcgcaagtgaagctgaacagtccacaccagccgagcagaaagagttgggttctgaacggaaagaagaagatcagcttagctctgaagttgttacggagaaggcccagaaagagctcaaaaagagtcagatcgatacctattgctatacatgcaagtgcccaatcagcgccacagacaaagtgtttggaactcacaaggatcacgaggtgtccactctggacacggctatctcggcggtcaaagtgcagctcgcggagttcctggagaatctccaggagaaatctctcaggattgaggccttcgtgtctgaaatcgaaagtttcttcaatacaattgaggaaaattgctctaaaaatgagaaaaggctcgaagagcagaatgaggaaatgatgaagaaggtgctggcccagtacgacgagaaagcccaatcattcgaggaggtgaaaaagaagaaaatggaattcctccatgagcagatggtgcattttctgcagtcaatggatacagcaaaagacaccctggagactattgtgcgcgaagcggaggagctcgacgaggctgtgtttctgacatcctttgaggagattaacgagagacttctgagcgcaatggaaagcacggcatcattggaaaagatgccggcagcctttagcctgtttgaacattatgatgatagtagtgcacggtcagaccaaatgctgaaacaagttgccgtccctcagccccctagattagaacctcaggaacctaatagcgcaacatctaccaccattgctgtgtactggtccatgaataaggaggacgtcatcgactcctttcaggtgtactgtatggaggaaccccaggatgaccaggaggtgaatgagctggtagaagagtaccggctgacggtgaaggaatcctattgcatctttgaagatcttgagccagacagatgctaccaagtctgggttatggcggtcaactttaccggttgctcattaccgagcgagcgagctatttttaggaccgcgccgagcacacccgtgatccgggcggaagactgtaccgtgtgctggaataccgccaccattagatggagaccaaccacacctgaggctacagagacttatacactggaatactgtaggcagcactctcccgaaggcgaaggcctcagatcatttagtgggatcaaagggctgcaactgaaggtgaacctccagccaaatgacaactacttcttttacgtgcgtgctatcaacgcttttggaacatcggagcaatccgaggccgctctgattagcactcgcggcacgagatttctactcttgagggagaccgcccatcccgcacttcatatcagctcaagtggcacggtcatcagttttggggagcgcaggagattgaccgaaatccctagtgttctaggcgaggagcttccctcgtgcgggcagcactattgggagacaactgttactgactgtccagcgtatcgcctggggatttgcagttcctctgctgtgcaagcaggagcactggggcaaggtgaaacgtcatggtatatgcactgctctgagccacagcgctacacattcttctattccggtattgtttccgatgttcatgttacggaacgaccagctcgcgttggtatcctgctagactataacaatcaacgtctgatattcatcaacgccgagagcgagcaactgctgttcattattcgccataggttcaatgagggcgtgcaccctgccttcgccctggagaaaccggggaagtgtacactccatctaggaatcgaaccaccggacagcgtaagacataagtag

SEQ ID NO: 110891 - DNA, 678 bp, Artificial Sequence
  Description of Artificial Sequence: Synthetic coding sequence
atggacctccgggccggagactcatgggggatgcttgcctgcctatgcaccgtcctatggcatctgcccgcggtgcctgcccttaacaggactggagatcctgggccagggccttctattcaaaagacttacgatctcaccaggtatctggaacaccagttgagatctctcgcaggcacctatttgaattacctcgggccgcccttcaacgagcccgatttcaaccctcctcgcttgggcgccgaaaccttaccaagggctactgtcgaccttgaagtttggcgttcactgaatgacaagctccgcttgacacagaactacgaagcttacagccatctgctatgttatctcagaggcctgaacagacaggccgcaactgccgaactcaggcgctctctggcccacttctgcacatcccttcagggactcctcggcagcatcgcaggcgtcatggccgcgttaggataccctttgcctcagcctctgcctggtacggaaccaacctggacacccggtcccgcgcacagtgactttttgcagaagatggatgacttttggctactgaaagaactgcaaacttggctttggcggtccgctaaagattttaatcgtctgaaaaagaaaatgcagcccccggcggcagcggtgacactgcatttaggggcccatggcttctag

SEQ ID NO: 110892 - DNA, 648 bp, Artificial Sequence
  Description of Artificial Sequence: Synthetic coding sequence
atgctggcctgtctgtgcacggtcctctggcacctccctgccgtgccggcactcaatcggactggtgatccagggccaggaccctctattcagaaaacgtacgaccttacacggtatctcgaacatcagttgaggtcccttgctgggacttatttgaactatctagggcctcccttcaacgagccggacttcaatccaccaaggctcggcgccgagaccttacctcgcgctaccgtcgacctggaggtctggcgctccttgaatgataaactcagacttacgcagaactacgaggcttactcgcacctcctatgctatctcagagggttgaatcgacaagcagcgaccgccgagctgagacgaagtctcgctcatttctgtaccagcctacaggggcttctgggttcgatcgcaggtgtaatggcagccctggggtatccccttccgcagccactgcctggaacagaacctacgtggactcccgggcctgcccatagcgatttccttcaaaagatggatgatttctggttgttgaaagaattgcagacatggctgtggaggtccgccaaagattttaacagactgaaaaaaaaaatgcaaccaccagctgccgccgttacattgcacctaggcgctcatggcttttag

SEQ ID NO: 110893 - DNA, 648 bp, Artificial Sequence
  Description of Artificial Sequence: Synthetic coding sequence
atgcttgcgtgcctgtgcaccgtgttgtggcatctgcctgcagttcctgcactgaatcgaacgggagaccctggccctggcccctcaattcagaaaacctacgatctcacgcggtacttggaacaccagctcaggtcactggcggggacctatttgaactacctgggacccccctttaacgagcccgactttaacccaccgcggctgggagcagaaaccctgcctcgagcaaccgtggatctggaggtctggcgctccctaaacgataagctacggcttacccagaattacgaggcctattcacatctgctgtgttacctccgaggcctgaaccgccaggccgcaactgcagagctccgccgatcactcgctcacttttgcacttcactgcaaggcctcttaggcagtatcgcgggggtgatggccgcactgggctacccactcccacaacctctgcccggcacagagcctacttggacgcccggccctgcccactccgattttctccagaagatggatgatttctggctgctcaaggaattacagacatggctgtggcgttcagccaaggactttaatcggctgaaaaaaaagatgcagccccctgctgccgccgtgactttacatttgggggcccatggcttttag

SEQ ID NO: 110894 - DNA, 1881 bp, Artificial Sequence
  Description of Artificial Sequence: Synthetic coding sequence
atgctggccttcgccgctcgtactgtggtaaaaccgctgggattcttaaaacccttctctctcatgaaggcaagctccagatttaaagcccaccaagacgccttgcctcggctgcccgtgcctcccctgcagcagagtctcgaccactatctgaaagctctacagcccattgtctcggaggaggagtgggcgcataccaagcaactagtggatgagttccaggctagtgggggagtgggcgagagactgcagaaagggctagaacgtcgcgcccggaagaccgagaattggcttagcgagtggtggttaaaaacagcctatctacagtataggcagcctgtcgtgatttatagctctccgggagtgatgcttcccaaacaggatttcgtagatctccagggccaactgaggttcgccgctaaacttatcgagggggttctcgatttcaaagttatgatcgacaatgaaaccctgcccgtggaatacctcggcggcaaacctctctgcatgaatcagtattatcagattctctctagttgcagggtgccaggtcccaagcaggacactgtttccaattttagcaagaccaagaaaccacccacgcacattaccgtggtgcacaactaccagttctttgagctggacgtctaccacagtgacggaacaccattaactgccgaccagatttttgtacagctagaaaagatttggaacagttctttgcagacgaacaaggaacctgttgggattcttacatctaaccatagaaattcgtgggctaaggcatataacacgctaatcaaggacaaggtgaacagagactccgtgcgctctatccagaagtccatcttcacagtgtgcctggacgcaactatgcctcgggtctcagaagatgtgtaccggagccatgtggcaggtcagatgctgcatggaggcggaagtagactgaacagcggcaatcgttggttcgacaagacactacagttcatagtcgctgaagacggctcttgcgggctagtgtacgaacacgccgccgctgaaggacctccaattgtgacactgcttgactatgtgattgaatacactaaaaagcctgagctcgtacgatcacccttagtaccccttcccatgccgaaaaagttgaggtttaacataacacctgaaatcaaatcagatatcgaaaaggcgaagcaaaaccttagtatcatgattcaagatcttgacataactgttatggtgtttcaccactttgggaaggatttccctaaatcagaaaagctgagtccagatgcctttatccaaatggcccttcagctggcatactacaggatctacggacaggcctgtgctacttacgaaagcgctagcttgaggatgtttcacctcggccgaacggacaccatccgcagcgccagcatggactccctaacattcgttaaagccatggatgactcctccgttaccgagcaccagaaggtcgagttactccgcaaggcagtgcaggctcatcgcggttacacggaccgagcaatccgcggagaagctttcgacaggcacctgctgggcctcaagctgcaagccatcgaagacctcgtcagcatgccggacatcttcatggatacctcctatgctatcgcaatgcactttcacctgtcaacctcccaagtacccgccaaaaccgattgcgttatgttttttgggcctgtagtccctgacggctacggggtttgttacaatccaatggaggcccatatcaatttcagcctgagcgcctataattcatgcgctgaaactaatgcagcaagactggcacactacttggagaaagcactgctggatatgcgggctttactgcaatcccatccacgcgctaagctgtag

SEQ ID NO: 110895 - DNA, 1638 bp, Artificial Sequence
  Description of Artificial Sequence: Synthetic coding sequence
atgctagctttcgccgcaagaacagtcgtgaagccactgggcttcctcaaaccattttctctgatgaaggctagtagtcgctttaaggcccaccaggatgctctaccccgactccccgttccacccctgcagcagtccttggatcattatctgaaggccctgcagccaatagtgtcagaagaagagtgggcacatacaaaacaactggtggatgagtttcaggcctctgggggtgtgggggagcgactgcaaaagggactggagagacgtgctcggaagaccgaaaattggctaagtgaatggtggttgaaaactgcttatttgcagtatcgtcagcccgtggtgatctatagttctcctggggtgatgctccccaaacaggatttcgtagatctgcagggacaattacggtttgccgccaaactgatcgaaggtgtcttggacttcaaggtaatgatagacaatgagacgttgcccgtggaatatctgggaggcaagccactgtgcatgaaccagtattatcagatactgagttcctgtcgcgttcccggcccaaagcaagacacggtgtctaacttcagcaagaccaagaaaccaccaacccatatcaccgttgttcacaactatcagtttttcgagctcgatgtttatcacagcgatggtactccgcttaccgccgaccagatcttcgtgcagctcgagaagatctggaactcaagcctgcagaccaataaggaaccagttggcatcttaacttcgaaccaccgtaatagttgggcaaaggcttacaacactttgattaaggacaaggtgaatcgcgactccgtgcggtcaattcagaagaagaagcctgagctggtccgctccccacttgtcccactaccaatgcccaagaagctgcgattcaatatcactcctgaaatcaaaagcgatatagagaaagctaagcaaaatctgtccatcatgatccaggatctggacattaccgtaatggtgttccatcactttgggaaagactttccaaagtctgaaaagctgtctcccgatgcatttattcagatggcgctgcagctcgcctactaccgaatctacgggcaagcctgcgccacctacgaaagcgcctcgctgcgtatgtttcatctggggaggacagacactatccggtccgcttctatggactctctcacattcgtcaaggcgatggacgactcctccgttactgaacatcaaaaagtggagctgttgaggaaagccgttcaggcacacagaggctatacggatcgggcaatccggggtgaagctttcgataggcatcttctggggctgaaattgcaggcaatcgaggacctagttagtatgccggatattttcatggatactagctacgctatcgctatgcactttcatttgagtacctcacaggtacctgctaaaacagactgcgtgatgttttttggaccagtcgttcctgatgggtacggggtctgctataacccgatggaggcacacataaactttagtctgtcagcttacaacagttgcgcggagacgaacgccgctcggctggctcattacctcgaaaaagcccttctcgatatgagagccctattgcagtcccatccacgggccaaactgtag

SEQ ID NO: 110896 - DNA, 2322 bp, Artificial Sequence
  Description of Artificial Sequence: Synthetic coding sequence
atggcagaagctcaccaggccgtggccttccagttcactgtaaccccagacggcatcgacctgcgactgtctcatgaggcactgcggcagatctacttgagcgggcttcacagctggaagaaaaagtttataaggttcaagaacggcatcattacaggcgtgtaccctgcctccccgtcaagctggctcattgtagtagttggcgttatgaccaccatgtatgcaaagatagacccttcattgggcatcatcgctaagattaaccggaccctcgagactgccaactgtatgtccagccagaccaaaaatgtggtgtccggcgtccttttcggaacaggcttatgggttgccttgattgtgaccatgcgttatagtttgaaggtgttgctgtcctatcacggctggatgttcacagaacacggaaaaatgagtcgcgcaaccaagatctggatggggatggtcaagatcttctccggtagaaaacctatgttgtattctttccagacctccctccctcggctgccagttcctgctgtgaaagacaccgtaaaccgctacttgcagtccgttcgcccgctcatgaaggaagaggactttaaacgaatgactgcacttgcccaggattttgcagttggattgggacctcggctgcagtggtatctgaaactcaaatcctggtgggcaacaaactacgtgtctgattggtgggaagaatacatttacctgagagggcggggccccctaatggtgaactccaactattacgccatggacctgctttacattctccccactcatattcaggctgccagggccgggaacgctattcacgcaatcttattgtaccgcagaaagctggaccgcgaggaaatcaagccaatccgtctgctcgggtctactatccccctctgttctgctcaatgggagcgaatgtttaacacatctcgcatccccggtgaagagaccgatacaatccagcatatgcgggactcgaagcacattgtggtgtatcaccgcggccggtattttaaggtgtggctctaccatgatggacggctgttgaagcccagagagatggagcagcagatgcaacgcatcctggacaacacttccgagccgcagcctggggaagcaagactggccgccctgactgcaggtgaccgtgtgccttgggcacgctgtcggcaggcttacttcggaagggggaaaaacaagcaatcattggacgcagtcgaaaaggcggccttcttcgtgactctggatgagacagaggagggatatcggtctgaggatcccgatactagcatggattcttacgccaaaagcctgcttcacggtcgctgttacgatcgctggttcgataagtcattcaccttcgtggtttttaagaacgggaagatgggactgaacgcagagcattcctgggctgatgccccaatcgtcgcccatttgtgggaatacgtgatgagcatcgacagcctacagcttgggtatgcagaagatggccactgtaagggtgatatcaacccgaatatcccataccccacacgcctgcagtgggacatccccggagaatgtcaagaagtaattgagacatctctgaatactgccaatctactggctaacgacgtcgattttcattccttcccttttgtggcttttggcaagggcatcattaaaaaatgcagaacttccccagatgcgttcgtccagctggcactccagctggctcactataaggatatgggaaaattctgcctcacctacgaggcatccatgacccggcttttccgggagggacgcacagaaaccgtgagatcttgcactaccgagagctgcgattttgtccgagccatggttgaccctgcacaaactgtggagcagcgcctgaaactgttcaagctagcctcggagaaacaccaacacatgtacagactcgcgatgaccggcagcggtatcgataggcacctattctgcctgtacgtagtcagtaagtacctggcagtcgaatcaccatttcttaaggaggtgctcagcgagccctggaggttgtcgaccagccagacgccgcagcagcaagtggaactgttcgacctggagaataatcctgagtacgtcagctctgggggagggttcggcccagtggcagacgatggatacggagtgtcatacattctggtgggggagaatctgatcaactttcacattagcagcaagttctcctgtcccgaaactgattctcacagatttggtcgccacctgaaggaagccatgacggatataattaccttattcggcctgtcatccaattcaaagaaatag

SEQ ID NO: 110897 - DNA, 2271 bp, Artificial Sequence
  Description of Artificial Sequence: Synthetic coding sequence
atggccgaagcccaccaagctgtcgcctttcaattcacagtgacgccagacggcatcgaccttaggttgagccacgaagcacttaggcagatttacctgtcagggcttcacagttggaagaagaagtttataaggttcaaaaatggcattattaccggcgtgtacccagccagccccagttcttggcttatcgtggtggttggtgtcatgacaacaatgtatgctaagatcgatccatccctcggtattatagccaagatcaatcgcacacttgagactgctaactgtatgtcgtcccagaccaagaacgtggtctcaggggtactattcggcaccggcctgtgggtcgcccttatcgtcaccatgcgctactctctgaaggtcctgcttagctatcatggatggatgtttacggaacacggaaaaatgagccgcgctacaaagatatggatggggatggttaagatcttttccggtcgcaaacccatgctgtacagtttccaaacatccttgcctaggttacctgttccagcagtaaaagatacagtcaaccgatatttacagagcgtgagacctcttatgaaggaggaagatttcaaaaggatgactgcactggctcaggacttcgcagttggactcggaccgaggctgcagtggtatcttaagctgaagagttggtgggcaactaattacgtgagcgactggtgggaggaatatatttacctgcgcggtaggggcccgctgatggtgaactccaattattatgctatggacctattgtatatcctgcctactcacatccaggcggcgcgggcaggcaatgcgatccatgcaattctgctgtaccggagaaaattagatcgtgaggaaatcaagcccatcagactgctaggctccactattcccctttgtagtgctcagtgggagcggatgtttaatacctcaagaattcccggagaggagacggatacaattcagcatatgcgggactcaaagcatatcgtggtctatcaccgaggtcgctattttaaggtttggctgtaccacgacgggagactgctcaagccccgtgagatggaacagcagatgcaaaggatcctggacaatacgtctgagccccagcccggggaagcaaggttggccgcattaacagccggcgaccgtgttccatgggctcgctgtagacaggcttactttggccggggaaagaacaagcagtctttggatgccgtagagaaggcagcattttttgtgaccctggacgaaaccgaggaaggatatcgatccgaggatcccgacacctctatggacagctatgcgaagtctctgttgcacggtcgctgttacgaccggtggtttgataaatcattcactttcgttgtgttcaaaaacggtaagatgggtctgaatgcagaacattcatgggctgacgccccaatcgtcgcacatttgtgggaatacgtgatgtctatcgatagtttgcaactcggctatgcagaggatgggcattgtaaaggggatatcaaccctaatatcccttaccctacacgcctccaatgggacatccccggggaatgtcaagaggtgatcgagacaagcctgaacacggccaacctcctcgccaatgatgtggattttcatagttttccattcgttgcattcggtaagggtattatcaagaagtgtcggacctccccagatgccttcgtccagcttgccctgcagctggcacactacaaagacatgggcaaattttgtctgacctatgaagcgagcatgacgaggctttttcgggagggacgcaccgagaccgtcaggtcttgcaccacagagtcttgcgacttcgtccgggctatggttgatcctgcacaaactgtggagcagcgcctcaaactttttaagctcgcctccgaaaagcatcagcatatgtaccggttggcaatgactggttccggcatcgaccggcatcttttttgcctgtacgtcgtgtcaaagtatctggccgttgaaagcccgttcctcaaggaagtgctgtccgaaccatggagactatcaacttcccagacaccacaacaacaggtggagcttttcgacctggagaacaatcctgagtatgtgtcctccggcggagggttcggccccgtagcagatgatggttatggagtctcttacatcctggtgggcgaaaacctgatcaattttcatatttcttcgaagttctcatgccctgagaccggaattatcagtcagggcccgtcctcggacacctag

SEQ ID NO: 110898 - DNA, 2322 bp, Artificial Sequence
  Description of Artificial Sequence: Synthetic coding sequence
atggccgaagctcaccaggcggtggctttccagtttacggtgactcctgatggaatcgacctgcggttgtctcacgaagctctgagacagatttatctgtccggtctccacagctggaagaaaaagtttatccgctttaaaaacgggattattacaggagtataccccgcatctccaagctcttggcttatagtggtagtgggagtgatgacgaccatgtatgccaagatcgacccttctctcggtatcatcgctaagattaatagaaccctggaaaccgctaattgcatgtctagtcagactaaaaatgtagtgagcggcgtgctgttcggcacgggactctgggtcgcgctgatcgtgaccatgaggtacagtttgaaggtcttactttcgtaccatggttggatgttcacagagcacgggaaaatgagtagagctactaagatttggatggggatggtgaagattttttccgggaggaagccgatgctgtactcgttccagacgtctctcccaagacttcctgtccctgcggtcaaggatactgtaaacaggtacctccagtccgtaagaccacttatgaaagaggaggactttaaacgaatgactgctctcgcccaggacttcgccgtgggcttgggacctcgcctccagtggtacctcaagctcaagagttggtgggccaccaattatgtgagcgattggtgggaagagtatatttatctccggggcagggggccactaatggtgaactctaactactatgccatggatttgctttacatcttgcccacacatatccaagctgctcgtgcaggaaacgccattcatgcaattcttctgtacagacggaagctggaccgagaagagattaaaccaatcagactgcttggatccaccattcccctttgtagtgcacagtgggagagaatgtttaacacatcgcgcataccgggcgaggaaacagacacaatccaacacatgcgtgatagcaagcacatcgtggtctaccatcgaggaaggtactttaaggtgtggctttaccatgacggtaggttgctgaagccccgggaaatggaacagcagatgcagcggatattggataacacaagcgagcctcagcccggcgaggcaaggctggctgcactgactgcaggcgacagggtgccttgggctaggtgtcgtcaggcttactttgggcggggcaagaataagcaaagtctggatgctgtggaaaaagcagcatttttcgtaacgctggacgaaactgaagagggttacaggagtgaagaccctgacacatcaatggatagctacgctaagtcactactccacggcagatgttatgatagatggtttgataagagcttcacttttgtggtcttcaagaacggtaaaatgggactcaatgccgagcactcctgggccgatgctcctatcgtagcccacttgtgggagtacgtgatgtctatcgactctctgcaactcggatacgccgaggacggtcactgcaagggcgacataaaccccaacatcccatacccaacgcgacttcagtgggacatacctggggagtgtcaggaagtcatagaaacttctctgaatacggcgaatctgctggctaacgacgtcgactttcattcgttcccatttgtggccttcgggaagggcataatcaaaaaatgcagaacaagtcctgatgcattcgtccaactcgcactccagctggcgcactacaaagacatgggcaagttctgcctcacttacgaggcctccatgacccgccttttccgcgaaggacgcaccgagactgtccggtcttgcacgactgagtcctgtgatttcgttcgcgccatggttgacccagctcagacggtcgagcaaagactgaagctgtttaagctcgcctccgaaaagcatcagcacatgtacagactggcaatgaccggctcgggaattgatcgtcatctgttctgtctgtacgtcgtaagcaagtatctggcagtggaatctcctttcctgaaggaggtgctgagtgaaccatggcggctgtccactagccagactccacagcagcaggtggagctttttgacctggaaaacaaccctgagtacgtttcatcaggcggagggtttgggcctgtggcggatgacggatatggggtttcctatattttagtgggggaaaacctgatcaacttccacatttcctcaaaatttagctgccccgagaccgactcccaccggttcggaaggcacctgaaagaagctatgacagacataatcacactgttcggtctgtctagtaactcaaagaagtag

SEQ ID NO: 110899 - DNA, 2322 bp, Artificial Sequence
  Description of Artificial Sequence: Synthetic coding sequence
atggccgaagcccaccaggcagtggcctttcagtttaccgtgactccggacggtatagatctccgactgtcccatgaggcactgcgtcagatttacctcagtgggctccactcttggaaaaagaagtttattcgctttaagaatgggatcatcaccggagtatacccagccagccctagcagttggcttattgtcgttgtcggcgtcatgaccaccatgtatgccaagattgatccaagcttgggtattatcgccaaaatcaatagaactttagagactgcaaattgtatgtcgtcacagacaaaaaatgtcgtctctggcgtgttgtttggcaccggtttgtgggtggcactcattgtgacaatgcggtactcacttaaggttctcctgagctatcacggctggatgttcactgagcacgggaaaatgtcacgggccacaaaaatatggatgggtatggtgaagattttctccggacgtaagccgatgctttactcattccagacctccctcccccgcctcccagtcccagctgtcaaggatacagtgaatcgctatctgcagtcggtgagacccctcatgaaggaggaggacttcaagagaatgacggcactggctcaggactttgccgtgggactgggacccagattacaatggtatcttaaactgaagtcctggtgggctaccaattacgtgagtgattggtgggaagagtatatctatctgagaggccgagggccgcttatggtcaatagcaattactacgcaatggatctactctacattctacctacacatattcaggcagcccgggccgggaacgctatccatgcaattctgctttaccgacgtaaactggaccgggaggagatcaaacctatccggctgctgggctcaaccattccactgtgttccgcgcagtgggaacgaatgttcaacactagccgcattcctggcgaagagaccgataccattcagcatatgagagatagtaagcacattgttgtctatcaccgggggcgctattttaaggtgtggctgtaccatgatggacggctgctgaagccgcgggaaatggaacagcagatgcagagaattctggataacacctccgaaccgcagccaggtgaagcgagactggcagccctgactgccggcgatagagttccttgggctagatgccgtcaggcttacttcggaaggggcaaaaacaagcagagcctggacgccgtcgagaaagccgcctttttcgtgaccctcgacgaaacagaagaaggctatcggtctgaagaccccgacacgagtatggatagttacgcaaaaagcttactgcatggcaggtgctacgaccgttggtttgacaaatctttcactttcgtggtgttcaaaaacggcaagatgggtctgaatgcggagcactcctgggctgatgcccccattgtcgcccatctgtgggaatatgtgatgtcaatcgactctctccagctgggatacgccgaagatggccattgcaaaggggatattaatcctaatatcccttacccaaccaggctccagtgggatatccccggcgagtgtcaggaagtaattgagacaagtctgaacaccgcaaatctcctggcgaacgacgtggactttcacagctttcctttcgtggcttttggaaagggtatcattaagaagtgtcgcacctcacctgatgcgtttgtccaattagcactccagctcgcacattacaaagacatgggcaaattctgcctgacctacgaggcaagcatgacccgcttgttcagagaaggaagaacagagacagtacggtcttgcaccaccgaaagctgcgacttcgtccgagctatggtggatcccgcccagaccgtagaacagagattaaaactgttcaaattggcgagcgagaaacatcagcacatgtacagacttgctatgactgggagcggtattgaccgacacctcttctgcctgtacgtggtctctaaatatctggccgtggaatcacctttccttaaggaagtgttgtcagaaccttggcgcctcagcacttcccagacacctcagcagcaggtggaattatttgatcttgaaaataaccccgaatacgtgtcttctggagggggatttggccctgttgccgatgacgggtacggtgtgtcttacatactagtcggcgagaatctgataaacttccacatttcctccaaatttagctgtcccgagacagactcacacaggttcggccggcatctgaaggaggccatgactgacattatcactctctttgggttatcctcaaattcaaaaaaatag

SEQ ID NO: 110900 - DNA, 2271 bp, Artificial Sequence
  Description of Artificial Sequence: Synthetic coding sequence
atggctgaggcccatcaggcagtggctttccagttcactgtcacccccgacgggatagatctgaggttgtctcacgaggctctgagacagatctacctaagcggccttcattcatggaaaaaaaagttcattcgcttcaagaacgggattatcaccggagtgtaccctgcgtctccgagcagctggttgatcgtagtcgtgggcgtcatgacaacaatgtatgccaagatcgatccttctctagggatcattgccaagattaaccgcacattggaaacagccaactgcatgagttcccagaccaagaatgtggtctccggtgttctgttcggcacaggcctttgggtggcactgatcgtcaccatgcgatactccctaaaagtgttactgtcgtaccatggatggatgttcacggaacacggcaagatgagcagggctactaaaatttggatgggcatggtgaaaatattcagtggaagaaagcctatgctgtatagttttcagacttcactcccacgcctgcccgttccggcagtgaaggataccgtgaacagatacctccagagtgtgcgtcctcttatgaaggaagaagatttcaaacgcatgaccgcgctggcccaggacttcgcggtaggactcggtcctaggttacaatggtacctcaaattgaaatcatggtgggcaacaaactatgtcagcgattggtgggaggagtatatctacctgcgcgggcgaggcccactgatggtgaattcaaattattatgccatggatctattatatatactccccacacacatacaggcggccagggctggcaacgccattcatgcaatcctcttatacagacggaagctcgatagggaagaaataaagcctatccgattgttgggcagcacaatccccctgtgcagcgcgcagtgggagcgtatgtttaatacctcacgaatccctggtgaggagacagatacaatacaacacatgcgcgacagtaagcatatcgttgtgtaccaccggggaaggtactttaaggtctggctttaccacgacggtcgccttctgaagcctcgggaaatggaacaacaaatgcaaaggattctggacaatactagcgagccacagcctggtgaagccaggctggcagcactgactgccggagacagagtgccttgggcccgctgtaggcaagcctactttggaaggggcaagaataaacaaagcctggacgctgtagagaaggctgcgtttttcgtgaccctggacgaaaccgaagagggttatcgtagcgaggaccccgatactagtatggactcatatgccaagtctctgttgcatggccggtgctacgatagatggttcgataagtccttcaccttcgtggtgtttaaaaatggcaaaatgggactgaatgccgagcattcctgggctgacgctccaattgtggctcacttgtgggaatatgtaatgtccatcgattcccttcaattagggtatgccgaagacgggcattgtaagggcgacataaatccaaatattccttacccaacccggctccagtgggatattcctggagagtgtcaggaggtgatcgagacgtctctaaatacagccaatctcctcgctaatgacgtggactttcatagctttccttttgtcgcctttggcaagggtatcatcaaaaaatgcagaacatcgcccgacgccttcgtacagcttgcacttcagctggctcactacaaggacatggggaagttttgcctgacatacgaggccagtatgactaggctatttcgcgaaggaaggacagagaccgtgcgatcgtgcaccactgaaagttgcgatttcgtgcgcgccatggttgatccagcccagaccgtggagcagagattaaagctcttcaagcttgctagtgagaagcaccagcatatgtaccgactcgctatgactggatctggcatcgataggcatctgttctgcctctacgtggttagtaaatatctggctgttgagtctccatttttaaaagaggtgctgtctgaaccttggcgactgtccactagccagactccgcagcagcaggtggaactttttgatcttgagaataatcctgaatacgtcagctccggtggaggttttgggcccgtagccgatgacggctacggggtaagctatattctggtgggagagaacttgatcaattttcatataagctctaagttcagttgcccagagacgggcatcatcagtcaaggtccaagctctgatacatag

SEQ ID NO: 110901 - DNA, 2319 bp, Artificial Sequence
  Description of Artificial Sequence: Synthetic coding sequence
atggctgaagcccaccaggcagtggcttttcaattcaccgtcacacctgacggcgtcgacttccgtctatcaagggaggcactgaagcatgtgtatctgtctggcattaattcctggaaaaaacgtctcatccggatcaagaacggaatcctacgtggagtttatcctggaagtcctacttcatggctcgttgtgattatggcaactgtggggtctagcttctgtaacgttgacattagcctcggactggtgagttgcatacagaggtgtctgccccagggatgcggcccctatcagaccccgcagactagagcgctgctgagtatggcgatcttttccactggcgtatgggtgactggtattttcttttttcgacagacccttaagttactactctgttaccatggctggatgttcgagatgcacggaaagacctccaatctcactcgcatctgggctatgtgtatacggcttctgtcttcccggcaccccatgctgtatagctttcagacttctctccccaagctcccagtgcctagggtgagcgccacaattcagagatatctagagtctgtcagaccacttcttgatgacgaggaatactacagaatggagctgctggcaaaagagtttcaggacaaaaccgcgcctagacttcagaagtacctggttctgaaatcctggtgggcctccaactatgttagcgattggtgggaagagtacatatacttgcggggtagaagtcccctcatggtgaacagcaattattacgtgatggatttggtgctgataaagaacactgatgtccaggccgctcgactgggaaacattatccacgccatgatcatgtatagaagaaaactggaccgggaggagatcaagcccgtgatggctttagggattgtcccaatgtgttcataccagatggagagaatgttcaataccacccgcattccaggcaaggatactgatgtgctccagcacctgagcgactctcgacatgttgcagtgtaccataaaggaagattcttcaagctgtggctgtacgagggcgctcgtctcctgaagccccaagatttagaaatgcaatttcaacgcatactggacgatcccagccctccacagcccggcgaggaaaaactcgctgccctgaccgccggtggacgtgtagagtgggcacaggctagacaggctttttttagtagcggaaaaaataaggctgcactcgaagccatcgaacgggcagctttctttgttgcactcgacgaagaatcctacagctacgatcccgaggatgaagcttctctatccttgtacggcaaagcacttctccacggcaattgttacaatcgctggttcgataagtcttttacactgataagcttcaagaatggccagctgggcctgaatgccgagcacgcgtgggccgatgcccctatcatcggccacctttgggaatttgtgctgggtaccgactcatttcaccttggatacacagaaacgggacattgcttggggaagcctaaccctgccctggcaccaccaactcgtctgcaatgggacatcccaaagcagtgtcaggccgtgatcgagtctagctaccaggtggccaaggctttggcagatgatgtggagttgtactgttttcaattcttgccgtttgggaagggcttgatcaagaaatgccgaactagccccgatgcgtttgtgcagattgctctacagcttgcacattttcgagatagggggaagttttgcctgacttatgaggcctccatgaccaggatgttccgcgaaggaaggaccgaaactgtgaggagctgcacgtctgagtcgaccgcctttgtccaagccatgatggagggaagtcacaccaaagcagatttgcgcgacttgtttcagaaggcagctaaaaaacaccagaatatgtaccgcctggctatgactggggccggaatagatagacacctgttctgcctgtatctggtgtctaagtacctgggagtgagttctcccttcctggccgaggttctctccgagccatggaggctctccacatctcagatcccacagtcacagattcggatgtttgatcccgaacagcaccccaaccatctgggcgcaggtggcggctttggccccgtcgccgacgacgggtatggcgttagctacatgattgcaggagagaatactatctttttccacatttccagtaagttctccagttccgagacaaacgcacaaagatttggtaatcacatacgcaaagcactcctggatattgcagacctctttcaagtccccaaagcctacagttag

SEQ ID NO: 110902 - DNA, 2319 bp, Artificial Sequence
  Description of Artificial Sequence: Synthetic coding sequence
atggccgaggctcatcaggcagtggccttccaattcacagttacccctgatggggttgatttccgcctgagtcgggaggcactcaaacatgtctacctgagcggcatcaactcatggaagaaacgtttaataaggattaagaacggaatattgagaggtgtatatcccgggtcacccaccagctggttggtggttattatggctaccgttggctcgtctttttgcaacgtcgacatctccctcggtctggtgtcatgcattcagcgctgtctgcctcagggttgtggaccctaccagacccctcagacaagagcgctgctctctatggcgatcttcagcaccggcgtgtgggtaaccggcatcttcttcttcagacaaacgctgaagctgctattgtgttatcacggttggatgttcgagatgcatggaaagaccagtaatctaacgagaatttgggccatgtgtatcagactgctgagtagcaggcatcccatgctgtattcttttcagacatctcttcctaaactaccggtgccaagagtgtctgcaactatacagcggtacctagagtccgtcaggcccttgttagatgatgaagagtactaccgcatggaactgcttgcgaaagaatttcaggataagactgcacctcgtctccagaaatacctcgtcctgaagtcctggtgggcatctaactatgtctcagactggtgggaggaatatatctacttgcggggccggtccccattgatggttaactctaactactatgtcatggaccttgtcctaattaagaacaccgacgtgcaggccgcacggctcggtaatatcattcacgccatgatcatgtacagaaggaagctggaccgtgaagagataaagcccgtgatggccctggggattgtgcccatgtgctcatatcagatggagaggatgttcaacacaacaagaattcccggcaaggatacggacgtgctgcagcatctctccgactcaaggcatgtggctgtctaccataaggggcgcttttttaagttgtggctttacgaaggtgccagactcctgaagccacaggatctggagatgcagttccagaggatacttgacgatccctctcctcctcaacctggcgaagagaaattagcagccttaacagccggaggacgggttgaatgggcccaggcccgccaggctttcttttcctctggcaaaaataaggccgcacttgaggcaatagagagagctgcatttttcgtggctttggacgaggagtcctactcctacgatccggaagatgaggcctccctatctctgtatggcaaggccctccttcacggcaactgttacaacagatggttcgacaagtcctttactctcatctccttcaagaacgggcagctcggtcttaacgctgaacacgcctgggctgacgcccccattattgggcatctctgggagtttgtccttggtactgatagcttccacctggggtacacggaaaccggccattgcctgggcaaaccaaatccagctctagcccctccaacaagactgcagtgggacattccgaagcagtgccaagcggtgattgaatccagctaccaagtggctaaggctcttgctgatgatgttgaactgtactgcttccagttcctgccatttgggaagggtctgatcaagaaatgccggaccagccccgatgcctttgtccaaattgccctgcagctggctcacttccgcgacagggggaagttttgtctgacttatgaggcatccatgacacgaatgttccgtgagggtagaactgaaaccgtcagatcatgtacctctgagagtactgcttttgttcaggcaatgatggagggaagtcacacaaaggctgatttacgcgaccttttccagaaagcagcaaagaaacaccagaacatgtaccggttagctatgacgggtgctggtatcgacagacacctgttctgtttatacctagtctccaagtacctgggggtctcttccccctttcttgcagaggtgctatccgaaccatggcgcttaagcacaagtcagatcccacagagtcaaattcggatgttcgacccagaacaacaccctaatcacttgggcgccggtggcggcttcggcccagtggctgacgatggatatggtgtgtcttacatgatagccggcgagaacacaatcttcttccacattagcagcaagttttccagctcagaaaccaacgctcagcgctttggcaaccatatccgtaaagctctactggacatcgcggacctgttccaagtgcctaaagcctattcatag

SEQ ID NO: 110903 - DNA, 2319 bp, Artificial Sequence
  Description of Artificial Sequence: Synthetic coding sequence
atggcagaagcacaccaggccgtggcctttcaatttaccgtcacccctgacggagtggatttcagattgagccgagaggcactgaagcacgtttatcttagcggaatcaacagctggaaaaaaagactcataagaataaagaacggcatcctgcgcggggtgtatccgggctcacctaccagttggctggtggtgattatggccacagtgggatcaagcttctgtaacgtggacatatccctggggctcgtctcatgtatccagcgttgcctcccgcaaggatgcggtccctaccaaacaccccagacaagagcactgctgagtatggccatattttcgactggggtatgggtgaccggtattttctttttcagacaaaccctgaagctgctgttgtgttatcacggatggatgttcgaaatgcatgggaaaactagcaatctgactaggatatgggcaatgtgcatacgcctcctgagcagtcgccacccgatgctgtactctttccagaccagcctccccaagctgccagttccaagagtgagcgcaaccatccagaggtacctggagtcagttagacccctccttgatgatgaggagtactatagaatggaattgcttgctaaggagttccaagacaagaccgccccgcgactgcaaaaatatctcgtgctaaaatcctggtgggcatctaattatgtgtctgattggtgggaagagtacatctatctccgcgggagaagtcccctcatggtgaatagcaattattacgttatggatctggtgctcattaagaatacagatgtacaggctgcccgattgggcaatataatccatgccatgataatgtatcgcaggaagctggatagagaagaaattaagccagttatggctctggggatcgtgccaatgtgcagctaccagatggagcgtatgtttaacactacaagaattcccggtaaagacacagacgtattacagcatttgtctgacagtcgccacgtggcggtgtatcacaagggacggttcttcaaattgtggctgtatgaaggggcgagactcctcaagccccaagatctggaaatgcagtttcagcgcattctcgacgacccctccccacctcaacctggagaagagaagctggcggccctcactgctggaggccgagtcgagtgggcgcaggcgcgacaggcctttttttcgagtggtaagaacaaagctgcactggaggctatagagagagcagccttctttgtcgcccttgatgaggagtcctactcttacgatccagaagacgaggcttccctgtcactttacggcaaggccctactgcatgggaattgctacaacagatggtttgataagtcattcactctgatctccttcaagaacgggcagctcggactgaacgctgaacacgcctgggcagacgccccgatcatcgggcatttatgggaattcgtacttggaaccgacagtttccacttgggatataccgagacgggccattgcctcggcaaacccaatccagcgcttgcaccaccaacacggcttcaatgggacattcccaaacagtgtcaggcagttatcgaaagtagctatcaggtcgccaaagcgctcgcagatgatgtggaactttactgtttccagttccttccattcggtaagggactgattaagaaatgcagaacgtctcctgatgcctttgtgcagatcgccttgcagctagcacattttagagatagagggaaattttgcctgacgtacgaggcttccatgacccggatgtttcgggaaggcaggacggagacggtccgaagttgcaccagtgaatctactgcttttgtccaagccatgatggagggttcacacaccaaggcagacctaagagacctcttccaaaaggccgcaaaaaaacatcaaaatatgtatcgcctggctatgacaggcgcaggaatcgataggcatctattctgtctgtacttagtgtctaagtatctgggcgtctcctccccctttctcgcggaggtcctgtcggaaccatggcgcctttccacctctcaaattccccagtcgcagatcaggatgtttgatccagagcaacatccgaaccatctcggagcggggggtggttttgggcccgtggccgacgacgggtacggggtatcttacatgatcgcaggggagaataccatcttttttcacatctcctccaagttctccagctccgaaaccaatgcgcagcggtttggaaaccatattagaaaggccctgttagacatcgctgatctgttccaggtacccaaagcgtactcgtag

SEQ ID NO: 110904 - DNA, 2319 bp, Artificial Sequence
  Description of Artificial Sequence: Synthetic coding sequence
atggctgaagcccatcaggcggtcgcctttcagttcaccgttactcccgatggggtggatttcaggctttcccgggaggcactcaaacacgtgtaccttagtggaattaattcctggaaaaagcgtctcattaggattaagaatggtatcctacgtggcgtgtacccgggaagtccaacctcatggctggtagtcatcatggccacggtgggctcatctttctgtaacgtggacatttccctcggcctggtgtcgtgcatccagcggtgcttgccacaaggctgtggaccgtatcaaacccctcagaccagggccctgctgagtatggccattttctcgacgggagtctgggtcactggaattttctttttccgtcaaaccttaaagcttctgctgtgttatcacgggtggatgttcgagatgcacggcaagaccagcaatttgaccagaatctgggccatgtgcataagattattgagctcaagacaccccatgctctactcctttcagactagcctgccaaagctgcctgtgcctcgtgtatctgccaccatccaaagatatcttgagtccgtaaggccacttctcgacgatgaagagtactaccgcatggaactgctcgctaaagaatttcaggataaaactgctccaagactgcagaagtatctagtgctcaaatcctggtgggcctcaaattacgtgtccgattggtgggaagaatatatttacctgagaggccggagccctctgatggtcaacagcaattactacgtcatggacctggtgttaatcaagaacacagacgtgcaggctgcccgcctgggcaacattattcacgctatgataatgtatcgcaggaagctcgatagagaggagattaaacccgtaatggcattgggcattgtgccgatgtgctcctatcagatggaacgcatgttcaatacaaccagaattccaggaaaggatacagacgttttacagcacctgagcgactcccgccacgttgccgtatatcacaaaggtcgtttttttaagctgtggctgtatgaaggtgcacggctgctgaagcctcaagatctggagatgcagtttcaaagaattctggacgacccaagccccccccagccaggagaagagaaacttgcggcactgaccgcgggcggacgcgtagaatgggctcaggctaggcaggcattctttagcagtggaaaaaataaggctgccctggaggccatagagagagccgcctttttcgtggcactggatgaggaatcttattcatacgaccccgaagatgaggcttcccttagcctctacggcaaggccctactgcatggaaactgctataatcgatggtttgacaagtctttcaccctgatttcgtttaagaatggtcagctggggctgaacgctgaacacgcctgggctgatgccccaataattgggcatctgtgggagtttgtgctaggaacagattcctttcacctgggttacacagagacaggacactgtttgggcaaacccaaccccgcccttgcacctccgactcggctccagtgggatattccaaagcagtgccaggccgttattgagtctagttaccaggtggccaaggcgctcgccgatgacgtggaactgtactgtttccagtttctgccttttgggaaggggctgataaaaaaatgcaggacatcccccgatgcctttgtgcagatcgccctgcagctggcccactttagagaccgcggcaaattttgcctaacctatgaggcaagcatgaccagaatgtttagagaaggaagaacagaaaccgtgcggtcttgcacatcagagtctacagcgttcgtccaggccatgatggaaggctcacataccaaggctgacctgagagatctattccagaaggcagctaagaaacatcagaatatgtaccggctcgctatgaccggcgctggaatcgacagacaccttttctgtctctacctggtgtcaaaatatctcggcgtctccagtccatttctggctgaggtgcttagcgagccatggcgcctgtcaaccagtcagatccctcagagtcagatccggatgttcgatccagagcagcatccaaaccatttgggcgcaggtggcggctttggcccagtcgccgatgacggttacggagtgtcttacatgattgctggtgagaataccatattctttcacatcagcagtaagtttagttcatccgaaacaaacgctcagaggttcggaaaccacatacggaaagctctactggacatagccgatctctttcaggtgcccaaggcatacagttag

SEQ ID NO: 110905 - DNA, 378 bp, Artificial Sequence
  Description of Artificial Sequence: Synthetic coding sequence
atggccgaggcacaccaggccgtggcattccagttcaccgtgacccccgacggcgtggatttcagactctccagggaagccctaaaacacgtctatctgagtggcatcaactcctggaagaagagactgatcaggattaagaatggcattctccgtggtgtgtacccaggatctccaacgtcttggttagtcgtaattatggctaccgttggtagctccttttgcaacgtggacatatctttaggcttggtttcttgcattcaacgctgcctgccccagggttgcgggccctatcaaacacctcagacgagagctttactttcaatggcaatcttctccacaggggtttgggttaccggaatcttttttttcaggtag

SEQ ID NO: 110906 - DNA, 1704 bp, Artificial Sequence
  Description of Artificial Sequence: Synthetic coding sequence
atggagcttcttgccaaagagtttcaggataaaaccgccccaagattgcaaaagtacctggtcctgaagagttggtgggcaagtaattatgtatctgattggtgggaggagtatatctatttgcgggggagatctcctctgatggtcaacagcaattattatgtgatggatctcgttctgatcaaaaatactgatgtgcaggccgcccggctgggcaatatcattcatgcaatgatcatgtacagacgcaagttggacagggaagagattaaaccagtgatggctctgggaattgtgccgatgtgtagttaccaaatggaaaggatgttcaacacaacccggataccagggaaggatactgacgtactccagcatctttccgattcccgccacgtggccgtgtaccataagggtcgctttttcaaactgtggctgtatgagggggcgaggcttctgaagcctcaggatctggaaatgcagttccagagaattctggacgatccttcaccaccccagcccggggaagagaaactcgcggcgctgacggctggcggacgagtggaatgggcccaggcaaggcaagctttcttctcttcgggcaagaacaaagcagccttggaggctattgaaagagccgcattcttcgtggccctggacgaggagtcctactcctacgacccagaagatgaagccagtctttcattgtatggcaaggctttactccatggtaattgttacaacaggtggttcgacaaatcgttcaccctgattagttttaagaatggacagctgggattgaatgccgagcatgcctgggccgacgcacccattatcggacacctgtgggagttcgtactaggtactgacagctttcaccttgggtacaccgaaacagggcactgtctagggaaacccaaccccgctttggcaccaccaaccagactccaatgggatattcctaagcaggccgtgatcgaaagctcgtaccaggtagccaaggctctggccgatgacgtggagctttactgttttcagttcctgcccttcggaaaaggccttataaagaaatgccggacaagcccagacgcatttgttcagatcgcactccaacttgcacactttagagaccgtgggaaattctgtttgacctacgaagccagtatgacccggatgtttcgcgagggccgaaccgaaaccgtccggtcatgcacctccgagagcaccgcctttgtgcaagctatgatggaggggagtcatactaaggccgacctccgagacctcttccagaaagccgcgaaaaaacaccaaaatatgtaccgtctggctatgaccggggcggggatcgaccgccacctcttctgcctgtacctggtgagcaaatacctcggagtttcgagtccgttcctggcagaagtgctttccgagccctggcggctatccacatctcagataccacaaagccagatcagaatgttcgatcccgagcagcatcccaatcatcttggagccggtggcgggttcggcccagttgcagatgacggttacggcgtgtcatatatgatagctggggaaaacactatttttttccatatttctagcaagtttagtagctctgaaactaacgctcagcggttcggcaatcacattcgcaaagccttgctcgacatcgctgatctgttccaggtgcccaaagcttattcgtag

SEQ ID NO: 110907 - DNA, 2076 bp, Artificial Sequence
  Description of Artificial Sequence: Synthetic coding sequence
atggcagaggcgcatcaggcggtggccttccagttcacggtcactcctgatggcgtggactttcggcttagcagggaggcactcaagcatgtctacctgagtggaataaattcctggaaaaagaggctcataaggattaagaatggcatccttcgaggagtctaccccggaagtcccacctcctggctggtcgttataatggcaaccgtgggaagctcattttgtaatgtggacatcagtctcgggctcgtatcctgcatccagcggtgtctgccccagggctgcggcccttaccaaactcctcaaaccagagcactgctatccatggctatattctccaccggcgtgtgggtgaccggaatattttttttccggcagaccctgaaactgttactgtgctatcacggatggatgtttgaaatgcacggaaagacaagcaacctgactcgcatttgggcaatgtgtatcaggctcttgagcagccgccatcccatgctgtactcatttcaaacctctctgcccaaactgcccgtacctcgggtgtccgccacaattcagaggtacctcgagtctgtgaggccgctgctggatgatgaggagtactacagaatggagctcctggccaaagagttccaggacaaaactgctccccgtctgcaaaagtacctggtgctgaagtcttggtgggcctcaaattacgttagcgactggtgggaggagtatatttacttacgcggaagaagtccactgatggttaactctaactattacgttatggatctcgtgctgattaaaaacactgatgtgcaggctgccagactggggaatataattcacgcaatgatcatgtacaggagaaagttagaccgcgaggagatcaaaccagtcatggccttaggaattgtccctatgtgttcctatcagatggagcgtatgttcaacaccacccgtataccgggaaaagataccgacgtgctgcagcacctatccgattctcggcacgtggccgtataccataaaggcaggtttttcaagctgtggctgtacgagggcgcccggctccttagtctctacggaaaggcactgctgcatgggaattgctataatcgctggttcgataaatccttcactcttatttcttttaaaaacgggcagcttggcctaaatgctgaacatgcctgggcggacgctccaattatcgggcacctgtgggagttcgtgcttggaaccgattccttccacctgggctacaccgagactggtcactgtcttggaaagcccaacccagctttggcaccccccacgagactgcaatgggacatccctaagcagtgtcaagctgtgatcgagtcctcataccaggtggctaaagccttggccgatgatgtggaactgtattgtttccagttcctgccctttggaaaagggctgatcaaaaaatgtagaaccagtccagacgcgttcgttcagatcgctctccagctggctcatttccgggaccgtggcaaattctgcctcacatacgaggcttccatgacaagaatgttcagggaagggaggaccgagacagtgcgttcctgcacaagtgagtctacggctttcgtccaagcgatgatggaggggtcccacaccaaggctgatttgagagatctctttcaaaaagcagcgaagaaacatcagaatatgtacaggctggccatgaccggggccggtatcgataggcacttgttttgcctgtatctggtctctaagtacctgggggtgtcttcccccttccttgcggaagttctgtcggaaccctggcgactgtcaacatcacagataccacaaagccagatcaggatgtttgatcccgaacaacatcctaaccaccttggagccggcgggggctttggtcctgtcgcagacgacggctacggggtgtcttatatgatcgccggagaaaacaccatctttttccacatcagttcaaaattctcctcctctgaaaccaacgcccagaggtttggcaaccacattaggaaggccctgctcgacattgccgatctttttcaggtaccaaaagcttattcttag

SEQ ID NO: 110908 - DNA, 2217 bp, Artificial Sequence
  Description of Artificial Sequence: Synthetic coding sequence
atggcagaagcgcatcaggctgtagcatttcagtttacagtgactccagatggagtggatttccggctaagccgggaggcgctgaaacacgtttacctgagcgggataaactcctggaagaaaaggctaattagaataaagaatggtatcctgcggggcgtgtaccccggctcccccactagctggcttgtggtaatcatggctaccgttggcagttccttttgcaacgtggacatctctctgggcctggtgtcctgcatccagaggtgcctgccccaaggctgcggcccatatcagacacctcaaaccagggcgctgttgagtatggccatattctctacaggcgtttgggtgaccggaatcttttttttcagacaaaccttaaaactgctgctgtgctaccacggatggatgttcgagatgcacggcaaaacaagcaacctcacgcggatttgggcctatcttgaatctgtccgacctctccttgacgacgaggagtactacaggatggagcttctggcaaaagaatttcaggataagaccgcgcctcggctgcaaaaatacttggtcctaaaatcatggtgggcgtcaaactacgtttctgactggtgggaggagtatatctacttgcgaggcagatccccactgatggttaacagtaattattacgttatggacctcgtgctcatcaagaatactgatgttcaggctgctcgcctcggcaatataattcacgccatgatcatgtaccgtagaaaactagacagggaagagataaaacctgtcatggccctcggtattgtacccatgtgttcctatcaaatggaaagaatgttcaacactaccagaattcctggtaaggataccgacgtcttgcagcacctctctgactctagacacgtcgcagtatatcataaaggccgtttcttcaaactctggctgtatgagggtgccagactgctcaaacctcaggatctggagatgcaatttcagcgtatccttgatgatccttcaccccctcagcccggggaagagaaactcgctgccctgactgccggaggccgtgtggaatgggcacaggcacgacaagctttcttctccagcgggaaaaataaggctgctctggaggctattgagcgcgccgccttctttgtggccctggatgaagagtcctatagttatgatccagaggatgaggccagcttgagtctgtatggcaaagccctgctgcacggcaactgttacaacagatggttcgataaaagtttcacactgatcagcttcaaaaacggacagctcgggctgaacgcagagcatgcttgggccgatgccccgattatcgggcatctgtgggaatttgtactgggcacagactctttccacttaggttatactgagacggggcattgtttaggcaagcccaatcctgcccttgcacccccgaccaggctgcagtgggacatccccaaacagtgccaggctgttattgagagcagctaccaggtggctaaggccctggccgatgatgtggagctgtattgctttcagttcctgccttttggcaagggcttaattaagaagtgtcggacaagtccggatgcattcgtgcaaattgccctccagttagcccatttcagggaccggggtaaattttgcctgacctatgaagcgagcatgaccagaatgtttcgagagggtagaaccgagacagtcaggtcctgtacatcagagagcactgcctttgttcaagcaatgatggagggctcacatacaaaagccgacttgagggatctatttcaaaaagccgctaagaagcaccagaacatgtacaggctggccatgacaggggcaggaatcgatagacacttgttctgtctgtatttggtgagtaaatatctgggcgtcagttccccatttctggcagaggttcttagcgagccgtggaggttgtcaaccagtcagatcccacagtctcagatcaggatgtttgaccccgagcagcaccctaaccacttgggtgccggcggaggtttcggcccagtggctgatgacggatatggagtgagttatatgatcgctggtgagaacacaatcttttttcacatttcatctaagttttcatctagcgagacaaacgcacagcggtttggtaatcacattagaaaggccttgctagacatcgctgacctattccaggtcccaaaggcctacagctag

SEQ ID NO: 110909 - DNA, 1458 bp, Artificial Sequence
  Description of Artificial Sequence: Synthetic coding sequence
atgttatttagctaccagcgatcgctgccaagacaacccgtaccgagcgtgcaggataccgtgcggaaataccttgaatctgtacgccccattctgtccgacgaggacttcgattggacagctgttcttgcccaagaatttctgagattgcaggcaagtctgctgcaatggtatcttcggctgaaatcttggtgggctagcaactatgtgtccgattggtgggaggagtttgtttatctccgatccagaaatcctctgatggtcaactcgaactactacatgatggactttttgtacgtgaccccaacccctctccaggccgcgcgcgcgggtaatgccgtccacgccctcttactctatcgtcacaggcttaatcgccaggaaatcccaccagtgagaggaccccaatgggtacgggacggcggagttgtcttatggccattaggccatgtgggtccgggaaggcagctgacagctcatggcttcctccagacacttctcatgggcatgcgacctctctgttccgcacagtatgagaaaatttttaatactacaaggattcctggcgttcagaaggactatatccgccacttgcatgattcacagcatgtggctgtcttccacaggggccgcttttttagaatgggaactcattcaaggaactctttgttgtccccccgcgccctcgaacagcagtttcagagaattttagatgatccaagccctgcttgcccacacgaagagcatttggctgctctcaccgcagcccctcggggcacctgggcccaagtgcgcacatcactgaaaacccaggccgcagaggccttagaggcagtggaaggagccgcgttttttgtcagcttggacgcagagcctgccggtcttacccgggaggacccagccgcctcattggacgcatacgctcatgcactcctggccggccgcggccacgacagatggtttgataaaagcttcactctcatcgtcttcagtaatgggaaattgggcttatctgtggaacatagctgggccgattgccccatttctgggcacatgtgggaatttacgcttgcgaccgaatgcttccagctcggctatagtactgatggacactgtaaaggacatcctgacccaaccctgccgcaacctcaaagacttcagtgggaccttccggatcagatccacagctccatctcgctggcccttcgaggggctaaaatcctttccgaaaacgtggattgtcacgtggtgcccttctccttgttcggtaagtccttcatccggcggtgccatcttagctccgacagctttatacagatcgcacttcagctggcccatttcagagtgagctgggtgccccatcctcaacctccccagggtctcagcccacctgaaccccctcgacccgccccgccacgcttcctggtggtggcagccatagtagggcgcccctcttag

SEQ ID NO: 110910 - DNA, 2412 bp, Artificial Sequence
  Description of Artificial Sequence: Synthetic coding sequence
atggccgaagctcatcaggcagtcggcttccgcccgagccttacctccgacggcgctgaagttgaactgtctgctccagtgttgcaggagatctatttgtctggcttgcgtagctggaagaggcatcttagccggttttggaatgacttcctgacaggcgtctttcctgcctctcctcttagctggttgtttctcttctccgcgattcagctggcatggttcttgcagctggatccatcgttgggactcatggaaaagatcaaggaacttctgcccgattggggcggccaacaccatgggcttcggggagtgctggcagccgctctgttcgcctcgtgcctgtggggcgccctgatattcacactccacgtggcactaaggctcttgctgtcttaccatggctggctcttagagccccacggagccatgtccagtcctaccaagacctggctggctttagtccggatttttagcgggagacatccgatgctgtttagttatcagcgttccctgccaagacagccagtcccaagtgtgcaggatacagttagaaagtatctggaatccgtcaggcctatcttatccgacgaagacttcgattggactgctgtcctcgcacaggagttcctccgtttacaggcttccctgctgcagtggtacttgagactgaaatcatggtgggcctccaattatgtatccgattggtgggaagagttcgtatacctgcgctcccggaaccctctgatggtcaatagtaattactatatgatggacttcctgtacgttacgccaacccccctgcaggcagccagagcagggaacgccgtacacgcgctcctgctgtatcggcatcgcttgaaccgccaggaaattccacctactctgctcatgggaatgcgacctctgtgttctgcccagtatgaaaaaatcttcaataccacacggatcccaggagtgcagaaggactatatacggcacctgcatgattcacaacacgtggcggtctttcatcggggccgcttttttagaatgggaacacattctagaaactcgctgctcagccctagggccctggaacaacaattccagagaattcttgacgatccatccccagcatgcccccatgaggaacacctcgccgccctgacagccgcacccaggggtacctgggcacaggttagaacgtccctgaaaacgcaagctgccgaggcactcgaggcagtcgagggtgccgcctttttcgttagcctggatgcggagcctgccgggcttacacgcgaggatcctgccgcatccctggatgcctatgcccatgcattgctcgcgggtcgaggccacgatcgctggtttgacaagtcctttacactcattgtgttcagtaacggcaagctgggtctgtccgtggagcactcttgggccgattgtccgatttccggtcacatgtgggaatttacgctcgccaccgagtgctttcaactgggatactcaactgacgggcactgtaagggtcatcctgatccaacactcccccagccccaacggctccagtgggatctcccagaccagattcatagctcaatttcattggcgttgcgtggcgctaagatcctgtcagagaacgttgattgtcacgtggttcctttctctcttttcggcaagtccttcatccggcggtgccatctgtcaagcgattcttttattcaaatcgccctgcagctcgctcacttcagggatcgcggacagttctgcctgacatatgagtccgccatgacccgcctgttccttgaggggaggacagaaaccgtccggagctgtactcgcgaggcctgcaacttcgtgagggcgatggaggacaaggagaagactgacccccagtgtttagccctgttcagggtcgcagtggataagcatcaggccttgttaaaagccgctatgagcggccagggcgtcgaccggcacctgttcgcactgtatatcgtgtcccggttccttcatttacagtcacccttcttaacgcaggtgcactctgaacagtggcagttatcaacctcgcagattcctgttcagcaaatgcatttgtttgacgtgcataattatccggactatgtctcctctggcggggggttcgggcctgcagatgaccacgggtacggcgtgtcctatatattcatgggagacggaatgatcaccttccatatatcgtctaaaaagagctctaccaaaaccgactcacaccggctcggacagcacatcgaggatgccctcctggacgtggcctcactctttcaggccgggcagcacttcaagcgcaggttcagaggcagtggcaaggagaactccaggcaccgctgcggctttctgagtcggcaaaccggagccagcaaggcctcgatgacctctactgacttctag

SEQ ID NO: 110911 - DNA, 2145 bp, Artificial Sequence
  Description of Artificial Sequence: Synthetic coding sequence
atggccgaggcccatcaagccgtgggctttagaccatccctgacgagtgacggagctgaggtagagctaagcgcacccgtcctgcaagaaatatacttaagcggactgaggtcttggaagaggcatttaagccgattttggaatgacttccttactggagtttttccagccagcccactgtcctggctttttctgtttagtgccatccagctcgcttggtttttgcagctggacccaagcctcgggctgatggagaagataaaggagctgcttccagattgggggggacagcatcatggattgagaggggtgctggcggccgccctgttcgcctcgtgtttgtggggggccctgatctttactcttcacgttgcactgagactcttgctttcgtaccacggctggcttctggaaccccacggcgcaatgtcaagtcctactaagacctggttggctcttgtgcggatctttagcggcaggcacccaatgttgttctcttaccagcggagtctgcccagacagcccgttcccagtgtacaggacacagtccggaagtatctggagtccgtacgacccatcctgtctgacgaggattttgactggaccgctgtcctcgcacaggaattcctcaggctgcaagccagtttgctgcaatggtaccttaggctgaagtcgtggtgggctagcaactacgtcagcgactggtgggaggaatttgtgtatctgaggagcaggaaccccctcatggtcaacagtaactactacatgatggattttctatatgtcaccccaacaccattgcaggccgctagagctggcaatgctgtgcacgcccttcttctctacagacatcgcctgaaccgccaggaaatccctcctaccctgctcatgggtatgaggccgctttgctctgcccagtacgagaaaatcttcaataccacaagaattccgggcgtccagaaggattatataaggcaccttcatgattctcagcacgtagccgtattccatcgggggaggttttttagaatgggaacacattctcggaattcattgctgtccccaagagctctggagcagcagttccagaggatcctggatgacccttcaccagcctgccctcacgaagagcacctggcagcattaactgccgcccccagaggcacatgggcccaggtgcgtacaagtctgaagacacaggccgctgaggcactggaagccgtcgagggcgccgccttctttgtctcattagacgctgagcctgcagggctgacccgcgaggatccggccgcctctctggacgcgtacgcccatgcactacttgccgggagaggacacgatcggtggtttgataaatcttttacgctgatcgtattcagcaatggaaaacttggactgtctgtggaacacagttgggccgactgccccatctcaggccacatgtgggaattcacacttgccactgaatgcttccagctgggatacagtaccgacgggcactgtaaggggcatccagatcctacacttccacagccccaacggctgcagtgggatcttcccgaccagattcactcttctattagtctcgcactgagaggcgctaaaatactgtcggaaaacgtagattgccatgtcgtgccgttctcattatttggcaaatccttcatcagacgctgccatctctcatctgattccttcattcagattgccttgcagctggctcatttccgcgatcgcgggcaattctgcctcacctacgaatctgcaatgacgaggctatttttagaaggcaggaccgaaaccgtgaggtcctgcacacgcgaagcctgtaatttcgttcgcgctatggaagacaaggagaagaccgccgacgaccatggatatggagtaagctacatcttcatgggcgatgggatgatcacctttcatatctcctcaaaaaagagctctaccaaaacagactcccaccgactcgggcagcatatcgaagacgcacttctggatgtggctagcctgttccaagcaggccagcacttcaagagacgattcagaggatccgggaaggaaaattctcggcaccgctgcggcttcctgagccggcagacgggtgcctcgaaagctagcatgacatctacagatttctag

SEQ ID NO: 110912 - DNA, 2412 bp, Artificial Sequence
  Description of Artificial Sequence: Synthetic coding sequence
atggccgaggctcaccaagcggtcggcttccgccctagtctgacctcagacggcgccgaggttgaactctcggcacccgtgctccaagagatatatttaagcggcctgagatcttggaaaaggcacctctcccggttctggaacgactttctcactggagtctttcccgctagtcctctcagctggctatttttgtttagtgctatccagttggcctggttcctccagctagacccatccctgggtctgatggaaaagattaaggagctccttcccgactgggggggacagcaccatggcctcaggggagtgttagcagccgccctattcgcatcctgcttatggggtgcactcatctttacgctgcacgtggcactccgactacttctttcctaccatggctggctgctggagccacatggtgcgatgtctagccccacaaaaacttggctggccctagtgagaattttctctggccggcaccccatgctcttctcctaccagaggtccttgcccaggcagcccgttccatccgtccaggacacagtgcggaagtacctggaatcggtcagacccattttgagcgatgaagatttcgactggaccgcagtgctggcccaagaatttctcaggctccaggccagtctgttgcagtggtatctgcggttaaagtcttggtgggcaagcaattatgtatccgattggtgggaggagttcgtgtatcttcggagcaggaaccccctgatggtcaatagcaattactatatgatggacttcctgtacgttacccccacccccctccaagcagccagggctggcaatgcagtccacgccctgctgctttacaggcacaggttgaatcgacaggaaatcccacccacgctgctcatgggaatgcgcccgttgtgctctgcacaatatgagaaaatcttcaacaccacgcggataccgggtgtgcagaaagactacatcaggcatctgcacgacagtcaacatgtcgcagtgtttcaccgtggtagatttttcagaatgggcactcactcacgtaacagcctgctctcgccccgcgcccttgagcagcagtttcagagaattcttgacgatccctccccagcctgtccccacgaggaacacttggctgcccttactgcggcccccagaggcacgtgggcccaggtccggactagcttgaaaactcaggccgcagaggccttagaggcagtcgaaggggctgcgttcttcgtttcgctcgacgcggagcctgctggcctgacaagggaggacccggccgcctctctagacgcatacgcccatgcattgctggccgggcgtggccatgatcgctggtttgataagtcttttacattaatagtcttttccaatggtaagcttgggctgtctgtggagcactcttgggccgattgtcccatctccgggcatatgtgggagtttacgttagcaaccgaatgctttcagctgggatactcaacagacggccactgcaagggccaccccgatccaacactgccgcaaccgcagaggctgcaatgggatttacccgatcagatccacagctcaatctcactggccctgaggggagctaaaatactgtcggaaaatgttgactgtcatgtggttcccttttccctgttcgggaagtcattcatccgacgttgccacctgagcagcgatagcttcattcagattgcacttcagctggctcactttcgcgaccgtggtcaattctgcttgacatatgagagtgctatgacacgcctcttcctggagggcagaactgagaccgtgcgaagttgtacaagagaagcatgtaacttcgtgcgcgccatggaggacaaggagaagaccgatccacagtgcctggctctgttcagagtggctgtcgataaacatcaggccctgctgaaagccgcgatgagtggacaaggggtcgacaggcatctgttcgcactgtacatcgttagccgctttctgcacttgcagtcaccctttctgactcaggtgcacagcgaacaatggcagctttccacctcccaaatacctgtgcaacagatgcacctgtttgacgttcataattatcctgactacgtcagctcagggggaggattcggtcccgccgatgaccatgggtacggcgtgtcatatattttcatgggcgatggcatgataacttttcacatttcctccaagaagtccagcactaaaaccgattcccaccggctcgggcagcacattgaagacgcccttttggacgtggcaagcttgttccaggctgggcaacatttcaagaggaggttccggggtagcggcaaagagaacagtaggcaccggtgcggatttctttctaggcagaccggtgccagtaaggctagtatgaccagcaccgatttttag

SEQ ID NO: 110913 - DNA, 2379 bp, Artificial Sequence
  Description of Artificial Sequence: Synthetic coding sequence
atggccgaagcccaccaagctgtaggctttcgcccttcccttacatctgacggggccgaagtggaattgagtgcaccagttctccaggagatttatctgtctggtcttaggtcctggaagcgccatctctcaaggttctggaatgacttcctgactggagtctttcctgcttctccgctctcatggctgttcctgttttccgccatccagttggcatggttcttgcagcttgacccatcgctgggcctcatggaaaaaatcaaagaactgctccccgactggggggggcagcaccacggcctccgcggcgttctcgcagctgcactattcgcctcctgcctgtggggcgccctcatttttacccttcacgttgccctgcgtttactccttagctaccatggctggttgttagaacctcatggagccatgtcctcaccgaccaagacctggctggcattggtccgaattttctctgggcgccatcctatgcttttttcctatcagcgctccctaccccgtcaaccagtgccttcagttcaggatactgtccgtaaatatctggagtctgtgcggccaatactgagcgatgaggatttcgattggacggccgtcttggctcaagagttccttcgactgcaggcatccctgctccagtggtacctcagacttaagtcctggtgggcctcgaattatgtttcggattggtgggaggaatttgtctacctccgctcccgcaaccctctgatggtaaatagtaattattatatgatggctgcccgggcgggtaacgccgttcatgccctgctgctgtaccgccatagattaaaccgtcaggagatccctccaacgctgcttatgggaatgcgcccactgtgcagtgcccaatacgaaaagatatttaacactaccaggatcccgggagtacagaaggattacatacgacacctccatgatagtcagcatgtagccgtctttcacagaggcagattctttcggatggggacccactctaggaactccctcttgagtcccagagccttggagcagcagttccagcggattcttgacgatccgtcaccagcatgtcctcacgaggagcatctagccgcgttaacggccgctcccaggggcacctgggcgcaagtgcgaacgagcctgaagacccaggccgccgaagcgctggaggccgtcgagggggctgccttctttgtatctttggatgccgagcccgctggacttacaagagaagaccccgccgccagccttgacgcgtacgcccatgccctgctcgcaggtcgggggcacgaccggtggtttgataaatcttttaccttaatcgtgttcagcaacggaaaactgggactctccgtggaacacagttgggccgactgccccatcagtgggcacatgtgggaattcactctggctaccgagtgctttcaattaggatacagcacagacgggcactgtaaagggcacccggacccaacgttgcctcaacctcagagactccaatgggacctgcctgaccagatccatagcagtatttctctcgccctcaggggtgcaaaaattctgtcggagaacgttgattgtcacgtggtcccgttttccctgtttggcaagagcttcataaggcgctgccatttatcgtccgatagctttatccagattgccctacagctcgctcactttagggatcgcggtcaattctgtttgacttacgaaagcgccatgacaaggctctttctcgagggcaggacagagactgtccggagctgcacacgggaggcttgcaacttcgtgagagctatggaggataaggagaagacagaccctcagtgcctcgcactctttagggtggccgtcgataagcaccaggcactcttgaaggccgcaatgtccggccagggtgtggatcgacatttgttcgccctctacatcgtgtcccggtttttgcatctgcaatccccatttctgactcaagttcactccgagcagtggcagctctcaactagccaaatcccagtacagcaaatgcacctctttgacgtgcataattacccagactatgtttcttctgggggaggctttggtcccgcagatgaccatggctatggagtgagctacatcttcatgggtgatggaatgatcacattccacatatccagcaaaaaatcatctactaaaaccgatagccatagactgggccagcacatcgaagatgcactgctagatgtggctagtttatttcaggccggacaacacttcaagaggcggtttcggggatctgggaaggaaaactccaggcacaggtgtgggtttctgtctagacaaacaggggctagcaaagctagcatgacctccaccgatttttag

SEQ ID NO: 110914 - DNA, 2412 bp, Artificial Sequence
  Description of Artificial Sequence: Synthetic coding sequence
atggctgaagcccatcaggctgttggctttcgtccctccttaacaagcgatggtgccgaggtggaattgtctgcgccagttctacaggagatctacctgtctggcctgagatcatggaagagacacttgagcaggttctggaacgactttctcactggcgtgttccccgcctcccctttgagctggctgttcttattctccgccattcagctggcttggtttcttcagcttgacccgagtctgggactcatggagaaaatcaaggagctgttgccagattggggcggacaacaccacggattgagaggcgtgcttgctgccgccctctttgcctcgtgtctgtggggtgcgctcatttttacactgcacgtcgccctgagactgctgctatcttatcacggctggctcttagagccacacggggccatgagctcccctactaaaacttggctggccctggttagaattttttctggccgccatcccatgttattcagctaccaacgctccctgcctcgccaaccagtacctagcgtccaggacacggtgagaaagtatctagaaagtgtgaggccgatcttatctgacgaggactttgactggacagcagtgctggcccaagaatttttaaggttgcaggcctccctgttgcagtggtacctgagactgaaatcctggtgggcaagcaattatgtcagtgactggtgggaagagttcgtctatctgcgaagtagaaacccactgatggttaacagcaattattatatgatggatttcctgtacgtgacccctacacccctgcaggctgcaagggccggcaatgccgtgcacgctttgctcctttacaggcaccgcctgaaccgccaggaaattcctcccaccttgctgatgggaatgaggccactgtgttcggcccagtatgaaaagattttcaatactacaaggatccccggagtgcagaaggactacattagacatcttcacgactcccagcatgttgcggtcttccacagagggagattttttagaatgggaacacactctaggaacagcttgctaagccccagagcactcgaacaacagttccagagaatcctcgacgacccatcaccagcctgtccccacgaagagcacctggccgccctgaccgctgctccaagaggtacgtgggcacaggtgagaactagcctgaaaacccaggctgctgaggcgcttgaagccgtcgaaggcgctgccttttttgtatccctggacgctgaacctgcgggactgacacgcgaggaccccgcagctagcttagatgcttacgctcacgctctcctcgccggcagggggcacgaccgctggttcgataagtcatttacattgattgtgtttagcaatggcaagctggggctgtcagtggaacattcctgggctgattgtccaatcagcggtcacatgtgggagttcacattggcaacagaatgctttcagttagggtattccactgatggtcactgcaagggccacccagatccaacgctcccccagcctcagcggctgcagtgggatctacccgatcagattcactccagtatttcattagccttgaggggcgctaagatcctgtccgaaaatgtcgactgccatgtcgtccctttctctctcttcggaaaaagcttcatcagacgctgccatcttagcagtgactctttcatccagattgcccttcagttagctcatttcagggatcgcggacagttttgtctgacctacgagtccgctatgacacggctgtttctggaggggaggaccgagactgtcagatcttgcactagagaggcttgtaactttgtgcgcgcaatggaagacaaggagaagaccgatccgcagtgcttagcactgtttcgtgttgcagtggataagcaccaggcactgctgaaagccgccatgtccggacagggcgtcgataggcatctgtttgccctgtacatcgttagtcggtttttacacctccagagtccttttctgactcaggtgcacagtgagcagtggcagctttcgaccagccagatccccgtgcaacaaatgcatctgtttgatgtgcataactatccagattatgtcagcagtggaggtggatttggtcccgcagatgatcatggctatggcgtgagttatatcttcatgggagatggtatgatcactttccacatcagcagcaagaagagttccactaaaacagactctcaccggttgggccaacacatcgaggacgccttactggatgtggcctctctgttccaggccgggcagcatttcaagcggcgattccggggctccggaaaagagaattccaggcacaggtgcggcttcctttctcgccaaacaggtgccagtaaagcctcaatgacgtcgacagatttttag

SEQ ID NO: 110915 - DNA, 1524 bp, Artificial Sequence
  Description of Artificial Sequence: Synthetic coding sequence
atggaccccaaactggggcgcatggcggcgtccctcctggcagtgctgttattattgctagagcgtggcatgttctcatctccatcacctccacctgcactgttagagaaagtattccagtatatagatctccatcaggatgagtttgtccagactttaaaggaatgggtagccatagagagcgattcagtgcagcctgttccccgatttcgccaagagctgtttcggatgatggcggtcgcagccgacacactacagcggctcggcgctagagtagcatccgtcgatatgggtcctcagcaactgcccgatggtcagtcactgcccattccacccataattctggccgaactggggtccgacccaactaaggggaccgtctgcttttacggccacctggatgtgcagcccgccgatagaggtgacggatggctgaccgacccttatgtgctgacagaagtggacggcaagctgtacggcaggggtgctacagacaacaaggggccagtgctcgcctggatcaacgcggtgtctgcctttcgggccctggagcaggacctgccagtgaatattaagttcattatcgaggggatggaggaggcagggagcgtggccctggaagagctcgtggaaaaggagaaggaccggtttttctctggcgtcgattacattgtgatctctgataatttatggataagtcaaaggaagcctgctataacctacggaacacggggtaattcatatttcatggtggaagtcaaatgccgagatcaggattttcattcaggaacgttcggcggtatcctgcacgaacccatggccgatttggtggctctgctcggtagcctcgtcgactcatcaggacatattttagttcccggaatttatgacgaagtggtccctttgaccgaagaggagatcaacacttataaagcaatccatctcgatctcgaggaatacaggaattcttcccgcgttgagaagttcttatttgacactaaagaagaaattcttatgcatttgtggagatacccttcactcagtatccacgggatagaaggcgccttcgacgagcctggaacgaagacagttattcctgggagagttatcgggaaattctccatccgcctggtgccgcacatgaacgtgtcagctgttgagaaacaggtcacccggcacctggaagatgttttctccaagcgaaactcctccaataaaatggtcgtgtcaatgaccttggggttacacccgtggatcgccaatattgacgacacccagtaccttgcggcaaagagagccattcgcacagtcttcggcactgagccggatatgattagggatggttcaactattcccatcgccaagatgtttcaggagatcgtgcataaatctgtggttctgattcctctgggcgcggtggatgacggagaacatagccagaacgagaaaatcaatcggtggaattacatcgaggggacaaaactgttcgctgcattcttcctggagatggcccagctccactag

SEQ ID NO: 110916 - DNA, 2484 bp, Artificial Sequence
  Description of Artificial Sequence: Synthetic coding sequence
atgctcctttgtctgtctccagcatggcttatgaaagtcccagcacctggtcagccgggggaagccgccctgcttgtttcaaaggctgtgtcctttcatccaggtggcctgactttcctcgacgacttcgtgcctccgcgaagagcaacatatttccttgcagggttaggactgggacctggacgcggacgcgaggccgctgagctggctcgggaccttacatgcccaacaggggcctcagcagagttggctcggctcttagaagaccgcctcctgactagacagctgctcgcacagcaagggggagtagcagttccagccaccctggccttcacctataaaccacctggactgctccgaggcggggacgccagtcttgggctgcgcttggtcgaactgagcggaaaggaggggcaggagacactggtgaaagaagaggtagaggctttccttcgctcagaggccttaggcgacatcttgcaggtggccgtcaaactcagtggatggcgctggaggggacgacaggcctggcggcttcatccgcgagcagagctgggcgcagtggtggacacagtgctcgcattattagaaaagttggaggaggaggagagcgtcctggtcgaagcagtatatccccctgctcagttgccttgctctgacggtccgtctccaggccccggacttgccgtcaggatctgtgccgtggtatgtcgaacacagggggatcgtcctctactgagtaaggtagtgtgcggcgtgggccggggggatcggcctctgagacatcataacagtctcccacggactctcgaggtcgcactagcccaatgcggtctcggcgaggaggctcaggttgctgccgttcgccagcgtgtaaaggccgcagcagaggccgccttggcagccgtgctggccctcgaggctggactgagcgctgagcagcgcggaggaagacgtgcacacacagacttcctgggcgtggacttcgcccttaccgctgctggcggcgtgctaacccccgtggctctcgagctgaacggtggactctgcctggaggcatgtggtgccctggaaggcctgtgggctgccccaagactcggcccggcagcggacgaggccgtggcggcccctctcgtagaaaccatgttgagacgttctgcgagatgtctcatggaaggcaagcagttacttgtggtgggagccggaggcgtatccaaaaagtttgtttgggaagcggctcgggactatggtcttcagttacatctggtcgaatctgatcctaatcactttgccagccaactggtccagactttcatacattttgacatgaccgagcataggcgggatgaagaaaacgccaggctcctggctgaactcgtgcgggctagaggcctcaagctcgacggttgtttctcctattgggacgactgcctggtactgacagcgctgctctgtcaggaactcggactaccatgttcaagtccagcagctatgaggctggctaaacagaagtccctcacacagctgcaccttctgcaccatcatggccctccttggcccgcaccttcactgcatgctgttccctgttgtccactcgaaagtgaagcagatgttgaacgagctgtgcaccaggtgcccctacccggcgtaatgaagctagaattcggcgccggggctgttggggtcagactggtcgaagacgccccgcagtgccacgaacattttagtcgcataaccagagacctgcagggggaggcagatcaccccggcattggtttaggatgggggaatgccatgctgcttatggaattcgtggaaggtaccgagcacgacgtggaccttgttctctttggcggtagactcctggcagcttttgtgtcagacaacggtccgactagactccccggcttcacggagactgccgcctgcatgcccaccggactggcacctgagcaggaggcgcagatggtgcaggccgcctttcggtgttgtctggggtgcggacttctcgatggtgtgtttaatgtggagctgaagctgacaggggctggtcctcgccttattgagattaacccccggatgggcggcttttacctccgagactggatcctggaactctacggtgtcgatttgctgttagcagcggtcatggtcgcatgtggcctgaggcccgcactgccaacaaggccccgggcacggggacacttagtcggagtcatgtgccttgtgtcccagcacctacaggcactcagtagcacagcctctagagagaccttacaggcactgcacgacagagggctgctaagactcaacctacttgaggaagcccttgtgcccggcgaatacgaagaaccttactgtagtgtggcgtgcgcaggcccatctcccactgaggcccggttgagactactggggctgtgccagggacttggaatcgacggcccttcttacccagtagcccactttctgtcacacttcaagtag

SEQ ID NO: 110917 - DNA, 2484 bp, Artificial Sequence
  Description of Artificial Sequence: Synthetic coding sequence
atgctgctctgcctcagcccagcctggcttatgaaggtgccagctccggggcaaccaggagaagccgctctgttggtgagcaaagcagtaagttttcaccccggtggtctcactttccttgacgatttcgtccccccaaggcgcgcaacttacttcctagcaggtctcggcctggggcctgggagagggagagaggcggcagaactcgcgcgcgacctgacctgtcccactggagctagcgctgagctggcgagattgctagaggatcgacttctgacccgccagttgctggcccagcagggtggggtagccgtgcctgccacactggcatttacctacaagcctcctggcttactgagaggcggggatgcatccctcggactgaggttggttgaactgtcggggaaagaagggcaggaaacactagtgaaagaagaagttgaggcattcctgcggtcagaggccctgggcgatatcctccaggtcgccgtgaaattaagcggatggcgttggcggggacgtcaggcttggaggctccaccctagggccgaactgggcgccgttgtggacactgtgctggccttgctggaaaaacttgaagaagaagagtccgtgctcgtcgaagctgtatatccccccgcacagctgccatgcagtgacggtccttctccaggcccggggctggccgtgaggatctgcgctgtcgtttgtagaacgcaaggcgatcgtcctcttctttcaaaagtggtgtgtggagtcgggcgaggagatcggccactgcgccaccacaatagtttgccacggactcttgaggtcgccctggcgcagtgcggacttggcgaagaggctcaagttgcggccgtgagacagcgcgtgaaggctgcggcagaggcggcgctcgccgccgtcttagcactggaggcaggcctcagcgcggagcagcggggtgggcggcgagcacatactgacttcctcggagtggactttgccctcactgcagcaggaggagtgctcacccccgttgccctggagctcaatggaggcttgtgtctggaggcgtgcggagccctcgaaggcctctgggccgcacctcggctcggccctgcggccgatgaggcagtggctgcgcctttggtggagaccatgctgaggcgctccgccagatgtctgatggagggaaagcagctgctcgtggtgggagcgggcggggtatcaaagaagtttgtgtgggaggctgcacgcgactatgggctgcagttgcacctggttgagagcgaccccaaccatttcgcctcacagctggtgcagacatttattcactttgatatgaccgaacacagaagggacgaggagaacgcaaggctgctagccgagctcgtaagagccaggggcctcaaactcgacggctgtttttcatattgggatgattgtctggtgctcacagcactgctctgccaggagctcgggctgccttgttctagcccagccgctatgagactcgcgaagcagaagtccctgacccagctgcacttgttgcaccaccatggtcctccatggcctgcaccctccctgcatgcggtcccctgctgtccccttgagtccgaagctgatgtggagagagctgtgcatcaggtcccgctgcctggagtgatgaaacttgagtttggcgcaggcgccgttggtgttcgattggtggaagacgctcctcagtgtcatgaacacttcagccgcatcaccagggacttgcagggggaggcagaccatccagggatcggcttgggctggggcaatgcgatgctgctgatggagttcgtggagggcacagagcacgatgttgatctcgttttattcggggggcgtctcttggccgccttcgtttctgacaacggtcctactaggctgccagggttcaccgagacagccgcatgcatgcccaccgggttagcaccagaacaggaggctcagatggttcaagccgcatttcgatgctgcctggggtgcggcctgctggatggagtctttaacgtggagctaaagctgactggggcaggaccaagactcatcgagatcaaccctaggatgggggggttctaccttcgggactggatacttgagctctacggcgtcgacctgctgctggccgctgtcatggtggcctgtggcttaaggcccgcattacctaccagaccccgcgcccgtggtcacctggtgggcgtgatgtgcttggtgagccagcacctccaggcactgtcctccacagcaagcagagaaactttgcaggcacttcatgaccggggactcctgcggcttaatctgcttgaggaggcccttgtgccgggggaatatgaggaaccatactgcagcgtggcttgtgccggtccttcacctaccgaggcccggctcaggttgctagggctgtgtcaaggtttaggtatcgacggcccctcttacccggtcgcacacttcctctcccattttaagtag

SEQ ID NO: 110918 - DNA, 2853 bp, Artificial Sequence
  Description of Artificial Sequence: Synthetic coding sequence
atgctttccctcgacccctcaggccccgagtgggactgcccactgggatccaaggacctcgaagaagaggggccgtggggcggggggagtgggctgccacctactgggtgcttcccagggtcatggcgtcaggacgtcggcctggattgcaaagggagtcctgagggtgccgaggctcgcgcctggacggtgtactactacagtctgctccaatcttgccttcagcaggctgggctcccagaaactcaagaccgcggacaggtgccacggacgggctgccccggggccgaggttaccctctgtgttttgggttcaccatcgaccttcttacctgtccttcttgaggggggcgtgcagagtccgggaaacatgctgctgtgtctctccccagcatggctgatgaaggttcccgctcccgggcaaccaggtgaagcagctctgctcgtttctaaggctgtgtcgttccacccgggcggtctcacttttctcgatgactttgtcccaccgcggagagcaacttattttttagccggactgggactggggcccggccggggcagggaagctgccgagttggctcgcgacctcacatgtccgactggggccagcgcggagttggcaagactcctcgaagatcggctgctgacgcgtcagcttctggcacagcagggtggggtcgctgttcccgcaacacttgccttcacatacaagcctcctggtctcttgcggggaggtgacgcctccctgggtctcagattggtggagctgtccggaaaggaaggtcaagagacactcgtgaaagaagaggtggaagcctttttgagaagcgaggcactaggcgatattctgcaggtggccgtaaagttgagcgggtggcgctggcgtgggagacaggcgtggcgtctgcaccctcgggcggagctgggcgccgtagtggataccgtactagcactgctggaaaaattagaagaggaggaaagcgtcctggtggaagcggtgtaccctccagcacagttaccatgcagcgatggtccaagtcccggcccaggcctcgctgtccggatatgtgccgtcgtgtgtcgtacccagggagaccgccctctattgtctaaggtggtgtgcggagtcgggaggggggatagacctctgcgacatcataatagcctgcctagaaccctggaagtagcactcgcccagtgcggactcggggaggaggcacaagtggctgcggtgcggcagcgggtgaaggcagccgccgaagctgccctcgctgcagtgctagctctagaggccgggctttccgcagagcagaggggcgggcgcagagcccacaccgactttttgggagttgatttcgccctcaccgccgctggcggcgtgctgacaccagtagcccttgaattaaacggaggactgtgccttgaggcatgtggggccctggaaggtttgtgggctgccccgagactcgggcccgctgccgatgaggcagtggctgcgcctctggtcgaaactatgctccgcaggagtgcacggtgtcttatggagggtaagcagctcctggttgtgggagccggaggtgtgtcaaaaaagtttgtctgggaagcagccagagactacgggctgcagctgcatttggttgagagcgatccaaatcactttgcatctcagcttgtgcagacattcatacattttgacatgacagaacatcgcagggatgaggaaaacgcaagattgctggcagagttggtgcgggccagggggctgaagctggacggatgttttagttactgggacgactgtttagtgctgactgccctcctgtgtcaggagctcggtctgccatgcagctcacctgctgctatgagattagccaagcaaaagtccctgacgcaattgcatctcttgcatcatcatggaccgccatggccagccccctctcttcacgctgtcccctgctgcccattggagtctgaggcggatgtggagagggccgttcatcaagtgcccctccctggcgtcatgaagctagaattcggtgccggggcggtcggtgttagattagtcgaggatgccccccagtgtcatgagcactttagcaggattacaagagatctccagggcgaggctgatcatcccggcatcgggttggggtggggcaatgcaatgctgctgatggagtttgtggaaggcactgaacacgacgtagatctggtgctgttcggcggccgtttgttggccgccttcgtctccgacaatggccctacacgcttacctggcttcaccgaaaccgcagcttgcatgcccaccggactcgcccccgagcaggaagcgcaaatggtccaagctgctttcaggtgctgcctgggctgtggacttctggatggcgtgttcaacgtggaactgaagcttacaggggccggccccaggctgatcgaaattaatccacggatgggcggtttctatttaagagactggattctggagctatatggtgtggatctgctgctggctgctgtgatggtcgcatgcggtttacggcccgccctgccgacccgcccaagggcgcgcggccacttggtgggtgtaatgtgtctcgtgtcccaacatttgcaagccctcagcagcacagccagtcgggaaactctgcaggccctccacgatagggggctcctccgccttaatctgctcgaggaagctctcgtacccggcgagtacgaagaaccctactgctcagtcgcttgcgcgggaccttcacccacagaagccagactgcgtttgttgggcttgtgtcagggattgggcatcgatggaccatcctacccagttgcacatttcctatcccactttaaatag

SEQ ID NO: 110919 - DNA, 2775 bp, Artificial Sequence
  Description of Artificial Sequence: Synthetic coding sequence
atgttgagtctagacccatcaggcccagaatgggactgccctctcggcagtaaggatcttgaggaagaaggtccctggggtggagggtctggattgcctccaactggctgctttcccggttcctggcgtcaggacgtggggttggactgcaagggatctcccgagggagccgaagcgagagcttggaccgtctattattactccctattgcagtcgtgcctccagcaagcaggcctgcccgagactcaggataggggccaggtccctcggacaggttgtccaggtgcagaggtgaccctctgcgtgcttgggtcgccctccacattcctaccagtgctactggaaggcggcgtacagtcccccggaaacatgctactgtgtttgtctccagcctggctaatgaaggtgcccgcccccggacagcctggggaggcggcccttttagtcagcaaagccgtgtcctttcaccccggagggttgactttcctggatgactttgtgccacctcgaagggctacttatttcctagccggccttggcctagggcctggtaggggccgcgaggcagccgaactagcgagggacctgacctgtcccaccggtgcctcagcagaactggcccgcctcctggaggatagattgctgacacggcagttactggcacagcagggtggcgtggcagtgcccgcaaccttagcgtttacatataagccacctgggctccttcgggggggagacgccagcttgggcctccggctagtcgagctgagtgggaaagagggccaagaaaccctcgtgaaagaagaagtggaggccttcctgcgttctgaggccctcggcgatatcctgcaggtcgcagtgaagctctccggatggagatggcgaggaaggcaggcttggcgccttcaccctcgcgcagaacttggcgcagttgttgacactgtcctcgcactcttggaaaagctggaagaagaagaaagcgtgctggtcgaggcagtgtatccacctgcgcaattgccttgctctgatggacctagtccgggccctggtttagccgtgaggatctgcgcggtggtgtgccgcactcagggggatcggcctttgctgtcaaaagtggtgtgtggtgttggacggggagaccgacccctgagacaccacaattctcttcccaggacacttgaagcggctctagctgcagtccttgccctcgaagccggcttgagcgcagaacagagaggaggaaggcgcgcacatacagactttttgggagtagatttcgccctaacagcggccgggggggtcctgacccccgtggccctggagcttaacggcggcttgtgccttgaggcttgcggagctttggagggtctttgggctgcaccccgcttgggacctgcagccgacgaggccgtggccgctccgctagtcgaaacgatgttgagacggtccgcgcgttgcctgatggaaggaaagcagttgcttgtggtgggggccggaggcgtgagtaaaaaattcgtgtgggaagccgcccgtgactacgggttgcaactgcacctcgtggagagcgaccctaaccactttgcctcccagctggtgcagacatttattcatttcgacatgacggaacatagaagggatgaagagaacgcaaggctcctggccgagctggtgcgtgctcggggcttaaagctagacggatgtttttcgtactgggacgattgtttggtcctgaccgctctcctgtgtcaggaactgggactcccttgctctagccctgctgccatgagactcgctaaacagaagagcctaacccagctgcacctcctgcaccatcatggccccccctggccggcacccagtctacatgccgttccctgttgccccctggagagcgaagccgatgtcgaacgcgcggtgcaccaggtcccactgccgggggtcatgaaactggaattcggggccggcgctgttggagtaaggctggttgaggatgccccccagtgccacgagcacttttcacgtattacccgggacctgcagggtgaggcggatcaccctggaatcggcctggggtggggaaatgcgatgttactgatggagttcgttgagggaactgaacacgatgttgacctggttctattcggcgggagacttctggcggcctttgtgtcagacaacggacccaccagactgccagggtttaccgaaaccgctgcttgcatgcctacaggcctcgcccctgagcaagaggctcagatggtgcaggctgcttttcgatgctgcctggggtgtgggctattagatggcgtatttaatgtggagttgaagctgacaggcgcgggacctcgactgatcgaaattaaccccaggatgggtgggttttatcttagggactggatcctcgagctctacggggtggatcttcttctggccgccgtcatggtcgcgtgtgggctgcgccctgcactgcctactcgacccagagccaggggccatctcgtcggcgtcatgtgtctagtgtctcagcacctgcaggctttgtcatctacggcttccagagagacgctgcaagcactgcatgatcgaggcctcctacggctgaaccttttagaggaggctctcgttccaggagagtacgaggagccttactgctctgtggcctgcgccggcccctccccaactgaggcaaggctgcgactattagggctctgccagggccttggcatagacggccctagctatccggtggcgcattttctcagccactttaagtag

SEQ ID NO: 110920 - DNA, 903 bp, Artificial Sequence
  Description of Artificial Sequence: Synthetic coding sequence
atgtgtcctctcgcccacccggcccaggaccttcctttactgcccagccagctcagtctagatcccagcgggcccgagtgggattgtcctctgggcagcaaagacctggaggaagaggggccctggggcgggggcagcggactccctccgaccggatgtttccctggcagttggaggcaggacgttggacttgactgcaaaggctcccctgagggggccgaagcgcgggcttggacagtatactactactctctcctgcagagctgcttgcaacaagccgggctgcctgaaacacaagataggggacaagtgcctaggaccggatgtcccggtgccgaagtgaccttgtgcgttctggggagcccgtccacatttttgcctgtgctgctggagggaggagtgcagtcccctggcaatatgttgctatgcttgagtccggcttggcttatgaaagtcccagccccaggccagcctggagaggctgccttgctcgtttcaaaagcagtgtccttccacccaggcggcctgacctttctagacgactttgtccctccacgtagagccacttacttcctagctgggctcggactgggccctgggcgcggaagggaagccgcagagctcgctcgggacctcacctgtcctacaggcgcctccgccgaactggccagactgctggaggaccggctcctgacccggcagttgttagcacaacaaggcggggtcgccgttcctgcaacacttgccttcacttataaacccccagggcttttgcggggcggcgacgcttccttgggattgcgcctagtggaactgtctggaaaggaggggcaggagacgttggtaaaggaggagcgaacctggctcggtccaaaaccatggacgaatcccggaaagacgtag

SEQ ID NO: 110921 - DNA, 2775 bp, Artificial Sequence
  Description of Artificial Sequence: Synthetic coding sequence
atgctaagtctggatccatcgggccccgaatgggattgccccctgggcagcaaagacttggaggaggaaggaccctggggaggtgggtcaggccttccgccaactggctgtttccctgggtcctggcggcaggatgtggggctggattgtaaggggtctccagagggcgctgaagcccgtgcctggactgtctattactactctctgctgcagtcatgtttacagcaagccggactccccgagactcaggaccggggccaagtgcctcggactgggtgcccaggagctgaagttaccctttgtgttctgggttctccatctacatttctgcccgtccttctggaaggcggggtccaatcccctggaaatatgctcctgtgcctatcaccagcatggctcatgaaggttcctgcccctggccaaccaggagaagcagctttgctggtcagcaaagccgtgtccttccacccgggggggctgaccttcttggacgacttcgtccccccccggcgcgcaacttattttttagccggtctaggactcggccccgggagggggcgggaagccgccgagctggcccgggatttgacctgccccactggggcctcagccgagctggccaggctgctggaagacagactgctgactaggcagctgctggctcagcagggcggtgtagctgtgccggccacattggcatttacctacaagcctcctggactgttacgcggcggcgacgcctctctgggcctccgtctcgtagaactgtctggcaaagaaggtcaggaaacgttagtcaaggaggaggtggaagcctttcttcggtcggaggcactgggggatattttacaggtggccgtgaaattgagcggatggcgctggcgcggaaggcaggcctggaggctgcacccccgggcggagctgggagcggtggttgacacagtgctagccttactggagaaactcgaggaggaggaatcagtccttgtggaagccgtgtatccccccgcacaattaccctgctctgacggacctagccctggccccgggttggcggttcgaatctgcgccgtagtatgtcgcacacagggagaccgaccactattgtctaaggtcgtgtgtggagtgggccgcggcgacagacctctgagacatcacaatagcttaccacgcaccctagaggtcgcccttgccgcagtgctggcacttgaagccgggctaagcgccgagcagagaggtggtaggagggcacacactgacttccttggtgtagacttcgccctaacagccgccgggggggttttgacccccgtagccctcgaactcaatggcggcctgtgtctcgaagcctgtggagccctcgaaggtctctgggcagcccccaggcttggacctgccgccgacgaggccgtggccgcccccctcgtcgagaccatgctgcgcaggtcagcaagatgcctgatggagggaaagcagctgttagtggtgggagccgggggagtatcgaagaaattcgtgtgggaggccgccagagactacggtctgcagctgcacctggtggagagcgatcctaaccatttcgcatctcaattagtgcagactttcatacatttcgatatgaccgagcatcggagagacgaggaaaacgctagacttctcgccgagcttgtgagggccagaggccttaagcttgatggatgtttttcttactgggatgactgtctcgtccttaccgccctactctgtcaggagcttggactgccatgtagttcccctgctgccatgagactggcgaagcaaaaatccctcacacagctccaccttctgcatcaccatggaccaccttggccagctccatctctacatgcagttccctgctgtccccttgagtccgaagcagatgtcgagcgtgccgtgcaccaggtgccccttcccggtgtcatgaagctggagtttggcgccggtgccgtgggtgtcagactcgtggaagacgcacctcagtgtcacgaacatttctctaggatcaccagagacctgcagggggaggctgatcacccaggcattggtttgggatggggtaacgctatgcttctgatggaattcgtggaaggcacagagcatgacgtggaccttgtactttttgggggaaggttactggcagccttcgtctctgataatggacctacgcgtttacctggcttcactgaaacagcagcctgcatgcctactggtctcgcgccagaacaagaggcgcaaatggtgcaggccgccttccggtgttgtctcggctgcgggctgcttgatggcgtgttcaatgtcgaattgaaattaacaggagcaggccctcggctgattgaaatcaatcctagaatgggtggattttatctccgcgactggattctggaactgtacggggtagatctgctgcttgccgctgtgatggtagcctgtggtttgaggcccgcccttccgactcgaccgcgggccaggggacacttggttggagttatgtgcctggtgtctcagcatctacaggccctgtcgtcgactgcatctcgcgagaccttgcaggccctgcacgatcgtggcctgctgagactcaatcttctcgaggaggccttggtgccgggggaatatgaagaaccctattgctccgtggcttgtgccggaccctcccctacagaagcacgactgcgactactgggcctctgtcaggggctgggcattgatggtccttcgtaccccgttgcacactttctgagtcatttcaagtag

SEQ ID NO: 110922 - DNA, 1206 bp, Artificial Sequence
  Description of Artificial Sequence: Synthetic coding sequence
atggagcctgggaggcgtggtgccgcagctctattggccctgctctgtgtggcctgtgctctgagagcagggagggcccagtacgagaggtattctttcagaagttttccccgcgatgaactcatgccgctggaatccgcctatcgccatgccctggacaaatattcaggagagcactgggcagagtcagtggggtacctagagatttctctgcggctgcaccgcttgctccgtgatagtgaagcattctgtcatagaaactgctccgcagccccccagccggagcctgcggcagggctcgcttcctaccctgagctccgcctatttgggggcctcttgaggagggcccattgcctgaagcggtgtaagcaaggactgccagctttccgtcagtctcagccaagtagagaagtcctagctgacttccagcggcgcgaaccgtataagttcctgcagttcgcctatttcaaggctaataacctgcctaaagccatcgccgccgctcacacctttttgttgaaacaccctgacgacgagatgatgaagcgtaatatggcgtactataaaagcttgcctggggcagaagactatattaaggatctcgagaccaagtcttacgagagtttgttcatcagggcggtgagggcctacaacggggagaattggagaacctccatcacggacatggagctggccctgccagacttcttcaaggcgttttacgagtgcctagctgcctgtgagggaagtcgggaaataaaagactttaaggatttttacctgagcatcgccgaccattatgtggaagtactggaatgcaaaattcaatgcgaagaaaatctgacccctgtgatcggcggctaccccgttgagaaatttgtggctaccatgtaccactacctccagtttgcatattacaaattaaatgatttgaagaacgcagctccatgcgctgtgtcttacttattgttcgaccagaatgacaaggtcatgcagcagaacctagtgtattatcagtatcatcgggatacatgggggctttcagatgaacacttccagccaagaccagaggccgtgcagttctttaacgtaaccacactccagaaagaactttatgactttgctaaagagaatatcatggacgacgatgagggcgaggtagtggagtatgtggatgacctgctcgagctggaagaaactagctag

SEQ ID NO: 110923 - DNA, 789 bp, Artificial Sequence
  Description of Artificial Sequence: Synthetic coding sequence
atggagcccggacggagaggagcagctgcactactggccctgttgtgtgtcgcctgcgctctgagggctggtcgggctcagtacgagcggtattcttttcgctccttcccccgcgatgaactcatgccccttgagtcagcatatagacacgccctcgacaaatattctggtgagcattgggccgaaagcgtcgggtacttagaaattagtctgcgtctccatcgactactgcgggactccgaggcattttgtcatcgcaactgtagtgcggccccccagcccgagcccgcagccggcctcgccagctatcccgaactgagactgttcggcggattgctgcgtcgcgcccattgcctaaaaagatgcaaacagggcctgccggccttccgacagagtcagccttcacgcgaagtgttggcagacttccaacggcgggaaccctacaaatttcttcagtttgcttactttaaagccaataatctgccaaaggccatcgcggcggcccatacattcctcctcaaacaccccgacgacgagatgatgaagcggaatatggcgtactacaagtccctgcctggcgcagaggactatctgaagacatggaagccctctcacatgaaagcctgtagctctgaacaatgcggacacaccacggtgaggacaggtgagcatccttctcagacatggagctggccgttccccacaagctctaagcctttcacctctgtgagccagcctgccagagtgcccggacgtagcagaacgtcacgaataagtacctttccctag

SEQ ID NO: 110924 - DNA, 789 bp, Artificial Sequence
  Description of Artificial Sequence: Synthetic coding sequence
atggagcctggacggaggggggccgccgcgttgctcgcacttctgtgcgtggcttgcgctctccgcgctggcagggcacagtatgagcggtattcatttcgctcctttcctcgggacgagctgatgccattggaaagtgcctatcggcacgccctggacaagtacagtggcgagcattgggctgagtccgtaggctacctcgaaatcagcctcaggttgcacaggttgttgagggacagcgaggcattctgtcacaggaattgctccgccgccccacaacccgagcctgcagcagggctggccagttatccagaactgaggctgttcgggggtctactcaggagagcgcattgtcttaagcggtgtaagcaaggcttgcccgcatttcgacaatcccagccatctcgggaagtcctggcagacttccagcggcgcgaaccttacaagttcttgcagtttgcttacttcaaggccaacaatttgcctaaggccatcgccgccgcccacacgttcttgctgaagcaccctgatgatgagatgatgaaacgcaatatggcatattataagtcactgcccggggctgaagactacattaaggacctcgagactaagtcatacgaaagtttgtttatcgaacagtgtgggcacaccacggtacgcacgggagaacatccatctcagacttggtcctggccttttccaactagtagcaaaccattcacctccgttagccagcccgcccgcgtccctggccggtccagaacatcccgtatctcaacctttccgtag

SEQ ID NO: 110925 - DNA, 1167 bp, Artificial Sequence
  Description of Artificial Sequence: Synthetic coding sequence
atggagcccggcaggcgcggcgctgctgcgctccttgcactgctctgcgtagcttgcgctctccgagcaggcagagcgcaatacgagcggtacagcttccggagctttccacgcgacgaactgatgcccctcgaatctgcttatagacacgctctggacaagtatagtggggaacattgggcagaaagcgtgcgggacagcgaggctttctgtcatcgaaattgctccgccgctccccaaccggagcccgccgccggtctggcctcttaccccgagctccggttgtttggcggactcctgcgccgagcccactgcctgaagcggtgcaagcaaggtctacccgcctttcgacaaagtcaacctagcagggaggtcctcgccgacttccagaggcgtgaaccttataagtttcttcagttcgcgtacttcaaagccaacaacctgccaaaggccattgcagctgcacataccttcttactgaaacatcctgacgatgaaatgatgaagcggaacatggcgtactacaagtccctgcccggggcggaagactacataaaggatctggagactaaatcttacgagtccttgtttatccgggccgttagggcttacaatggagaaaattggcgcacaagcatcaccgacatggagctcgctctgcccgacttcttcaaagctttttacgaatgcctagctgcctgcgaaggaagtcgcgagattaaggattttaaggacttctatctgtccatagccgaccactacgttgaagttttggagtgcaagatccagtgtgaggaaaaccttacaccggtcataggtggatacccagtggaaaaattcgtggccactatgtaccattaccttcagttcgcatactacaagctgaatgatctcaaaaatgcagctccgtgcgccgtgtcctacctgctgttcgaccagaatgacaaggtcatgcagcagaacttagtctattaccagtatcatagggatacatggggtctgagcgacgaacatttccagccccggccggaggccgtccaattctttaacgttactaccctccagaaagaattatatgactttgccaaagaaaacatcatggatgacgacgaaggggaggtcgttgaatatgtggatgatcttctcgagctggaggaaacaagctag

SEQ ID NO: 110926 - DNA, 3471 bp, Artificial Sequence
  Description of Artificial Sequence: Synthetic coding sequence
atggcctcactgctaccattgctgtgtctatgtgtggtagccgcccatctcgccggcgccagggatgctacccctacagaggagccaatggcaaccgcgctagggcttgaacgccgttccgtctacacaggccaaccaagccccgctctggaggattgggaagaggcaagcgaatggaccagctggttcaacgtcgatcatccgggtggggatggagatttcgaatccctggctgcaatccgtttttactatggcccagctagggtctgcccgagacccttggcattggaagcacgcactacggactgggcactgccctccgccgtaggtgaacgtgtgcatctgaatcccacgcgagggttttggtgtcttaatagagaacagcctaggggaaggaggtgtagcaactatcacgtcagattcagatgcccgctggaggcatcttggggcgcttggggaccttggggtccctgtagtggtagttgtggcccgggcagacggctgcggcgaagacactgcccatcccctgcgggcgacgcctgtcccggtcggcccctggaggcccagaaatgcgtgagacctaggtgcccgggctgcagtctcgatacgtgtgagtgccctgaccacatcctgctggggtctgtcgtcaccccttccggccagccactgctgggtgccagggtatcccttcgggaccagcccgggacagtggctacctctgacgctcacggcacgttccgagtgcctggtgtttgtgctgactcgcgcgccaacatccgggcccaaatggacggcttttccgccggtgaggcccaagcacaggcgaacgggtcaatctccgtagtcactatcattcttgataaactggagaagccctatttggtgaagcatcccgagagtcgggtccgcgaggctgggcagaatgtgacgttttgctgcaaagcaagtggcacaccaatgccaaaaaagtacagctggtttcataacggaactttactggatcggcgcgcacatgggtatggcgctcacttggagctgcgcggtcttcggcccgatcaggccggaatctatcactgtaaggcttggaacgaggcaggcgccgtacggagcggtacggccagactgacggtgctcgcgcctggacagccagcgtgcgatccgcgaccccgggagtatcttatcaagctgccagaggattgcgggcagcccgggagtggccccgcctatctagacgtcggtctgtgtcccgataccaggtgcccctcactcgcaggatcgagtccgcgttgcggtgacgcctcaagcagatgctgcagcgtccggagacttgaacggagggagatccattgcccaggttatgtgttgcccgtgaaagtggtcgccgagtgtgggtgccaaaaatgcctacctccgcgtgggctcgtccggggacgggtggtggccgccgactccggagagcccctccgattcgcacgaattttgttgggtcaggaaccgattggatttaccgcttatcaaggcgacttcactatcgaagtgccgccttcaactcaaaggttggtcgtgaccttcgtggacccctccggcgagtttatggatgctgtgagagttttgccctttgatccccggggcgctggtgtgtatcatgaagtcaaagccatgcggaaaaaggcacctgtgatcctgcataccagtcaaagcaacaccataccacttggagagctagaagatgaggccccactgggggagcttgtcctgccctctggggcatttaggcgtgcggacggaaagccttactctggtcccgtggaggcccgtgtcaccttcgtagatcctagggatctgacctcagccgccagtgccccttctgacctgaggttcgttgatagcgacggcgagcttgcaccccttcgcacctatgggatgttttcagtggacctgagagctcccggctccgctgaacaactgcaggtggggcccgtggccgtgcgggtggccgcctctcagatccatatgcctggtcacgtcgaggccctcaagctctggagtctgaacccggagacagggctgtgggaagaggagagtggttttcgtcgggagggttcgagtgggcctagagtgagaagggaggagcgtgtattcctggtgggaaatgtcgaaatccgggaaaggcgcttgtttaatttggatgtgcccgaaaggcgccggtgcttcgtgaaggtgcgcgcttacgcaaacgacaagttcacgccatctgagcaagtggagggcgtcgtggtgacgctggttaacctggaacctgctcctgggttctcagctaatcctcgcgcctgggggaggtttgactccgcagtaactggtcccaatggagcctgccttccagccttctgcgacgctgaccgaccagacgcctataccgcgctggtgaccgccacgttggggggcgaagagctcgagccagccccatccctcccacgaccactccccgcgacagttggggtgacgcagccgtatctggacagactgggttatagacgaacagaccatgatgaccctgcgtttaagaggaatggattccggatcaacttggcaaaacctaggcccggcgatcccgcagaagctaatgggcctgtgtatccatggaggtcactcagggagtgccagggggccccagtgactgcttcgcacttccggtttgcgagggtcgaagcggacaagtatgagtacaatgtcgtgcctttccgggagggtacaccggcctcctggactggcgatctcctggcttggtggcctaatccacaggaattcagggcatgcttccttaaggtgaagatacaaggccctcaggaatacatggttcgctcacataatgctggggggtctcatcctagaacccgcggacagctttacggactgagagatgcccggagcgtgcgcgatccagagaggccagggacttccgccgcctgcgtggaattcaaatgtagtggcatgctgttcgaccagaggcaggtggacaggacgctggtcactatcatgccacagggaagctgtaggcgagtggccgtcaacggtttactgcgagactatctaacacgacaccccccacctgttcctgccgaggaccccgcagctttctccatgctcgcaccactcgatcccctgggccataattacggcgtgtacacagtcacagaccagagtcctcgcctggccaaggagatcgccataggaaggtgcttcgatggatcctccgatgggttctcccgggagatgaaagccgacgcgggcaccgctgtgacatttcagtgccgcgaaccccctgctggacgaccttcactcttccagcggttgctggagtcacccgcaactgcactgggggatatcaggcgtgagatgtcagaagccgcgcaggctcaggcccgagcaagcgggcccctccgcacgcggcgcggcagagtgaggcagtag

SEQ ID NO: 110927 - DNA, 3555 bp, Artificial Sequence
  Description of Artificial Sequence: Synthetic coding sequence
atggtgggcacaaaagcttgggtgttttcattcttggtgcttgaggtaacttcggtgttggggcgccagaccatgcttacccaaagtgtgcgcagagtgcagcctggcaagaagaacccctccatcttcgccaaacccgctgatactctagaatccccaggcgagtggaccacatggttcaatattgattaccccggcgggaaaggagactacgagcggctggatgctatcaggttttattacggcgaccgggtttgcgctcggccactgcgactggaggcccgtactacagactggacacccgctggatccacaggccaagtggtgcatggctcaccacgcgaaggattttggtgcctgaatcgagagcaacggcccgggcagaattgttccaactacacagtgaggtttctatgccctcccggaagcctgaggagggacacagagcggatttggagtccgtggtccccttggtctaagtgtagcgcggcttgtggacagacaggcgtgcagaccagaactcgcatatgtcttgctgagatggtgagcctctgctccgaagcgtccgaagaaggacaacactgtatggggcaagactgtactgcatgtgacctgacgtgccctatgggacaagtgaacgcagattgtgatgcttgtatgtgccaggactttatgctgcatggcgccgtttcactcccaggtggagcccctgctagcggagcggccatttatctactgactaagactccaaagcttctaactcagactgattcagacggacggtttcgcatccctggactatgtccagacgggaagtctatactgaagataacgaaggttaagtttgcgcccattgttctgacaatgcccaaaacctccttaaaggcagccacaatcaaggccgagtttgtcagagctgagacaccatatatggtgatgaatccggaaacaaaggcgagacgtgccggtcaatctgtctcgttatgttgcaaagccacggggaaacctcgtcctgataagtacttctggtaccataatgacaccctgttggatccgagcctttacaaacatgagagtaagctcgtacttaggaagctgcagcagcaccaggctggggagtatttctgcaaagcgcagagtgatgctggtgccgtcaaaagcaaagtggcccaactcatagtaatagcctccgatgagactccttgtaatccggtacccgagtcgtacttgattcgcctgccacatgactgcttccagaatgctacaaactccttttactacgacgtcggccggtgccccgtgaaaacttgtgccggacagcaggataacgggatcaggtgtcgagatgctgtccagaactgctgtggaataagcaaaaccgaggagagagagatccagtgtagtgggtatactctcccaacaaaggtggcaaaagagtgtagctgccagcggtgtactgaaacccggagtatagtgaggggtcgggtaagcgccgctgataacggcgagccaatgcggttcgggcacgtgtacatggggaacagcagggtaagtatgaccgggtacaaaggtacttttacgctacacgtcccgcaggatacggagcgccttgtgcttaccttcgtggatagattgcagaaattcgtgaacaccacaaaggtgctaccatttaataagaaagggtctgctgtgtttcatgagatcaagatgctcagacggaaaaagcctataaccttggaggctatggagacaaatattatccctctgggggaggttgtgggagaggacccaatggctgaactggagatcccgagtagaagcttctatcgccaaaatggcgagccgtacatcggcaaagtaaaagcttcggtgacttttctggatcccagaaatatttccaccgccactgcagcccaaacagacctgaattttattaacgacgaaggtgacacttttcctctgagaacatacggcatgttctccgtagatttccgggatgaagtgacatccgaacctctcaacgccggtaaagtgaaagtgcatctggacagcactcaggtaaagatgcctgagcacatctctacagtgaagctttggtccctgaaccccgataccggattatgggaggaagagggggactttaagttcgagaaccaacgtcgcaataaacgcgaagatcgcacatttctggtcggaaaccttgagatcagggagagaaggctattcaacctggatgtgcccgagtcccgccgctgcttcgtaaaggtccgggcttacagaagtgagcggtttctgccaagcgagcaaattcaaggtgtcgttatttcagtgatcaacctcgaaccgcgaaccggcttcctgtcgaacccccgtgcctggggacgatttgactccgtgatcacaggccccaacggtgcctgtgtacccgcgttctgtgacgaccagagtcctgatgcttattctgcgtatgttctggcaagcttggcaggggaggagttgcaggccgtggaaagttcccccaaattcaatccgaatgccattggggtccctcagccttaccttaataagctgaactaccgcaggaccgatcacgaagatcccagggttaaaaaaacagcctttcagattagcatggccaaaccgagaccaaattcagctgaggagagcaatggaccaatttacgccttcgaaaatctgagagcatgtgaagaggctccgccttcagctgcacacttccggttctatcaaatagaaggggacagatacgactacaacacagtgccctttaacgaggacgatcctatgtcctggacagaagattatctggcatggtggcctaaacctatggagttccgagcatgctacattaaagtgaaaatcgtcggaccattagaagttaacgtgagatctagaaacatgggggggacccatcgacagacagtggggaagctgtatggcattagagatgtccggtcaacacgggacagagaccagcccaatgtgagcgctgcctgcctagagttcaaatgttccgggatgctgtacgaccaagatagggtagacagaacactggtgaaggtgatccctcaaggtagttgtaggcgcgccagcgtgaaccccatgctgcatgagtatctcgtgaaccatctacctctggccgtgaacaatgatacaagtgaatacactatgctagcaccgctggaccctcttggacataactacgggatctacactgttactgatcaggatccgcggaccgctaaggagatcgccctgggacgctgtttcgatggtactagtgacggctcaagtaggataatgaaatctaatgtgggagtcgctctgaccttcaactgtgttgagaggcaggtgggcagacagagcgccttccagtacctgcagtctacccccgcccaatctccagccgcgggaaccgtacaggggagagtgccttcccggcgccagcagcgcgcgagccgaggcggccagcgccagggcggcgtggtggcctccttgagattcccgagagtcgcacaacaacctctgatcaactag

SEQ ID NO: 110928 - DNA, 8148 bp, Artificial Sequence
  Description of Artificial Sequence: Synthetic coding sequence
atggccgccgccgctggcggaggcagttgtccgggtcccggatctgctcgaggacggtttccgggtcggccaaggggagctggtggcggggggggccggggtggtcggggaaatggggccgaacgggtgcgtgtcgccctgcgcaggggcggaggcgccaccggacccggcggagccgagccgggcgaggacaccgcgctgctccggctccttggactcaggaggggactgagaagactgcgcagactgtgggcagggcccagagtccagagaggccggggtagagggagggggagaggatggggtccctcccgcgggtgcgttccagaagaggagtcttctgatggagaaagcgacgaggaggaatttcagggctttcacagcgatgaggacgtggcgccgtcgagtctccgctctgctttgcggagtcaaagaggccgggcacctagagggcgaggcaggaaacacaagaccactcccctgccccctccacgcttggccgatgtcgcgcctacacctccgaaaacccctgcccgcaagcgaggcgaggaggggacggaaagaatggtgcaagccctgactgaactgctgaggagagctcaggcaccacaggctccacgtagtcgggcttgcgaacctagtactccacgccgcagccgggggcgacctcctggaaggcctgctggaccctgtaggagaaaacaacaggccgtggtggtggcagaagccgcagttactattccgaaacctgaacctccgccacccgtagtccctgtgaagcaccagaccggctcctggaaatgcaaggagggtccaggcccaggccctggcacaccacgccgtggaggccaaagctcacgcggaggaaggggaggtaggggtcggggccgggggggcggactgccctttgtcatcaagtttgtgagtagggccaaaaaggtcaaaatgggccagttgtctctggggctggaaagtggacaggggcagggccaacatgaggagagttggcaggatgtgcctcaaaggagggttggtagcggccaggggggctcaccctgctggaaaaaacaggaacagaagttggacgacgaggaagaagaaaaaaaggaggaggaggaaaaggataaagaaggcgaagagaaggaagaaagagctgttgcagaagagatgatgcccgccgcagagaaggaggaagctaagcttccacctcctcccctgacaccgcccgctcctagccctccgccacccctgcctccacctagtacgagcccacccccacctttgtgccccccaccccctccccctgtcagcccaccccccttgccctcacctccacccccaccggcacaggaggaacaggaagagtctcccccccccgtggtgccggccacttgtagcagaaaaaggggaaggccccctctgacaccttcacagcgcgctgaaagggaagctgcccgggcgggacctgagggaactagcccaccaaccccgaccccctctacagcgacgggcggacctcctgaggattctcccaccgtggctcctaaatcaactactttcctaaaaaacataagacagttcataatgccagtggtgagtgctcgtagttcaagagtgatcaaaactcccaggagattcatggacgaggacccacctaagccacccaaagtcgaagtgagtccagtgctacgacctccaataaccacttcaccaccagtgcctcaggaaccagctcctgttccgagcccaccccgtgccccaacaccgcctagcaccccagtgcctctccccgaaaagaggcgctctattctccgagaacctactttccgctggactagtttgacaagggaacttcctccgccacctcctgcccctccacccccaccagccccatccccaccccctgcccccgccacctcctcgagacggccactacttcttagggctccgcagttcactcctagtgaagcccatttgaaaatctatgaaagtgtgttaaccccacctcccctcggagcccctgaagctcctgagcccgaacctcccccggctgacgactcacctgctgagcccgagcccagggctgtcggcagaaccaaccatctctctctgccacgatttgcaccggtggtcacaacccccgtaaaggctgaggtgtccccacacggagcaccagccttgtccaacggtccacagactcaggctcaacttctgcagcccctgcaggcacttcagacacagctgctcccccaggctctgcctcccccacagcctcagttacagcctccgccctctccacagcagatgcctcctttggaaaaggcccggattgcgggggtgggatcactgccgctgagtggtgtggaagagaagatgttcagcctgcttaagcgtgcaaaggtgcagcttttcaagatcgaccaacagcagcagcagaaagtggcagcctcgatgccattatctcccgggggccagatggaagaagttgcgggcgctgtgaagcagatctccgatagggggcctgtacggtcggaagacgagtcagttgaggctaaaagggagaggccatcgggcccagagtctccagtccaagggcctcggattaaacacgtctgtcgccacgccgctgtggccctagggcaggcacgcgctatggtccctgaagatgttccgcgattatcagccctcccgctccgcgaccgacaggatctggctaccgaagatactagtagcgccagcgagacagagtcagtgcctagcaggtcgaggcgtgggaaggtcgaagctgctggacccggcggggagtcagaacccaccggatcgggagggactctagcccatactcctcgcagatcactcccttcccaccatggcaagaaaatgcggatggcccggtgcggacactgccggggttgcctgagagtccaggattgtggcagctgcgtgaattgcctggacaaacccaagtttggaggccccaacacaaaaaaacagtgttgcgtttatcggaaatgtgacaagattgaggcccgcaaaatggaacgtttggccaagaagggccggacgattgtcaagactctgttgccatgggactcggatgagtcacctgaagccagtcccggcccccctggcccaaggcgaggtgcgggagccggcggcccaagagaagaagtggtggcgcatcctggaccagaagaacaagattccctactccagaggaaatctgcaaggcgctgtgttaaacagcgtccctcatacgacattttcgaggattccgatgatagtgagccgggcgggcccccagctcccagaaggaggacacctagagaaaatgagctgccactgccagagccagaagagcagagtcgtccgaggaaacccaccctccagcctgtcctgcagctgaaggccagaaggcggctggataaggatgccctggccccaggcccattcgcaagtttcccaaacggctggacggggaaacaaaagtcccctgacggagtgcatagggttcgcgtcgactttaaggaagactgcgacttggagaacgtgtggctcatgggtggattgtcggtactcaccagcgtcccaggcgggcctcctatggtgtgcctgctgtgtgcctcgaaaggacttcatgagctggtgttctgccaggtatgttgcgacccttttcatcctttctgtctagaggaggccgaaaggcctctcccccaacatcatgacacgtggtgttgccggagatgtaagttttgtcacgtctgcggacgaaaagggcggggatctaagcatctactggagtgtgaacgatgcaggcatgcataccatcccgcgtgcctcggcccatcctaccccaccagggctacaagaaagaggcgccattggatctgctccgcatgtgttcgctgtaaaagctgcggggcaactcctggaaagaactgggacgtggaatggagcggcgactacagcctctgccctcggtgtactcagctctacgagaagggaaactattgtcctatctgcaccaggtgttacgaggacaacgattacgaatcaaaaatgatgcagtgtgctcagtgcgatcactgggtgcacgctaagtgcgaggggctctccgacgaggactatgagatcctctctggtctccctgattccgtgttgtatacctgtgggccttgtgctggcgcggcccaacccaggtggcgggaggctctgagcggagctctgcagggcgggttaagacaggtcctccagggcctccttagttctaaagtcgtgggacccttgcttctgtgcacacagtgtgggccagacggaaaacagctgcaccctggaccatgtggactgcaggcggtttcccagcgattcgaggacggccattataagagtgttcactcttttatggaagatatggtcgggatactgatgaggcacagtgaggagggtgaaactcccgatcggagagcagggggccagatgaaagggctgctgttgaagctccttgagagcgcatttggttggttcgacgcgcacgatcccaaatactggcggagatctacgcggctgccaaacggcgtactgccgaatgccgtgctgcctccttctctggaccatgtgtatgcccaatggcggcaacaagaaccggagacccctgaatccggccagcccccaggggacccctccgctgcctttcaggggaaagatcccgctgcgttttcgcacctcgaagatccgagacagtgtgctctgtgcctgaaatatggcgatgccgactcaaaagaagccggccgcctgctgtacattggacagaatgaatggacacacgtgaactgtgctatttggtcagccgaagtttttgaggaaaacgacggctctctcaaaaatgttcacgctgctgtcgctcgtgggcggcaaatgcgttgtgaactgtgccttaagcctggggccacagtcggatgctgtctctctagctgcctgtcaaacttccattttatgtgtgcccgagcttcctattgtattttccaggacgataagaaggtgttttgccagaaacatactgatctgctggacgggaaagaaatcgtcaatccagatgggttcgatgttctgcgaagggtgtacgtggacttcgaagggattaacttcaaaagaaagtttctaacaggactggagcccgacgctattaatgtgctgatcggatccatcaggattgactccctgggtacactctctgacctgagcgattgcgagggccgcctgtttcccattgggtatcagtgctcccgcctttattggagcacagtagacgcgcggcgccggtgctggtaccgttgtcgcattctggagtaccgaccatgggggccaagggaagagcccgcccaccttgaggccgctgaggaaaaccaaacaatcgtccactcccccgcgcccagcagtgagccccccgggggtgaggatcccccactggacacagacgtgttggtgccaggagcccccgagagacacagtcctattcagaatctcgacccaccccttcggccagactccggatcggctcctccgcccgccccccgctctttttctggagctcgcattaaggtgcccaattactctccctcccggcggccccttggcggggtgagcttcggacccctgccaagtcctggaagcccttcttctctcacccatcacattcccactgtgggcgatccggatttcccggctccaccacggagatcacggcggccaagtcccctggctcccagacccccaccatctcgctgggcctcacccccacttaaaacatcacctcaactgagagtaccaccaccgacaagtgtggtcacggcgctgacaccgacctctggcgagctggcacctcctggacctgctccttctcccccgcctccggaagacctcgggccagactttgaggacatggaggttgtaagtggactttctgcagccgacctggactttgctgcctcgttgctaggcacagaaccctttcaggaagaaattgtcgccgcaggggctatgggatccagtcatggcggccctggtgattctagcgaagaggagtccagtccaacgtcacgttacattcactttccggtgaccgtcgtgtcagcccctggattggcgccaagtgcaacaccaggcgctccacgaattgagcaattggacggtgtcgatgacggtacggattccgaggcagaggcggttcagcaaccacggggccaaggcacacccccatctggccctggagttgttcgggcgggagtcctaggcgcggctggggatagagcccggcccccagaagatctgccaagtgagattgtagacttcgtgctcaagaatctgggaggccctggcgacggaggggctggccctagagaggagagtctcccccccgctccaccccttgccaatggtagccagccaagccagggactaaccgccagccccgccgatcctacgcggacattcgcttggttacccggggcccctggtgtcagggtgttgagtctgggacccgcacccgaaccccccaagcctgctacttccaaaattatcctcgttaataaactgggccaggtttttgtgaagatggccggagaaggcgagcctgtgcctcctccggtgaagcaacccccactcccacctacaattagcccaacagcccccacttcttggactctgcctccaggacctctgttgggagttctgcccgtcgtaggcgtagtaaggccggctcccccaccacctcccccccctctgactttggtactgagcagcggcccagccagtccccccagacaggccattagggtaaagagagtgtccaccttttccggccggtcgcctcccgcccctccaccttataaggcccctaggctggacgaggacggagaagcttccgaggacacaccccaggtgcctggcctgggttccggaggctttagcagagtacgcatgaaaaccccgacggtgaggggcgttcttgatctggatagacccggcgagcccgccggtgaggaatcaccgggccccctgcaggagagatcacccctcctgcctctccctgaagacggacctcctcaggttcccgacggcccccctgatctgctcctcgagtcacagtggcatcattattctggggaagcatctagttcggaggaggagcctccaagccccgacgacaaagagaatcaggcaccaaaaagaaccggaccccacctgagattcgaaatcagctctgaagatgggttctccgtggaggcagagtcactagagggcgcctggcgtactctgattgagaaggtccaggaagcccgtgggcatgctcgactgagacacctaagctttagcggcatgtcaggggcccggttactggggatacatcacgatgctgtgatttttctggccgaacagcttcccggggctcagcgatgtcagcactataagtttcgatatcaccagcagggagaggggcaggaggagccaccgctgaacccccacggggcagcaagagcagaggtgtatcttagaaaatgcaccttcgacatgttcaactttctggctagccagcaccgcgtgcttcctgaaggtgcaacgtgtgatgaagaagaagatgaggtgcagctgcgctccacccggcgggctacaagcttagagctacccatggctatgcgcttccggcatctgaaaaaaactagcaaagaagctgtgggtgtctatagaagcgcaattcacgggaggggactgttctgcaagcgcaacatagacgcgggagagatggtgattgaatatagcggcatcgtgattcgatcagtactgacagacaaaagagagaagttctatgatggtaaggggattggctgttacatgttccggatggatgatttcgacgtggtcgacgcgacgatgcacggtaacgctgctcggttcatcaatcatagctgcgagccaaactgttttagcagagtcattcatgtcgagggccaaaaacacatagttatttttgcgctgaggcgcattctgaggggcgaggaactaacatatgattataagttcccaattgaggacgcgagcaataagctgccctgtaactgcggggccaagagatgtcggcgattcctgaactag

SEQ ID NO: 110929 - DNA, 2115 bp, Artificial Sequence
  Description of Artificial Sequence: Synthetic coding sequence
atggtgcccgatacagcttgcgttctgctgttgactctggccgcgctcggagcgtctggccagggccagagccctctgggatctgaccttggacctcaaatgttgcgagagctgcaggaaactaatgcagctctgcaggacgtgcgcgaactcttgaggcagcaggttagagaaattactttcctgaagaacaccgttatggaatgcgatgcttgtggtatgcagcagtcagtccgaaccggtctgccgagtgtccgcccgctcttgcactgtgcccccggcttttgctttccaggggtggcatgtattcagaccgagagcggcgccaggtgtggaccctgtccggcaggattcactggcaacggatctcactgcactgatgtaaacgagtgcgaaacagggcagcataactgcgtgcccaattcagtgtgtatcaacacgcggggatccttccagtgcgggccctgccagccaggctttgtcggggaccaggcctcgggttgccagcgacgcgcacaacgattctgcccagacggtagcccatctgaatgtcatgagcacgccgattgtgtgctggagagggatgggagtaggagctgtgtctgcgccgttggctgggctggcaatggcatcctttgtggtagggacacggatctcgatggtttccctgacgaaaaacttaggtgcccagagcgccagtgtcggaaagataattgcgtgacagttccgaactccggacaggaggatgtagatcgggatggtattggcgatgcttgcgaccccgatgcggacggtgacggggtgccaaatgaaaaagataattgcccgcttgtcagaaacccggaccaaagaaatactgatgaggataaatggggtgatgcttgcgataattgcaggtcgcagaagaatgacgaccaaaaagatacagatcaagacgggcggggcgacgcttgcgacgacgatatagatggtgatcgtatccgcaaccaggcagataattgcccaagggtgccaaactctgatcagaaagactccgacggggatgggatcggggatgcctgcgataactgtcctcagaagtctaaccctgaccaggctgacgtggaccacgatttcgtcggtgatgcctgcgacagcgatcaggatcaggatggtgacggacaccaagattcacgggataattgccctacggtacccaattcggctcaagaggattccgaccacgacggtcagggtgacgcatgtgacgacgacgacgataacgatggcgtgcctgacagcagggataattgccggttggtgcccaacccgggtcaggaggacgcggaccgcgacggagtcggggatgtttgccaggacgactttgacgctgacaaggtcgtggacaagatcgacgtttgtccggaaaacgcagaggtgacactcaccgattttagagcatttcaaacagtggttctcgaccctgaaggtgatgctcagatcgatcctaattgggttgttttaaaccagggccgggaaatagtgcagactatgaatagtgatcctggcctggccgtaggctatactgcattcaacggcgttgattttgaagggacgtttcacgtgaacaccgtgaccgacgacgactatgctggtttcatttttggctatcaggatagctcgagtttctatgtagttatgtggaagcagatggagcagacgtactggcaggccaacccatttagagccgtcgccgaacctggtatacaactgaaagctgtaaagtcgtcaaccggccctggagaacagttgagaaatgctctgtggcatacaggagacacagaatcacaggtccggctgctctggaaggatccacggaacgtcggctggaaggacaagaagtcctacagatggttcttgcagcatcgcccccaagtcggctatatacgtgtgagattctacgaggggcctgaattagtcgccgatagtaacgtcgtcctcgacaccactatgcgtgggggccggctcggtgtgttttgtttctcacaggagaacatcatttgggccaatctgaggtaccgctgcaacgacactatcccagaggactacgaaacccatcagttacgtcaggcatag

SEQ ID NO: 110930 - DNA, 2235 bp, Artificial Sequence
  Description of Artificial Sequence: Synthetic coding sequence
atggtcccagatacggcatgcgtcctgctccttaccttagccgcactgggagcttcgggccaagggcagtctcctctcggatccgacctggggcctcagatgcttagagagctccaggagacgaacgcagcgctgcaagatgtcagggagctgctgaggcagcaagttcgcgagataaccttcttaaaaaacacggtgatggagtgcgacgcctgtgggatgcagcagtcagtaagaaccggcctaccaagtgtgcggcctctgctccactgcgcacccggattctgtttccccggtccctgtcccgccggattcactgggaatggctcacattgcaccgacgtcaatgagtgtaatgcccacccttgcttcccacgagttcggtgcataaacacctctcccgggttccgctgtgaagcctgccctcccggctattccggccccacccaccagggagtgggactcgcctttgctaaggccaacaagcaggtatgtaccgatataaatgagtgtgaaacaggacaacataactgcgtcccgaatagtgtgtgtatcaacactcggggaagcttccagtgtggaccatgccagccagggttcgtcggagatcaggcctcggggtgtcagaggcgtgcccagaggttctgccctgatgggagtccctcggagtgtcatgaacacgcagactgcgtcctcgagagagatgggtcaaggtcttgtgtctgtgccgtaggctgggctgggaatggtattctctgtgggagggacaccgatctcgatggtttccctgacgagaaacttaggtgcccagaacggcaatgtagaaaggataactgtgtaactgtgcccaattccgggcaggaggacgttgatagagacggtatcggggacgcctgtgatcctgatgctgacggggacggggttccgaacgagaaagacaactgcccgcttgtgcgaaacccggaccaacggaatactgacgaggacaagtggggggacgcctgcgacaactgtagaagtcagaagaatgatgatcagaaggatactgaccaggacggcaggggtgacgcctgcgacgatgacatcgacggggacaggatccggaaccaggccgacaactgtcctagggttccgaatagcgaccagaaggactctgatggggacggtattggcgatgcatgcgacaactgtccacaaaaatccaaccctgaccaggccgacgttgatcacgattttgtgggtgacgcatgtgactctgatcaagaccaggacggggacggccaccaggactcccgggataactgtccaaccgtcccaaactctgcccaagaagattcagaccacgatgggcagggagacgcgtgcgacgatgacgatgacaacgacggtgtacctgacagcagggataactgcagattggtccctaacccggggcaagaggatgcggatcgcgacggcgtgggcgatgtgtgccaggacgattttgatgccgataaggtggttgacaaaattgatgtgtgtcccgagaatgccgaagttactctcaccgactttagggcgttccagacagtggtgctggatcctgagggggacgcccagattgacccaaactgggtcgttctgaatcagggaagggaaattgtccaaacaatgaactctgatccgggcttagctgtgggttacacagcctttaacggcgtggacttcgaggggactttccacgtgaatacagtgacggatgatgactacgccgggttcatattcgggtaccaggattcaagcagcttctacgtcgttatgtggaaacagatggagcagacttattggcaggcaaacccctttcgagctgtggccgagcccggcatacagttgaaggctgttaagtcctctaccggtccaggtgaacagctgcgtaatgccctgtggcacactggagatacagagtctcaggtcaggcttctgtggaaagatccaaggaacgtcggttggaaggacaagaaaagctacaggtggttccttcagcatcgcccacaggtaggttacattcgagttaggttctatgagggacccgagttggtcgcggattctaacgtcgtactggatacaacgatgcgcgggggacgtctcggggtgttttgcttctcccaagaaaacatcatctgggccaatctgaggtatcgttgcaacgataccattcctgaggactacgaaacccaccagcttcgccaggcatag

SEQ ID NO: 110931 - DNA, 2394 bp, Artificial Sequence
  Description of Artificial Sequence: Synthetic coding sequence
atggcagcgctggcctataacctgggaaagcgggaaattaatcactacttttccgtaagaagcgccaaggtgcttgcactggtggccgtgcttcttctcgcagcctgccacttggcaagccgccggtatcgcggaaatgatagttgcgaatacttgctgagctccggaaggttcctcggagaaaaggtctggcaaccgcactcctgcatgatgcacaaatacaagatctccgaagccaaaaactgtctcgtggataagcacattgcgttcattggtgattcacgaattaggcagctcttttacagtttcgtgaagatcatcaaccctcagttcaaagaggagggaaataagcacgaaaacattcccttcgaagataaaacagcatccgtaaaagttgattttctgtggcatccagaggtgaacggatccatgaaacaatgcatcaaggtctggaccgaggacagcattgccaaaccacacgtcattgtggcgggagccgcaacgtggtccatcaagattcacaacggttctagcgaggcactgtctcagtacaagatgaacatcacgagcattgccccactccttgagaaactggctaaaaccagcgacgtatactgggttctgcaggatccagtatacgaagatctcttaagtgagaaccgaaagatgattaccaacgagaagatcgacgcgtataatgaggccgctgtctcgattctgaacagctccacccggaatagcaaatccaatgttaaaatgttttcagtgagcaaactgatcgcccaggaaacaatcatggagagtttggacggtctgcacttacccgaaagcagccgggagactacagcaatgatcctaatgaatgtatattgcaataagatcctgaaaccggtcgatgggtcatgttgccagccgcgaccgcccgtgaccctcattcagaaattggctgcttgtttcttcacactaagcattataggatatcttatcttctacataatccatcgcaacgctcataggaagaataaaccatgcactgacctggagtcaggtgaagaaaaaaaaaatatcattaatacccccgtgagctccctggaaatcctgttgcagtcattctgtaagctgggacttatcatggcctacttctatatgtgcgatcgcgccaacctcttcatgaaagagaataagttttatacacattcttctttcttcatccccataatttacattttagtgctgggcgtgttctacaatgaaaacaccaaggaaactaaagtcctcaaccgtgaacagactgatgaatggaagggctggatgcaattggtcatcctgatctaccatatcagcggggcttcaaccttcctgcctgtgtatatgcacattcgcgttctggttgcagcatacctatttcagacaggctatggacatttcagctatttttggatcaaaggcgactttggaatatacagggtgtgccaggtattgttcaggctcaattttttggtcgtggttctgtgcatcgtgatggacagaccataccagttttattatttcgtgcctcttgtaaccgtctggttcatggtgatctacgtaaccctagctctgtggccacaaattatccagaaaaaagcgaacggcaactgtttctggcacttcggattgttactaaagttaggcttccttctgctgtttatctgttttctggcctactctcaaggtgcatttgaaaagatcttctccctttggcctttatctaaatgtttcgagctgaaagggaacgtgtacgaatggtggtttagatggagactagatcgttatgtggtgttccacgggatgctgtttgctttcatttatctagcactgcagaaacggcaaatcctgtcggaggggaagggggaacctctgttctctaacaaaatctccaatttcttgctttttattagcgtagtcagctttcttacgtactcaatttgggcttcatcttgcaagaataaggctgaatgcaatgaactgcacccgagcgtgagcgtggtccaaattctggcttttatcctgatcaggaacatccccggctatgcccgctcagtgtattcctcattctttgcttggttcgggaagattagcctagagctgtttatttgccagtaccacatttggctagctgccgacaccagagggatattagtgcttatcccaggtaacccgatgttaaatatcatcgtcagcactttcatcttcgtctgtgtggcgcacgagatcagtcaaataacaaatgacctagcgcaaataatcatcccaaaggataacagttccctgctgaaacgtttagcttgtatcgccgcatttttttgtgggctgctcatactttctagcatacaggacaaatccaagcactag

SEQ ID NO: 110932 - DNA, 2721 bp, Artificial Sequence
  Description of Artificial Sequence: Synthetic coding sequence
atggccgggaacgtgaagaaaagcagtggagctggcgggggatcgggctctggggggtccggaagtggcggcctcattggattaatgaaggatgcattccagccacaccaccatcaccaccatcatctgtcgccccatccccccgggactgtggacaaaaagatggtggagaagtgctggaagctgatggataaagtggtgcgcctttgtcagaaccccaagctggccctaaaaaattctccaccttatatactggacctgctgccagatacctaccaacacctgcgcacaattctttctcgatatgagggtaagatggagactctgggtgaaaatgagtactttcgagtctttatggaaaacctgatgaagaagactaaacagacaatttctctattcaaggaaggcaaggaacgcatgtacgaagagaactctcagccgcgaagaaacttgactaaactcagcctgatcttcagccacatgcttgctgagctgaagggaattttcccatcagggctgttccagggcgacacctttagaatcacaaaggcagacgcagccgaattttggcggaaagcattcggggaaaagactatagtaccttggaaatcatttcgtcaagcattgcatgaggtccatcccatttcctccggactagaggcgatggcccttaaatcaactatcgatctgacatgtaatgactacattagtgtttttgagttcgacatatttacaagactgtttcagccatggagtagtcttctccggaactggaatagcttagcagtgacacaccccggatacatggcttttttgacctatgatgaagttaaggcaagacttcaaaaattcatacacaaaccggggtcttacattttccgattatcctgcaccagactcgggcagtgggccatcggctatgtcacagccgacggaaatatccttcaaactatcccccataacaagccgttgtttcaggccctgatcgacggattcagagaaggattttatctgtttcccgacggcaggaaccagaatcccgacttaactgggctctgcgagcctacaccacaggatcacatcaaagtgacgcaggaacagtacgagctgtactgtgaaatggggtcaaccttccagttgtgtaagatatgcgctgagaacgacaaggacgtcaaaattgagccatgcgggcacttaatgtgtacatcatgccttacaagttggcaggaatctgagggtcagggctgccccttttgcagatgcgaaattaaagggaccgagcctattgtggtcgacccctttgatcccagaggctctggtagcttgctacgacaaggggcagagggggctccttcaccaaactacgatgatgatgacgatgaacgggccgacgacactctttttatgatgaaagagctcgccggagcgaaagtcgagcgtccaccgtcgccttttagcatggcgccacaggcctccctgcctccagtcccccctaggctggacctgctgccacagcgcgtgtgcgtaccatccagtgcatccgccctcggaaccgccagcaaagctgctagtggcagcctgcacaaggacaaaccactgcctgtcccacccacactgcgcgatctgcctcccccaccaccccctgaccgcccctactctgtgggagccgagagtcgaccacagcgacggccattgccctgcactccaggggattgccctagccgagacaaactgcctcccgtgccaagcagccggctcggagactcttggctcccccggccaattccaaaggtgcccgtgagcgcaccttcctctagcgacccctggactgggcgtgaactgaccaaccgacactccctgcctttcagcttgcccagtcagatggagcctcggccagatgtgcctaggctgggttcaacctttagcctagatacttccatgagtatgaactcttcaccactcgtggggccagaatgcgatcacccgaaaataaaacctagtagttctgccaatgcaatctactctctggccgctagacctctgccggtccccaaactgcctcccggagaacagtgtgagggcgaagaggacactgagtacatgaccccttcaagccgaccgcttaggcccctggacacatctcagtcctcccgggcctgcgattgtgaccagcaaattgacagctgcacctacgaggcaatgtacaacatccagagtcaagccccaagcatcaccgaaagcagtacctttggagagggtaaccttgctgcagctcatgcaaatactggacccgaagagagcgagaacgaagacgatggctatgatgtgcctaaaccccccgttcccgcggtcttggccagaagaaccctcagcgatattagcaatgcttccagctcctttggctggctctccctggacggtgaccccaccaccaatgtcaccgaagggtcccaggttcccgagaggccgcctaagccgttcccccgccgaataaatagtgagagaaaagcggggagctgtcagcagggatccggacccgccgcaagtgcagctacggcttctcctcaactgtctagcgagattgagaatctgatgagtcagggttatagctatcaggatattcagaaggcccttgtgattgcccagaacaacatcgaaatggctaagaatatccttcgggagtttgtctccatttcttcccctgcacatgtggccacttag

SEQ ID NO: 110933 - DNA, 2949 bp, Artificial Sequence
  Description of Artificial Sequence: Synthetic coding sequence
atggcgaattccatgaacggcaggaaccccggcgggcgcggagggaatcccaggaagggccgcatcctcggcattattgatgcaatccaagatgcagtgggaccgcccaagcaggctgctgccgaccgacgaaccgtggaaaagacatggaaactgatggataaagttgtacgcctttgccagaatccaaagctccagctgaagaacagtccgccatacatcttagatatcctgccggatacataccaacacctgcgcctaatcttgtccaaatacgatgacaaccagaagctggctcagctttctgaaaacgagtactttaaaatatatattgactctctgatgaaaaagtctaagcgcgcaattaggctgttcaaggaaggtaaagaacgcatgtacgaggaacaaagtcaggaccggaggaacctcaccaagctgtcgctgattttctcccacatgcttgcggaaataaaggcgatttttccaaatggacaattccagggtgacaactttcggattactaaggctgacgccgcagagttttggcgcaaattttttggagataaaacaatcgtaccctggaaagtgttcaggcaatgcctccatgaggtccaccagatcagctccggcctggaggccatggcgctaaaaagtactattgacctcacctgtaatgattatatctcagtttttgagttcgatatttttacaaggctgttccagccctggggctcaattctgcgtaattggaactttcttgccgtcacccaccccggctatatggctttcctgacgtacgacgaggtgaaagctcgcctccagaaatactctaccaaacccgggtcttacattttccggctgtcctgtactagactggggcagtgggctatcggttatgtcacaggtgacggcaatatcctccagaccatcccccacaacaagcctttatttcaagctctcatcgacggctcccgcgaggggttctacttataccccgatgggcgctcatataatcccgacctcactgggttgtgtgaaccgacaccccatgaccacatcaaggtgacccaagagcagtatgagctgtattgcgaaatggggagtaccttccagctgtgcaaaatctgcgcagaaaacgacaaggatgttaagatcgagccttgcggtcatctaatgtgtacttcctgcctgacagcatggcaagagagcgacggccagggctgccccttctgtaggtgcgagatcaagggcaccgagcctatcatcgtagacccttttgatcctcgggacgagggctctagatgctgctccatcatcgatccatttgggatgcccatgctggacctcgatgacgatgatgatcgagaggaatcgcttatgatgaatagattagccaatgtccgaaaatgcaccgatagacagaatagccctgtgaccagcccaggctcttcgcctttggcccaacgtcggaagccccagcccgatcctctgcagatccctcacctcagtttacctcctgtacccccaagactggacttgattcagaaaggcatagttcgaagtccttgtggctctcctaccgggtcaccgaagtcctccccctgcatggtcaggaagcaagacaaaccactcccagccccacccccccccctccgcgacccaccccccccccccccggaacgccctccgccgatccctcccgacaatcggctctcccggcatattcatcacgtcgagtccgtcccgtcacgtgacccaccaatgccgttagaggcctggtgcccccgcgacgtcttcggcacgaaccagcttgtgggatgtcggctcctaggagagggtagtccgaagcccggaatcacagccagcagcaatgtgaatgggcgccactcacgggtaggctccgatcctgtattgatgaggaagcacagaagacacgacctaccactggagggggcgaaagtctttagcaacggccatctggggtctgaggaatacgatgtgccgccgcgtctgtcgcccccacctccagtaacaaccctgctgccaagtatcaagtgtactggaccgctcgcaaactcactgtcagagaagactcgtgacccggttgaggaggacgacgacgagtacaagatcccttcatcacaccccgtttcgctcaacagtcagccgagtcactgccataatgtgaagcctccggtacgttcctgtgacaacggacactgcatgctcaacgggacccatggaccaagcagcgagaaaaagtcaaatatccccgacctaagcatttaccttaagggcgacgtgtttgactctgccagcgaccccgtgccgcttccacccgctagacccccaactcgtgacaacccgaagcatggctccagcctgaaccgaaccccatcagattatgatcttctgattccacccctgggcgaggatgccttcgacgccctgccgccctctctgcccccgcccccgcctccagctcggcactccttgatcgagcactctaagcccccaggatcatcttccaggcctagtagtggtcaagacttattcctgctgccaagcgaccctttcgtggatcttgcttccggtcaagtgcctctgcctccagcacggagactgcctggggagaacgttaagaccaacaggacttcacaggactatgatcagcttcctagttgctctgacggttcacaggcaccagctaggcccccgaagcctaggccaaggagaacggctcccgaaatacatcaccgcaaaccccatgggcctgaagcagccttagagaatgtggatgccaagattgccaaactcatgggggagggctatgcattcgaagaggtgaaaagagcccttgagatagcccagaacaacgtagaggtggcaagaagcatcctgagagaattcgcttttccccctcctgtgtcaccccggctgaatctgtag

SEQ ID NO: 110934 - DNA, 2883 bp, Artificial Sequence
  Description of Artificial Sequence: Synthetic coding sequence
atggctctcgcccctggccccgatgctcacgcgcatttgccgcctttaattgagttgaaattccagatggcaaatagcatgaatggcagaaacccaggcggcaggggtgggaaccctcgcaagggaaggattcttggcataatcgatgccatccaggacgcagtgggtccacccaagcaggccgcagccgatcggcggacagtagaaaagacttggaagttaatggacaaagtggtgcgcctgtgccaaaatccaaaactgcagttaaagaattctcccccatacatcctggacattctccctgacacgtaccagcatttgagactgattttatctaaatacgacgacaatcagaaactcgcccaacttagcgagaatgagtactttaaaatttatattgatagcttgatgaaaaagagcaagagggccattcgtttgttcaaggagggaaaagaaagaatgtacgaagagcagagccaggatcgaagaaatctgaccaagctcagcctgattttctcacacatgttggctgagatcaaggccatttttccaaatggccaattccagggcgacaattttcggatcacaaaagctgacgctgccgagttttggaggaaattctttggcgacaagaccattgtgccatggaaggtcttcaggcagtgccttcatgaagtccaccagatctcctccggtctcgaggcaatggccttaaagtcgaccatcgaccttacctgcaacgactacataagcgtattcgaattcgacatctttacgcgcctctttcaaccgtggggatctatcctacgtaactggaacttcttagccgtcacgcatcctggttacatggccttcctaacatacgatgaagtgaaagcacgactgcagaagtactccacgaagccaggttcctacatcttcagattaagctgcacaaggctggggcagtgggccatcggctacgtgacgggcgatggcaacatcttgcaaaccattcctcataataagcctttgttccaagctctgattgacgggtcaagggagggcttttacctttatcccgatggccgctcgtataatcccgatctcacaggtctctgtgaaccaacacctcacgaccacatcaaagttacccaggagcagtacgaactctattgtgagatgggaagcaccttccaactgtgtaagatatgtgccgaaaatgataaggacgtgaaaattgaaccttgtggccaccttatgtgtacctcttgtttaactgcctggcaggaaagtgacggacagggatgcccgttttgtcgctgtgagattaagggcactgaacccatcattgtggaccctttcgacccacgcgacgaagggagtcggtgttgcagtataatcgaccctttcgggatgcccatgctagatcttgatgacgacgacgatcgtgaggaatcccttatgatgaatcgcttagctaacgtgcgcaaatgcacagacagacaaaactcgcctgtcacttcacccggttccagtcctctagcccagcggcggaaacctcagcctgaccccctgcagattccccacctgtcgttaccgcctgtaccacctcggttggatctgatccaaaaagggattgtgcgatcaccgtgtggatctcctaccggctctccgaaatcaagcccatgcatggttcgaaaacaggataagccgcttccggctcccccaccccccttgagggaccctccacccccccccccagagcggccaccccctattccccccgacaatcgcttgagtcgacacatccatcatgtcgaaagcgttccatccagggaccctcctatgcctctggaggcttggtgtcctcgtgacgtgttcgggaccaaccagcttgtcggttgtcgcctcctcggcgaagggtcccctaaacctggaatcaccgcctcaagcaatgtgaacggcaggcattctagagtaggctcagacccggtgctcatgaggaaacatcgtcggcacgacttgccgctggaaggggctaaagtcttctccaatgggcatctcgggtctgaagagtatgacgtgcctccacggttgtcacctccaccgcctgtgactacgctgttgccaagtattaaatgcactggacccttggcaaattcactgtccgaaaagacaagagatcccgttgaggaagacgacgacgaatacaagatccctagcagtcacccagtatccctgaattcacagccaagtcattgccacaacgtgaagccccccgttagatcttgtgacaatggccactgcatgttgaacggaactcacgggccaagtagtgaaaagaaatctaatatacccgatctttctatttacctgaaaggggaggatgccttcgacgccctgcctccttcacttcctcctccccctcctcccgcaaggcacagcctgattgaacacagcaagcctcctggatcatcatccaggccctccagcggacaagatttatttcttctaccaagcgatccctttgtagacttggccagcggacaagtacccctgccaccagctcgaagactccccggggaaaacgtcaagacgaatagaacaagtcaggactacgatcagctgcccagctgttccgacgggtctcaggcgcccgctcggccacctaagccacgtcctagaagaaccgctcccgaaatccaccaccgaaagcctcatggcccagaggctgcactcgaaaacgtggatgctaagatcgccaaactcatgggtgagggatatgcttttgaagaggtgaaaagggctttggagatcgctcagaataacgtagaagtagcccggtctatcctccgagagttcgcttttccccctcccgtctctccccggctgaacttatag

SEQ ID NO: 110935 - DNA, 2313 bp, Artificial Sequence
  Description of Artificial Sequence: Synthetic coding sequence
atggccaattcaatgaatggcaggaacccaggaggtcgcggcgggaaccccaggaaaggcagaattctggggataatcgacgcgatccaggacgctgtcggacctcctaagcaggctgccgccgaccggcgaaccgtcgaaaagacctggaagcttatggacaaagtcgtgaggttgtgtcaaaatcccaaactacaactgaagaactcaccgccatacattctcgatattttgcccgatacatatcagcatctgcggcttatcttgtctaagtacgacgataaccagaaactggcacaactttccgaaaatgaatattttaaaatttacattgattctctcatgaaaaaaagtaaaagagcaatcagacttttcaaagaggggaaggaaaggatgtatgaagagcagtctcaggaccgcaggaacttgaccaagctgtccttgatctttagtcatatgctggccgaaattaaagcaatttttcctaacggacaattccagggggataactttcgaatcaccaaggccgatgccgcggagttctggcgtaagttcttcggggataaaactatcgtgccatggaaggtgtttcgccagtgcttgcatgaggtgcaccagatttcctcagggcttgaggccatggctctcaaaagcactatagatctgacgtgtaacgactacattagcgtatttgagttcgatatctttacgaggctgttccagccatggggaagcattctccgaaactggaacttcctggccgtgacgcacccagggtatatggcctttctcacatacgacgaagtgaaagcccgattgcagaagtactcaaccaaacccggcagttacattttcagactgtcctgtactcggctcggacaatgggctatagggtacgtgactggggatgggaatatcctccagaccattccccacaataagcccctgtttcaagcactgatcgacggcagtcgggagggcttctatctgtaccccgacggacgctcttacaacccagatctgacggggctgtgtgaaccaacaccccacgaccacataaaagttactcaggagcagtacgaactctactgtgagatgggctcaacttttcagttgtgcaaaatatgtgctgagaatgacaaggatgttaagatagaaccctgcggccatcttatgtgcacctcctgcttaactgcgtggcaggagagtgatggacaggggtgccccttctgtagatgtgagattaaggggaccgaaccgattatcgtagacccttttgaccctcgtgatgaagggagtaggtgctgctcgataatcgatccctttggtatgcccatgctagacctagatgatgatgacgaccgggaggagtccctaatgatgaacagattagcgaacgtgagaaagtgtaccgaccggcagaatagcccagtcacctccccagggtcgtctccactggcgcaacgcagaaaacctcagcctgacccactgcaaatcccacacctgtcactgcctcccgtgcccccacgactggacctgatacagaagggcattgtgcggagtccatgcggctcacccacgggcagccctaagagttcaccatgcatggtgaggaagcaggacaaacccttgcctgcccccccaccccctctgcgtgacccaccccctcccccacccgaacggccccctcccatccctcctgataaccgtctaagccggcatattcatcatgtcgagagcgtgccaagtagagatccccctatgcccctggaggcttggtgccccagagatgtatttggaacaaatcagctggtggggtgcagactactcggggaagggtcaccaaagcctgggatcaccgcctccagcaatgtcaacggcagacactcaagggtcggttcagaccccgttctaatgcgcaaacaccggcgccatgacctgcccctggagggtgctaaagtgttttccaatggccatttgggatccgaggaatatgatgtgcctccccgtttaagccctcctcccccggtgaccaccttgttgccatctatcaagtgtaccggcccactggcaaatagcctgtcggaaaagacccgagatcccgtcgaggaggacgacgatgaatacaaaattccttctagccacccagtcagcttgaactcccagcccagccactgtcataatgtgaaaccgccagtcagatcatgcgacaacggtcactgtatgctcaatggaacacatgggccaagttctgaaaaaaaaagcaacattcccgatctgtccatttacctaaagggcacctaccgaatctag

SEQ ID NO: 110936 - DNA, 2433 bp, Artificial Sequence
  Description of Artificial Sequence: Synthetic coding sequence
atggctaactccatgaacggtcggaatcctggcgggaggggaggcaatccgcgtaagggccggattctgggaattatcgacgccattcaagacgccgtggggcctcccaaacaggccgccgctgataggcgtacagtggaaaagacttggaaactgatggacaaggttgtgcgcttgtgccagaatcctaaacttcagctgaaaaattcaccaccatatattctggatatacttcccgacacatatcaacatctgaggctcatcctgtctaagtatgacgacaatcagaaattggcccagctgtccgagaacgagtactttaaaatctacatcgattcgctcatgaagaaaagcaaaagggccatacggctgttcaaggaaggaaaggaaaggatgtatgaggagcagagccaggataggcggaatctgacgaagctgtctctgattttctcacatatgctggctgagatcaaggcaatctttcccaatggtcagtttcagggcgacaacttccggattaccaaagcagacgctgccgaattttggagaaagttcttcggggacaagaccatagtgccttggaaggtgttcaggcagtgcctccatgaggtccatcaaattagttccgggctcgaggccatggctctgaaatcaactatcgatcttacctgcaacgattatatatcagtcttcgagtttgacatctttacacgcctatttcagccatggggctcaatcctaaggaattggaactttctggccgttactcacccagggtatatggctttcttgacctacgatgaagtgaaggcaagactacagaagtactctacaaaaccaggttcctatatctttcgcctgagttgtacccgcttaggacaatgggcaatcgggtatgtgaccggagacggcaatatactgcaaacgattcctcacaacaagccattgtttcaggccttgattgacggcagtagagaaggcttttatttgtaccccgacggacgctcctacaatcccgatctaaccggactatgcgagcctacaccgcatgatcacatcaaggtcacgcaagagcaatacgagctgtattgcgagatgggatccactttccagctgtgcaagatctgcgccgagaacgacaaggacgtcaaaattgagccctgcgggcacctgatgtgcacgtcctgcttgaccgcgtggcaggagagtgatggccagggatgccccttttgtaggtgtgaaattaagggcacggaacctattattgttgatcctttcgatcctagggatgaggggtctagatgttgctcaattattgatccttttggaatgccgatgctggacctggacgacgatgacgatagagaagaaagtcttatgatgaataggctcgctaacgttaggaagtgtaccgaccggcagaatagtccagtgacgagcccgggcagctcccccctggcccagaggagaaagccacaacccgacccgttgcagataccacacctttccctgccccctgtacccccaaggctagatctgatccagaagggcatagtgagatcaccatgcggcagtcctaccggaagcccaaagtcttccccgtgcatggtgaggaagcaggacaaacctctacccgctcctccaccgccccttcgcgaccctcctcctcctccacccgagcgcccaccgccaatcccccccgataatagactttctcggcacattcatcacgtagagtcagtgcccagccgcgacccaccaatgccattggaagcctggtgccctcgcgatgtgttcggaactaaccagctggtggggtgtcggctgctgggagagggttcgcctaagcccggaatcactgcttcttctaacgtgaatggcagacacagccgcgtgggctcagaccctgtactcatgagaaaacataggcggcacgacttacctctcgaaggagcaaaggtgttcagtaacggccacttaggaagcgaggaatacgacgtgccgcctcgcttatccccaccgccgcccgtgaccacccttttacccagcatcaaatgcacaggtccactggccaattcactgtctgagaagacccgggatcccgtggaggaggatgacgacgaatacaagattccaagcagccatccggtcagcttgaattcacagcccagtcattgccataatgtgaagcctcctgtgcgctcttgtgataacggtcattgtatgctaaacgggacccacggcccctcatccgaaaagaagagcaacatacccgatctcagcatctatcttaaaggcgacgtgttcgactcagcctcggatcccgttcctctgcctcccgcccggccaccaactagagacaatcccaagcatggaagttcactcaaccggaccccatctgattacgaccttctgatcccacctctgggctag

SEQ ID NO: 110937 - DNA, 420 bp, Artificial Sequence
  Description of Artificial Sequence: Synthetic coding sequence
atggccaactcaatgaacgggagaaacccgggaggtcggggtggaaatccgagaaagggaagaatactcggcataatagacgcgatacaagacgctgtcgggccccccaaacaggccgctgctgatcgtcgtaccgtagaaaagacatggaaactcatggataaggtagttaggctctgccagaatccgaagttacagttaaagaattcaccaccatacattctggacatcctcccggacacttatcagcatctccggttgattcttagtaagtacgatgacaaccagaagctggcacagttaagcgagaacgaatactttaagatctatattgactctcttatgaaaaagtcaaagcgcgccatccgtttgttcaaggagggtaaggagaggatgtatgaggaacagtcccaggactag

SEQ ID NO: 110938 - DNA, 684 bp, Artificial Sequence
  Description of Artificial Sequence: Synthetic coding sequence
atggcactcgcccccggacctgacgcccatgcacatttgccacccctgatcgaactaaagtttcagatggccaactcaatgaatggtcggaacccaggggggcgtggaggtaaccctcggaagggcagaatcctgggcattatcgatgccattcaggacgctgtcggccctccaaaacaggccgcagccgacagacgcaccgtggaaaaaacctggaagctaatggataaggtagttaggctctgtcagaaccctaaactgcaattaaaaaattctcccccctacattttggatatactgcccgatacgtatcagcacttgcgtctcatcctgtcaaaatatgatgataaccagaaactggcgcagctgagcgaaaacgagtactttaagatctacatcgactctctaatgaagaagtccaagcgcgccattcggcttttcaaggagggcaaggaaagaatgtacgaggaacagtcccaagacaggaccatcgtgccatggaaggtgttccggcaatgtctacatgaagtacaccagattagcagcggtttggaagccatggcacttaagtctaccatagacctgacttgtaacgattatatcagcgtgtttgaattcgatatcttcacacgcctctttcaggttagtgataacttcactgaatatctgatatatcttacctag

SEQ ID NO: 110939 - DNA, 1425 bp, Artificial Sequence
  Description of Artificial Sequence: Synthetic coding sequence
atggccttggctgttgcaccatggggccgccagtgggaggaggcacgagccctgggtagggccgtcagaatgctacaaaggctggaggaacagtgcgtcgacccaaggctttcagtgtcaccacccagcttgcgggatctgctgccaaggacagcgcagctgctgcgggaggtagcccactcacgcagggctgcaggaggaggaggaccgggtggccctggtggctccggtgacttcctcctgatttatctggcaaacctggaggcaaagagcaggcaggtagccgctctgctgcctccccgcggaagacgtagcgcgaatgatgagctgtttcgcgccggctcaaggttgaggagacagcttgcaaagctggcaatcatcttctctcatatgcatgccgagctacatgcgctatttccgggcgggaaatactgcgggcatatgtatcagttgacaaaggcgcccgcccacactttctggcgggaatcatgcggagcaaggtgcgtgcttccatgggctgaattcgaatctctgcttgggacttgtcaccctgttgagcccggctgtacagccctggctctgcggaccaccatcgatctgacatgtagcggtcacgtgtcaatctttgaatttgacgtcttcactcggctctttcagccctggccaacccttttgaagaactggcaactcctggccgttaaccatccgggttacatggcctttctcacctatgacgaggttcaggaacgcctgcaggcctgcagggataagccaggtagctatatattccgcccatcttgcacgagattgggtcagtgggcgatcggatatgtgagcagtgacgggtcaatcctgcaaactatcccggcaaataagcctctgtcacaggttctgctggaagggcagaaggacggattctacctatacccggacggaaaaacccataaccctgacctgacagagttgggacaggcagagccacaacagaggatccatgtatctgaggaacagctacagctctactgggccatggactctacattcgaactgtgcaaaatctgtgcggaatcaaacaaagacgttaaaattgagccttgcggccatctgctgtgctcatgttgtctagcagcttggcaacattctgactcacaaacttgtccattctgtaggtgtgaaatcaaaggctgggaggcagtctcaatttaccagttccacggacaggccacagctgaagatagtggcaactcttctgaccaagagggtagagagctggaacttgggcaagtgccattatcggccccgcccttgcccccgagacctgatctgccgccaagaaagccgaggaacgcccagcccaaggtgagactgctgaaagggaattcccctcccgccgctctaggtcctcaggatcctgcacccgcatag

SEQ ID NO: 110940 - DNA, 1287 bp, Artificial Sequence
  Description of Artificial Sequence: Synthetic coding sequence
atggctctcgccgtagctccctgggggagacaatgggaggaagccagggctctggggcgtgccgttcggatgttgcagcgcttggaagagcagtgcgtcgatcctagactgagcgtgtccccgccctctttacgcgatcttctccctaggaccgctcagctgctaagagaagtggctcactcaagacgggctgccggaggcggaggacccgggggaccgggcggctccggcgattttctgttgatatacctcgcgaatctggaagcgaagtcccgccaggtggctgcgcttttgcctcctcggggaaggaggtccgccaatgatgagctgtttagggccggctctaggctaagaagacaattggccaaactagcaataatcttttcccatatgcacgcagagctgcacgcattattccccggtgggaaatactgtgggcacatgtaccaactgaccaaggcacctgcacataccttctggagggaaagttgcggcgctcggtgcgtgctgccctgggcggaattcgaaagcctactgggaacttgccatccagtggaacctggttgcaccgctctggccctccggacaaccattgatctgacgtgctctggccatgtttcaatatttgagtttgacgtgtttaccagactctttcaaccatggcccaccttattgaagaactggcagctgctggctgttaatcatcctgggtacatggcttttcttacgtacgacgaggtccaggaacggctgcaagcttgtagagataagcctggaagctacctttatcctgatgggaagacacacaatccggacttaactgaacttggtcaggccgagccccagcaacggatccacgttagtgaggaacaactccagttgtactgggcgatggactctacatttgagttatgcaagatctgtgctgagtccaataaggacgtgaagatagagccttgtgggcatttgctgtgctcctgttgcctggccgcttggcagcacagcgacagtcaaacgtgtcctttttgtcgctgtgaaattaaagggtgggaagcagtttctatctaccagtttcacggccaggctacagccgaagatagtggcaatagttccgaccaggagggccgggaactggagctcggccaggtgcctttgagcgcaccacctctcccaccacgtccggatctgcccccacggaaaccccggaatgcccagcctaaggtgcggctgctgaaaggaaacagtccccctgcagctctgggccctcaggaccccgctcctgcatag

SEQ ID NO: 110941 - DNA, 2355 bp, Artificial Sequence
  Description of Artificial Sequence: Synthetic coding sequence
atgtcagatcaaaagaaagaggaagaggaggaagccgctgccgccgccgcgatggcgacggaggggggaaagacgtccgagcctgagaataataacaagaaacccaagacaagcggctctcaggattcacagccctcacccttagctcttctcgccgctacctgcagcaagattggtactcccggcgagaatcaggccaccgggcagcagcaaattatcatagaccctagccaggggcttgtgcagctgcaaaaccagccccagcagctggagttagttactactcagttggccggtaatgcctggcaactggtcgctagcacaccacctgccagtaaggagaataatgtgagccagcctgcaagttcttcctcttcatcgtcatctagcaataacgggagcgcctcacccaccaaaacaaaaagcggcaactcttcgaccccaggtcaattccaggttatccaggttcagaatcccagcggatccgtacagtatcaggttatccctcagctgcaaacagtggaaggacaacagatccaaattaaccccacaagctcatccagcttacaggacctacaaggccaaatccagctgatcagcgctggtaacaaccaagctatccttacagccgctaaccggacagctagcggaaacattttggcacagaacctggctaaccaaaccgtccccgtccagattaggcccggcgtgtcaattcccctccaattgcagactctccctggtactcaggcccaagttgtaacgactctccccattaatattgggggtgttaccctggcgctgccagtgattaacaacgtggccgctggtggcggaacaggtcaggtgggccagcccgcggccactgcggactcgggcacttccaacggtaatcaattagtctctacccctactaatactacaacatccgcttccaccatgcctgaatcccctagttcaagcaccacatgtacaacaacagcaagtaccagcttaaccagctcagacactttggtttcttccgccgacactggccagtacgcgtcaacatccgccagtagctcggagaggactatcgaggagtctcagacccctgctgcaacagaaagtgaagctcagtcctcctctcagttgcagcctaacggtatgcagaacgctcaggatcagtccaacagcctgcagcaggtgcagatagttggacagccaattctccaacagattcagattcagcagccccagcagcagataatccaagccatccctccccaaagctttcaattacagtcaggccagacaattcagaccattcagcagcagccgttgcaaaatgtgcagttgcaggctgtgaaccctacccaggtattaatacgcgcgcccactctgactccctcagggcagatttcatggcaaaccgtgcaagtgcagaacatacagtcgttgtccaatcttcaggtccagaatgccggtctgagtcagcaactgacaattacacccgtctccagtagtggcgggacgaccttagcccagatcgcacctgtagccgtggccggggcgccaattactctgaataccgcccaactggcctccgttccaaacctccaaacagtgagtgttgctaatctgggagcggcaggagtgcaggttcagggagttcccgtgactattacgtctgtggccgggcagcagcaagggcaggacggcgtgaaagtgcagcaggctacaattgcccccgtgacggtggctgttgggggaatcgccaacgctactatcggggcagtcagtccagaccagctgacacaggttcacttgcagcagggccagcaaacatcggaccaagaagttcagccaggtaaaagactgaggcgagtcgcctgctcttgccccaactgcagggagggcgaaggacgaggctccaatgagcccggcaaaaagaagcagcatatttgccacattgagggctgtggaaaggtgtatggcaaaaccagtcacttgagggcccatctgcgatggcatactggagagcgtcctttcatttgtaactggatgttctgcggcaaacggtttaccaggtctgatgagctgcagagacacagaaggacccataccggagagaaaaggtttgaatgtccagagtgctccaagcggttcatgcggtccgaccacctttctaagcatgttaaaactcatcagaacaagaagggtggaggtactgcactggctatcgtcaccagcggcgagctggactcctccgtgacagaggtgctgggcagtcccaggatcgtcactgtagccgctatcagccaagactccaacccagcgactccaaatgtgagcactaatatggaggaattctag

SEQ ID NO: 110942 - DNA, 1476 bp, Artificial Sequence
  Description of Artificial Sequence: Synthetic coding sequence
atggatcacactgacaacgagttacagggaacgaacagttccggaagcctgggcggactggacgtgcggaggcgcattccgatcaaacttatttccaagcaagccaataaggccaaacctgcgcccaggactcagagaacgattaacaggatgcccgcgaaggcgccgccaggcgacgaagagggattcgattacaatgaagaagaaaggtacgattgtaagggaggagagttgttcgccaatcagcgccggtttcccgggcatttgttttgggactttcaaatcaatatactgggcgaaaaagatgatactcccgttcacttctgtgacaaatgcgggcttcctattaaaatttacgggcgcatgatcccctgcaagcatgtattctgctacgactgcgcaatactgcacgagaagaaaggcgacaagatgtgcccagggtgctccgacccggtccagagaatcgagcagtgcacccgcggttctttatttatgtgcagtatcgttcagggttgcaagcgtacctatttgagtcagcgagacctgcaagcacacataaatcaccggcacatgcgcgctggcaaacccgtgacgcgtgccagtctggagaatgtgcatccccccatcgcgccaccacctactgagattcccgagcgatttatcatgcctccagataaacaccatatgtctcacatcccgccaaagcagcatatcatgatgccccccccccctcttcagcatgtgccccacgaacattacaatcagccccacgaggatatccgcgccccgcccgctgaactgagcatggcaccccctccacccagatctgtttctcaagagaccttcagaatctctacccgcaagcacagcaatcttatcacggtccccatccaggatgattcgaactctggcgctcgggaaccccctccgcccgcaccagctcccgctcaccatcacccagagtaccagggccaacctgtcgtgagccatcctcaccacatcatgccacctcagcaacactacgctcccccccctcctcctccacctcctatttctcatcccatgcctcaccccccacaggctgccggaacaccacaccttgtgtacagtcaggcaccaccgcctcccatgacctcggctccaccaccaattacaccccctcctggtcatattattgcacagatgcctccctatatgaatcacccaccccctggaccccccccacctcaacacggcggtccccccgtcacggccccgcctcctcaccactataatcccaatagcctgcctcagttcaccgaggatcagggtactctctcgccaccattcacccaacctggcggaatgtcccccgggatctggcccgccccccgaggcccaccacctccccccagactgcagggcccacctagccagacacccctgccggggccccaccacccagatcagacccggtacagaccctattatcagtag

SEQ ID NO: 110943 - DNA, 1113 bp, Artificial Sequence
  Description of Artificial Sequence: Synthetic coding sequence
atgatcccctgcaagcacgtgttttgctatgactgtgccatcctgcatgaaaagaaaggagataaaatgtgtccaggttgcagtgacccagtgcagaggatcgaacagtgcacgcgaggcagtttgtttatgtgttcaattgttcagggttgcaaaagaacttatctctcacaacgcgacctgcaggcgcacatcaatcacagacatatgcgcgctgggaagcccgtcacccgggcttctctagagaacgtacatcctcctattgcccctccacctaccgagatccctgagagatttatcatgccaccagacaaacaccatatgagccacatccccccgaagcagcacatcatgatgccaccgcctcctctgcaacatgtgccacacgagcactacaatcagccacacgaggacataagggccccccctgcagagctgagcatggcacccccgccaccaaggagtgtaagtcaagagacttttcgaatttcaactcgcaagcacagcaatctgatcacagtgccgattcaggacgattcaaattccggcgccagggagccacctcctccagcacctgctcctgcgcatcaccacccagagtatcagggtcagcccgtggtatctcatccccatcacattatgccgcctcagcagcactatgctccaccgccccctccacccccccccatctcacatccaatgccccatccaccacaggcagcgggaaccccacacttagtctattcacaggcacccccaccacccatgacatcagctccacctcccatcactcctcccccaggtcacatcatcgcccagatgcccccctatatgaaccatccgcctcccggccccccacctccacagcatgggggtccgcctgtgaccgccccccccccccaccattacaatcctaattcccttccacagtttactgaagatcagggaacgctctctcctccctttacgcaacctgggggtatgagccctggcatctggcctgcgccacgcggcccacctccgcctcctaggttgcaagggcctcctagtcagacacctctgcctggcccacaccatccagatcaaacacgctaccgcccctactatcagtag

SEQ ID NO: 110944 - DNA, 681 bp, Artificial Sequence
  Description of Artificial Sequence: Synthetic coding sequence
atgaaagttttaatcctggcgtgtctggtcgccctcgcacttgcacgcgaaactatcgaatctttgtccagcagcgaagaaagcatcacagagtacaagcagaaggtggaaaaagtcaagcacgaggaccagcaacagggtgaggacgaacatcaagataagatttatccttcatttcagccccagcctctcatttatccttttgtcgagccgattccttacggctttcttccacagaatattttgccgttggcccagcctgcggtagtcttgccagtccctcagccagaaattatggaagttcctaaggctaaggatacagtctacaccaagggcagggtcatgcctgtcctgaaatcccctaccatccctttctttgatccccagatacccaaactgaccgatttagaaaatctgcatctgcccctcccactcctgcagcccctgatgcagcaggtgccccagcctattccacagaccctagctctgcctcctcagccgctatggtcagtgccccaaccaaaagttttacctatacctcagcaggtcgttccatatccacagcgcgcggtacctgtccaggcattgttgctgaaccaggaactcctcctaaatccaactcatcagatttaccctgtgacccagcctcttgctccagtgcacaatcctatcagtgtgtag

SEQ ID NO: 110945 - DNA, 549 bp, Artificial Sequence
  Description of Artificial Sequence: Synthetic coding sequence
atgaagtccttccttttggtggtgaacgcactggcgcttaccctaccctttcttgctgtggaggttcagaatcagaagcaaccagcctgtcatgaaaacgacgagcggcctttttaccagaaaacagcgccctatgtcccaatgtactacgttccaaacagttatccatactatggcacaaacctgtatcagagaagacctgccatcgctatcaacaatccttatgttcctcggacttattatgctaacccagccgtggtccgccctcacgcacagatcccgcagcgccagtacctgccaaatagccatccgcctaccgtcgtgcgtagacctaacctgcatccatcgttcatcgcgatacctcccaaaaaaattcaagataaaattattattccaaccatcaacactattgccacagtcgagcctactcccgcccccgcgactgagcctactgtcgacagcgtggttacccccgaggcctttagcgagtctataatcacatcaactcccgaaactacgaccgtggctgtgacacctccaactgcatag

SEQ ID NO: 110946 - DNA, 978 bp, Artificial Sequence
  Description of Artificial Sequence: Synthetic coding sequence
atggcttcttcctcaggctccaaagctgagttcattgtgggcggcaagtataagttggtccggaaaattggctctggctcctttggagacatctatctggcaattaacatcaccaacggggaagaagtggccgtgaaactagaaagtcagaaggcgagacatcctcagcttctgtacgaatccaaactgtataagatcctccagggcggggtgggcattcctcatattagatggtacggccaggaaaaggactataatgtcctggtcatggacttgctggggccatcgctcgaggatttgttcaatttctgcagtcggcgatttacaatgaagacagtgctgatgctcgcagatcagatgatttcacgaatcgagtatgtgcatacaaagaattttatccacagagacattaagccagacaattttttaatgggcataggacgacattgcaacaaacttttcctaatcgattttggtctggccaaaaagtatagagacaacaggaccaggcagcacattccttacagagaggataaaaacctgaccggtactgctaggtatgccagcatcaacgcacatctgggcattgagcagagtagacgggatgacatggaatctctcggctacgtactgatgtactttaatcgcacatctctcccatggcaaggcctgaaagccgcgacaaaaaaacagaaatacgagaaaatttccgagaagaagatgtcaacccccgttgaggtactctgcaagggctttcctgccgagtttgctatgtatttgaactattgccgcgggctgaggtttgaggaggctccagactatatgtacttacgccagctgttcaggatcctttttcggaccctgaatcaccagtatgactatacatttgactggaccatgctgaagcaaaaggccgcccagcaggccgcgtcgtcttccggccagggccaacaggctcagaccccaactggtttctag

SEQ ID NO: 110947 - DNA, 978 bp, Artificial Sequence
  Description of Artificial Sequence: Synthetic coding sequence
atggcctcttcctccggtagcaaagccgaatttatagtaggcggcaagtataagctcgtccggaagattggatctggttcatttggggatatttatctcgccatcaacattacaaacggcgaggaggtggccgtcaaactcgagtcccagaaggctcgccatcctcagctgttatatgaatccaagttatacaaaattttgcagggcggcgtggggattcctcacataaggtggtacggtcaggagaaggattacaatgtgttggtaatggatctgctcggaccaagtttagaagatctattcaatttttgcagcaggagattcacaatgaagaccgtacttatgttggcagatcagatgatatcacggattgagtacgtgcacacaaagaacttcatacatagagacatcaagcctgacaattttctgatggggataggccgtcactgcaataagctcttcctaatcgatttcggcctcgctaaaaaataccgggataatcgaaccaggcagcacatcccctaccgggaagacaagaacttgacagggaccgcacgctacgccagtatcaacgcccatctgggcatcgaacagagtcgacgtgatgacatggagtctttgggctatgtcttgatgtacttcaatcgcacttccctgccatggcagggcctcaaggccgctacaaagaagcagaagtatgagaagatttcagaaaaaaagatgtctactccagttgaagtgctctgcaaaggcttccctgccgagttcgcgatgtacctgaactattgtcgggggctgcgattcgaggaggcccccgactacatgtatcttagacagctcttccgtattctttttcggactctcaatcaccagtacgactacacttttgactggactatgctcaaacagaaggccgctcagcaggcggcatcctcctctggacaaggtcagcaggcccaaaccccaactgggttttag

SEQ ID NO: 110948 - DNA, 1014 bp, Artificial Sequence
  Description of Artificial Sequence: Synthetic coding sequence
atggctagctcctccggctccaaagcagaatttatcgttggcggcaaatataagctggtccggaaaattggcagcggatcctttggcgatatatatctggccatcaacattacgaatggtgaggaggtcgcggtgaagcttgaatctcagaaggcgcgccaccctcagctgctgtatgagtcgaagctgtacaaaattttgcagggaggtgtggggattccccatattagatggtatggccaggagaaggattacaacgtgctggtcatggacctcttgggaccttctctggaggatctcttcaatttttgtagtagaagatttacgatgaagaccgtgttgatgctcgcagatcagatgatttcaaggatcgagtatgtgcataccaagaatttcatccaccgcgacattaagcccgataactttctcatgggcatcggcaggcattgtaataagctgtttcttatcgacttcggactcgcaaagaaatacagggataatagaactagacagcatatcccctatcgcgaagacaagaatttaacgggcaccgcgcgctacgctagtatcaacgcacaccttgggatagagcagtctcgccgagatgacatggaaagtcttggttacgtgctgatgtactttaacagaaccagtcttccatggcaaggcctgaaggcagcaaccaagaaacagaagtatgaaaagattagtgagaaaaagatgagtacccccgtcgaggttctgtgtaagggttttccggccgaattcgccatgtacttaaattactgcaggggcctgcgctttgaggaggccccggactatatgtatttacggcagttgtttcgaatccttttcaggacattgaatcaccagtatgactacaccttcgactggaccatgctcaagcaaaaagccgctcagcaggctgcctccagttcggggcaggggcagcaggctcagacaccaacaggaaagcagactgacaaaactaagagcaatatgaagggattctag

SEQ ID NO: 110949 - DNA, 1098 bp, Artificial Sequence
  Description of Artificial Sequence: Synthetic coding sequence
atggcaagtagcagtggttcaaaggcagagtttatagtcggtggcaaatataagctggtgagaaagatcggcagtggatcgttcggcgacatatatctggccatcaatatcactaatggggaggaagtcgcagttaagctggaatctcaaaaggcgcggcacccccaattgttgtatgaatccaagctgtataaaattctccagggcggcgtgggtatcccacacatccgctggtacggacaagaaaaagactataatgtactggttatggacctcttgggaccaagcctggaggacctgttcaatttctgttcccgccgcttcaccatgaagaccgttctcatgctggcagatcaaatgattagccgaattgagtatgtccacacgaaaaactttattcatagggatattaaacctgataacttcttgatgggaatcggccggcattgcaacaaatgtctggagtcacctgttggcaagcgaaagaggtcaatgacggtgagcacaagtcaggacccttcattcagtgggctcaaccagctcttcctaattgacttcggtcttgcaaaaaaatatcgggacaatagaacacgccaacacattccttaccgagaggacaaaaacttaacaggcaccgccagatacgcttccatcaacgcacacctgggcatcgaacagtcacggcgcgacgatatggaatctttaggctacgtgctcatgtactttaaccggacatcactgccctggcaaggactgaaggccgctactaagaagcagaagtacgagaagatctcagaaaaaaaaatgagtacgcctgtggaagtgttatgcaaaggatttccggcagagtttgctatgtatttaaactactgcagaggcctgaggtttgaggaagcccctgattatatgtatctgaggcaactttttcgtatcctgttcagaactttgaaccaccagtacgactataccttcgactggaccatgcttaagcagaaggcggctcagcaggcagcctcatcctcgggacaaggccaacaagctcagacacctaccggaaagcaaactgataagactaaatcgaatatgaagggattctag

SEQ ID NO: 110950 - DNA, 1029 bp, Artificial Sequence
  Description of Artificial Sequence: Synthetic coding sequence
tgtagagaggagatatctaggatcgagtacatacattccaagaattttatccatagggacgttaaacccgacaatttcctgatggggctaggcaaaaaggggaacctggtatatatcatagactttgggctcgccaaaaagtatagggacgctcggacccatcagcacatcccttacagagagaataagaatttgaccgggacagcacgctatgcatccatcaacacccatttaggtatagaacagagtaggcgtgatgacctggaatcattagggtacgttctgatgtacttcaacctgggatccttgccctggcaagggctcaaggctgccacaaagcgacaaaagtacgaacggattagcgaaaaaaaaatgtccactcctatagaggtcttatgtaaagggtatccatccgagtttgctacctacctgaacttctgccggtcattaaggttcgatgacaagcccgattactcctatctgagacagctgttcaggaacctgtttcaccgccaggggttcagttatgattatgttttcgactggaacatgctcaagttcggggcaagtagggcagccgatgacgctgagagggaaaggagggatcgcgaagagcgcctccggcactctcggaatccggccacacgtggcctcccctccacagccagcggccggctccggggcacccaagaggtcgctccgcccactccactcacgcccacatcgcatacggccaacacaagtcccagacccgtgagtgggatggagagagagaggaaagtgtccatgaggctacatcggggggctcccgtgaacattagctcatccgacctgaccgggcgacaggacacatcgagaatgagtacctcccaagtaggggctgagctgcctggcggtagatgggcctccggatatcccgttcgggtgaagtctgggctttggtttctgcagggatttttcttcccctttttcccgcctttcctgcgcgtgttcaacctggctagagtgtggcgccttggctgtaggtag

SEQ ID NO: 110951 - DNA, 1248 bp, Artificial Sequence
  Description of Artificial Sequence: Synthetic coding sequence
atggagttgcgagttgggaaccgatatagacttgggaggaagattgggtccggcagctttggagacatctatttaggtaccgacatcgcagccggcgaagaggttgcaataaaactggagtgcgttaaaacgaagcacccacagctgcatatcgagagcaaaatttacaaaatgatgcagggtggagtgggcattcctaccatcaggtggtgtggcgcggagggcgactacaatgtgatggtcatggaactcttggggccaagtctagaagacctatttaacttttgctcccgcaagttttcactcaagaccgttctgttgctggctgaccaaatgattagcaggatagagtatattcacagcaaaaattttattcaccgggatgtcaagcccgataatttccttatgggactggggaaaaagggtaacctagtatatatcattgatttcggacttgccaaaaaatatagggacgcccgcacccaccaacatattccataccgtgagaacaagaatctgacgggaactgcccggtacgcttccatcaatacccacctgggcattgagcagtcgcggagagacgacctggaaagtctgggctacgtcctgatgtatttcaacctgggcagcttaccatggcaaggccttaaggccgcgaccaaaaggcagaagtacgagagaatttccgagaagaaaatgtctacgcctattgaggtgctctgcaaaggctatccgtctgagttcgctacctacctgaacttctgcaggagcttgcgttttgatgataagccagattacagttatcttcgccagcttttccggaatctgtttcatagacagggtttctcttacgactatgtattcgactggaacatgctgaaatttggagcttcacgagctgccgacgacgccgagagagaacgcagagaccgtgaggaaagactgagacacagtcgcaatcctgccacgcgggggctgccatccacagcaagtggccgcctgcgcggtacccaggaagtggccccgcctactcctctgacgccaacatcccacactgccaacacgtcaccaagaccagtcagcggaatggagcgggagcgcaaggtctcaatgaggctgcaccggggagctcccgtaaacatctcctcgagtgacctcacaggccggcaggacacctcccgaatgtccacttctcagatacctgggcgtgtagccagtagcgggcttcaaagtgttgtgcaccggtag

SEQ ID NO: 110952 - DNA, 1230 bp, Artificial Sequence
  Description of Artificial Sequence: Synthetic coding sequence
atggaactgagggtgggcaaccggtatcgtcttggccggaaaatcgggagtggctcattcggtgatatttacttaggcaccgacatcgccgctggagaggaagttgctatcaagctcgagtgtgtaaaaactaagcacccacaactgcacattgagtctaaaatatacaagatgatgcaagggggcgtgggcatccctacaataaggtggtgcggggcagagggggattacaacgtgatggtgatggagttgctgggaccaagcttggaagatctgttcaatttctgttctaggaagttctctctgaagacagttctgctgctggcagaccagatgatcagtagaattgaatatatccattctaagaactttattcaccgcgacgtgaagcccgacaactttttgatgggcctggggaaaaaagggaatttagtgtatatcattgactttggcctcgctaaaaagtatagggacgcgcgcacacaccaacacattccctatagagaaaacaaaaacctgacagggacggcccggtatgcttccattaacactcacctcggcatcgagcagtctagacgtgacgacttggaatccctaggttatgtgctaatgtacttcaacttgggcagtctgccttggcaaggtctgaaggctgccaccaaacggcagaagtatgagcggatctctgaaaaaaagatgtcaacccctatcgaagtgctttgcaagggataccccagtgaatttgcaacgtatctgaacttctgccgcagtctccgcttcgacgacaaacccgactatagttacctccggcagcttttccggaatctgttccatcggcaggggttctcctacgattatgtgttcgactggaacatgttgaaatttggggccagtagagcagcagatgacgccgagcgcgagagacgtgaccgggaagagcgccttagacactcacgcaacccggccacccgggggttgcctagcacagctagtggacgcctgcgaggaactcaagaagttgcaccccctactcctctgacgcctacgtcccacacagctaatacatccccaaggcccgtgtccgggatggaaagagagagaaaagtgtccatgagattgcaccggggggccccagttaatatctcatcgtcggatttgactggtcgtcaggataccagtcgaatgagcacttctcagaactctatccccttcgagcaccatggtaaatag

SEQ ID NO: 110953 - DNA, 1077 bp, Artificial Sequence
  Description of Artificial Sequence: Synthetic coding sequence
atgatgcagggcggcgtgggcatccctaccatcaggtggtgtggggccgagggcgattacaacgtgatggtgatggagctgctcggcccttctttggaagacctgttcaatttttgctctagaaagttctcactcaaaactgtactgttgctggccgatcaaatgataagtagaattgagtacatccacagcaagaacttcatccaccgcgatgttaagcccgacaactttctcatggggctcggcaagaagggaaaccttgtctatatcattgatttcggcctcgcaaagaagtatcgtgacgccagaacacatcaacacatcccctatagggagaataagaatttgactggcacagctagatatgccagtatcaatacacacctgggtatcgagcagtcccggcgggacgatctggaatcccttggctatgttttaatgtattttaacctaggttctctgccatggcagggactaaaagctgctaccaagaggcagaagtacgagagaatcagcgagaaaaagatgtctaccccaattgaggtactctgcaagggctaccctagtgagtttgcgacctatttaaacttctgccgctcattgaggttcgacgataagccagactatagctacctgaggcagttatttcgtaatctctttcacaggcaggggttttcctatgactatgtgttcgattggaatatgctgaagttcggcgcgtcccgtgcggcggatgacgctgaacgggaaaggcgggacagggaggaacggcttcgccattcccgcaatcctgctacaagagggctcccgtcaaccgcttctggtcgattgcgggggacacaggaggtggcgcccccaacgccactcacccctaccagtcacacagccaacaccagccctcgccccgtttcggggatggagcgagagcgcaaggtctctatgcgactgcaccggggcgcccccgtcaatatcagctcttccgacttgactggacgacaagatacctcccggatgtccacatctcagatcccgggcagggtcgcaagctccgggctacagtccgtcgtccaccgatag

SEQ ID NO: 110954 - DNA, 381 bp, Artificial Sequence
  Description of Artificial Sequence: Synthetic coding sequence
atggagctacgcgtaggaaatcgctatcgactgggcaggaagattgggagcggcagttttggtgacatctatttaggaaccgacatcgctgccggcgaagaagtcgccattaagctcgagtgcgtgaaaacaaaacacccccaactgcacatagagtcgaaaatttataagatgatgcagggtggggtcggtattcccacaataaggtggtgtggggccgagggggattacaatgtcatggttatggagctcttaggaccttcacttgaggacctctttaacttctgttcacgcaagttctctctgaaaaccgtgctgctgttagcagatcaaatgaacaacccggaggaaatgacatggtcattgtgggcaacgtgttag

SEQ ID NO: 110955 - DNA, 1251 bp, Artificial Sequence
  Description of Artificial Sequence: Synthetic coding sequence
atggaactacgggtagggaacaagtatagactgggtagaaagattggttctggctccttcggcgatatatatctgggcgctaacatcgccagcggcgaggaggtggccattaaactggagtgcgtgaagacgaaacacccgcagctccatatcgagagtaaattttacaaaatgatgcaaggcggggtgggaatccctagcatcaagtggtgtggggccgaaggtgattataacgtcatggttatggagctgttgggcccctctctagaggatctgttcaatttctgctctcggaagttctctctgaagaccgttctgctgctagctgatcagatgatttctagaatcgagtacatacacagcaaaaacttcatccacagagacgtgaagcccgataacttcttgatggggctcgggaaaaagggcaacctcgtctacattattgatttcggcttagcgaaaaaataccgcgacgccaggactcatcaacacattccatatcgcgaaaataaaaaccttacaggaactgccaggtatgcctcaataaacactcaccttggcatagaacaaagtaggagggacgatttggagtccctgggctatgttctgatgtacttcaatcttggctcactgccctggcaaggcctcaaagcagccaccaagagacagaaatacgagaggatttccgaaaaaaagatgtcaactcccatcgaagtgctgtgcaagggttacccctccgagttttccacctacctgaatttctgcagatccctgcgtttcgatgacaagcccgactactcatacctccggcagttattccgaaacctgttccaccgtcagggatttagttacgattacgtgttcgactggaacatgctaaagttcggtgctgcgagaaatcctgaggacgtggaccgggagagacgcgaacatgagagagaggagagaatggggcaactcagaggcagcgctactcgtgcgttacccccaggccctcctactggcgccaccgcaaatcgccttaggtctgcagctgagccggttgcatccacccctgctagtcggatccagcctgctgggaacacatccccacgagcaattagccgggttgaccgcgagcgaaaggtgtcgatgcgattacataggggtgcccccgctaacgtgtcatccagcgatttaacaggccggcaagaggtgagcaggataccggctagccagaccagcgtcccctttgaccacctaggtaagtag

SEQ ID NO: 110956 - DNA, 360 bp, Artificial Sequence
  Description of Artificial Sequence: Synthetic coding sequence
taacgcaatcccgaggatgtagatcgcgaaaggcgggagcacgagagggaggaacgcatgggccagctgcgaggatccgcaactagggctctcccaccagggccaccgaccggggctaccgcaaatcgactgcgttctgcggcggaaccagtcgcatcaactcctgccagccggatccagcccgccggcaatacttctccccgggctatttcacgagtagatagggaaaggaaggtgagcatgaggctccacagaggtgccccagcaaatgtatcgtccagtgacctgacaggccgtcaggaagtgtcgcgaattccagctagccaaaccagtgtccccttcgaccacctaggcaagtag

SEQ ID NO: 110957 - DNA, 1251 bp, Artificial Sequence
  Description of Artificial Sequence: Synthetic coding sequence
atggagttgagagtggggaacaagtatcgactagggcggaagattggtagcggttctttcggcgatatatacctcggtgctaatatcgcatctggcgaggaagtggcaattaaactagagtgtgttaaaacaaagcacccccagcttcacatcgagagtaagttttataagatgatgcagggtggggtgggcataccttccattaagtggtgcggggctgaaggcgactataatgtgatggtgatggagctgctaggacccagcttggaggatttgttcaatttttgttctaggaagttctccctcaagaccgttttattattggcagaccagatgatttcaaggatcgagtatatccacagcaaaaacttcatacacagagacgtgaaacctgacaacttcctaatggggctcggcaaaaagggcaatcttgtgtacattatcgatttcggcctcgcgaagaagtaccgggacgcacggacacaccagcatatcccctatcgcgagaacaagaatcttacaggcaccgccagatacgcgagtattaacacacacctggggatcgaacagtcccgaagagacgacttggagagcctgggatatgtcctaatgtattttaatcttggatcattgccttggcaggggctgaaggctgctaccaagaggcagaagtacgagcggattagtgagaagaagatgagcacacctatcgaggtcttatgtaaggggtacccgtccgagttctcaacctatctcaacttctgcagaagtcttcgtttcgatgataaacccgattatagctacttacgccaactgttccggaatctcttccaccggcagggattcagctacgattacgtgttcgattggaacatgctgaaattcggtgccgcaaggaatcccgaggatgtagatcgtgagcgtcgcgagcatgaacgcgaggaaaggatgggacagctgagaggctcagcaacccgtgccctacctcctggtcctcctaccggggctactgcaaacaggttgaggtctgcagccgagccggtcgcttccacccctgcctccaggatacagccagccggcaacacttcacccagagcaatctcccgagtggatagggaacgtaaggtttctatgaggctgcaccggggggcaccagccaacgtttccagcagcgacctgaccggtaggcaggaagtgtcccgtatccctgctagccagacaagtgtgccttttgaccacctaggtaagtag

SEQ ID NO: 110958 - DNA, 1251 bp, Artificial Sequence
  Description of Artificial Sequence: Synthetic coding sequence
atggagctgagggttgggaacaaataccgcttagggcggaaaattggatcgggaagctttggggacatatatctaggagccaacattgcttcaggtgaagaggttgccatcaaactggagtgtgttaagactaagcatccccagctacatattgagtcaaagttttataaaatgatgcagggcggcgtgggtatcccttctatcaaatggtgcggcgctgagggggattacaatgttatggtcatggagcttttgggtccttctctggaagatctattcaatttttgttctagaaagtttagtctgaagaccgtcctgttgctggccgaccagatgattagtcggattgagtatattcatagcaagaactttattcatcgggacgtgaaaccagataactttttgatgggactgggaaagaagggtaacttagtttatattatcgatttcggcttagcgaagaagtatcgggacgctcgaacccaccaacacattccttatcgggagaacaagaatttgacgggcacagctaggtacgcttcaattaacacccacctcggcatagagcagagccggagagatgatctggagtccctaggttacgtactcatgtacttcaatttgggctccctaccttggcagggcctaaaggctgccaccaaaagacagaagtacgaaagaatcagcgaaaaaaagatgagtacccctattgaggttttgtgcaaaggatacccctcggagttctctacgtacctcaatttttgtcgttccctcaggtttgatgacaaacccgactactcataccttcgccagctgttcaggaatctgtttcaccgccagggattttcatacgattatgtgttcgactggaatatgctgaaatttggggctgcacggaacccggaagacgtagaccgagaaaggcgcgaacacgagcgagaggagagaatgggtcagctccgcggaagcgccacaagagcactgcccccaggccctcccacgggagcgacggcaaaccggctgcgcagtgctgctgagcccgtggcctcaaccccagccagcaggatacagccagctggaaacacaagtccacgcgctattagtagagtggatagagagcggaaggtgtccatgagacttcatcgcggcgcaccagcaaacgtgagcagcagcgatctgactggccgccaggaggtatctcgaatcccggcatcccagacctcggtaccttttgatcatctgggcaagtag

SEQ ID NO: 110959 - DNA, 1251 bp, Artificial Sequence
  Description of Artificial Sequence: Synthetic coding sequence
atggaactcagggtcggaaataagtatagattgggacggaagatcgggagcgggtcattcggcgatatctatctgggtgctaatatagcatctggcgaagaggtcgcaattaagctggagtgcgtgaagaccaagcatccgcaactacatattgagtcaaagttttataagatgatgcagggtggggtcggcataccttcaattaagtggtgcggcgccgagggcgattacaacgtgatggtgatggagctgttaggacccagtctcgaagatctcttcaatttttgcagcagaaagttctcactcaagaccgtcctgctcttggccgaccaaatgatttctagaatcgagtacattcattcaaagaactttatccaccgggatgtaaagcctgataatttcctgatgggtctcggcaaaaaagggaacttggtatacatcatcgattttggcctggccaagaaatatcgcgacgctagaacccaccagcacataccatacagggagaacaagaatctcaccggcaccgccagatacgcatccattaacacgcaccttggtatagagcagtcccgacgcgatgatctggagtcactcggctacgtactgatgtattttaacctcgggagcctgccatggcagggactgaaggccgctacgaaacgccagaaatatgagcgtatttctgagaagaagatgtccaccccaattgaggtgttgtgcaaaggatacccttctgagttcagcacttaccttaacttctgccggagcctgcggttcgatgataaacccgactacagctatctgcgccaactattccggaatctttttcatcgtcagggcttctcatacgattatgtctttgactggaatatgctcaagttcggcgccgccagaaatcctgaagatgttgaccgagagagacgggagcatgagagggaggaacggatgggtcaattgaggggttctgccacgcgggcacttcctcctggtcctccaactggggcgactgccaatcggctgagaagcgcagctgaacctgttgcctcaactccagcctctcgtattcaaccggcgggcaatacctccccccgcgctatctctcgtgtggaccgcgaaagaaaagtatctatgaggctgcatcgaggggccccagccaacgtgtcttcttctgaccttacaggcagacaggaagtttcaaggatccctgcttcacagacttcagtgccttttgaccatcttggaaaatag

SEQ ID NO: 110960 - DNA, 1251 bp, Artificial Sequence
  Description of Artificial Sequence: Synthetic coding sequence
atggagttgcgggtgggtaataaataccgtctcgggcgcaagataggtagtgggtcgtttggggatatttatctgggagcaaatatagctagtggcgaagaagttgctattaagctggagtgtgtgaaaaccaagcacccgcaactgcacattgagagtaaattctacaaaatgatgcaaggaggagtcgggattcctagcattaagtggtgtggcgccgaaggagactataatgtgatggttatggagctgctcggtcctagcctagaagacctctttaacttttgtagccgtaagttttctttaaaaaccgtcctcctgctcgccgatcaaatgatttcccggattgaatatattcatagtaaaaactttatccatcgtgacgtcaagccagataattttcttatgggactgggtaagaagggaaacctggtgtatattatcgatttcggccttgctaagaagtatagagacgccaggacacaccagcacatcccctatcgggaaaacaaaaatctgaccggtacagcgcggtacgcttcaatcaatacacacttggggatcgagcagtcgcgaagggatgatttggaaagcctcggatacgtgctgatgtattttaatttggggagtttaccctggcaggggcttaaggctgctaccaagaggcagaagtacgagcgaataagtgagaaaaagatgtctacacccatagaggtgctttgcaaggggtatcccagcgagttcagcacttatctcaatttctgtagaagtctgcggttcgacgacaaacccgattattcatacctacggcagctgttccggaatctgttccaccgtcaggggttctcgtacgattacgtgtttgactggaatatgctaaaatttggagccgcaagaaacccggaagatgttgacagagagaggagggagcatgaacgcgaagaaagaatgggccaattgcggggaagtgctactcgggccctcccgcctggaccgcctactggtgccaccgctaatcgcttgaggagcgcagcagaaccagtcgcttctacccctgcctcacggatacagccagctggcaacacgtctcctcgcgcaatatctcgcgtggatcgggagcgaaaagtatccatgcggctacacaggggtgcacccgccaatgttagcagcagcgatctaaccggacggcaggaggtttcacgtatccccgccagccagaccagcgtgccgtttgaccaccttggaaaatag

SEQ ID NO: 110961 - DNA, 678 bp, Artificial Sequence
  Description of Artificial Sequence: Synthetic coding sequence
atggagctgcgtgtgggcaataaatatcgactaggcagaaagattggaagcggctcctttggtgacatataccttggcgcaaatattgcgtccggtgaagaggtcgccataaagttggaatgcgtgaaaacaaaacatcctcagctccatattgagtctaaattctacaagatgatgcaggggggcgtggggattcctagtataaagtggtgtggggccgagggcgactacaacgtgatggtgatggagctgctaggccccagtttagaggacctgttcaacttttgttctcgcaagttttccctcaagaccgttttgctgctcgccgaccagatgattagccgaatcgagtacatacacagtaaaaactttatccacagagacgttaagcctgacaatttcctgatgggccttgggaaaaaagggaatctggtctatatcatcgatttcggactggcgaagaagtacagagacgccagaacacatcagcacataccatacagggagaacaaaaacctgactggaacagcacgttacgccagcatcaacacccatctaggcatcgagcaatccagaagagacgatttggagagcttaggctacgtccttatgtacttcaacttggggtccctaccttggcaaggactaaaagccgccaccaagcgacagaaatattag

SEQ ID NO: 110962 - DNA, 435 bp, Artificial Sequence
  Description of Artificial Sequence: Synthetic coding sequence
tgaagaaatctcttccacaggcaggggttcagctatgactacgtgttcgattggaatatgctcaagttcggagccgccaggaacccagaagatgtggatcgagagcgacgagagcatgagcgagaggagagaatgggtcaacttcgcggcagtgccacccgggccctaccacccggcccccctacaggggctaccgcgaatcggctgcgtagcgccgccgagcctgttgcgtccacacctgcatcacgcatccaacctgccggaaacactagtccaagggctattagtcgcgtggacagggaaagaaaagttagtatgcggcttcaccgcggcgctcctgctaacgtaagctcctccgacctgactggccgccaggaagtgtcccgcatccccgctagtcagacaagcgtgccttttgatcacctcggcaagtag

SEQ ID NO: 110963 - DNA, 1182 bp, Artificial Sequence
  Description of Artificial Sequence: Synthetic coding sequence
atggatcatcctagtcgcgaaaaggacgagaggcagcgtacaactaaacctatggcacagcgaagcgcccattgctcacggccgagcggatcctcctcttccagtggggtgctgatggttggtccaaattttcgcgtgggaaagaaaattgggtgcgggaactttggggagctccgcttgggtaaaaacctgtatacaaacgagtatgttgcgatcaagctggaaccaattaagtccagggccccgcagctacatctggagtatcgcttctataaacagctgggctccgcgggggagggcctgccccaagtttactatttcggaccttgtgggaagtataacgccatggtcctggaactcctcggtcccagcctggaagaccttttcgacctgtgcgaccggacattcacgctgaagaccgtcctgatgatagcaatccagcttctgtctcgcatggagtatgtccactccaagaatcttatatacagggacgttaaacccgagaatttcctgattgggcgccagggtaataagaaggagcacgtaattcatatcattgacttcggactcgcgaaagagtatatcgaccctgagacgaagaaacatatcccgtacagagagcacaagtcgctcacagggacagcacgctacatgtccattaatacgcatctggggaaggagcagtcccgaagggatgacctggaagctctcggacacatgtttatgtactttcttagaggctcgctgccttggcagggcctgaaggcggatacacttaaggagcgatatcaaaagataggcgacaccaagcgcaatactcccattgaagccctgtgcgagaacttccctgaggagatggctacataccttcgatatgtgcgccggctcgatttctttgagaagccagactacgagtacctacgtacactgtttaccgatttattcgagaagaaagggtacaccttcgattacgcatacgactgggttggtaggcccataccgaccccagtgggcagcgtccatgtggacagcggggcctccgccataacaagagagtctcatacccaccgggatcggcccagtcagcagcagcctttgagaaatcagtccctcagaactgtcactgctgagcactacgatgtcaacaacagcgccatctggcacagaggacgaggaacctag

SEQ ID NO: 110964 - DNA, 1269 bp, Artificial Sequence
  Description of Artificial Sequence: Synthetic coding sequence
atggatcatcccagtagggagaaggacgaaaggcaaagaaccacgaagccaatggctcagcggtctgctcactgctctcgccccagcgggtcatccagctccagtggtgtgctgatggtgggtcctaactttcgcgtgggcaaaaaaattggatgcggcaatttcggagaactgcgtcttggtaagaatttgtacacaaatgaatacgtggctattaagcttgaacccataaagtcaagagctccacagctgcatttggaatataggttttataaacagcttgggtccgccggtgagggtctgccacaagtctactatttcgggccctgcggaaaatataacgctatggtccttgagctcctggggccctcacttgaagacttgttcgatctctgcgacaggaccttcaccctgaagactgttctaatgatagccattcagctgctttcgaggatggaatatgtgcacagtaaaaacttgatctatagggacgtgaagccagagaatttcctgatcggccgccagggaaacaagaaggaacatgtcatccatatcatagatttcggcctcgccaaagagtatattgatcccgagacaaaaaaacatatcccgtaccgcgaacacaaatccctcactggcaccgctcgctacatgtccatcaacacacacctgggaaaagaacagagcaggagggacgatctcgaggcgctaggacacatgttcatgtatttcctgaggggtagtctcccttggcaaggcttgaaggcagacacactgaaggaaagatatcaaaaaattggcgacaccaagcggaacacaccaatagaagccttgtgcgaaaactttcccgaggagatggctacatatttgcgatatgttcggagactggattttttcgagaaacctgattatgaatatctgagaaccttgtttaccgacctgttcgaaaagaaagggtatacctttgactacgcctacgattgggtgggcaggccaataccaacgcccgtaggttcagtccacgtcgactccggcgccagcgctatcactcgcgagagccacacgcaccgcgacagaccatcgcagcagcagccgttaagaaatcaggtggtctccagcaccaacggggaacttaacgttgacgatcccacaggcgcacattcaaatgcccccataacagctcacgccgaagtggaagtagtcgaggaggcaaagtgctgttgtttctttaaacgcaagcgcaagaaaaccgcccaaaggcataagtag

SEQ ID NO: 110965 - DNA, 1137 bp, Artificial Sequence
  Description of Artificial Sequence: Synthetic coding sequence
atggatcatccatctcgcgaaaaagacgagagacagaggacaaccaagcctatggcccagaggtccgcgcattgctctagaccttcgggttccagtagcagcagcggggtacttatggttggcccaaactttcgagtaggaaaaaaaatcggatgtggtaattttggggagctgcgcttagggaagaatttatacaccaacgagtatgtggccatcaagctggagctgcttggaccgagtctcgaggacctattcgatctgtgcgatcggacatttactctcaaaactgtcctgatgattgctatccagcttctttctaggatggagtacgtacactccaagaacctgatatatagagacgtcaaacctgaaaactttttgatcggtcgtcagggtaacaaaaaggagcacgttattcacatcatcgattttgggctggccaaggaatatattgaccccgagaccaagaagcatataccataccgcgaacacaagtcacttaccgggacagctcggtacatgtcaatcaacacccatcttggcaaggaacaaagtcgtcgtgacgacttggaagccctgggccacatgtttatgtactttctccgcgggtccctgccttggcagggactgaaagctgataccctcaaggagagataccagaagatcggcgacaccaagcgcaacacgcctatcgaggcactctgtgaaaattttccagaggagatggcaacatacctcaggtacgttaggaggctcgacttctttgaaaaaccagattacgagtatttacgcacattatttacggacctcttcgaaaaaaaaggatacacgtttgactatgcctacgactgggtggggcgcccgatccctaccccagtcggatctgttcacgtggatagcggcgcttcagcaatcactagagagtcccacacgcacagagaccggccctcccagcagcagccactgcgcaaccaggtggtaagcagtactaatggagagctgaacgttgacgaccctacaggggcgcactccaatgcccctatcactgcccacgccgaagttgaggtcgttgaagaggccaaatgttgctgtttctttaagagaaagcgtaaaaagacagcacagcggcacaagtag

SEQ ID NO: 110966 - DNA, 1248 bp, Artificial Sequence
  Description of Artificial Sequence: Synthetic coding sequence
atggatttcgataagaaaggcggaaagggggagaccgaagagggaaggcgtatgtctaaggctggcggcgggaggtcttctcacggaatcaggtctagcgggaccagttcaggggtcctgatggtaggtcctaatttccgggtcggaaaaaagatcggctgcggcaacttcggagagctgcgattaggcaaaaacctgtacacaaacgaatatgtggccattaagctggagcctattaaatccagagctccccaactgcacctggagtatcggttctataagcagctgtcggctactgaaggagttcctcaagtgtattactttggaccttgtgggaagtacaatgctatggttttggagttgctcggccctagcctcgaagatctgtttgatctttgtgataggacattcactctgaaaaccgtcctcatgattgcaattcaactgataacacggatggagtacgtacatactaaaagtctcatttaccgagacgtcaaacccgagaatttcttagtgggccgaccgggtacaaaacggcagcatgcaatccatattattgattttggcctggccaaggaatatatcgaccccgaaaccaagaaacacattccataccgcgaacataagtctctcacgggtactgcccgatacatgtccattaatacacacttggggaaggaacagagtcgacgagatgatctggaagctctgggccacatgtttatgtacttcctgcggggatccctgccctggcaggggttaaaagcggacacactcaaagaacgctatcagaaaatcggcgatactaagcgggctactcctatcgaggtactctgcgagaatttccctgaggaaatggcaacttaccttcggtacgtgagacgtctggatttcttcgaaaagcccgattatgactacctgcggaagctcttcaccgatctgttcgataggtctggctttgtatttgattacgaatacgactgggccggtaaacccctgccaacaccaatcggaacggtgcacaccgatttgccctctcaacctcaactcagagataagactcagccgcattctaaaaaccaggccctgaacagcaccaatggggaactaaatgcggacgatcctactgcgggccactccaacgctcccattactgcccccgccgaagtggaggttgccgacgaaaccaagtgctgttgctttttcaagagacgcaagaggaaaagtctccagcgtcacaaatag

SEQ ID NO: 110967 - DNA, 645 bp, Artificial Sequence
  Description of Artificial Sequence: Synthetic coding sequence
atgtctatcaacacccatcttggcaaagagcaaagccgccgagacgatctcgaggcactcggccacatgtttatgtattttctacggggatcacttccctggcagggactgaaggctgatactctgaaggagaggtatcagaaaattggcgatacgaagagggccaccccgattgaggtcctgtgcgaaaacttccccgaagagatggcaacctacctcaggtacgtgaggcggttagatttttttgaaaagcccgactacgactacttgcgaaaactctttactgacttgttcgatcggtcgggtttcgtctttgattacgaatatgattgggccggcaagccgctgcccactcctatcggaaccgtgcacaccgacttaccaagtcagccgcagctaagggacaagactcaaccacccgagtcaagtccttgttctcccctgggccgggacttagtgcggggtccccgtggcccccctacagctgcacaaggccagacactggccgggtctcagaatgccgactgcaggggacgagcttggctgcggagaccgcaccctcgggatgtgggaagtctgccaagctgcaaaacactcgctgagatttccaccccggtgtcatcgccacccctgcaggagcattag

SEQ ID NO: 110968 - DNA, 1272 bp, Artificial Sequence
  Description of Artificial Sequence: Synthetic coding sequence
atggaaaataagaagaaagacaaggataagtcagatgataggatggcacgcccaagcggccgaagcgggcacaatacccgcgggactggatctagctcctcaggcgtgctaatggtcgggccgaactttagggtcggaaaaaagataggttgcggcaatttcggggaactccggctgggcaaaaatctgtatacaaatgagtatgtggctatcaaactcgaacccatgaagtcacgcgcgccacagctgcacctggaatacaggttctataagcagctgggcagtggagatggaattcctcaggtctactacttcgggccctgtgggaaatacaacgcaatggtcttagaattactcggtccctctctggaggatctgttcgatctttgcgaccgaaccttttctctgaagacagtcctgatgatagcaatacagctgatatcaagaatggagtacgtccatagcaaaaacctgatttatagggacgtcaaaccagagaactttctaattggccgccccggcaataaaacccagcaggtcatccacatcatagactttggactggcaaaggagtatatcgaccctgaaacaaaaaaacacatcccatacagggaacacaagtcactcactggaaccgcccgctatatgagtattaatacccacctaggcaaagaacagtccagaagagatgatctggaggccttaggacacatgttcatgtatttcttaagaggctccttgccatggcaaggcctgaaagcagatacactgaaggagagataccagaagatcggtgataccaagcgcgccacaccaatagaggtactgtgcgagaatttcccagaaatggccacctacctccggtacgtcaggcggcttgatttctttgagaaacccgattatgattatctgagaaaactgttcactgacttgtttgacaggaagggatacatgttcgactatgaatacgactggattggaaagcagcttcctacccctgttggggccgtgcagcaagatcctgccctgtcctcgaatagggaagcccaccagcatagagacaaaatgcagcagagcaaaaaccaagtcgtcagttccactaatggcgaactgaataccgacgaccctaccgccggccggagcaacgctccaataacagcaccgactgaagtggaggtgatggacgaaacaaattgccagaaagtgctcaacatgtggtgttgttgtttcttcaagagacgcaaaagaaaaactatacaacgacataaatag

SEQ ID NO: 110969 - DNA, 1368 bp, Artificial Sequence
  Description of Artificial Sequence: Synthetic coding sequence
atggaaaacaagaagaaggacaaagataaaagtgatgacagaatggcaagaccatccggacggtccggtcacaatacacgtgggaccggatccagcagctcaggtgttctgatggtggggcccaatttcagggttgggaagaaaattggttgtggtaacttcggggaactaagactcggcaaaaatctttacaccaacgagtatgtcgccattaaactcgagccaatgaaaagcagggcccctcagcttcacttggaatacaggttctacaaacagctcggcagcggggatggcatcccgcaggtgtactattttggcccctgcggtaagtacaatgccatggtgttggagcttcttggcccgtccttggaagatctgtttgacctttgtgatcgaaccttctctctgaagactgtgcttatgatcgctatacagctgattagcaggatggaatacgtgcattccaaaaacctaatttatagggacgtcaaacccgagaacttcttgatcgggagacctggcaacaagacacagcaggttatccatattatagattttggccttgccaaggagtatattgatcctgagaccaagaagcatatcccataccgggagcataagtccctcacagggacagctcggtatatgtctataaacacacatttgggcaaagagcaatcaagaagggatgacctggaggctctgggacatatgttcatgtacttcttgagaggctcactgccttggcagggactcaaagccgatactctgaaagagaggtatcagaagataggagatactaagcgtgctactcctatcgaggtcctctgcgaaaacttccccgagatggcaacctatttacggtacgttagacgcttggatttttttgagaagcctgactatgactacctgagaaagttgttcaccgatctgtttgataggaaaggttacatgttcgactacgagtacgactggatcggtaaacagctgccaacgcccgttggtgctgtgcagcaggatccagcgttgagctcaaaccgggaggctcatcagcaccgggataaaatgcagcagtctaagaaccagtctgcagaccaccgtgccgcatgggattcccaacaggctaatcctcaccacttgcgggcacatctggccgctgatcgccacggaggttcagtgcaggtggtcagctccactaacggtgaactcaataccgatgatcccaccgccggacggagcaacgctcccatcacggcacccactgaagtggaggttatggacgaaaccaactgtcagaaagtgctgaacatgtggtgttgctgtttctttaagagacgtaaacggaagactattcagcgccataagtag

SEQ ID NO: 110970 - DNA, 1344 bp, Artificial Sequence
  Description of Artificial Sequence: Synthetic coding sequence
atggagaataagaaaaaggataaagataaaagcgacgatcggatggctagacctagtggtcggtcgggccacaacacacgcggcaccgggtcctcatcaagcggcgtgctgatggtcggccccaactttcgagtgggaaagaagatcggctgtggcaatttcggggagctgcgattgggaaagaacctctatacaaacgagtacgtagccatcaagctggagcctatgaagagccgcgcgccacagctccatttggaataccgtttttataaacagctggggtcaggtgacggaattccgcaggtttattattttggcccatgtggtaaatacaacgctatggtattggaactcctgggcccgtccctagaggacctttttgatttgtgtgaccggaccttctcactgaagaccgtgttaatgatagctattcagttgattagcagaatggagtatgtgcattccaagaacctgatctatcgagacgtcaagcccgaaaactttctgatcggacgacccgggaacaagactcagcaggttatccacattatcgacttcggcctcgctaaggaatacatcgatcctgagactaagaagcatattccttacagggaacataagtcactgaccgggactgctcgctacatgtctatcaacacccatcttgggaaagagcaatcccgccgtgacgacctcgaagctctcggtcacatgttcatgtatttccttcgcgggtcacttccctggcaaggcttaaaagctgacaccctcaaagagcgataccagaagattggtgatacaaaacgcgcaactccaatcgaagtgctctgtgagaacttcccggaaatggctacatatttaaggtacgtgcgaagacttgacttctttgaaaagcccgattatgactatctccgaaaactgtttacagatcttttcgaccggaagggttacatgttcgactatgaatacgactggatcgggaaacagctgccaactccggtcggcgccgttcaacaggaccctgcccttagttctaaccgtgaagcgcaccagcacagggacaaaatgcaacagtccaagaatcagagcgctgatcatcgggccgcatgggactctcagcaagccaatcctcaccatttacgagcacatctagcggcggaccggcatggggggtcagtccaggttgtgagttctaccaacggagaactgaatacagatgacccaaccgccggcaggagcaatgcccccatcactgcgcctactgaggtagaggtaatggacgaaaccaagtgctgctgtttcttcaaaagaagaaaaaggaagaccattcagaggcataaatag

SEQ ID NO: 110971 - DNA, 1344 bp, Artificial Sequence
  Description of Artificial Sequence: Synthetic coding sequence
atggagaataaaaaaaaggacaaagacaagtccgatgatcgaatggcaagaccttctggccgctctggtcataatactaggggcaccgggagcagctcctctggcgttcttatggttggccccaattttagagttgggaagaagatcggctgtggtaacttcggcgagctaaggttgggaaagaacttgtacaccaacgagtacgtggctatcaagctcgagccaatgaagagccgggctccccaactgcatttagagtatcggttttacaagcagctcggctccggtgacgggattccccaggtctactattttggcccttgcggtaagtacaacgctatggtcttggagttacttggcccatctcttgaagacttgttcgatctctgcgatcgcacattttcactgaaaacagtcctgatgattgcgatccagcttattagcagaatggaatatgtgcatagtaaaaacctcatttatcgggacgtgaaacctgagaatttcctcattgggcggcccgggaacaaaacccaacaggtgattcatatcatcgactttgggctggctaaggaatatatcgacccagagaccaagaagcacataccatatcgcgaacacaaaagccttacaggcaccgcccgctatatgagtattaatacacatctgggaaaagagcagtccaggagagacgaccttgaggccttgggccatatgtttatgtattttctcagaggctctctcccgtggcaggggctcaaagcagacacactgaaggagagatatcagaagatcggagacaccaagcgcgctactcctatcgaagtgctctgtgagaattttcctgagatggccacatacctgagatatgttcgccgcctggacttttttgagaaaccggactatgactacctcaggaagctttttacagaccttttcgatcgcaaaggatacatgtttgactacgagtacgattggatcggtaagcagctgcccactccggttggggcagtacagcaggatccagcccttagtagtaatcgagaagctcatcaacaccgggataagatgcagcagagcaaaaatcaatcggccgatcacagggcagcctgggattctcaacaggccaacccacatcacctgcgggcccacctcgcagcagatcggcacggcgggagtgtgcaggtggtgagctcaacaaatggggaactcaacaccgatgacccaactgccgggcggagtaacgcccctattactgcccccaccgaggtggaggtgatggacgaaacgaaatgttgctgcttctttaagcggagaaaaaggaaaactattcagcggcataaatag

SEQ ID NO: 110972 - DNA, 1368 bp, Artificial Sequence
  Description of Artificial Sequence: Synthetic coding sequence
atggagaataagaagaaagacaaggataaaagtgatgatagaatggcccgtccgtctggtaggtctgggcataatacaagaggtactggatctagtagtagcggcgtgctaatggtgggccctaattttcgagtagggaagaagatcggctgtggcaattttggcgaactgcgcctgggtaagaatttatacactaatgagtacgtggcaattaaacttgagccaatgaaatctcgggccccacaactgcacctggagtatagattttacaaacagctcgggtccggagatggcatccctcaggtttactactttggcccttgtggaaagtacaacgctatggtgctggaactattgggtccaagccttgaggacctgttcgatctgtgtgaccggacattttccctgaagacagtgctgatgatcgccattcagctgatctctaggatggagtatgtgcattcgaagaacctgatctacagggatgtgaagcccgaaaattttctgatcggtcgtccaggcaacaagacccagcaggtgatccacattattgatttcggactggccaaagagtacatagatcctgagaccaagaagcatattccatacagagaacacaaatctctgaccggaaccgcgcgctacatgtctataaacactcatcttggcaaggagcagtcccgccgggacgatttggaagctcttggccacatgttcatgtatttcttaaggggcagcttaccgtggcaggggctgaaagcagataccctaaaggagcggtaccagaagattggagacaccaagcgggcaactcccatcgaagtcctttgcgaaaacttcccagagatggctacatatctccgttacgttaggcggctagacttctttgagaagccggattatgattacctgagaaagctattcacagacctcttcgatcgaaaagggtatatgttcgactacgagtatgactggataggtaaacaattgcctacccctgtaggcgccgttcagcaagaccccgctttgtcaagcaaccgagaagcccaccagcacagagacaagatgcagcagtcaaagaaccagagtgcggaccatcgagctgcttgggatagccagcaggcaaacccacaccacctccgcgcccacctcgcagcagaccggcacgggggctccgtgcaggtcgtgtcctcaactaacggagaacttaacaccgatgacccaaccgctgggcggagcaatgcacctataacagcacctacagaggtggaagtgatggacgagaccaattgccagaaggtgctgaacatgtggtgctgttgttttttcaagagacgtaaacgcaaaacgattcagcggcataagtag

SEQ ID NO: 110973 - DNA, 1275 bp, Artificial Sequence
  Description of Artificial Sequence: Synthetic coding sequence
atggagaataagaaaaaagataaggataagtccgacgaccgcatggcgaggccctccggacggtccgggcacaatactcgaggaacgggcagctcctcctcaggagtgcttatggttgggccaaattttagggttggcaagaaaatcggctgtggcaactttggtgaactacgtcttggaaaaaacttatatacgaatgaatacgtggccattaagctggagcctatgaaaagcagggcacctcagctgcacctagaatataggttttacaagcagctggggagcggagacgggatacctcaagtgtattacttcggtccatgcggcaaatacaatgcaatggtgctggagctgctgggcccatctcttgaagatctgttcgatctctgcgaccgtactttctctctgaaaacagttctgatgattgcgatccagttaatatcacgcatggagtacgtccatagcaaaaacttaatctatcgcgacgtgaagcctgaaaattttctcataggacgtccaggcaacaaaacacaacaggtgatccacatcatcgactttggactggcgaaagagtacatagatcccgagacgaagaagcacattccctacagggagcacaagtctttgacaggaaccgccaggtacatgagcattaacacccatcttggtaaggaacagtcacggcgcgacgacctcgaagcgctcggtcacatgttcatgtatttcctgcgcggtagtctaccctggcagggacttaaggccgatactttgaaagagaggtaccaaaagattggtgatactaagcgcgctacccccatcgaggttctgtgcgagaattttcctgaggaaatggcgacttatctcagatatgtaagaaggctcgatttttttgagaaaccagactacgattacctgcgtaagctgtttaccgaccttttcgacagaaaaggatacatgttcgattatgaatacgactggatcggcaagcagctgccaacgcccgtcggagccgtacaacaggacccagctctgagcagcaatcgggaagcccatcagcatcgcgataagatgcagcaaagcaaaaatcaagtagtgtcttcaaccaacggagagctcaacacggatgaccccacagcaggaagatcaaacgccccgatcacagcacccactgaagtggaggtgatggacgagactaactgccagaaggtgctcaacatgtggtgttgctgcttctttaagcgcagaaagcgcaaaactattcaaaggcataagtag

SEQ ID NO: 110974 - DNA, 1272 bp, Artificial Sequence
  Description of Artificial Sequence: Synthetic coding sequence
atggaaaataagaaaaaagataaagacaaaagcgacgatcgcatggcacggccatcaggccgcagcggccacaatacccgcggcactggaagcagtagcagtggcgtgctaatggtgggaccgaactttcgcgtaggaaagaaaatcggctgtggaaattttggcgagttacgattgggaaaaaacctgtacacaaacgaatacgtggctatcaaattagaacccatgaaaagtcgggcgccacagctgcacctagagtaccggttctataaacagctgggatctggcgacggaatcccccaagtttattactttggtccctgcggcaaatacaatgccatggtgctggagctgctcgggccctcgctggaagatttgtttgacttgtgtgatcgaacttttagcctcaaaactgttctaatgatagctatccagttgatcagccgaatggagtatgtgcatagcaagaatctgatctaccgggatgtgaaacctgaaaactttctgatcggcagacctggtaacaagacacaacaggtgattcatataattgattttggcctggctaaagaatacatcgatccggagaccaagaagcacatcccctatcgcgaacacaagtctcttaccgggaccgctcgatacatgagtattaacacccacttggggaaagagcagtcccggcgtgacgatctcgaagcgctgggccacatgtttatgtacttcctgagagggtccctgccctggcaaggcctcaaggccgacacactgaaggagaggtaccagaaaatcggggataccaagagggccacgcctatagaggttctttgcgaaaattttcccgagatggccacctacctgaggtacgtgaggcggcttgatttctttgaaaaacctgactacgactacctccgaaaactatttaccgatctgttcgataggaagggttatatgtttgattacgaatacgactggataggtaagcaactcccaacacctgtgggagccgtgcagcaggaccctgctctctcttctaaccgagaggctcaccaacatagagacaaaatgcagcaatcaaagaatcaggttgtgagcagcactaatggcgagttgaatactgatgatcccactgcaggcagatctaatgcgccgattactgctccaactgaggtggaggtgatggacgagaccaactgtcaaaaagtcctcaatatgtggtgctgctgtttctttaagcgcaggaagcgaaagaccattcagcggcataagtag

SEQ ID NO: 110975 - DNA, 648 bp, Artificial Sequence
  Description of Artificial Sequence: Synthetic coding sequence
atgtcatcgtccgaagaagtgagttggatcagttggttttgtggcctgagaggtaacgagtttttctgtgaagtggacgaggactatatacaagacaagtttaatctgacaggactgaacgagcaggtgcctcactaccgccaggcgctcgatatgattctggatttggagccggacgaagagctagaagacaatcccaaccagtcagacctgatcgaacaggcagcagagatgctgtacgggctgattcatgcccggtacatcctgactaatagaggcatcgctcagatgctagaaaaatatcaacagggagatttcggatattgcccaagagtttactgtgagaatcagccaatgcttcccatcggattgagtgacattcccggtgaagccatggtgaagttatattgcccaaagtgcatggatgtgtatacccctaagtcctcccggcaccaccacacggatggcgcttactttggaactggattcccacacatgctgttcatggtgcacccagagtaccgccccaagagacctgcgaaccagttcgtccctcggctctatggctttaagatccaccctatggcttatcagctgcagttgcaggccgcaagcaattttaaatctccggtgaaaactatcaggtag

SEQ ID NO: 110976 - DNA, 648 bp, Artificial Sequence
  Description of Artificial Sequence: Synthetic coding sequence
atgtccagctccgaggaggttagttggatttcttggttctgtggtctacgcgggaatgagtttttttgtgaagttgacgaggactatattcaggataaattcaatttaactggattaaacgagcaagttccgcattatagacaggcactggatatgatactcgacttagagcccgacgaggaattagaggacaatccgaaccaatcagatctgattgaacaggccgctgagatgctctacgggctaatccacgcccggtatatcctgacaaatcgcggcatagctcagatgcttgagaagtaccagcagggcgactttgggtattgcccccgcgtgtactgcgaaaatcagcccatgttgccgatcggcctctcagacatccccggagaagccatggtcaagttgtactgtccaaagtgtatggatgtctacacacccaaatcctcgcggcaccatcacaccgacggggcatactttggaaccggtttcccacacatgttattcatggtgcaccccgaataccggccaaagcggcccgcgaatcagttcgtgccccgattatacggctttaagatccatccaatggcataccagctccaactccaggctgctagcaacttcaagtctccagtgaagaccatcagatag

SEQ ID NO: 110977 - DNA, 648 bp, Artificial Sequence
  Description of Artificial Sequence: Synthetic coding sequence
atgtcctcaagcgaggaggtgtcgtggatctcttggttttgtgggctgcggggcaatgaattcttctgcgaagtggacgaggactacatccaggataaattcaacctgactggattgaatgaacaggtgccccactatcggcaggcgctggatatgatcttggatctggagcccgacgaggagcttgaggataaccccaatcaatccgatttaatcgagcaagccgctgagatgctgtacggtctgatacatgctcggtatatccttactaatcggggcatcgcgcagatgctggagaagtaccagcagggcgactttggttactgtcctcgggtgtattgtgagaaccagccaatgctaccaattgggctttctgacatcccaggggaggccatggtaaagctgtactgcccaaagtgcatggacgtgtacacgcctaagtcctccaggcaccaccatactgacggtgcctatttcgggaccggattcccgcacatgctgttcatggtgcaccctgagtacagacccaagaggcctgctaaccagttcgtgccacgtctctatggattcaagatacaccccatggcctaccagctgcaattacaggccgcgagcaatttcaaaagccccgtgaagaccataagatag

SEQ ID NO: 110978 - DNA, 648 bp, Artificial Sequence
  Description of Artificial Sequence: Synthetic coding sequence
atgtctagctctgaggaggtctcctggatcagctggttctgcggtctgagaggcaacgagttcttctgtgaggtagacgaggactacattcaggacaagtttaacctcacagggctcaacgagcaggtgcctcactatagacaagcattggacatgattctagatctggagcccgatgaagagcttgaagataatcccaaccagtctgacctcatcgagcaagcagctgagatgctttacggacttatccacgctcggtatatccttaccaatcgcgggatcgctcagatgttggagaaatatcagcagggggactttggatactgccctcgcgtgtactgcgaaaatcagcctatgttacctataggactgtctgatatcccaggggaagcaatggtgaagctctattgccccaaatgcatggacgtgtacactcccaagagctcccgccatcaccacacggatggcgcatacttcggcacaggtttccctcacatgctgttcatggtgcaccctgagtaccgtccaaagcgtcccgcaaatcaattcgtccctagactatacggcttcaagatccatcctatggcctaccagctacaattgcaggccgctagcaatttcaagtcaccagtcaagaccatacgctag

SEQ ID NO: 110979 - DNA, 687 bp, Artificial Sequence
  Description of Artificial Sequence: Synthetic coding sequence
atgtcatcatctgaggaggtgtcctggatttcatggttttgcgggttgcgtgggaacgaatttttctgcgaggtggacgaggactatatacaggacaagtttaacctcactggactgaatgaacaggtccctcattatcggcaggccctcgacatgattttggatctcgagcccgatgaagaactggaggataacccaaatcaaagcgatctcatcgaacaggccgccgagatgttgtacggtttgattcatgcccggtacatcctgactaatagagggatagcccaaatgcttgagaagtaccaacagggtgacttcggctactgccctcgagtctattgcgagaatcaacctatgctgccaattgggctctccgacattcccggtgaagccatggtcaaactgtattgtcctaaatgtatggacgtctatacccccaagtccagccgccatcaccataccgacggggcttactttggcacggggtttccgcacatgctgttcatggtgcatccagagtaccgaccaaaaaggccagccaaccaattcgtaccatctagttgttcgcggcacccagacgtgcctctcttgcccagaaggagacccttctgtaggatgcactttcggcttagagaagtttaccaccaacagttgattcctgtccatggggatcaccatttgctatag

SEQ ID NO: 110980 - DNA, 648 bp, Artificial Sequence
  Description of Artificial Sequence: Synthetic coding sequence
atgtcatcgagcgaggaggtcagctggattagctggttctgtggcctacgaggcaacgaattcttttgtgaggttgacgaggactatattcaggacaagtttaatctgacgggattaaatgaacaagtaccgcattacaggcaagctttagacatgatcttggatctcgagccagacgaggagctcgaagataatcccaaccagagtgacctgatagagcaggcagctgagatgttgtatggcctgatccatgcgcggtacatcctgacaaatagaggaattgcccagatgctggagaagtaccagcagggcgatttcggctactgcccacgagtttattgcgaaaatcagccgatgctaccaatcgggctgtccgatatccctggggaagctatggtgaaactctactgccccaagtgtatggatgtatatacgcctaaaagttcacggcatcaccatactgacggagcatactttgggactggctttcctcacatgttgtttatggtacatcccgagtataggccaaagcggcctgcaaaccagtttgtacccaggctgtacgggttcaagatccatcccatggcctatcagttacaactacaggcggcttctaatttcaagagtccggtgaaaacaattaggtag

SEQ ID NO: 110981 - DNA, 648 bp, Artificial Sequence
  Description of Artificial Sequence: Synthetic coding sequence
atgagctccagtgaggaagtcagctggatttcgtggttctgtggactgagaggcaatgagttcttctgcgaggtggacgaagactacattcaggataagtttaacctaactggcctcaatgagcaggtgccccactacagacaagcactggatatgatcctcgacctagagccagatgaagagctcgaggacaaccccaatcagagtgacctgattgagcaggcagcagagatgctctacggcttgattcatgctcgttacattctaaccaatcgggggattgcacagatgctggaaaaatatcagcagggggacttcggctattgccctcgggtgtattgtgagaaccaaccaatgctgcccatcggtctgagcgatattccgggagaggcaatggttaaactttattgcccaaaatgtatggacgtctacactcccaagagcagccggcaccaccacacagatggagcctactttgggacaggttttcctcatatgttattcatggtgcacccagaataccggccaaagagacccgccaaccaatttgtaccccgcctttacgggtttaagattcatcccatggcataccagctgcagcttcaagccgcaagcaacttcaagtcaccagtcaaaacaattcgatag

SEQ ID NO: 110982 - DNA, 705 bp, Artificial Sequence
  Description of Artificial Sequence: Synthetic coding sequence
atggagaaatgcaagggcaccagtaggatggccggcaccactagcgccgatgtcaaaatgagtagctccgaggaggttagctggatcagctggttctgcggtttgagggggaacgagttcttttgtgaggtggatgaggattatattcaggacaagttcaatcttactggcttaaatgaacaggtccctcattacagacaggccttagacatgatactcgatttggagcctgacgaggagctggaggacaacccaaaccagagcgatctgatcgagcaagccgccgaaatgctttatggtctcatccatgctcgctacatactgacaaatagaggtatcgctcaaatgttagaaaaataccaacagggtgatttcggctattgccctcgcgtctattgtgagaaccaacccatgcttccgatcgggctatccgatatccctggtgaggcgatggtgaagctctactgtccgaaatgcatggatgtgtacactcctaaatcatctaggcaccatcacaccgacggggcgtacttcgggactgggttcccacatatgctgttcatggtgcatcccgagtaccggcctaagcgccccgccaaccaattcgtgcccagactttatggcttcaaaatccatcccatggcttaccaattacagctgcaggcagcttcaaacttcaaaagtcctgtcaagaccatccgctag

SEQ ID NO: 110983 - DNA, 648 bp, Artificial Sequence
  Description of Artificial Sequence: Synthetic coding sequence
atgtcctcttctgaagaggtgtcctggatttcctggttctgcggccttagaggcaacgaattcttttgtgaggtggatgaggattacatccaggacaagttcaatctgacagggctcaacgagcaagtgcctcattaccggcaggcattagacatgattctggacctcgagcccgacgaggaattggaagacaatccgaatcagtcggacctcatcgagcaggctgccgaaatgctgtacggactaatccatgcgaggtacattctgacaaatagaggtattgcacaaatgttggaaaagtaccagcaaggtgactttggatactgccctcgcgtttactgcgaaaatcaaccaatgctacctataggcttatctgatatccctggtgaagccatggtgaagctatactgccctaaatgcatggacgtatatacaccaaagagctcacggcatcaccatacagacggtgcttattttgggactggatttccccacatgttgtttatggtccacccagagtatcgaccaaagcggccggcgaatcaatttgttcctagactgtacggttttaaaattcatccaatggcatatcagctccagcttcaagccgcctccaatttcaagtcacccgtgaagaccattaggtag

SEQ ID NO: 110984 - DNA, 687 bp, Artificial Sequence
  Description of Artificial Sequence: Synthetic coding sequence
atgtcatcaagcgaagaggtcagttggatctcctggttttgcggcctacgggggaatgagttcttttgcgaagttgacgaggactacattcaggacaaattcaatcttaccggattgaacgaacaggtgccgcattaccgacaggctctagacatgatactggaccttgaaccagatgaagaattagaagacaacccgaatcagagtgatctcatagagcaagccgccgagatgctgtacggcctgattcacgccagatacatcctcaccaacaggggcatagctcaaatgttggaaaaataccagcagggtgacttcggatactgtccaagagtgtattgtgagaaccagccgatgttaccaatcggtctcagcgatattcctggtgaggctatggtgaagctgtattgccctaagtgcatggatgtttacactccgaaatctagtcgccaccaccacaccgatggagcgtacttcgggactggctttccccatatgctcttcatggtgcatccagaataccggccaaaacgaccggccaaccagttcgtgccttccagctgctcgagacatcccgatgtgcccctgctgccccgaagaagaccgttctgccgtatgcacttccgccttagggaagtctatcatcagcaacttattccagtgcatggtgaccaccacctgctgtag

SEQ ID NO: 110985 - DNA, 687 bp, Artificial Sequence
  Description of Artificial Sequence: Synthetic coding sequence
atgagctcttccgaggaggtgtcttggatcagttggttttgtgggttgaggggcaacgaatttttttgcgaggtggacgaagattatattcaggacaaatttaacctcactggactgaacgagcaggtgccccattaccggcaggctctggacatgattcttgatttggaacctgatgaggagctagaagacaaccccaatcagagcgatttgatcgagcaggcagctgagatgctttacgggcttattcacgcccgatacatcctcactaatagggggattgctcagatgctggagaagtatcagcagggtgacttcggctattgccctagggtctactgcgaaaaccaacctatgctgcccatcgggctgtctgatatacctggggaagcaatggtaaagttatattgccccaagtgtatggatgtctacaccccaaagagcagccgccaccaccacacggacggcgcttattttggaaccggcttcccgcatatgttattcatggtgcaccctgaatacaggcccaagcgtcccgcaaaccagttcgttccatcatcatgcagcagacatccagacgttccgctgctgcctcggagacgacccttctgcagaatgcatttccgacttcgtgaggtctaccatcagcaactcattcctgtccacggtgatcatcacctgctatag

SEQ ID NO: 110986 - DNA, 648 bp, Artificial Sequence
  Description of Artificial Sequence: Synthetic coding sequence
atgagcagctcggaggaagtctcttggatttcctggttttgtggcctgcgcggcaacgagtttttttgcgaggtggatgaagactatattcaggataaattcaacctaacaggtctcaatgagcaggtgccgcactaccgccaggccctggatatgatcctggatctggaaccggacgaggaattggaagataaccccaatcagtccgacttgattgagcaggccgcagaaatgctctacggactgatacacgcaagatatattctgacaaacaggggaatcgcccagatgttggagaagtatcaacaaggggactttggctattgccctagagtgtactgcgaaaatcagcccatgctgccaatcggcctcagcgacatcccgggggaagccatggttaagctgtattgtcccaagtgtatggacgtttatacacccaaatcctcccggcaccatcacacggacggagcttacttcggaaccggatttccgcacatgctcttcatggtgcatcctgagtacaggcccaaacggcccgcaaatcagtttgtacctcggttgtacggcttcaaaattcatccgatggcgtatcagctccagttgcaggcagcgagcaacttcaagagtcctgttaagacgattcgatag

SEQ ID NO: 110987 - DNA, 705 bp, Artificial Sequence
  Description of Artificial Sequence: Synthetic coding sequence
atggagaaatgtaagggtaccagtcgcatggccggaactacttctgccgatgtaaaaatgtctagtagcgaagaggttagctggataagctggttctgcggcctcagagggaatgagttcttttgtgaagttgatgaggattatatccaggataaatttaacttgactggtctgaatgagcaggtaccacactataggcaggctctggacatgatcctggacctagagccggatgaagagctggaagataaccctaaccagtcagatttgattgagcaggccgcagagatgttgtacggtctgatccatgcgcgttacatcctcaccaatcgaggtatagcccaaatgctggagaagtaccagcagggcgacttcggctactgtcccagagtctactgtgagaatcagcctatgctgccaatcggattgtccgatattccgggagaggccatggtcaagttatattgtccaaaatgcatggatgtgtacaccccaaaaagttctcggcatcatcatacagacggagcctacttcgggaccggcttcccgcacatgctgtttatggtccatcctgagtaccgcccaaaacggcccgcgaaccagtttgtgcctcgcctctatggctttaaaattcacccgatggcctaccagctgcaactgcaggcggcctctaatttcaagagcccagtgaagactatacgctag

SEQ ID NO: 110988 - DNA, 648 bp, Artificial Sequence
  Description of Artificial Sequence: Synthetic coding sequence
atgtcatcatcagaagaggtcagttggatttcttggttttgcggtctcaggggaaacgaattcttttgcgaagtggatgaggattacattcaggacaagtttaacttgaccggactgaacgagcaggttccgcactatcggcaggccctcgacatgatactcgacctagaacctgatgaggagctcgaggataatccgaatcagtcggatcttatagaacaggctgctgagatgctctacggcctgatccacgctagatacatcttaacaaatcggggtatagcccagatgctggaaaagtaccagcagggcgattttggctattgcccacgggtatattgtgaaaatcagcctatgttgcctattgggctctcggatatcccaggagaggcaatggtgaagctctactgcccaaagtgtatggacgtctatacgcctaaaagttctagacatcaccacaccgatggtgcctattttgggaccgggttccctcacatgttgttcatggtacatcccgaataccgccccaagaggccggctaaccagtttgtcccacggctctacggtttcaaaatccatcccatggcttaccaacttcagctccaggctgccagcaatttcaagtctcctgtgaagacaatacgttag

SEQ ID NO: 110989 - DNA, 705 bp, Artificial Sequence
  Description of Artificial Sequence: Synthetic coding sequence
atggagaagtgcaagggcacatctcgcatggctggaacgactagcgcagatgtcaagatgtccagcagcgaggaggtatcttggattagctggttttgtggcctgcgtggtaatgaattcttctgtgaggtcgatgaggattatattcaagacaaattcaatctaactgggctcaatgagcaagttccacattatcgccaagccctagacatgatcttggatctggagcccgacgaggagcttgaagacaatcctaatcagagtgatctgatcgaacaggccgcagaaatgttatacggactgatccacgctagatatatcttaactaacagagggattgcccagatgctcgaaaagtatcagcagggcgattttggctactgcccgagggtgtattgcgagaaccagccaatgctgccaatcggcctctcagatatccccggtgaagctatggtcaagctgtattgccctaagtgcatggatgtttacacacctaaatcaagcaggcatcaccacactgatggcgcatacttcggaacaggttttccccacatgctctttatggtgcacccagagtatcggccaaaaagacctgcaaaccagttcgttcctcgcctttacggttttaagatccaccccatggcctaccagcttcagcttcaggccgcatcaaactttaaatcccctgttaagacaataaggtag

SEQ ID NO: 110990 - DNA, 705 bp, Artificial Sequence
  Description of Artificial Sequence: Synthetic coding sequence
atggaaaaatgcaaaggcacttctcggatggcaggtacaaccagcgcggacgttaaaatgagttctagcgaggaggtatcctggattagttggttttgcggtctacggggcaatgaattcttctgcgaggtagacgaggattacatccaggataaatttaacctgacaggcctcaacgagcaagtcccccattaccggcaggctctcgacatgatcctggacctggaacccgatgaagagcttgaagacaatccgaatcaaagtgatctgatagagcaggccgctgagatgctgtatggtttgatccatgctaggtacatccttaccaacagaggcatcgcccagatgctggaaaagtaccagcagggcgactttgggtactgtccaagagtctactgcgagaaccagcccatgttgcccatcggcttgtcagatattccaggcgaagctatggtcaagctgtattgtcctaagtgcatggacgtgtatacccccaaatcttcccggcatcaccataccgatggggcttattttggcaccgggtttccccacatgctttttatggtacaccctgaataccgccccaaacgccccgctaatcagttcgtccctcgtttatatggctttaagatccatccaatggcatatcagttgcagctccaggctgcttccaattttaaatcacctgtgaagacgattcgttag

SEQ ID NO: 110991 - DNA, 648 bp, Artificial Sequence
  Description of Artificial Sequence: Synthetic coding sequence
atgagcagctctgaggaagtctcctggatatcctggttttgcggcctgagaggaaacgaattcttttgtgaggtcgacgaggactacatccaggataaatttaatctgacaggcctcaacgagcaagtacctcattacagacaggctcttgatatgatcctggacctggagcccgatgaggaactagaggacaacccgaatcagtcagacctcatcgaacaagccgccgagatgctgtacggccttatacatgcgcgctacatcctgacgaatcggggcatcgcgcagatgctggagaaataccagcaaggggacttcgggtactgtcctagggtgtattgtgagaatcagcccatgctgcccattggtttaagcgacattcctggagaggctatggtaaaactatactgtcccaagtgtatggatgtatatacaccaaaatcctcacgccaccatcatacagacggcgcttactttgggacgggtttcccccatatgctattcatggttcacccggaatatcggcctaagcggcctgccaatcagttcgtacctcggctgtacggcttcaagattcaccctatggcttatcagctacagctccaggcggcttcaaattttaaatctcccgtgaaaaccatccgatag

SEQ ID NO: 110992 - DNA, 648 bp, Artificial Sequence
  Description of Artificial Sequence: Synthetic coding sequence
atgtccagcagcgaagaggtgtcgtggatctcctggttttgcggtctccgtggtaacgaattcttctgtgaagttgacgaggattacatacaagataaatttaacctgaccggtcttaatgagcaagtgcctcactaccgccaggccctcgacatgatcctcgacttggaacccgatgaagagctggaagataatccaaatcagtctgacctcatcgagcaggcagccgaaatgctctatggcctgattcacgctcgctacatactgaccaaccgcgggatcgctcagatgctggagaagtatcaacaaggcgacttcggatattgcccacgcgtctattgcgagaaccagccaatgctgcccatcggactttctgatatccctggagaggccatggtgaagctgtactgcccaaaatgcatggacgtatacacgccaaaatcctccagacaccaccatacagacggggcttactttggtaccggatttccacatatgttgttcatggtgcaccctgaatacaggcccaagcgccccgcaaatcaatttgtgcccagactgtacggttttaagatacaccccatggcctaccaattgcagctgcaggcagcctcgaacttcaagagtcctgtcaaaacgattcgatag

SEQ ID NO: 110993 - DNA, 705 bp, Artificial Sequence
  Description of Artificial Sequence: Synthetic coding sequence
atggaaaaatgcaagggcacaagcagaatggctggtaccacctccgctgatgtcaaaatgagctcaagcgaggaggtctcctggattagctggttctgcggtctccgaggaaacgagtttttttgcgaggtggatgaagactacatccaggataagtttaacctgaccggcctcaatgagcaggtcccccactatagacaggctcttgacatgattctggaccttgaaccggatgaagaacttgaggataatccaaaccagtcggatctgatagaacaagccgcggagatgctttacggactgatccacgctcggtatatcttaaccaacaggggaatcgctcagatgctggagaagtatcaacagggcgatttcggctactgtcctcgcgtctattgtgaaaatcagcccatgctgcccatcggcttatcagacatcccgggtgaggcaatggttaagctgtactgtccgaaatgcatggacgtttatacacctaagtcgagtcggcaccaccatacggacggtgcgtactttggtacaggatttcctcacatgctgttcatggtgcatcccgaatatcgaccgaagcgcccggccaatcagttcgtacctcgattgtacggctttaagattcatcctatggcatatcagctacagctccaggccgcctctaatttcaagagtcctgttaaaacaatcagatag

SEQ ID NO: 110994 - DNA, 648 bp, Artificial Sequence
  Description of Artificial Sequence: Synthetic coding sequence
atgagctctagcgaagaagtctcatggataagctggttctgcggactcagaggtaacgaatttttttgcgaagtggatgaggattatatacaggacaagtttaatctgactggtctcaacgagcaggtgccgcattacaggcaagccctcgacatgatcctcgatctagaaccagacgaggagctggaagataacccaaaccagtcggacctaatcgagcaggccgctgagatgctttacggtctgatccacgcccgttatattttgacgaacagagggattgctcagatgttggagaagtatcagcagggggactttggttattgtccgagagtgtactgcgaaaaccagcctatgctgcctatcggactatctgatatcccaggcgaggctatggtgaaactgtactgtcctaaatgcatggatgtgtacacccccaaatctagcagacaccatcacacagacggtgcctactttggaacgggcttccctcatatgctgtttatggtgcaccctgaatacagacccaaacgaccggccaaccagttcgtgccccgactttatgggtttaaaattcatccaatggcctatcaattacaactgcaggccgcctccaattttaagagccccgtgaagacgatccgctag

SEQ ID NO: 110995 - DNA, 687 bp, Artificial Sequence
  Description of Artificial Sequence: Synthetic coding sequence
atgagctctagcgaggaggtcagttggattagctggttctgtggactccgcggaaacgagtttttttgtgaagtcgatgaagactacatccaggacaagtttaatttaaccggcctcaatgaacaggttcctcattatcgacaggctctggacatgatcctggatctcgagcccgatgaggagttagaagacaatcccaaccagtccgacctgattgaacaggctgccgaaatgctttacggcctcatccacgccaggtatattctgacgaacaggggcatcgctcaaatgcttgaaaaatatcagcagggggattttggctactgccctcgggtttactgcgagaatcaacccatgctccccattgggctgagcgatattcccggagaagccatggttaagctttactgccctaaatgcatggatgtgtacactcccaaatcctcgaggcaccaccataccgacggagcttacttcggaacaggcttccctcatatgttatttatggtccacccagagtataggcccaagcgccccgcgaatcaattcgtcccgagctcttgctcccgccaccctgacgtacccctgcttccacgccgtaggccattttgccgcatgcactttcgattgcgcgaggtatatcatcagcaactgattcccgtacatggcgatcaccatctactttag

SEQ ID NO: 110996 - DNA, 705 bp, Artificial Sequence
  Description of Artificial Sequence: Synthetic coding sequence
atggaaaagtgcaagggaaccagccggatggcaggcactactagcgcagacgtcaagatgtcatcttccgaggaggtgtcttggatttcatggttttgcggcctgagggggaacgagtttttctgtgaagtggatgaggactatatccaggataagttcaacttaaccgggttaaatgaacaagtcccacactataggcaagccctcgacatgatactggatctggaaccggacgaggagttggaggataatccaaaccaatcggacctcattgagcaggccgctgagatgctgtacgggctgatccacgcacggtatatcttgaccaatcgcggcatcgcccagatgctcgaaaagtaccaacagggggatttcggctactgcccgcgagtgtactgtgagaaccagcccatgttgcctatcggcctttccgacatcccaggggaagccatggtcaagctctactgccctaagtgcatggatgtgtatactcctaagagctccaggcatcatcacactgacggtgcctacttcgggacgggcttccctcatatgctgtttatggtgcaccctgagtatcggcccaagcggcccgccaatcagtttgttcctcggttgtacggcttcaaaattcaccccatggcttatcagcttcagttgcaggccgcgagcaatttcaagagtcctgtgaagaccatccggtag

SEQ ID NO: 110997 - DNA, 648 bp, Artificial Sequence
  Description of Artificial Sequence: Synthetic coding sequence
atgtcctcgtctgaggaagttagctggatttcatggttctgtggcttacgtggcaacgagttcttctgtgaggtagacgaagactatatccaggacaagttcaatctcacaggccttaacgagcaggtgcctcactacaggcaggctcttgacatgattctggacctagaacccgatgaagaactggaggataaccccaaccagtctgacctgatcgagcaggcagcagaaatgctttatggactcatccatgctaggtacatcctcaccaatcgcggcattgctcagatgctggaaaagtatcagcagggagactttggatactgccctcgggtgtattgtgagaaccaacctatgctgccaataggattgtccgacataccaggagaggctatggtgaagctgtactgccccaagtgcatggacgtgtacacgcccaaatcgagccgccatcatcacacggatggtgcttacttcgggactggcttccctcacatgttgttcatggtgcaccccgagtaccgaccaaagcgccctgctaatcagttcgtgccccggctgtacggtttcaaaattcatcccatggcctatcagctccagttacaagccgcctcaaatttcaagtcccccgtgaagactatccgctag

SEQ ID NO: 110998 - DNA, 648 bp, Artificial Sequence
  Description of Artificial Sequence: Synthetic coding sequence
atgtcttcatctgaagaagtgtcatggattagttggttctgtggattgcgcggtaatgaatttttttgtgaagttgatgaggattacattcaagataaattcaatttgactgggctgaacgaacaggtgccacactacagacaagctttagatatgatcctcgacctggaaccagacgaggagttagaggacaaccccaaccaatccgacctgattgagcaggcggcagaaatgctttacgggctgattcatgcccgctatatccttaccaaccgcggcattgcccagatgctagagaagtaccagcagggcgacttcggatactgtcccagagtgtattgcgagaaccagccaatgttgcccatcgggctttctgacatcccgggggaagcgatggtcaaactatactgccctaagtgcatggatgtatatacacccaagtcctctcggcatcatcacactgacggagcgtactttggcaccggattcccacacatgttattcatggtccatccagagtacaggccgaagcgacctgccaaccagttcgtcccacggctgtacggcttcaagatacaccccatggcctaccagcttcagctgcaggcagctagtaacttcaagtcgccagtgaagactattcgatag

SEQ ID NO: 110999 - DNA, 648 bp, Artificial Sequence
  Description of Artificial Sequence: Synthetic coding sequence
atgtccagctccgaggaggtcagctggatttcttggttctgcggactgaggggtaacgaattcttctgcgaggtggatgaggactatatccaggacaagttcaacttgactggactgaacgagcaggtgccccactaccgccaggctttggatatgatactggacctggagcctgatgaagagctagaggataaccccaaccagagcgacttgattgagcaggctgccgagatgctgtacgggctgatccacgcccgctacattctgacaaacagagggattgcccagatgctagagaagtaccagcagggggactttgggtattgcccacgtgtctattgcgagaaccagccgatgcttcctatcggactttccgacatccccggtgaagccatggttaagttgtattgcccaaaatgcatggatgtatatacaccaaagtcttcccgccatcatcatactgatggcgcttatttcggaacaggattccctcatatgctgtttatggtgcacccagagtacaggcctaagaggcccgccaaccagtttgtgcctagactatacgggtttaaaattcacccaatggcctaccaattgcaacttcaggcagcctccaactttaagagccccgtgaaaaccattcggtag

SEQ ID NO: 111000 - DNA, 648 bp, Artificial Sequence
  Description of Artificial Sequence: Synthetic coding sequence
atgtcatcatccgaggaagtctcttggatctcctggttctgcggtctgcgcggtaacgagttcttttgcgaggtcgacgaagactatatccaagacaagtttaatctcaccggactcaatgagcaggttccccactaccgccaggctctggacatgattctggatttagaacccgatgaagagctggaggacaacccaaaccagtcagatctgatcgaacaggccgctgaaatgctgtacggtcttatccatgctcgttacatcctgacaaatcggggcattgcccagatgctggaaaagtaccaacagggagatttcggttattgcccacgagtatactgcgagaaccagcccatgttgcctatcgggttatccgacatcccaggggaggccatggtaaagctatattgtccaaaatgcatggatgtctacacccctaagtcctcacgacaccaccatacggatggtgcgtacttcggcacgggcttcccgcacatgctttttatggtgcaccctgagtatcggcctaagcgacccgcaaaccaatttgtgccacggctttatggttttaaaattcaccctatggcctatcagctgcaactgcaggccgcttctaacttcaaaagtccagtgaagacgattagatag

SEQ ID NO: 111001 - DNA, 648 bp, Artificial Sequence
  Description of Artificial Sequence: Synthetic coding sequence
atgtctagcagcgaggaggtctcctggatcagttggttctgcggactgaggggcaatgaatttttctgtgaagtggacgaggactacattcaggataagtttaatctcaccggtttgaacgagcaggtgccgcactatcggcaggcacttgatatgatccttgacctcgagcctgacgaggaacttgaggataaccccaaccagagcgacctgatcgaacaggcagctgaaatgctctacggtctgatccacgcacggtacatcctgaccaatcgagggatcgctcagatgctggaaaagtatcagcagggcgattttggatactgcccacgggtctattgtgaaaaccagccaatgctcccaatcggacttagtgacatcccgggtgaggcgatggtgaaactttactgtcctaagtgcatggacgtctatactccaaagtcgtctcgccaccaccatactgacggtgcttatttcggcaccggctttcctcatatgctgttcatggtgcaccccgagtatagaccgaagcgccccgcaaatcagttcgtcccaagattatacgggttcaaaattcaccccatggcttaccagctacagctgcaggcagctagtaactttaagagccctgtgaaaaccattagatag

SEQ ID NO: 111002 - DNA, 648 bp, Artificial Sequence
  Description of Artificial Sequence: Synthetic coding sequence
atgtccagttcagaggaagtctcttggatctcatggttttgcggcctacgcgggaatgagtttttctgtgaggtggacgaggactacatccaagacaaattcaaccttaccggactgaacgagcaggtgccccactaccgtcaagccctagacatgattctggatttggagccagacgaagaactggaagacaatcctaatcagtccgacctgatcgaacaagccgctgaaatgttatacgggctgatacacgctcgttatattctgacaaatcgtggcattgcacagatgctggagaagtatcagcagggagatttcggatattgcccccgagtgtattgtgagaatcagcccatgctaccaattggcctgtcagatattccaggggaagccatggtcaaactgtattgtccgaagtgtatggacgtctacacgcctaaatcttcgagacatcatcacacagatggtgcatatttcgggaccggctttccccatatgctcttcatggtacacccagagtaccgacccaagcggcctgcaaaccagttcgtgccgcggttatatggcttcaaaattcaccctatggcctaccagctacagttgcaagcggctagcaactttaaatctccagtgaagacaatccggtag

SEQ ID NO: 111003 - DNA, 648 bp, Artificial Sequence
  Description of Artificial Sequence: Synthetic coding sequence
atgtcctcttctgaagaggtctcatggatcagctggttttgcgggcttagaggcaatgaattcttctgcgaagtcgacgaggactatatacaggacaagttcaacttgactggccttaacgagcaagtgccacactaccgtcaggctctggatatgatcctcgacctggagcccgacgaggaactggaagataacccaaatcagagtgacctcatagagcaggcagccgagatgctctacgggctcatacacgcaagatacatactaactaaccggggcatagcccagatgttggagaagtatcaacaaggagactttggctattgccccagagtctattgcgagaatcaaccaatgctaccaataggcctttcagacattccaggcgaagctatggtaaagctgtactgccccaagtgtatggacgtgtacacacctaaatccagtcgccaccatcataccgatggtgcctattttggtacgggtttcccacatatgcttttcatggttcaccccgagtatcggccaaagcgtcccgccaaccaatttgtacctaggctttacggtttcaagatccatccaatggcataccagctgcagctgcaggccgctagtaacttcaaaagtccagtcaagaccattcgatag

SEQ ID NO: 111004 - DNA, 648 bp, Artificial Sequence
  Description of Artificial Sequence: Synthetic coding sequence
atgagtagcagcgaggaggtttcttggatctcatggttctgcggccttcgaggaaatgaatttttctgcgaggtcgacgaggactacattcaagataaatttaacctgaccggacttaacgaacaggtcccacattatagacaggccctagatatgatattggacctggagccagatgaggaattggaggataatcccaatcagagtgaccttatcgaacaggccgccgagatgttgtatgggctaatacatgccaggtacatacttaccaaccgcggcattgcccagatgctggagaagtaccagcagggcgattttgggtactgccctagagtgtactgtgagaaccagccgatgttaccaatcggcttaagcgatatcccaggggaagcaatggtaaaactgtactgcccgaaatgcatggacgtgtacacgcccaagtctagccgtcaccatcacaccgacggtgcctactttggcaccggctttcctcacatgctgttcatggtacaccccgagtatagacccaagcgaccagccaaccagttcgtgcctaggttatatggttttaaaatacaccccatggcatatcagttgcagctgcaggctgcttctaatttcaagtccccggtcaaaactattagatag

SEQ ID NO: 111005 - DNA, 648 bp, Artificial Sequence
  Description of Artificial Sequence: Synthetic coding sequence
atgagctccagcgaagaagtgtcctggatctcttggttctgcgggctccggggaaacgagttcttttgcgaggttgatgaagattacattcaagataaatttaatctcactggattgaatgagcaggtcccccattaccggcaggcactggacatgatcctagacctggagccggatgaggaactggaggataaccctaaccagtcagacctgattgaacaagccgctgagatgctttatggtctgatccacgcccggtacattctgactaatagaggaatagcccagatgctggaaaaatatcaacagggagatttcgggtactgcccccgcgtgtattgtgagaatcagcctatgctgcctatcggcttatcagatatacctggtgaggcgatggtgaaattgtactgcccaaaatgtatggacgtgtacactcctaagagtagtaggcatcaccataccgacggcgcgtactttgggaccgggtttccacatatgctgttcatggtgcatccagagtatagacccaaaagaccggccaaccagttcgtgccccggctgtacggtttcaaaattcacccgatggcctaccaactgcagctgcaggctgcctccaatttcaaaagtccggttaagactattagatag

SEQ ID NO: 111006 - DNA, 4296 bp, Artificial Sequence
  Description of Artificial Sequence: Synthetic coding sequence
atgggcaaagaacaggaactggtacaggctgtgaaagccgaggatgtggggaccgcccaacgactcctccaacgccccagacccgggaaagcgaagctgttaggctcaaccaagaaaattaatgttaacttccaggaccccgacggcttttccgcccttcatcacgcagccttaaacggtaataccgagttgatttctctcctactggaagcccaggccgccgtagacataaaggacaataaaggaatgagacccttgcactatgcagcctggcaggggagaaaagaacctatgaaattggtgctgaaggctgggtctgcagtaaacataccttccgatgaaggtcatattcccctgcatctcgccgcccagcatggtcactatgatgtttctgagatgctgctgcagcatcagtccaatccgtgcatggtcgacaactccggaaaaaccccacttgacctcgcttgcgaatttggccgagttggtgttgttcagctcttactatcctccaatatgtgtgccgcactcctggagcctagacctggcgatgctacagatcccaatggcacatctccactacatctagccgccaagaatggccatatcgacatcattcggctgctgctacaggccgggattgatatcaaccgccaaaccaagtcaggcaccgccctccacgaagctgccttatgtggcaaaacagaggtggtgagattgcttctggactccggcattaatgcccacgtgagaaacacctatagccaaactgcgctcgacatcgtgcatcagttcactacgtctcaggcgtctagggagattaagcagctgctccgcgaagcgagcgcagcactgcaggtccgcgctaccaaagattactgtaataattatgatctgacaagcctgaatgtaaaggccggcgacattataactgtgttagaacagcaccctgatggtagatggaaaggctgtattcatgacaaccgcaccgggaacgatcgcgtgggatatttcccaagctctctgggagaggcaatcgtgaaacgagcaggatcaagagcaggtaccgagccctctctcccccaaggcagcagtagctcaggcccttctgcacctcccgaagagatctgggtcctgcggaagccatttgccggcggagaccgctccgggagtatctcaggtatggcagggggccgtggctcgggcggccatgcactccacgccggctccgaaggggtgaagctgctggcgaccgtcctaagccagaagagcgtctctgagtccgggcctggtgattcaccagccaagccccctgaaggaagcgcaggggtggctcgctcgcagccccctgttgcccacgcaggtcaggtgtacggcgaacagccgccaaagaagctggagccggcctcagagggcaaaagcagcgaagccgttagccaatggttgaccgccttccagctccagttgtacgcgcctaacttcatatctgcaggctacgatctcccgaccattagtcggatgactccagaagatttaacagccatcggcgtgactaagcccggccataggaaaaaaattgccgccgagataagtggactcagtatcccagactggctgcctgagcacaaaccggccaacttggcagtgtggctgagtatgattggactggcccagtattataaggtgctggttgacaacggctacgagaacattgatttcatcaccgacatcacttgggaggacctgcaagagattggcataacaaagctgggacaccagaagaagctgatgcttgcagtccgtaaactggctgagctccaaaaggccgagtacgccaaatacgagggagggcctttacggagaaaggccccccaaagcctggaggtaatggccattgagagcccccctccaccagagccaactcccgccgattgccagtcccctaaaatgaccactttccaggacagcgagctgtccgacgaactccaagccgctatgacagggcccgcggaagtcggccctaccaccgagaagccttctagtcatctgccgccaactcccagagctaccacaagacaggacagtagtctgggcggcagggcccggcacatgtccagctcacaggagttgctcggggatggacctcccggaccatcttctccaatgtcacggagtcaggaatatctcctggatgaaggcccagccccaggaaccccccctagagaggcccgacccgggcgacacggacactcaataaagcgggcaagcgtgcctcctgttcctggaaagccacgccaggtgcttccgcctgggacgagtcatttcaccccgcctcagacgcccaccaaaacaaggccaggttccccgcaggctctgggcgggccccacgggccagcaccagccaccgctaaggtcaaaccgactccccagctgctaccccctaccgaacgccccatgtccccgcggtcattgccccaatcccccacccatcggggattcgcttatgtcctcccacagcccgtggagggcgaggtcgggccagccgcccctggcccagctcctccccccgtaccaaccgcagtgccaacgctgtgcctgcccccagaagctgatgctgaacctggccggccaaaaaagcgcgcacatagccttaatcgctacgccgcttcggatagcgaacccgaacgggacgaacttctcgttcccgctgctgccggaccttacgcaactgtgcagcgcagggtggggcggtctcattctgtgcgtgcccctgcaggggccgacaaaaacgtgaaccgatctcagagtttcgcggtcagaccccggaagaaagggcctccgcctccccccccaaaaagaagcagctctgcgctggcctctgccaatctcgccgatgagccggtgcccgatgcggagccggaagacgggctgcttggggtaagagcccagtgcaggcgggccagcgatcttgccgggagcgtggataccggatcagccggatctgtgaaaagcatcgctgccatgcttgagctttccagcattggtggaggcggcagagcggctcggaggcctcctgaaggtcatccaaccccccgacccgcatcccctgagccagggcgggttgccactgtgcttgcatctgtcaaacacaaagaagccattggccccggtggagaggttgtgaacagaagaagaacgctctctggacccgttacagggctgttagccaccgcacgccgcgggccaggagagtccgccgatcccggaccttttgtggaggatggaactggcaggcagagacctcgaggtcccagtaagggcgaggccggcgtggaaggtccccccttggcaaaagtggaggctagcgcgactctaaagaggcgcatcagggctaagcaaaaccagcaagaaaatgtcaagttcattctgactgaatccgataccgtaaagcgtaggcctaaggccaaagaacgcgaagctggccctgaaccaccccccccactgagcgtgtatcacaatgggacaggcactgtgaggcgccgccccgcctctgagcaggctgggccccctgaattacctccccctcccccgcctgctgagccacccccgactgatctggcccatctgccaccattgcccccccctgaaggagaagccagaaagccagctaagccccctgtctcacccaaacctgtgctgacacagccagtgccaaagctgcaggggtccccaactccaacttctaaaaaggtcccgctcccgggacccgggtctccagaagtcaagcgggcacatggaacacctccacccgtttcgccgaagcccccccctccccctactgcccccaagccggtgaaagccgtcgcaggcctgccaagcggcagtgctggaccctcccctgctccgtcaccggcccgtcagccaccagcggcactagccaagccacctggcactccaccctcgctcggagctagcccagccaagccaccttctccgggagccccagcgctgcacgtgcccgccaagccccctagggcagcagccgccgcagctgcagccgctgccgcgccgcctgcgcccccagaaggcgcgagtcccggggactccgcccgacaaaaattagaggaaacaagcgcgtgccttgcagcggcactgcaagccgtcgaggagaagattcgtcaggaagacgcgcagggtccacgcgattccgctgcagaaaaaagtactgggtcaatcctggatgacatcggctctatgttcgacgatcttgccgatcagttagacgccatgctcgagtag

SEQ ID NO: 111007 - DNA, 2115 bp, Artificial Sequence
  Description of Artificial Sequence: Synthetic coding sequence
atgtgtgctgctctgctcgagccacgtccaggcgacgccaccgaccctaacgggactagccccctgcatcttgcggccaaaaatggccacattgatattataagactgcttcttcaggccggtatcgacatcaaccgccaaacaaagtcaggcacggccctgcatgaagcagccctctgtggcaaaaccgaggtggtccgactgttgcttgactcaggcatcaacgcacatgtccggaatacctactctcagactgcactggatatcgttcaccagttcaccacttctcaggcctcacgtgagattaagcagctgctaagagaagcgtccgcggctctgcaggtgcgcgccaccaaggattactgcaacaactacgatctgacatctctgaatgtaaaggcaggcgatatcataactgttctggagcaacatcccgacggccgttggaagggctgtattcacgataataggacagggaacgatagggtgggctacttcccttcgagtcttggagaggccatcgttaagcgggctggctctagggcaggtaccgagcctagcctcccacagggctccagctctagcgggcccagcgcacctccggaggaaatctgggtattacgcaagccatttgccggtggtgaccggagcggctccataagtgggatggcaggaggacggggttctggaggccacgccctccacgcagggtccgagggtgttaaattactggccactgtgctctctcagaagtcagtctcagaatcggggcctggggattccccggcaaaaccaccagagggttcagctggtgtggccagaagccagccacctgttgcacacgcaggacaggtttacggggagcaaccccctaagaagttagagcccgctagcgagggcaaaagcagtgaggctgtcagccagtggctgacagcgttccagctccagctgtacgcccccaacttcatcagtgccggctatgatctgccaactataagcaggatgacccccgaggatctcactgccatcggtgtgacaaagcctgggcatcgtaagaaaattgccgccgaaatttctggtcttagcataccagactggcttcccgagcacaagcctgccaatctggcagtgtggctcagcatgataggcctggcccagtattacaaggtcctggttgacaacggctatgaaaacatagacttcatcactgatataacgtgggaggatctccaggaaatagggatcactaaactgggccaccagaagaaactcatgctggccgtccgcaaactcgccgagctgcagaaggctgagtacgccaaatatgaaggtggacctttaagaaggaaggccccccagagcctggaagttatggcaattgagagccctccccctccagagccaaccccggctgactgtcaatcaccaaagatgactacgttccaagattccgaactctcagacgaattgcaggccgctatgacagggcctgccgaagtaggcccgaccaccgagaaacctagctctcacctgcctcccacaccacgagccacgacccgtcaagactcgagtctggggggccgggccaggcatatgtcatcatcacaggagttgttaggagacgggccacccggacccagctcccctatgtcccggagtcaggagtacctcttagacgaaggacctgcccctggtacacctccccgagaggcaaggcccggaaggcatggtcactcaattaaacgggcttctgtcccaccagtgcccggaaaacccagacaagtcctgcctcccggcactagccactttactccgccccagacccccactaaaacccggcccggcagtcctcaagctctgggcggtccccatggccctgctccagcgacagctaaagtgaaaccgactccccagctcctcccacccaccgaaaggccgatgtcccccagaagcttgccacagagtccaacccaacggaccgggccagggccagctcagaattgtcctagcggacgccccgcttccaggtctggcgctgctcagggaaccggtgaccaaggacagggtccacccgctccgcctcatcctcagaacataagttatcaagagtattag

SEQ ID NO: 111008 - DNA, 3609 bp, Artificial Sequence
  Description of Artificial Sequence: Synthetic coding sequence
atggggcgcgaacaggatctcatcctcgcagtaaagaacggcgatgttacgggagtacaaaagcttgtggccaaggtaaaggctaccaagaccaagctccttggaagcaccaaacggctcaatgtaaattatcaggacgccgatggtttcagcgcgctccaccacgcagccctggggggcagtctggaactaatcgccctgctgttggaggcccaagccacagtggacatcaaggactcaaacggcatgcgtcccctccactatgccgcctggcaaggtcgcctcgagcctgtgaggctgttactccgcgccagtgctgcagtcaatgctgcctctttagatggccaaattcccctgcacctcgcagcgcaatatgggcattacgaagtgagtgaaatgcttctccagcaccagtctaatccatgcctcgttaacaaagcaaaaaaaacccctctggaccttgcctgcgagttcggccgccttaaggtggcccagctgctcctgaactcccacctctgcgtcgccctgctggagggggaggccaaagatccgtgcgaccctaactacaccacacccttacacttagccgctaaaaatggtcatagggaagtcatcaggcagcttttaagggccgggattgagattaatcggcaaacgaaaaccggcacagccctgcacgaggcagcgttatacggcaagacagaggtggtaaggctgctgctggaaggtggcgtcgatgtaaatatccgcaacacgtataaccagacagccctggatattgttaatcagtttactacgtcacaagcatctcgcgaaatcaaacaactgctgcgggaagcttcaggaatcctcaaagtgagagcactcaaagacttttggaacttgcatgatccaactgcactgaacgtccgtgctggcgatgtgatcactgtgctagagcagcatcctgacggaagatggaagggtcatattcacgaaagccagaggggaactgaccgaattggttacttccctcccgggatcgtggaggtggtctcaaaacgtgttggaattcctgctgcgcgactcccttccgctccgacgcccctgaggccaggattctccagaacgcctcagccgccagcggaggagccgccccatccgctgacctattcccaacttcctagggtgggcctgtcacccgatagccccgcaggcgacaggaattcagtgggctcagagggttcagtcgggtctatcaggtccgcaggcagtggccagtcttctgagggcacgaatgggcatggtcctggcctgttgatcgagaatgcccagcctcttccttccgcgggtgaggaccaggtccttccaggcctgcatccaccctctttggccgataatctttcacaccgacctttggcaaactgtagaagcggcgagcaaatatttacacaggatgtcagacctgagcaactgcttgagggtaaggacgctcaggccatccataattggctatctgaattccagctggagggatataccgcccacttcctccaggcgggatacgacgttcctactatctcgaggatgacacccgaggatcttacagctattggtgtgacaaaacctggccaccgtaaaaagatcgcgagcgaaattgcacagctttctatagctgagtggctgccttcctacatccccacggacctgctcgagtggctatgtgctctgggccttccacaatatcataagcagctggtgtcttctgggtacgatagtatgggattagtcgccgatttgacatgggaagaactccaggagatcggtgtgaataaattgggacaccaaaagaaactgatgttgggcgtcaaaagactggcggagctgagacggggactgctccagggcgaggccctgtctgaaggaggcagacggctggcgaaggggcccgagcttatggccatcgagggccttgaaaacggggagggccctgcgacggccggcccccggctgcttactttccagggaagcgagctcagcccagagctacaggctgccatggccggtggcggacccgagccccttcctctgccaccagcccgcagcccctcccaggaatctatcggagctcgctcacgtggctccggccattcgcaggaacaaccagccccacaaccttcggggggcgatccttctccgccccaagaaaggaacctgccggaaggtaccgagcgcccccccaaactttgctccagtttacctggccagggcccccccccctatgtctttatgtacccacaggggagcccttcctctccagcacctggacctccaccgggggcgccttgggccttctcttacctcgccggccccccggctacccccccagaccccccccgaccgaaacgacgctcgcactcactgtcccggccaggcccaaccgagggcgacgcggaaggggaagctgagggtccggtgggcagcacactgggatcctacgctaccctcactagaaggccgggcagaagtgctctggtgcgtactagcccatctgtgacacctactccagccaggggcacccctcgcagccagtcattcgccctccgcgctaggcgcaaaggaccccctccaccgccccccaagagactttccagtgtatcaggtcctagcccagagccaccacccctggatgagtctcccggcccgaaggagggagccactggccccaggagacggacactgtcagaacccgctggcccgagtgaacccccgggacctccggcccccgctggacccgcgagtgacacagaagaagaggaaccaggtccggagggaactcccccgtcacgtggtagtagtggcgaaggcctgccctttgcagaagaagggaaccttactatcaagcagagacccaagccagctgggccccctccacgggagacaccagtgcctccaggcctggactttaatctcactgaatccgacacggtgaagaggaggccaaagtgtcgggagagagaaccactgcagaccgccctactggcctttggcgttgcatcagcaacccctggaccagctgccccactcccaagcccaacaccgggagaatcaccacccgccagcagtctgccccagccagaaccatccagtctgccagcacaaggggttccgacaccgctggccccttctccagccatgcagcccccagtgccgccctgccccggaccaggcctggagagtagcgcagccagtagatggaacggagaaacagaaccccccgctgcccccgcagcactgctgaaggtgcccggggcagggacagctcctaaaccagtgagcgtggcctgtactcagttagcattctcaggcccgaagttggcaccaagactcggacccaggcctgtgcctcctcccaggcctgaatcaacaggcacagtgggacccgggcaggcccagcaaaggctggagcaaacatcaagcagcctcgctgcagcccttagggccgcggagaaatcaattggaactaaggaacaggagggaacccccagcgcctccaccaagcacatcctggatgacatcagtaccatgtttgacgctctcgcagatcagcttgatgctatgcttgactag

SEQ ID NO: 111009 - DNA, 3363 bp, Artificial Sequence
  Description of Artificial Sequence: Synthetic coding sequence
atgaggcccctgcactatgcggcctggcagggtagactcgaaccagtgcggctcctccttcgggcttcagccgccgtgaatgctgcatccttggacgggcagatccctctgcatctggcagcccaatatggacactacgaggtgagtgagatgctgctgcaacatcagtcaaacccatgcctggtcaacaaggcaaaaaagacgccactcgatctggcgtgtgagttcggtagacttaaagtcgcacaactactgctcaattctcacctgtgcgttgctttgctggaaggggaagcaaaagatccttgcgaccccaattacacaacacccctgcacctggcagccaagaatgggcaccgggaagtgattagacagctgctaagggccggaatcgagattaacaggcagaccaaaaccggaaccgcccttcatgaggcagcactctacggcaagaccgaggtggtccgtttattgttagagggaggggtggacgtgaatattcgcaacacgtacaaccaaacagctctcgacatcgtgaatcaattcacaacttctcaagccagcagggagataaaacagttgctgagagaggcttccggaattctgaaagtcagggccctgaaagacttttggaacttgcacgatccaactgcactgaatgtccgagcaggcgatgtgattaccgtcttggaacaacaccccgacgggcggtggaagggacatattcacgaatcgcagcgcgggacagatagaatcgggtacttccctcctggtatcgtcgaggtggtgagtaaaagggtcggcatcccggcagctaggctgccatccgcgccaaccccgctgcgcccaggtttctcccgcacgccccaaccacctgcagaggagccacctcatccactcacttattcccagctgccaagagtgggtttatcccctgactccccagctggtgatagaaattccgtgggatccgagggttccgtgggtagtatccggtctgctgggtccggccagtccagtgaaggtacgaacggtcacgggcccggtctattaatcgagaatgcccagcctctaccctcagctggggaggaccaggtcctccccggattgcacccaccctccctagccgacaacctgtcccatcgacctttggcaaactgccgcagcggcgagcagatcttcacccaggatgtgcgcccggagcaactgctggaagggaaagatgcgcaggctatccacaactggctctccgagttccagttggagggctatacggcccacttcttacaggccgggtatgatgttccgactatttctcggatgaccccggaagatctcactgcaattggcgtgaccaaaccgggccatcggaaaaagatcgcgtcggagatagctcaacttagtatcgccgagtggctgccatcttacataccgaccgacctgctggaatggttatgtgccctgggacttccccagtaccacaagcagctagtatcctccgggtacgactccatgggcttggtcgccgacctcacatgggaggagttgcaggagattggtgtgaataagctggggcatcaaaagaaactgatgcttggcgtgaagcgccttgccgagctacgacggggtttactgcagggcgaggctctcagcgaaggcggacgtcggctcgccaaaggaccggagctgatggcgattgaaggactggagaatggggaggggccagcgacggcaggtcctagactgctcacctttcagggcagtgagctgagtcctgaattacaggccgcaatggccgggggcggcccagaaccactccccctgccgccggcccggtccccttcccaggaaagcattggcgctagatctcggggaagcggccactcacaggagcaacctgccccacagccatcagggggagacccatcaccaccacaggaaaggaacctccccgagggtacagaacgaccccccaagttatgctctagcctgccaggccagggcccaccaccgtacgttttcatgtacccccagggcagtcctagttcacctgcacccggtcctccacccggcgcaccctgggccttcagttatctggcaggccctcctgcaaccccgcctgaccctcctagacctaaaaggagatcccacagcctttcacgacctggacctactgagggggatgctgagggtgaggcggagggacctgtggggagcacgctaggctcgtacgcgactttgaccagacgacctggaagatctgctctggtccggactagtccatcggtaaccccgacacccgctagaggaactcctcgatcacaatcctttgcactgagggcccggcgtaagggccctcccccaccccccccaaagcgcctgagtagtgtgtcagggccctccccagaaccacctcctttagacgaaagccctgggcctaaggaaggtgccaccggaccacgcagacgcacactgagcgagcctgccggacccagcgagcccccgggaccacctgcccctgctggtcccgcctccgacacagaggaggaggagccgggtccagagggcaccccaccctcccgggggagctcaggagaggggctgccatttgcggaggaagggaatttgacaattaaacaacggcctaaaccagcgggcccaccaccccgggagactcccgtgcctcccggcctggacttcaacttgactgaatccgatacagtgaaaaggcggcctaaatgccgcgagcgggagcctctgcagactgcgttgctcgcattcggagttgcaagcgcgacccccgggcctgctgcaccattgccttcacctacccccggagagtccccacccgcctcctccctgccccaacccgaaccttcctctttgccagcgcaaggcgttccaactccacttgcccctagtccagctatgcagcctcctgtgcccccctgtcccggccccggtctagagtctagtgccgctagtcggtggaacggagagaccgagccgcccgccgctcccgccgcacttctcaaggtgcctggcgcagggaccgccccaaaaccagtgtccgtggcatgcacgcagctcgcattctccggtcccaaattagctccacgacttggcccccggcccgtaccaccgccgagaccagaaagtacagggaccgtaggtccaggacaggcccaacaacgactcgaacaaacaagctccagcctcgcagccgcgctccgggccgccgaaaaaagcattggtacaaaagaacaggaaggtactcccagcgcttccaccaaacatattctcgatgacatctctacaatgtttgatgcactagctgaccagttagatgctatgttggattag

SEQ ID NO: 111010 - DNA, 1026 bp, Artificial Sequence
  Description of Artificial Sequence: Synthetic coding sequence
atggctgatgagaaaccctctaatggggtcttggttcacatggtaaagctcttgattaagacatttctggacggcattttcgacgatctcatggaaaacaacgtcctgaacactgacgaaattcacctgattggcaagtgtcttaagttcgtcgtctcaaacgcagagaaccttgttgatgacatcacagagaccgctcaaaccgccggaaaaatatttagagagcacctttggaacagcaagaagcagctgtcgtccgacatctcctccgacggggagagggaagccaacatgccaggtctcaacatccgtaataaggagttcaactaccttcacaacaggaatgggagcgagctggacttattggggatgagagacttgctcgagaacttaggatacagcgttgttattaaagaaaatttaactgcacaggagatggaaactgctctccgccaattcgctgcgcatcccgaacatcagagctcagacagcacgtttctcgtattcatgtctcactctattttgaacgggatttgtggtaccaaacactgggaccaggaacccgacgtcctgcatgatgacacgatcttcgaaatatttaacaacaggaattgtcaaagccttaaggataagcctaaggttattataatgcaggcatgtagagggaatggagccggaattgtttggttcacgactgatagtggaaaggccggagcggatacccacggacgccttctgcaggggaatatctgtaacgatgccgtgactaaggcgcatgtggaaaaggatttcatcgcctttaagtcaagcacacctcacaacgtgtcatggagacatgagaccaacgggagcgtgttcataagccagataatttattacttccgggagtacagctggtcccaccatttagaggagatatttcagaaagtgcagcactccttcgagacccctaacattttgactcagctgcccaccatcgaaaggctgtccatgactcggtatttctacctgttcccaggtaattag

SEQ ID NO: 111011 - DNA, 1026 bp, Artificial Sequence
  Description of Artificial Sequence: Synthetic coding sequence
atggcagacgaaaagccctcgaatggcgtcctcgtgcatatggtgaaactattgattaagaccttccttgacgggatcttcgatgatctcatggagaacaacgtcctcaacacggatgaaattcatcttatcggtaaatgcttaaaatttgtggtgtctaacgccgagaacttagtggacgatattaccgaaactgcccagaccgcaggtaagatctttagggagcatctctggaattctaaaaagcaactatcctcagatatttccagcgatggtgaaagggaggctaatatgcctggactaaatatccggaataaagagttcaattacctgcacaataggaatggatctgaactggacttgctgggtatgagagatctcctggaaaatctggggtatagtgtggttatcaaggagaatctgacagctcaggagatggaaactgcactaaggcagtttgctgctcatccagagcatcaatcctcagattctacattcctcgttttcatgtcacacagtatccttaatggcatttgtgggactaaacactgggaccaggagccagatgtgcttcacgatgacaccatatttgagatcttcaataaccggaattgccagtccctcaaggacaagcctaaagtgatcattatgcaagcatgtcgaggtaatggagctggcattgtctggtttacaacagactctggcaaagccggagccgatactcatggccggctcctgcagggaaatatctgcaacgatgccgtgaccaaagctcacgttgaaaaagacttcattgcctttaagtcctccacgccacacaacgtttcttggcggcacgagaccaatggcagtgtgtttatctctcagattatctactattttagggaatatagctggagccaccacctggaagagatctttcagaaggtccaacatagctttgaaacaccgaatatccttacccagctgccgacaatcgaacgactcagtatgaccaggtacttttaccttttcccagggaattag

SEQ ID NO: 111012 - DNA, 834 bp, Artificial Sequence
  Description of Artificial Sequence: Synthetic coding sequence
atggagaacactgagaactccgtcgactccaagagcatcaagaatctggaacccaaaatcattcacgggagtgaatccatggactctggaatctctctggataattcctacaagatggattacccagagatggggctctgtattattatcaacaataagaacttccacaaaagtacgggaatgacaagtaggagtgggactgatgttgacgcagcaaatcttcgcgagacctttaggaatctgaagtacgaggttcgaaataaaaatgacttaaccagggaagaaatcgtcgaactcatgagagacgtctctaaggaggatcacagtaagcgatcctcttttgtttgcgttctgctcagtcacggagaagaaggcattatattcgggaccaacggtcctgtggacttaaaaaagatcacaaatttctttcgtggggatcggtgccggtcactgacagggaagccgaagcttttcattatacaggcctgccggggcaccgagcttgattgtggcattgagaccgattcaggagtggacgacgacatggcctgtcacaagatccccgtggaggccgactttctttatgcttattccaccgctcccggctactattcgtggcgcaactccaaggacggaagttggttcatccagtccctgtgcgctatgctaaagcagtatgcagacaagttagaatttatgcatatattgaccagggtgaataggaaggtggccacagagtttgaatcgttctccttcgatgctacatttcacgccaagaagcagattccatgtattgtgagcatgttgacaaaagagctctatttctaccactag

SEQ ID NO: 111013 - DNA, 471 bp, Artificial Sequence
  Description of Artificial Sequence: Synthetic coding sequence
atgagcgacgccttgataaaggtgagcatggaaaacaccgagaattctgtggattctaagagcattaagaatctggagccaaaaattatccacggatccgaatctatggattccgggatttccctggacaatagctacaaaatggactacccggagatggggttatgcattatcattaacaacaaaaattttcacaaatcgacgggcatgaccagccggagcggtacagatgttgatgcagcgaacttgcgggaaacattccgaaatctcaagtacgaggttcggaacaaaaatgatcttactagagaggagatcgtggagctgatgcgagacgtctcgaaggaagaccacagcaagcggtccagtttcgtgtgtgttctcctgtcccacggcgaggagggcattattttcggaacgaatggccctgttgatttgaagaacaacaagctgtttcagagaggaagtctttag

SEQ ID NO: 111014 - DNA, 354 bp, Artificial Sequence
  Description of Artificial Sequence: Synthetic coding sequence
atggagaacacggaaaatagcgtcgacagtaaatccatcaaaaatcttgaacctaagatcatccatgggtcagagtcaatggatagcggaatctccctcgacaattcatacaaaatggactatcccgaaatggggctctgcattattattaataataagaactttcacaaaagcacaggtatgaccagccggtccggcaccgacgtggacgccgccaacctgagagagacatttagaaatctgaagtatgaggttagaaacaagaatgacctcaccagggaggaaatcgtggaactcatgagggacgttagcaaggaagaccactctaagcggtccagcttcgtctgcgtgtag

SEQ ID NO: 111015 - DNA, 834 bp, Artificial Sequence
  Description of Artificial Sequence: Synthetic coding sequence
atggagaatacagagaattcggtcgatagcaagagtataaagaacctcgagccgaagattatccacgggagtgaaagcatggatagcggtatatctctggataacagctacaaaatggattaccccgagatggggctgtgcatcatcattaataataaaaactttcataaaagcactgggatgacgagcaggtctgggaccgacgtggacgcggcaaaccttagagagacctttaggaacctgaaatatgaggttcgcaacaaaaacgacctaacgagagaggagatagttgaattgatgagagatgtttcaaaagaggaccactccaagaggagtagctttgtgtgtgtgctgctgagtcacggggaagaagggataatatttgggactaatgggcctgtcgacctcaagaaaatcactaacttttttcgcggagaccggtgccggtcgttgaccgggaagcccaaactctttatcatacaggcatgccggggcacggagttggactgcgggatcgagaccgattccggcgtggatgacgacatggcctgccacaaaattccggtggaggcggactttctttacgcctactcgactgcgcctggctattattcttggaggaattcgaaggacggttcctggtttatacaatccctgtgcgccatgctcaaacagtacgccgacaaactggagtttatgcacatccttaccagggtcaacaggaaggtcgcaaccgaatttgagtctttctccttcgacgcaacgttccacgctaagaaacagatcccctgtattgtgtctatgcttaccaaggagctgtatttttatcactag

SEQ ID NO: 111016 - DNA, 966 bp, Artificial Sequence
  Description of Artificial Sequence: Synthetic coding sequence
atggcagactctatgcaggaaaaacagcgtatggctgggcagatgcttttgcaaacattttttaatattgaccagatctctccaaacaagaaagcccaccccaacatggaagccggccccccagaatcgggcgaatcaaccgatgctctcaagctgtgcccccatgaggagttcctgagactgtgcaaagagcgggccgaagagatttatcccatcaaggaacgcaataatcggacacgactggccctgatcatttgcaacaccgagtttgatcatctccccccgaggaatggcgctgacttcgatattacgggtatgaaagaacttctcgagggtctggactactctgtggacgtggaggaaaatctcactgctcgtgatatggaatccgcccttcgagcattcgctacgcgaccagagcataaaagcagcgactccactttcttggtcttgatgtcacatgggatcctcgaaggcatctgcggaacggtgcacgatgagaagaaacctgacgtgctcttatacgatacaatcttccagatattcaacaacagaaactgcctctccctgaaagacaagccaaaggtgattatcgtccaggcttgcaggggtgccaaccgaggcgaactgtgggttcgcgactccccagcgagtctggaggtcgcgtcaagccagagttctgagaatctcgaggaggacgctgtttacaaaacccacgtcgagaaagactttatcgccttttgctcatcaacaccccacaacgtgagctggagagactcaaccatggggtcaatctttatcactcaacttataacatgctttcagaaatactcttggtgttgccacctagaagaagtgttcagaaaggtacagcagagctttgagacaccccgggccaaggcgcaaatgcctaccatcgagagactctcaatgactaggtacttctacctattccctggcaactag

SEQ ID NO: 111017 - DNA, 213 bp, Artificial Sequence
  Description of Artificial Sequence: Synthetic coding sequence
atggagaaaaaagagtgccctgaaaaatcctccagcagtgaggaagaacttccgaggcgtgattctgggagctcacgaaatatcgacgcctcaaaactgataagactccaaggcagtcgcaagctgttggtcgataatagtattcgcgaattgcagtacactaaaacgggcatttttttccaagcagaggcttgtgttacgaacgatacctag

SEQ ID NO: 111018 - DNA, 3099 bp, Artificial Sequence
  Description of Artificial Sequence: Synthetic coding sequence
atgcccggcagagcggaggccggcgaagctgaggaggaggctggcgctgggagcgggtcagaagctgaggaagacgcgctgtgggagcgtattgagggtgtgcgccaccggctggcaagagctctgaatcctgccaagctgaccccttatctgaggcagtgtcgggtgatcgacgagcaggatgaagaggaggtgttgtccacatatagattcccctgccgggtcaaccgaaccggacggctgatggatattcttaggtgccgcggcaagcgaggatatgaggctttcttagaggctctggagttctattaccctgagcactttactctgctgaccggccaagaacctgcccagaggtgctccatgatcctggacgaggagggtccggagggcctgactcagtttttaatgaccgaagtgcgcaggctccgggaggccaggaagtctcaactgcagcgggaacagcaactccaggccagagggcgggtgctggaagaggagagggccggcctggagcagcgtctgagggaccagcagcaggcccaggagcgctgtcagaggttgagagaagattgggaggccggcagcctggaactcctgagacttaaggacgaaaattacatgattgccatgaggttggctcaactcagcgaagaaaagaatagtgccgttttaagatcacgtgatctgcagcttgccgtcgatcaacttaaactgaaggtttctcgactcgaggaggaatgcgctttactaagaagagccagaggtccccccccgggcgcagaagagaaagagaaagagaaggagaaagaaaaggaaccagacaacgtggatcttgtgagtgaattgagagccgaaaatcagaggctgactgccagcctgagggagctgcaggagggattgcaacaggaagcctcccggcccggggcccctgggtcagaacggatcctgttggatattctggaacatgactggcgggaggcgcaagattcccgacaggagttgtgccagaaactgcacgcagttcagggagagcttcaatgggctgaggagctgcgggatcagtatctccaggagatggaggatctccgcctgaagcaccgcacactgcagaaggattgcgacctgtataaacaccggatggctaccgtactggcacagctggaggagatcgagaaggaaagagaccaggctatccagagcagagataggatccaacttcagtacagccagagcctgattgagaaagatcagtaccgtaagcaagtgcgggggcttgaggcggagcgtgacgagctgctaacaactctgacaagcctagagggaactaaggcgttactagaggtccagctgcagagagcccagggcggcacctgtcttaaggcctgcgccagttcacattccctatgttccaacctctctagtacatggtccctatcggagtttcccagtcccctggggggccccgaggccactggagaagccgctgtgatgggaggaccagagcctcataactctgaggaggcaactgactctgagaaggaaataaatcgactttctattctcccattcccgcctagcgccggaagtatcttaagaaggcagcgggaggaagaccctgcgccccccaagcgctcattctcctctatgagtgacatcaccggatccgttactcttaagccctggagcccaggtctgagcagttcctcctcaagcgatagtgtgtggcctctgggcaagccagaaggcttattggctaggggatgtggcctggattttctcaacaggagcttggctataagagtctccggaagatcgccacctggcggcccggagccacaggataagggccctgacggattgagtttttatggggatcgttggtccggtgcagtggttcgtcgggtgctgagtgggcccgggtccgcgcggatggagccccgggaacaaagggttgaggctgcaggactggaaggagcctgccttgaagctgaagcccagcagagaacattgctctggaaccagggttcaacattgccctctctcatggactccaaagcatgccaatctttccacgaagccttggaagcttgggcaaagggtcccggggcggagccattctatatccgcgccaacctgacattacctgagcgcgctgacccacatgcgctctgcgtgaaggcccaggaaattctacggctggtcgattcagcctataagcggagacaggagtggttttgtacccgtgtcgaccctcttaccctccgtgatcttgacagaggcacggtgcccaactaccaacgggcgcaacagctgctcgaagtgcaggaaaaatgccttcccagttcccggcatcgcggccctcgcagcaatctcaaaaagcgcgccttggaccagctgaggctggtccgcccgaagccggtcggggctccggcgggtgacagtccagatcagctcctcctggagccgtgtgcagagccggagagaagtctgcgtccttactctctggtacgacccctcctggtgagcgctctgcggcccgtcgtgctgttaccggagtgcctagcccccaggcttatccgaaatctcctagatctgccctcttcccggttggacttccaagtttgccccgcggaatctctgtccggggaggagctttgtccgtcctccgcccccggcgctcctaaggcccagccagctacccccgggctgggcagcagaattagagctattcaggagtccgtgggcaagaaacactgcctcctggaacttggtgctcggggggtccgcgagctggtgcagaatgaaatctacccaatagtcatacatgtggaagttaccgagaaaaacgtgcgcgaggtcaggggactgttgggacggcccgggtggcgagatagcgagcttcttcgccaatgtaggggtagtgagcaggtcctttggggtcttccttgtagctgggttcaagtgccagcacatgagtggggccatgcagaggaacttgcgaaagtggtccgcgggcgcattcttcaggagcaagctagactcgtgtgggtcgagtgtgggtctagtcgtggttgtcccagcagctccgaagcttag

SEQ ID NO: 111019 - DNA, 3099 bp, Artificial Sequence
  Description of Artificial Sequence: Synthetic coding sequence
atgccaggacgcgcagaagccggcgaggcagaggaggaggcaggggccggttcagggagcgaggcagaggaggatgcgttgtgggaacggatcgagggggtgaggcacagactggcaagagctctgaatcctgcaaaactgactccatatctgcggcaatgccgtgtgatcgacgagcaggacgaagaagaagttctttcaacgtatagattcccatgcagagtgaatcggacaggccgcctgatggacattttgaggtgtcgcgggaagcgaggatacgaagcattcctggaagccttggaattttactaccctgagcattttacactgcttaccggtcaggagcccgcacaacgatgtagcatgatcttggatgaagagggacctgagggtctcacgcaatttctgatgactgaggtgagaagactgagagaggcaagaaagtcccaactacagagagagcaacaactgcaagcccggggaagagtcctggaagaagagcgggccgggctggagcagcgcttacgcgaccaacagcaggcacaggagaggtgccagcgtttgcgggaagattgggaggctggaagcctggagctgctgcggctaaaagatgagaattacatgatcgccatgcgccttgcacaactctctgaggaaaaaaacagcgcggtgctgagatcccgagacctgcagctggcagttgatcaactcaaattgaaggtgtcgaggctggaggaagagtgtgcattgctccgccgcgcaagagggccaccgcccggcgccgaggaaaaagaaaaggaaaaggagaaggagaaagagccagataacgtggatcttgtttccgaactgagggcggagaatcaaaggctgactgcttcactccgggagctgcaggaaggattgcaacaagaagcctcaaggcccggcgcgcctggtagcgagagaattttactcgacattctagaacacgattggagggaagcccaggactcacgtcaggaactgtgccagaaacttcacgcagtccagggtgagcttcaatgggcagaggaactgcgggatcagtacctgcaggaaatggaagacctacgcctgaaacacaggactctgcagaaagactgtgacctgtataagcatagaatggcgacagtgctggcacagctagaggaaatcgagaaggagagggaccaagcgattcagagcagggataggatccaactgcaatattcacagagcctgattgagaaagaccagtaccgaaaacaagtgcgggggctcgaggccgagagggacgagttactcaccacactaacatctctggaaggcactaaggccctgctcgaggtgcaattgcaaagagctcagggggggacctgtctgaaggcatgtgcttcttcccactccttgtgctccaatctgtcctccacatggtcgctttccgaatttccaagccccctgggcggtcccgaggctacgggagaagccgccgtcatgggaggtccagaacctcacaattctgaggaggctaccgactccgagaaggagattaatcggctgtccattctgcctttccccccttccgcgggcagtatactgcggaggcagcgtgaagaagatcctgctccacctaagagaagcttctcctccatgtctgatataacaggctcagtcaccctcaaaccttggagcccagggctctccagctcgtctagtagcgactcagtttggccactggggaagcccgaaggtctgcttgcccgcgggtgcggactcgactttctcaaccgatctttggctatccgtgtctccggaagatcacccccaggaggcccggaaccgcaggacaagggccctgacggcctgtctttttatggagacagatggtctggtgcagttgtcagaagagtcctgagtgggcccggctctgcccggatggaaccacgagagcagcgggttgaggcagcaggactggagggggcatgtctagaggcagaggcgcagcagaggacactgttgtggaatcagggatctacactgccgagcctcatggattcaaaagcctgtcagtctttccacgaagctctcgaagcttgggcgaagggcccaggcgccgagcctttttatatcagggccaacctcacactgcccgaacgggccgaccctcatgccctgtgcgtaaaggctcaagagatcttgagactggtggactccgcatacaagaggagacaggaatggttctgtacccgagtggatccccttaccctgcgggacttagatagaggcaccgttcccaattaccagcgcgcccaacagttactggaggtacaggaaaagtgcctgccatcttcccgccaccggggtcccagaagtaatcttaagaagagagccctcgaccagctacggcttgttagaccaaagcccgttggggctccagctggggattctcccgaccaactcctcttggaaccatgcgctgaaccagagagatccctgcgcccctatagtcttgtgcggccactgctcgtaagcgcactgcgcccagtggtgctcttgcctgaatgtctcgctccgcgcctgattaggaacctgcttgacctgccgtcgtcaaggctagatttccaggtttgtcctgccgaaagcctcagcggggaagagctgtgcccctcttcagctcccggcgctccgaaagcacagcccgcgacccccgggctggggtcgagaatcagagctatccaggaaagcgttgggaagaagcattgtctattggaattgggagccagaggcgtgcgcgaacttgtgcagaacgagatctacccgatcgttatacacgtcgaggtgactgaaaagaatgtgcgcgaggtaagaggcctgctgggtcggcccggttggcgagattccgaactgttacgacagtgtaggggtagtgaacaagtcctttgggggctgccctgctcctgggtacaggtcccagctcacgagtgggggcatgccgaggagctcgccaaagttgtgcggggtcggatcctgcaggaacaggccagactagtgtgggtggagtgcggctcttccagagggtgccccagctcaagtgaggcttag

SEQ ID NO: 111020 - DNA, 2241 bp, Artificial Sequence
  Description of Artificial Sequence: Synthetic coding sequence
atgggtgttggcgttggactcggaaacggcctgagactgctgccttggatggaggccagtcgccccggcgcccctggaagcgaaagaattctgctggatatactcgagcacgattggagggaggcccaagattcccgtcaggagctttgccaaaagttacacgcagtgcaaggggagttacaatgggcagaagagctgcgggatcagtatttgcaggagatggaggacctccgactgaagcatcggacattgcagaaggactgtgacctgtataagcacaggatggccaccgtgttggcccagctagaagaaatagagaaagaacgggatcaggccatccagtcacgggatcggatccagctacaatatagtcaatctcttattgagaaagaccaatatcggaagcaggtaagagggctggaggccgaaagggacgagctgctcaccacactgactagcctggaaggtactaaggccctgctggaggtgcagttacagcgggctcagggaggcacttgtttgaaggcctgtgccagctcacattccttatgctccaatctgtccagcacctggtcactttccgagtttccatcccctttaggcggccctgaagccaccggcgaggcggcggttatgggcggaccagagccacataacagcgaggaggcaaccgactcagagaaagaaattaaccggctgtccattctgcctttccctcccagtgccggttcaattttgcgacgtcagagggaagaagaccccgcccccccaaagaggtcctttagctctatgtccgacatcactgggagtgttaccctgaaaccttggagccctggcctatcatcaagttcaagttctgacagcgtctggcctctggggaaaccagaaggcctgctggccagaggatgtgggctcgattttttaaatcggagtctggccatacgggtgtcgggccggtctccacctggcggccccgagccgcaggataaggggcctgatggcctgagcttttatggagaccgctggtccggagcggtggtgcgcagagtactgagcggacctggctcggcaaggatggaaccgagggagcagagggtagaggctgccggccttgagggagcatgtctagaggctgaggctcagcaaaggactctgttgtggaaccagggtagcactctcccctcccttatggattctaaagcctgtcagagctttcacgaggctctggaggcatgggcaaaaggaccaggcgctgaacccttctatattagagccaatctcacgctgcctgaaagagctgatcctcacgccttgtgtgtgaaggcccaggaaatcttgaggctagtcgactccgcctataaaaggagacaggagtggttctgtactagagtggatccgctcactttgcgcgacctggatcgcggcaccgtgcccaactatcagagagcgcagcaattactggaggtgcaagagaaatgcttgccatctagcagacaccgcggtcccagaagtaacctgaagaaacgagcactggatcagctgcgattagtacggcctaagcctgtaggagcacctgccggagactcacctgatcagcttttgctggaaccttgtgccgagcctgaacgctcactccggccatactctttagtccggcctttgctggtctccgctttgcgcccagtcgtgctactgcccgaatgtttagcacctcggctaatccgtaacctcctggacttgcccagtagccgcctggattttcaggtgtgccccgcagagtctctgagtggggaagaactgtgccctagcagtgcacctggcgcccctaaagcccaacccgccacccccgggttgggctcaaggatccgcgccattcaggagagcgtcggcaaaaaacactgtctgctggaacttggcgcgcgcggagtgcgggagttggtgcaaaacgagatttacccaatcgttatccatgtagaagtgactgagaaaaatgtgcgcgaggtcagggggcttctgggacggccaggctggcgcgactctgaactgcttagacagtgccggggtagcgagcaggtgttatggggtctgccatgcagttgggttcaggtccctgcgcacgagtggggacatgccgaagaattggcaaaggtcgtgcgcggtcgtatactgcaggagcaagccaggctggtatgggtggaatgtggaagttctagaggatgtcccagtagcagcgaagcttag

SEQ ID NO: 111021 - DNA, 1443 bp, Artificial Sequence
  Description of Artificial Sequence: Synthetic coding sequence
atggaagatctccggcttaagcaccgtaccctgcagaaggactgtgacctttacaagcatagaatggcaacggttttagctcagcttgaagagattgaaaaggaacgggaccaagccatccagagtagggacaggattcagctgcagtactcccagtcgttaattgaaaaggatcagtacaggaagcaggtgcgaggcctggaagctgaacgagacgaactattgaccacactcacttcactggagggaacaaaggctctcctcgaagtgcagctccagagggcgcagggtggcacctgcctaaaggcctgtgcaagcagccactcgctatgcagcaacctgagtagcacatggagcctgtccgaatttccatctcccctgggcggacccgaggccaccggggaagctgcagtcatggggggcccagagcctcacaatagcgaagaagccactgattccgaaaaggagattaatagattaagcattctgccatttccaccgagcgctggctccatcctccgacgccaacgcgaggaggatccagcccctcccaagcgcagttttagctcaatgagtgatattaccggatctgtcacactgaagccctggtctccaggcttgtcctcaagctcgagtagtgactctgtgtggccacttggcaaaccagaaggacttcttgctcgcggctgtggcctggacttcctcaaccgctcccttgctattagagtgtcagggcggagcccgcctgggggcccagaaccacaggataaaggacctgacggcctttcattctatggtgatagatggtcaggagccgtggtcagacgtgtgctatccggtccaggtagcgcgagaatggagcctcgagagcaaagagtggaagctgctggattagaaggcgcctgtcttgaagctgaagcccaacagaggacattgctgtggaatcagggcagcactctgccaagtctgatggactcaaaagcctgccagagcttccacgaagccctagaggcctgggctaaaggaccgggtgccgaacctttctatattcgggcaaacctgactctgccagaacgggctgacccccacgcactttgtgtgaaagcacaagagattctacggctcgtggattctgcgtataagaggcggcaagaatggttttgtacccgcgtggatcccctgaccttaagagacctcgaccgtggcacagtcccgaactaccagcgggcacagcaattgctggaagtgcaggagaagtgtttaccctccagcagacataggggaccacgcagtaacctgaaaaagagagctctggatcagctgcgcctggtacggccaaagccagtgggggctccggccggagactcacccgaccagctcctactggagccatgtgctgagcctgagcgcagcctgagaccctattccctggtcaggccctag

SEQ ID NO: 111022 - DNA, 222 bp, Artificial Sequence
  Description of Artificial Sequence: Synthetic coding sequence
atgccagggggcggtcctgagatggacgattatatggagactctcaaggacgaggaagacgccttgtgggaaaatgtcgagtgtaatcgccatatgttaagccgttacatcaacccagctaagctgactccctatctacgtcagtgcaaagttattgatgagcaggacgaagatgaggtattgaacgcgcctatgttgccaagtaaaattaacagagcgtag

SEQ ID NO: 111023 - DNA, 3465 bp, Artificial Sequence
  Description of Artificial Sequence: Synthetic coding sequence
atgcctggaggggggcccgagatggatgattatatggagactttgaaagatgaggaagacgcgctttgggaaaatgtggaatgcaacagacatatgcttagccggtacatcaacccagcaaagctcaccccataccttcgccagtgtaaagtgatcgatgaacaggatgaagacgaggtgcttaatgcacctatgctcccatccaagattaatcgtgccggtaggcttctggacattctgcataccaagggtcagcgcggatacgtggtgtttctggaatccttagagttctactaccccgagctttataaactggttaccgggaaagagcctacccgccgatttagtactattgtggtagaagaaggccatgagggattgacacactttctcatgaacgaggttatcaaactgcaacagcagatgaaagctaaagatcttcaaaggtgtgagttgctcgcccgattaagacagctggaagacgaaaaaaaacaaatgactctgacccgcgtagaacttctaaccttccaggagaggtactacaaaatgaaggaagaacgcgattcttacaatgacgagctggtcaaggtaaaggacgacaactataatttggctatgcgctacgcccaactctcagaggagaaaaatatggccgtgatgcggtcccgcgatctccaactggaaatagaccagcttaagcacagactcaacaaaatggaagaggagtgtaaactggaacgaaatcagtccttgaagcttaaaaacgatatcgaaaacaggcccaagaaggaacaggttctagagttagaaagagaaaacgagatgttgaagacaaagaaccaggaactgcagtctatcattcaggccggaaaaaggtccctacctgattccgacaaagccattctcgatattttggaacatgaccgcaaagaggctctcgaggataggcaggagctggtgaataggatctataatctccaggaagaggcgcgccaggcagaagagctgcgagataaatacctcgaagagaaagaggatcttgaattaaagtgcagtacactcggcaaagattgcgaaatgtacaaacaccgaatgaacactgttatgctgcaactcgaagaggtggaaagggaacgcgatcaggctttccactccagggacgaggcacagacacagtactcgcagtgcttgatcgagaaagacaaatatcgcaagcagattagagaactggaagaaaagaacgatgagatgcgcatagaaatggttcgtcgcgaggcatgtatagtgaacttagagtccaaactgcggcgcctgagcaaggattcaaacaacctcgatcagtcactccccagaaacctgcccgtcacaattatctcacaagattttggggatgcttccccaaggactaacggacaggaggctgacgatagtagtacgtcagaagagtcaccagaggattccaagtacttcttaccctaccatcctccccagagaaggatgaatttaaagggcatccagctgcaaagggccaagagccctatcagtctgaagaggactagcgattttcaggcgaagggacacgaagaagagggtacagacgcttctccttcttcctgcggcagcttgcccattactaactcatttaccaagatgcagccacctcggagtagaagctctattatgtctatcacagccgagcccccgggaaacgactcaatagttcgccgttataaagaggacgccccacatcgaagcacagtcgaggaggataacgattctgggggatttgatgccctggacctggacgacgactcccatgagagatactcctttggcccgagctcaatccattcctcctcctcctctcatcagtccgaggggttggacgcctacgacctggagcaggtaaatctgatgttccgcaaattctctctggaaaggccttttcgccccagcgtaacttccgttgggcacgtccgcgggcccggcccatcagtgcagcatacaaccctgaatggcgactctctcacaagtcaactgacacttctgggaggcaacgcccggggcagcttcgtgcatagtgtgaagcctgggtccctagccgaaaaggccggcctccgggagggacaccagttgctcctgttagaaggttgtatacggggcgagaggcaatctgtgcctctggatacttgtaccaaagaagaggcacattggacaatccagcggtgctctggtcccgtgacactgcactacaaggtcaaccatgaaggttataggaaactagttaaggatatggaagatgggcttattacctccggggatagcttttatattcggcttaatctgaatattagtagccagcttgacgcctgtacaatgtccttgaagtgcgacgacgtggttcatgtgcgagacaccatgtaccaggacagacacgagtggttgtgcgcacgggtcgaccccttcactgatcacgatctggatatgggcaccatcccaagttattcaagggctcagcaattgttattggtaaaactgcagaggcttatgcaccgcggttctcgggaagaggtggatggcacccaccacactctgcgcgcgctgcggaacacactgcagcccgaggaggccctgagtacttccgatccccgcgtctcacctagactaagcagagcctccttcctgttcggacagcttctgcagtttgtttccagatcggagaacaagtacaagcggatgaacagtaacgaacgggtgaggattatctcagggtcacctctcggctcacttgctcgcagtagtctggatgcaaccaaactactaacagagaaacaagaagagcttgatcccgaatctgagctcggcaagaacctcagtctcattccttactctctggtaagagccttctattgcgagcgccgaaggccggtgctgttcacccccaccgtgttggctaaaactctcgtgcagagactgctgaattcaggcggggccatggaatttactatctgcaagtctgacattgtcactcgggacgagtttctgcggcggcagaaaacggaaacgattatttactcccgggagaaaaaccctaacgcctttgagtgtattgccccggctaatatcgaagccgtggcagcaaagaataagcattgccttctagaggccgggatcggatgtacgagagacctgataaaaagcaatatctaccccattgtcctattcatccgcgtatgcgaaaaaaatatcaaacggtttagaaagctgctacccagaccagagaccgaagaagaatttctacgcgtgtgcaggctgaaagagaaagagctcgaggcgctgccctgcctctatgccactgtcgaacccgatatgtggggaagtgtggaggagctgctgagggtcgtcaaggataagatcggagaggagcagcgcaaaacaatctgggttgacgaggatcagttatag

SEQ ID NO: 111024 - DNA, 3114 bp, Artificial Sequence
  Description of Artificial Sequence: Synthetic coding sequence
atggctacagaaagtaccccgagtgagataatagagagggaaaggaaaaagttgttagagattcttcagcacgaccccgacagcatcctggacaccctgacttccagaagactcatttctgaggaagagtatgaaacgctggaaaacgttactgatttgttgaagaaatcccgcaagctcctgatattagtacagaagaaaggggaggcgacgtgccagcactttctaaaatgtttgttttccacttttccacagagtgcagcgatttgcggcttgaggcatgaagtcctgaaacatgaaaacacagtgcctccacaatccatgggggccagctctaatagcgaggatgctttctctcctgggatcaagcagcccgaagctccagagatcacggtcttcttctcagaaaaagaacacctcgacctggagacctccgagttctttagggacaagaaaacaagttatcgagaaacagctttgagtgcgaggaagaacgaaaaggagtatgatacgcccgaagttaccctgtcttacagcgtagaaaaggtcggctgtgaagtaccagccaccattacttatatcaaggacggccagaggtacgaagagttagatgattcactttacctggggaaagaagagtacctggggagcgtggataccccagaggacgctgaggctactgtggaggaggaggtgtacgatgatccggaacacgtaggctacgatggagaggaggatttcgagaactccgaaaccaccgaatttagcggtgaagagccctcttacgaagggagcgagacaagcctaagtcttgaggaagaacaagagaaaagcattgaggagcgcaaaaaagtgtttaaagatgtcctcctgtgcctgaacatggaccggtctaggaaggtcctccccgacttcgttaagcagtttagtttggatcgtggctgcaaatggacacccgaatcccccggcgatttggcttggaacttcctaatgaaggtccaagcccgcgatgttacggcacgcgacagtattcttagccataaggtgctggatgaggactccaaagaagatctgttggcaggcgtcgagaatctcgaaattcgcgacatacagaccataaatccattggacgtcttatgtgccaccatgctatgctccgattcatccctacagcgacaggtgatgtctaacatgtatcaatgtcagttcgcattgccccttttgctgcctgacgctgaaaataataaatccatcctgatgttgggggccatgaaggacatcgtgaagaagcagagtacccagttttccgggggtccgactgaggataccgagaagtttctaacgctgatgaagatgcctgtcattagcttcgtcagacttggctactgtagttttagcaagtccagaatcctgaatactctgctgtctccagctcagcttaaattacataaaatattcctgcatcaggacctccccttgctggtgctgccgcggcaaatctccgatggactagtggagattacttggtgtttccctgactcagacgacagaaaggaaaacccatttttccagaagccggtggcactagcgaatctgcgcggtaatctggagtctttttggactcagttcggattcttgatggaggtcagttccgctgtgtttttctttactgactgtctcggggagaaggaatgggatctcctcatgtttctcggggaggccgccattgagagatgctatttcgtcctgagcagccaggctagggagagcgaggaggcgcaaatattccagcggattctgaacctcaaaccggcccagcttttgttctgggagaggggcgacgccggtgatcgccggaaaaacatggaagggctgcaagccgcacttcaggaggtgatgttctcttcttgcctcaggtgtgtgtcagtcgaagacatggcggccctggcacgcgagctgggaatacaggttgatgaggacttcgagaacacacagaggattcaggtttcctccggggagaacatggcaggcacagctgagggagaaggccagcagaggcatagtcaactgaaaagttcatccaaatctcaggcgttaatgcctatccaggagccaggcacccagtgtgaactgagtcagaatttgcagaatctgtacgggacccctgtattcagacctgttctcgaaaattcatggctctttcctaccagaattggaggtaacttcaatcatgtgtcattgaaggcatcttgggtcatgggtagaccattcggaagtgaacagagacctaaatggttccaccccctcccgttccaaaatgcgggagctcaggggaggggcaagtctttcggtatccaaagttttcacccccagatcttctacagcggcgagagatttatgaagttcagtcgcgttgcaagggggtgtcattccaacggtacgtttgggcggctgcctaggccaatctgtcagcatgttcaagcatgtcccgaaagaccccaaatgatgggcaccctggaacgcagtcgagctgtagcgtctaagatcggtcactcctactccttggactctcagcccgccagggctgtcggtaagccatggccccagcaagcgtgtacacgagtgacagaacttacagaggcaaccggaaaactcatccgaacgagccacattgggaagcctcacccccagtcttttcaaccggcagcagcgacccagaagctgcggcccgcgagccagcaaggcgtgcagatgaaaacccaaggcggggcttctaatccggctttacagataggaagtcaccccatgtgcaagtcctcacaatttaagtcagatcagtcgaaccccagcactgtgaagcactctcagcccaagcctttccattccgtaccttcccaacccaagtcctcccagacaaaaagctgtcagtcccagccctcgcagacaaaaccctcgccatgcaaaagcacccagcctaagccgagtcagccatggcctcctcagtctaagcctagccaaccaagacctccacagcccaagagctcctcgacgaaccctagccaggccaaggcccaccatagtaaggccggtcagaaacgtggcgggaaacactag

SEQ ID NO: 111025 - DNA, 933 bp, Artificial Sequence
  Description of Artificial Sequence: Synthetic coding sequence
atggctacggagtctacaccaagcgagatcatcgaaagagagaggaaaaaactgctcgaaattctccagcatgaccccgactctatcctggacacactgacctcgcggagactcatctctgaagaggagtacgaaacgctggaaaatgttactgatttactgaaaaaatccaggaaattgcttattctagtgcagaaaaagggcgaggccacttgtcagcattttctaaaatgccttttctccacctttccacagagcgctgccatctgcggattgcggcccgaagtgttgaagcatgagaataccgtgcccccccaaagcatgggggcgtcttccaattcggaagacgccttcagccccggtatcaagcagcccgaggcaccagaaattactgtcttcttctccgagaaggaacacttagacctggagaccagtgagtttttccgcgacaaaaagacctcttaccgcgagactgccctctcggcgcgtaagaatgagaaagaatatgacacaccagaggtaacattgtcttacagcgtggaaaaagtgggctgtgaagtaccagccactatcacttatattaaagatggtcagcgttacgaggagctggatgactccctgtacttgggtaaagaagagtacctggggagtgtggatacccccgaggatgccgaggctacagtcgaagaagaagtgtatgatgaccccgaacacgtcgggtacgatggcgaggaagacttcgaaaattcagagaccacggagttctctggcgaggaaccaagctatgagggttctgaaacaagcctgagtctggaggaggaacaagaaaagtctatcgaagggtggtccaggactcacggactgaagcggtcttcccacgtaggcctgcctaagtgctgggactaccgaagagaacccccctgtttagcttag

SEQ ID NO: 111026 - DNA, 1446 bp, Artificial Sequence
  Description of Artificial Sequence: Synthetic coding sequence
atggccactgagtccacaccctcagaaatcattgagcgcgaacgcaagaaactcctggagatcttacagcatgatcctgactcaatcttagacactctgacttccagaaggctcattagcgaggaagagtacgagaccttagaaaatgtgactgatctgcttaaaaaatccaggaaattgctgatcctggtgcaaaagaagggcgaggcaacatgccagcactttctgaagtgtctcttcagtacctttcctcagagcgccgctatatgtggcctgcgacatgaggtcctgaagcatgagaacactgtcccgcctcagagtatgggtgcatctagcaatagcgaggatgccttcagtcctgggataaagcaacctgaggcccctgagattacagttttcttctcagagaaggagcacctcgatctggagacaagcgaattctttcgcgacaaaaaaacctcttaccgggaaaccgctctcagcgccagaaagaatgagaaagagtacgatacaccggaggtgacgctgtcctactccgttgagaaggtaggctgcgaggtcccagcaaccatcacatatattaaagatggtcagcggtatgaagaactggatgactccctttacctggggaaagaggaatatctgggtagcgttgacactcctgaggatgccgaagccaccgtggaagaagaggtctatgatgacccagagcatgtgggctacgatggcgaagaagattttgaaaattcagaaacaaccgaattttccggagaagagcccagttacgagggttccgaaacttcactttctctcgaggaggaacaggagaaaagtatcgaggagcgtaagaaggtgttcaaagatgtactgctctgcctgaatatggaccggtccagaaaggtgctcccagactttgtcaagcagttctcgctcgaccgcggttgcaaatggactccggagtctcctggcgacctggcctggaactttctcatgaaggtgcaagccagagacgttacagctcgagactctattctttcacacaaggttctcgacgaggattctaaggaggatctgctcgctggtgtagagaaccttgaaatacgcgacatacagactataaacccattggacgtcctgtgcgccacaatgctgtgctctgatagcagcctgcagcggcaagttatgtccaatatgtaccagtgccagtttgcccttcccctgcttctccccgacgcggagaataacaagagcattctgatgctgggtgctatgaaagacatagttaagaaacaaagcacccagttctccgggggaccaacagaggatacagagaaattcctaaccctgatgaagactttaaaaaccctgagagagttcaagttccctctcgagaaaacttggctgggacaactcaaagtgcgggtctccaaggatactgtgagttag

SEQ ID NO: 111027 - DNA, 570 bp, Artificial Sequence
  Description of Artificial Sequence: Synthetic coding sequence
atggtgctggagcaccctgcccgagtggaaccattttacgcggtgctcgagtcacccagctttagtctgatgggtatcctactcagaatcgcctctggcacccgactgagcatccctatcacttctaatactttgatctactatcatccacacccagaagatatcaagttccacttgtatcttgtgccaagcgacgccctgctgaccaaggcaattgatgatgaggaggaccggttccatggggtgcggctccagacgagtcctccaatggaacctttgaacttcgggagttcctacattgtgagcaactctgccaacctgaaggtgatgccgaaggagttgaagctgtcctatagatcccccggcgagatacaacatttctcgaaattttacgccggccagatgaaagagcccatccaacttgaaatcacagagaagagacatggcacccttgtatgggacactgaagtgaagccagtcgacctgcagttagtcgccgcatccgcccctccacccttttcgggcctgctctggcagcgccagccccttaatcccccacctgcccggtag

SEQ ID NO: 111028 - DNA, 1296 bp, Artificial Sequence
  Description of Artificial Sequence: Synthetic coding sequence
atgatgcggcagcgccagagtcactactgttcagtgctgttcctgtctgttaattatctgggaggcacctttcctggcgatatctgttccgaagaaaatcagatagtgagctcttatgcctctaaggtgtgtttcgaaattgaggaggattataagaatagacagtttctcggcccagagggaaacgtggatgtggaactgatcgataagagcacgaataggtactcagtatggtttcccactgccggctggtatttgtggtctgcaaccggattgggctttttggtgagagacgaggttacagtcaccatcgctttcggctcctggtcccagcatcttgcccttgatctgcagcatcatgaacagtggctggtgggggggcccttgtttgacgtgaccgccgaacccgaagaggccgtagctgaaattcacctgccacattttatttcgctgcagggagaagtcgacgtctcatggttcctcgttgcacactttaagaatgaggggatggtattagaacaccctgctcgtgtggaacctttctacgctgtgctggaatccccctccttctctctgatgggtatcctgctacggatagcctctggcacccggctgtcaattcccattactagcaataccctcatatactaccatcctcaccccgaggacattaaatttcacctgtaccttgtccctagtgatgcccttctgacgaaagccatcgacgatgaggaagaccgctttcacggcgtccgacttcagacatctccccccatggagccactgaacttcggatcttcctatatcgtcagcaacagcgcaaacctcaaagtcatgccgaaagaactcaaactatcctatcgctcacctggagaaatccagcacttctccaagttctatgcagggcagatgaaagaaccaattcaacttgagatcactgaaaagcggcatggcacgctcgtttgggatacagaggtgaagcccgtggacttacagctggtggctgctagcgcgccgccacctttcagcggcgcagctttcgttaaagagaatcacaggcaattgcaagcgaggatgggagatctgaaaggagttctggatgaccttcaagataatgaggtgctgaccgagaacgagaaggaactcgtggagcaggaaaaaacccgccaatccaaaaatgaagcactgctgagcatggttgagaagaagggcgacctggccctggacgtactattccggtccatctcagagcgagatccatatttggtgtcataccttaggcagcagaacctctag

SEQ ID NO: 111029 - DNA, 1614 bp, Artificial Sequence
  Description of Artificial Sequence: Synthetic coding sequence
atggagaagaaggagtgtcctgagaagtcgagcagctcggaggaggaactgcccaggagagattctggctcttctcgcaatattgatgcttccaaactcataaggctgcaggggtcgagaaagctgctcgttgacaattctattcgggaactgcagtataccaaaactggaatctttttccaggccgaagcatgcgtgaccaacgacacagtctatcgggaactaccatgcgtgtctgaaaccttgtgcgacatcagtcactttttccaggaggatgatgaaacagaagccgagccgttgctgttcagagcagtcccagagtgtcaacttagcgggggggacattccatcggtatcggaggagcaggagtcaagtgaggggcaagattccggggacatctgttcagaagagaatcaaatagtaagttcatatgcgagcaaagtttgctttgaaatagaggaagactacaagaatcgacaatttctgggccccgaaggaaacgtagatgtggaactgattgacaagtctactaacaggtattcagtttggttccccacagctggttggtacttgtggtcggccacagggctcggctttctggtgcgtgatgaagtcacagtgactatagcatttggttcttggagccagcacctcgccctggacctgcagcaccacgagcaatggcttgtgggcggcccgctgtttgatgttacagccgagccggaagaagctgtggccgagatccatcttccgcactttatcagccttcaggcaggggaggtcgatgtatcgtggttccttgtcgcccacttcaaaaacgaggggatggtcctggaacacccagctagggtcgagccattttatgcagtactcgagagcccgtcgttcagcctgatgggcattcttcttagaatcgcctcgggcactaggctttcgataccaataacatctaacacactgatctattaccacccccatccagaggatattaaattccacctctatcttgtaccaagcgatgcactgttgaccaaggccatcgacgacgaggaagaccgatttcacggtgttcggcttcagaccagccccccaatggagcctctcaacttcggatcaagttacatcgtttctaactcggcgaacctaaaggtcatgcctaaggaactcaaactgagctacagaagtcccggcgaaattcaacacttttctaaattctatgccggacagatgaaggaacccattcagcttgagattaccgagaaaaggcacggtactcttgtgtgggacaccgaagtgaaacctgtagatttgcaactggtggcagcaagtgcccctccgcccttttccggagccgcttttgtaaaggaaaatcaccgacaactgcaggccagaatgggtgacctcaagggcgttctcgatgatcttcaggataatgaggttctgacagaaaacgaaaaagagctggttgagcaggagaaaacgcgccagtcaaaaaacgaagctctgctcagtatggtcgaaaaaaagggtgatttggctctggatgtattgttccgtagcattagcgagcgagatccgtatctggtgtcttatctcaggcagcaaaatctctag

SEQ ID NO: 111030 - DNA, 1464 bp, Artificial Sequence
  Description of Artificial Sequence: Synthetic coding sequence
atggaaaaaaaggaatgcccagagaaatcgagttcctcagaggaggagctacctcggcgagtttaccgagagctgccctgcgtaagcgagacgctgtgtgacattagccacttctttcaggaagatgatgagacggaggccgagccattactcttccgagctgttcccgaatgtcagctgtctggcggggacatcccttcagtatcagaagagcaggaaagctcggagggccaggattccggcgacatctgctccgaggaaaatcagattgtgtcctcctatgcatcaaaggtctgtttcgagatcgaagaagactacaagaaccggcaattcctggggcccgaagggaatgtagatgttgagctaatcgacaagtctactaatcgctactctgtgtggttcccaactgccggctggtatttgtggagtgccaccggcctcggattcttggtgcgggatgaagtgaccgttaccattgcattcgggagttggagtcaacaccttgccttggatctacagcaccatgagcagtggctcgtaggcgggccccttttcgatgtgacagccgagcctgaggaagctgtggccgaaatccacctgcctcacttcatctctctccaggctggagaagtggacgtttcctggtttctggtcgcgcacttcaagaacgagggaatggtgcttgaacacccagccagggtggagcctttttacgcagtgctggaatctccctctttttccctgatgggaatcttgctgcggatagccagtggtacgaggctgtcaataccaatcacctcaaacactctcatctattaccatcctcatcccgaagatatcaagtttcatttgtacctggttcctagtgatgctctgctcaccaaggctattgacgatgaggaggacagattccatggcgtgagattgcagacatcaccacccatggaacctctgaacttcgggagttcctacatagtgagcaacagcgctaacctgaaggtgatgcccaaggagcttaagctgtcttaccgttcaccaggagaaatccagcatttttccaagttttatgctggacagatgaaggagccaatccagctggagataaccgagaaacgacacggtactcttgtttgggacacggaggtaaaacccgttgacctccaactggttgctgctagcgcccctcccccatttagcggagccgcctttgtgaaagagaaccatcgccagctgcaggcccggatgggcgatctgaagggggtcctagacgacctacaggataacgaagtgttgacagagaatgaaaaggagctggtggagcaggagaagacccgccagtcaaagaatgaagccctgcttagtatggtggagaagaaaggcgatctggccctcgatgtcctgttcaggagtatctctgagagggatccctatctcgtctcatatctgcggcagcagaatctttag

SEQ ID NO: 111031 - DNA, 1101 bp, Artificial Sequence
  Description of Artificial Sequence: Synthetic coding sequence
atgtccgactacgagaatgatgatgaatgctggtcagtcctggaaggcttcagggtaaccctgacatccgtgatagacccttcacgcattactccgtacctgagacagtgtaaggtactgaaccccgacgatgaggaacaggtattgtcagacccaaatcttgtgatccgtaagagaaaagttggcgtcctgctggacatcctgcagcgcactggccacaagggttacgtggcttttttggagagtctggaactgtattatcctcagttgtacaagaaagtgacaggtaaagagccagcccgggtgttttccatgattattgatgcatccggcgagagcggcttgacccagctgctgatgactgaagtgatgaaattgcagaaaaaggtacaagatctgaccgctctcctgtctagcaaggatgattttatcaaggagcttcgggtgaaagactctctactgaggaaacatcaagaaagggtgcagaggctgaaggaggagtgtgaggccggcagtcgagaactcaaaagatgcaaagaggagaattacgatctggccatgcgccttgcacatcagagcgaggagaaaggagcggctttgatgagaaatcgcgatctgcaattggaaattgatcagctaaagcatagcttaatgaaggcagaggacgactgtaaggtggaacggaaacacacgcttaagttgaggcacgctatggagcagagaccctctcaggagctgctgtgggaacttcagcaggaaaaggccctgctgcaagcccgcgtacaggagcttgaggcgagcgtacaggaggggaagttggataggagctctccctacatccaggttctggaggaggattggcgccaagcactcagggaccatcaggagcaagccaacacaatcttctctctgcgcaaggacttgcgccaaggcgaggcacgaagattgcggtgcatggaggagaaagagatgttcgaactccagtgtctggcgttgcggaaggatagtaaaatgtacaaggataggatcgaggctatccttctgcagatggaggaagtagcaatagaacgggaccagtccactcagatggagggcctatag

SEQ ID NO: 111032 - DNA, 1611 bp, Artificial Sequence
  Description of Artificial Sequence: Synthetic coding sequence
atgagcgactacgagaacgatgatgaatgctggagcgtacttgagggatttcgagtgacccttacctcggtgatagatccgagtaggatcactccttacctccggcagtgcaaggttcttaatcccgacgacgaggaacaggtgctaagcgacccaaacctggtaatccgcaaaagaaaagtcggtgtcctgctcgatattctccaacgaacagggcacaaagggtatgtagctttcctggaatcccttgagctctactatccccagctttataagaaagtgacaggtaaggagcctgcaagagtattctctatgatcatcgacgcctctggcgagagcggattgacacagctgctgatgactgaggtgatgaaacttcaaaagaaggtgcaggatctgacagcgctgctgagctctaaagatgactttatcaaggaactgagagtgaaggacagtttgctccgcaagcaccaggaacgcgtccagcgtctgaaggaagaatgcgaggctggatcaagggaactcaagaggtgcaaggaggaaaactacgacctggctatgagactggcacatcagagcgaagaaaaaggcgccgctctgatgagaaatcgggacctacaactagaaattgaccagctgaaacattcgctgatgaaggctgaggatgattgcaaggttgagcggaagcacaccctgaagttgcggcacgcaatggagcagagaccaagccaggagcttctatgggaactccagcaggaaaaggccctcttgcaggcaagagtccaagaactagaagcctccgttcaggaaggcaagctggacagaagttccccatacatacaagtgttagaagaggattggcgacaggcactccgcgaccatcaggagcaggcgaacactattttttccctgcggaaagatttgcgccagggtgaggcacgaaggttaaggtgtatggaagaaaaagagatgtttgagctgcagtgtcttgcccttcgaaaggattccaagatgtacaaggatagaatcgaagccattcttctgcagatggaggaggtcgccattgaacgggaccaggctatagccacccgggaggagctgcacgctcagcacgcccgggggctgcaagaaaaagatgccctgcggaagcaggtgcgggaactgggggagaaggcggacgaactccagttgcaagtgtttcagtgtgaggcacagctgctcgccgtggaaggtaggctgcgtcgccagcagcttgaaactctggtcctgagcagcgatctcgaggacgggtctcctcgcagatcccaggaactgagtctgccccaggaccttgaagatactcagctctccgacaaggggtgtcttgcgggaggcggtagtcccaagcagcccttcgccgccctacaccaggaacaggtgctgaggaacccccacgacgcaggattgagcagcggcgagccaccggaaaaagagcgaaggcgtctgaaggagtcgtttgaaaattatcgccggaagcgcgccctgagaaagatgcagaaaggctggaggcagggcgaggaagaccgcgaaaacaccacaggatctgataacaccgacacagaagggagttag

SEQ ID NO: 111033 - DNA, 1479 bp, Artificial Sequence
  Description of Artificial Sequence: Synthetic coding sequence
atgtccgactatgagaacgatgatgaatgctggagcgtgctggaggggttcagggtcaccctgacatcggtgatagacccgagtcggatcaccccttacctgaggcaatgcaaggtgctaaaccctgatgacgaagagcaagtcttaagtgaccccaacctagtgatcaggaaacgtaaggtaggtgttctgctcgacattctgcagagaaccggtcataagggctatgtggcatttttagaatccctggagctgtactaccctcaattatataagaaggtcaccggaaaggagccggcgcgggtgttcagcatgatcatcgacgcctcaggtgagtcaggcttgacccaactgttaatgacagaggtaatgaagctgcagaagaaggtccaagatcttaccgctcttctgtcctccaaggatgacttcataaaggagcttagggttaaagattccttgctccgcaagcatcaggagagggtgcagagacttaaagaagagtgcgaagcagggtctagggagctgaagagatgtaaggaagaaaattatgatctcgccatgcggctcgcccatcaatctgaagagaagggggcggcactgatgcgaaatagggatctccagctcgaaatagatcagctgaagcacagtcttatgaaagcagaggatgactgcaaggtggaacggaagcataccctcaaactccgccacgctatggagcagcggccgtcccaagagctgctctgggagctccagcaagaaaaggcgctcttgcaagcaagggtccaagagctagaggcctccgtccaggaggggaaactggacaggagtagcccctatattcaggttctggaagaagattggcgacaggccttgcgggatcaccaggaacaggcgaatactatttttagtctcaggaaggatctgcgtcagggggaagcaagacgcctgaggtgcatggaggaaaaggaaatgttcgaactgcaatgccttgcgttaaggaaagattcgaagatgtataaggacagaattgaagcaattctcctacaaatggaggaggtagcgatcgagcgggatcaggcgatcgcaacacgggaggaacttcatgcgcaacacgcacgggggttacaggagaaggacgcactgcgcaaacaggtgagggaactgggcgaaaaagccgatgaacttcagctccaggtctttcagtgtgaggcgcaacttcttgctgtagagggtagactcagaaggcagcagctcgagacactcgtgctctccagtgatctcgaagacggcagtcctagacgatctcaagagctgtctttgccacaagatttggaagatacccaactgagcgataagggttgcctcgctgggggggggtcgcctaagcagccgttcgcagccctgcatcaggagcaggtgctgagaaatccccatgatgcaggacctgccggactgcctggaataggggcagtgtgttag

SEQ ID NO: 111034 - DNA, 3501 bp, Artificial Sequence
  Description of Artificial Sequence: Synthetic coding sequence
atggacctcggtaccgcagagggcacccgttgcactgatcccccagctggaaagcccgcgatggcccctaaacgcaagggggggttaaagctgaacgctatctgcgccaagcttagtagacaagtcgtcgtcgagaaacgggctgacgccggttctcataccgaagggtccccgtcacagcctcgggaccaggaacggtcaggccctgagtcaggcgccgcccgagcccccaggagcgaggaggataagcgacgggctgtgatcgagaagtgggtgaatggtgagtactccgaagagccagcaccaaccccggtccttggcagaatcgctagagagggacttgagcttcctcctgagggggtctacatggtgcagccacagggatgctcggatgaggaggaccatgccgaggaaccatctaaggacgggggtgccctggaggaaaaggattcagacggcgcggctagcaaagaagacagtggaccgtccacccgtcaagcaagcggcgaggcctccagtcttagggactacgcagcctcaaccatgaccgagtttctggggatgtttgggtacgacgaccagaatactcgagacgaattagcgagaaagatttcctttgagaaactgcatgccgggagcacgcctgaggccgcgaccagctctatgctgcctacatccgaagacacactgtcaaagcgagctcgattcagcaagtacgaggagtacatccgaaaattgaaggccggtgaacagttgagttggccagcgcccagcactaaaactgaagagagagtcggaaaggaggtggtgggaacactgccagggcttaggcttccctcctctacagcgcacctggagactaaagctaccattttaccactgcctagccattcctcagtccagatgcaaaacctggtcgccagagcttccaagtatgactttttcattcagaaactaaaaactggggaaaacttgcggcctcagaacggttccacatacaaaaaaccatctaagtatgacctggaaaacgtgaaatatcttcacctatttaagcccggggaagggtcccctgacatgggcggtgccatcgcgttcaaaactggaaaagtggggcgcccctctaagtatgacgtccgcggcatccaaaagccgggacccgccaaggtacctccaaccccgagtctggcgcccgccccactggccagcgtgccatcagccccttccgcccctggccccggtcccgagccccccgcgagcttgtcgttcaatactcccgagtacttgaaatcaacattttctaagacagatagcatcacaaccgggaccgtgagtactgtgaagaacggactgcccaccgacaaacctgccgtgactgaagacgtgaatatctaccaaaagtacatcgcgcgattttccggcagccaacactgtggtcatattcactgcgcgtaccagtatcgcgaacactaccattgtctagatccggagtgtaattaccagcgctttacctcgaaacaggatgtgatccgacactacaacatgcacaagaagcgggataattccttacagcacgggttcatgcggttttctcctctggatgactgctctgtatactaccatggatgccatctcaatggtaaaagcacacactatcactgtatgcaagtaggctgcaataaggtttacactagcacaagtgacgtgatgacccacgagaactttcataaaaaaaatacccagttaattaatgacggctttcagcgcttcagagctacagaggactgcggcacagcggattgtcaattctatggccagaagactacacacttccactgcaggcgccctgggtgcacatttacattcaaaaacaagtgtgacatcgaaaagcacaagtcttatcacatcaaggatgatgcttacgctaaagatggttttaaaaaattttataagtatgaggagtgcaagtacgagggatgcgtatactctaaagccacaaaccattttcactgcatccgggccgggtgcggatttacttttacttctacttcgcagatgacttcccataaaaggaaacacgagcgccgtcacatacggagcagcggagccttgggactgcctccctcccttttgggcgccaaggacacagaacatgaggagtcatccaacgatgacctggtggactttagtgctctctcctctaagaacagttctttgtctgcgagcccgacctcccagcagtcttctgcctctttggccgcagcaactgccgcaacagaggccgggccaagcgcaactaagccaccaaatagtaaaataagcgggctgctgcctcagggcctaccaggttctattcctctcgctctggctctaagcaacagtggtctcccaaccccgactccgtatttccccatccttgccggtagggggtccactagcctccccgtaggcaccccctcgttacttggcgcagtgtcctccggctcagcagcttcggccactcccgacacaccgactctggttgctagtggcgccggggacagcgccccagtggccgcggcttccgtcccggctcctcctgcgtcaatcatggagcggatatccgcgtcaaagggactcatctctcccatgatggctcgactcgcagctgcagccctgaagccttctgcgacctttgacccggggtctgggcagcaagtgactcccgctcgcttccctcccgctcaggtgaagcctgaaccaggagagagcaccggggcaccgggcccccatgaggcctcccaagaccgcagcctcgatttgaccgtcaaagaacctagtaacgagagcaacggccatgctgtccccgccaattcaagtctgctgagttctctgatgaataagatgtctcaaggcaatccaggtctggggtcgttgctcaatatcaaagcggaagctgagggcagtccggccgccgagcctagccctttcctgggtaaagccgtgaaggcgttggtccaggaaaaattggcagagccttggaaggtctacctccgacgctttggtaccaaggatttttgcgacggccagtgcgacttcctccacaaagcacattttcattgcgtggtggaagagtgtggagccctgttctctaccctcgacggagctatcaagcacgccaattttcactttagaaccgagggcggagccgctaagggaaacaccgaagcagccttcccagcatcggcagctgagactaaaccaccaatggcaccctctagtcctcctgtcccgcccgtcacgaccgcaaccgtgtcctcattagagggaccagccccaagccccgcatcggtgccatctacacccacactgctggcatggaagcagctggcttccacaatcccacaaatgcctcagatccccgcctcggtgcctcaccttcccgcatctcctctggccacaactagtctggagaacgccaaacctcaagtcaagcccgggttcctacagtttcaagaaaagtag

SEQ ID NO: 111035 - DNA, 5280 bp, Artificial Sequence
  Description of Artificial Sequence: Synthetic coding sequence
atggatcttggaactgccgaaggaacgcggtgcaccgatccccctgcaggcaaacccgccatggctccaaaacgtaagggtggcctgaaactcaacgccatctgtgccaagctgtccagacaagtagtggtggagaaaagggctgacgcaggcagccataccgaaggaagtccatctcagcctagggatcaggaacgctcgggaccagagtccggggccgctcgcgcccctaggtccgaagaagataagaggcgcgcggtgattgagaagtgggtcaatggagagtattcggaagaacccgcccccactcccgtcctggggcgcatcgcgcgggaggggctggaactgccacccgagggtgtatacatggtccaaccccagggatgttccgacgaagaggatcatgcggaagagcctagtaaggatggcggcgcgttagaggaaaaagacagcgatggggctgcatccaaggaagactcaggtccatcaacaaggcaggctagcggcgaggccagcagcctgagagactacgctgctagcaccatgacagagttcctcggcatgttcggatacgacgatcagaatacccgagatgagctggcaagaaaaattagctttgaaaaactgcacgcgggatcaacaccggaggccgccacttccagcatgctgcctaccagcgaagatacactgtctaaaagagcacgtttctcgaaatacgaggagtacatacgaaaactgaaagccggggaacagttgtcctggcctgcacctagcaccaaaaccgaagagagagttggcaaggaggtggtgggaacccttcctggattaagactgccttcatccacagctcacctggagaccaaggcaacaatcctgccgctgccgtctcatagtagtgttcagatgcagaatctggtcgcccgagccagcaagtacgatttctttatccagaaactgaagacaggcgaaaatctcaggcctcagaacgggagcacctacaaaaagccgtccaaatacgatctggagaacgtgaagtatctccacttgttcaagccgggggaggggagccccgatatgggaggtgcaattgcgtttaaaacgggcaaggtgggacgccccagcaagtacgacgtgaggggcattcagaagccaggcccagccaaggtgcctcccactccttccttggcgcctgcaccactcgcatcggttccaagcgcgccttccgcccccggacccggccccgaacctccagcctccttgtcatttaacaccccagagtacctgaagtccaccttttctaagacagactctatcacaactggaactgtgagtaccgtgaagaacgggctgccgaccgacaagcctgcagtcacagaggacgtgaacatatatcagaaatacattgcacgcttttcaggaagccaacattgtggccacattcactgtgcctaccagtatagagaacattatcactgcctcgaccccgaatgtaattatcagcggttcacgtccaagcaagacgtgattcgacactacaacatgcataaaaagcgggataactccctccagcatgggtttatgagattttcccctcttgatgattgctcagtgtactaccatggctgccacctaaatggcaagtcgacccactatcactgtatgcaggtcggatgtaacaaggtgtacacctctacctccgacgtgatgacccatgaaaacttccacaaaaagaatacgcaactcataaatgatggtttccaacggttccgggctactgaagattgcggaactgccgactgtcagttctacggtcagaagacaacgcattttcattgtagacgcccgggatgcacgttcaccttcaaaaacaaatgcgacatcgaaaagcacaagagttatcacatcaaagatgatgcatacgcaaaagacgggttcaagaagttttataaatacgaagaatgcaaatatgaaggctgtgtgtactccaaggctaccaatcatttccattgcattagggcaggctgcggtttcacatttacaagtacctcacagatgacctcgcacaaacgcaagcatgagaggaggcatatccggtcatctggtgctctgggcctgcctccttcgcttctcggcgccaaagacacagaacacgaagaatcctcaaatgatgatctggtcgatttctctgccctttcctccaaaaacagcagtctgtctgcaagtcctacctctcaacagtctagcgcttccctggccgctgctacggcggctacagaggccggtccatctgcaactaaaccccccaattccaagatctccggtctgctgcctcagggtctccctggctctattccactggccctcgctctttccaattccggacttcccactcccaccccttatttccccatcctggccggaagagggagcaccagccttcctgtgggcacaccatcactcctgggcgctgtttcatccggcagtgccgcgagtgccacccccgatacacccacgctagtagcttcaggagccggcgactcggcccctgtcgcggccgcgtccgtccctgccccccctgcgtcgatcatggagcgtatctccgcttctaagggacttatatccccaatgatggccagactggccgccgcagcactgaaaccgtcagccaccttcgatcctggttcgggacagcaggtgacccccgctcgcttccctcctgcccaggttaagcccgaacctggagaaagcacgggcgcccccgggcctcacgaagcaagtcaggaccgttcgctggacctgactgtaaaggaaccttccaatgagagcaatggccacgcagtccccgctaattctagtctgctctcatcccttatgaataagatgtctcagggcaaccctgggctgggcagcctgctgaatataaaggctgaagctgaggggagtcctgctgccgagccctcaccttttctggggaaggccgtgaaggctcttgtccaagaaaaattagccgaaccttggaaggtatatctccggcggtttggtacaaaggatttttgtgatgggcagtgtgacttcctccacaaggcacatttccactgtgttgttgaggagtgcggcgcgctgttcagtaccttagacggggccatcaagcacgccaactttcactttcggactgagggaggcgccgccaagggcaatacagaagcagcctttcctgcaagtgcagctgaaactaaacctccaatggctccaagtagtccccccgtaccccccgtaacgactgccactgtatcttcactggaaggccctgcgcctagtccagcgtccgtcccttccaccccaacactccttgcatggaagcagctggcatctacgattcctcagatgccacaaatcccagccagcgttccccacctacccgccagtcccctggccacaacaagcttagaaaacgcaaaaccgcaggtcaaaccgggctttctgcaattccaggagaacgatccatgcctggctacggactgtaaatacgccaacaaatttcacttccactgcctgtttggaaattgcaaatatgtgtgcaaaacctcaggaaaagccgagtcccactgcctagaccacatcaacccaaataataaccttgttaacgtgagagatcaattcgcttattactcattgcagtgcttgtgccctaaccagcactgcgagtttcggatgagaggccattatcactgtctgaggaccggatgctacttcgtcaccaatatcacaacaaagctgccttggcacatcaagaaacacgaaaaggccgaacgaagggccgccaatggattcaagtactttacaaagcgggaagagtgcggaagattaggatgcaaatataatcaagtcaactctcactttcattgtatccgcgaaggctgccaattcagctttctgctgaagcaccaaatgacctcgcacgctcggaaacacatgagaaggatgctggggaaaaacttcgaccgagtgcctccatctcaggggcccccagggctgatggacgccgaaactgacgagtgcatggactatactggctgttctcctggcgccatgtcttcagagagcagcacaatggatagaagctgtagttctactcctgtgggaaatgagtccaccgccgctggtaacaccatatctatgcctaccgcgtcaggtgctaagaagagattctggatcattgaagatatgagcccttttggaaagcggcggaagaccgcctctagtcgcaagatgctcgacgaaggcatgatgcttgagggctttcggcgctttgatctgtacgaagactgtaaggacgctgcctgccagttttccctgaaggtcactcactaccactgcacccgggagaattgcggttacaaattctgtggaagaacacatatgtacaaacatgcacagcaccacgatagagtggataacctcgtattggacgacttcaaaaggtttaaggcgtccctgtcttgtcactttgcggactgtccttttagtggaacttcaacccactttcattgtctgagatgccggtttcggtgcacagactctacaaaagttacagcgcaccgcaagcaccacgggaagcaggatgtgatttcagcggcaggattttgccagttcagttcatccgcagattgcgccgtgcccgattgcaagtacaaattaaaatgcagtcactttcactgcacctttcccggctgcagacatactgtggtcggcatgagccagatggactcccacaaacggaagcacgagaaacaggagcgcggggaacccgctgccgagggacctgctccaggacctcccatctccctggatgggagtttgtcattaggcgcagaaccgggctctctccttttcctgcagtccgcagccgccgggctgggactcgcactgggggatgccggcgaccctggcccacccgatgccgctgctccaggacctcgggaaggcgcggcggctgccgcagctgccgcgggggaatccagccaggaagacgaggaggaggagctggagttgcctgaagaggaagcggaagacgacgaggacgaggacgacgacgaagatgatgatgatgaagatgacgacgaggacgatgacgacgaggatttacggacagactccgaagaatccctgccagaggccgccgctgaggcagctggggccggtgctcggacacctgcccttgctgctctggccgccctcggggccccgggccccgcccccacggctgcgtcttcaccatag

SEQ ID NO: 111036 - DNA, 4332 bp, Artificial Sequence
  Description of Artificial Sequence: Synthetic coding sequence
caggaactggaggctgctcttcatcgggatgacgtggagtttatctccgacctgattgcttgcctcttacaggggtgttatcagcgccgggatatcacgcctcagacattccacagctatctagaggacatcataaattacaggtgggagcttgaggaagggaagccgaacccgttgagggaggcctcctttcaggaccttcccctcagaacccgtgtagagatactgcatcgcctctgcgattaccgtttagatgcggacgatgtgtttgacctgctcaagggtctggacgcagattccttgagagtggagccgctgggcgaggataatagtggtgctctgtattggtatttttacggcactcggatgtataaggaggaccctgtgcagggaaaaagtaatggcgagttgtcattaagccgcgagagtgagggccagaagaatgtctcaagcattcccggcaaaactgggaagcgacgaggaagaccacccaagagaaagaagctgcaggaagagattctgctcagcgagaagcaggaagagaacagccttgcttctgaaccacagacacggcatggatcgcagggtcctggccagggcacctggtggttgctgtgccagaccgaggaagagtggcggcaggtgacagagtcctttcgggaacgcacctcgcttagggaacgccagctttataagttattgtctgaagatttcctgccagagatctgcaatatgattgctcagaaaggcaagcgaccgcagcgcacgaaggccgaacttcacccccgctggatgagtgaccatctgtccattaagcccgtgaaacaggaggagaccccagtgctcacccggattgaaaagcaaaagcgcaaagaggaggaagaagagaggcaaatactgctcgctgttcagaagaaggagcaggaacagatgctgaaagaggaacggaaaagagagctggaggaaaaggtcaaggccgtagaagggatgtgttccgtgcgggttgtgtggaggggggcttgcctgtctacttcccgtcctgtagacagggctaagcgcaggaaactgagagaggagagggcttggcttctggcacagggcaaggagctcccgcctgaactgtcccacctggaccccaactctccgatgcgagaggagaagaagacaaaagacctattcgagctcgacgatgatttcaccgctatgtataaagtgctggatgtcgtcaaagcccataaggactcctggccgttcctcgaacccgtcgacgaatcatacgctcccaattactaccaaataattaaggcgccaatggacatctcttcaatggagaagaaactgaacggcggcctctactgtacaaaggaagaatttgtgaatgatatgaagactatgtttaggaattgccgcaagtacaacggggaaagctctgaatatacaaaaatgtctgataacctggaacgctgtttccatcgtgctatgatgaaacattttccaggcgaggacggcgacacagacgaagagttctggattagggaggatgaaaaacgtgagaaaaggaggagccgcgcaggccgatccgggggctcccatgtgtggacccgctcgcgggaccccgaagggagctcacgtaaacagcagcccatggaaaatggcggcaaatctctgccacccacacgcagggccccctcttccggcgacgaccagtcgagcagttccactcagcctcccagggaggtgggaacatccaatggccggggttttagccatccactgcactgcggggggacaccatctcaagctcctttcctgaaccagatgaggcctgccgtccctggcacattcggccccctacgaggatcagatccggccaccctctacgggtccagtggggtgccagaaccacacccaggtgagcctgtgcagcagcggcagccatttactatgcagcctcctgtcgggatcaattccctgcggggaccccgactgggcacaccagaagagaagcagatgtgcgggggcctcacccacctttcaaatatgggaccacatccggggtccctgcaactggggcagatctctggtcctagtcaggacggctctatgtacgccccagctcagttccagccagggttcataccaccgaggcatggcggagcgccagcccgcccacctgatttcccagagtcgtctgagataccacccagccatatgtaccggtcatataagtatcttaatagagtgcattccgctgtgtggaacggcaatcatggagccactaaccagggccccttaggccccgacgagaaaccccacctgggtccagggcccagtcaccagccccggaccttgggtcatgtcatggacagccgcgttatgcgaccacctgtgcctcccaatcagtggaccgaacagagcgggtttctgccccacggcgttcccagctctggttacatgcgccctccctgcaagtctgccggccacaggctgcaacccccccctgtgccagcacccagttctctgtttggtgcacccgcccaggctttaaggggcgtgcagggcggcgattctatgatggatagccctgagatgatcgccatgcagcagctctcgtctcgcgtgtgcccaccaggcgtcccataccacccccatcaaccagcccatcctaggcttccgggtccgttcccccaggtagcgcatcccatgagcgtcacggtgagcgcccctaagccagcattgggtaaccccggccgcgcccctgaaaactccgaagcacaggagccggaaaacgaccaggcagaaccattgccaggacttgaagagaaacctccgggtgtgggcacatccgagggcgtgtacttaactcagctgccgcaccctactcccccattacagacagactgcactcggcagagctcccctcaagagcgcgagacagtcgggcctgagctgaagtcctctagctcagaaagtgccgataattgcaaggccatgaagggaaagaatccatggccttccgactctagttacccaggcccagctgcacaagggtgtgttagggatctctcaaccgtggcggaccgaggcgccctgagcgaaaatggagtcatcggagaggcttcaccctgtggatccgagggcaagggtttggggtcatccgggtccgagaaactgctctgcccaaggggaaggacacttcaggagaccatgccctgtacaggacaaaatgctgcaacccctccaagtacagatcctggactcaccggaggaactgtaagtcagtttcctcccctgtatatgccaggactggaatacccaaattccgccgctcactatcacatttcacctggccttcagggggttggccctgtcatgggggggaagtcaccagctagtcacccccagcatttcccgccccgtggattccagtccaatcacccgcattctggtggattccccaggtacaggcccccccagggcatgcgatatagttaccacccccctccacagcctagctaccatcactatcagagaaccccatattacgcctgcccccagtctttttccgattggcagcgccccctgcacccccaaggaagtccctcgggcccaccagcctctcagccccctcctccccgatccctattctctgacaaaaacgctatggcatccctacaggggtgcgaaacacttaatgcagcgctgacctctccaacccggatggatgccgtcgctgccaaggtgccgaacgacggccagaacccaggccccgaggaggaaaagctggatgaaagcatggagcgtccggaaagtcctaaggaattcttggatctcgataatcacaacgctgccaccaagagacaaagttctctgtccgcatccgagtatttgtacggaacacctccccccctgtcttcaggcatgggatttggatcatccgcttttcccccccatagcgtcatgttacagacaggcccgccatatacaccacagaggcctgccagccattttcagcctcgagcttatagctcccccgtggcggccctgccacctcatcatcccggcgcgacacagcctaatggtctatcccaagaaggaccaatttaccgctgtcaggaagaaggactcggacatttccaagccgtgatgatggagcaaatcggcacccgtagtgggatccgcggccccttccaggagatgtatagacccagtggaatgcagatgcaccctgtgcagtcccaggcctcgtttccgaaaacacccacggcggcaacgtcacaggaagaggtgccaccccacaaacccccgaccctgcctctggatcagtcatag

SEQ ID NO: 111037 - DNA, 1371 bp, Artificial Sequence
  Description of Artificial Sequence: Synthetic coding sequence
gagttggaggcggctctccacagagatgacgtggagttcatttctgacctgatcgcttgcctgctgcagggctgctaccagcggcgcgatataacacctcagacttttcactcttaccttgaagacatcatcaactaccgctgggaactggaagagggcaagcccaatcctttaagggaggcctccttccaggatctgccacttcgaacccgcgtcgaaatcctgcataggctctgcgactataggctcgacgcggatgacgtgtttgacctgctgaagggactcgacgccgacagtctcagggtcgaaccgctgggtgaggacaactctggcgctttatactggtacttttatggtactcggatgtataaagaggatccggttcagggaaagagcaatggggaactctccttgtcaagggagagtgaaggccaaaagaatgtgtcctcaatccctggaaagactgggaaaagacgcggccggccaccaaagagaaagaagctgcaggaggaaatactgctttccgagaaacaagaagagaatagccttgcctcggagcctcagactagacatggatcgcaggggcccggacagggcacctggtggctgctctgccagactgaggaggagtggcgccaggtaaccgaaagcttccgtgagagaactagcctgcgcgaacgccagctctataagctgctgtccgaagactttctcccggaaatttgcaatatgattgcccagaaggagacccctgttctgactagaattgaaaagcagaagcgcaaggaggaagaagaggaaaggcagattctcctggccgtgcagaaaaaggagcaggaacaaatgttgaaggaggagcgaaaaagggaattggaagagaaggtgaaggcagtggagggcatgtgcagtgtgcgagttgtgtggagaggagcgtgcctgtcaacaagcaggccagtggatagggctaaaagaaggaaactgagagaggagcgcgcgtggctactggctcaggggaaagagttgccccccgaactctcacacctcgaccccaactctcccatgcgggaggaaaaaaaaacaaaagacctgttcgaactggacgacgactttactgcgatgtataaggtcttggacgtggttaaggcacataaagactcctggcctttcctcgaacctgtggacgaatcctatgcccctaattattatcaaattattaaagctccgatggacatctcatctatggagaagaagttaaacggtggcctttactgtactaaggaagaattcgttaatgacatgaaaactatgttcagaaattgtcgtaagtataatggggagtcaagcggtaaacaaggacgatcgctctgctag

SEQ ID NO: 111038 - DNA, 1584 bp, Artificial Sequence
  Description of Artificial Sequence: Synthetic coding sequence
atggccgactctagggatcccgcgagcgaccagatgcagcattggaaagaacaacgtgctgcgcagaaggcggacgttctgactaccggggccgggaaccccgttggtgacaagcttaacgtgataacagtcggtccgagaggacccctgttggttcaggatgtcgtctttaccgatgaaatggcacatttcgacagagaaaggattccggagagagtggtgcacgcaaaaggcgccggggcattcggatattttgaggtgactcacgacattacaaagtactctaaggcaaaagtgttcgaacatataggaaagaagacacctattgccgtcaggtttagtactgtggccggagaaagcggttcagcggacaccgttagagacccccgcggatttgccgtcaagttctataccgaggatgggaattgggacttagtggggaataacacacctatcttctttatacgtgaccctatcctctttccctcttttatacatagccagaaacggaacccccagactcacctgaaggacccagatatggtgtgggacttctggtctctgaggccagaaagccttcaccaagtgtcctttctcttttctgataggggaatccccgatggacatcgccacatgaatggctacggtagccatactttcaagctcgtaaacgccaacggcgaagctgtttactgcaagttccactataagaccgaccagggaattaaaaatctgtcggtcgaggatgctgcgcggctgtcccaggaggatccagactatgggattagagatctgtttaatgctatagccacagggaagtacccttcatggactttttatattcaagtgatgacatttaatcaggctgaaacatttccctttaatccattcgatctcaccaaggtgtggccccataaagattacccactcatcccagtaggcaaattagttttaaacagaaatcctgttaattacttcgccgaagtagaacagattgctttcgacccaagcaacatgccccccggcattgaagcttctcctgacaagatgttgcagggccgcctgtttgcttatcccgacacccatcgacaccgtctagggccaaattatctgcacataccagtgaactgcccatatcgagctagggttgccaattaccagcgcgatggacctatgtgcatgcaggataatcagggcggagccccaaactattaccctaactcattcggagcacccgagcagcagccttccgcccttgagcactctatccagtactctggtgaggtgcgtaggttcaataccgcgaatgacgataacgtgactcaggtccgtgcgttctacgtgaatgtgcttaacgaggagcagaggaaaagactttgcgaaaatattgcaggccatttaaaagacgcccagatcttcattcagaagaaggcagtgaaaaactttacagaggttcatcccgattatggctctcacattcaggcgttacttgacaaatataacgccgagaaaccgaagaacgcaattcacaccttcgttcagtcaggaagccacctggcagcccgtgagaaagctaacctttag

SEQ ID NO: 111039 - DNA, 816 bp, Artificial Sequence
  Description of Artificial Sequence: Synthetic coding sequence
atgcccgaggccccccctcttctcctcgcggccgtgctgttgggattggtgctcctcgtcgtgctgctcctgctgttgcgtcattggggctggggcctatgccttataggatggaacgagttcatacttcagcccattcacaatctgctcatgggcgacacaaaagaacagaggattttgaatcacgtcttgcagcatgctgaacccggcaatgcgcaaagtgtgctggaagcgattgatacctattgcgagcaaaaggagtgggctatgaatgtgggggacaagaaaggaaagattgtcgacgcagtgattcaggagcaccaaccttccgtgctgctcgaactgggagcctattgcggatacagcgctgttcggatggcacgactgctgtctcctggggcacggctcattacaatagaaattaatccggattgcgccgccatcacacagcggatggtggactttgcaggggttaaggacaaagtcacattagtggtgggggcctctcaggacataatcccccagctgaaaaaaaagtacgacgtggatactttggacatggttttccttgaccactggaaggatcgatatttgcccgatactcttctccttgaagaatgcggattgcttcgaaagggtacggtgttactggcggacaacgtcatttgcccaggcgctcctgacttcttggcccacgtgagagggtcttcctgctttgaatgtacgcactatcaatcattcctggagtatcgcgaagtcgtggacggtctggaaaaggccatctacaagggcccgggcagcgaagccggaccatag

SEQ ID NO: 111040 - DNA, 816 bp, Artificial Sequence
  Description of Artificial Sequence: Synthetic coding sequence
atgccggaggctccacccctgttgttggccgcagtcctgctgggcttggttttgttggtggtgctgcttcttctcctacgacactggggctggggcctgtgcttgatagggtggaatgagttcatcctgcagccaattcataacctcctgatgggtgacaccaaagagcaacggatcctgaatcacgtgctgcaacatgccgagccaggaaatgctcaatccgtactagaagctatagatacgtattgcgagcagaaagagtgggcaatgaacgttggcgacaagaaaggaaagatagtggatgcggtaatccaggagcatcagcccagcgtactgttggagctgggggcctactgcggatattctgccgtgcgcatggcgaggcttctcagccccggggcccgcctgatcaccatcgaaattaacccagactgtgccgctatcactcagaggatggtcgactttgccggggtgaaggacaaagtgacactggtggtgggggccagccaggatatcatcccccagctgaagaagaagtacgatgtggacacactcgacatggtcttcctggatcactggaaagaccgatatctgccggacacgctgctgctagaggaatgtggactcctcagaaaggggactgtgctgttagcagacaatgtgatctgccccggcgccccagatttcctggcccacgtgaggggcagctcctgttttgagtgtacacattaccagtcctttctggagtatcgagaggtagtggacggcctggaaaaggccatttacaaaggccccggctctgaagccggcccctag

SEQ ID NO: 111041 - DNA, 816 bp, Artificial Sequence
  Description of Artificial Sequence: Synthetic coding sequence
atgcccgaggctccgccactgcttctggctgctgtcctgctagggctggtacttctggtggtcctcctcctcctgttacgccattggggatggggcttatgcttgatcggttggaacgagtttatcctgcagcccatccataaccttctcatgggagatactaaagaacagagaatcttaaatcacgttctccagcacgctgaacctggcaacgcacagtcagtgctcgaggctatcgacacctattgcgagcagaaagagtgggctatgaatgtaggggataagaaaggaaagatcgtggatgccgtgatacaggagcatcaaccctccgtgctgctggaattaggcgcctactgtgggtattctgcagtcaggatggcgagactgctgtctccaggtgcccggttgataactatagagattaaccctgactgcgccgccatcacccagcgtatggtggactttgcaggggtgaaagacaaggtgacacttgtcgtgggcgcgtcacaggatatcatccctcagctgaagaaaaaatatgacgttgacacactagatatggtgtttctggatcattggaaggacaggtacttgcccgataccctcctgctcgaggaatgtgggctgctgaggaaaggcacagtgctcctggccgacaatgttatctgtccaggtgctcccgactttcttgctcatgtgagagggtcgagctgcttcgagtgtacacactatcagtcattcctcgagtaccgagaggtcgtcgatgggctcgagaaagccatttataagggccccggatccgaggccgggccctag

SEQ ID NO: 111042 - DNA, 666 bp, Artificial Sequence
  Description of Artificial Sequence: Synthetic coding sequence
atgggcgatacaaaggaacaaagaatcctgaatcacgtgctgcagcacgctgaacccgggaacgcgcaatcagtcctcgaggccatcgacacgtattgcgaacagaaagaatgggctatgaatgtaggcgataaaaaagggaagatagtggatgccgtgatccaggaacaccaaccatctgtcttgcttgaattaggagcctattgcgggtactcagctgtacggatggccaggcttttatctcccggtgcacgccttattactatcgaaattaatcccgactgcgccgcgattacacagcggatggtggatttcgcgggcgtgaaggacaaggtcactctcgttgtcggcgccagccaggatataatcccgcagctgaaaaagaaatacgatgtggatacactggacatggtcttcttggatcactggaaggatagatatttgccagacacccttcttttggaggaatgcggactactccggaaaggcaccgtcctgctggctgataatgtcatctgcccaggcgcaccagacttccttgcccacgttcgtgggtcatcatgctttgagtgcacacattaccagagtttcctggaatatagggaggttgtggacggcctggagaaggccatttacaagggacccggttcggaggccgggccatag

SEQ ID NO: 111043 - DNA, 672 bp, Artificial Sequence
  Description of Artificial Sequence: Synthetic coding sequence
atgcctgaagcaccaccactgcttctcgccgcggtgttactcggtcttgtgctgctggtcgtcttgctccttctgcttcgtcattggggctggggcctgtgtctgattgggtggaatgagttcatcttgcaacctatccataacctgcttatgggcgacaccaaggaacaacgaattctcaaccacgtgctccagcacgccgaacctggcaacgcccagagtgtgcttgaagctattgatacatactgcgagcagaaagagtgggctatgaatgtaggggacaagaagggcaaaatcgtcgacgcggtgattcaggagcaccagccaagcgtgttgctcgagcttggagcttactgcgggtattccgctgtcaggatggccagactgctgagcccaggagccaggctaatcaccatcgaaattaacccggactgcgcggctattacacagcgcatggttgatttcgccggcgtgaaggataaagttacgttagtagtcggagcgtcacaggacatcattcctcagctaaaaaaaaagtatgatgttgacacattagacatggtctttctggaccactggaaggaccgctacctcccagacacactgctgctggaagaatgtggactgttgaggaagggtaccgtgctgctagcagataacgtgatctgctag

SEQ ID NO: 111044 - DNA, 666 bp, Artificial Sequence
  Description of Artificial Sequence: Synthetic coding sequence
atgggggatactaaagaacagcgcattctgaatcacgtccttcagcatgccgaacccgggaatgctcaatcagttcttgaagcgatcgacacctattgtgaacagaaggaatgggctatgaacgtgggtgacaaaaaggggaagatcgtcgatgcagtgatccaggaacaccagccctcggtgctgctagaactgggcgcttactgcggatactccgcagtgagaatggcccgtctcctgagccctggcgccagactgatcactatcgagataaatcctgattgtgcagcgattacacaaagaatggtggatttcgcaggcgtaaaggataaggtgacactggtggtgggagcctctcaggacataattccacaactgaaaaaaaagtacgacgtcgacaccctggatatggtgttcctggaccattggaaggacaggtacctcccagataccctgctcttggaggaatgtggcctgttgaggaagggtaccgtgcttcttgcagacaatgtgatttgccctggggctcctgatttcctcgcccatgtgagaggctctagctgcttcgagtgtactcactaccaatcttttctggaataccgtgaggtggtcgacggtctcgagaaagcaatatacaaaggacccgggagcgaggctggtccctag

SEQ ID NO: 111045 - DNA, 2664 bp, Artificial Sequence
  Description of Artificial Sequence: Synthetic coding sequence
atggccaacggaacccttacacgtcggcaccagaatgggaggttcgtgggagatgccgaccttgagcgccagaagttttcggacctaaagctaaacgggccccaggatcactctcacctgctgtactcaacaatccctcggatgcaggagcccggccagatcgttgaaacttacactgaggaggatcccgagggcgccatgtctgtcgtctccgtggagaccagcgacgacggaaccacacggaggacagagaccacagtgaagaaggtggtgaagacagtgacgacccggactgtgcagcccgtggcaatgggccctgacgggctgcctgttgatgcctccagcgtgagcaataattatatacagaccttggggagagattttagaaagaacggaaacggtgggccaggaccctacgttggccaagcgggcactgccacactgccccgaaatttccactacccccccgacggttactccaggcactatgaagacggttaccctggagggtcagacaattacggcagtctttcacgagtcaccagaatagaggaacggtatcgcccgtccatggaaggctacagagcacccagccgccaggacgtgtatggcccccagcctcaggtccgtgttggcggatcctcagtggatctgcaccgatttcacccagagccctacggcttggaagatgaccagcgttccatgggctatgacgatcttgattatgggatgatgtccgattacggaacagcccggaggaccggcacacctagcgatccaagacgacgtctgcggtcatacgaagacatgataggagaagaggtccccagcgaccaatactattgggcgcctttggcccaacacgaacgcggaagcctggcaagcctggatagtctaaggaagggagggccgcccccgccaaactggcggcagccagagttgcctgaggtgatcgcgatgctgggcttccgccttgatgccgtgaaaagtaacgcagctgcctacttgcagcacctgtgttacagaaacgacaaggtgaagaccgacgtgaggaaactcaaaggcattcctgtgttggtgggccttctagaccacccaaagaaggaggttcatctcggtgcttgtggggcccttaagaacatttcatttgggagagatcaggacaacaaaatagctataaagaattgtgacggtgtcccggcactcgtacgattgcttcggaaggctcgcgacatggacttaaccgaagtgatcacgggaaccttgtggaatttgtcaagccatgattcaattaagatggagatcgttgaccatgctcttcacgcccttacagatgaagttattattcctcattccggatgggaaagggagcccaacgaggattgcaagcctcggcatatcgagtgggaatctgttttaacaaacacagcaggttgtctcagaaatgtgagttctgagaggagcgaggcaaggcgtaagctgagagagtgtgacggcctcgtggatgcattgattttcatcgtgcaggccgagatcggacagaaagactctgattcgaagctcgtcgaaaattgcgtatgtctcctgcggaacctaagttatcaagttcatcgcgagatccctcaagctgaacgctaccaggaagctgcgccaaatgtggcgaacaataccggcccccacgctgcaagctgttttggtgccaagaaaggaaaggggaaaaagccaattgaggatccagcaaacgacactgttgactttccgaagcgcacctcccccgcacggggttacgaactgcttttccagcctgaagttgtccgcatctatataagcctgctgaaggagtccaaaacccccgcaattctggaagcctcggcgggcgctatccagaacttgtgtgccgggcgctggacatacgggcggtatatccggagcgcgctaaggcaggagaaagccttgtcagccatagcagatctccttacaaatgagcatgagcgcgtggtaaaagctgcgagcggggctctgagaaacctagccgtcgacgcccggaataaggagcttattggcaaacatgcaatcccaaatctggtcaagaacctccctggaggccagcagaactcctcctggaacttctccgaagacacagttatcagtatactcaacacgattaacgaggtcatagccgagaaccttgaggcagccaaaaaactgcgagaaacacaggggatagaaaagctagttctcattaataaaagcgggaatagatccgaaaaagaggtccgggccgctgctctcgtgcttcagactatctggggctataaagagttgaggaagccactggaaaaggagggctggaaaaagtctgatttccaggtcaatctgaacaacgcttcccgatcccagtccagccatagctatgacgacagcaccttgcctctgatagatcgcaaccaaaagtcggataacaactatagcaccccaaatgagagaggcgatcacaatagaacgcttgaccggtcgggcgatttaggagatatggagccactgaaaggaaccacccccctgatgcaggacgagggacaggagtccttggaagaggagttggatgtgctggttttggatgacgagggtggccaggtctcatatcccagtatgcaaaaaatatag

SEQ ID NO: 111046 - DNA, 1755 bp, Artificial Sequence
  Description of Artificial Sequence: Synthetic coding sequence
atggatggctggcgcaggccactccagtcagtcggcaaagtgtgcgaaaaaaacatgaagacgagtgagatgcacacaatgtctggagcacagacaggaagaaaagagaagggggacccactgaatatagctatcgacaagatgacaaagaagactagagacctgcgccgccagttgcgcaaagcagtcatggaccacatcagcgactcattcctcgagactaacgtgcctttactcgtgcttatagaggctgctaagtcaggtaacgagaaagaagtaaaggagtatgcccaagtgtttcgcgagcatgcgaacaagcttgtggaggtagcaaatctggcctgttctataagcaacaatgaggagggcgttaaactggtgcgaatggccgctacgcaaattgactccctctgtccacaggtcattaacgcagccctgacactagccgcccgcccacagtccaaggttgcacaggataacatggacgtgtttaaggatcagtgggagaaacaggttcgagtattaactgaggctgttgatgatattacatcagtggacgatttcctctccgtgagtgagaatcacatccttgaggatgtaaacaaatgcgtgattgctctccaagaaggcgacgtagatacgctggaccgaacggctggcgccataaggggcagggctgcccgtgtgattcatatcataaacgctgaaatggaaaactatgaagccggagtgtacactgagaaggttcttgaagccaccaagctgttaagcgaaactgtgatgcctagatttgcagaacaagtggaggttgcaatcgaggctctatcagccaatgtgccgcagccgtttgaggaaaacgaatttattgatgccagtcgcctcgtttatgacggggttcgcgacatccgcaaagcagtgctaatgatacgcactcccgaagaactcgaggatgatagcgacttcgaacaggaagactacgacgttcgctcccggaccagcgttcagacagaagatgaccagctcatcgccggccagtctgcgcgtgccattatggctcagctgcctcaggaagagaaagcaaaaatcgccgaacaggtcgagattttccaccaggagaagtcaaagttggatgccgaggtcgccaagtgggacgacagcgggaatgacatcatagttcttgctaagcagatgtgcatgattatgatggaaatgacagacttcacaagaggtaagggtccgctgaaaaatacctctgatgtgatcaatgcagccaagaagattgccgaggccgggagccgaatggacaagctcgctcgggctgtggccgatcagtgtcccgactcagcgtgtaagcaggatctgcttgcgtatttacagcgtatcgccttgtactgtcatcagttaaacatatgctcaaaggttaaagctgaggtccagaacctaggaggcgagctgattgtgtcgggacttgactccgccacaagtctgatacaggcagccaaaaacctgatgaacgccgttgtcctaaccgtgaaggcgtcctacgtcgctagcacaaaataccagaaggtatatggcacggccgcggtgaactccccagtggtgtcctggaaaatgaaagctcccgagaagaagcccctggtaaagagagaaaaaccagaagagtttcagacacgggtaagacgcgggagccagaagaaacacatctcgccagtgcaagcgctctccgaattcaaagctatggactcattttag

SEQ ID NO: 111047 - DNA, 2820 bp, Artificial Sequence
  Description of Artificial Sequence: Synthetic coding sequence
atgagcggactcatatgcctgcagtacgggctgtggcacgggcagaaaatcgatttcgggggacctcgtagactcctgcaacgtaaccggggagagggctctatgactagcgctacgagtcctattatattgaaatgggaccctaagtcgctggagattaggacgcttacagtggaaaggctgctggagcccctggtcacacaggtgaccacgctggtgaacacttctaacaagggtccatccggcaaaaagaagggccggtcaaagaaggctcatgtgctggccgcgtcagtcgagcaagcaacccaaaacttcctcgagaagggcgagcagattgctaaagagtcacaggaccttaaggaggagcttgttgcagccgttgaggacgtgaggaaacaaggcgagaccatgagaattgcctcatctgaatttgccgatgatccttgctcaagcgtgaagcgcggcactatggtcagagccgctagggctttactgtccgccgtgacccggctcctaatcctcgctgacatggcagatgtcatgcgcctcctgagtcatctgaaaattgtggaggaggctctagaggctgtgaaaaatgctacaaatgagcaggacctggccaacagattcaaggagttcggtaaagagatggtaaagctaaactacgtcgccgccagaagacaacaggaactgaaagacccccactgtcgtgacgaaatggctgctgctagaggagcattgaaaaaaaatgccacaatgttgtacaccgcctcacaggcttttctccgccatcctgatgtggcagccacaagagcaaaccgggattacgtgttcaagcaagtccaggaggcgatcgctggcatcagcaacgccgctcaggcgacgtctcctacagacgaagccaaagggcataccggaatcggcgagttggccgcagccctgaatgaattcgataacaagataattctggatcctatgacgttttccgaggccagattccgccccagcctggaggagcgtctggagtccattatcagcggtgctgctctgatggcagacagttcctgtacccgggatgacagacgcgaacgcatcgtagcagaatgtaacgcggtcaggcaggcgctccaggatttgctatctgaatatatgaataacaccgggcgcaaagagaaaggcgatcccttgaacatagctatcgataagatgacaaagaaaacacgcgacctgcgacgtcagctgcgcaaagcggtcatggatcacataagcgacagctttttggaaacaaatgtgccgttactcgtgctgatcgaggccgcaaaaagcggcaacgaaaaggaggtgaaggaatatgcacaggtgtttagggaacacgcgaataagcttgtcgaagtggcgaacctcgcctgtagcatctctaacaatgaggaaggcgtgaaactggtgaggatggccgccactcagattgactctttgtgtccacaggtgattaacgccgctttgacactagcagcccggccacagagcaaagttgcccaggataatatggatgtctttaaggaccagtgggagaagcaggtgagagtgctgaccgaggcggtcgacgatatcacctccgtggatgactttttgagtgtaagcgagaaccacattctggaagacgtaaataagtgtgtcatagccctccaggagggcgatgtggacactttggaccggaccgccggtgcaattcgcggtcgagcagcccgggtgatccacatcatcaacgccgaaatggaaaattatgaagctggcgtttataccgagaaggtgttagaagctaccaagttgctgagcgagactgtgatgccacggtttgctgaacaggtggaagtcgctatcgaggctctgagtgccaacgtgccccagccctttgaagagaatgaatttatcgatgcctcaaggctggtctacgacggtgtccgcgatatccggaaagccgtacttatgattcggacgccggaggagctggaggacgacagcgacttcgaacaggaggactacgatgtgcgttctcgtacctctgtacagactgaagatgaccagctaattgctggtcagagtgcgcgcgccattatggctcaactgcctcaggaagagaaggctaaaattgccgaacaggttgagattttccaccaggaaaagagcaaattggacgccgaggtggccaagtgggacgatagtggcaacgacattatcgttctcgccaagcagatgtgcatgattatgatggagatgaccgatttcactaggggtaaaggtccactgaagaatacatctgacgtgatcaatgcagcaaagaagattgccgaggcaggttcccggatggacaagctcgccagagccgttgcagaccaatgtcctgattctgcgtgcaagcaggatctcttagcatacttgcaacggatcgccttatactgtcaccagttgaatatatgttccaaagtcaaggccgaggttcagaatctcggaggagagctcattgtaagcgggcttgacagtgccacttcgctgatccaggccgctaagaacttaatgaacgcggtggtgctaaccgtcaaagcgtcatacgtggcctccacaaagtaccaaaaggtgtacggtacagcagccgtgaatagtcctgtggtgtcatggaaaatgaaagccccagagaagaaacccctggtaaaacgggaaaaaccagaggaattccagacacgagtacggcgaggatcccaaaaaaaacatatctctcctgtccaggcactctctgagttcaaagccatggactcattctag

SEQ ID NO: 111048 - DNA, 2862 bp, Artificial Sequence
  Description of Artificial Sequence: Synthetic coding sequence
atgacatctgccacgagtcctattatcctgaaatgggacccgaagtctctggaaatcaggactctcactgtggagagactgctggaacccttggtcacacaagtcaccaccctggtcaacacatcaaacaaaggccccagcgggaagaagaagggtcgatccaagaaggcccatgtgctcgccgcgagtgtggaacaggccactcaaaactttctcgagaaaggagaacaaatagcgaaggaatcccaagatttgaaggaagagttagtggccgcagtggaggatgtgaggaaacagggtgagacgatgaggatagcaagttccgaattcgcagacgacccctgcagtagtgtaaaaaggggaaccatggtgagggcagcacgcgccctgctgagtgctgtgacccgacttctgattttagcggatatggcggacgtgatgagactcctatcccaccttaagatcgtggaagaggctctggaggctgtgaaaaacgccacaaatgaacaagacctagcaaataggttcaaagaatttggcaaagagatggtgaaactgaactacgtagcagcgcgtcgccaacaggaactgaaggatccacactgtcgcgacgagatggcagcggccaggggggctctcaagaaaaatgctactatgttgtacacagcaagtcaggccttcctacgtcatcctgacgtggccgccacccgtgccaaccgcgactacgtgttcaaacaggtccaagaagcgatcgcaggcatttcaaacgctgcacaggctacgtctcctacagatgaagcgaaaggacacaccggaattggtgagttagctgccgctctgaacgaatttgacaataaaatcatacttgatcccatgaccttcagcgaagcgcggtttagaccaagtctggaggagagactggaatctattatttccggtgcggctctcatggcagactcctcatgcacgcgggacgatagacgcgaaagaatcgtggccgaatgcaatgccgtgcgccaggccctgcaggatctgctgtccgagtacatgaataacactgggagaaaggaaaagggggaccccttgaacatcgcaatcgataaaatgacaaagaaaactagggatctccgacgacagctccggaaggcggtcatggaccacatctcagactcttttctcgaaactaacgtgccactgttggtcttgattgaggcagctaaatcagggaatgagaaggaggtcaaggagtatgctcaagtgtttcgcgaacacgcgaacaaactagtggaggtagccaacctggcttgtagcatcagcaacaatgaagaaggcgtcaaattagtgaggatggctgctacccagatagactccctttgcccgcaggtgatcaatgcagctctgacactggctgcacgaccacaaagtaaagtcgcccaagataacatggacgtgtttaaagaccagtgggagaagcaagtgcgcgttctcactgaagccgttgacgacattacaagtgttgacgactttctcagcgtttcagaaaatcatatcctcgaagacgtaaacaaatgcgtcattgccttgcaagaaggagatgtcgacaccctcgatcgcaccgcgggagctattcggggtagagctgctcgggtgattcacattatcaacgcggaaatggagaactacgaggctggagtgtacaccgaaaaagtcttggaggccacaaaactcctgagcgagacagtcatgcctcgttttgcagagcaggtggaggtggctatagaggcactatccgcgaacgtgccacagcccttcgaggaaaacgaatttattgacgcttccaggttagtttacgacggagtccgcgacattcgtaaggctgttttgatgatccggactccggaggagctggaagacgattccgactttgagcaggaggactatgatgtgcgttcccgtacatcagtccagacagaggatgaccagctgatcgccggacagagtgccagggccatcatggcccagttgcctcaggaggagaaggccaaaatcgctgaacaggtggagatattccatcaggaaaaatctaagctcgacgcagaggttgcaaagtgggatgatagcggtaacgacattatcgtcttagcaaaacaaatgtgtatgataatgatggaaatgactgacttcacaagagggaagggccccctgaaaaatacctctgacgttattaacgctgccaaaaaaattgctgaagcgggtagcagaatggacaagctcgcccgcgcggtggcagaccagtgccctgattcagcatgtaagcaagacttgttagcctacctgcaacgaatcgccctctattgccatcagctcaacatttgttccaaggtaaaggccgaagtccagaacttaggaggagagctgattgtcagtggtactggtgtccagagtaccttcactactttctatgaagtcgactgtgacgtgatcgatggtgggcgagcgtcgcaactctcaacacacttgccaacatgcgcagaaggggctccaatcggttctggttcatccgatagttccatgctcgattccgccacaagtctcattcaagccgcgaaaaatctgatgaacgctgtcgtgctcaccgtaaaggccagttacgttgcctcaacaaagtatcagaaggtctacgggaccgctgcggtcaatagcccagttgtgtcatggaagatgaaagcccccgagaaaaagccgctcgtgaagcgcgagaagcctgaagaatttcagactagggttcgcagaggcagtcagaagaaacacatatcaccggtacaggctctatccgaatttaaggctatggactccttttag

SEQ ID NO: 111049 - DNA, 354 bp, Artificial Sequence
  Description of Artificial Sequence: Synthetic coding sequence
atgacaagtgcgaccagcccgatcattctgaagtgggatccaaagtctttagaaattcgcacacttactgtggaacggctcttggaaccactggtcactcaggttacaaccctggtcaacacatctaacaagggcccctccgggaaaaagaaagggaggtctaagaaagcacacgtgctcgcagcctccgtggagcaggctacgcagaacttcctggagaagggcgaacagatagccaaagaaagccaggatttaaaagaagaactggtagccgccgtggaggacgtaaggaaacagggagaaactatgcggatagcctctagcgagttcgccgacgatccttgttcatcatag

SEQ ID NO: 111050 - DNA, 201 bp, Artificial Sequence
  Description of Artificial Sequence: Synthetic coding sequence
atgacttccgctacatcccccattattttgaaatgggatcccaaaagccttgagatacggaccttgaccgtggaacgcctgttagagccactggtaacacaggtgaccaccctggtgaatacaagcaacaaaggccctagcgggaagaagaaaggaagatctaaaaaagcacatgtgctcgccgcttcagtggagcaatag

SEQ ID NO: 111051 - DNA, 2718 bp, Artificial Sequence
  Description of Artificial Sequence: Synthetic coding sequence
atgacctccgcgaccagcccaataattttaaaatgggatccgaaatctctggagatccgaaccctaacagtagagagacttctcgaacctctggttactcaggtaactaccttggtgaatacttcgaataaggggccatcaggcaagaaaaaaggcaggtctaaaaaggcgcatgttctggccgccagcgtcgagcaggccacccagaacttcctggaaaagggtgaacaaattgcaaaagaaagccaagatctgaaggaagaactcgtggcagccgttgaagatgtgcggaagcagggtgagactatgagaatcgctagctccgagttcgcagacgacccatgcagcagcgtgaagagggggaccatggtgagagccgccagagctcttctctccgcggttacgaggctcctcattctcgccgatatggccgatgtcatgcgcttgctatctcacttaaaaatcgtggaggaggcccttgaagctgtaaagaacgcaacaaacgagcaggatctcgcgaacagattcaaggaattcgggaaagagatggtgaagttgaattatgtagccgcaagaagacagcaggagctgaaagacccacattgtcgtgacgaaatggccgcagcacgcggtgctctcaaaaaaaacgccaccatgctgtacactgcatctcaggccttcctgcggcacccagacgtggctgccactcgggcaaatcgcgactacgtgttcaagcaagtccaggaagccattgcgggcatatctaatgccgcccaggctacgagcccaaccgatgaggctaaaggacataccggaatcggcgaacttgccgctgccctcaacgaatttgataacaagatcatccttgacccgatgacattttcggaagcccgttttagaccgtctctggaggagcgcctggagagcattataagcggcgccgcactgatggcagattcatcgtgcacacgcgacgataggagagaaagaattgtcgcagagtgcaacgcagtgcgccaggccctccaggaccttctgagtgagtatatgaacaacacgggcaggaaggagaaaggagatcccctcaacatcgcaatagataagatgacgaaaaagaccagagatctgcgccgtcagttacgcaaggcagtgatggatcatatctccgacagtttcctagagaccaacgtgcccttgctggtactcatcgaggcagcgaaaagcgggaacgagaaggaggtcaaggagtatgcacaggtatttcgcgagcatgcaaataagcttgtggaagtggccaaccttgcttgctctatctccaacaacgaagagggcgtgaagttagtgagaatggccgccactcagatcgattccctatgcccccaggtaatcaacgcggctttgactctagcggccagaccacagtcgaaggttgctcaagacaacatggatgtgtttaaggatcagtgggagaagcaggtaagagtgctgactgaggcggtggatgacatcaccagtgtagacgatttcctctctgtttctgaaaaccacatcctggaggacgtgaataagtgcgtcatcgctctccaagagggggacgtggatacattggacagaacagctggcgcgatcagagggcgcgccgcaagggtgatccacatcatcaatgcagagatggagaattacgaagcaggagtctacactgaaaaggtcttagaggcaacaaagctgttgtcagaaaccgtgatgcctcgatttgcagagcaggtcgaagttgctatcgaagctctttctgcaaatgtgcctcagccatttgaagagaacgagtttatcgatgccagcaggctcgtctacgatggcgtcagagacattcggaaggcagtcctcatgattagaacgccagaggaactagaggatgactccgatttcgaacaagaggactacgatgtcagatctagaaccagcgtgcagacggaggatgaccagctgattgccgggcagtcagccagggcaatcatggcccagctgccacaggaggaaaaagcgaagattgccgagcaggttgagatttttcaccaggaaaagagtaagcttgatgccgaagtcgccaagtgggacgactcaggaaatgacataatcgtgctcgctaaacagatgtgcatgatcatgatggaaatgactgacttcaccagaggaaaaggacctctcaagaatacatctgatgttatcaacgcagctaagaagatcgccgaggccggctcgcgcatggacaaacttgcccgggcagtcgcagaccagtgtcccgattctgcatgcaaacaagacctcttggcctaccttcagaggattgcactctactgtcatcagttgaacatatgttccaaggtgaaagctgaagtccaaaacttgggcggagagttaattgtctcgggactggactcagctacctcattaatacaggctgctaaaaacctgatgaatgcagtggtcctgacagtgaaagcgagttatgtcgcctcaaccaaatatcaaaaagtttacgggaccgctgccgttaacagccccgtggtttcttggaagatgaaggcacctgaaaagaaaccgctggtgaagcgcgagaaaccagaggagttccagacacgcgtcaggcgcggttctcaaaagaaacacatttccccagtacaggcactctctgagttcaaagcaatggacagcttctag

SEQ ID NO: 111052 - DNA, 2718 bp, Artificial Sequence
  Description of Artificial Sequence: Synthetic coding sequence
atgacaagcgcaaccagcccaatcatcctaaagtgggatcctaagtcactcgagattcgaactcttaccgttgagcggctgctggagcctctggtcacacaagtcaccaccctggtcaatacctccaacaaggggccatctggtaaaaaaaagggccggtccaaaaaggctcacgtcctggccgcaagtgtggagcaggccactcaaaatttcctcgaaaaaggggagcagattgcaaaggagagccaagatttgaaggaggaactggtggcagccgtagaggatgttcggaaacagggcgaaacaatgagaatcgctagctccgagttcgctgacgacccctgttcttctgtaaaacgtggcacaatggtccgcgcagctagagcactgctctcagctgtcacccgcctgcttattctggccgatatggctgatgtcatgaggttgttgtcccacctcaagatcgtggaggaagccctggaagccgtcaagaatgcaactaacgagcaggacctggcaaacagatttaaggaatttggaaaggagatggtgaaattgaattacgtggcggctagacggcagcaggagctgaaggatcctcattgccgagatgagatggccgcagcccggggtgctttaaagaagaatgctaccatgctgtatactgctagtcaggcttttttaagacaccccgatgtcgccgccacacgggctaatagagactatgtcttcaagcaggtgcaggaggccatcgccggcatcagcaacgcagcgcaggcaaccagccccacagatgaggcaaaaggacacactggaataggcgaactggccgccgcccttaatgaattcgacaacaagatcatactcgatccaatgaccttctctgaggcccgtttccgcccctcgctcgaggagagactagagtccatcatcagcggcgccgccctcatggctgactccagctgtacgagggacgacagaagagagcggatcgtcgcagagtgcaacgctgtccgccaggccctgcaggatctgctgtctgaatacatgaataatacaggccggaaagaaaaaggtgatccgctaaacatcgctatcgataagatgactaagaagaccagagacctaagaaggcagctcagaaaggctgtcatggatcacataagcgattccttcctggagacgaatgttccacttttggtactcatcgaggctgccaagtcggggaatgagaaagaagtaaaagagtatgctcaggtcttccgagagcacgctaacaagctggtggaggtagctaaccttgcttgtagcatcagcaacaacgaagagggagtcaaactcgtgcgtatggcagctactcagattgattcactgtgcccgcaggtaattaacgccgctttgactctcgcggcgcggccacagtccaaagttgcccaggataatatggatgttttcaaagatcagtgggaaaaacaggtgagagtgctaacagaggcagtggacgacatcacgagtgtggatgactttcttagcgtttctgagaatcacatcctcgaagatgtcaataaatgtgttattgctttgcaggaaggagatgtcgatacccttgatcggacagccggcgctatccgagggagggccgcccgcgtaattcacatcataaatgcggaaatggagaactatgaggctggagtgtacaccgagaaggtactggaagctaccaaactgctgtctgagacagtcatgccccgcttcgcagagcaggtcgaagtggcaattgaggcactctccgccaacgttccacagcctttcgaggagaacgagtttattgatgccagtcggttggtgtatgatggggtcagagacataagaaaggccgtgttaatgattcgtactccagaggaactggaagatgactctgattttgaacaggaggattacgacgttagaagccggacaagcgtgcagacggaggatgatcaactcattgctggacagtctgctagggctattatggcacaactcccccaagaagaaaaggctaagatcgcagagcaggtcgagatatttcatcaagagaagagtaaactggacgcggaagttgccaaatgggacgattccggtaacgacatcatcgtgctggccaagcagatgtgcatgatcatgatggagatgacagacttcactaggggcaagggtccacttaagaataccagcgatgtgattaatgccgccaagaagatcgcagaggccggatcacgaatggacaaattagcaagagcagtggcagaccagtgccccgatagcgcttgtaaacaggacttgctcgcctaccttcagcgcattgccctttactgtcaccaacttaacatttgtagcaaggtcaaagccgaggtccaaaacctagggggcgagcttatcgtgtccggtctggacagcgcaacatccctgattcaggccgcaaagaacctgatgaacgccgtggttctcaccgtgaaggcttcgtacgtggcgtccacgaaataccagaaagtgtacggcactgctgctgtaaactccccagtagtgagttggaagatgaaggctcccgaaaagaaacccctggtgaagcgggaaaaacccgaggagttccagacccgggtgcgcagaggatctcagaagaagcatattagcccagtccaggccctgagtgagttcaaagcgatggactcattttag

SEQ ID NO: 111053 - DNA, 2583 bp, Artificial Sequence
  Description of Artificial Sequence: Synthetic coding sequence
atgacatctgcaacttcacccatcatccttaagtgggacccaaagtcacttgagattcgcacactgacagtggagaggctcctagagcctttagtgacacaggtgaccactcttgtcaacacctccaacaaagggcctagcggcaagaagaaggggcgaagcaagaaggcgcacgtgttggctgcgtcggtggagcaagctacccagaactttctggagaagggggaacagattgctaaagagagccaagacctcaaggaagagctggtggccgccgtcgaagatgtgcgtaagcaaggagagaccatgagaattgcaagtagcgagtttgcagacgacccctgctctagcgtgaagcgcgggactatggtgagggccgcacgagccttgctgtcggccgtgacaagacttctcattttggcagacatggccgacgtcatgagacttcttagccaccttaagatcgtagaggaggctctcgaggctgtgaagaacgctaccaatgagcaggatctcgctaatagattcaaggagtttggaaaagagatggtcaaactgaactatgtcgcggcccggcgacagcaagaattaaaggaccctcattgcagggacgagatggctgctgcccggggcgctcttaaaaaaaacgctaccatgctgtacacagcctcccaggcctttcttcgtcacccggatgtggccgcaacacgtgccaatagggattacgtgtttaagcaggtgcaggaagctattgctggaatcagtaatgcggcccaagccacatctcccacagatgaagctaagggacacaccggcattggtgaactcgctgccgcgcttaatgagtttgacaacaaaatcatactggaccctatgaccttctctgaagccaggtttcgaccctctctggaggaacgactggaatcaatcatctcaggtgctgctctgatggccgactcttcttgtactcgagacgaccgccgggagagaattgtggctgaatgcaacgcagtacggcaggctctgcaggatctcctgagcgagtacatgaacaataccggaagaaaggaaaagggagatccccttaatatcgcaattgataagatgaccaaaaagacacgtgaccttaggcgacagttgcgcaaggctgtgatggatcacatatctgattcatttctggaaacaaacgttccactcttagtcctcatagaagccgcaaagagcggcaatgagaaagaagttaaggagtatgctcaagtgttccgagaacacgcaaacaagctggtcgaggtggctaacctggcatgcagtatttcaaacaacgaggagggcgtgaagctcgttcgcatggccgccacacagatcgactctctctgtccccaggttattaacgcagcactcactctggctgccaggccccaaagcaaagtggcccaagacaacatggatgtgtttaaggaccagtgggagaagcaggtccgcgtactgactgaggccgtggatgatataacgtctgtagacgattttctctccgtcagcgagaaccacatcctggaggacgtaaataaatgcgtaatcgcactccaggagggggacgtggacacactggaccggacggccggcgccatcaggggacgcgcagccagagtgatccacatcataaacgccgagatggaaaattatgaggccggggtctacacggagaaagttttggaggcgacaaaactgctgtctgagaccgtgatgccgcggttcgcagaacaagtggaagtggccatcgaggccttgtccgctaacgttcctcagccctttgaggaaaatgagttcatcgacgcaagcaggctagtctatgatggcgttcgcgacatcaggaaagccgtgctgatgatcaggactccagaggagctggaagacgatagtgatttcgagcaggaggactacgatgtgcggagccgcacaagtgttcagacagaggatgatcagttgattgcgggtcagtctgctagagccatcatggcacagctgcctcaggaggaaaaagcaaaaattgctgaacaggtcgagatttttcatcaggaaaaatctaagctggacgcggaagtggctaaatgggatgattctggaaacgatatcatcgtcctcgccaagcagatgtgcatgatcatgatggaaatgacagacttcacgaggggtaagggccccctaaaaaatacttcagatgttatcaatgctgctaagaaaatcgccgaggcaggaagtcggatggataagcttgcccgggccgtagctgaccagttggattcagccacctctctgatccaggccgcaaaaaatcttatgaacgctgttgtcctgactgtgaaagcatcttacgtggcctccacaaaataccagaaagtgtacggcacggccgccgtgaattcacctgtagtttcatggaagatgaaagccccagaaaagaagccactggtcaaaagggaaaaaccggaggagtttcagacacgggtccgccgagggtcgcagaagaagcacatatctcctgtacaagcactctccgaatttaaagcaatggactctttctag

SEQ ID NO: 111054 - DNA, 2718 bp, Artificial Sequence
  Description of Artificial Sequence: Synthetic coding sequence
atgacaagcgcaacaagtcctattatactgaagtgggacccaaagtctctcgagataagaaccctaactgtggaacgccttctcgaacctttggtcacgcaggtcaccacacttgtaaacacttccaataaggggccaagtgggaagaagaaaggcaggtccaaaaaagcccacgtgcttgccgcatccgtcgagcaggctactcagaacttccttgaaaagggcgagcaaatcgctaaagagtcccaggacctgaaagaggagctcgttgccgccgtggaggatgtgcgcaagcagggggagaccatgcgtatcgcttcctcagagttcgcagatgatccctgcagcagcgtgaagcggggaaccatggtccgggccgcacgagcgctgctgagcgccgtcacacgacttctaatcctggcagatatggcagacgtcatgagactgcttagtcatctgaaaatagtagaggaggccctcgaggctgtaaagaatgccactaacgaacaggacttggccaataggtttaaagagttcggaaaagagatggtgaagctcaactacgtggctgcccgtcgtcagcaggagttgaaggatccacactgtcgtgatgaaatggctgcagctaggggagctctgaagaaaaatgccaccatgctttatactgcctctcaggcgttcctgagacaccccgacgtggctgccacaagagctaatcgggattacgttttcaagcaggtgcaggaggctatcgccggaatctctaacgcagctcaggccacatcccctaccgatgaggccaaagggcacacagggattggagagctggccgctgcacttaacgagtttgataacaagattatcctcgatccgatgaccttcagcgaggcacgatttcgccccagcctggaagagagactggaaagcattataagcggagcagccctgatggccgactccagctgcacacgcgatgataggcgggaacgtattgtcgctgagtgcaacgcagtcaggcaagcattgcaagatctgctgagtgaatatatgaacaatacggggaggaaggagaaaggtgatccactgaatatcgccatcgataaaatgaccaagaaaacaagagacctcagaaggcagctgcgcaaggcagttatggaccacatctctgattcatttctcgagactaatgtccccctcctggttcttatagaggccgctaagtctggcaacgagaaggaggtgaaagaatacgcccaagtgttccgagagcacgccaacaagctcgtggaggtcgcaaacctcgcctgttctatcagtaacaatgaggagggagtgaaactcgtgagaatggctgctacccagatcgacagcctgtgcccccaagtcattaacgctgccctgactctggctgctcggccacagtctaaggttgctcaggataacatggacgtatttaaggatcagtgggagaagcaggttcgggtactaacggaggcagtggacgatataacctccgttgacgattttttatccgtgagtgaaaatcatatcctggaagatgtcaacaaatgtgtgattgctctacaggagggagatgtcgacactctagaccgtactgctggtgccattcgcggaagagcggcccgcgtaatccatatcattaatgcagagatggagaattacgaggctggcgtctatacagaaaaggtcctagaggcaaccaaactcctgagcgaaactgtgatgcctagatttgcagaacaggttgaagtggcgattgaggcgctgtctgctaacgtgccccagccctttgaggagaatgagttcatcgacgcctcccgtctggtgtatgacggggtccgcgatatccgcaaagccgtattgatgatacgtacgccagaggaacttgaggatgatagcgatttcgagcaggaggattacgacgttagatcaagaactagcgtacaaacagaagatgatcagctgatcgctggacagtccgctagagctataatggcccaactgccccaagaggagaaggcaaagatcgctgaacaggtagagatctttcatcaagaaaaaagtaagctagacgcagaggtggctaagtgggatgactctggaaatgacattatcgtcctcgccaaacagatgtgcatgattatgatggaaatgacagactttacgagagggaaggggccgttgaaaaatacttccgacgtgatcaacgcagccaagaagattgcggaagccggaagccgtatggacaagctagccagggctgtggccgatcagtgtcctgattcagcttgcaagcaggaccttctcgcctacctgcagcgtatagcactgtactgtcatcagcttaacatatgcagcaaggtgaaagctgaagtgcaaaatctgggtggtgagttgatagtgtcaggactagactctgccacctcattgattcaggcggccaagaatctgatgaatgcagtggtcctcacggtcaaagcgagttacgtggcctcaactaagtatcaaaaagtgtatgggacggctgcggtgaattctcctgttgtcagttggaagatgaaagctccagagaaaaagcccctagtgaaacgcgaaaagcccgaagaatttcagactcgagtgcggaggggcagccaaaagaaacacatctcacccgtccaggctctgagcgagttcaaggccatggattctttctag

SEQ ID NO: 111055 - DNA, 582 bp, Artificial Sequence
  Description of Artificial Sequence: Synthetic coding sequence
atgagcgctgagactcctataaccctgaatatagacccacaggacctgcaggtacagacgttcacagtggaaaaactcctcgaaccgttgattatccaggttactacgctcgtgaactgcccgcaaaatccatcttcgcgtaaaaagggacgctcaaagagggcaagtgtcctgcttgcatctgtcgaagaggccacatggaacctgttggacaagggagagaagatcgctcaggaagcaactgttctaaaggacgagctgactgcatccctggaggaggtgcgcaaggagtccgaggccctgaaggtctccgcggagcggtttacggatgatccctgctttctaccgaagcgggaagctgtggtgcaagcagctcgggcgctgctggccgccgtaacaaggctgctgatcttagcagatatgattgatgtgatgtgtcttttacaacacgttagcgctttccagcgcacgttcgaatcattgaaaaatgtggccaacaaatcagatcttcagaagacctaccagaagttgggcaaggagttggagaatttagactatctggccttcaagcgccagcagtag

SEQ ID NO: 111056 - DNA, 705 bp, Artificial Sequence
  Description of Artificial Sequence: Synthetic coding sequence
atgacccagttgccagaggcagaaaaagagaaaatcgctgaacaggtggctgactttaaaaaagtcaaatctaagctagacgcagagatcgagatttgggacgacacctccaatgacataattgtgcttgcaaagaatatgtgtatgatcatgatggaaatgaccgactttacccgaggaaagggtcctctgaagcacactacagacgtaatctacgcggctaaaatgatctctgaatcagggagccgcatggacgtactggctcggcagatcgctaatcagtgtcccgatccttcctgcaaacaggatttactggcctacttggagcagattaaattctattcgcaccagctcaaaatttgtagtcaagtaaaggccgaaatccagaatctaggcggcgaactcattatgagcgcacttgatagtgtgacctccttaatccaagccgctaaaaatctcatgaacgccgtggttcagacagtgaagatgagttacatcgcatccaccaaaattatcagaattcagtctccggccggcccccgccatcctgtggtgatgtggagaatgaaggcaccagccaaaaaaccactgataaagcgggaaaagccagaggagacatgtgcagccgttagacgcggaagtgctaagaaaaagattcaccccctgcaggttatgtctgagttccggggaagacaaatatactag

SEQ ID NO: 111057 - DNA, 2688 bp, Artificial Sequence
  Description of Artificial Sequence: Synthetic coding sequence
atgtcggccgagacccccatcacccttaatatcgatccgcaagatctgcaagtgcaaacatttacagtggagaagctgctcgagcctttaatcattcaggtgacgaccctagtgaattgtccccagaaccccagcagtcgtaaaaagggccgctccaagcgtgcttctgtactgctggcgagcgtcgaagaagcgacctggaacctgctcgataaaggtgagaagatagctcaagaagccacggtgctaaaagatgaactgactgcaagcttggaggaagtgcggaaggagagcgaggcactgaaggtctctgcggagcggttcacagatgatccatgcttccttcccaaacgagaggccgtggtgcaagccgcacgggctctcctcgcagcagtcacacggctgcttatcttggccgatatgattgacgttatgtgtctacttcagcatgtctcagcatttcagcgcacatttgagagccttaaaaacgtggccaataagagcgatctgcaaaaaacgtaccagaagctgggcaaagaactggagaatttggattacctggctttcaagagacaacaggatctgaagtccccaaatcagcgggacgaaattgccggagctcgcgcaagtctgaaggagaattcgcctttactgcactcaatctgctcagcttgcctggaacactcggatgttgcatccctaaaagctagcaaggatactgtgtgtgaggaaattcagaacgcccttaacgtgatcagcaatgcctctcaggggatacagaacatgacgaccccaccagagcctcaagcagctactctgggtagcgcactggacgaactggagaacctcattgtattgaaccccctgacagtaacggaggaagagatcagacccagtctcgagaaacgcctcgaggccattatatcaggggcagcattgttggctgattcgagctgtacccgggatctgcacagagaacgcattatcgccgaatgtaatgcaattagacaggccctccaggatcttctgtctgagtatatgaacaacgccggcaagaaggagagaagcaataccctgaatattgccctggataacatgtgtaaaaagactcgggatcttaggagacaactccgaaaggcaattatcgaccatgtttctgattcattcctggacacaactgttcccctgttagtcttaatagaggctgccaaaaacggccgtgagaaagaaataaaggagtacgccgctatattccacgaacacacgagtaggctggttgaagtcgctaatctggcgtgcagcatgtctaccaacgaagacgggatcaaaatagtgaagatcgctgccaaccacctcgagactttatgcccacagatcatcaatgccgctctggctctcgcagctcgacctaaatcccaggccgtgaaaaatacaatggaaatgtacaagagaacgtgggaaaaccatattcacgtcctcactgaagctgtggacgatataacctctatcgacgatttcttagccgtgtcggagtcccacattctggaggacgtcaacaagtgcatcattgcattaagggatcaggacgcagacaacctggatcgagccgctggcgcgatacggggtcgcgcggcccgcgttgcccatatcgttactggagagatggatagttatgagccaggggcgtatacagaaggcgtgatgcggaatgtgaatttcctgacatcaactgtcatcccagagttcgtgacgcaggttaatgtcgccctcgaagcactgtccaagtcatcattaaacgtgctggacgataatcagttcgtggacatctccaaaaaaatttatgacacaatacatgacattcggtgttctgtgatgatgatccggaccccggaagagctcgaagacgtttccgaccttgaggaagagcacgaggttcgcagtcacaccagtatccagacagaaggaaaaacagacagagcaaagatgacgcagttgccagaggcagagaaggagaagattgcagaacaagtggcagacttcaagaaggtgaaaagcaagctcgacgctgaaatagagatatgggacgatacatccaacgatataatagtgctcgcgaagaatatgtgtatgatcatgatggagatgacagacttcacccgcggcaagggcccactgaaacacaccacagacgtgatctatgcagctaaaatgatttccgaatcaggcagccgcatggatgtacttgcgaggcaaattgcaaaccagtgccccgacccctcttgtaaacaggacctgctcgcataccttgagcagatcaagttttacagccatcaactgaagatttgtagccaggtcaaggctgagatccagaacttgggcggcgagctgataatgtccgcactggattcagtgaccagtctgatccaggcggcaaaaaatttgatgaatgcagttgtgcaaactgtcaagatgtcatatattgctagtacaaagatcatccggatccagtctcctgccggacctaggcatccagtcgtaatgtggagaatgaaggccccagcgaaaaagcctctgatcaagcgcgaaaaaccggaggagacatgcgcggctgtacgcagggggagtgccaagaagaagatccatcccctgcaggtgatgtctgaatttagaggacgacagatttattag

SEQ ID NO: 111058 - DNA, 2688 bp, Artificial Sequence
  Description of Artificial Sequence: Synthetic coding sequence
atgtcggccgagacacctataacactcaatatcgacccccaagatctgcaggtgcagaccttcacagtggaaaagttacttgagccgctcatcatccaggtgacaacattggtaaactgcccgcagaatccaagtagccgtaagaagggccggtccaagcgagccagcgtgctccttgcttcagtagaagaagctacgtggaaccttttagataaaggtgagaagattgcacaggaggcgaccgtgctgaaagacgagctaacggcctcactcgaggaagttcgcaaggaaagcgaggccttgaaggtgagtgcagagaggtttacggacgacccttgtttccttcccaagcgggaagccgtggtacaggccgctcgagccctcctggccgcagtgacaaggctgctgatcctggctgacatgatcgatgtgatgtgtctgctgcaacatgtgagtgccttccaaaggacgtttgagtctctcaaaaacgtagcaaacaagtctgacttgcagaagacctatcagaaactcggaaaagaactggaaaacctggactacctagctttcaagcgccagcaagacctgaaatctcccaaccaacgggatgagatcgccggcgcccgggcctccttgaaagagaatagcccgctgctgcattccatctgcagtgcatgtctcgagcactccgacgtggcatccctaaaggcatccaaagacactgtctgcgaagagatccagaatgccttaaatgtgatatccaacgctagccaaggtatccagaacatgacgacaccacccgagccacaagccgctaccctcggaagtgccttagatgaacttgaaaatcttatagtactgaatccactcactgtgacagaagaagaaattcggcctagcctggagaaaaggctcgaggcgatcatctcaggcgcggcccttctcgccgattcttcttgcactcgggacttgcacagggagcgtattatcgccgaatgtaacgcaattcggcaggcgctgcaggatctcctgagcgaatacatgaacaacgccgggaaaaaggagcggtcaaacacactaaacattgcactggacaatatgtgtaagaaaacaagggacctgcgaaggcagctgaggaaagctatcatagaccacgttagcgactcgtttctcgatacgacagttccattactggtgcttatcgaggcggccaagaacggaagagaaaaagaaatcaaggagtatgccgcaatattccatgaacacaccagcaggctcgtagaggtggctaatctcgcttgcagcatgtcaaccaacgaggatggtattaaaatcgtgaagatcgcagcaaatcacctggaaaccctgtgcccacagatcataaacgccgccctcgctcttgccgcacggcccaaatctcaggccgtgaaaaacactatggagatgtacaagagaacgtgggagaatcatatacatgtgttaacggaggctgtggatgatatcacctccatagatgattttctggctgtatctgagtcccatattctggaagacgtgaacaagtgcattatcgcgctgcgggatcaggacgccgataatcttgacagggcagccggcgccatccgcgggcgcgccgctcgggtggcgcacatcgtgaccggagagatggattcctacgagcctggagcgtacacagagggggtgatgcggaacgtcaactttctgaccagtactgtcatcccagaatttgtgacacaagttaatgtggctctcgaggccctgtccaaatcctcgctgaacgtgcttgatgacaaccagtttgtcgatatcagcaagaaaatatacgatactatacacgacatccgctgcagcgtgatgatgatcagaacaccagaggaacttgaagacgtgagtgacttggaggaggagcacgaagtgcgaagtcatacttcaatccaaaccgaggggaagactgatagggcaaagatgacccagctaccagaggcagagaaggaaaaaatcgccgaacaggtcgcagattttaagaaagtcaaatccaaactcgatgctgagatagagatctgggatgacacctcaaacgacataattgtactcgctaaaaatatgtgtatgatcatgatggagatgacagatttcacaagaggcaaggggcccctgaagcacaccacggacgtaatttatgctgcgaagatgatctccgaatccggcagtaggatggacgtgcttgcaagacagatagcaaaccagtgcccggacccgtcttgcaaacaggacctacttgcctacctcgagcaaatcaaattttatagtcaccagttgaagatctgtagccaggtgaaagccgagattcagaatcttggcggagagctgatcatgtccgccctggacagcgtgactagcctcatccaggctgccaagaaccttatgaatgcagtggtgcagaccgtgaagatgagctacattgcgtcaacaaagatcatcaggattcagtcccccgccggtcctcgacaccccgtggttatgtggcggatgaaagcgcccgcgaagaagccattaattaaacgggagaagcccgaagagacctgtgctgcagtccgtaggggatcagcaaagaagaagatccatccactgcaggttatgtctgaatttaggggccgccagatttactag

SEQ ID NO: 111059 - DNA, 1131 bp, Artificial Sequence
  Description of Artificial Sequence: Synthetic coding sequence
atgagcgcagagacccccattaccctgaacattgatccacaggacctgcaagtccagaccttcaccgttgaaaagctgctggagccccttatcattcaggtgacgacgcttgtcaattgcccccagaacccttcatcgcggaaaaagggtaggtccaagcgggctagcgtgctgctggcatctgtagaagaggctacatggaatctgctggacaagggggaaaaaatagcccaggaggctactgtgctgaaggatgagctgactgctagtttggaagaggtgcggaaggagtctgaagcccttaaggtgtctgctgagcgcttcacagacgatccgtgtttcctgccaaagagggaagccgtagtgcaagccgcgagggccctcttagctgctgtgactcgcctgctgattctcgccgatatgattgacgtcatgtgtttgctgcagcatgtgtccgcgttccagcggacatttgaatccctcaagaatgtggccaacaaatctgatctacaaaaaacctaccagaagctggggaaggagctggaaaacttggactatctcgcgttcaagcgccagcaggacctgaagtctcctaatcagcgagatgaaatcgccggggcccgcgcaagtctgaaggagaactctccactgttgcatagcatctgtagcgcatgcctcgaacactcggacgtggcctcccttaaggctagcaaggatacggtgtgtgaagaaattcaaaatgcattgaatgtcattagcaatgctagccaggggattcagaacatgactacccctccagaacctcaggcagctaccctcggcagcgcactcgacgagctggaaaatctgatcgtcctgaatcccttgactgtaacagaggaggagattcgacccagcctagagaagcgcctggaagccatcatatccggcgctgctcttcttgcagatagttcatgcaccagagatctgcatagggaaagaattatcgccgaatgcaatgcgatcagacaggcccttcaggacctgctgagtgaatatatgaacaatctgtgtaatcagaaatccgaccttgggttaacgggcgtcaagattaagctactcgaggaatgcatcattttctggtccctctag

SEQ ID NO: 111060 - DNA, 582 bp, Artificial Sequence
  Description of Artificial Sequence: Synthetic coding sequence
atgagcgcagaaaccccaatcaccctgaatattgacccccaagacctgcaggtccaaactttcacagtggaaaaactgttagagccattgataatccaggtaactaccctggtcaactgtccccagaatccttcttcacgtaagaaaggacgcagtaaaagagctagcgtgctgctggcttctgtggaagaagcgacttggaatctgcttgacaaaggcgagaagattgctcaggaggccaccgtgctgaaggatgagttgacagcctcactggaggaggttagaaaggaatccgaggccctaaaggtcagcgcggagaggttcacggatgatccatgtttcctgccaaaacgcgaagcagtggtgcaggccgctcgagccctcttagccgcagtgacccggctgcttattttagctgatatgatcgatgtcatgtgtctactccaacatgttagcgcattccaaagaaccttcgagagccttaaaaatgtcgccaacaagtctgacttgcagaagacctaccagaaattggggaaggagctagaaaacttggactacctggcctttaagaggcagcagtag

SEQ ID NO: 111061 - DNA, 1131 bp, Artificial Sequence
  Description of Artificial Sequence: Synthetic coding sequence
atgtcagctgaaaccccaatcacattaaacatcgaccctcaggacctgcaggttcaaacatttaccgtggaaaaactactggaacctctgattatccaggtaacaaccctggttaactgccctcagaatcctagctctcgtaagaaaggtagatctaagagggcctccgtgctgctggcctctgtcgaagaggcaacgtggaacctactggataagggggaaaagatagcccaggaggccactgttctgaaggacgagctcactgctagcctcgaggaagtcagaaaggaatcagaggccctgaaagtctccgcagagcgtttcaccgatgatccgtgcttcttacctaagcgggaggcagttgtgcaggcggcccgggctctgctggctgcggtaacaaggttactgatcctggcagatatgatagatgtaatgtgcttactccagcatgtgagcgccttccagcggacattcgagtcactgaagaatgtcgccaacaagtcagatctccagaagacatatcagaagttagggaaggaactggaaaacctcgactaccttgctttcaagagacagcaggatcttaagagccctaaccagagagacgaaatagcaggcgcccgggcctctctgaaagaaaactctcccctgctgcatagtatctgttcggcttgcttggagcacagcgacgtggccagcctgaaggcgagcaaggacacggtgtgcgaggagatccagaatgcattaaatgtgatttccaacgcttcccagggtatccagaatatgactacccctcccgagcctcaagcggctaccttgggcagcgctctcgatgaactggagaaccttatcgtcctcaatcccctgacagttacagaagaggagataagaccttctctagagaaacgcttagaagccataatttccggagccgctctgttggccgacagctcttgcacacgggatctgcatcgggagcgcattatcgccgagtgcaatgcaattcgacaggccctccaggacttgctttcagaatacatgaacaacctgtgtaatcagaagagcgatcttggtctgaccggagtgaaaattaagcttctggaggaatgcattattttttggtccctgtag

SEQ ID NO: 111062 - DNA, 2205 bp, Artificial Sequence
  Description of Artificial Sequence: Synthetic coding sequence
atggccgcctcccccgggcctgccggcgtggggggcgccggagctgtttatgggtcaggctcgtccggcttcgcgttagattccggcttggagatcaagaccaggtcagtggaacaaacactgctgccccttgtctctcagatcacaacccttattaatcataaagacaatacaaagaaatcagataaaaccctccaggccatccagcgcgtgggacaggccgtgaatttggctgtagggagatttgtgaaagtcggcgaggccattgccaacgagaattgggacctcaaggaagaaataaatatcgcatgcatcgaggctaaacaggctggcgaaacaattgcagctctgacagatatcactaatctgaatcacttagagagtgacggacagataactatttttaccgataaaacaggggtgattaaggcagctcggctgctgctgtcttctgtgactaaagtgctgctgctagctgaccgggtggttattaaacagattatcacttcacggaataaagtcctcgccactatggagcgcttggagaaggttaacagctttcaggagtttgtacagatcttctctcagttcggaaatgagatggtagagttcgcacatctcagtggcgacagacagaatgaccttaaagatgaaaaaaaaaaggccaaaatggcagccgctagagccgttctcgaaaaatgcactatgatgctgctgaccgcaagcaaaacctgtcttagacacccaaattgcgaaagtgcccacaaaaacaaggagggcgtgtttgacagaatgaaggtcgcgcttgataaagtgatcgaaattgtgaccgactgcaaacctaatggggaaaccgacattagctctattagcatttttaccggaatcaaggagttcaaaatgaatatcgaggccctgcgcgagaatctctactttcaatctaaggagaacctgagcgtgaccttggaagtgattttggaacgtatggaagattttaccgactctgcttacactagccatgaacacagggagcgaattctggaattatctacacaggcccggatggagttgcagcaactcatctcagtgtggatccaggcgcaaagtaaaaaaacaaagagtatcgcagaagaactggagttgtccatcctgaagatttcccactcgctgaacgagctcaaaaaggagctccacagtacagccacccaactggcagccgatctgctcaagtaccacgccgatcatgtcgtgctaaaagcactcaagctgactggggttgaggggaatctcgaggccttagccgaatacgcatgtaagctgtccgagcagaaagaacagctcgtggagacgtgtcggttgctaaggcacatctcgggcacagagcccctggagatcacctgtatccacgcagaagaaacctttcaggtgactggtcagcagatcatcagcgccgcagagactttgactctccatccctcctcaaaaatcgcaaaggaaaatctggacgttttttgtgaggcgtgggagtcacagatctccgatatgagtacactgcttagagagattaatgatgtgttcgagggccgccggggagaaaagtacggatacctgagcctcccaaaacctatgaagaacaacgctaaccttaaatccctgaagcccgataaacccgactccgaagagcaagccaagattgccaagttggggctgaagttggggctcctgactagcgatgccgattgcgaaattgaaaaatgggaggatcaagagaacgagatcgtgcagtacggacgtaacatgtcctctatggcctattctctatatctgtttacacgcggcgaagggcccttaaagacttcccaagatctcatccaccaactggaggtcttcgcggccgaggggctgaagttgacatcatccgtgcaggcgttttctaagcagctgaaggatgacgacaagcttatgctgcttcttgaaattaacaaacttatcccactgtgccaccagctgcagactgttaccaagaccagcctgcaaaataaggtgtttctgaaagtggacaaatgtattacgaagactagatctatgatggctctgttggttcagctcctctcactgtgctacaaacttctcaaaaaacttcagatggagaataatggctgggtctctgtcaccaataaggacacaatggactccaagacatag

SEQ ID NO: 111063 - DNA, 1953 bp, Artificial Sequence
  Description of Artificial Sequence: Synthetic coding sequence
atggcagcaagcccaggtcctgccggggtcgggggggcgggcgctgtgtacggatccggaagcagtggatttgcacttgattccggtctggaaatcaaaacacggagcgtcgaacagactttattacccctcgtttcccaaatcacaacactcatcaaccataaagacaatacaaaaaaatcagacaagaccttgcaggcaatccagcgcgtggggcaagctgtcaatctcgccgtgggtcgatttgtgaaagtgggcgaggcgattgcgaacgagaattgggacctgaaggaggagatcaacatcgcgtgtatcgaggcgaagcaggctggcgaaactattgccgccctaactgacatcactaacctgaaccatctcgaaagcgacgggcagataaccatcttcacagataagacaggcgtgatcaaagccgccaggctgctactctcttccgtgactaaggtactcttgctggcagatagagttgtcattaaacagattattacaagccggaataaggtgctcgcaaccatggagcgactggagaaagtgaatagcttccaagaattcgtgcaaatcttctctcagttcgggaacgagatggtggaatttgcacacttgagcggggataggcaaaatgacctcaaggacgagaagaagaaggctaagatggctgccgccagagcagtgctagagaagtgcacaatgatgctgctgacagcatccaagacttgcctccgccaccccaactgcgaaagtgctcacaagaataaagaaggcgtgttcgacagaatgaaggtcgccctcgacaaagtgatagaaatcgtcacagattgtaagccaaacggggagaccgacatcagtagcattagcattttcaccggcattaaggagtttaaaatgaatatagaggcgctacgagagaatctctattttcaatccaaggagaatctcagtgttactctggaagtgatcctggaacgcatggaagatttcacagactcagcttacacttcgcatgaacacagagagcgaattctcgagctgtctacccaggcccgtatggaactgcagcagctcatcagcgtgtggatccaggcccaatccaagaaaactaaaagtatcgccgaggagctcgagttgtctatcctaaagatctcacactctctgaacgaactcaagaaagagatcataagcgcagcagaaacgctcactctgcatccgtctagcaagattgctaaagagaatctcgatgtattttgtgaggcctgggaatcacagatttcagatatgtctaccttactcagagaaattaatgatgtgtttgaaggacggcgaggcgaaaagtacggatatctttcccttcctaaaccaatgaaaaacaacgcgaacttgaaaagtctgaaacccgataaaccggattcggaagagcaggccaagattgctaagctggggctcaaactgggtctccttaccagcgatgctgactgtgaaattgagaagtgggaggaccaggagaatgaaatcgtgcagtacggacgcaacatgtcgtcgatggcctatagcctgtacctgtttacaaggggggagggtccattgaaaacttctcaggatctcatccaccagctggaggtgtttgcagccgagggcttgaagctgacgtcttctgttcaagccttctcaaaacagctcaaggacgacgacaaactcatgctgctgctcgagatcaacaagctcatcccactttgtcaccaattgcagaccgttactaagactagtctgcagaacaaagtcttcctgaaggtagataagtgcattaccaaaacacggagtatgatggccctcctggtgcaattgttgtcactgtgctacaaattgctgaagaaactacaaatggagaataacggttgggtttcagtgacaaataaggacacgatggacagtaagacctag

SEQ ID NO: 111064 - DNA, 552 bp, Artificial Sequence
  Description of Artificial Sequence: Synthetic coding sequence
atggccgcttcccctggaccagccggcgtaggcggcgccggcgcagtctacggctcaggatcatccggctttgccttggatagcgggcttgaaatcaaaacccggtcagtggaacagactctacttccattggtgagtcagatcactacgctgataaatcataaagacaacacaaagaagtccgacaaaacattgcaggctatacagagggtgggtcaagctgtgaatttggcggttggtaggtttgttaaggtgggagaagcaatcgcaaacgagaactgggatttgaaagaagagattaacatcgcctgcattgaagccaaacaagctggagaaacgatcgccgctctgactgacattacaaacctgaaccacctggagagcgacggccagatcacaatatttacagacaaaactggcgtaattaaagcggcaagacttcttctgagctcagtgaccaaggtgctgctcctcgccgatcgggtggtcattaaacagatcattactagccgcaataagagactgactatctacaaccttcgacacagttag

SEQ ID NO: 111065 - DNA, 408 bp, Artificial Sequence
  Description of Artificial Sequence: Synthetic coding sequence
atgtcatcaatggcatattctctgtatctgttcactcgaggcgaaggaccactgaagacctcacaggatctgattcatcaattggaagtttttgcagcggagggcttaaagttgacttcatcagtccaggcattttccaagcaattgaaggacgacgacaagctcatgctcttgctggaaatcaataaacttattcccctctgccatcaactccagacagtgacgaaaactagcctacaaaataaggttttcctgaaggtcgacaaatgcatcactaaaacacggtcgatgatggccctgttagtacagcttctatccttgtgttataagctcctgaagaagctccagatggagaacaatggatgggtgtccgtgacaaataaggacacgatggattctaagacctag

SEQ ID NO: 111066 - DNA, 2157 bp, Artificial Sequence
  Description of Artificial Sequence: Synthetic coding sequence
atggctgcttcgcctgggcccgctggtgtcggtggagccggcgctgtgtacgggagtggctctagcgggttcgcgctggactccgggctcgagatcaaaacgaggtcagtggagcagacgctactgccgctcgtgtcccagattaccaccttgataaatcataaggacaataccaagaagtctgataagaccctgcaggccatccaacgagtgggccaagccgtgaacttagctgtgggccgctttgtgaaagtcggggaagcgattgctaatgaaaattgggacctgaaagaagagatcaatattgcatgcattgaggccaaacaggccggggagactattgcagccctaaccgacatcactaacttaaatcacctggagtctgacggccagattacaatctttaccgataaaactggggttattaaagcagcacgactcctgttgtctagcgttacgaaggtgctgctgctcgctgatcgcgtggtgattaagcaaattattacctctagaaataaagtgcttgccactatggagcgcttggaaaaggtgaactctttccaggagttcgtccagatcttttcacagttcggcaatgagatggtggaatttgcgcatctgtccggcgaccgtcagaatgacttgaaggacgagaaaaaaaaggccaagatggctgctgcgagagctgtgttggaaaaatgcaccatgatgctgcttactgcgagtaaaacctgcttaagacatcccaattgtgagtctgctcataaaaataaagaaggagtgttcgacagaatgaaagtcgctctcgataaagtaatagagatagtcaccgactgtaaacctaatggagaaacggacatatcttcaatcagcatatttacaggtattaaggagtttaagatgaatattgaagccctcagggagaatctgtattttcagtccaaagagaacctaagcgtcacactggaagttattctggagcgaatggaagatttcacagattccgcctacacatcccatgaacaccgcgagcggatcctagaactctctacgcaggcgcggatggaactccagcagttgattagcgtttggatccaggctcagtccaaaaagaccaaaagcatagccgaggaactcgaactatcgatacttaagatctcccactctttaaacgagcttaagaaggaacttcactcaaccgccacccagctagcggcagacctcctgaagtaccacgccgaccacgtggtgctgaaagctctgaagttaacgggggtcgaaggaaacctggaggccctagcagagtacgcatgcaaacttagtgagcaaaaggagcagctggtagaaacttgtcggctgctgagacacatatccgggaccgagcctttagaaataacctgtatacatgcggaggaaacattccaagtgaccgggcagcaaattatttccgcagcagagacattaaccctgcatcccagttcaaaaattgccaaagaaaacctagatgtcttctgtgaggcctgggagagtcagatatcagacatgtctaccctccttagagaaattaacgatgtgtttgaaggacgtaggggggaaaaatacggctatctgagtctgccaaagcctatgaaaaataacgctaacctgaagtcactgaagcccgacaagcccgactccgaggaacaggctaagatcgctaaacttggtctcaaattgggacttctaacctctgacgcagactgcgagatcgagaaatgggaggatcaggagaacgaaatcgttcaatacggcagaaacatgtccagtatggcgtactctctctatttattcactcgcggggagggaccgcttaagacgagtcaggacctgatacatcagctggaggtctttgcagccgagggccttaagctgacctcttccgttcaggcattctcgaagcaacttaaagatgatgataaactgatgctgcttcttgagatcaacaagctcatcccactgtgtcaccagctacaaactgtgaccaaaaccagtctgcagaacaaagtttttcttaaagtggacaagtgcatcaccaaaacacggagcatgatggccctgctggtgcagcttctctccctgtgttataagttgttgaaaaagagcgagacccggtattag

SEQ ID NO: 111067 - DNA, 2802 bp, Artificial Sequence
  Description of Artificial Sequence: Synthetic coding sequence
atggatgattctgaagttgaaagtactgcttccatcctggcctccgtcaaggagcaagaggcccaatttgagaaactcacacgtgctctggaagaggagcgtaggcacgtgtcagcccagctcgaacgggtaagggtgagtccgcaggatgcaaaccctcttatggcgaacgggaccctgaccaggcggcaccaaaacggaagattcgtgggagacgccgaccttgagaggcaaaagttctccgaccttaaactcaatggccctcaggatcactcccatctgctctactctacaatcccaaggatgcaagagcctgggcagattgtggagacctacactgaagaagatccagagggagccatgtccgtggtgagcgtcgagacttcagacgacggaaccacacgacgcacagaaaccacagtgaagaaggtcgtcaaaacggtaacaacgcgtacggtccagcccgtggctatgggcccggacggcttacctgttgacgcctccagcgtctcgaacaattacatacagactctcgggcgcgacttccgaaagaatggaaatggcggcccggggccatacgtgggtcaagcagggacagctactttgcctaggaacttccattacccgccagacggctattccagacattacgaagatggataccccggtggttccgacaattatggaagcctcagcagagttacccggattgaggaacgctataggccttctatggagggctaccgagctccttcccggcaggatgtgtatgggcctcaaccacaagtccgcgtggggggctcaagcgtagatctgcacagattccacccagaaccttatggcttggaggacgaccagaggtctatgggctacgatgatctggattacggcatgatgagcgattacggcacagctaggagaacgggcacaccgtcagatccacgccgtcgtctcaggagttatgaagatatgataggggaagaagtgccttctgatcaatactactgggcacccctggcacagcatgagcgcggctcgttggccagtctggatagcctacgcaagggtggccctcctccacccaactggcggcagccagaactccctgaagtcatcgcgatgctcgggttccggctggatgctgttaagtcaaatgccgccgcttacttgcagcatctctgttatcgtaacgataaagtgaagacagatgtgaggaaacttaaaggcatcccggttcttgtggggctgttggaccaccctaaaaaggaagttcatttgggagcttgtggggccttgaaaaacatctctttcggccgggatcaagacaacaagatcgctataaagaattgcgatggagtgcccgctttagttagattgctgcgaaaagctcgggacatggacctgaccgaggtcatcaccggtacgctgtggaacttaagttcacacgatagcatcaagatggaaattgtcgaccacgccctacatgcacttactgacgaagtgattatcccccatagcgggtgggagagagagcccaacgaggactgtaagcctagacacatcgagtgggaaagcgtcctcactaatacggccggttgcttacggaacgtttcctcagagcgctcagaggccaggcggaagctcagggaatgtgacgggctggtcgacgcactgatcttcatcgtccaagcggaaataggacaaaaagactctgacagcaaactcgtcgagaactgcgtctgtctgctcaggaatctatcctaccaggttcacagggaaataccccaggcagaacggtatcaggaggccgcacccaatgtcgcgaataatacaggacctcatgccgcaagctgcttcggcgctaaaaaagggaagggcaaaaaacctatcgaggatcccgccaatgatacagttgacttcccaaaacgcaccagccccgcccgcggctacgagcttctgtttcagcccgaagtggtcaggatctacatttcgctgctgaaggaaagcaagaccccagctattctggaagcgagtgccggagctatacagaatctttgcgccggtagatggacttatgggcgctacattcgaagtgctttgcgtcaggagaaggccctgagcgccattgcggacctgcttactaatgaacacgagagggtggtgaaagccgcttccggggccctgaggaatctagctgttgacgccagaaacaaggagctgattggcaagcatgcaattcctaatctcgtgaagaaccttccaggtgggcagcaaaattcgagctggaattttagtgaggatacagtgatctctattctgaacaccatcaatgaagttattgcagagaatttggaggctgccaaaaagcttcgggaaacccagggtattgagaaattggtacttattaataagagcggcaaccggtcagagaaggaggtgcgagctgctgcactggtgctgcagaccatctggggctataaggagctacgcaagcccttggaaaaggagggctggaaaaagagcgacttccaggtgaacctgaataatgcctcccgatcacaatcttcacattcttacgatgatagcacactgccactgatagaccggaatcagaagagcgacaagaagcccgacagagaagaaattcaaatgagtaacatgggctccaacaccaaatcgttggataacaactattctacccctaacgagcgtggcgatcataatcgtacactagacagaagtggagatctgggagatatggagcccctgaaaggaactaccccactgatgcaaaaaatctag

SEQ ID NO: 111068 - DNA, 2844 bp, Artificial Sequence
  Description of Artificial Sequence: Synthetic coding sequence
atggatgattccgaggttgagagtacagccagcatccttgcgagcgtgaaggaacaggaagcccagttcgaaaaactgactcgcgccctggaggaggaacggcgacatgtgtccgctcaacttgaacgcgtacgcgtctccccccaggacgccaatcccctgatggcgaatggcaccctaaccaggcgccaccagaacggccgctttgtgggggacgccgatctggaacggcagaagttctctgacctcaaattaaacggcccccaggatcactcacatctgctgtacagtactatccctcggatgcaggaacccggacaaattgtggagacctacaccgaggaggatccagaaggcgctatgtctgtcgtgtctgtagaaacgtctgacgacggcacaacacgaagaactgagactacggtaaaaaaggtggttaagacggtgacgactcgaaccgtgcagcctgtggcaatgggccctgacggtctacccgtggatgcaagcagcgtttctaataattacatccagaccctgggcagggactttcgtaaaaatggtaatggcggacctggcccctacgtcggacaggccggtaccgccaccctccctcggaactttcattaccctcccgatgggtactccagacattatgaggacggatatcctggaggcagcgacaactatggttctctgtcacgcgtgacacggatcgaagagcgttaccgcccgtccatggaagggtacagagcgccctctaggcaggacgtgtatggcccacagccccaggtacgtgtaggcggctcttcagtcgaccttcacaggttccatcccgagccttatggcctggaagacgatcaacggtcaatgggatatgacgatcttgactatggcatgatgtctgattacggtaccgctagacggacaggaactccctcagaccccaggcgcaggctaaggagctacgaagacatgattggggaagaggttccttccgatcagtactactgggcacctttggcacagcatgagagaggctcactggcctctctcgacagccttagaaaaggagggccaccccccccaaattggagacagccagaattaccggaggtcatcgctatgcttggattccgactggacgccgtcaagtctaatgctgcagcctacctgcagcacctctgttaccgaaacgacaaggtcaagactgacgtaagaaagctgaaagggattcccgtcctcgtcgggctcctggatcaccctaagaaggaggttcacctcggagcatgtggggccctgaaaaatattagcttcggtcgtgaccaggacaacaaaatcgccatcaagaattgcgatggtgtgcccgcgctggtgagactgttgcgcaaagcccgggacatggatttaacagaggtcattaccggtacactgtggaacttaagctcccatgactctatcaaaatggaaatcgtggatcacgccctacacgcactgacggatgaggtcataatccctcattccgggtgggagcgggagcctaatgaggactgcaaacccaggcacatcgaatgggagtccgtgttaactaacacagccgggtgcctgaggaatgtgtctagcgaacgcagcgaagccagacggaaattaagggagtgtgacggcctggtagatgccctcatttttatcgtccaggcggagatcggacagaaagatagtgactccaagttagtcgagaattgcgtctgtctgcttaggaacctgtcatatcaagtgcatcgggagattccccaggccgaacggtaccaggaggccgcccctaacgtggccaacaatactggaccccacgcagcgtcttgctttggagccaagaagggtaaggacgaatggttctcccgggggaagaaacctattgaggatcccgctaatgatactgtggatttcccaaaacggactagcccagcccgagggtatgagttgcttttccagcctgaagtggtgagaatttatattagtcttctgaaagagtccaagacgccggccattctcgaagcctcggcaggggcgatccagaacttgtgcgcaggcaggtggacctacgggcgatacatccgctcagcgctgcgccaggaaaaagccctgagtgcaattgcagacctgctgacaaacgaacatgaaagagtcgtcaaggcagcctccggggccttgcgcaacctggctgtagacgctagaaacaaagaactgatcgggaaacatgctatccccaaccttgttaaaaacctccccgggggacagcagaatagtagctggaatttttccgaagacaccgtgatcagcattttgaacacaatcaacgaagtcattgccgaaaacctggaagcagccaagaagctcagggagactcagggcattgagaaacttgtgctcattaataaatcaggtaacaggtctgagaaggaggtgagagccgctgcgctcgtgctccaaactatctggggttataaagagctgcgtaaacccctggagaaagagggttggaaaaaatctgactttcaagtgaacctcaataatgcgtcccgatctcagtcctcccatagttatgatgatagtacgctgccattgattgataggaaccagaaatcagacaacaattatagcaccccaaatgaacggggggatcacaatcggacgctcgatagatcaggagacctgggcgacatggaacccttaaaggggacgacccccttgatgcaggacgaagggcaggagtcacttgaagaggaactggacgtgcttgtactagacgatgaaggaggacaggtgtcgtacccaagcatgcagaaaatctag

SEQ ID NO: 111069 - DNA, 2889 bp, Artificial Sequence
  Description of Artificial Sequence: Synthetic coding sequence
atggatgactccgaggtggagtcaacggcctccattctcgcatcagtaaaggaacaggaggctcagttcgagaaactgacccgtgccctcgaggaagaaagacgacatgtttctgcccagctggaaagggtccgagtctcaccgcaggacgcaaatccgcttatggctaacggcacccttacccgccggcatcaaaatggtcgcttcgtcggagacgcagatctggaaagacagaagttcagcgatttgaagctgaacgggcctcaggatcacagtcacctgctctactctaccattcctcgcatgcaggaaccgggacagatcgtcgagacctataccgaagaagacccggagggggcgatgtccgtggtgagcgtggaaaccagcgacgacggcacaactcgccggactgaaacgacagtcaagaaggtcgtgaaaacagtcacgactcgaactgttcagccagtcgccatggggccagatggcttgcctgtggatgcgagttccgtgtctaataactacatccagactcttgggcgggactttagaaagaacggtaatggtggacctggaccctatgtgggccaggctgggactgcaaccctcccgaggaattttcactaccctccagacgggtatagccgtcactacgaagatggctacccgggaggcagcgataactatggtagtctcagtagagtgacacgtattgaggagaggtaccgaccctcaatggaaggctatcgagctccttcaagacaggacgtctacgggcctcagccacaagtgagggtgggaggatcctctgttgatctccaccgattccatcctgaaccctacgggttagaagatgaccaaagatccatggggtacgatgacctggactatggtatgatgtctgattacggcacagcccgcaggactggtacccctagcgatccccgcagaaggctgcgctcgtacgaggatatgatcggagaagaggtgccctccgatcagtattattgggcacccctcgcccagcatgaacgtggctcactcgccagtctggacagcctgaggaagggcgggccaccgccacccaactggcgtcagccggagctgcctgaagtgattgcaatgctcggttttaggttggacgccgtcaagagtaacgccgccgcctacctccagcatctctgctaccggaacgacaaggtaaagacagacgtacggaaactcaagggcattccggtgttagtgggactgctggaccatccaaagaaggaggttcacctgggtgcatgtggggctctgaaaaatatatcctttggacgagatcaagacaataaaatcgccattaagaattgcgacggcgtgcctgcgttagtgcgcctcctgcgcaaggcacgggatatggaccttacggaagtcataaccggtaccctgtggaatttgagttcccatgacagcattaagatggagatcgtggatcacgctctgcacgccctcaccgatgaggttatcattccacacagtggatgggagagagagcctaacgaggactgcaaacccagacacatagagtgggagtctgtgttaacgaacaccgccggctgcctgcggaacgtgagcagcgaaaggtccgaagccagacgaaaattgagagaatgtgacggcctcgtggacgcccttatatttatcgtgcaggccgaaataggtcagaaagattctgactcaaagcttgtcgagaactgcgtctgcttactgagaaacctctcctaccaagtccatagagaaattccacaggctgaaaggtaccaggaagcagctcctaacgtggcaaacaacacagggcctcatgccgcatcatgttttggcgcgaaaaagggtaagggcaagaagccaattgaagacccagccaacgacacagtggattttccgaaacgcacgtcacccgcccgcggttatgagctgttgttccagcccgaagtcgtacggatatatatcagcctcttaaaggagtctaagactcccgcaatactagaagcgtctgctggagcaatccaaaacctgtgtgctggccgctggacgtacggacggtacattcgcagcgccttacgccaggagaaggcactgagtgccatcgccgacttgttgacaaacgaacacgagcgggtggtgaaggcagcttcgggcgccttacgaaatctggcggtggacgcccggaacaaggaattgattggcaagcacgcaatcccgaacctggtgaagaacctaccgggtgggcaacagaactccagctggaatttttcggaggataccgtcatctccatcctcaatacgatcaatgaagttatagccgagaatctggaggcagccaagaagctgagagaaactcaaggcattgagaagctagtactgattaacaagtctggtaaccggtctgagaaggaagtacgggccgctgcccttgtgctccagactatatgggggtataaagaacttcgcaagccactggagaaagaaggctggaagaagtccgacttccaggtgaacctaaacaacgcgtctagaagccaaagctctcatagttatgacgatagcacactgccactcattgatcgcaatcaaaaaagcgataagaagcctgacagagaagagatacagatgtccaatatgggttctaatactaaatccttggacaataactacagcacccccaacgaacggggagatcataatcgtactttagaccggagcggagaccttggcgacatggagcccctcaagggaactacacccctaatgcaggatgaggggcaagagtccctagaagaggaactagacgtactcgtgctcgatgatgaaggtggccaggtgtcgtacccatcaatgcagaaaatctag

SEQ ID NO: 111070 - DNA, 2826 bp, Artificial Sequence
  Description of Artificial Sequence: Synthetic coding sequence
atggatgactccgaagtagagtccacagccagcatacttgcgagcgtgaaggagcaggaggcacagttcgagaaacttacccgcgccctcgaggaggaaagaaggcatgtcagcgcccaactggagcgggtcagggtgagcccccaagatgcaaacccactgatggcaaatggcacgctcacacgccggcatcagaacgggagatttgttggggacgccgatctcgaaagacagaagttttccgatctcaagctcaatgggccccaggatcattcccacttgctgtattctacaattcccagaatgcaagagcccggtcagatcgttgagacatacacagaagaggacccggagggagctatgtcagttgtgtccgtggagacctctgacgacggcactacgaggcggactgagactacagtgaagaaggtcgtcaaaaccgttacgacacggaccgttcaacctgtggccatgggccctgatggtcttccggtggatgcttcaagcgtgagcaataactacatccagacccttgggagagatttcaggaagaacgggaatggaggacccggaccctacgttggacaagctgggactgcaacactgccccgcaactttcattacccgcctgacggctacagccgacattacgaagacgggtatcctggggggtctgataactacggctctctttcaagggtcacgcgtattgaggagcgctatcggccgtcgatggaaggttaccgggcaccctcgagacaagatgtttatgggcctcaaccccaggtgcgagtaggcggctcatccgtcgacctgcaccgatttcatccggaaccctacggccttgaggacgaccaacgtagcatgggctacgatgatctcgattatggaatgatgagcgactacggtaccgcccggcggaccggcactccgtctgatccaaggcgcaggctgcggagttatgaagacatgatcggagaggaggtcccaagcgaccagtattactgggcaccactggcccaacacgaaagaggatcccttgcctccctagactcgcttaggaaagggggcccccccccacccaactggcggcagcctgagcttcctgaggtcattgctatgcttggatttcggcttgatgctgtgaaatccaatgcagccgcttacctgcagcatctgtgctacaggaacgacaaggttaaaacagatgtacgcaaactcaagggcatccctgtgctggtgggtttattggatcaccccaagaaggaagtgcacttgggtgcctgtggtgccttaaagaatatctcgtttggccgagaccaggacaacaagatcgctatcaagaattgcgatggcgttcccgccctcgtacgcctgttgcgcaaggcaagagacatggatcttaccgaggtaattaccggtacactatggaacctatctagccacgacagcattaaaatggaaatcgtcgatcacgctttgcatgccctgacagacgaagtgatcattcctcattctggctgggagcgggagcctaatgaagactgtaagccacgccatatcgaatgggagagcgtcctgacaaatactgcgggctgcttgaggaatgtgagtagcgaaagatccgaagccagaagaaaattgagggagtgtgatggactggttgacgcattgatttttatcgtccaggccgaaattggccagaaagattccgacagcaagttagtggagaactgtgtatgtctgctgcgcaacctgtcataccaagtgcaccgggagatccctcaagccgagcgctatcaggaagctgctcccaacgtggccaataacaccggaccacacgccgcctcttgtttcggcgccaagaaaggcaagggtaaaaaacctattgaagaccccgctaatgatacagtagattttccgaagcgaaccagtccagctcgtggttacgaattacttttccaaccagaagtagtgcgaatttacatctccctgctgaaggagtcgaagacacctgctatattggaggcgtctgctggcgccatccagaacctttgcgccggtaggtggacatatgggaggtacatcagaagtgcccttcggcaggagaaagcgctgtcagcaattgctgatctccttacaaatgagcacgagcgagtcgtgaaagctgcttctggagctcttcggaacttggccgtggatgcacggaataaagagctgattggcaaacatgctatccccaacctggtaaagaatttacccggcggccagcagaattcctcatggaactttagcgaagatacggtcattagtatcttaaacacgatcaatgaagtgatcgctgaaaacctggaagcagcaaagaaactgcgcgagacccagggtatcgagaagcttgtgcttatcaacaagagcggaaatagatcagaaaaggaagttagagccgccgccttggttcttcagacaatatggggatataaagagctgcgcaaacctttggagaaagagggctggaagaaatccgattttcaggttaatctcaataatgccagccgtagtcagtcgagtcacagctatgacgactcaacactgcctctcattgataggaaccagaagagcgataacaactactccacccccaacgagaggggggatcataatagaacacttgaccgctctggagatctaggcgacatggagcccctgaaaggaaccacaccactgatgcaggacgaaggccaggaatctttagaggaagagctggacgtgctggtgctcgatgatgaagggggacaggtgagttacccttcgatgcaaaaaatctag

SEQ ID NO: 111071 - DNA, 2802 bp, Artificial Sequence
  Description of Artificial Sequence: Synthetic coding sequence
atggatgactccgaagtcgaaagcacggccagtattctcgcctcggtgaaggaacaggaggcccagtttgagaaactgactagagcccttgaagaggaaaggaggcacgtctccgcacagcttgaacgggtccgggtgtctccccaggatgcgaatcctctaatggccaacggcaccctgactaggagacaccagaatggcagattcgtgggcgatgctgatctggagcggcagaaatttagcgatcttaaattgaacggaccccaggatcattcccatcttctgtacagcactataccccgcatgcaagaacccggacagatcgtcgaaacctacacggaagaggacccagagggcgctatgagcgtagtgtccgtagagactagcgatgatgggaccacgcggcgcactgaaaccaccgtgaaaaaggtcgtcaagactgtcacaaccaggactgtacaaccagtggccatgggcccagacggcctcccggtcgacgcctcaagcgtctccaataactacatacagaccctggggagagattttcgcaaaaatggcaacggggggcccggcccctacgtaggccaagcaggcaccgctactctccccaggaacttccactatcctcccgacggatatagtcgacattacgaagatggatacccaggcggcagtgataactatggcagcctctctagggtgaccaggatcgaagaacggtacaggccctccatggagggctacagagctccttccaggcaagatgtctatgggccacagccccaggtaagggtcggaggctcgagcgtggacttacatcgcttccatccggagccatacggcctagaggacgaccagagatccatgggttatgatgatttggattacggtatgatgtcggactacgggacagcacggcggaccggaacaccgtcagaccctcgcagacgacttcggtcctatgaagatatgatcggagaagaggtgcccagcgaccagtactattgggcgcccctcgcacagcacgagagggggtctctggcaagcttggactctttaagaaaggggggacccccccctcccaattggagacagcctgagctgcccgaagttattgccatgctgggattccgcctcgatgccgtaaaaagcaatgccgccgcctacctgcagcacctgtgctaccgcaacgataaagtgaagacagatgtgcggaagctgaaagggattcctgtgctggtgggcctgctggaccatccaaagaaggaggttcacctgggtgcttgtggcgcccttaaaaacatcagtttcggtagagatcaagacaataagattgctatcaagaactgtgacggtgtgcctgcactggttagactgttgagaaaggccagagatatggacttgacagaggtcatcaccggaacgttgtggaatctatccagccacgactccataaaaatggagatcgttgaccacgctcttcacgctctgactgacgaggtcattatcccacattcaggctgggagcgggaacccaatgaggactgcaagccgcgccacattgagtgggagagtgtcctgactaataccgctggatgcctgcggaacgtttccagtgagcggagcgaggcccgtaggaagttgcgggagtgcgatgggctggtggacgctttaatttttatagtccaggccgagattggtcagaaagacagcgactcaaagctcgtcgaaaactgcgtgtgcctgctacgaaatctcagctatcaggtgcaccgcgagattccacaagccgaaaggtatcaggaagcagctccgaacgtcgcaaacaatacaggaccacacgcagcctcttgctttggcgctaaaaagggcaaaggaaagaaacccattgaagaccctgcgaacgatacggttgatttccccaagaggacaagccctgcccggggatacgaactgctcttccagcctgaagtggtccggatttacatatccctgctgaaggaaagtaaaactccggcgatcttagaggcaagcgccggcgctatacagaacctgtgcgccggacggtggacttacggtcggtacattagatctgctctacgacaggagaaagccctctcagcaatcgctgatctgcttactaatgaacacgagcgcgtcgttaaagcagcttccggcgcgctgagaaatctggctgtggacgcacgcaacaaggaactcataggaaagcatgcaatacccaatctagtgaagaaccttccaggcggccagcagaatagcagttggaactttagcgaagacacagtgatttctatcctgaacactatcaacgaggtgatcgctgagaatttggaagcagccaagaagttaagggagactcagggaatcgagaaactggtgttgattaacaaaagtggaaatcgaagtgagaaagaggtgcgcgcagcagccctcgtacttcagacaatctggggatacaaagagttgagaaagcccctcgagaaggaggggtggaagaagtctgacttccaggtaaacctgaacaatgccagtaggtcgcagtcctctcactcttatgatgactccacattgcccctgatcgaccgaaatcaaaagtctgataaaaaaccagatcgagaggagatccaaatgtcaaacatgggcagcaatacaaagtcacttgataacaactacagtacccccaatgaacgcggcgatcacaaccgtaccctagatcggtcgggtgacctaggggacatggagccactgaagggcactacgcccctgatgcagaaaatctag

SEQ ID NO: 111072 - DNA, 2817 bp, Artificial Sequence
  Description of Artificial Sequence: Synthetic coding sequence
atggacgacagcgaggtggaaagtaccgcttctattttagccagtgtcaaggagcaggaggcacagtttgagaagttgaccagggcacttgaagaagaaaggagacacgttagcgcacaattggaacgcgtgagagtcagcccccaagacgcaaacccactgatggccaacggaacactgacgcggcgccaccagaatggacggttcgtgggcgacgctgacctggagaggcagaagttttcagatctcaagctcaacgggccgcaggatcatagccacctgctgtacagtacaattccacggatgcaagagcctggtcaaatcgtagagacgtatacagaggaggacccagagggagccatgtccgtggtctcggtggagacttcggatgatgggaccaccaggaggaccgaaacaacggtgaagaaggttgtgaagacagtcacgaccaggaccgtccagccagtcgcgatgggacccgatgggctccccgtggacgcttctagtgtgtctaacaattacattcagacactgggcagagactttagaaagaacggtaacggcgggcctggaccatacgtagggcaagctggcacagccactttgccgcggaattttcactatccgcccgacgggtactccaggcattatgaagacgggtaccctggcggatcagataattatgggagcctctccagagttacgcggatcgaggagagataccgccccagcatggaggggtatagagccccaagtcgacaggatgtttatggcccccagccacaagttagggtgggtggatcatcggtggatctgcataggtttcacccggaaccttacggcctcgaagacgatcagcgatccatgggatacgacgatctcgactacggaatgatgagtgactatgggaccgcccggagaaccggaacaccttcagatcccagaagacggttgcggtcttacgaggacatgataggagaagaggttccaagcgaccagtactactgggcccccctggcgcagcatgagagaggcagccttgcatcactggattccttgagaaagggcgggccgccacctcctaactggcggcagcccgagctgccggaggtcatagcaatgctcggctttagactcgatgccgtgaagtcaaacgccgctgcctacctgcaacatctgtgctatcgcaacgacaaggttaaaaccgacgtgaggaagctaaaggggattcccgtactagtgggcctcctcgaccacccaaagaaggaagtgcaccttggagcctgcggagcgctgaaaaatatctcttttggccgtgatcaagacaataaaatcgctattaagaattgcgatggcgtgccagctctggtccggttgctccgcaaagcgagagatatggatcttacagaggtcatcaccggcacattgtggaatctcagctcgcacgattcaatcaagatggaaatcgtcgatcatgcattacatgctctgacagacgaggtgataatcccacacagcggttgggagagggagcccaatgaagattgtaagccgcgccatatcgaatgggaaagtgtactgacgaataccgccgggtgtctgcgtaacgtctcatctgaacgctccgaggcacgcaggaagctacgcgagtgcgacgggttagtcgatgcactcatcttcatcgtgcaggccgagatcggccagaaagactctgattcgaaactggtcgaaaattgcgtgtgcttactgcggaatctgagctaccaggtgcatcgggaaatccctcaggcggaacgctatcaggaggccgctcctaatgtcgcgaataatactgggccccatgccgcaagttgttttggggcgaaaaaagggaaggacgagtggttctcgagaggcaagaaaccgattgaggaccctgcaaacgacaccgtggactttccaaaacgtacctcacccgccagaggttatgagcttctgttccaacccgaggtggtacggatttacatcagtctcctgaaagagtctaaaacccccgctattttggaagccagcgccggggcaatccagaacctgtgtgccgggcggtggacatacggccgctatattcgatccgcattgcggcaggaaaaggccctttctgctattgccgatctactcaccaatgagcacgagcgtgtcgtcaaggctgcatctggcgccctgcgcaacctcgccgtggacgccagaaacaaagaactgatcggcaagcacgctattccaaacctcgttaagaacctcccaggtggccagcaaaacagttcttggaatttcagcgaggacacagtcatttctattctgaacacaattaatgaggtaattgcggagaacttggaggcagccaagaagttaagggaaactcaaggtattgagaaattagtgctaattaataaatccgggaacaggagcgaaaaggaagtgcgtgccgccgccttagttctgcagacaatttgggggtataaagagctgcggaagccactggagaaggaaggatggaaaaaatccgattttcaggttaacctgaataatgcgtcccgctcacagtctagccattcctacgatgactccacactgccgctcatcgatcgtaatcagaagtcagacaagaagcctgacagagaggagatccaaatgtctaatatggggagcaatacgaagtccctggataacaactatagcactccgaacgagaggggcgaccataaccggactttggatcgctctggagacctcggcgacatggaacctctgaagggaacaactcctctgatgaaaatctag

SEQ ID NO: 111073 - DNA, 2907 bp, Artificial Sequence
  Description of Artificial Sequence: Synthetic coding sequence
atggacgatagtgaggtggagagcacagcctccattctggcctccgtgaaagagcaggaggcacagttcgagaagctcacccgggccttagaagaggagagacggcatgtatctgcgcaattggagcgtgtgagagtctcaccccaagatgctaatccactgatggccaatggcaccctcacgagaaggcatcagaacggacgatttgttggagatgctgatttggaaagacagaagttcagtgacctgaagctgaatggaccccaggaccattcccatcttctctattccactattccacgcatgcaggaaccaggacagattgtagagacttatacagaggaagatccagaaggcgcaatgtcagtggtgagcgtggagacctccgatgacggtacgaccaggcggactgagacaacagttaaaaaagtggtaaaaacagtgacaactcgtactgtgcagccggttgcaatggggccagatggactgccagtggatgcctcgtcagtcagcaataactacattcaaaccctgggcagggatttcagaaagaacggcaatggcggacctggaccgtacgtgggccaggccggcacagcaaccctgccccgtaacttccattacccccccgacggctactctagacactatgaggatgggtaccctggtggttcagacaattacggtagcctgagccgggtaacaaggatagaagagagatatcggcccagtatggaaggatatagagctccaagccgtcaggacgtctatggccctcaaccacaggtgcgcgtgggaggtagcagcgtggaccttcatcgtttccaccccgagccttatggcctggaagatgaccagcgcagtatgggctacgatgatttagattacgggatgatgtctgattatgggactgcccgccgcacagggacaccttccgatcccagaaggcggctgcgcagctacgaggacatgattggtgaggaggtgcccagtgaccaatactactgggcgcccctggcccagcatgagagaggatcactagcctcattagacagtttgagaaaaggaggccccccccccccaaattggcgacaacctgaacttcctgaagtaatcgcgatgttagggttcaggctggacgcagtgaaaagcaatgcggctgcctacctacaacatctctgctatcgtaatgataaagtaaagacagatgttaggaaattgaaggggattcctgtgttggtaggcctgttggaccatcccaaaaaggaggtacacctgggagcatgtggggctctgaagaacatttcttttggcagagaccaagataacaaaatcgccatcaagaactgcgacggtgttccagcgcttgttagactattgcgaaaggcaagggacatggatttaaccgaggtaatcaccggaactctatggaatttaagcagccatgactccatcaagatggagattgtagaccatgccttacatgcgttgactgacgaagttatcatccctcattcgggatgggagcgagaaccaaacgaggactgcaaaccccggcatattgaatgggaaagtgtgctaactaacacagccggatgcctgcggaacgttagcagtgagcgatcggaagcgcgcaggaaattgcgcgagtgcgatgggctggtggacgcgttgatatttatcgtccaggcagagattggccagaaggatagcgactccaaacttgtggagaactgcgtctgcttacttcgtaatctgagctatcaagtgcacagagagatcccccaggccgaaagataccaggaggccgcacccaacgtggctaacaacacaggtccccatgccgcttcttgctttggagctaaaaagggtaaggacgaatggttctcgcgcggcaagaaaccaattgaggaccccgccaacgatacagtggatttcccaaagcgcaccagccctgcccgggggtacgagctgctctttcagccagaggttgtgcgaatctatatatccctcctgaaggaaagtaagactcccgctatactcgaggcatcagctggcgccatccagaatctgtgtgccggtagatggacctacggccgctacatccgatcagccctgcgtcaagaaaaagctctctccgccatcgccgatctgttaaccaacgagcacgaaagggtggtcaaagctgcctcgggggcactccgaaatctcgctgttgacgctagaaacaaggagcttattggaaagcacgccatccccaacctcgttaaaaatttgcctggcggacagcaaaattcctcttggaactttagcgaagacaccgtgatcagcatcctgaacacgatcaatgaagtcatcgccgagaacctagaagctgccaagaagctgcgtgaaactcaggggatagaaaaattagtattgattaataaatccggaaataggagcgaaaaagaagtgcgtgcggcagccttggtcttgcagactatttgggggtataaagaactgcggaaaccgctcgaaaaagagggatggaagaaatctgactttcaagtgaatctgaacaacgcaagccgcagccagtcctcacattcctatgacgactctacattacctctgatcgaccgaaaccagaagtctgataaaaagcccgatcgagaagagatacagatgagtaacatgggaagcaacaccaaatccttggataataactacagtacccccaacgagaggggggaccacaatcgcactctggacaggagcggtgacctgggtgacatggaaccgctcaaggggaccacaccgctcatgcaggacgagggtcaggagtccttggaagaggaactggacgtgttggtgctggacgatgaaggagggcaagttagctacccttcaatgcagaaaatttag

SEQ ID NO: 111074 - DNA, 2604 bp, Artificial Sequence
  Description of Artificial Sequence: Synthetic coding sequence
atgcaggagccgggtcaaatcgtggagacctacacagaggaggacccggagggcgcaatgtctgtcgtgtccgtggagacttccgacgacggcactacacggcgcacagaaacaactgttaagaaggtggttaagactgtgaccactcgaacagtgcagcccgtggcgatggggccagatgggctccccgtggacgcctcaagcgtgtctaacaactatattcagacgctcggacgggacttcaggaagaatggtaacggggggcctggcccatacgtggggcaagctggtaccgcgacactgccgcggaattttcactatccccccgatggctacagtcgccactatgaggacgggtaccctggcggctctgataactacggtagcctgtcccgtgtaacccgaattgaggaaagatatcgcccatccatggagggatatcgggccccatctaggcaggatgtgtatggcccccaaccccaagtgagggtggggggcagcagcgtcgacctccaccgatttcacccagaaccatacggattagaggacgaccaacgaagcatggggtacgacgatcttgactatggaatgatgtccgactacggcacagcgcgtcgtaccgggacacctagcgaccctagaaggagattgaggtcctacgaagacatgatcggcgaggaagtaccttccgaccagtactattgggcccccttggcacagcacgaaagaggctccctcgcctctctcgactctttgcggaaaggaggaccacccccccctaactggagacagcccgaattgccagaggtaatcgcaatgctgggttttcggcttgatgcagtgaagtcaaatgccgctgcctacctgcagcacctgtgttaccgcaatgacaaagtgaaaaccgacgttcgtaagttaaagggcataccagtcctggtcggccttctagatcatcctaagaaggaagtccatttaggggcctgcggggcactcaaaaatatatcctttggcagagaccaggacaacaaaatagctattaagaactgcgatggcgtgcccgcgttggttcggctgctgcgtaaggcgagggacatggatctgactgaagtgattaccgggacgctctggaatctgtcatctcatgattcgataaaaatggaaattgtggaccatgccttacacgccctgactgacgaagtcataattcctcatagtggctgggaaagagagcctaatgaggattgcaaaccgcggcatatagaatgggagagcgttcttacgaacaccgccgggtgcctgcggaatgtgtcctctgagcgctctgaggctaggcgaaagctaagagaatgcgacggcctggtcgacgctttgatctttatcgtgcaggccgaaataggacaaaaggactcagactccaagcttgtggagaactgtgtatgcctgttgcgcaatttgtcctaccaagtgcatcgggagatcccccaggccgagaggtatcaggaagcagcgccgaacgttgcaaacaatacgggtcctcacgcagcttcttgcttcggtgctaagaaaggaaaggacgaatggttctcgagggggaaaaagcccattgaggaccccgcaaacgacactgtcgactttcctaagagaactagccccgccaggggctatgagttgttgttccaacccgaggtggttagaatatacatcagcctcctgaaagaatccaagacgcctgccatattggaggcctctgcaggcgcgattcagaacttgtgcgccggccggtggacatatggtaggtatatccgcagtgcactgcgacaagaaaaagcactgtcagccattgcagacctgttaaccaacgaacatgaaagggttgtaaaggccgcaagcggggctctccgcaatctggctgtggacgcccgcaacaaagaactaatcggaaagcatgccattccaaaccttgttaaaaatttgcccggagggcagcaaaactcaagctggaattttagtgaggacacggttatcagtattctaaacacaattaatgaggttatcgcggaaaacctggaggctgccaagaagcttagggagacacagggcatcgagaaacttgtgctcatcaataagtcaggtaaccgatctgaaaaagaagtaagggccgctgcgcttgtgcttcagaccatttggggttacaaagagttaaggaagcccttggagaaagagggttggaaaaagagcgacttccaggttaatctgaacaacgcctcacgatcccagagctcgcattcttatgacgactctacattgcccctaatcgatcgcaaccaaaagtctgacaaaaagcctgatcgggaagagattcagatgagtaacatggggtccaatacaaaatcattagacaacaattacagtaccccgaacgagcgcggtgaccataaccgcacacttgataggagtggggacctgggcgatatggagcccctgaaaggcaccaccccactcatgcaagatgaggggcaagaatccctagaggaggaacttgatgtcctggtgcttgacgacgaaggaggacaggtgtcctatccgagcatgcaaaaaatttag

SEQ ID NO: 111075 - DNA, 2499 bp, Artificial Sequence
  Description of Artificial Sequence: Synthetic coding sequence
atgcaagaacctggacagattgtcgagacatacactgaagaggatcctgagggcgcaatgagtgtggtctcagtagaaacctccgacgatgggacgacgcggcggaccgagactaccgtgaaaaaagtggtcaagaccgttactacgcggactgtgcagccagtcgctatggggcctgacggtttgccggtggacgctagctccgtaagcaacaactacattcagactttaggacgcgattttaggaagaacggaaacgggggacctggaccttacgtcggccaggctggcacagctaccctgccaaggaacttccattaccctcctgacgggtactccagacactatgaggatggatatcctggaggctccgataactatggatcactttccagggtaaccagaattgaggaaagataccggcccagtatggagggctatcgggctccttctcgccaggatgtgtatgggcctcagccgcaggtgagggtggggggctcttctgtggacctgcaccggtttcaccctgagccctacggattagaagacgaccagcgatctatgggttacgacgatttggactacgggatgatgtctgattacggcacagctagacggacgggaacccctagcgacccacgccggcgccttcgtagctatgaggatatgatcggtgaggaggtgcctagcgatcagtactactgggctccgctggctcagcacgagcgaggatcattggcttccctggactcactccgtaaggggggccccccccctcccaattggaggcagccagaactgcccgaggtcatagctatgctcggctttcggctggacgcagtcaagtccaatgctgctgcctatctgcagcatctgtgttataggaatgacaaggtgaaaacagacgtcagaaagcttaagggcatccctgtgctggtgggcctgctcgatcacccaaaaaaagaggtacatttaggtgcctgcggagccttaaaaaatatatcctttggacgcgatcaagataataaaatcgcgattaagaattgtgacggtgtaccggctctggtacgtctattaaggaaagctcgcgatatggacctgacggaggtcatcactggaaccctgtggaacctgtcctcacatgattcgatcaaaatggagatcgtcgaccacgccctacacgccctgacggacgaagtgataattccacatagtggatgggaaagagagcccaatgaggactgcaagcctcgtcatattgagtgggaatccgttctgacgaacactgctggttgcttgcggaacgtgtcctccgagaggagcgaggcaagaaggaaattacgagagtgtgatgggcttgtcgacgctctgatcttcattgttcaggcagagatcggccagaaagattccgatagcaaattagttgagaactgcgtgtgtctgttgaggaacctttcgtaccaggtgcacagagaaatcccccaggctgagagataccaggaggccgcacctaatgtggcaaacaacacgggacctcacgccgccagttgcttcggcgcaaagaaaggtaagggtaagaagccaattgaagatcccgctaacgacactgtagatttccccaaacgtacctctccggcgcgaggctacgagttgctcttccagcctgaagttgttaggatatacatatcactgcttaaagagagcaagacaccagcaatactggaagcctcagcaggcgcaatccaaaatctctgtgccggcaggtggacctacggcagatatattcgttcggctctgaggcaggaaaaagcgctctcggctattgccgacctgctaacaaacgagcacgagagggtcgttaaagcggcctctggagccctccgtaatttggctgttgacgcaaggaataaggagttaattgggaagcacgccatccctaacctggtgaaaaacctcccaggaggccagcaaaatagctcttggaatttcagcgaagacactgtgatctcaatcttgaatacgataaatgaggttatcgccgaaaatctggaggctgccaaaaagctgagggagacccagggtatcgaaaagcttgtgctaatcaacaaatcagggaaccggagtgagaaggaggtgcgagcagcagctctggtcttgcagactatctggggatacaaggaactccgcaaacctctggaaaaggagggttggaaaaagagtgactttcaggtgaacctcaacaatgcttcgagatcacaatcgtcccattcatacgacgatagcacattacccttaatcgaccggaaccagaaatccgacaaaaagcccgacagggaggagattcagatgagcaacatggggagcaatacaaaaagccttgacaataactattcgactcctaacgaaagaggcgaccataaccgtaccctggatcgtagtggcgatctgggagatatggaacctctgaaagggacaacacctctgatgcagaagatatag

SEQ ID NO: 111076 - DNA, 2802 bp, Artificial Sequence
  Description of Artificial Sequence: Synthetic coding sequence
atggacgattccgaagttgaaagcaccgcaagtatcctggcctcagttaaggagcaggaggcccagttcgagaagttaacaagggctctggaagaagagcggcggcatgttagtgcacagcttgagcgcgtccgcgtgtcaccacaggacgccaatcccctgatggctaacggcaccctgactcgcagacaccaaaatggccgttttgtaggagacgcagaccttgaacgccagaaattcagcgatctgaagttgaacggaccgcaagaccacagccacctcctttactccactataccaaggatgcaggagccaggacagatcgttgagacatacacagaagaagatccggagggcgctatgtcagttgtaagtgtagagacttccgatgacgggacaacacgccgaacggagactaccgtgaagaaagtggttaagacagtgacaacaagaaccgtgcagccagtcgctatgggtccagatggtcttcctgtggacgcttcatccgttagcaacaactatatacaaacactgggaagggactttcggaagaatgggaacgggggccctggcccttacgtggggcaggctgggacggccacacttcctcgaaactttcattacccccccgatgggtactcgaggcactacgaggatggataccccggaggcagcgacaattacggaagtctgtctagggtcacacgcattgaggagagataccgaccctctatggagggttacagggccccttcgagacaagacgtgtacggaccacaaccacaggtgcgggtggggggctcttctgtggaccttcaccgttttcatcccgagccttatggtcttgaggacgaccagcgatctatgggatatgatgacctggactacggcatgatgtcggactatggaacagctagaagaaccgggactcccagcgacccgcggcgccggctccgaagctatgaggacatgataggagaggaggtcccgtcagaccaatattactgggcacccctggcccaacatgaaagaggttcactggcctctctggacagtctcaggaaggggggcccacctccacccaattggcggcagcctgaattgccagaggtcattgctatgttgggatttcgcctggacgctgtaaaatctaacgctgctgcttacctccagcacctctgttaccggaatgacaaggtaaaaactgatgtgagaaagctcaagggcattccagtcctggtgggcctgctcgaccacccaaaaaaggaagtgcaccttggcgcatgcggagccctcaagaatatcagtttcgggcgggaccaggataacaaaattgcgattaagaactgcgatggggttcccgctctggttagactgctccgaaaggccagagacatggacttaactgaggtcataacaggcacactgtggaacttgtcttcccacgactctattaagatggaaatcgttgaccacgcgctgcacgctcttaccgatgaggtgataattcctcactctggctgggagcgggagcccaatgaggattgcaaacctcgacatattgaatgggagtccgtgctgacgaataccgcgggatgtctgcgcaacgtctcctctgagaggagcgaggcccggagaaagttgagggaatgtgatggacttgttgacgcactgatctttattgtccaggctgagatcggtcagaaggattccgactctaaacttgtcgagaactgcgtgtgcctgttacgcaatctctcgtaccaggtgcaccgagagatcccccaggcagagaggtaccaagaggcagcaccaaacgtggcaaataatacaggcccccacgccgcgtcctgtttcggcgctaagaagggaaaaggaaaaaagcccattgaagatccagcaaatgatactgtggacttccctaagcgtacctctccagcaaggggctacgaactcctgtttcagcccgaagtagttcggatctacattagtttgttgaaggagtccaaaactcccgcgatcctggaagcctccgccggagccattcagaatttgtgcgccgggcgatggacttacgggaggtacattcggtccgcgctcagacaggagaaggctctgtcggctattgcagacctcctcacaaacgagcatgaacgtgttgtcaaggcagcctctggcgctcttagaaacctggccgtagatgccaggaataaggaactgattggaaagcacgcgatccccaatctggtaaagaacctgcccggtgggcagcagaatagcagctggaacttctcagaggacacggtgatcagtatcctgaatacgatcaatgaggttatcgcagagaatctggaagccgcaaaaaaactccgggaaacccagggtatcgaaaaacttgtgctgatcaacaaatcgggaaacagatctgaaaaagaagttagggccgctgccttagttctgcaaacaatctggggttataaagagctgcgaaagccacttgagaaggaaggctggaaaaaatcggattttcaggtgaatttgaacaacgcaagccggtctcaaagcagccatagctatgacgattcaacgctgccgctgatcgacaggaaccaaaaaagtgacaagaagccggaccgggaggagatccagatgtctaacatggggtcgaatacaaaaagcctggataataattactccactccaaacgagagaggcgaccataatcgaaccctggataggtccggggatcttggagatatggagcccctgaaaggaaccaccccactaatgcagaaaatctag

SEQ ID NO: 111077 - DNA, 15 bp, Artificial Sequence
  Description of Artificial Sequence: Synthetic coding sequence
atggatgactcctag

SEQ ID NO: 111078 - DNA, 2802 bp, Artificial Sequence
  Description of Artificial Sequence: Synthetic coding sequence
atggacgattcagaagttgagagtactgcgagcatcctcgcgtcagtgaaggaacaagaagcacagtttgagaagctgaccagggctctggaggaggaacgcaggcatgttagcgctcagttggagcgggttcgcgtcagtccccaggacgccaatcctctcatggccaacggcaccctcaccagacggcaccaaaatggtagattcgtcggtgatgccgacctagagcgtcagaagttttccgaccttaaactgaacggcccccaggatcactcgcacctgttgtacagcacgattcccaggatgcaggagcccggccaaatagtcgagacttataccgaggaagacccagagggcgctatgtctgtagtgagtgtggaaacatcggacgacgggaccactcgtagaacagagaccaccgtcaagaaagtcgtgaaaacagtaacaactcggaccgtccagcctgtggcaatgggccctgacgggctgcccgtggatgctagctctgtttcaaacaactacattcagaccctggggagggactttcgcaaaaatggcaacgggggtcccggcccgtatgtcggccaagccggcaccgctacactacccaggaactttcattatccccccgatggctattcacgacattatgaagacgggtatccaggcggcagcgacaattacggtagtctctctagggtgacaagaattgaggaaaggtacagaccaagtatggagggttaccgcgcccccagccggcaggacgtgtacggcccacaaccgcaagtgagagtgggcggcagtagcgttgacctgcataggttccaccccgaaccctacggtcttgaagatgaccagcgaagtatggggtatgatgatctggattacggaatgatgtcggattatggtaccgcaagacgcaccgggacccctagcgatcctaggaggaggctgcggtcatatgaggacatgatcggggaagaagtgcccagcgatcaatattattgggcccccctggcccagcatgaaagagggtccctcgcctcccttgacagcttgcggaagggcggacctcctccccccaactggcgccagcctgagctgcctgaagtcatagccatgctgggctttcgactggacgcagtgaagtcaaacgcagctgcctatctgcaacacctgtgctacaggaacgataaggttaaaactgacgtgcgaaaacttaaaggcatcccagtgttagtaggacttctggatcatcctaagaaagaggttcacctcggtgcttgcggggctctgaaaaacataagtttcggacgagatcaggacaataagattgctatcaaaaactgtgatggcgtacctgctttagtgaggctccttagaaaagcacgcgatatggatctgacagaggtcattacgggaactctttggaacctgagttcacatgactctatcaaaatggagatcgtcgatcatgcacttcatgcgttgaccgacgaagttattattcctcattcaggctgggagcgggaacccaatgaggactgtaaaccccgccatatagagtgggagagcgtgctgaccaacacagctggatgtttgcgcaatgtcagcagcgaacgctcagaggcccgccgcaaactccgtgaatgcgacggactcgtagatgcactcatcttcatcgtccaggccgaaattggccagaaagacagcgacagcaagctggtggagaactgtgtatgtctgttacggaacctgtcctaccaggtccacagggagataccgcaagccgaaagatatcaggaggctgctcccaacgtcgctaataatactggacctcatgcggcgtcctgctttggtgcgaaaaaaggtaaggggaaaaagccaatagaagacccggcgaatgataccgtggatttcccaaagcgcacatctccagctaggggttacgagctccttttccaacccgaggtggtgagaatctacatctcactgctgaaagagagcaagacaccagcaattctggaagcatccgccggggcaattcagaacctatgtgcaggccgttggacctatgggagatacatcagatccgctctgagacaggagaaagccttgtccgccatagcagatctactgaccaacgagcacgaacgcgtggtgaaggctgcatctggagctctgcgaaacctggctgtggatgcacgcaacaaagagctgattggcaagcacgccatcccaaacctagtcaaaaatctacctggtggacaacagaattcctcatggaatttctctgaggacactgtaataagcattcttaacacaattaatgaagtcatagctgagaatttggaagccgctaaaaaactcagagaaacacaggggatagagaagcttgtcctcattaacaagtccgggaaccggtccgaaaaggaagtgcgcgcagcagccctggtccttcagacaatttggggatacaaagagctgaggaagcctctggagaaagaaggctggaagaaatcggatttccaggtaaacctcaataacgccagtcggtcccagagctcgcatagttatgacgatagtaccttacctctgatcgatcgcaatcagaaaagcgataaaaagcctgatcgtgaggagatacaaatgagcaatatggggtcaaacactaagagcttggataataactactcgactcccaacgagagaggtgatcacaatcgtacgctggatcggagcggcgacttgggagacatggagcccctaaaaggcacaacgcctctcatgcagaaaatttag

SEQ ID NO: 111079 - DNA, 1851 bp, Artificial Sequence
  Description of Artificial Sequence: Synthetic coding sequence
atgatcggagaggaggtgccctccgaccagtattactgggcccccctcgcccaacatgagcgaggttctctcgcttctcttgactctctgcgaaagggtggaccacctcccccgaattggcgacagccagaattaccggaagttatcgccatgctcggttttaggcttgacgccgtgaaatccaatgccgccgcttacctacagcacttgtgttacagaaacgacaaagtgaaaaccgacgtcagaaagctgaaggggatcccagtactggtcggactcctggatcaccccaagaaggaagtacatctgggcgcctgcggagcactgaaaaacatctctttcgggcgcgaccaagataacaaaatcgcaattaagaactgtgacggagtccccgcgcttgtgagacttctgcggaaagccagagacatggatctcaccgaggtgatcaccggaactctgtggaacttgagctcccatgacagcattaaaatggaaattgtcgaccacgctctgcatgcccttacggacgaggttattatcccacattctgggtgggagcgagagcctaatgaggactgtaaaccgcggcatattgaatgggagtctgtactcactaatactgcagggtgcctgcgaaacgtatccagtgaacgttccgaagcaaggaggaaactaagggagtgcgatggcctagttgatgctcttatttttattgtgcaggccgagataggtcaaaaggactccgactcaaagctggtcgagaattgtgtgtgtctcctgcgcaaccttagttaccaagtccatagagagatcccacaggcagagagatatcaggaggccgcacccaatgtggctaataacactgggccccacgctgcctcgtgcttcggggcaaaaaagggaaaagacgagtggttctctcgcggcaagaaaccaatcgaggaccctgccaatgataccgtggatttcccaaagcggaccagccccgccagaggctacgaactcctgtttcaaccagaggtggtccggatctatatttccctgcttaaggagtcaaagacaccagctatcctagaagccagcgcaggcgccattcagaatctgtgtgccggacgctggacctacggaagatatattagatcagccttgaggcaggagaaggcgctgtcagcaatcgccgatttattgaccaacgagcacgaaagagtggtcaaagcagcatcaggagctttgcgtaatttggcagtcgatgctcggaacaaagaactgattggtaagcatgccatcccaaaccttgtgaagaatctgccaggcgggcagcagaactccagttggaatttcagcgaggatacagtgatctcaattctgaataccattaacgaggtaatcgctgagaacctagaggctgccaagaagcttcgcgagacgcagggaattgagaagctcgtgcttatcaacaagtctgggaatcgaagtgaaaaagaggtgcgtgcggctgctctcgtccttcagacaatttggggttacaaggagttacggaagccgcttgagaaggaaggttggaaaaagtcggacttccaggtgaatttgaataacgcatcccgttcgcaaagcagccactcctatgatgatagcacactgcctctgattgatcgcaatcaaaagtctgataagaaacctgatcgggaggaaatccagatgagtaatatgggatccaataccaaatcgctagataataactattccacacccaatgagagaggagatcacaaccggaccctggatcgctcgggggacttgggggacatggagcccctcaagggaactacccccctaatgcaaaaaatctag

SEQ ID NO: 111080 - DNA, 2727 bp, Artificial Sequence
  Description of Artificial Sequence: Synthetic coding sequence
atggcgaacggcactctgaccagacgccaccagaatggtcgatttgttggtgatgccgacctagagcgacagaagtttagcgatcttaaactgaatggcccacaagatcatagtcatctgctgtacagtacgatcccacggatgcaggaaccaggacaaatcgtggagacgtacacagaagaagaccccgagggtgctatgagcgtggtgtctgtcgagactagcgatgacgggacaaccagacgcactgagactaccgttaaaaaagtcgttaagacagtgaccacccggacagtgcagcccgtcgccatgggcccagatggactccccgtggatgcctccagtgtgtccaacaattatattcagacgctgggaagagattttcgtaagaatggtaatgggggcccaggcccatatgttgggcaagccggtaccgctacactgcctcgtaacttccattacccccctgacggatatagcaggcattacgaagacggttacccaggcggcagcgacaattatgggtctttgtcaagagtgacccggattgaggaacgctaccgcccatcgatggagggctatcgcgcaccatctcgccaagatgtatacggtccacagcctcaggtaagggtgggaggatccagcgtcgatttgcacaggtttcaccctgaaccatatgggctcgaagacgaccagaggtcgatgggatacgatgatctcgattacggtatgatgagcgattacgggaccgctagaaggaccggcacgcctagcgatccacggcgtagactccggtcttatgaggatatgattggtgaggaagtaccctctgaccaatactactgggctccattggcgcaacacgaacggggatctctggcatccctggatagccttcgcaaaggagggcctcctccaccaaattggcgtcagccggaattgcccgaggtgatcgccatgctaggattccgacttgatgccgttaagtcaaatgccgcagcctacttacagcacctgtgctatagaaacgataaggttaaaactgacgtgaggaaactgaaaggcattcccgtgctggtggggctcctcgaccaccctaagaaggaggtccatctcggagcctgcggagctctgaagaatataagctttggccgggatcaggacaacaaaattgccattaagaattgcgatggcgtcccggcactcgtcagacttctccggaaggctcgggatatggacctaaccgaagtgatcaccgggactctgtggaacttatccagccatgacagcatcaaaatggagatcgtggaccatgcactgcacgcccttaccgatgaggttattatcccccactcaggctgggagcgcgagcctaatgaggattgcaagccacgtcacatcgagtgggaatccgtactgacgaataccgctggatgtttgaggaacgtcagttctgagagaagtgaagcccgtcgtaaactccgtgaatgcgatggtttggtcgacgcgctgatattcatagtccaggctgaaatcggacaaaaagactctgatagcaagctggtcgaaaattgtgtttgccttctaagaaatctgagctatcaggtgcatagagaaatcccccaggccgaacgctaccaagaggccgcacctaatgtggccaacaacacagggccacacgccgctagctgctttggcgccaaaaaaggcaagggcaaaaagccaattgaagatcccgccaatgataccgtagactttcccaaacggactagtcccgcacgtggttatgaattgctgtttcagcccgaagtcgtgagaatctatatcagtctgctgaaggaaagtaaaacaccggccattctagaagccagcgccggcgccatacagaacctttgcgcggggcggtggacttacgggcgctatattagatcagctctgagacaagaaaaagccctctcagctatagctgacttgctcaccaatgagcacgagcgagtggtcaaggccgctagtggagccctcaggaacctcgcagtcgatgccagaaacaaagagctcatcgggaaacacgctatcccaaatctggtcaagaacctgccaggaggccaacagaattcctcgtggaattttagcgaagatactgtgatctccattttgaacaccataaacgaggtgatagccgaaaatttagaagccgcaaaaaagttacgcgagactcagggcatcgaaaaattggttctcattaacaagtctggaaacaggagtgagaaggaggtgagggcagcggcattggtgctgcagaccatatggggttacaaagaacttcggaaaccactcgagaaggaggggtggaaaaagagtgatttccaggtcaacctaaacaatgcttcaaggagtcaaagttcacacagctatgatgacagtaccctgccgctgatagatcgtaaccagaagtctgacaaaaaacccgatcgagaggaaatacagatgtcaaacatggggagtaataccaagtcgctcgataataactattctacgcccaacgagaggggggatcataatcgcactcttgacagatctggggacttgggggacatggaacccctgaagggcaccacccctctgatgcaggatgaaggccaggagagtctggaggaggagctggatgtgctcgtgcttgacgacgaggggggccaagtttcttaccccagtatgcaaaaaatctag

SEQ ID NO: 111081 - DNA, 1833 bp, Artificial Sequence
  Description of Artificial Sequence: Synthetic coding sequence
atgatcggtgaggaggtcccttccgaccagtattattgggcccccttggcacaacacgagcggggctcgctcgccagcctggatagtttgcgcaaaggaggacctccacctcccaattggcgtcagccagaattgccagaagttattgctatgcttggatttcggctggacgccgtcaagtctaatgccgcggcgtacttgcagcatctgtgctatagaaatgacaaggtgaagaccgatgtgcgtaaactgaaaggaattccagtcttggtaggactgctcgaccacccaaagaaggaagtgcacctgggagcatgcggtgctttaaaaaacatatcattcggaagggaccaagataacaaaattgccatcaagaactgcgacggggtccctgctttggttaggctgttacggaaggcacgggacatggacctgaccgaggtgatcacgggcactctgtggaatctatcttcccacgattccataaagatggaaatcgtggaccatgctcttcacgccttgacagacgaggtgattattccacactctggatgggagagagaacccaacgaagactgcaagccaagacacatcgagtgggagagcgtattaaccaatacagcagggtgcctaagaaacgtgtcaagcgagcggtccgaggctcgacgcaaactgcgggaatgcgacgggctggttgacgctttgatcttcattgtgcaagcagagatcggccaaaaagattccgatagtaaacttgtggagaattgtgtctgccttcttagaaatttatcatatcaggtgcacagggaaatcccacaggcggaaagatatcaggaagctgccccaaatgtggcgaataacactggtccccacgctgcatcttgttttggcgcaaagaaggggaagggcaaaaaacccatcgaggacccagctaacgataccgtggacttccctaagaggaccagccccgctcgaggatatgagctgctgttccagcccgaggttgtgcgaatttacatatcgcttctgaaagagtcaaagactcctgcaattctggaggccagcgccggagcaatccagaacctgtgcgctggtcgttggacatacggacgctatattaggtcagccctgagacaggaaaaagctctgtctgccatcgcggatttactgacgaacgaacacgaaagagttgtcaaagccgcaagcggggccctgcggaatctggccgtagacgcccggaataaagagctaattggtaaacacgccattcccaatctcgtgaagaatctccccggcggacagcaaaactcgtcatggaatttctctgaagatactgtgatcagcatacttaataccatcaacgaggtgatagccgagaatcttgaagcggcgaaaaagctgcgggaaacccaaggaatcgaaaagctagtcctgataaacaaatctggcaacagaagcgagaaagaggtgcgcgcagccgccctcgttctccagacaatttggggttacaaagagctgagaaaacccctcgaaaaagaaggctggaagaagagtgatttccaggttaatctcaacaacgcctcccgcagccaaagttcacattcatatgatgattctacactcccactaatcgaccggaatcagaaatctgataagaagcctgatagagaggagatccagatgagtaacatgggcagtaatactaaaagcctggataacaattactctacccctaacgagcgaggagaccataataggacgctcgataggagtggagacctgggcgacatggagcctctcaagggtacaacccccctcatgcagaagatatag

SEQ ID NO: 111082 - DNA, 1938 bp, Artificial Sequence
  Description of Artificial Sequence: Synthetic coding sequence
atgatcggggaagaagttccatccgatcagtactactgggcacctcttgctcagcacgagagggggtcactcgcgagtttggatagtctcagaaaagggggtccccccccgcctaactggcggcagcccgagctgccagaggtgatcgccatgctcgggttcaggctcgacgcagtgaagtcaaacgctgcagcctaccttcagcatctatgttataggaacgacaaggtgaaaaccgacgtacggaagctgaaaggcattcccgttctagtcgggctgctcgatcatccaaagaaggaggtgcacctcggagcatgcggagcactgaagaatatctctttcgggagggatcaagacaacaaaatcgccatcaagaactgcgacggagtcccagctctggtgagacttctgagaaaggcacgggatatggatttaactgaggtcattactggaacactgtggaacctgagctcccacgatagcattaaaatggaaattgtggatcatgccctgcatgctctcacggatgaagtcattataccacacagcgggtgggaacgcgagcccaatgaggactgcaagccgcgccacatcgaatgggagtccgtgctaactaacaccgcagggtgcctaagaaacgtttctagcgaacggagcgaagctcggcgcaagctgagagagtgcgatggtttggtggatgcactcattttcatcgtgcaagctgagatcggccagaaggactccgacagcaagctggtggagaactgcgtttgccttctccgcaatctgtcttaccaggtccatagggagattccacaggccgaacggtatcaggaggctgcccccaacgtggccaacaatactggaccccatgccgcatcttgctttggagccaagaaaggcaaagacgagtggtttagtagggggaaaaaacctatcgaggatccagctaacgatactgtagattttccaaagaggacatccccagccaggggctacgaacttctgttccagcctgaagtggtaagaatttatatttctcttctgaaggagagcaagacccctgccattctcgaagcaagcgccggcgccatccagaacctatgcgcgggccgatggacctatgggagatacatcaggagcgcgctgcgccaggagaaggcactgtctgccattgctgacctactaaccaacgaacatgagagagtggtaaaggcagcgtcaggcgcgctgaggaacctggctgtggatgccagaaacaaagagctcattggcaagcatgcaatcccaaatctagtcaagaaccttcccggtggacagcagaatagtagttggaatttcagtgaggacactgtaatctccatcctgaacacgatcaacgaggttatagcagaaaacctggaggccgctaaaaaactgagagagacacagggcatcgaaaaactggtcctgatcaataaatccgggaacagatctgagaaagaagtgagagccgcagctctcgtcctgcagaccatctggggctataaggagctgagaaagccgcttgagaaagaaggctggaaaaagtcagacttccaggtaaatctaaacaatgcctctcgttcccaaagctctcactcctatgatgactccacactccctttaatagatagaaatcaaaaaagcgacaagaagcccgaccgcgaagagatacagatgagcaatatgggatctaacaccaagagtctggacaacaattattctacccctaacgaaagaggcgaccataatcggacactcgaccgtagcggggatctaggggacatggagcccctcaagggtaccacgcctctgatgcaagacgagggccaagaatctctcgaggaagaattggatgtgctagtgctcgacgatgaaggcgggcaggtctcatatccaagcatgcagaagatctag

SEQ ID NO: 111083 - DNA, 2517 bp, Artificial Sequence
  Description of Artificial Sequence: Synthetic coding sequence
atgcaagagccaggacagatcgtcgaaacatataccgaagaagaccctgagggagctatgtccgtcgtgtccgtggaaacctctgatgatggtacaacgcgccgcactgagaccacagtcaagaaagttgtcaaaaccgtgacaacaaggactgttcaaccagtggccatgggaccagacggtttaccagtggatgcttcgagcgtgtctaacaactacatacagactctggggagggactttcgtaagaacgggaacgggggtccaggaccttacgtggggcaggcagggactgccactttgccacggaacttccattacccaccagatggatattccagacactatgaagacgggtaccctggcggttcagataattatggatctctaagcagagtaactaggatagaagagcgctatcggccgagtatggagggttacagggcaccatcccggcaggatgtatatggaccgcagccccaagtgcgggtcgggggatcctcggtggacttgcaccggttccaccccgaaccatacggtctggaagacgaccaacgtagtatgggttacgatgatctcgattacggcatgatgtccgactatggcacagcccgcagaactggcactccttctgatcctagacggaggctgcggtcctacgaggatatgataggcgaagaggttcctagcgaccagtactactgggctccacttgcccagcatgaacgggggtcgttagcctcactcgattccctgaggaaggggggccctccaccccctaattggagacagcctgaactaccagaagtgatagcaatgttggggttcaggttagacgcagtaaaatccaacgcagcagcatacttgcaacacttgtgttacaggaatgataaggtaaagactgatgtccggaagttgaaagggatcccagtcctggttggtctcttagaccatcccaagaaggaagtgcacctcggagcgtgtggcgccctgaagaatatatcatttggacgggatcaggacaacaagatcgccatcaaaaactgtgatggcgtaccagctctggttagactgctcaggaaggccagagacatggacctcaccgaagtcattacaggcactctttggaacctgtcaagtcatgactcaatcaagatggaaatcgttgaccacgccctccatgccctcacggacgaagttatcatcccgcacagcgggtgggaacgcgagccaaacgaagactgcaaaccaagacatatcgaatgggagtctgtactcacaaacacagcaggatgtctgaggaatgtctcgagcgaacgatcagaggctcgcagaaagcttagggaatgcgatggcctggtggatgcactcatctttatcgtacaggccgagatcggacagaaggactcggacagtaaactcgtcgaaaattgcgtctgtttgctgagaaacctgtcctaccaggttcatagggagataccacaggctgagcgttatcaggaagctgcacctaatgttgctaacaacacgggcccacacgccgcctcttgttttggtgcgaagaaaggaaaagacgaatggttttccagaggtaaaaaacctatagaggaccccgcaaatgacacagttgactttccaaaacgcaccagtccagctcgcggttacgaattgctcttccagcccgaagtagtgcgcatctacatttccctgctaaaggaatccaaaactccagcaattctcgaagcttccgcaggagccatacaaaacctctgtgcggggcgttggacatacggtaggtacatccggtccgccctgagacaagaaaaagctctgtctgcaatcgccgatctgctgacaaatgagcatgagagagtggtaaaagcagcgtccggcgcactacgcaacctcgccgtggatgcccggaataaggagctcatagggaaacatgctataccaaatttggttaaaaatttacctggtgggcagcagaattctagttggaatttcagcgaggacaccgttatttctattctcaacaccataaacgaagttatagcggaaaacctcgaggctgcaaaaaagttacgggaaacccaggggatagagaagctggtgcttatcaacaagagcggcaatcggagcgagaaagaggtaagagcagcagcgcttgtgctgcagacaatctgggggtataaagagctccgcaaacccctcgaaaaggagggttggaagaaatctgatttccaggtgaatctcaacaatgcttctaggagtcaatctagccattcttatgatgacagcacactaccgctgattgataggaatcagaaatcagataagaagcccgaccgagaggagatccagatgtctaatatgggctccaacactaagtcactagacaacaactactctacccctaatgaacgcggggaccataatagaacgctcgatcggagcggcgatcttggggacatggagccactgaaagggaccactcccctgatgcaaaaaatctag

SEQ ID NO: 111084 - DNA, 2640 bp, Artificial Sequence
  Description of Artificial Sequence: Synthetic coding sequence
atggccaatggtactctgactcgacgtcatcagaacggaagattcgtcggcgatgccgaccttgaaaggcagaagttctccgatctcaagctgaatgggcctcaggaccactcccacctgctttactctacaatccccaggatgcaggagcccggccagatagtggaaacctatactgaagaggaccccgagggggcaatgtctgtggtaagtgttgaaacttcagacgacgggacgaccaggcgcactgagaccaccgtgaaaaaggtggtcaaaaccgtcacaacccgcacagtgcagccagtggcgatgggccctgacggactgccggtggatgccagctcagttagcaacaattatatccagacactgggccgggacttcagaaaaaatggcaacgggggccctggcccatacgttgggcaggccggtaccgccaccttgcccaggaatttccactacccccccgacggctatagccggcactacgaagatggatatcctggcggtagtgataactatggcagtctgagcagagtcacccgtatcgaagaaagatatcgaccctcaatggagggctatagagcaccctcccggcaggatgtgtacgggccacagccccaggttcgcgttggtggctcctccgttgaccttcaccggttccaccctgaaccgtacggtctggaagatgaccagaggagcatgggctatgatgatttagattacggcatgatgtccgattacgggacggcacggaggacaggaaccccttccgaccctcggaggcgcttaaggtcatatgaagacatgattggtgaggaagtcccctccgaccagtattactgggccccactggctcaacatgagagggggtctttggcgtcactggattccctgaggaaggggggacctcctcctcccaactggaggcaacctgagctgcccgaggtgatcgctatgctggggttccgtctggacgctgtgaagagcaatgcagctgcgtatctccagcacttatgctataggaacgataaggttaagactgatgtacggaagttgaagggcatccccgtcttagtcggactgcttgaccaccctaagaaggaagtccatctcggagcctgtggcgcactcaaaaatataagtttcggtagagaccaggataataagattgccataaagaattgtgacggggttcccgccctggtacggctgcttaggaaagccagggacatggatctgaccgaagtcattacgggaacgctgtggaacttgagctcacatgactccataaagatggagatcgtcgatcatgcacttcatgctttaacagacgaggtgatcataccgcacagtggttgggagcgcgaaccaaacgaggactgtaagcctagacacatcgagtgggagtcagtgctgacaaacaccgctggatgcttgcgcaacgtatcctccgaaaggtctgaggccaggcggaagctgagggaatgtgacgggctggtggatgctctcatatttattgttcaggcggagattgggcaaaaagattccgatagcaaactcgttgaaaactgtgtgtgcttgctgaggaacctttcatatcaagtccaccgcgaaattccgcaggccgagcggtaccaggaggcagctccgaatgtggcgaataacaccggcccacatgctgcttcttgcttcggggcgaaaaagggtaagggcaaaaagcctattgaagacccagctaacgataccgtcgactttccaaagcgtacgtcccccgctcgaggatatgaactcttgtttcagccagaggtggtcaggatttacatttctctattgaaggaaagcaaaaccccggccatcttggaagccagtgctggcgccattcagaacttgtgcgccggaagatggacttacggaagatacattcgtagtgcactccggcaagaaaaagcactgagtgctatcgctgacctgctaaccaatgagcatgagagggtggtaaaggctgcatcgggcgctctcagaaatcttgcagttgatgccagaaataaggaacttattgggaagcatgccatacccaatctagttaagaacttgccgggtggacagcagaacagttcatggaacttctctgaagacaccgtgatttcaatccttaataccatcaatgaagttattgccgaaaatctggaggccgcgaagaagctgcgtgagactcagggcattgaaaagctggtccttataaataagtctggcaacagatccgagaaagaggtccgggccgctgccctggtgctccagaccatctggggatataaagaactgcggaagccattggagaaagaagggtggaaaaagagcgattttcaggtgaacctgaataatgcaagtaggagccagtccagccactcttatgacgactcaaccctgccactgattgataggaatcagaagagcgataaaaagcccgaccgagaggaaatccagatgtcaaatatgggcagcaacaccaaatcgttagataataattattcaacacctaatgagaggggcgatcacaaccggacacttgataggtccggagatcttggagatatggaaccactaaagggtaccacacccctgatgcagaaaatctag

SEQ ID NO: 111085 - DNA, 2640 bp, Artificial Sequence
  Description of Artificial Sequence: Synthetic coding sequence
atggcaaacggaactctaacccgacgacatcagaacggcaggttcgttggcgatgcggacctggagcgccagaagttttctgacctgaagctcaacggcccccaggaccatagtcacttgttatatagcactatcccgcgcatgcaggagcctggccaaatcgtggagacatacacagaagaagaccccgaaggggctatgtcggtcgtgtctgtggagaccagtgacgacggaaccactaggcggaccgaaactacagtgaagaaggtggttaagacggtgaccactaggaccgttcaaccggtagcaatgggtcccgacggactccctgtggacgcctctagcgtctccaacaattatatccaaactctgggcagagattttaggaagaacgggaatggtggccctggcccgtatgtcgggcaggctggcacggcgacacttccgaggaactttcactatccccccgacggctactcccgccattatgaggacgggtacccgggcgggagcgacaactatgggtcgctctctcgagtgaccagaattgaggagaggtatcgcccatccatggaagggtatagggctccttcgaggcaggacgtgtacgggccacagccccaggtgcgagtagggggttcgagtgtggatcttcatcgcttccatcctgaaccatatggtttggaggacgaccagaggtctatgggctacgatgacctcgattacgggatgatgtctgactatggcactgctcggcgcactgggaccccatctgatcctaggagacgactgcggagctatgaggacatgatcggcgaagaggtaccctccgatcaatattattgggcgcctcttgcacagcacgaaagaggctcgctcgcctcactggactcccttaggaaaggagggccacctcccccgaattggagacagcccgagttgcccgaggtgattgccatgctgggctttcgcctggacgcagtgaaatcaaacgctgcagcctacctgcaacacctgtgctaccgcaatgataaggtcaaaactgacgtccgcaagctcaaagggatcccagtgctggtgggcttactggaccaccccaagaaggaagtgcaccttggagcttgtggcgcccttaagaacatctcatttggccgagatcaggataataagattgctattaagaattgtgatggggtcccagcccttgtccgcttgctccggaaggctcgcgacatggatctcacagaggtcatcacgggaacgctgtggaacctgtcttcccacgactctattaagatggagattgtagatcatgccctccacgcactgaccgatgaagtgattatcccccactcaggatgggagagagagccaaatgaggattgcaaacccagacatattgagtgggagagtgtgcttaccaataccgcgggttgtctccggaatgtttcatctgagagatcagaagctaggcgtaagttgcgagaatgtgatggccttgtagatgcccttatcttcattgtgcaagctgaaatcggccagaaggactctgatagcaagcttgtcgaaaactgcgtgtgtctgctcagaaatttatcgtatcaggtacatcgggagataccccaagctgagagatatcaagaagccgcacctaatgtggctaacaataccggacctcacgctgctagttgtttcggggccaaaaagggcaaaggcaaaaaaccaatcgaggaccccgcaaacgataccgtggattttcctaagcggacgagcccagcaaggggatacgagctccttttccaacctgaggtcgtgaggatttatatttcactgctgaaagaatccaaaacccctgcaatactcgaagcatccgcaggagctattcaaaacctgtgtgcgggtaggtggacctatggccggtatatcaggagcgcgctcaggcaggaaaaggctctgagtgccatcgctgatctgctgactaacgaacatgaacgtgtggttaaagctgcttcaggtgcgctgagaaacctggccgttgacgctcgaaataaagagttgattggcaaacacgcaatcccaaacttggtgaaaaacctgcctggtgggcagcagaacagctcctggaacttttctgaggatacagttattagcatccttaataccattaatgaagtcattgctgagaacctggaagctgcaaagaaactgcgcgagacacaaggaatagagaaactggtgctcattaacaagtctggaaacagatctgaaaaggaggtccgggccgcagcactggttcttcagacgatctggggctataaggaactgagaaaaccgttggagaaggaaggatggaagaagtcggatttccaggttaaccttaacaatgcaagccgctcccaatcctcacacagttatgacgatagcacactgcccttgatcgaccgtaaccaaaagtcagataaaaagcctgatcgggaggagatccaaatgtctaacatggggtctaatacaaagtctctcgacaacaattacagcacacccaacgagaggggagaccacaataggaccttagataggagtggggatttgggggatatggagccactgaagggaaccacgccactgatgcaaaaaatatag

SEQ ID NO: 111086 - DNA, 2499 bp, Artificial Sequence
  Description of Artificial Sequence: Synthetic coding sequence
atgcaggaaccaggacaaattgtcgagacctacactgaggaagacccggaaggtgcgatgtcagtggtgagtgtggagacctcagacgatggcaccaccagacgcaccgaaaccaccgtcaaaaaggttgtaaaaacagtcaccaccaggacggtgcaaccggtcgcgatgggtcccgacggcctacccgtcgatgctagtagcgtgtccaacaactacatccaaaccctgggccgggacttcagaaagaacggaaacggcggtcctggcccctatgtcggccaggccggaaccgccacactgcctcggaacttccactacccgcccgatggatactctcggcattacgaggatggatacccagggggtagcgataactacggatctctgagtcgcgtaacgcgcatcgaggagcgctatcgcccgtcaatggaaggctaccgggccccctcacgccaggacgtatacggcccccagccacaggtccgagtcggcggctcatccgttgatctgcacaggttccaccctgaaccatatggtctcgaagatgatcagaggagcatgggctatgatgacttagattatggtatgatgagcgactatggcactgcaagaaggaccggcacccccagtgatccccggcgaaggctcaggtcatacgaagacatgattggggaagaagtgccctccgatcagtattactgggctcctcttgcccagcatgaacgcggcagcctcgcctcccttgactctctgagaaaaggaggcccgcccccccccaattggaggcagccagagctgccagaagttattgctatgttggggtttcgcctggacgcagttaagtcaaacgctgcggcttacctgcagcacttatgttacagaaacgacaaggtaaagacagacgtgcggaaacttaaaggtatcccagtcttggtgggactgcttgaccaccctaagaaggaagtccacctcggtgcctgcggagcattgaaaaatatcagctttggaagggatcaagataataaaatcgctatcaaaaattgcgatggcgttccagccctggtcaggcttctgcgaaaggcccgggacatggatttaaccgaggtcattactgggacattgtggaacttgtcctcgcacgactccattaagatggagattgtggatcacgctctccacgcgctcaccgacgaagtcattatcccacacagcggctgggagcgcgagcctaacgaggactgtaagcctcgacacatcgagtgggagtcggtgctgactaacacggctggatgtctccggaatgtcagcagtgagcgttcggaggcaagaaggaaattgcgggagtgtgatggattggtagacgccctgatttttatcgtacaagcagagattggccagaaggatagcgactcgaagttagtggagaactgcgtgtgcctgttgagaaacttatcctaccaggtgcatagagagatcccccaagctgagcggtaccaagaagctgctcctaatgtggcaaataacacgggcccccacgcagcatcttgtttcggggcaaagaagggcaagggtaaaaagccaatagaggatcccgcaaatgacacggttgactttccaaagcgcacatccccagcacgtggatacgaattgctttttcagcctgaggtggtgcgaatctacatctcactattgaaggagtccaagacaccagctatactcgaggctagcgcgggggcaatacagaatctgtgcgcaggtcgatggacttatggccgctacatcagatccgctttgcgtcaagaaaaagccctgtccgccatcgcggaccttcttaccaatgaacatgaaagagtggttaaagcagccagcggcgcactgaggaatctggctgtagatgctcgaaacaaggagttgattggaaaacacgctatacccaatctcgtgaagaatctgcctgggggccagcaaaatagttcttggaacttcagtgaagataccgtaattagcattctgaatactatcaatgaggtcatcgcggagaatctggaggcagccaagaagctcagagaaactcaggggatcgaaaagctggtcctgatcaacaagtcaggtaatcgcagcgagaaagaggtgagggcggctgctctggtgttgcaaacaatttggggatacaaggagctacgaaagccactggaaaaagaaggctggaagaaaagcgattttcaggtgaaccttaacaacgcaagccgtagccagagctctcacagctacgatgattccacattgccactgatagaccgtaaccaaaaatctgacaaaaagccggatagggaggagatccagatgagcaatatgggcagcaacaccaagtctctcgataacaattactccaccccaaacgagaggggagatcataaccgcacactcgatcgcagtggcgatctaggggatatggagccgctgaagggaacaacaccacttatgcagaagatctag

SEQ ID NO: 111087 - DNA, 390 bp, Artificial Sequence
  Description of Artificial Sequence: Synthetic coding sequence
atggctaacggaaccttgacccgccgacatcaaaacggtcggtttgtgggcgatgccgatctggaacgccagaagtttagtgatctgaaactgaatgggcctcaggaccactcacacttgttatacagcactattcctagaatgcaggaaccaggacaaatcgtggagacttatactgaagaagatcctgagggcgccatgagtgtggtcagtgtcgaaacttccgacgacggcaccactaggcggaccgaaactacggtaaagaaggtggtgaagacagtcaccactcggactgtgcagcctgtggcaatggggcctgatggcctcccagtggacgcaagtagcgttagcaacaattacatccagacccttggacgggatttccggtag

SEQ ID NO: 111088 - DNA, 2586 bp, Artificial Sequence
  Description of Artificial Sequence: Synthetic coding sequence
atgcaagagccaggccagatcgtcgaaacatacaccgaggaagaccccgagggggccatgagcgtggtatccgtagaaacaagcgacgacgggactaccagaagaaccgagaccaccgtgaagaaagtggttaagaccgtcacgacccggacagtccagcctgtggccatgggaccagatggactgcccgtggatgcaagtagcgtgagcaataactacattcagacactgggccgagacttccggaagaatggcaacggagggcccggtccgtacgtggggcaagctggaactgcaaccctgccacgaaatttccattatccccctgacggttacagcagacattacgaagatggctacccggggggcagcgacaactacggctccctgagcagggtgacaaggatcgaggagcgatatcgcccttccatggaaggatatcgagcccccagtcgtcaggacgtgtacggcccacagccccaggttcgcgttggtggttcctctgtggacttacatcgcttccaccccgaaccctacggactggaagatgatcagcgttctatgggctacgacgatctggactacgggatgatgagtgactacggtactgccaggcgcacagggactccctctgacccgcgaagacgcctgcgctcttatgaggacatgattggcgaggaggtccccagcgaccaatattattgggccccgttggcccaacatgagcgggggtccttggcgtctctcgattcactgcgcaaagggggtccgccacccccaaattggcgtcagccggaacttcctgaggtgattgcgatgcttgggttccggcttgacgcagtcaagagcaacgcggccgcgtacctccagcatttgtgctataggaatgataaggtgaaaacagacgttcggaaactgaagggcattcccgtgctggttggacttttagaccatccgaagaaagaggtacacctgggagcttgtggcgctttaaagaatattagttttggccgggaccaggataataagatcgctattaaaaattgtgacggcgtgcctgctctcgtacgactgctgcgcaaggctcgtgacatggacctgacggaagtgatcactgggacgctgtggaacctttcatctcatgactctatcaaaatggaaatcgtggatcacgcactgcatgcactgaccgacgaggtaataattccccattctggttgggagagggagccaaatgaagactgtaagccacggcacattgagtgggaatctgtgcttacgaatactgctggatgtcttcggaatgttagctctgaacgctctgaggcccggagaaagttgcgggaatgtgatggactggtcgacgcactgatattcattgtgcaggccgagattggacagaaggattctgattccaagctcgtggagaactgtgtgtgcctgctaagaaacctttcgtaccaggtccacagagagattccacaggctgagaggtatcaggaagcagcacctaatgtggcaaataatactgggccacacgccgcaagttgttttggggccaagaaggggaaagggaagaaaccaattgaagacccagcaaatgacaccgttgactttcctaagcggacctcacccgcccgggggtatgagctgctgtttcagccggaagtggtaaggatatatattagcctgctgaaggaaagcaaaacacccgctatactcgaagcctcagccggggcaatccagaatctgtgcgctggacgctggacctacgggcgctacattaggtcagctttgaggcaggagaaggctctatctgctatagctgatctccttaccaacgaacacgagagagtggttaaggccgctagcggtgccctacggaacctggccgtcgacgccaggaacaaggagcttattggtaagcacgccatccccaacttggtgaagaacctgccaggcggacaacaaaattcatcctggaacttttccgaagatacggtgataagcattctgaacactatcaatgaggtgatcgccgaaaatttggaagccgccaagaaactgcgggagacacaagggatagagaaactggtgttaatcaataagtcgggaaaccggtcggaaaaagaggtgcgggccgctgcgctcgtccttcagaccatctgggggtataaggagctccgtaagccgctggaaaaagaaggttggaagaagagcgattttcaggtcaatctgaacaatgcttcaaggagtcaatcatctcattcttacgacgactctaccctgccactgattgatagaaaccagaaatcagacaaaaaacccgacagggaggagattcaaatgagcaatatgggctcaaataccaagtcgctggataacaattacagcacccccaacgaacggggtgatcataaccggacattagatcgaagcggagacctcggggacatggaacctctgaaaggaacaacccctctgatgcaggatgaaggccaggagtctctggaggaggagctggatgtgttggtactggacgacgaggggggtcaggtctcctaccctagcatgcaaaagatctag

SEQ ID NO: 111089 - DNA, 2658 bp, Artificial Sequence
  Description of Artificial Sequence: Synthetic coding sequence
atggccaacgggactctgaccagaagacaccaaaacggaaggtttgtaggggacgctgaccttgagaggcaaaagtttagcgatttaaagctcaacggaccccaggaccactcacacctgttgtatagcacaattccaagaatgcaggagcccggacagatcgtggaaacctacacagaagaggacccagagggagcgatgagcgttgtgtctgtggaaacttctgacgacggcactaccagaagaactgagacaacagtgaaaaaggtggtaaagacagtcacgacaagaactgtgcagcctgttgccatgggccctgacggcctgcctgttgacgcttcctctgtaagcaataattacatacagactctgggtagggatttcagaaagaacggtaatgggggccccgggccttacgtgggccaggccggaaccgctaccctgccgagaaattttcactacccccctgatggatatagcaggcactatgaggacggctaccccggcggctcagacaattacggatctctgtcgcgtgtaaccagaattgaggaaagatacagaccctctatggaggggtaccgtgcccctagccggcaagatgtctacggcccacagcctcaggtgcgcgtgggaggtagtagcgtcgatcttcaccggttccacccagagccctacggtttagaagacgaccagcgaagtatgggatacgatgacctggactacggaatgatgagtgattacggcacggctcgtcgtacaggaactccctccgaccctaggagacgtttgcgctcttacgaagacatgatcggtgaagaagtccctagtgatcagtactattgggctcccctcgctcagcacgagcgaggaagcctcgcaagccttgatagcctgcggaaggggggcccgcctccacctaattggaggcagcccgaactgcctgaagtgattgccatgctagggttcagactcgatgctgtgaagtcaaacgcagcagcctacttgcaacatctctgctacaggaacgataaggttaaaacagacgtgaggaagttgaagggaatccccgtgctcgtggggttgctcgaccacccaaaaaaggaggtacacctgggggcctgtggagctctgaagaacatatcattcgggcgggatcaggacaacaaaattgcgataaaaaattgcgatggtgtccctgctttagtgcgcctgcttcggaaagctcgagatatggacctgaccgaagtaatcaccggaactctttggaatctgagctctcacgatagcatcaaaatggaaattgttgatcatgcattgcatgccctgaccgatgaagtaataatccctcattcgggctgggagagggaaccgaacgaggactgtaagccacgccatattgaatgggagtccgtgctcacaaacactgcagggtgtctgaggaatgtatcatcagaaaggtccgaagcccggcgtaagctgagagaatgcgacggtctcgtggacgctctgatttttattgtccaggccgagatcggtcagaaagatagcgattctaagttggtggaaaactgtgtctgcctgctccggaatctctcctatcaggtccatcgggaaattccccaggccgagaggtaccaagaggctgcacctaatgtcgccaataacacaggcccgcacgctgccagttgttttggggccaaaaaggggaaagatgagtggttctctcggggaaagaaaccaatagaagacccagcaaatgatactgtggacttccccaaaagaacgtcacctgcacgtggatacgaattattgttccagcccgaagtcgtgcgcatatacatctcactgctgaaggagagtaagacccctgcaatactggaggcgagtgcaggggctattcagaacctttgcgccgggcgctggacttatggtaggtacatccgttcggccttgcggcaggagaaagcactttcagccatcgccgatttgctgactaacgaacatgagagggttgtcaaggcagcctccggagcactaagaaacttggcggtcgacgcacggaataaggagctgattgggaaacatgctattccgaacctggtcaaaaaccttccgggaggacaacagaatagctcatggaatttttctgaagacactgttatcagtatactgaacacaatcaacgaggtcattgcagagaatctagaagctgcgaaaaaattgagggaaacacagggaatcgagaagttggtgctgattaataagtcgggaaacagatctgagaaggaggtccgcgcagctgccctggtgctgcagactatttggggctataaggaactgcgcaagcctttggaaaaagaaggatggaaaaaaagtgacttccaagttaatctgaataatgcctccaggtctcaaagcagccatagttatgatgatagcacactgccattgatcgatcgcaaccaaaaatctgacaaaaagccagatcgagaagaaatacagatgtccaatatgggctcaaacacaaaatcattagataataactacagcactccaaacgagcgaggagatcacaaccggaccctggatcgctcgggtgatctgggtgatatggaaccattaaagggaactacgccacttatgcagaaaatatag

SEQ ID NO: 111090 - DNA, 1920 bp, Artificial Sequence
  Description of Artificial Sequence: Synthetic coding sequence
atgattggagaggaagtgccatctgaccagtactactgggccccactggcccagcacgagcgtggctccttggcgagtctcgactctctgcggaagggcgggccgccgccccctaactggaggcagccggaattgccggaagtaatagccatgctcggcttccgcctcgatgcagtgaagtccaatgccgctgcttacttacagcatttatgctaccgcaacgacaaggttaagaccgacgttagaaagctcaagggaatacctgtgctcgttggacttctggaccaccccaagaaggaggttcaccttggagcttgtggagccctgaaaaacattagttttggaagagaccaggataataaaattgcaataaagaactgtgacggcgtacccgcgctggtcaggttacttcgcaaggcaagggatatggacctaacggaggtcattactggaactctgtggaatctttccagccatgatagtatcaaaatggagatagtcgaccatgccctgcacgccctgactgacgaggtgataattccacacagtggatgggagagggagcccaacgaggactgcaaacctcgtcacatcgagtgggagagcgtgctcacgaatacagccggctgcttgcgcaacgtcagctcagaaaggagtgaggctcgacggaagttgcgggagtgcgatggactcgtggacgccctgatcttcatcgtacaagccgaaattggccagaaagactctgactctaagctggttgagaactgtgtgtgccttttgaggaatctgtcttaccaggtccaccgggaaatacctcaagctgaaagataccaagaggccgcgcccaacgtggccaacaacaccgggccacatgctgcctcctgtttcggggccaaaaagggtaaaggaaagaaacctatcgaggatcccgctaatgataccgtcgatttccccaaacgaactagcccagcacggggctacgaactgctgttccagcctgaggtcgttcggatctacatctcccttttaaaagaaagcaaaacccctgcaatcctggaggcttccgcaggagcaattcagaatctgtgtgcagggagatggacatatggcaggtatatcaggtctgctcttcgtcaggagaaggcactgagtgccatagccgacttgctcactaatgagcacgagagggtggtgaaggctgccagtggagccttaagaaatctggcagtggatgcccggaataaggagttgattggcaagcacgctatccccaatctcgttaaaaacctgccaggaggccagcagaacagctcttggaacttttccgaagataccgtgataagcattctgaataccatcaatgaggtgattgccgagaacctagaggccgctaaaaagctgcgtgagacccaggggatcgaaaaattagttctaattaacaaatccggcaacagaagtgagaaggaggtgcgcgctgcagccctggtgttgcagacaatctggggatacaaggagctccgcaagccactggagaaggagggctggaagaagtccgactttcaggtcaacttgaacaatgcttccaggagccagtcctctcatagctatgatgactcaaccctgccactcatcgataggaatcagaaatcagataaaaagccagacagagaggagatccaaatgtccaatatgggtagcaacacaaaatcattggataataactacagcacgcctaatgagcgcggagaccacaaccgcaccctggaccggtctggcgacctaggggacatggagcctctgaaaggcaccacccctctgatgcaagatgaaggccaggagtctctagaagaagagttggacgtgctcgtcctcgacgatgaggggggacaagtaagttaccctagcatgcagaagatttag

SEQ ID NO: 111091 - DNA, 2499 bp, Artificial Sequence
  Description of Artificial Sequence: Synthetic coding sequence
atgcaggaaccaggccagattgtcgaaacctatactgaggaggatcccgaaggcgccatgtctgtagtgtccgtagaaaccagcgatgacggcacaacccgcaggactgagaccaccgtaaaaaaagtcgtcaagacagtaaccacccgtacagtgcagcctgtggctatggggccagatgggctccccgtggacgccagcagcgttagtaataactacatacagactctcggacgagattttcgcaagaacggcaacggcggtccgggaccttatgtgggacaagctggcactgccaccctgcccaggaacttccattatccacctgatggatatagcagacattacgaagacggctaccctggcggcagcgacaattatggctcccttagccgggttacgcgaatcgaggaaaggtatcgcccatctatggagggatatcgggccccatctagacaggatgtgtacggcccccaaccgcaggttcgggtgggcggaagtagtgtagacctccacaggttccatcccgagccctatgggctggaggatgatcagcggtccatgggttatgatgatctcgattatggaatgatgtccgattacggcacggcgagacgaacaggaaccccctcagacccccggcggcgccttcggagttatgaagacatgatcggcgaagaagtcccatccgaccagtactactgggcccctcttgcccagcacgaaagagggtctctggcctcactcgattctctgcggaaaggtggtcctcctccacccaattggcgtcagccagagcttccagaggtcatagcaatgcttggcttcagactggatgccgttaaatccaacgccgccgcttacctacaacacctgtgctaccgaaatgacaaggttaagactgacgtaaggaaacttaagggcatccccgtgctcgtgggactcctagatcatccaaaaaaagaagtccatttaggcgcatgcggggcccttaagaacatatcttttggaagggaccaggacaataagatcgccatcaagaattgcgacggggtccccgcccttgttagactcctgaggaaggcgagggacatggacttgacggaagtgatcaccggaactttatggaacctctctagtcatgatagcattaagatggaaatcgttgaccatgccctccacgcactgacagacgaggttatcatcccacattccggttgggaacgcgagcctaacgaggattgtaagcctcggcatatcgaatgggaatccgtgttgacgaataccgccggctgtttgcggaatgtttcatctgagcgctctgaggcgagacgaaaattgagggaatgtgatgggctggtcgacgcattgatctttattgttcaggcggagatcggtcagaaggattccgacagtaaactggtggagaactgcgtttgcctgctgcggaacctgtcataccaagtgcacagagagattccccaggccgaaaggtaccaagaagccgccccaaacgttgccaataacacaggaccgcacgctgcctcatgtttcggcgcaaagaaggggaaaggcaagaagcccatagaggaccctgccaatgacaccgtcgattttcccaaacggacaagtccagcaagaggttacgaactactgtttcaacctgaagtggtgagaatctatatcagtctccttaaggaaagcaagacccctgccattttggaagcgtctgccggagctatccagaatttgtgtgccgggcggtggacctatggtagatatatcaggagtgcattgagacaagagaaggcattgagcgctatagccgatctgctgactaacgaacacgaaagagtcgtcaaagccgcctccggagccctccgaaacttggctgtggatgctcggaataaagagttgataggcaaacacgcaatccctaatctggtaaaaaaccttcccgggggccagcagaacagttcatggaacttttcggaagatacagtgatcagcattctgaataccattaatgaagtgattgctgaaaaccttgaggctgcaaagaagcttcgggaaacacagggcatcgaaaagttggtcctcattaataaatcgggcaaccggtcagagaaagaagtcagggccgccgccctcgtgctccagacaatctggggctacaaagagctccgtaaacctttggagaaggaaggttggaaaaagagcgatttccaggttaatttaaataatgcatccagatcacaaagttctcactcctacgacgactccaccctgcctctgattgataggaaccaaaagagcgataagaagcccgaccgagaggaaatccagatgagcaacatggggtcaaatacgaaaagtctggataataactactcaacacccaacgagagaggtgatcacaacagaaccctggacagatccggcgacctgggagacatggaacccttaaagggaactaccccactgatgcagaagatatag

SEQ ID NO: 111092 - DNA, 2499 bp, Artificial Sequence
  Description of Artificial Sequence: Synthetic coding sequence
atgcaggaaccagggcaaatcgtagagacctacaccgaggaggaccctgaaggggcaatgagcgttgtgagcgttgagacgagcgatgatggtaccacccgcagaaccgaaacaacagtcaagaaagtcgttaagactgtgacaacaagaacggtacagcccgtcgccatggggcccgacggccttccggtggacgcaagttccgtgagtaacaactacatccagactctgggaagagacttccgcaagaatggaaatggtgggcccggaccatatgtcggccaggctggcaccgcaaccctacctcgcaacttccactatccacctgacggctactctagacactatgaggacggttacccagggggtagtgacaattatgggtccctgtccagggtcacacgaattgaagagcgctatcggccttcaatggagggatatcgcgctccttctagacaggacgtctacgggccacaaccccaggtaagggtgggcgggtctagtgtggacctacacagattccacccggagccctatggtttggaggacgatcagcggagtatggggtacgatgacctcgattacggtatgatgtccgattacggaacagcacggcgcacgggaactccaagcgaccccagaaggcggttgagaagctacgaggacatgataggagaagaggtacccagtgatcagtactactgggcaccattagcccagcacgagcggggatccctagcgtctctggactccctgcgaaagggcgggcccccaccacctaactggcgccagccggaactgccagaagtaatcgcgatgttggggtttaggctggatgccgtgaaaagtaatgctgcagcctacttacagcacctctgttacagaaacgacaaagtcaaaacagatgtgaggaagctcaagggcattcctgttcttgttgggctacttgatcaccccaagaaagaggttcatctgggagcttgcggtgctctgaagaacataagcttcggccgggatcaggacaacaagatagctattaagaactgtgatggggtcccggctctggtgagactgttgcgaaaagccagagacatggatctgactgaggtcatcacaggtaccctttggaatctgtcctcacatgactctatcaaaatggaaattgtggaccacgcacttcatgctctcacggacgaggtgataatccctcatagcggatgggaacgggagcccaatgaagattgcaaacctaggcatatcgaatgggaatcagtccttacaaatacagccggctgtttgaggaatgtctcatctgaacgatcagaggcaagacgcaagctgcgggagtgtgatggactggtcgatgccctaattttcattgttcaggcagagatcggacagaaagattctgacagcaaactagtcgagaactgcgtctgccttctgagaaatttatcttaccaggtccacagggagataccacaggctgagagataccaagaggctgctccaaacgtggctaacaatacgggcccacacgcagcgagctgttttggtgctaagaaagggaagggcaagaagccaatcgaagatcccgctaatgacaccgtcgacttccccaagcgaaccagccccgccaggggatatgagctgctctttcaaccagaggtggttaggatttatatcagcctgctgaaggagtctaagactcccgcaatcttagaagcatctgcgggagccattcagaatttgtgtgcaggtagatggacatatgggagatacatcagaagcgccttacgtcaggagaaggcactgtctgctatcgcagacttgctcacaaatgagcacgaacgcgtggtgaaggctgcaagcggtgcacttagaaacctggccgttgatgccagaaacaaagaattgattggcaagcacgccatacccaatcttgtgaaaaacttacctgggggccagcagaactcttcttggaacttttctgaggacactgtgatcagtatcctcaacaccataaacgaggtaatcgcggagaatctggaggcagcgaaaaagttacgggagactcaggggattgaaaaattagtgctgatcaataagagcgggaaccgaagcgagaaggaagtaagagcagcagccctcgtcctgcagacgatctgggggtataaagagttgcggaaaccgttagaaaaagaaggctggaagaagagcgactttcaggttaatctgaacaacgcttcacgcagccagtcctcccactcatatgatgactcgacactgccattgatcgaccgcaaccagaagagtgataaaaagcccgaccgggaggaaattcagatgtcaaacatgggtagcaacactaagtcgctcgataacaattattccactcctaacgaacgaggagaccacaaccgcacgctggaccggtcaggagacctaggcgacatggagcccctgaagggtaccaccccactcatgcagaagatctag

SEQ ID NO: 111093 - DNA, 2640 bp, Artificial Sequence
  Description of Artificial Sequence: Synthetic coding sequence
atggccaatgggaccctcacccgccggcaccagaacggtagattcgtaggagacgccgacttagaacgccagaaattcagtgatctgaaattgaacggtccacaagaccactcccacctcctttattcaacaatcccacgtatgcaggaacccggccagattgtagaaacctatacagaggaggatcccgaaggcgccatgtctgtagtctctgtggagacctcagatgacggcacaacaaggaggacagagacaacagtaaaaaaggtggtcaaaactgttacaacgcggactgtccagcccgtcgccatggggcctgatggactgcccgtggacgcgtcctccgtgtcgaataactacatacagacgcttggacgcgattttaggaagaatggtaacggtggtccaggcccatacgtgggccaggccggaacggccaccctgccgcgaaactttcattatccacccgacggctattcccggcattatgaggacgggtacccgggaggatcagacaattatggctctttatcccgggtaactcgaattgaagagagatatcggccttcaatggaggggtaccgtgctcccagcaggcaggacgtgtacggtccccagccacaagtgagggttgggggatcgtcggtcgacctccacagattccacccggagccatatgggttggaggatgatcaaagaagtatgggctacgacgatctggattatggcatgatgtctgattatggcacagcaagacgaaccggcaccccatctgatccacgccgacggctcagaagctacgaggacatgataggcgaggaagtacctagcgaccagtactactgggcgcccctggctcagcacgaaagaggtagcctcgcttcgcttgattctctgcgcaaaggggggcctccaccgccaaattggcggcaacccgaactccctgaggtgattgctatgctggggtttagacttgacgccgtgaagtccaatgctgcagcctacctacagcacctatgctacaggaacgacaaggtcaaaacggacgtcagaaaactcaagggaatccccgtacttgtcggattgctggatcacccgaaaaaagaggtgcatctgggagcctgcggcgcgctcaagaacatcagcttcggaagggaccaggacaacaagattgccattaaaaactgcgatggggtccctgcgttagtgagattgctgcggaaagccagggacatggacttgacagaagtcattacaggaacgctctggaatctgtcctctcatgatagcatcaagatggagatcgtcgaccatgcactgcacgcccttactgatgaggtgattatccctcacagcgggtgggaacgagaacctaatgaggattgcaagccccgccacatagagtgggaatccgtgctgacaaacacggcagggtgcctaagaaacgtatcgagcgaacgctcagaggctaggcggaaattgcgagaatgcgatggccttgtggatgctctgatctttatagttcaagctgaaattggtcaaaaagactcggactccaagctggttgagaattgtgtgtgtctccttcgtaatctgagctaccaagtccaccgcgaaattccacaggcagagagatatcaggaagcggcccccaacgtggctaacaatacagggcctcatgccgcttcatgttttggcgctaagaagggcaaggggaaaaaacccattgaggaccctgctaatgatacagtcgatttcccaaagcgcaccagtccagcccgcggatacgagctgcttttccagccagaggtggtccgaatttacatcagcctattaaaggagagtaagacgcctgcaattcttgaagccagcgccggagccatccagaacctgtgtgctgggcgctggacctacggcaggtacataaggagtgcgttgagacaggagaaagccctctcagccatcgctgacttactgacaaatgaacacgagagagtggtgaaagctgcaagtggggcactgcgtaacctggcggtcgacgcccggaataaagagctaatcgggaagcacgcgatacctaatctagtgaaaaatttaccaggcggacagcagaattcatcctggaactttagcgaggacacagtgatcagtatcctgaataccatcaatgaagttatcgcagagaatctcgaggcagcgaaaaagcttcgggaaacgcagggaatcgagaaattggtacttataaataagagcggtaaccgctccgagaaagaggtgcgcgccgccgcccttgtactgcagacaatctgggggtacaaagagctccggaaacccctggaaaaagaaggctggaagaagtcagatttccaggttaacctcaacaacgcctcaaggagtcaaagcagtcattcatatgacgattccacccttcctcttatcgatagaaaccaaaaaagtgataagaagcccgatcgggaggagattcagatgagcaacatgggctccaacaccaaaagcttggacaataactacagtacgccaaacgaacgtggggaccacaaccggactttagaccggtccggagacctgggagacatggagccgctgaagggaacaacccccttgatgcagaaaatatag

SEQ ID NO: 111094 - DNA, 2523 bp, Artificial Sequence
  Description of Artificial Sequence: Synthetic coding sequence
atgcaggaacccggccaaatcgtggagacctacactgaggaggatcccgagggggccatgtcagtggttagcgtggagacttctgatgatggaacaacaagacgaaccgagactaccgtgaagaaggtggtgaagactgttaccacccggactgtacagccagtcgccatgggtccagacggactgccagtggatgccagcagcgtgtcaaataactatattcagacgctggggagggattttcggaagaacgggaatggaggaccaggtccttatgtcggccaggccggcactgccaccctcccacggaattttcactacccacccgacggatacagccggcactatgaagacggctaccccggcggctcggacaactatggatccctgtcccgcgtcacacgcattgaggaaaggtaccggccgtccatggagggctaccgggccccttcaaggcaggatgtatacgggccacagccacaggtccgggtgggaggatcatctgtagaccttcaccgctttcacccagaaccttacgggctcgaagacgaccaaaggagtatgggctacgacgacttagattacggcatgatgtctgactacggcacagcaagacggacaggaacccctagtgatcctagacgaaggctgcgatcttacgaggatatgataggcgaagaggtgcccagtgatcaatattattgggccccgctcgcccagcacgagagaggaagcctggcaagcttagatagtttgagaaagggcgggcctcctccacctaattggaggcagcctgagctgccagaggtgatcgccatgttaggcttccgccttgatgctgtcaagtctaacgccgccgcctaccttcagcacttgtgttaccgaaatgacaaggtgaaaaccgacgtaagaaaattgaaaggtatcccggttttggtggggctgttggaccacccgaaaaaggaggtgcaccttggcgcgtgcggtgctttgaaaaatattagttttggacgggaccaagacaataaaatcgcaattaagaactgtgatggcgtgcctgccttggtccggttgcttcgtaaagccagggatatggatctaaccgaggtcataacaggcactctctggaatctgagtagccatgactctattaagatggaaattgtcgaccacgccctccatgccctgacagacgaggtgatcatccctcacagcggatgggaacgcgaacctaacgaggattgtaagccacgtcacattgagtgggagagcgtacttaccaatacagcaggttgtctgagaaacgtcagctctgaaaggtcagaggccaggagaaaactaagggaatgcgacgggctcgtagatgcattgatctttatcgtacaggccgaaattggacagaaagatagcgacagcaaattggtggagaactgtgtgtgtctgctgagaaacctctcctaccaagtgcacagagagatcccccaggcagagagatatcaggaggcggctcccaatgtggcaaacaacacagggccccatgccgcctcttgctttggagctaagaagggtaaaggaaaaaaacccatcgaagatccagctaatgatacagtggacttcccaaaacggacctcacctgcacgaggctacgagctgctattccagcctgaggtggtgcgcatatatatctccctgttgaaggagtcgaagactccagcaatccttgaggcatccgcgggagctattcagaatctgtgcgccgggcggtggacctatggccgatatattcgaagtgcactgagacaggagaaagcattatcagccattgcagacctgttgaccaacgaacacgaacgtgtggttaaagcagcatcgggagctcttaggaatttagccgtagacgcacgcaacaaggagttgatcggtaagcacgctatccctaatttagtgaagaacctcccagggggccaacagaattcatcttggaacttcagcgaggacactgtgatctccattctgaacacaatcaatgaggtgatagctgagaatctcgaggccgctaagaaattaagggagacacagggcattgaaaagctggtcctcatcaataagtccggaaacagaagcgagaaagaggtccgcgcagcagccctggtgctgcagacaatctggggttataaagaattacgcaagcctttagagaaggaaggctggaagaaaagtgattttcaggttaacttaaataacgcctctagatctcagagttctcattcttacgacgattcgacactgccgcttatcgatcgcaaccaaaagtcagataacaattactccacaccgaacgagaggggcgaccataatcggacgttagacaggagtggagacctgggggatatggagcctctaaagggaacaacccccctaatgcaggacgaaggtcaggaaagcttggaagaggagctagatgtgctcgtgctggacgatgaaggcggccaggttagctacccatcaatgcaaaaaatatag

SEQ ID NO: 111095 - DNA, 2745 bp, Artificial Sequence
  Description of Artificial Sequence: Synthetic coding sequence
atggcaaatgggactttaactcgtcggcaccagaacgggcgtttcgttggggatgccgatctggagcggcagaagttcagtgaccttaaactgaacggcccacaggatcatagtcatttattgtacagcacaatcccccggatgcaagaaccgggacagatcgtcgagacctataccgaggaagatccagagggtgctatgtcagtcgtgtccgtggagactagtgatgatggtacaaccagacggaccgaaacaactgtcaagaaagttgtgaagacggtgacaactcgcactgtgcagccagtggctatgggccccgatggcctgccggtggacgcctctagcgtaagcaacaattacattcaaaccctcgggcgcgactttcgaaaaaacggcaacgggggcccgggaccttacgttggtcaggccggcaccgctacactaccccggaactttcattacccccctgacggctattcacgccactacgaagatggctatcctggagggtcggataattacgggagtttgtctcgagttacacgcatagaggagaggtacaggccctctatggagggatatcgggcaccctctaggcaggacgtgtacggaccgcaaccccaggtccgggtcggagggagctccgtggacctgcaccgatttcacccagagccatacgggctggaagatgatcagaggtcgatgggatatgatgacttagactacgggatgatgtccgattatggtacagccagaagaactggcacacccagtgacccaaggcgccggctcaggagttatgaggatatgattggagaggaggtcccctcagaccaatattattgggctcctctagcccagcatgagcgcggtagcctggcatcactggattccctgcgcaagggcggccccccaccaccgaactggcgacagcctgaattgccagaggttatcgccatgttaggatttagactggacgcagtgaagtcaaacgccgcggcatacctgcagcacctttgttaccgaaacgataaggttaagacagacgtgcgcaagctgaaagggattccggtcctcgtgggcctgctggatcatcctaaaaaagaagtgcacttgggtgcttgcggcgccctaaagaacatctctttcggacgggatcaggataataaaatcgccatcaaaaattgtgatggcgtccctgccctggtgcggctcctcagaaaagcacgcgacatggacctgactgaagtaatcacagggactctgtggaacctgagttctcacgactcaatcaaaatggaaatcgtagatcacgccttacacgcactgaccgacgaggttataattcctcacagcgggtgggaacgcgagcccaatgaagattgtaaaccccggcatattgaatgggagagtgttctcacgaacaccgccgggtgcttgcggaacgtcagctctgaaaggagtgaggcacgcaggaaactgcgtgaatgcgatggtctggtggacgctctgatcttcatagtgcaggccgaaatcggccaaaaggacagcgactcaaagttggtggaaaattgcgtttgcctgctgcgcaacctgtcttaccaggtgcaccgtgaaattccgcaggctgagcgctatcaggaggccgcacctaatgttgctaacaacaccgggccccatgcagcctcttgttttggggccaaaaagggaaaagacgagtggtttagccgtggtaaaaagccaatcgaagaccccgccaatgacactgtggacttccctaaacgtactagtcctgccaggggatatgagctactgttccagcccgaagtcgtgcgaatctatatcagcctgcttaaggaaagcaaaacacccgccattctggaagccagtgccggcgccatacagaacctgtgcgcagggcgatggacctatggacggtatataagatccgccctgaggcaggaaaaagccctgtccgctatcgccgaccttctgactaacgaacacgaacgagtcgtcaaggccgccagtggcgccttgaggaaccttgcggtagatgctcggaataaggaattgatcgggaagcacgcaattcccaatcttgtgaagaatttgccaggaggccagcagaactctagctggaatttctccgaagataccgtgatctccatactaaacacaatcaacgaggtgattgcagagaatctggaagccgccaagaaactccgggagacccaggggatagaaaaattggtcctgattaacaaatctggcaatagaagtgagaaagaggtcagagccgcagcccttgttctgcagacaatctggggctataaggaactgcggaaaccccttgagaaggaggggtggaagaagagcgactttcaggttaacctgaacaacgcatcgcgatcccagagttctcacagctacgacgatagtaccttgcccctgattgaccgaaaccagaagtcagacaaaaaaccagaccgggaagaaatccagatgagcaacatgggctcaaacactaaaagcctggacaacaactacagtacgccgaatgagagaggggaccataatagaaccctcgaccgctcaggcgatctgggggacatggaacccctgaaaggaacaactcccctcatgcaggatgaaggtcaggaaagtctcgaagaggagctcgacgtgctggtgctggacgatgaaggaggccaggtgtcctaccccagcatgcagaagatctag

SEQ ID NO: 111096 - DNA, 381 bp, Artificial Sequence
  Description of Artificial Sequence: Synthetic coding sequence
atgatcggagaagaggtccctagcgatcaatactattgggctccgctagcacagcacgagcgcggaagcttggcctctctggatagcctgcggaagggaggcccgccgccgccaaattggagacagccggaactacctgaagtcattgcaatgttgggcttccgtctggatgctgtcaaaagtaatgctgctgcctatctacagcacctgtgttaccgcaatgacaaagtcaaaactgacgtgcgaaagctaaagggcatacccgtgctagtggggctacttgaccatcctaagaaggaagtgcatctgggagcttgtggagctcttaaaaatattagttttggacgggaccaagataataagatcgcgataaagaattag

SEQ ID NO: 111097 - DNA, 2640 bp, Artificial Sequence
  Description of Artificial Sequence: Synthetic coding sequence
atggctaacggcacgctcacacgacgtcatcaaaacggacgcttcgtcggggatgctgaccttgagagacagaaattttcagacctcaaactgaatggcccacaggatcactcacatctgttatactctaccattccaaggatgcaggaacctggacagatcgtggaaacctatacagaagaggatcccgaaggcgcaatgtctgttgtttccgtcgagacttccgacgacgggacaacgcgcagaaccgaaacaacagtcaagaaagtagtgaaaactgtaacaacccggacagtgcagcctgtcgccatgggtcctgacggtttaccggtggacgcctcatccgtatcgaataactatatccaaacactgggccgcgatttccgtaaaaacggaaacggcggacctggcccctatgtgggccaggctggcacagccaccctccctcgcaactttcactaccccccagatggttattcccggcactatgaagatggctatcccggaggaagcgacaactatggcagtctgagtagagtgactcgcatcgaggaacgctacagaccttctatggaaggataccgagctccctcaagacaggatgtatatgggccacagcctcaggtccgcgtaggtggtagttccgtcgaccttcaccgattccacccagagccctatggcctcgaagatgatcagaggtctatgggctacgacgacttagattatggtatgatgagtgactatggcaccgcacggcgaaccggtacaccaagcgaccctcggaggcgattacgctcttatgaggatatgatcggagaggaagtgccgtctgatcaatattattgggctccactagcccagcacgagcgcggcagcctggcctccctcgactccttgaggaagggcggcccccctccacccaactggcgccagcccgagcttcctgaagttattgccatgctgggcttcagactggacgccgtgaagagcaacgcagcagcttacttacagcacctgtgttatcgtaatgacaaggtgaagaccgatgtacggaagttaaagggaatccctgttctcgttgggctgctcgatcatcctaagaaagaagtgcacctaggcgcttgtggcgctcttaaaaacattagcttcggtagggatcaagataataagatagcaatcaagaactgtgatggggttcctgcgcttgtgaggctgttaaggaaggcgcgcgacatggatttaacagaggttattaccggaactttgtggaatctttctagtcatgattcaataaagatggagatcgtagaccacgcccttcacgccctgactgacgaggtgatcattcctcatagtggttgggagcgggagccgaacgaggactgcaagcccaggcatatagagtgggagtccgttctgactaacacggccggctgcctgcgcaatgtgagtagcgagcgctcagaggccagaaggaaattgcgtgagtgtgatgggttggtggatgccctgatcttcatcgtgcaggctgaaattggacagaaagatagtgacagcaagcttgtcgagaattgcgtgtgccttctgcgaaatctgagctaccaggtacaccgcgagattcctcaggctgagcgatatcaagaggcggctccaaatgtggcgaataatacgggcccgcatgctgcatcttgctttggcgcgaagaaggggaaaggaaagaagccaatcgaagatcccgccaacgatacagtggatttcccgaaacgaacatcgcctgcgcgaggttatgaactgctgtttcaacctgaagtcgttaggatttatattagtctattaaaagagtccaagaccccagccatcttagaagcttccgcgggagcgattcagaatctgtgcgccgggcgatggacatatggtcgctacatacgcagtgcactgcgacaggagaaagccctgtctgctatcgccgatctactcactaatgagcacgaacgtgttgtgaaggcagcatctggggcgctcaggaacctcgctgtggacgccaggaacaaagagttgatcgggaaacatgctatccccaacctcgtgaaaaacttgcccggcgggcaacagaactcttcttggaacttctctgaagacactgtgattagcatcttgaacacgattaacgaagtcatagcagagaacctcgaggccgctaagaaattgagagagacacagggcatcgagaaactggtgttgattaataagtcaggcaaccgtagcgagaaggaagttagagccgccgccctagtattgcagaccatatggggctataaagagctgcgcaagcctctcgaaaaagaagggtggaagaagtcggatttccaggtaaacttgaataacgccagccgatcccagtcgtcccactcctatgacgactccactctgccactgatcgatagaaaccagaaaagtgataaaaaacccgatcgcgaggagatccaaatgtcaaacatgggctccaacaccaaatctttggataacaattatagcacacccaacgagcgaggcgatcacaatcggactctggatagatccggagatctcggggatatggaacccctgaaaggaactacccccctgatgcagaaaatctag

SEQ ID NO: 111098 - DNA, 3678 bp, Artificial Sequence
  Description of Artificial Sequence: Synthetic coding sequence
atgttcgcccgcaagcccccaggcgccgcccccctcggcgcaatgcccgtgccagaccaacctagcagtgcttctgaaaaaacatcttcacttagtcctggtcttaatactagcaatggcgacggaagtgaaacagagacgacctcagcaattttggcttcagtcaaggagcaggaattacagttcgaaaggctaactcgcgaactggaggcggaaagacagatagtagcaagccagcttgagcgatgcaagctgggttccgagaccgggagtatgagcagcatgtctagtgctgaggagcagttccaatggcagagtcaggatggacagaaggacattgaagatgaactgaccactggcttggagttagttgatagctgcatccgaagtcttcaggaaagtggaatcctggaccctcaggattacagtacaggagagcggccctcacttctgtcccagtctgccctacaactgaactcaaaacccgagggaagctttcagtaccccgcatcataccactctaaccaaactttggcattaggggaaaccaccccctctcagctgcccgctcggggaacccaggcgagggcaaccgggcagagctttagccagggcacaacctccagagcagggcacctggccggccccgagccagctcctccccccccaccgcctcctcgagagcccttcgcgccctccctaggtagcgcctttcacctgccggatgcgcctccagccgctgccgccgcagccctgtactattcatcaagcaccctgcctgcaccacccaggggaggaagcccacttgcagccccccagggtgggagccctactaaacttcagcgtggcggttccgccccggagggcgctacctacgcagcacctcgcggaagcagccctaaacagagtcctagccggctggccaaaagttattctacgtcctctcctattaacattgtagtctcctcagctggcctctctccaatccgcgtgacgtcaccccctactgtccagtccactatatcctcgagccccattcaccagctttcatctacaattggaacctacgcgacactttctcctactaaaagactggtgcacgcttctgagcagtactcgaagcactctcaggaattatacgctaccgccacccttcagagaccaggctccctagccgccggatccagagcgtcctactccagccaacacggccacctgggtccagaactgagggctctccagagtcccgaacatcatatcgatccgatctatgaagacagggtatatcagaagccacctatgaggtccctgtctcagtctcagggggaccctctgccgcccgcgcatacaggcacctacagaaccagcaccgcacctagtagtccgggcgtcgattccgtgccattacagaggactggttcccagcacggaccacaaaatgctgccgccgccacctttcaacgggcatcgtacgccgcaggaccagcctcaaactacgcggacccgtatagacagctgcagtactgtccatccgttgagagtccctattctaagagcggtcccgcactgcctcctgagggcactttggccagatctccctcaatagatagtatccagaaagacccccgggagttcgggtggcgagatccagagttacctgaagtgattcagatgctgcagcatcaattccctagcgtgcagtcaaacgctgcggcctacctgcaacatttgtgttttggagacaataagattaaagccgagataaggcggcaggggggtatccagctcctagtcgatctcttagaccaccggatgaccgaggttcatcggagcgcttgcggcgctctccgcaacctggtgtatggtaaagccaatgacgataacaagatagctctgaagaattgcggaggcatcccagccctggttaggctgttgcggaaaacgacagacctggaaattagggagctcgtcacaggcgtgttatggaatcttagctcatgcgacgccctgaaaatgccaattattcaggatgctttggctgttctaaccaacgccgtgatcataccccacagcgggtgggaaaactctcctctgcaggacgacagaaagattcagctccacagctcacaggtactgcgtaatgccactggatgccttaggaatgtctccagtgccggggaggaggcacgaagacggatgagagaatgtgatggactcaccgatgccctcctttacgtcattcagtcagccctcggcagcagtgaaatcgattctaagaccgtggaaaactgtgtgtgtatcctgcgaaacctgagttaccggctggcagctgaaacatcacagggacagcatatggggactgatgagctagacggacttctgtgtggggaggccaatgggaaggacgcagagtcttctgggtgctggggcaaaaagaaaaaaaagaagaaatctcaagatcaatgggatggcgtgggacccctccccgactgtgccgagcctccgaagggtatccaaatgctctggcaccccagcatcgtcaagccttatttaacattattgtccgaatgctccaatcctgatactttggaaggggcagccggtgctctgcaaaacctcgcagctggctcctggaagtggtctgtgtatatccgcgcagctgtgcggaaggaaaaaggcctccccatcctagtcgaactgctcagaattgacaatgaccgcgtggtgtgtgctgtcgccacagccctccgcaacatggcactcgacgtgcgcaacaaggaactcataggaaagtatgccatgcgggatctggtgcacagactgcccgggggcaataattccaacaacaccgctagtaaggccatgagcgatgatactgtgactgcagtttgctgcacccttcatgaagtgatcacgaaaaatatggagaacgctaaagctctacgagacgcaggaggtatcgagaaacttgtcggtatcagtaaatcaaaaggtgacaagcactcccccaaagtcgtcaaggccgctagccaggtgctcaactccatgtggcagtacagagacctgagatccctgtataagaaagacggttggtctcaatatcacttcgtggcttcctcgagcactattgagcgcgaccggcaaagaccatactcctctagtcggactcctagcatctcccctgtgcgggtctctcccaacaatcgaagcgcctctgcaccggcatcgccgagggaaatgatcagcctcaaagaaagaaagacagattacgagtgcaccggaagtaatgccacctaccatggagccaaaggagaacatacatccaggaaggacgccatgaccgcccagaatactgggatctcgaccctgtataggaactcctatggcgccccagcagaagatataaagcacaatcaggtgtcagctcagcccgtccctcaagagccttcacgaaaggactacgagacatatcagccgtttcagaacagtacgaggaattatgacgaatctttctttgaagatcaggtccaccacagaccccccgcctccgagtatacaatgcatctgggtctgaagtccactggcaattacgttgatttttactcagcagctcgtccctattctgagttgaattacgagacctctcattatcctgcctcgcctgacagttgggtgtag

SEQ ID NO: 111099 - DNA, 3504 bp, Artificial Sequence
  Description of Artificial Sequence: Synthetic coding sequence
atgtttgccaggaagcccccaggagccgcccccttaggagcaatgcccgtgccagaccagccttcctccgccagcgagaaaaccagctccctgagccccggcttgaatacaagcaatggagacggatccgaaacagaaaccacatccgcgattctggccagcgtcaaggagcaggaacttcagtttgaaaggttgacgagagagctcgaagcagaaagacagattgtggcgtcccagcttgagaggtgcaaactaggatctgagaccggaagtatgtcatcaatgtcctctgccgaggagcagttccagtggcagtcccaagatggccagaaagacattgaggacgagctcactacaggtttagaactagtggactcttgcattagaagcctgcaggaaagcggcatactggatccccaagactactcaacaggtgagagacctagcctgctgagtcaatctgcactgcagttaaacagtaaacccgagggatcatttcagtatccagcatcataccactccaaccagaccctggccttgggcgaaactaccccaagccagctgcctgccaggggcacccaggctagagctaccggacagtcattttcgcaaggcaccacaagtcgagcaggacaccttgcaggcccagagcccgccccaccgcctcctcctcctccacgggaaccattcgcacccagcttgggcagtgcctttcacctgcctgatgcccctcctgctgctgcagcagcagctctgtattacagctctagtacattaccagctcctccgagaggaggctctccactcgccgctccgcagggggggtcccccaccaagctgcagcgaggaggatcagcgcctgagggcgctacatatgccgctccaagggggtcttcaccaaaacaaagcccctccagattggcaaaatcctacagtacctccagtccaattaacatagtggtcagcagcgcaggcttaagccccataagggtcactagcccaccgactgtgcagagcactattagctcaagccctattcaccaactctcgtctaccatcgggacctacgctacactgtccccaaccaagcgactggttcatgcatcagagcagtattccaagcattctcaagagctgtacgcaactgccactctccagagaccaggatccctcgcagccgggagccgcgcaagctactccagtcagcatgggcatctaggcccagaactgcgcgcattgcagtctccagaacaccatatagacccaatctatgaggacagggtgtaccagaagccccccatgcgtagtctgtctcagtctcagggagaccccctaccacctgcgcacacgggaacctatcgcacttccacagcccccagcagccccggggtcgactcagtgcctctccagcggacaggtagtcagcatggaccccaaaacgcagccgctgcaacctttcagagggccagctatgccgccgggcctgcctctaactatgctgatccttatcgacagctgcagtattgtcccagcgtggaaagcccgtactccaagtctggaccagccctgccccctgaaggaaccctggcgcgctctccctccatcgatagcattcaaaaggaccctagggagttcggttggcgcgaccctgaacttccagaggtgatccaaatgctgcagcaccagtttccaagcgtacagtccaatgccgcagcctacctgcagcacctgtgtttcggcgataacaaaatcaaagccgaaatccggcggcaaggaggaatccaattgctggtagatctgctggatcacaggatgactgaagttcataggtctgcgtgtggggctctgcggaatcttgtttacggtaaggccaatgacgataacaagatcgcactcaaaaattgtggcgggataccagcacttgtcaggctgctgcgcaagacgacagaccttgaaattagagagcttgtgacgggtgtgctctggaacttgagctcttgcgatgccttgaaaatgccaataattcaggacgctctggctgtcctcactaacgcagttattatcccacattcagggtgggagaactccccccttcaggacgacagaaagatccagctccactctagccaggtgctgaggaacgcaacggggtgtctccgcaatgtttctagcgctggtgaggaagcaagacggcggatgagagagtgtgacggactgacggatgccctgctatacgtcatccagagtgctttaggctcctcagagatcgacagtaaaacagtggaaaactgcgtctgcatcctgcggaacctgtcgtatcggttggcagccgagaccagccagggacagcatatgggaacagatgaactcgacgggttgctttgtggggaggcaaatggcaaggatgccgagagctcaggctgctggggcaagaaaaagaagaagaagaagtcccaggatcagtggtcagtgtacattcgcgcagccgtgcgcaaagaaaaagggcttcctatccttgtggaacttctgcgaatcgacaatgatcgggtggtctgtgctgtcgctaccgctctgaggaacatggctcttgacgtccggaacaaggaactgatcgggaaatacgccatgagggacctggtccaccgactgcccggcggaaataactccaacaacactgcctcaaaagcaatgtcagatgacaccgtgaccgctgtgtgctgtacacttcacgaggtgatcactaagaacatggagaacgctaaggctttgcgcgacgcaggaggcattgagaagctggtaggaataagtaagtccaaaggtgataagcacagcccaaaggtcgttaaagccgcctcccaggttctgaactctatgtggcaataccgagatctcaggtctctgtataagaaggacggatggagtcagtaccacttcgtggcttccagctctactattgagcgggatcgccagcgtccctacagcagctcacggactcctagcatatctcccgtccgtgtgagtcccaataatcggagcgccagcgccccggcttcacctcgggagatgataagcttgaaagagagaaagactgactacgaatgcacgggctccaatgcaacataccacggtgccaagggggaacatacaagccgaaaagacgctatgacagcacagaataccggaatctctaccctttacaggaattcgtatggggctcctgcagaagacataaaacacaatcaagtaagcgctcagcccgtacctcaggaaccgtcccgcaaagattacgagacatatcaaccctttcaaaacagtactcggaattatgacgagtctttctttgaggatcaagtgcatcacaggcccccagcttccgagtatacaatgcacctggggctgaaaagcacgggaaactacgttgacttctacagtgccgcaagaccttattcagaactgaattatgagaccagtcattacccagctagcccagactcatgggtctag

SEQ ID NO: 111100 - DNA, 2379 bp, Artificial Sequence
  Description of Artificial Sequence: Synthetic coding sequence
atgaggtctttgagccagtcccagggggatcctctgccaccagctcacactggtacctacaggacttccactgccccatcgtccccaggcgtggattcagttccattacagcggaccggatcacaacatggacctcagaacgctgcagccgccacctttcagagggcctcatatgccgcgggtccagcgtctaattatgccgatccgtaccgccagcttcagtattgccccagcgtggaatcaccctactccaagtcaggtcccgcgcttccccctgagggcaccctcgcacgcagtccatccatcgatagcatccagaaggatccacgcgaattcggctggagagacccagaattacctgaggtgatacaaatgctccagcaccagtttccatccgtgcaaagcaatgccgctgcttatctgcagcacctgtgcttcggcgacaacaagattaaggctgagatccggagacaaggcggcattcagctcctggtcgaccttttggatcatcggatgaccgaggtacaccgatctgcgtgtggcgcccttagaaatctggtgtacgggaaggccaacgatgataacaagattgctctgaagaattgcggaggcattcccgccctcgtacggctgctgaggaagaccaccgatctggaaattagggaattggtgaccggtgtactgtggaacctgagcagctgcgatgcattgaagatgcccatcatccaagacgctcttgcagtgctcactaacgcagttattattcctcattctggatgggagaatagtccactgcaggatgatcggaagatccaacttcactcaagccaggtcttacggaacgccaccggatgtcttcgcaacgtaagtagcgctggagaagaggctagaaggagaatgagagaatgtgacggcctcaccgatgctctgctctatgtgatccagagtgcactcggcagctcggaaatagattctaaaaccgttgaaaattgtgtgtgtatcctgcggaacctgagttaccgacttgcggccgaaacatcacaaggtcagcacatgggcacagacgagctggatggcctcctgtgcggcgaagctaatggcaaagacgctgaaagctccggctgttggggcaaaaagaaaaaaaaaaaaaaatcacaggatcaatgggatggggttggacccttaccagactgcgccgagcctccgaaagggatccagatgttatggcatccttcgatcgtcaaaccctatctcaccctcctttccgaatgctccaacccggatacccttgagggcgcggcgggcgcacttcagaatcttgcggccggaagctggaagtggagcgtttacatcagagctgcagtgcggaaggagaaaggcctgcctatcttagtagagctgttacggatcgacaacgacagagtcgtgtgcgccgttgctactgctctgagaaatatggccctggacgtgaggaataaggagcttatcggcaagtacgccatgcgcgatctggtgcaccggcttccagggggtaataattccaataacacggccagtaaggcaatgtcagacgataccgttactgccgtgtgctgcacactgcacgaggtgatcaccaagaacatggagaacgcgaaagcccttcgtgatgccggagggatagagaagctcgtcgggatttctaaaagcaagggggataagcattccccaaaagtagtcaaggccgcaagtcaggtgttgaattccatgtggcagtaccgtgatctccgctctctctataagaaagacggctggagccagtatcatttcgttgcttcttctagcacaattgaacgcgatcgtcaacgcccctattcatcttctcgcaccccgtctatatcccccgtgagggtctctcccaataatagaagcgcatctgctcccgcctcgccgcgggaaatgatctccctgaaagaacggaagacagactatgagtgtaccggctcaaacgccacctaccatggcgccaaaggggagcatacatccagaaaggacgcgatgactgctcagaataccggcataagcactctctacagaaactcctacggtgcgcccgctgaagatattaagcacaaccaggtgagtgcccagcccgttccccaggagcctagtcgtaaggactatgagacctaccagcctttccagaacagcacacgcaattatgacgagagtttcttcgaagaccaggtccatcacaggccgccagcgagtgagtacacgatgcaccttggcctgaagagcaccggaaattatgtcgacttttattctgctgcaagaccgtattccgaacttaactacgaaacttctcattaccctgccagtccagattcttgggtttag
